United States Patent 10,233,465 (OPTIMAL SOYBEAN LOCI) - sequence listing, part 2

SEQ ID NO: 1568 - DNA, 1792 bp, Glycine max
  Soy_ogl_6548 Gm19:44032301..44034092 Cluster 6
taatattattttgttaaaactaccacggttttatttaaagtgaaaatccattgaattaaaactcatattagtgttcaaattgaccaactaagatcgaggatccacaatattccacagtaaattgagaagggttagaaatgaatagtgtgtggttttggggttgagtcctttaaatccgatttcgaccacatccaaccagtgattagccctggaattgacggtcagggagtaccccaaattttgacctgtaagatatgtgacgactaatgaaatcttgttatatttctcaagttggaatatatttgagcaatgagcatgatggtatactatttgtgaacgataattttcatgataaatgcaaactgttttctgctacaactcaaccatttcaattttagagttgacttgcacctcaactcaactcccttctttctcggcatggatgggtcatcttccagtggttcaagaatctttggtcggtcaataaagtatgagaaatcatatcttttaattgttttcttaccgctaatttattagttttgttaaaaatattagcgaaaagatttgaactaaaaacatcttggctctctctttttcatttaccaattagtctttcattatcaagccttcaaacttttaaatgaatcttattaccttaaattaaaaaattaatttccttaactccttaccaagaaaataccatgagctcaaaaagaaaaaaatcttcagccaaactaattcatcattaaaagctaacttaaagctaataaaaattaatagagaatattttaggtcattaaaaggaatattttaggttaagaattaacaatttaactcctctagcaaaaataaaattacgtgaatcttgcgttaagcaatattgttgaaaaaaataataagttgtatttctacaaattcgttatttgttaggtgtatttatcaattatctatttttctcatcaattattgatgtgtaacattatattgtttttacaacactctccaaattcttgaaaaaaaagacaagactctccaaatcaactctttaatactatataaagaaaatattaaataacatatgatacgtttaatattgtagcaacataaaatgtatttgatttttcatttaaaaaataagaaaatattatataagaatttaaaatattcatgatgaattaagcacatgtttaattcatttaatattagaaaatatttcctaattttaataatttccaaaaataaaaataaataaactattattatttttacgaaaacaatcccaactaaagttttatcaggatattaattttaccttttctcgtaaaggagtcatatattttaaccatatacttaatgaaaaattgtttttctctatattcaattctttttaatggtatatttaactacatatcaaagtcataacataactaacaatagttaattcaagtgattatgtgtctgatccctcaggcaagattttagatttaaattttgtaaataaaaaaaaatataattaagaaaaaaattataataaaagtagtatatcagattcctaacaaagattaatcacagaactaataaataatctgcgtcattcagtatcatgattacccattaaaaaaaactataacataaatcaagtgtcattttttatgagaacttgtataagatatggttctaaaattctgatggtcttccattaatgcccgttgaatataataatgatgcaattaatatattcagtataaatatatcaatggagaatcatagttgatcgaggaaccaccttata

SEQ ID NO: 1569 - DNA, 1233 bp, Glycine max
  Soy_ogl_1747 Gm06:587101..588333 Cluster 6
ggaacattttcaaagttttgtggtggatattttttttaaaaaaaattatgaaaaagaaattaagaaaaaagaatggattgcgttactctaaaaaattaaaaccaatttttataatatattaaaatcaatttatacatttaccttttatagaagttctattatttaagtttgttcaaaaattaaagtgtataaattgattttaatttttgaaaaatcttttttttatcttataagtatttatagaaaaaattattcatataaacatttaaggatttagggatgcgatgtaaacactacaccttttgcgttcctcgtctacaatttaaggtattccattttttcttttatattttttatgatatttttaaaggctttttattttttatgatattaacttattaaggttccacaattttcatacttgttgtgctttagttttgtccacatgtatttaaaaggtataacttaataatacacattaaatttataatttttaagaaaagaaacacttggattcaacccctaaccaagtttcgaaccaagaaaattaattctataaccgatttgtaaaaatattttagaattctattatagaactaaagattctaatgaggaacaaatctacgccaaagactatgaaataattgtctcattagttaaacttttttacttaaatatattaaataattaggattgtccacgtaaattattttttaagaaaaaatgcaaaaattattagagataaaaaaataaattaatactaattttattcactttataattttaaattgatagaaacatgagtgttttgattttttttttatgataagattgtgcatttgtaaaagtttataatatttttttctctataaaatatcattgattattttttactaccactagaaaagttttcttgatccgtcgctgatcctaattatgattattaaaaaaaagagttttgtgcacgtgttttatgctgtttattttatccggtgtccacggtttgacatatgataggatcgacttcaattttaaaatacacctacttcaacactcttgtggcatgtacaacttagaactctaaaaaatataaataaaaatgtacaactgagtgggggagacacataacaaaacaagaaagaagctccatagtaagtgctagattggagtttattttcaatttgttggaaatattttaagatttattataagattaataacagtagaatacac

SEQ ID NO: 1570 - DNA, 1400 bp, Glycine max
  Soy_ogl_3504 Gm10:42924801..42926200 Cluster 6
tagatttaaatttcgttgttaatataagaattttgtttgataaataatttataaatattcatgtaagtgtttagtgtaacttgaagtattttctgatcttaataagtttcaaaacctaaattcttttaaactttttatgttaaaaaaatatttgttttaataaatgtttaaattgaagtccaatttaaatttgtaacttgtgtttacataaacaatccaagtcttagcttatataaaactgaatctttagtcaattttaacatataaacatatttctcagctgactcttttgatggtaactaaacatattacgaaattaaatttattttttaaactgaattagaaacaccttaaacaaaagatcaaacatagccttagtcttcccacataaactttttaattaattttagtttttactgtataaaattgtatattgaacctaaaaattaaataaaaaaaattaaactgaatcaaaaagtgtatgtgtaaagactaaaataaggtaaaaaaatatatacagaatgagtaatttttagatgtaaggactaaagcataatgtagtaaaaaaaagagtaaagcataaaaattatgcatgtatagaaatcaaataaatatttaaaacatactattttttaaatcaactttttattattgacaaaaaaaatattaaaaattataagttttatgagtattttagtttgaaaattttaaaaaatgacctggtttttaaaagttttagtctgatttgatttcagtttattttaatttacaattctattatcccgatgtaagtctggaattggctgggtctcaattaataaattgttggcgattgctatatacgttattctttattactactaatatactgccctttctatttattttttctttccaaaatactagaacacaattaatgagaggaaaagcgtggagcatcaagaggaggagtgatcagtgggtatctgctggtagtgattaggttataattaattaagctatatagtattaaaacttataagttattgtttgttaagtttaattataaatgaaatgaaagttttcggatttaattaattataagttgtgttcattcgtgcatataataaatttcatagtaaatctatccgtacttataaattgaaataagtggggaataatatatagcatcatacttttaatatatttttattagttaaaatttattgagacacatgaaatggaaatattttttaataaatttcacttgtaattctataagttttaataaataatttataagaataaattgttattatttctgtcaaaataaaagtgaaagttttgttgtgacttgtgagagacagtgacacaacatgagggaaatttcctttgataaggttcaacggagcaaaatcatg

SEQ ID NO: 1571 - DNA, 1600 bp, Glycine max
  Soy_ogl_4929 Gm15:8913901..8915500 Cluster 6
attttttatttatatatgaattcagaagagcatttccaaattctatggtcctaatatcttgttcaatcgagatatgtcttggaagacataagttggatgtcctaacctatactagctagtatgctagacaatacgatagacactgtccgtcaagaatgaatttcatgctgcaagttgcaagattatttttttacagaagcttaggtatctcctttttgtgtctaagaattgaagcaacatagaagcttattcttaacgtgcttacgaaatggacgtttccaatttatctgaaacatttaggaaatggagcattaagattaattcttaattataatcttctcttatgaaatcactgatattattgtctttatctccattaacacattatcgtcgttgtcaatattgttattatattttcaccatgtaataacaatgaagacaagattagttttaaaggtttttcattccatcataatttttttaattgtgatttaatttttataattaagagtttatctgaaaattgtgagaatatttataaacgttttaatacagtgaatgacattgtcaatttttttaatccaagtgatactaatttgaacaaaatcttgaacggtaaacttacactttctttttccatttctcatcgatattctcttttgaaaacaattttgttcttaatatagttaaatattaatatatgtacacttttttcaatagatatttagatttttgttcctcacaatctcacattatgggagactactactttcacttaacctatcctccgttaaaaacttttacaatattatgaggaatggaactttttgcattaaaaacaaacaaatatgatgtacgtgaaatcgtgaatagctaatagtagtacattatataaggcgtgcaaataaagttactcaaaagaaagttttagatgacttgagtttataaggtaaatcatattcttaattagttaatcttgacaagcgcgagacacttccctttttagttgattagtaactccgacgtctaaaatcacctgcaaaaaagaataaacaattctttttgaggaccttgcaaaaaaaacaattgttttttagggggttcatatccttgaaaagaaaatccgaactccattgaaacatctttgtacatattggaatgcaacggaaaaatcaaactaatttattgttacatttgtttaacagaattagatattttgtcaaagaatttttccttaacgtttcttgggagtatatcagtaacagatataagtaaattcagtgagttttttttgttttttggtgaatgaattaaattcatcgagtttacttcaactttgagtctcacagaaattaagctgcaataatgcatgaatcgtcctttcatcgttgttaagaggtgtttgatttataggcatccatctaattttagtatttaaaatgtttaaatactttggattagctgtacaaataagatatttacatttaatacacgaatgcgatcgagataataagaaaatcataaatgttcatcatctgacatttttattgtttgtacccattggtacattttaaaatttacaagtacaagttttcacata

SEQ ID NO: 1572 - DNA, 1536 bp, Glycine max
  Soy_ogl_5612 Gm17:9643969..9645504 Cluster 6
gaatgactgagtatttcatgttaaatgttttaaatatattttatttacttaccggattacaatgaattgagagataggcatgatatataaactagttataactacctttagttcatatgacaatttataataacagaatttgtgatataattatgtatttttcaataaaaaatataattatatattttaacatataaatcaatcaaatcaatattatttttgaagattcatccctttatcatttttttctttccatagtcgtcttttatcctctggcttgtttgaattaaaaatggatgaaataattgatatgattatgcataagagtgattatgaaattatataaagattatttttattttatttttgaacgtcataacttaaaattattttatatgcaaatagttacgcataaattattatgtgtgcaattagttttttattaattgtatatgttaattaaacaattgatttattaataatattaacgttaataataagtatgcagtaaaaaatttatcgtacatgtataattattataattaactgccaatcatttttattattataattgtaattataaaaattctgtttgcaattaattattatatacaactttcatgttttttaatttcaaacgaattttctttaaaaaaattcaaataaatttattgcttagaacttttgaagatgccacgtgtaaatattctttttgaaaaatagtttcatattatataatattttcatatgtatatagcattgatacagatatccaagagtaaattatggattgtatttttgtcaaaactcagtcgaatctcataagttggttggatcctgtagaaagtattcaaaataaaattcctaccactagtactcccgggctgtaatatttttcagaagtaataaaatttcttaaaagtcatgcatgactcatgataatatcttaaatttagaataaagcttttaattatagttctctaaatttaaaattaatttttttaatcctataatttagagagagaaaaaaactattttagtatactttgtaaagaaaacaccaaaatatggttggatgtttgaatataagaatacaaaattaaaaaaacaaagttattattgtaagtaatttgtaatccgttagtcacctaataacatatttaatcaattcacatatattttattttaatgatatatttttaagtaacagatgaatcccttaaataatctttaaattgcaagaaaattatttttttactcatataagcaaccgttggttatagaaataatcaaaacttaattttacacgatctaatatgacaagtagatcgatcatctccaatgataaaaaaaaaaaataagtaacggtgtctaaaaaaataaacaatccattaaacaaaccaatgttagagatgctctaaataaaacgtgtaatgacatttgggtagaatgacttaaataaatttcttctttttaattaaaagaccaaagagattaattttaaatttgaggaataaaaaataaacttatctcaaa

SEQ ID NO: 1573 - DNA, 1100 bp, Glycine max
  Soy_ogl_5771 Gm17:39132601..39133700 Cluster 6
ttaaaagactattttagtagtaatcttaaagacttatatagtggcatgttaaatatttaaaaaattattttgtttatcaaaattttagataactaatgtaatagagcatataattttagaggattaacttgagagtttattcttaaaagcagctttgtatttggcttctatttttcctaacttggaactatatgtattctctactagtgaggctaattcagtaattctttgaatgaaaattttcatatataatgtttaaactcaaaactttacttaaagaaaataaacatgcaacattttatttaaccacttgtatgttgtttttctcattctttctattcccatgttaagtatatacgttaatttttcctgagactaaaagttttaaaacccattactaaggttaatttctgataagagtaaatgtactgaaacccacatagaatccagttgttttagatttttatataaatgattttgagaaaatgaaattgaaaaataatttgtatttaagaattatatttaaaaatgagtttagaagaattaatttttgtttagatgattgagcaaaattactttttaatcacaaatataaatatgttttaagtccaatatctaaaatacatcaagagaaattttattttttaatattttatttaccatatgatttatttaaatcaaaaccaattctgtaggaattgattattttggccaccatgaatttagaaggggaccaaccaggctaccaatcatttactttcactgatacaatttccttctaaaacattcattctcacataattttatttttttaaaaaataaaagttaaataaaatttgataacattcataaaaaatgaagcattaattaaatatatttttaaattttctcaaaacaactattacaatcatagtgtgtctaaaagaagttgttttgatcttaaaataaacaccttcaagcagtactcttgcttagacaaacaagattcacatattacttgtcaaagatatctcttatttgcaaatgaatattgaaactaacttataagtatttgataaatgagtttatgtcattaattgttaacattttctctaacagaa

SEQ ID NO: 1574 - DNA, 1720 bp, Glycine max
  Soy_ogl_6557 Gm19:44263181..44264900 Cluster 6
ggtacactggctttgtgtactacaattcttgggagccatgtttatacttgttggaagactaactctgtgtttagtctatgatttgcacaaatttcaagtcagatgaatgaaaaagaaaaggtgtacgagtgcatggattaagatgaatgtttgtttgagttgttttaatggaaattcaaatatataataagtataaatttaaaatttcatttaattgaactaaacatcaatccatcttctctgttccttttacgcttactgtttgggaaggtgagactttccatttacaatattttcaaccaattttgaaacacactataaaaaatttcaaacaatataattggactatacattcagtcatttaaattttccactttaattttatttatttatcatgaataaagctttaaagtctatgttgaggtggttagtaaacaagaattaatatttttttccatgtataaaatgtgtttaaaatgttagaaaccaaaatcttatgtaaattactcaaactccttatcattagatggaccctagtagtttttatatataaggtttaagatttaatattgtgaacataaacattatgcaatataggtaagaaatataattagaaagaaaagaaagaaaaaaaaatcacaaatagtctgtttaaataaagagtctttttatcttataaatagaaaaaatgttattaaaaagaaatcttataaaaaagatcaaccaaaatttataatagaaattatttttaattattgtaaaagattttgtttagttttcattctttaaaaaaaataaagtaaatacttttagtccttatcatcatatttgattaattgcttatgtatcaaatagaaggacacagtcattatagttaattagtacctgataatgtacatgtattgtgatgtcaagacatgatttctataattaactaaagctctaaaataaatgatgtttatttttcttaagatgaaaatggtagggatgaaaaataatgagtgcaaattttagatggatgaaaactaaagattttttttttatatagaaaccaaaacaaaaattcactaaatttactgtaaaaataattatttaaaattttagaggtataaaatctaaataaaaaatgttttatagatgaaatcaaaatttgctcaattaatttacataatcacagacatagtttaaactattaattagaaatattcaaaagaaattatcattttgggagtgtaccagaagatttgtatcttactaattagaaaaggaaattgcatatcattaatgcttttatattgactttattcatatttttactaaaggccagcaccgcttttcatatttttaaacatcttcaccaaatcatgcgatcattttagtggctggtattcgatattataaacaatgagtggattatatgtaaacccagataaggctgcaggtcaaattcaaacaaaatattgctaatgaagttacgcaatatgatttgctaattaatgaatctattagacctgttcaagctcttcacagttgatttataatcaggccatgatactgatgttttttaatttgatatatcgtcaaaactcaattatttaggctacagccccatcaattactcattgctacattttgccattttggtactacaaaattcagttcttttcttcctttgagacttttgtgcctgcatgatttgcgtgacgcaaccaataaagga

SEQ ID NO: 1575 - DNA, 1310 bp, Glycine max
  Soy_ogl_4681 Gm14:5453901..5455210 Cluster 6
attaaaaattataaaagtgtacaagtcttactctttatttaataaatcttatttataattttgtaatttttttataatttttatttaataaaagagtgtgtgctgagagatgttactgcttactagttctagtactgctattattaatatcgaagttgatttcaacataggttgaaaattatccgtatatatacatggtatcaagtcaatcactaataataaaatattaaagaaaattttttagtgttcatgacaatctagtagaattttttttagtaaaatatatatgcgatctttaaaaaaaaatcactaaattatcaaattatgctattcaaaactcatagttgacaatgatcgagtctgagtagagcacatacacacagataaactcataaagtttataatcgatcatatactacacgacgctattcaacatgcatacatctcatattagataaattcataaattttataatcgaccatatatatttcacaacgctatttgacgcatacatcattatccgttgcattaaatggttgaacacattgtaattatagatacagtttggaaaatgatgtgccaccatttgacgatgccccttcacagatcaaatgccatgcttagcaggcgaaaaaatagccttttaatttgtctcatcgataaaagtcataaactattgaattttctatcgagggtcttgtatttgaagttaattctcattagtgttgtattcatgaatcaacattattatttaagtgaatcttttattttgaataaatagctaaaatgaacagaattatatattttaaatatcattaattaatattaatggtagaaataaactaacgcggtttttttttatcagccaaataaaacctcaaataccatagttggcacaagagatgtccaccccaaatacaaggaatagaacaagaaagaaaacaaaaaagcctccagacataaagtataaccatagccttcatcaaaccacgcggtttttttttttttttgacagaactaacgaattgtttctcgataattacttatagaagataaaaataagaacaaaaaatgagattagttaacttctctatgacctaaagtttatttataatatgcagtttgtagttttgaggcacttgaactttgtactttcgtggcatacaaagtttggagctagttgtgctttgaacttgttttaatcatattaatgatctattttcctttttttttttggagaagttaatataagagaggttctacacagcagtttttgcataaactaatgttatctatggagaagttttga

SEQ ID NO: 1576 - DNA, 1519 bp, Glycine max
  Soy_ogl_5926 Gm18:4474082..4475600 Cluster 6
tattttttaattgtattttttattcacaaaatttaaatttggggttttccttaaaatgtgagtctcgttgtactcacattaacaacttgttaataacttttatattagtttaataatggatatttttgtagaaataaattttatttttaagcttttatgggaaattatttattaatttatttgaattatttttaaaaaaatgtttttatggcctttaaattttttcataagataaatttctttataacaagtcaaattaaatatgtcgagaaatttttaataaaaagtaacacactaatatataaaaaaaaaaactttggagattgattattttcaatattttaagtcgatttcatgagtggatgtaaaaccaaccaatacataaagtaaatactttttaggttgatttcataattaatgcagaaagtaatttttttagatcaattttactattgtagccacaactgactttctacattagttgtgaaaataattgttgaacaaagtctttttttatatatatataaaaataaagctacaattatattgcctcctaaatatacaatattacaattaaaaaataataaataaaaaactataaaaaataaaacaatttcatttcattgattttatatatataatacatctcgtatatcaaaacgtaagtgtaattttcctattacaagtttacaactaaatataagtgtaatttgactgtttacatgagccaaatgtgagaaaatttcgattccttttattttcttctgatccaataaattttatttccctctaaggtatttttccttccctttatgttccacatttctttattatattaatacatgtctgacaaaaactatcaccatcattttgtactctctaacacccatttttaagtggggttttttttttttttgttaaatccagtagaaaataatgggtgttgtcatgttggaatgtataaggtagtggtggtagctttattagatatatatgaattaatattacttgagtggaagatttataataaaagaaaaaaaaaagaggaaaggaaaactgccttcatagaagaattgaatttctattgaataacaaaacaaaaagaaaaagaatagtcaaatttatagtatttggtccatgtaactagaaaaaagagaagttaagttcatgatctcttattgttgtaatattagaccatgataataatgtttggagtcctcaaacaaaatacacattcatctataggtgaaaaataagaaggttaagtaggatttgaaacacggaaagagattagggtttgaaaaagtcataattagagagaaatagaaaaggttatctcagaaaggagcgaagaaagtgcatgtataaagaacatcttatgagactagggtttgaaagatgaacacattgaaaacaaaaaagtttcagaaaaattaaaatgatataaagaaaataaaaaaaacgaactcgtgaaggtatatgtaaagttgaaaatatttttctcgggacgttggaatag

SEQ ID NO: 1577 - DNA, 1647 bp, Glycine max
  Soy_ogl_4000 Gm12:4692754..4694400 Cluster 6
aaacaaaattttatttcttcaaaattaaaaatatttttttaatttctataaaatgagtgagttttgattttggtcaattagggatcaaatgttgatatagtaacacaaacattagtggtatccatctagagtgattgtttgaccttctgctacatataaacagttgagaatggatttcaaatttttgaagaatgaaagtcaatgaaaaaatatagggattaaaattaaaacttacttattttaaccaaaaacttatttaagttttatttttttgtgaaggattaacttttgaagaaacaaacacgagagaatcaaaggatttcaagttcagaaaataaatgaataaatgaaaaattaggaagaacaacagaaaaaataaaataaaaaaatcttaattaagaattgaaaaaaatagactttttaactagaaaaaaatatttttaattagttaaaaagtgttattcttttttagagacaacaagtatcatatgctgtttgactcaaattaaactctctttaaatatgtatttaatataatactaccgctggtcgttattataagtaataattatagtgcattttttcgcacttattgttacttataataaaaataaaaaatgatcgcgtacatcaataaaaagtttaaatttaatatatctaattaagttaaaataatttttatgtaaattaattcactcgttctatgtttgaaaagtgcttaaaaacacactcttaaatgcagttaattgattagaaattttgtccactcaaatttttcctctaaaatgtccagtacgtagacgtaaagcatttaaattgtcattcctttgcaaaggtgaacttattttcacttttgtatgaaaacaatatcagctcattagttattttaaaaaacattaatgaaaacgataatgtgttgaccatggatatctatctatatatataattgaagattcaatccatcccatgccacaaatacaatgaaaaagaaaggcagaagcttttattttaaactagattttgttatggatctaagggaaacaccatcattatattagagttgtgctttagggatccactcttatatagggctaaactaagaaaggaatattgaagaaaaaaaaacgaaaaggaatttatgttaagaagtgtcaaatgtcatgaaaatttgcaatcgaaatctttaaagttagggcacacgcaaaaaaggaaatttattatacagcaaactaagtaaaacttttcattttccttgatgaaaaataaatataaatggtagttatttttattttttaaagaaatatataatactagtttttttttttaaaaaaaagctaaatatattatcttaagtaattataaacatttatgaatatttactacccaagacataaagtcttaaatatataattacattaaatattaaaacaaaaaaatgttatatataagaatctcattcacctcaaatataattatctttcacataagataattgtagtttcatacaaacaaagaaacatttatggtcatatcatacatgatatacctttcatacaacagtaaattttgtaaatgataaacttagtttgcatttctactaataaattttactcatagaataactttaatttatgtcatataaataaa

SEQ ID NO: 1578 - DNA, 1300 bp, Glycine max
  Soy_ogl_4172 Gm13:20532901..20534200 Cluster 6
ttaaatttatattaattattacactattggataattttaatcataatttgattttaaaatctaccgttaaattaaaaattcccatgtatttaatttatataaatgtcactctttataataaatggtaataaatggtcatttattataaatcttttagtgttatatatataagttaaatttaatatattaatttaaaatttaagtttaatatttatatttggcttttggaaagaaaatgacatggtgagataattttatgattggacaacatactcttgaaatttacttgtctaattcatttttatacggatcacataataactgtagcaatttattaactatcgcttttcaacttatttgcataattataaatttataattaaacatgatagttttaatcaaccttttgctatatttaaaatgatggaaaatatgaaaaataccaaaatgaaatgatatatgatgagattcaatcgatagtaaataaaatttgataaaaattatttttaccaaaaattaaacttgtatataatattttattatctgaataatttaaaacgacaataaataaaataaaattagacaaattcaaatacatttcatgtgcatctcttatttccattcctcgaactttaaagatatgaaatggaatcatacttttttttttttcctgattctattataaaaacatctaaataaaactttaacttcaccttatttcatccatcattaaatacttaagaataatttttaaagttttagagtaattgaacaattttctttttactatttattgagcatctttataataaccaatataccaaaaactaaggttgtgttcagtaaagacggggatatgattgagaagagaaaaataacaattgttggtttacacatgagataagtaaaaaagtttagtttaaatttgatcggctccattatgataacttttgtcttctaataataaatatactattttacccttatgaattatcttcttttgattttttttttttaagtatcatgcaactgttgaggacaatattatattttaaatagttcattcaattattttcactttatttacaaaacatattattttatttctacactatttcttttcaaattatttttctcctatttttatcttcatttctctcttctaaatcaagcacaacacacaaaaaaatttaactagtactgcccgaacctaaacataagtaaagatgattaattttaagttgattatgaaagttggttaatgtaatttacttatattaattatatttagaaaataaac

SEQ ID NO: 1579 - DNA, 1337 bp, Glycine max
  Soy_ogl_17 Gm01:1269858..1271194 Cluster 6
cgtgcatcgatgtatgttttcagtgttcacacttcacacaaacctaatacaatcatttaataaattgttaagagcgtttccctatgttaattcaagattcatgttaacttgaattttgtttcatacatatgacaattcctaaaactatttaaaagagtagtaattttactgtgtcccataatatatttgtcgtgtaaaaagaaaaaaaatctaaaaaattattactttaatttttcaatataatattaattgcttcttcacttataaaattaacgatgatcaataaaaattaaaaataaattaacaatgataaaattaattttataaaaattttattctctcatctaatttattaatttttttatgtataaaataacttacaatgataattataatgaaacagagaaaataataaaatataaagtgtgtttttaatctctaattaagtaatctgacgtgatcaactagtccaaaaaaaatgagtaattaatgcactacattgttttgaaatatcttctaatgtaacatcattttaacccacaatatgcaaaatttttgttttatgttgtctcttagcgaaatcgatcaatagcaataattaccctatgtaatattggctaggctggagatagctaccaaaaatcaagctactagtgtcgactttggccgagacaaatatgaaattaatgtcagtttaattagggcgtttgtttaaaaactaaattttttaattagatgcatcattttagtattctagaaccatttgcagttcggtttggttcaagagaacttgctgtttgtttcagtctagtatgatttcaacaatcctagtaaccgctattttatgtgtttcttgtagtgattatagccctcacttattgtagtatgacaaatcttaattatatgacaaacctaacaaaaaaagtgagaaaatttaatcttcatcatacaatcatacataaatgattatttaattaaattttaatcttaattacatagatttaaattatttgattaactctttcctcacctcttataagcttcttttatatatgtgtatgtttttcttatcaataatattttgaatttatttcaatttctacccacatttgtctaacatttcttaaaataatcgtaacatttcgattaaatgaattgtcttttaaccttacgcaatctaattaaccaccatgcttatcgttcttctatgcgctcacgtacggttcacacaaacctagtacaacatataataagaaactagagtaccaatataaaggtgtttccttcctctgttaattaattcaatccattatgaattccccgaaatcagcattact

SEQ ID NO: 1580 - DNA, 1465 bp, Glycine max
  Soy_ogl_1156 Gm04:1106177..1107641 Cluster 6
gtttgaagagtgaatatcattttggagagataccccggttgtagtatatattttgcaagtcataaaatttccgttgcctcagttgtcttcattagtaaactgatccaattttgtatttggggcaaactatggtcttaaaagaaaaaaggggaattgatttagaatcagagggagaacgtggaaaatgccaaagaaggtgatcaaccccctttccaacaagacttacggattattaaaccagttgatgtgagtaagaggtttgattaaaggcgtttaggttacgatcccaaacgggctattcaagcaaagtatataaacatcaagaaaatgtcgacagcggcctagtaattaaaaatgacaaaatttattattattatttttttaatgcagaaatcaatcgagatttaaattttatatcacacaattaagagatatgaatcactatcatttatgtcaatcattattaactacattttctcacttatttaacttttaagatgaagtatcaagtagaaaatatttttagggtgaaaaaaaaataatgtgaggcatttgcaaaatatctataataagtatttaaaaaagttattgtaatttataggtttaatcatccttttagttcttatttatagctgtaacaaattttatttataattataatatttattttaaaaaatatttaatattatttaattttgttaatcccacacaaaacataagttttctttacaaataaaccttcgttggaatatgatataaaaaatcattgaaaataattttttaattaaatgaagaatattttagaattaatctcatattaaatataataaaattagttaatattatttatgtttgagaccaaaatatatgattttttttaacttatacttaagaccaaagtaataacaacattttatcgaacacgatattatatttatcttaaaatataccttaactataattatatatttctttgattattaattatatgtaatgttgagattaacatactatgtgaattagttgggttgaccttactctaagaagtaagcaagcttgagccctctcctgtggcagttcttgtctagcttctttggtagtagatcaaactgtataactagttataaagactgaagtctagacttttttatttaattgaatttcaaatcaatagatttattgatttgaaattcaattaaataaaaaaggctacccttccatatctattgagtcttggttgggttaatattgagtttacaatattcactatatcacatttcaatcttaataagaacacaggtaaattgattctcacctgtccaatagggagaaagagtaaacatacataatgagtataatatattttaaagaataatacagttattatattcatacaccttattacaaaagatgaataactatattattttttatataatttttttatttattttttgaataaaga

SEQ ID NO: 1581 - DNA, 1073 bp, Glycine max
  Soy_ogl_2153 Gm07:3233228..3234300 Cluster 6
gtcctcaatatttcaaacaaataacgataatagttactaaagaatagtggttcgaaatgaatattttcctaaattaaaatgtgaaacttttataaaataatttaatatttatgaatggatcgacgagaggaggaaaaaatgtatagtttccttcatgtgaggttaaaactttcaaatgtatcattgggtttgatatttcttatattgactttgaatattagaatcaatttagaactcgtattatattagtggtaaatataatttattttgttgataaattacttttataaatgattaccaacacgtgaaaaaatataatatttacaaatgaatattataattacagacttaaagttgaatttttttagattaaattattaatttaggtcttctaatatcattaatttagccttctgaacattatgtaatatttgagcatgggaagtcataaaaattatccttattttgatgcatgttatattgttggattaacgtggtccaagatggaaatggcttgttaatgcagcccattttcctttctttcattgcctaacggctaaaaagacttgggctcagggcctaccctctttttctgttaggtcaggtgcactactaaattgaataaaccgtgaaaaaagattatttttttttgtcaaatgtctaaaaggtaaatgtataacattacgaatttatttggataatttttcaataattactcattgtaaaataaaataagaataaaaagtaaaacaattttttcataaattaaaatcaagttaaaataatcttttagaaaaactaattgagagtgttcctacaaattaatttatatataaactaaattcaactaattgagggtgttcctataaattaatttatacgtaaactaaatttaactaattgagagtgttcttgcactctcatgttgcttcctgcactctttctaaaatattttcttaaaaattttattcaaacaaaacctaccttactattgtcaacatgggaaatggaccaaaacatctgtacttggacatttcttttattgggacctggacttcataggttattggagg

SEQ ID NO: 1582 - DNA, 1500 bp, Glycine max
  Soy_ogl_5225 Gm16:1137501..1139000 Cluster 6
tccaagatgcccaggaatcttaattcttaaacatataaacacagcttaaataatgtatttgtaattgaatatgaaaattcatattcatttcaatatgtagacattacaacatccacagaatctttaataactttttgctcttatactaaataagggatgacaaaattttcctgcattgcagataaaatatggttatatgtagacatattgaaaatacttagaaatttaggatttccgcattactatcaacttagttttgtatattctaacttttttggttgttagggaagctcaatcccatatttttacataccctaaaatgtcaatttagtgcatcaacagatttataagagcacacagtttaaattttccagttgaaaataaacctaaattctcaagtagaggttgagagctatggatattttttaatattgtcttatgtgagaatttttggaagggaataaagctttctaaattatatttcctctgttcatatctttagaaaattttagccacaagctatatatcaacttattagatctttcctactgatataggagttgtctatcaaacttttttggtaaatttacacatttagcttgcttaattaactaacggtgaaatgcaacaaaatgctagctattgatattttttttccattcagattaatttcaaataagcttcctgtgaaaatttaattatttatgaacttttttttaccctttcgcggtggagcgaatctcctttcatgaattttgttggcatagctttctacaaagaaaattgatgggaaaaaggatagctttacattgatttgaagtattcacaatcttttcatagcagtcgtcttcaaaagttaaaacagtcaaattcatctgtaaaagttaatgcaaattctgttacttttccattttgatttctcctctttgaacattggataaatgtattactacttacggggataatctatgaatgttctattgacaattgctacaaattcagcaacttgggaaaataattttttagtaccaaataatagtaacgaccttttatgtgcttagagttatccacgtctatgctcatgcattataccaacttttatatagaaagaaaaaaaaaagcataactactaataatcctttttaatggagtatctgaagtttcaactcggatacgttttatttaaaaatatttgtgtatttttatatttctcgctgagctaataaggcagttgatctccttgccaaatgggtgtttgagcaatttattattggagtgctcctcctgatggtgctttatatatacgtcttgacaaaggatagctatttgtagttttttctttgccttttatctctaaaaatgttttttttatttaaattttataaatctttatataattattaggcttaaatatatttttaatctctataattttgtgtgtgtgttttttttttaatttttcatgcttaaaaaattatttttttattgttaattcttaca

SEQ ID NO: 1583 - DNA, 1500 bp, Glycine max
  Soy_ogl_6828 Gm20:38051401..38052900 Cluster 6
tgcattttagttatataatatattttctgcgcctgagacaatgggtatcctctggacaaatgataattttgttcaatttgcaagcatccttagcttagcatgatgggattaacttccaaagtgttcggaaatataagatcggtatagtagtgagagggaggctaaagggtaaaggaagaggtagcatgtttgaatctttccactaacatttcttataaaatcatgttttcatagtgtaagaggggcataaaaaaatacataacataaacctgattctattatttattttgtgaacagaattttttgacacatttcttacacaatgagaacatgttttggttgatcaaatacttaatagaaatgtgattttgttgtatttttcttaacaaaaattcatttttgttgtgctaaacttctatcatttttttccaattaattatagatatatgtttgttaaagtaatcaaattaatgatgatataattatctttttttaaaattgaaattaaattaagaaaaaattaacttttttaaaagtagttagattatatatattgagaaaaaaagttatgcaccgatagtaatcatacaaaataattttttttttacattattagtgcataaatattaaactcataaaaattatatttttttaattagatagaaattatcatttataaaaataattaaattaattatcatacgaattacctttattaataataattaaattcattttgttattaatttatatcataattaatttgtttataattaaaaagggtaacttgtgttatcataattaatttgattactattaaaaaaaaggtaacatggatggtaattaagatttgtatcataattaattcaaaaatgattaaaaagataacttttttttaattaagaacaactttttttaaaaatttaacatacaaaaacgtattttagtttttagtttaaaaaagtattttagttaaataagagggagtgcaaaatatacacaaggaaaatttccgttgtgtaatgaagggtattatgagaatcgtatttttaaagcacgtgggaatgtaaatagtaaaagtggaagtgaatattgtaactccctaaacacaggatgaacattagtcctctttagcccacttacatagaaaacccataagcgcagcactattcattgtgcaaagcccacgaacccagagatttggagatatagaaaaatagaactgccagccagcaacacacaggtcgcctccaaattttttgagtgggagcaatatttgtaactgtaaatgtgcctgtgccatttgcaatcttgcactagttgtacgaagatgccctctgttccctttcacaagtcacaaccttgttatttctcgattgccccatatagaacaaaggaaaagagtgagttaatttcttgcatcctgatctagagtgttagacatagccacataggagtgaggcctagttccaccaaaaccactcatgcatacaggtcctt

SEQ ID NO: 1584 - DNA, 1200 bp, Glycine max
  Soy_ogl_3331 Gm10:2945901..2947100 Cluster 6
tcttcctaggcctaacgtatgattttttttttcttatgatagaatatggcatttctttctccataatgcataagtcattgcaattttttcaactttaaattagtttttagtatgctatttttgaaatttttttagtcccacaatgactagataaagtattggaatagtacatattatgagttaacttttgaatttaaagaatttttaaatattaataagcaaccttcatcctctgagttgacttttttttgtctaaagttaattcataaagttagaattgctcctataccaaagtaagattaaatttatctatttatatacactatttaacaatataaaaaactatatattggtaatattttatttccatttgcaaaatttatgtttgaggaaggcgaagaaaattataaagctgatgtgttggtaaagggaggatggagaaagaaagagttcctgagtttgaattgttttactactaaaaaaataataattaaccattaatattttatttccatttgcaaaatttatgtttgaggaagacgaagaaaattataaagttgatgtgttggtaaagagaggatggataaagaaagagattgggagttcgaattgtttcactactaaaaaaaataattaaccattaatatttgtagataaaaaaaaaaattcctgtcaaaagtaaggtttataactatatttgcaacgtgaattttgttaacctaaagacaaaacaaaaattgaagttgaacaagtctttattgttgtaaaatatatgttaatggattcgaaccctcactgtactcttggagatttgatccctttacctgcattcaacatcagtctcatttgttagtgttatgcgatgttgcactccttcgttttgttatggagtggctgtccctgtaatagatattgcagtttctgaaggccactgtgatgtacatcacaagtggttctaagatagatattaaatagttagaataaaagagaacactgtgtttttactttttactatcaatttcaacagttaaactgtgtctttattctaattaaaaataattgttacgcagagatggatcatgatgagtgtattgaaggaggggctgaattttttttgcataattatttaaatattataattctaataaataattatttaacaaataataagtttaaaaatatttattatgaattttatgg

SEQ ID NO: 1585 - DNA, 1028 bp, Glycine max
  Soy_ogl_339 Gm02:3075201..3076228 Cluster 6
tcaagcagtttgccttatcaatttatatttaatttattcaaatataaaatataagccttgaaataaggaaatcaaacaaaccagggaaggagaagaaaataacaaaggcagaagaacattgtgaatgattctcgtttcagttcattaaggttcacaagaaaaaagttaggttagaaatgtaacatccataatttttaatttgttgactgctctgacaccattatatttgacgtaataatacttaatatttttgttgatgagaatctttctcagattagaattctcatgtaagtaattttttttcaaatctcaaaatttagatatgtgtgcttcgaagattaacaatggacttttaatgattcttcttattactattcaaagcaaaagacgcttgatggactataggcggggcgtgacggacggaacatttagtgtagcaaattgtgaataaggtgataaacaacattctgataaacaacattctcacgtccttttgttgtattgatcttcgatatttcgaaatagaatgtgtattgaatgattaaactgaaaaaagattacgggttaaaatttttcagttaataaatctaacaatttaataaattaagatataaaaaacaaagtggtatttctctttgtttttctatttattttaaatttcaattaatttaatcatcatacatgaaatcatgaatcatataaaaatatggtttaaagtatgataaatttattaatttttacaataattattttaaaatttatagtaacagtaatatttttttttataagcagtataatttttttttatactaacagcacataattattaaattctaataaaattattaatttttgtagtaattatctcaaaaaatatttagtcctttttaattgattaattataagacttaacacttcatttgaaaaaagaaaataactatcttttgattactctataataatatatgtttactttgaacggttttgtcattattttcataacataactgattaagcagtctataaat

SEQ ID NO: 1586 - DNA, 1315 bp, Glycine max
  Soy_ogl_976 Gm03:39659486..39660800 Cluster 6
catggaatacagatgaatcatcatcaattatatatgggagtcttgtaaattattttaatcatcaccaattatgcagtatgtttttgatccccgggattggccaaaggactgcatattggtccattctattaatttactcctcctgcgtgttaagatttaaaagtgggacacacgtgcaactttaatgtttgatttaacatggatgtcactgacgtttattaaacacgggagtttatcttcaaaagaaacaagtagctgcctttcttgtttcttatagcaaaataattttcatttttactgtatcagtgatgtgaagtaattatttattttattaatgattaatttttattaaaattttaattaattatttttaataaattttttctttctaattatataattttatttacaagacttaaatctaagtttttattaacaaaattattcaaactaacaacatattctttgggaataaatctgtagctagtattgtgggtaattgtccccgctaaaattttagtgcagcctgttattatatatactattatattttaattgatctcactttatataatataatgtatatttagtgtttccgttcatattttatgtcatacaattctttatgtaattcccctcattgaacaattgtcctcataattttgataaaaacatttataaaatttcctatgataatatactatattttttgacaaaaaatcaattacttgtgtactcattgaaaatagaaaaatttagtttatttgttatagtctatcatgtatttgttatttgtttttaccaaatgcatttatttttgtttctgttttatattttagttacataagtgtcaaattaattgttacttgtataatctttaagttataatctttattggacatgcatatccttaaatgtaataagtaatgaatataataattaaatatataaaatattaataattaaaatttattaagaaaagaaattgtgaactcgcatgcataaccctgttttacttttgttattcaatatcttatgaaagttttttctgctaggaatatctaaaaatcttatgtcaaactatataagagatagttaagacaaattctaacatggacctatgactcaaatgctcatgatggatcagtgcaaaaaaagtggtactgtagctaagtatgatatgattgatgggatgagtaaacaagttttaaccctttaggttcataatcagttcctcatcatccttagtgccaattcttgcaactcccccaagtcattgttgttgtatggtttttttctatagcttggatatgga

SEQ ID NO: 1587 - DNA, 1086 bp, Glycine max
  Soy_ogl_1724 Gm05:38066107..38067192 Cluster 6
attggtatacattaaaatattaaaagaaatcctccgttccaaagacatttaagatttttccacaaaatattaaaaaatgtaattaatttattaaatttaaaataaaatattaaataatttcctaatatacattttatcattctaattaatgattaatttattctttctgtgcactattatcgttaagtatgtattaaagatatctttaaaataattaatgtaatattaattttatttaatgaaatatattttgaaatcatttttcttctctgatatatcatatattctgaaacagggagtatcatctaccttctcagtgattagttttaatttttttagttgtaagtgtttctatctaaaatattacaagttcttaatagcatgtaattgtaaatctttttaattaatataaattgtagttacacacatataaaaaaagtacggagattagagattacttattcacaaaattgaaaattctgttaaagtaaacttagtaagatgattgcaaaagcaaaactattattaactaaagtactttgtatgtatttagtatctaccattaatttgacttaaagtattttgtaattttaactaactttaaattgttaaattataattttaatctttctttaatttttcattcataactttttgggggattttagttctcatattttgtatatgttttattattttttattttggtccaattgaattctaaatctaatatatttatttaaggtactataaaaatattaaattaattaaaatataagggagaaacatgtaaaaaattaagaattaaacaaaaattatagattttctaaaatgtttggactaagatagaagataaaataggaaacccaaaatcacaaataagaaattaaaagaactaaaattaaaatttaaccttagtaattaatttactttttttcattttacacattttctcactttcaaagagtcaaacttactaaagaagatggatataaattttaatatagatttttaaatataaattataaaataatatgttatactattttataaatttaaaatcacaaaagtttatttcaaatttca

SEQ ID NO: 1588 - DNA, 1200 bp, Glycine max
  Soy_ogl_2174 Gm07:4107301..4108500 Cluster 6
tctattgcctggttacattgtaggagaggatccaagtgcatcagtcacattttagattatacagtgaagtttattttaaaatgtgacaattaatataaaatgcttaatttataggataaaaaccattgaacaattgcttactgttcttacataaaaaaattttctccataaatttatttacaatttaatgaggagtatactcctgtatgtgttaactctatcacgtaagatcgctacatgggatttgaacacatcaataggctggttgatgttggaggaggccttgggatcactctaaacaaatcacttcaaaataccctcacattaagggtatcaattttgacttgcctcatgtcatagaacacgcctccccctatcccggtatgatatctagtttatagatctactagtatatgtgttcaacaatatatatcttttttttttaattactataatttggaactttgactcttggatggaaacttgagatatcccacaagctttggttttgatcttttggacaattatgaaattcttaatgcagagttcaatcatatttaaaacttttccgtttctcctaaaaaatataatgttaaaaataatataatggttaaaataaacaatatgatataaaaaacattaaaaataaaagataaaataagtgtatcatctatcaatataaataacttaaagtataatgtcaaataaatgaaataaatgttataaataatataattgttgaaataaacagtgttatataaaaaaaagcatctgagaaataataataaacataaaatattttttttgtcatctatcattatcaataccttatgtagtaaaatgattaaaaaaataaaatcctatcgtatgtataagaaaatgtaaaataataaaaccatatttttgagtagaagaagaaaaactaaaaaatataataaaatcctaccttgaggtaaaaaatatataaaattaaaaattaatgatttaaaaaaacgttttaaagttgcacgcatttaaaaaacacgttacatgttactaaaaaaattctttattaaacattattggtcaaacaagtttttttgcgagtaaaaaaattaagaacaaccagatgaaataacatcccaaacataatatatgaaactataagtttgtctaactatgtcaatgtgttgtaacaaaatttaattttcaaatcgggta

SEQ ID NO: 1589 - DNA, 1000 bp, Glycine max
  Soy_ogl_2290 Gm07:8357401..8358400 Cluster 6
aaacataattctatcaataaaaattgaactctcatcttagctcaagatgtggcgaggagttgtcatcacaaaatacaaaaccatgaaggtatttagttttgattcacccataacaactaaacgcaaaaggctaaaagctaggttgctatccacccgtgtccatgttcctgatctatcccaaagcattttaacacttgtaggtactcacatttaatattcaaatagaagtttgagatcttagtattttttttatctcatagtatcatatcacttttaagatttccttcactttttatttcaataataaatcttattttaagattttaaatctttttttttagatcatagaagaattagatataaatcaattttttgaagagagtaaaaaatcaaatttttttaaatggatatcttaaccgttttttttataaaaattgaattttcacatggagatccagcatgctactccaaaatgaattttaacaagattaaatcttgagactaaaattttcttataagatctcttattaaagatgctcttaatttttaaaaaatttctatttgtaaaaaaaataatgataatggtgatatatgacacttgtaaaacattcatttatatctttgtatcggaatcttcttattacctaattacatctaccaagtgttactagcatacactttactaagatttatatttattaaaaattataaaatcataaccaagagttactattaaataaaaagactatttttttttaattttcaataaataataattaataataaaaagtatatatatgttcaaaagaatatattggacaaagttttgttaatatttctcttgcatctgtatttaccttttttttactatctttttctctgtcggagtccagaagagcagtgggtgatcaaggatattttcttgaaaaaaaattaatcatgctgctttttttttttgtttgtttacgacctttaactgcttaaatttgattatgctttt

SEQ ID NO: 1590 - DNA, 1339 bp, Glycine max
  Soy_ogl_4835 Gm14:49101761..49103099 Cluster 6
cgatgatgcaattcaatcttattgtaattggttatgattgcttgatcgaattacatatataaactaaactaaatctgatctcaactaattcgactaaaattaatcatttgaccttcattcacccctttgcacatgggtgcagatcctccaattttataatttctttgttggcttttgatactcggtctaaataaatgtttctttttagtgaaaatcaaaataaaaatgcacacacatataataggtaaaggatttggatagtttatcgaaatccttagttctaaccttttactgactattgtctaaaaaataaataatagacacattttaaaatcgtactctttattattttttttaacatcatttttattatttaatttcgtaacatcaataaatctttgcaatctaatacaaataatgtcttaaatattcaacatatgaaaaaaaaattatttattcaattaaacactagaaaacaggaaaagtatagttaactgaatagattttcaatagaatttaactcatcagtgtgtttttaattagattaattgtaaatatttttatttatttaaagtttaaatctgtatcattttcgttatattttttttatgatcgtaaatgaaataactagagcatttgatattatgttcgtgtaagttaataattcaagataaaatttcaaattatttatccaatatactagtttatattttttttcctttaaaagaattaaggagaaagagagtctttttcattttgggtgtgtgagagttgatggaaattggaaaaggaaaaggaaaagatttcacacacacaaaaaaaacttcatagtcaattttgctttgttaaataatacttttaaaaaattatttgatgttattattaagaattaaatagacgaataattttaatctttttgaattaatagcaatcaacttaaaatttactaaacctttgatacgggaaatatatttttctctttttatagaaaaaacatttttgttacatttttctttatggtacattaaacaaccatttagttccatgcaaacaagcgtgagtaagtgcaaaacaataactaatcaagcactaaatatttaatactttttaagtacggatgttgacatggtaacccaaatattttatgagttatggcaaatagtagcttttgtttaaaaataaataatatgtatactgatagtatagataaatttatatactcatttaaatatgaattttcatatataataagtttttctgttaatctctattttaaaaaatcattagatgatttttaaccgataataaaacttaatttgtatattgacggtgtattaac

SEQ ID NO: 1591 - DNA, 1098 bp, Glycine max
  Soy_ogl_4941 Gm15:9253127..9254224 Cluster 6
gaccttttatgcactataaattgttatttaataccaaaataaaatgttcattgttgggattaatttcgttgaagtaaaatttgtctagtaaaaattaaattgtaaatacaaacattataaaattaagctaaccatatgctattgtacttttatttggtattttaatagtgtatatcaatttttactcaagtaaaattatgtttatatattgtattatattattagtataaactcgcaatatctatattaaaagattaatttctattagataaaaattgtattaatggctggcattcaccaaaaagaaaagattgtattagtggaggctgattcaattcaatgtatgtgaaatatgaaatacaaggcgttaatatgatttttgttaaattatatttggcagttacttcattttagtacataattaagtcttaaaattttaattttaatcttttatattttctaaatatattattttagtattttttttctcaatttttcatttgaaacattaatcttccgttaacaataaaattttaaaataattaatttaatatcatgatcgttaaaaactattactactataattaaacaaaatgagtgtttatttatttttttcttctttcccttttttcattctctttccaattcgtgttctctctcctattctgcttcacccatgttctgatggtgctgtgcttgttctgattgatggcgtggtggctccgacgatggagttatccctcacccctaatgatggattttgatttgggatttagaattttactattgctttttttttttatgattgatgaatatttattattcagggattgtgaagaattcttgtatcatctaatgcttatttgtgattcattcttgtgtggaggaatggaggttggatggtggtgttggggttcgaagaaggagacgatcggaaggaagatggattttttttagtagtttataattttttaaataaaatataaatataataatggtttttagtcttcattgtttgaaattaattattcaaaaactttaagttaacagaatcactaaaatcactaatgttactattggaaataaaaaaaaaaaaaa

SEQ ID NO: 1592 - DNA, 1267 bp, Glycine max
  Soy_ogl_5773 Gm17:39203034..39204300 Cluster 6
aattaaaccttatatttccaaaccacatacattttaacatctacaattaaaacgagtgttaataatatacttttaacacattttaattttaaaatttatgtaaatctcactaatttatggataaaatgcacaaattgaaaaataaaatccacataattgatgagagttatataagtttcacccaggcttaaaaaaagaaaagagagagaaaaatgttatatgatgaccgactcacactataaaaaaattttatacgattaacccatattcataatgtataataaatttaaatcggtaatatgtgattgtatgacggtgtaaaattattttatattatataaatattaaaatcttaaaaaaacgtaaatttcacccaataaaaaaatatgtgaaaaaagaatattaaaactaaaagagtccattaataccatttctcactctcctctcgtatgcaaatctctcaagtttatggttgaaatgaacaaattatgtattatgacccgtgaaaataaaatcttagatatatattttattattcttttttatatttttttacttcttgcatacttttcaaacatgtctcattttttttacaatatcttagatatataattgttatagttttatacaaacatcctgatttcctgttaaaataaaatcttcatatataataattataatttataattataacttttttaaggcgaattataattataagtttttttagaggatttataattataacttaaaaaccaagaatccgataataactgtgaaaagacttttttggtcaaattcaacatacagttggtcaaaataattgattatgaagtataaacgtttttaaatgttacacaaggtatcatcacggattttggtatgatatgacaggaacataaagagattccaccttaatatattcctttgaaaaaagtattactcttttacgtaatattaatatactagacaaaactcctttaagttttgtttttttcaactatttttacacttcttagactctttcaaatatccttaaaaaaaaaagactctttcaaatatatataggaagtggtgttattatactttcttctaaaatgacatttttctaagattcaaacttttatcgattcctcaaaaaacaattggtttattactatttcgatacaagtttattagtaacatctagttcgccttgagtcctaacattttgactcatttaccttatcttagtggtgatggagcagaatttgtagataattctact

SEQ ID NO: 1593 - DNA, 1100 bp, Glycine max
  Soy_ogl_2973 Gm09:3813801..3814900 Cluster 6
acttaaaatacaatttgagatgttttgcatgttatataattttcacctaaaggatgagaaataaacctagaagaatcatagatgaagatgtaaagtgaaattctgatttacaaaataacaaaatatataataacaaaaatatataatagcggaaataatagaattggtaggcaaattgggaagtaataatgtagtgaatattagtaataatggtataataatatttttacacaataaattatattctcactacataagaattcacattcccaccctccttccataagaatcaaatcaatacaaaaataaaataaacatcgaaatttcattttcctaagagtaaaacatgttcaaaaatattttttattaccttctaacaattctatctctatatttctggaaatctacaaaatttatgtgaaacaaacgccattatccgtctgtctaagaaaaaacttccatttttttatcaaacaaatattgtagatttggcatttttatcgtattactttctttctattttctttcaacctttttttttagcaagacaaaggtatattgcagtatattatattgaatattacgttaaaaaattaataattatgaaaaagtagacttttttttttaaataagtgaaattttaataccctttttttcatattaagcgatgttttagattttcaataaagcattaaatattttatttcaatttaaacccaaataaatagttaatttgatggagtcactcttcagataaaaataaataataaagatagtttattgaaaaaattcccacttcataattcttaaattaaaagagttattatttatatcattttatttatgtaaagaagataacaatatcgtttttacgagagtgaaataatttcaatgactatcatatttatcttttataaatatagcatgttgtcatccactcgtccattttttcaaccaaattattttatcaagttgtgatagaaacatcagagttgtttgtggttttaccttgtcatagaaacttcagtactaagatatttttcctttgaataattcttcttcgaactcgcgtatcaatgtatggttgctgacaagtgtaa

SEQ ID NO: 1594 - DNA, 1073 bp, Glycine max
  Soy_ogl_5224 Gm16:1099328..1100400 Cluster 6
agtatgtgaaaaagctttattgggtcatggaatcttttcaaaatgatactatgagggtccaaaaaaatgagatgagacgtactccgaacatttaacgcttctgcatttatttatgtacttgttgatactgaaaggaaataaaatctcactggcatttttatagagaaatttttgtaagaactttattaattcgaaacacgttttatactcgcaatgcatttaaaaaaaaaaaacaaaactggttgcaatctattaattcgaaatacgttttatacttgcaatctcaacagagttttagccatattatataacaaccaaaaaaaaaaatacaaaactattttgcggataaaactggaattcacaactggttgaacattttggttggcgcaaacaaaaaatcttgatagattgcatatcaacataaaattagatattcctactgaacatttatatgtgaaacttttttttaatgagaagttaaagactaattacagactttgaccggaggtttcaaataaaaatacagatggtaaatttcttattcagttatatgaaacctgatatttagcaaatgactttttctcttctcggatggagaaaagttgttttacgggtcaagaagctgagaaagacataagaactcaagaaattgtggcccatagaactgtgcttaatttaatagcaaaatttgggccaatagaacattttgggcgtgtaaagtgtccaacttatcaaactcatatccaaaaatctgtttcattttcaatagggatgttcatagtttgagaatttatataactacaatcataactaaattataagtgagtataatcataactagttataatttgaaataaccagttattttttttaaatagtatataatcaaatatgaataaactagttatataacaagttatatttaaaatcaatcataaaattggttatgaatgaataaaaataagtaatttgaaataaccatttttataaaattagttatatttttataattatttttaaataaaaataaattatttgaaacaatcataactataaaattgattatactttta

SEQ ID NO: 1595 - DNA, 1058 bp, Glycine max
  Soy_ogl_6932 Gm20:42338143..42339200 Cluster 6
attttctgattttatattctgttttcattttttcattataaaattactattttgttttcaatttatttatcgtttttaaatatttgtacaagaaacgtaaaatcaattctttttctaccatatatcaatctttttctttctaaaatcaacttacaaagttacactcccatatataaaacttaaagccattaaatcgtccaatcttttgcgacaagatacattaagcatcatgttattcaaaagcctgcgcacgcacagattaacttgataattggaaaatagaacttaagaataaagggagaagtgatgagaaaggaatcatgaatctaaatgtcttttattatatttttaataaaaataataaaataacatttattaataataataaaaacatcaaattcaggctcatctagcaagaacaacaagaaaaggaagaaacaaacccaaattaaagctggcagtaacggaaatgcaaagtacacaagccattaattatataatagaatattagtgtgttttcgacagagcaacacacactggtaggtgtgtatatatattttcttttaatttaacaattctaaagagaaatttatctttgattgttagatttaaaaaaaaataaagagtgatgatggagaataattattttggaaaaacttaattctttctcatataaattaaaagagtttgttggtttgtgttacattatagaataattttaaatcttccaaacaaatctataacatctttgtactaatttttcctacttagcttgtttaatgaagaaaatattaaatatcttatatattttgaagataataatatagtaattttgttaatgtatgtccgtgaattggctttccaaaactggaaagaacccataaaattcctgtatgtttggattgaaattagaaatgttagatatatgttttaaggaaaattcaataaataaaaataaaataaaaaattgatcttttggaaaaaaataattttaccttaaaaacatttttttacctcctgaaaatcaagcataatgcaaaatgatttaaaaaacaaat

SEQ ID NO: 1596 - DNA, 1300 bp, Glycine max
  Soy_ogl_4639 Gm14:4091001..4092300 Cluster 6
cctaaagtagtgaatgtgaataatacatgtgtatttaatgaacaataatgtttattggaggtcctatccttttaattccaacctcgttggcccttgggcttgtgtgcattcattaccatctgggtaatctattctctaagcaggggtatgtggttcaattttgtgattactagtaaatgtgattatttccttgtgtaggttcgtatggatactcaattacattgatctaatacatatatggtatgttgtttcagtcctctctagtggggccgaacaagtatttgatgtcgatctagtatgttatgtaaatctaatcaattatgaaagctttaaaaaattcatagagatccaagatcaatttaaacgtctaggacaaaatatcgattcaacgtatccaataagagattaacgttaaacaaattagtcacgaattagcacaaaagtaaagaggaaaaaaaaaaagaattgttaattgactcaaggctcaacagtgctgttcccaagagctggagtgtgttgaagaggcttagctcgtgggaaagtaatgcctatataagagagattaacatttctcttaatatgttcttatcatttatactttcacaatataatgaaatgttattgtcactttttaaaaagataaattattcaatttatctccctgagaaatatttgattaaagggattgttaaattccaaatatcatttgtaagtgtgtaacttaaattattcttattattataccttcattaattatacactactaattgaaaatactttaataagctgaattaaaagcttgattgtgtatcattaataagaacactgataaatatcttgtttcagaaatattatattttaataagaaaatatttagaatgtcaaaattggtttttgagacttttttgaatatttttttagaattcttacgaaaatgacaaaagtactcctagttaagcagatggaagctcaatactagtttattgggaatttctagaattcattgttctaataatttataaagtaaaaatttaatttaattacgtaattatttttagtaattatagtaagtaacaaaaagtactttttctatgctttttctttaataaatttagttactccaattaactaaaatggtaacttagttgacttctcattacataggtcttgattttgttaaggataatcatgaacaattacaactaaattaaatctatactataatttttctagaccacaaattacttggccacttgtcatgaagttggcaattcttattaaaacttatcaagcaagccaa

SEQ ID NO: 1597 - DNA, 1100 bp, Glycine max
  Soy_ogl_4935 Gm15:9073601..9074700 Cluster 6
ataatcattacgtctcatttgtacgtttcaaatattctaattagagcttaagaaactacactgtattcttttcttttaacagagcatcgtattttaaaaataaaaaggagtattttttttaacgtttttgttaacattatccaatggttatggatatgattttttttatatttaaagataaaataatttttgtcgttgtaatttcatattaattttataaaaaaatatttatttattttattcttcttcttcgtaagttttaattttagttttaaaataataaaaatattacttccatttatattttgtcccatacatcacacaggatcatccactagttaattaataatgtaagctgcaaaattttatattgttcatggatttgctgaaaattggcaaagtgttggtgtggcttagacattcaactttcgcactgactttgaaattattgtttcattttcggcaagttgttcattgatatgcaatccaatttgcttcattcattagttattttcagtcactctcaaagaaaaaaaatgttaatttcagtaatataaattttctgaatccgctgcgtgcacaagataataaaattttcagaaaagcgaaaccctgccaagtatgaacgaaaccaatactctatctatatatctatatctatattaaaatacaactaaggttgtggacagctcataatgctgcatccttacataacaataaaattaaattattacatttaatttaattattgaaggatgcagagtacgtagtactgcaatctatattatgtgcgtatatttatattatttacaatttgcaatttttttgacaaagacattattatttacaatatctgtatatataggaccgtggccccgtgggtatcattatgttaatgagataattgcttgaggcctctagtcactaaatgtttaaattctttatttttttaaaattttatttaaaatccaagttgtcaagtaataatgtttgtcacaataattatttattgaattttttttctctgatgtttttatgtcaatttaaataaatttataatatttctaggaaaattaattttataataattactataaatc

SEQ ID NO: 1598 - DNA, 1000 bp, Glycine max
  Soy_ogl_6566 Gm19:442801..44633100 Cluster 6
caaaaaactcaaaaaaagtgagccttgatattagatgtttttgtgacttcaacttgtatcaatttttttcaacatacttcaattttgtgttgctaacttcaattttttaacaaaaaatacgagaaaaatctacccaaatataaaatttcctacaaaaaaaattaatgaaagaaattgaataaacctatttgaaagaacaaaaaaaatatagcataaaaaagaaatcaatatacctctccatgaaccaaacccaatctaagtattttttaaaaatcttccataaaattatttataggcggtgaaacttacaaaaatccaaatgcataatttcatgtaattccgtatcaaatattcttatatgaaaattattttctcttatgtaatgaaacatcacagcatgatcctctatcaagtaataaaaagttgcaaaaatgttgccaactttattgatacaaattgattgtcttgaacatcaaattaaatttcatgttcattgtattttcatagggatcatttaaattaacaactccagcttctaagtcgacttcataacaattcaagaaattggtagaaaacattgcacgaaatttgagaacaaattaattaaaatatgtagaagaatataaatcatgatgaaaaaaatcacatttaaatataaaatcaacatacattttaaataaaaaaatgtgtagaagaatataaattaaaaaaacaaaaaattacatataaataaaaaatcaacagaaattcagaatgaaaaaaaaaaacaataagaaatttaatagtaacatatttaacccagtttgggttaaatttaacagtaaaactcttaaaccaatcatgaatttcacaagttggatgatatccatcttactatttttttaaaggggaaaaaatcaatattgtagtttgtgtcactactttaacggtaaaatcctgtttttttttcttcaaacgcactccaatgttcaaccacacaaacctcttaaactttaatatt

SEQ ID NO: 1599 - DNA, 1358 bp, Glycine max
  Soy_ogl_108 Gm01:4402901..4404258 Cluster 6
ctgaggttaattttgaacaataagaataaataagaggctaaagtgggcaaaaaagtttagatgaactaaaaatgatgaaaaaaaataatagaggactaaaaattgtcaaaaaaatttaaggattaaaatttaaaagctaaaaaactagagagattaaaaatttaattaattctaattttttatctcaagaaaaaagaagatcatttaaaaaaaaaaaagtgcaggctgagtcaatcagtgacgaaggatgaattgacattctgagttaaaaggattatatttttttgtacttttgttggtggagttcttttgttgtatcataggatctaattccaatagtacgatggtgatgactagaaaccccccacctatttttttacatgaaatcggagaaccttttcagcataattatacgtcgcagatgccaaattcgggtggaaaaaaaaagttaggtgaagatatgactcatgttgaatagttcgatgtatttcttaaaatttaagtatcattttagtttaggtactatttggtttaattttttacctttttttgttgggggggttgcttctttttattttaatgattggggcacagtttaaaaaaaaaaaaaaaaacttatgaataaaaattcaaaaaacagacctcttaattatagcaattgtttagagaaaaaaatacttgaaaaagaaaaattcaataaaattatatcaagtgctactttatttatttgacattagtttctttatcttaatatccacctgaaagttaatttaaaggaatactttgtaataaagcttgtaaatatgcataagttaattaaagtaaacttcttatatatagaccattgagtctaattaacctttatgcgaatcaatgaagaaataattttaaagtaaagtgagaatttaacaaccactacaccattcgtgttaaagtagtcaccaaatattcttgcgatctcctactagcaactaattcatttaaactgtaattatttcagtagctaaattgagaatttggcaattgtaggaaaaaatagtcgttatctcatcttcaatccaaaaaatcaaaaatcacataaacaaacaaatcttaaaaattacatattttttacggtcttgtttagttttcgaatcttgttataaaaaataaaccaaaccgaacaaatcacatattatattacattgattttattgtgataattaataataaacatgaaatatattacttttcttttatattataattaagatgcatattttactttcacatattaaaaaagatgtactaatgttattataaaattgtgttaaatactaagtgatgcataaattgctatcatattataaaaacagttc

SEQ ID NO: 1600 - DNA, 1367 bp, Glycine max
  Soy_ogl_2683 Gm08:14518648..60014 Cluster 6
gacattttttaggacgagaaccaatataattaaatatgatactacagcaaatattatttagataacaactcaaacactaatttatactactataatagtattttttttgtcttttttattatattattaattaccacatgtttttttaaaatcttttatataaatgacatttctcattaaatattaatttgtaccaacaaaaaattctttaatgcattttttaatatcgtagtaataagtttattgaaatttattaaactatgaatgaaactcgttaaataaaaaatgagttgacttataaaaaaacatttttaatattttttaatcaataatacagaatatgttcaaaaaatattataagcaattcaatactagtatttttcttcaatatgtatggcttttattataaaataaatattaaaaaaaattaattatatcgaatgaatgaataaataataaaatatttaaccacgcacactcatgatttcaaatggccattaaaaattctgtaccaaaaaatagtcattaaaaattgggtaacagaatctccaactccaattatgaaaagggtaaagttagagaaaattattgcttattcatatgttattatgcttgattattgcacatcttgtcatcatcttagaatatctaatgatgtaagaactccttaactcaaaggttatggttagttcttttaagaaaaagcttaaattataaagctgaaattgtttctttaaaaaattcgttcagctgaattattattcacgctgtcatacgttcgatgtttcctaggcaaaagtctgacaaaaaaaataaaacaagtagatttattttatgatttcattacttcgtaagctaagcatataatcttcgaaagactttattatcaatcttgtatcttgtgaagtaataaaactaaggtcaccgaatcgcatatagtttatattactccatatatgctggttacttatggataatgactgtcttccatttttataatttgcattttacttacatcctgcaaattaaataaaatacaaactaataataagatatttgatgaataaaaggggggaatagaaataggagtgtgtaacaatcactccctttttatttagtaaattatcattttgatagactaaattgtaatgccatgtcaattaagttagtacctagagttaaaaaaactaaaaacaaaaatccttgaatataattcttcctaatcgagttagcctctaacatctgcctcgtaacttagtgttgttgcaatgctaatttaacagattaaataatgcgcatgcatccgcatgttttcctatggtatgcgtagtcaagcactatatatagtgaaatcaacaaggaacttt

SEQ ID NO: 1601 - DNA, 1006 bp, Glycine max
  Soy_ogl_2879 Gm08:44181701..44182706 Cluster 6
gacttattggaaagcagaatatgattgactcacttcttattttcccaaatatataaaccaactcactttcacaccattaaaaatgatttacaaaaataaatttataaaggttgaaataaatattttttaaaaaaattataactaaatttatccatatttaagaataaatagtgtatgcactaacattataaagagtttttataccatcattcaataattatctttatatatatgatagatttattattaatgtttataataattattttaattttaatcatatttcaaattgtaactcaaatgattagctcactagtataagatttaatgtgttcacataaatgaaaataatttatttaatataaaaatttatatttaatttttattatatgaaaaattatttaaattaataatagtcgcacacatcatgagattaatctttaacttagttggttgagatacatcaataattttttatcaagaaaaaaatgttttctattataaaaatcatatcaatttgcgagtgattttttttgcattaacaacaaaaaaaattcaattcattttagaaattaaaattacataaaaaagcatatatttgtattttgtaacgaggaaggtatatgagtcaaagcggttgatggtgcacttgctgctgtttcagaaccgatagagtcaaattcattaaattcaacaaaatcatcatgaaagttatccaagtttacaaatttgatgattcaattcaatatgaataatgattgctaaaccaagtttgatgtcagaatcttcaaataaattcatttatggcagtacttaccaccctatgttgtgtcccatgggaacggttgctacatatatgtatgagtatacatatatacatgtttaggcataatattatgattagtaaataacatttgtatggtcaacaaaaggatgatgtaatcggtaaaatattagttatatatattataggactcttttaattaatttatatttttaaaaaata

SEQ ID NO: 1602 - DNA, 1115 bp, Glycine max
  Soy_ogl_3020 Gm09:5779386..5780500 Cluster 6
acattattcaatcttctgattatatttaagttaattatttctagttaaaaaatgtggttctgaaacatacgcaacattataatgcatatctttttaattatatatacatttggttttaaaacatgcatgagaagtttattaatttttcttcagtagaaaaaagtttattaattttcctgtgagactacaggtgtttttttttaataaaagacaattttttcgaattgggaattcagttcctatctttcatatttattaacttttaacacatttaatgaacgaaaattaattttagtgaaagaaattagtttctagtagtatgatgaaattaaattcaaattcctactaagagaaataaatattatgctttgaacgcgatggcttttttaaaaaataactatagaaaaagaagcttatttagactgaataaaattattatggtaacaaatcatttttctctcagcctttgatagaaatggtatgtttctttttaaagagaaataaatgattgtgacggaaagaaaaacagctgcaaatttacaaaagtggaagcaatttaaaaaaaaatgacaagaatggtagattttaaaaatattataggatatgggaaagtgatgttttaacacatgactttagaactgaatttttttaaaaagatattgaagtcgtgatttcgaacacgattgtattttatattttttaaaaaaatattgaagacttttttgaattacgatttcaaatattctatattaaaaaaaatattaaagttgtgattcaaaatagattttagtattttttttaattacaatgttctaagttgtattttaaaacacgattttatataaaaaaattgtattttaaaatacgagttacccatatcatgtaatattttcaaaatctatctattcttgtaatttttttaaaaaaaaattgctccacttttgtaaattttccaaaaacagcacaaaatccattctttacacaatttggtagtaatggtatgtttgtctaaaattcattgttgagtcccgcatatttgtttgtttcatagtaataatttctttctagatttcgacaaaagagagaaaaggaaagttatttcatatgttttttta

SEQ ID NO: 1603 - DNA, 1048 bp, Glycine max
  Soy_ogl_4144 Gm12:38120276..38121323 Cluster 6
caaaccatacatgtgaaacaggcaaaaaagtaagatgaacaagattgtgtcggtaaagttatgtggagtgtttcctccctttccactcacatgaacgtgaaaatattgcacactggtcacattaaaatttcaaaaatttataggctctttctatcctaccaaaccaagtgagttctcatatttctacacagtccacgctcttcttgtctcctcttcaaatttcttgcccactaaacacatgcttcgtcagaacgaattgaaaaaaaaaacatataaaaaaacaaaaataatgaagaactatattacaattatatacacattagaaaaaaaaacaacataagaattatattcaaatttatctaattattactgtatcattatttatctgtcagtgccagtattttattaataaaaaaattattaaactcatctaacagtcttttgtcaaaaaaaaaaaaaaactcatttaacagggtactcaaacagtccaacatgattcaactgctggtttgagaataaagcaaaaaaaaataaaaaattctactcctttctatttctattaaaatgcaaataaaaacattctaaatatatcctcaatcaattagaattcttaaacatttaaaatgattagtcttgagaaatctatttaattcgacttttggttgacccaaactaatgatttcaatcaatttttaaaaaataatttataataaaaacttatatttattttatgaatttaagttatatgtaatgttagtataatctttttgacagaaacatttaaataaaaatttaccttattgttgcataattctattccttaatgtaacgtcacaacacaagaaatttttattaaatgatgaattaaaaaaattaaacagaaaatgcatgtaagttactaattcttagtatttcaatgagaaaaatcaaaacttgtgatttgtcaattattcagcaagagagagagagagaaactgcacgttatgatagcaacaagttaactttgatttttaattgaagtaatgttataatttacaatgtgtttttc

SEQ ID NO: 1604 - DNA, 1200 bp, Glycine max
  Soy_ogl_3779 Gm11:6826301..6827500 Cluster 6
acaatataacacttatcaacattaaacaaaattgcctaataaatatacataaatcacacctcaataattaaggttaatgatgtgaggttttccatcaccccctccacaaatacctaccagaccaagtaatacacgaactacaaaaatgatgaagatctccttcataaaccatagatatcatattagaaaggagagatgataactcagttttacaagaaatattttaacaatatttttagtcaaatatgtgaaatttactttcaaccggaattctaggttaaaaaaaactagacatctataatacaagtgacataacatagactaaatggtgtttaatattatgtttaagattttatcttaaaattaattgatgttaagtaaaattactcaagaaatatataaattacactcccaataacagagacattgtgaaacttttcaaaattccaaaacagagcataacataaatggaatatattgatctttagctggttcttatttttggcttgtgtgatatattgatctttcacttatatatgtcaccacattgttttatttttttatataattcctcaaagatttaaaatgttatcatatatgtctcacatctcaaagatataatttttgatttattcctctatttttggcttgtttgatatataagtgaacttgagctttcacttatatatgtcaccgcattaattattacaattcctcaaagatttaaaaggttatcatatatgtctctcaaacacacatacatatttgataaatacgtatagttatattgcttgaattgtaatgtatgctgacattttattttattttttgctctaaccaattatttaataactaaatatacgtaaaaaagctattaaattataaatttaaatctaaaagtaatacaggaattaatagtagctctttgaaagaaaataaaatcaacaatttgaacctgcgatgagccttacctagctaactcattgttaagaaaaaaaaataaattataatagttagttcctagctgcagacaagtcattatattgttagtccttcttaattaaaaatattaaacaataaaattagtgcattggtaagaaggggaaagagctttatcacttaccatagtttattcatcatactggtgtatctgggtctgattattaattcattgaacttaacaatatgtccaaaaaaaag

SEQ ID NO: 1605 - DNA, 1006 bp, Glycine max
  Soy_ogl_1607 Gm05:8894595..8895600 Cluster 6
taactcaccataaaaaagcttggtggcacaagttgtcaacttggaacccgtactacggtactgtggtaggttgaggccgcagggctacggatactttgaatttacttcacttttttttttttgttttaaattttaattattgctgtgttaatgttaaggttattttctcttaattgatgtagataggatttcatgtattctctctctctcttttatcattatacatttttttattgtttggtttatgcgttgaaatatatccactaacttttcctatttattgtcttatcattttttaaaaaaaattgataaaagaaatgatttgctgaaattttacgtgcatcctagccttttcttaattaatctcaggtttttgttttggacatctgaattttgataaccaaatgattttgaacattaaaaaaataaaattgtaacaccggttcctaacaacacacattttcaacattgaaaatacattttttttataaggaaatcgatgtggataacatgacatgtaaatatcttaaatgtgttgtctacaacaatttagtataaaattgatgtaaatatcaagattctacaatgttttgaaaatcatcgttgaaagcggtgaaatttttactacactcgattcaatgacagttgataaaaatcatcgttgaaagacttgcaaaattgacactgaaagtctttgtgtaatagtgcatttttatttgttaatttgcctaaaatacatttccaactaatattgtacaacaaaattaaagaacttaatttaggtgtacgtctcattaattttgtagttttaatttgaattaattatcaatatttggtcatcaaattattctaaatggtttaatttgatcccctatattttttaaaaggtttaatttagttgttaaattcttaaaaatgaattaatttaattctcaaaattttaaaaacttgagaacaaaaatcaaccatttaaaagaatttggagatcaaattaatttattttaaa

SEQ ID NO: 1606 - DNA, 1115 bp, Glycine max
  Soy_ogl_2209 Gm07:5328386..5329500 Cluster 6
cacataaaatactagttactgtcaaaatacttaaaaataaacttcttcgcataactgtttgtgagtttatattttatcttttccattatggatgcatgatataatacataatgtgtatacaagatcttttcttctctaatcccttctttatcctttttgaatgcccattgcctaagcctaatctatgattatgctatggtcgcctatggaatatgtttttccaacattttttcagaagataagatttgaatgttataattatctgatatctgatatcatgtagtgaaataatgtagttattgtatctgattttcattttttatttatataagttcaatttctttgataatcgttcttattggaaaaatctcgtaattatctgttgccagttgaacaagttcaattacgtggtcaagttcgattaacgagtaggtttaattgcgtggtaaaagtttatccatattttaaaaggatttaaattcatcgtccgaagttgaccaaggaatgttaatgttaggtatatatatgataacaaaatccacaataattgttacacgtgtggatatatacgtataaaaaaaagtaatattaattacctccgatttttttataaatataaaataggataggagggagtaattattttaaaaacttagatatgaaaatagatactataatatcattattttattccctaaaagtttatttcgttgcctttcaaaaaaaagtgcatatatattgttaacacattattctctaaaaataataaaattaaaaaaaatcctaaaatttaatatgtcactcacactggtctaactgtaaaatacttctatcaaagttaaaacaattgtgcctacatggtcatgttatatatttacatatgtgaccattgaagatatatgtacacataaaaacatacatgtaacggtttagccaattggactaaaataaaagttgatttttattatttggacttatgacatcacaacatgtatcattttcaacttaatcatttacaatcattatggtcctctaacataattaatattgtcattttaatctgaaaatgcttttgaattatcagttaaatcacattttacatgtaaattattaaa

SEQ ID NO: 1607 - DNA, 1500 bp, Glycine max
  Soy_ogl_20 Gm01:1353801..1355300 Cluster 6
tgtggaatgtactagaataattttaaaatataaaagtaataaattttatatattaaaaaataaaatggctttgattttcgtggtttaatttattaataaattatgtagtactttttataaatgaaatatttttagtgttaataacatgcatattgcagtaaaaaaaataatatttatgcgtgaatcaattgccatttcaattttgaaataatgattcacatatgaaaatactcatggtaaaaataataatattttgaacgaattattgtccaaatgaaaaactacaatttataaaggattatgacaaagtaacaaaaaaaactatagaacattagagcacaatgctaaaattaaatgcataatacacgtaaaagaaataattttacaattaatatttatttgcctaaataatttaaatactaatttacttttatgtcatatttttattatagtgggagtatttattcttttctttatagaaatgtaaatattattctagtaatataaatattgataaacttgcaaattttgtgtccttttgattttaatgggacttttgaataccaatgtctaacactaaaacttagctcaatactcttttaaattagaaaaaaacgttggaaggagagattgtttcctgattagtattggtagtccgcatcaatattatgatagataaaaataaaacttttaaatctcctcccttatgagccaagccaatacatatattggtccattgttttattatttctttggaccaaaaatgttaaaggctaccacggttttgcatgccctagaacatgacgtgtcccttggaccctttgcttcctttgaacaacaccaacagtataacattttgtgaacaaaaaaagaagaagaagaaaagacaaagcaatcacaccaatgtggacaatcgtggcatttgattgtcatttatgcatgttatgcattaccattttaataatgagaaaaaaaaagagagaaggaatttgatgcagatatctccttttaatttatcatgttaggacgacattttgtgtactgcaagcaaaaccaagaaaaacacagcctaatgcaatttttccaaaagaaaagagtttcgctatcaccaaactacatttgcaaatgtacataaacaagctacaagttgtaattccgtattcaaatagagagcacctaagtcaattttaataataatgctgcataacattgcgtccgatatttaaaagaaaagttctgttatacatgcatcaactcatacaacaatttttacaacactattcttttctctaattatctctacaacatcatcaattatatgattatatctcatatttctctttcctctcgttttctctctcttttttatacaaattgttttacaaataacagaatatgaagtgggtcatcctaaaattcgtaactcataataaaattaaggttattgcttcatgcacttcccagttgcttcttgcactcccttttgccttcctgaatgac

SEQ ID NO: 1608 - DNA, 1304 bp, Glycine max
  Soy_ogl_3281 Gm10:654097..655400 Cluster 6
gaactaaaatatgtccagcatatgcaagtggcctatttgcaagttgcagtctctttcagaccaaatcttatccaaagatgacaagataaacaaatagagtactcttgaacatttctaagtaaaagattgaaatggtaaatgtttgttagtaaatttgcgccgttagagtacttttacgaccgtgggggtggctatgaatttattagtattgttctatgtcgacaattgagaatggtatcaacttgttgaactattaaactctgcttctattacaatgcttgtatagtttaaaattaatttgtaatcttattaaaaaatgtgattgtggagaaacaaactatgattataatattcgttaaagaaaacaaagatgtgattgtggagaaaaataggatttcttcctcttattcggttgaaaaaatgatttttttttccccacaatttttttattcaattaatcacaaaaaagtgcaaaaaataaaataagagagagaatgcattagacaaaaagaatttgaaagaataatagattaaacaagaatggaattgaatttaatctgtgttgatatcaactttgaaaagattctttttaatcatgtaattttataactgaaaaaaatatactctatttctatatataatactcaattatctaattcattaagattaaaaaaattgattaatttaatttataataataaatttatcttaaatttataactttttcaaaattatcattatcattaatactcttctctcttctaattattttttaatattttatctcttttcttttaataaataatatttctagtataaaaataataaatgtaaaaaacattttacattatgtcttataaaaaacaacaaccattatttcaaaaggttggatattatgaataggaaggtaggagtatttttatatgcagtagtttgaacatatcaattttgaaagagtaatagattaagcaagaatggaatttaaatccgtataaatagtaaaccagatcgatatcaaatttggaaacatatttcttttattgcataagcttaaattgaatgtaaaataatcctttaaatgagtatttgttaatagtttcaatatgttattcgagttttgaataaaaaaaggttaaattataatttttgtttttttaatttataattcctaattgaagattttgaccctctcgtaattttgatctttctatttaaatatctttaactttgcatatgcttttttataattaattgagcattagacctgataaattaacttaaaataccataaaaataatttgatt

SEQ ID NO: 1609 - DNA, 1400 bp, Glycine max
  Soy_ogl_4502 Gm13:37083301..37084700 Cluster 6
tcttatttgagatttttaaaatcggaataatagtttgactgacaaagactatgattcaatgtttaataatttattcattgttgaattagtaataactaaataatattatttttaatataatatattaaataatactaaataaaaaataaattaatattcataaatttataatattaaaaattaaactttataaattataaaagcaaggaagaaaaagaaaaaaaaaagctagtgctaaacaataacatttgaccgttatgtttgctctaaccagaaaatacgaaacagttctcctttgggtagtaggataattaacacaacccaaatacgataaaagaaggcctaagtgatgccaaatcctcggaggcccaaacaaacccatctaactcaaaaggaacagagcattgttagacgcatatgacatgggagaaaaaaatatttaagtaaaaaaaaaaaaacagattgggtatctccagcttggtaaccaagggtccttcgcaactagggcaattacctccttttatttcttgcactttttaactttttgaaaagactaattcaaaaatgtaaaatttcattttagaagggctaatctaaaaagtaacaactaactaattaggtgcaagaagcaactttctttaaatttgttttagttcttaccgcctaaagaccaaattgtaaaaactaaaaatgtatatgtatgtgtgtgagagaaaactaagatgagttaaaaagtgcatatatagatatactagaatgaataatttttagatgtaagaaataaaacataataaacataggagccaaataagtttttatgttttttttattggcaaaaaaactgataaattaatgaagaaggtataagctatgccccagacaaatacaaattagagttacaggaaagaaagaaaacggttacatcatacaagtttttttataaatgtcattaaacaattattttatatgcataagaagtttttagattaattggagtacatgtatattttgttaatgttaattgtgtatattttttttatgaatgcaatttatattctatattaaggattttggcaagataaaataatttttaaatcatgaatagtacaagagaaattaaactagttaatatataaaggataattaaaatcaaaattatttccagtaaaaaatcacaattatcctgaagtcggcaatttgcacaaatatagagattttgattaattattggtataatttaacctttccgaaactcaaaaaacatgtatgtataggcagtataacgcacatgtagttgcaattttctttgatatttgagattttttttttctctttatcagtgactatatacatttgtttttcgttaaactgtcgatagttttgtctgtcttagataatta

SEQ ID NO: 1610 - DNA, 1419 bp, Glycine max
  Soy_ogl_6926 Gm20:42134483..42135901 Cluster 6
tctttcaattgcattatttagtactataatcacatagaatgacttaaagtagattgatgtagtacaatattcttcttcaactacatgctgcttgaactgtgactggattacattttgaaaatgcactatactaaaaaaaaaaaaaaatcgttatcataatatttttaaatttccagataaaacaattgcaacaagggtagtcattataaatctaatttgaaactgttttttttagtaaatacatttttttgttgtagtttatagttcattagtttgtactttgtagattgaaatctcttctacgtgaatgggttgcatgtttttattatttcattataattaattttatctccttttgtgcatttttatattaatatacgttgatatcacatgtttcataaaagaactacattttaatatacagttacataaaaaatatctacggttaacaagttaaaaatcatccaagaattatttaaaaagtttataatttttaattacatagaaatttattattaaatgacagcaaaaaaaattctataaatttttcataattaaattctttataaaaatacacaactaccaattttattcattatttgaatatcgaacaaaaaaaaattccacgatttaaaaaaaaaataaacccaacattactgcaaattgaaccgagatagtgttcttacaaaaaaaaaaggagccaaagttttatgaacacgcctttgataatgattaaattaaattactaaattaatgataattagttgtttgccgataaaaaaaaaatataattagttattcattcgtgcagtgacgcggtttttagctttagaatgtttggcaaatcagatactttttgtctccgtttgcatgtgaggaagctatagatggaaggcccacgcaactaaccataagtctttataatgaaattatggacgtttcggcttattaatccaactcattttatctgacaaaaaaaaattactacataaaacttgacgattctaataagtattactattaataaaaataatatatagtgtaggcaatgattgagaaaattctaaaaaggtagaaaaacacaatacctttgttttttttaatttatattaacactcacattcttttaaattttggtatgaggatttcctagattctaaagttagcatgatgataatcataatgcatgcgagaatatatatgcacgcataaggtggaaaatatataaataaatagcttcagcactattccgagaaagcaactgatgttcagcgccagaatcgattgtgatgtgaaaaccatttagataatcacatgacttcatttactttgatcaacataagaaaagtataattaccaagaccggtaatacaagtaataattagtttgtattttcaatttcaaattttgtatagggta

SEQ ID NO: 1611 - DNA, 1321 bp, Glycine max
  Soy_ogl_1686 Gm05:35432201..35433521 Cluster 6
ttaggaacttttttttttatttagatggtgaaaattggttctatttttttttctgatcattaaatggctgctaaaactcaagcttccctcatgttcttagatggcatgtctcaatttttttttaccttaatgactcttttcttctgaataatatcaataataaataaaataacagcatgtgaaaaaattgtaacatttttttcatgttttcaacttttaaaaacattatatgtaaataaatattaaaattaaaatatttcatgtattaataaatcacgtgtattatattgaaattttatttatttattaaaatataatttataaaatattttcaatataatttttttcaaaatttataagatattctataaaattatcaatattgttttacccattttggtagcattgatgaaataacaataagtattttagacattatataaaaataatcaatatatggctaacatatttttttttaaaaaaaataaattatgtacttatagtataaaaaattttatgttatcaaccaattataaattatcatatgtaatatattttttatttttataataaatatcttaaaaattatactatcaataatttttaattgattaagtaaaattattttgcattgatgattattaaattctaatttttaataggataactctactgtcattgtagtaaaacttttttattggttttcttactaatattctaaaatcttagaccagtttgtttattcaggtgaatggacaaatgttttcaaacaatataaaaggtcttatttatttattattttcccccaaagctcattttcaccctatggccataaacactttctcacaccacaatgcagcacttgcattaactgccagaaatagtgaattaactttttaatacaggaagatcttgtactggaagtggggcccactggatcttcagccgcatttaaagccagcaccattatccatcccattgtatgtatacgtatgaatgactatgtgtatgtcctaaacataccatggatcattccatattatcatgcatgatgaattgatcacatatcactacttttttgtgtgtgtgttttccttttatttttccgaaatttggattgtccccggttaagtaacaggacccttattttttttttatgagataacaatgatacacgaatttaaatcattttaattacaaatacaaatgatagacaattacatttaaattatttttatttaaaatattattttcactttattattttttattaatgctaaggctaaagttaagaaacaaatttaccatcacattaatttca

SEQ ID NO: 1612 - DNA, 1668 bp, Glycine max
  Soy_ogl_383 Gm02:4928376..4930043 Cluster 6
gaaaagaaaaaaatgtttggccttaataatatatcttcccgaagtcacgcccaaccaatataaaacaggaaaatatgcctgagaagaagtatcctaaaaaggctataaaagtatattcaatgaaaacttgagtaacaagtttaaaaaattatataaaatgatctatgtacatctaatacgcacacgcgcgcatgcgccatgatcgtagaacaaagattatgtttattacttcataaaaaaagaaaatcattatgattattcccataatacattagaattcaactacataattagtggtacagatatattatcttgaaaaaaatgacacaccacaaatatgtttcgtatactcaattaatcgcgtaagcacaaaacagggataccactcagcaaaaaaaaacaaaaacaaaataaaacagctagggatacaaaaatgaaaacgacttttgatttttgaatattataatcttatatctcgccctttgggtcagtttttttaattttttttagataagtattattcacagaagaaaattctctttaagttgaataaaattataatataggataaaaaaatttcttccagttatttagtgcaattgcacatcaagattcaaactcaagatcatttgtgaagtaaaaataattttacattctttaattcatgtgtttgatataataactttgatcacttctaactcagttccaaaatttgattcattaataaggattattttttatttatacattattttgaacatattattttttcttgatatcttgagagtgaaatttacataaaacatatacatgtgatttaatgatgacatgataataaataatacaacggataaacctaacaatacctattaagataggtttttgaaactatcttgtaatttgagtattagtctatctcgattttaaaagctaacacatgaattaagtgttgtagtttttagagacatgatttacatgcatgtattgttggggaaaaaaattatttaaaattattttaatatgtgtgctatttcaataatagaatttttttttcttttttgggaaattgattgtaaaaatataaaaaaaaacttgagtgttttcttataaagtattatattcctgttttatactattcgatcagcgtgaaaataattcttctttttttaacaaatattttatttttcttttttattattttattgtgaagataaatacattttttggataaaatatttaaatataatttatttctattttttaataaagtttctttgtatataatccgttatttctgttttaaatactataaatggttgcatttgcaatcaaattacataattaaccttttctttatatttttttacaaatgatttcaaaatttaaatttattcaataatctttgtcaatacaagactctgatagcttaaacattcagatatagtaataaatattctcttttcttattatcattgttttttgtatccttgagtgcatgggttcaaatatgtctttgtgtaaaacttgaaaaagcaaaccaaatatctgaaaataaaccttgatgagatgtgagatgatattagtaatattaaccctttaaaaaatgtttaatttatcttttataaatatattttctattaacatgcttttgaatcattttaaagaaca

SEQ ID NO: 1613 - DNA, 1135 bp, Glycine max
  Soy_ogl_1514 Gm05:6447..1453581 Cluster 6
aattcagattattctgagattgtataaatagagcatttaaaaaaaacatttcttcagcttgggattttacaaaaagtgattcgttatagttttttttttatttttataaaataactaaatttatgttttgtaaagttagactgatgcattaaaatatcttaaaagtaaaatatccaagtcataatttagaagactaatttgaggctttacattcttcttgagtccttaattttcaatttatgttaatttattgctcataaaatggcgagaacaagcatgattttgtcgttgtacataatatatttagtatattttataactaaatttaaaattttttaaaatagtatttgcaattaagctaaaaaatttatttgcaatgctatataattaggaattggaataattgaatgttttcttcaattaaattacatatttttcttttaattaacgctctttttttttaattagttttcatcattaatattaatataatatcacaacattcatgttttattaatttatcgaacagatacctaatgtgagattgtattcaacatttttttttatgcaaagattgtattcaacatatagatacattatgtagataagtgatccaagtataaacacatatataccttgtaagtgttcaagttgtcacccacctgaatatggatttaaatacatgattttaatgcgaatatgggaaccaccattttaatatatcttacctaactctactactatcattcccaccaaatagtgacagggtcttactcagtggcctactcctttggcaggaaggctcttcgtttttatttcttatttgatttttctattttctttttaaaaaataattataaaataaatttgaaaaaataaagggactgattcataaaatataatttttagaaactaaaaaatatatctaaaatttaaaataactatactaagtattttatgttcaataataacatacatattacatattaaatgacaaactatgataaactttataccaaaaatatatagaaattaaataatcaaacctttgaaaaaaatgcaattaacagctgatatgataatagtatatgtaaaaatacgaaaatcatttaaaaggtatcggtaaaaacattca

SEQ ID NO: 1614 - DNA, 1207 bp, Glycine max
  Soy_ogl_4548 Gm13:38488101..38489307 Cluster 6
atagagttgcaaaataaagaaaagtcatggatggaaatgaaaattttgacaaaaaaaatgttggaaacaaaataagatacactaatgtgatactaaattaaatttagaagatgaaaaattaaaatttactaaatgatatttttattactgtacgtcttctttcattttaattatcttcttttattttagacaaaaaggttttaaagcttttttttaaaaaatcatttatttaaccacacacattttgtaaatattatacaactttggataaaatatatttttattattcaaaattcagctttactttttgtaaaaatttaaagtatttttaggtgtagcctaactaaaaaaaaagaaatcacgtggaaaaaaactaaaaataaacaaaaaattaatacaaatttttatatactgcacatgataaccactacaccacaccaacttaattatttagcaagtaattataatattaaatgtcttagaagagcaaccagaaccagatccatcaattcttcggcccaatttcgtgcatgctttgcctttaccgtggtgggcagagttttgttttggacttttggttctaattaacaccttaagttttgaatggaattagacccctaaatgaaattgtggatgaatttgataaagtgtttttcattcaaatcatcatggaattcggttctgattaaatcttctaacatacttcaattatttaaaacacaaagtattcttctaaaaaaacataaagtattgaataaaaattgttgaattttcaccaaaaataaaaaattgttgactactttagaaactgccaaagcaaaaaaaataaaaaattgtgatgaaacttaaaaaacatctattatttgtttttgtatatttggaggattatttaggttcactaattaaaatggcatagaactgcttcagtgaagtttaatttattaaaggcagaaacaagtaccttatgtgacattaattatatgcacttatggttaggggtaatgatttggtttttcataaaaattatctgaaacaaacttaaaaaatatatttaatttagtttaatttgattttgatttaaaataaaatttgaacgaaatcaaatcaaatattttgcgatttttttaagtttgagttttgtgttttttattaaattattattattttattaaaatttatatatttttcatttttaaattaaattaca

SEQ ID NO: 1615 - DNA, 1011 bp, Glycine max
  Soy_ogl_3555 Gm10:45943101..45944111 Cluster 6
taagtttacccaattcaaataaggacaatagtttggtcatgaaatgggaaatacccgttcattccaccttttaaagaaagtatacacaattaattcatgtataatgttaaaaacaaatatcagtaaaaaagaatgtaggttgaatatgtttttagttccttaaatgtgagtaatatttttttagttctctaaatgttattttttagttttaaaaattcgtaaaatatttttttaagtctttttgtaaagtataaacagaaaataaaatattcataatttttatcattttttaccattagaacttgattgtctaatttatattttaaagtatggtttttttaaggttttaaactgccaaagttaagtcaataaaaaaatttaaagtaatttttaaaaccattaatgaatttttaaattttttagtaacttgaatatgatagtatgtaacctccagaagcatattttaaaatataaaatataaaatataaaacaaaattttgataatcaaaagttattataaatcacgaatcttttattttatgtttgacttacactgtgcaaaaggactaaaaaaaaaattatgtatttcaaggattaaaaaaatcaaatttaaatttggaaaactaaaaataaaattactcaaatttaaagtactaaaaacatatttaactcaaaatttatttatttatatgtaattcaaaggaatattttatgagtgtgcactctaaaatatgaagctactgttgaaagaatatactttactttaatatgtaaaaataaatttaaaagtaaataatttaagaagtataaattgctagtcctgagagaaaaataacataaatttttttgaattaattaatttgataatataaacaaattaaacttagataaaaattaatgaatttaagagttttaaaactaggttaaaaatatttttcaaaagtaaagccttgaaaattaagaattacaatactaaattaatacatacatattcaaaaccaccttaattca

SEQ ID NO: 1616 - DNA, 1541 bp, Glycine max
  Soy_ogl_1492 Gm04:48587701..48589241 Cluster 6
aacttcttgtactttagctctattattccccctgacaaatattaaaactaaaacgattctaataaagtaaaatagcatccatgatttagttctactcaatttcattattgtttcagattaattttattattccctaaaaagatcaattttattatttttaaatgatctattatatatttcatttagcgagattatatataaaaacaaatgataaacaaacataattaattcaaatacatatataaataatacaagtggctaaatatttaaggaggaaaaataaaaaatatatatagttaatttaaaagtatagatagttgaaatgtgataaaaagaggaaatttgataaagtttatttaaattaaaattcaagggaaaaaggaaatgataacgtaaaaaaatttatttatttggaatactcttaaagatactgatctcgttcccgttctcgtaaaactgaagatgaattgcactatagtatttttagacatttgtacaaacgtggtttgtagggagcggattcagatcctttgcaattcttttatatataatgcaattgttattattaaatttttttatgtctagagcatctgcatccatatccgaggagtgacacagtttgtattttgtaacgcatagacttaaattgttcatgatggaatcgcgcgacttcaattttaatagttgataattaattaatacaagttgacagatattcacattttattcttttgtgttcatgacaggtatcgtattcctattagaataacaaaatttattctcgttctagaactctcaaccgaaattggtatcatgaatttgatacttatggtactgcttaagatctcttaattagattatgctactttaagtattatatattaattgaatgttcttaattaattaaagagttaaaaattaaagtgtttataaacggaaaaatatactattcaatatttttaatgtattttactgtaattataaaaaatattatttggtgattccattgacactaggaaacttgttagtaaaattaaatttattaaatcattcaaaaatataagctacctcttccaataaaatttttttttatcaaataatcttttaagctttacccccaaataaatgacgtaacacatgtatagaaattatattgtcataatgttatatgatttctttttcaaccaaaaaaaatgttatagtatttctttggtcatttctgacaattcaaataacttttaaaatcaagatattttttattaataaaaattaactttattacaactttttatgtttcactcttctttttttttagtttgtttaggaacttattttgatcaagacattgttttatttgttttcgggaactagtttctgaaatttagtaagttaggtttgttatgttcaaaaaattagtttctaaaatgctaatagttttatgctttgttccaaaatttagtttccagaacataaattaatagataattccgaaacataataatttctttttaagtgttgtcgtggaatttaatttctgaaac

SEQ ID NO: 1617 - DNA, 1100 bp, Glycine max
  Soy_ogl_4484 Gm13:36413901..36415000 Cluster 6
aactttaacttttagaacttatattaaattttaatgttgactttcattgtacaagtttctgcaactaaaattttaattttaataaaaagaacacttaaaatattgtacctatattttgtgacaattaattaaatagataactgatatccgttcattcatacttgattagttgaatagcatatgctcttttttaaaattctgacaatttcattaaatcgacttttatcgacaaccaagtagttaagatacccaataacatatgaacaacaatgcttcaatcgcttttatatatgtgtgtgtatttcccaagaatattgcgaagagattatgagactccatttgaaaaggttagcctcaaaaaataatttcaatatttattttttcttttatgtcattcaattccatgctcacattcttttcaataatttaaattcatttatatgtcattcaatatattctcatgtatgattccctctttaaaaaaaaaactgataagttttgttgagttttgtaatgattgttttaaaatacatatttaatattttttatattctgtatatcatttttgtcggtgattgtcatgaaataagaataaaatccacctcctttactgtctatttagtttaagagaaatattgttcagtataaaaacacttttcgtcatttttacccgaatgatgattttattcaaattatattttttatttttaaatcaatatttgacaatagtgaaaacaaaggataaacattccccattaagctttcttctcattttatgtgtaaaatgtaaataattcgtaccaaatatcaacgttcttagtttataggaaaggaactgaagaaatagagataaaaattaaattgaaaaataaaaaacaggagagccatatttaaattgttgtttttaaaataaaattttctctctgtcttttatttctatttcaatctaataagaaaaacatcattattaatattttgccttacgttttttcttgtctctcactgttacacatcacgaatgagaattacaataattttattctattaaagagtatgtattaaaaaagtatgtgaaaatttatcaatgaattgaattgtct

SEQ ID NO: 1618 - DNA, 1431 bp, Glycine max
  Soy_ogl_1706 Gm05:37439370..37440800 Cluster 6
ataaatgaaacggtgcatttcaaaaatcttcaatggaattcaaacacgagcttcaacataattatttatgaaacactcttcctgttaggggcacactgtttttcacaacatcatgtctaatggtatgtttggttgtaaaaaaaataggagagaaaggaagaaaaaaatttaaaatttaatatgggtctcatattttttttcatttttctgtatttttttctcttttctctaaccaaaccaatcataagtgtagagcttattttcacattttacataactcaatggtgaatttcattaggaaacaagctatttatattgtccacaccttagccagggttgcaggatcttatactagcatccataattttgattatattataagttgtatcttttctcttattttgaatgaaatccagtaagtttcctccttttttttaaaaaaaaaaagcacgtaaaaattaactaatcagtctattgaaatgtggtgcctctacattataaaattttcatggcacgtaaaaattagctgatcaatctattgaaatgtggtggctgtaattttttatctttaacgttctatatatagtgaattgagctatcagtatctttgtgtttaatatccttcttcaaatcaggtgtctatattatttttttaattatcacaattatttaaaatggtatggaataatttaaatttttaaataaattaaattcttttacttttcattgatttaatattttcttatcgatttatttaagatacactggtttaaggaattgattataaaaatgtaaaaaaaaaaaggcttgactttatttactttctccgtccagaatgattgcagttattttatttttatttttttaaatcaaattgactaatattctcatttttgaatgagatattaaaacatctattccaatttaatttgttatgtaataaataatattatcttgtaagacttaataatatatttattgaaattaagagagaaaacaatgatattttagtaaaattattccttattaaatgttaattttcttgaaatatttgttttctttgtcattgtgaaaaaacttcaaatatcagttagtttgggacagaggaagtatttgttaatatttgttgctatttttttatttgttttaatatacactgtcataaaatagttaagtattcacatgaagagaaaagatcaatcctctcgtaaaaaaataaaaagaaaaaagatcaaccggaatttcagttgctaacttatatattttggtaattggcttaacgactaatttgacaatcaaataacggtgatcacgattatcaagtcaccgacttgtttaatgataaaatagtagcagctcaaaaatggcgttattcaattctcagatccaaatcgtcactattcatagtcgttagttctatttagacaaaaa

SEQ ID NO: 1619 - DNA, 1004 bp, Glycine max
  Soy_ogl_6544 Gm19:43940797..43941800 Cluster 6
ggagttttaaaatcatattataaaatttcatgataaaaccggtacaaagtattcatttttaaagtaatcaatgctaattttattttcacatatcttatgctttatttttttcataataataacaatcttataacttgattgatcctcgggttggaatatgaatctcaaccaatgttttaagaattgaatcattcatcgtactagccaaaaaactaggttaattggccattgatcaaatcaaaatctcactggtcaaaccaatttgattcattatgcatcaaaaaattataaaaataatataagtaggtaactaatataatttaatcattcaatattttaaatttaaaatgattgtcattataaagtaactaatatttatgtcaataaaaattcataaataaatttcaaatacaaacaaacatccaatgttttaaaaataaacataagttcacaaaaaataacataaaaaagttcataattttatattttaaaaaaatagcactagatccaaccaaagatccactttggttcaataaaaaatacacttaattcaatcaaagacctatcccgattcaaccaaagattctccttgatcaacccaaatcatgcatttttgatccttttaatgaactaaacaagtgtggtaactagatatcagccggttcagtatggttcttaaaacactaacctcgggtattgagaccatggacctcagttatcgagttaagaggatacaaatattcttcagctttttttgatacactctctatcttttcttttcttggtatacacttaaacttattcaacttatttttaatggtccccatcttaattttaaaagaaacttagaaaaaaacatatattcaaagggaatacactactatctttaattaggcaaacttagtaaaatatatttgaaacatattagtaaaatacatttgaaaatgttttgaacttgaaaacaaaaaccaaaattaaactctattttaatagtatattagttt

SEQ ID NO: 1620 - DNA, 1082 bp, Glycine max
  Soy_ogl_292 Gm01:52361801..52362882 Cluster 6
aattgattggttcgaattattagtttgcttcagattttaactgtaaacttgatgattttgctaagaaaaaaactgtaaactttatggtattaatttggatatggaatttgagtacacaaaaccttaacttaatcaatcaaaattggagtatcattttagaaaattttaattttttatgctggtaattttataacttttataattttaataagtactaattaacaacacatttttactgacaaataccatgttattaattagaatctattaaaagaggattagaagagaaaaactcaatattaaaggtaaggtagaaatagaattcactaaaatttattattattaataaattttagttaaaaataaagagtattatttttaaaaaaaaatatgttgctagaatttcttaattctaatttttagtctatattcttcggaaaattcctcttgtttcctcctcatataaacaaaaccaaaccaccctaagttaaaattgactttaacaagtgcctacgtaaatttaaagtaggatcctgtacactaatatgcaaaacagtcatttcatttcaagatgctgaaaaaataaattaaaaataaaggcagtcaaaaaaaaataaattaagatatatatagttgagtaactatgtataaacgaagaggtaatataacgacagtaaagacggaattggagtggaagaatatcgagtcttaattacaaaacttcctacaatgaagccgagctaactataattctaaaacttcctacaatttttttatttaatagatagaagattattgaatgtttataaaattttcaaagtactaaatgcatttattttttatttaatatttttataaaaacatagaaaggtttataagaagattttcaaggagatattagatataacttaactctattgtaaaatacaaaataatgttatatctttttataatatactcttactaaccttcattaataatttaggaagaaagtattaaatacaaaagtaaacgcacttgaagtcttaaaaatatgtaaaattaaaaaagattttgttcacttaataagtaaaaggattaat

SEQ ID NO: 1621 - DNA, 1494 bp, Glycine max
  Soy_ogl_2880 Gm08:44183101..44184594 Cluster 6
tttttacaatgatttaactaaaattaaaacttaaaatctcgtacatattacccaaactttccacgtacactggaccgattatagtggttgtaaaaaaccgatagtaagaatttttacattgttatttaattaaaaattaatatatataataaatttattgacttttataatatattattttaaaaattatgttaaacgtgtaatttgtttttacaccaaccgtatattaatctgatataattcaataaatattaagaacattgaattgcatgtaaatccgtaaatttgtattgtcaaaatttgattatttatttttatcttacataaaaaatcataggtatttttcaattagatcggaatgggtttgtcaaaattcgatttgatactataagaacacgtacaaatccaaaaactggttaggataatcagatgaaaagtacataatgtgttatagcaacactaaattcagatgaaaagtaataaattattttgagaaatgatattaagacagaaagacactccattttcttaatttattttcttctccaaataattacaattgccagagacaaaactacattatggttaggataatcatggctacccaaaagattattgaaactttttggagtaacagtaactaaatgattggctaagaaaagtattagctaccctaaacctatattataggtgtgaaatattatcacatttaaaacctttcttaatattattccgccttcattgcatgaatgacctgggaatggtactacaataaatagattctttttttataaaaaaaatctaataaatagattctttttttcgtactaaaccatatctgatttttaaattttcaggcatacactacccctgaagaagaaatgacaattgatgtttgtatcattttatgcaatttttcaacattcagttattggattttctgtgtattttgtgatgttgaatcaatttaaacaaacacacacactttctctatctatatccatagggctctgtcaggcgagtgaagtctttttatgatagtattacttcagagaaaaaagggaaaggaaataaagagaaatggaaaaaataaataaataaatgagatgattttgtgagtagtctaataagaaaagaaaataaaaaagataaaaaatattttctcttttttatgttcatagaaagtaataatatatataaagaagtgacataaatattcataatacaaaaaaaatctaaaaataaaaatattttgatctttttactactcaaaatattttttatttttctattatctaaaagttcttcctatgaatatcccgctagatactcgggacttaaacttgaaattgtcaatttttatagacattgaatttcattaatccaacagttggtttaagagttcacattaaatatgttaagtgtacaaaaattcatatatataattaaaacttatttgatattgcacatatcaatcaattttattttaacata

SEQ ID NO: 1622 - DNA, 1293 bp, Glycine max
  Soy_ogl_3351 Gm10:3609973..3611265 Cluster 6
tagataaaattaacaagcttataaaaatatcataagccttttggatagtatatatttaaaacaatttctttccaacatatccttggtatgagttggctcaatatgagagattggtcaaacaattctattaaaaaactgtgtttaattttactaataaactttagttgatatattatttattatttctataaatatttcaaactttaaataagttaatctatgtcgtttaaaacttgttagtagaaaaatgtataaatatcataaaaaaaataataaaatagttcacttatacataaaaatacaacgttgacaacttattaaaaattatatattttttaccatcattttctcacacaatgagagaaaaaaatgataagatacaataaaaataataatagaactaaaagctaaattttaatattctcacaacaaaataatacactagccaatgaaggtcaagcaaaacattaaaatatcacttttatgataactaacacccaacaattttattctattaaacttgtaccaaatataaaaatttcaattttcttaagactaattttagaaatagaaaaaattgaaaagagtgagaaaattttgtcaaataacaaatttatagatctgtctttttaacatggaaatgaaaaaaacaaaggaaccagaaaaccaaaaaacaaacgcctaaaatgcgtgaattaaatcaaaaccagggaagccaaaatatatgaggtggctcattccactctttttttcttttcttgtgagaaaataaggtatctctataatccaaaatcatgaaactatttcttcaaaaagaaaatagagtatgactatatgttaagggataacttctcttcccataaattagtgttattttattcacataataagaaattaaactcctgttatatacttaaaaggaaaaaagtcattaacaacctgtatcacacctcataggtccactctctaattagttttttgtcattgtattaaaagatataaaatttatgtaaaaaaataatgttatttatatcatttttcctttcaacaaagttagagcaaaaatatttatctatcacttacctttttatctgaataatataataaataaaataagttattttttatttttagtttgcaactaaatatattttctatttaaaatcttgaaatcagaccaattcttttagagacgacacgttaatgattaatttctctttctacaggtattgttgtattcatataacaaaaaatcaaacctttgtcatatatttaaaagacatagactattag

SEQ ID NO: 1623 - DNA, 1446 bp, Glycine max
  Soy_ogl_3544 Gm10:45228255..452130 Cluster 6
cttaatttaagtttccatatgagccctaatatacaatcttatccaatcatgaataaactattcaatttctgccttactcttatccaattattcttcttaattaattaatcagtctttaccaattgaaattattaaattatgatttttttaccacaaaatatattagtaattgatgaacaatattaaattacagcatgcatgtctaacagcgcttcctgttagttggaagtacaacttacaaatataaactacaacataaagttcgtctttgaaataaatattttccttataagctaaaaattaatatgaatagataattaacattgatctaagcaaaatactaaagataatagaagcttttggagaagttgacggagagaactttacaaatttacttacagataagcccaggtttaattataaaaaaatgttaattcatttaaatttttaaaaaattatccttatggaatctcaaaccagaccacagctgcagcacgcataacatgggtgctatatatccttcccgctttacaacaaattaagaaaatgaaatatgcatgtgctaaaattttcaattaattacttgaatttttttaactgctattatagttctttaatgtaacctgttttgcgatgatctttccatttcatattataatattatattgaaaatgtttaaaaaaactattttggccttcatccactacaataaaagtgtcttctattgaaaaaaagaaatctattcaactcaaaaactattaacctccttcatttatttatttattattatttatctataaaagaatctaaaacgataattatttttaaagtactacacccagttgaattaaacactatttaatagagttaacaaggcaggtaatttctggtggaacctacagactccatgggtttgtctcttttctactggatcaatggacatgatatttttccatgtgtgcatcagtgtcttcttgttttgtctcgccaaactcaccccatccacgtgattcatgcgaacaacaaatacgaatgcttccgatgatgagacaattttcatttccgatgatgtggttcgattagattagatcgtttattagaagaacattgtttgcttcttcaagttcaacaattgtttaaagaaataaattaaagctcaaatatgacatatatccgtctttaaaatgttttttatataaaatattgaaggcaataatttaatgaataatacctaaccccttagaatatcaaacattttttaccgtttgtttttataagattttttttataaaaaattatatcaacaattattatgagttagaacttagaagtacttcaaaaattatatgtcatattataaaatgtttgcttcttcaacttttttttttattttcttaattaatatgttaagatggtcattcatttgtttactaaaagagatttaaa

SEQ ID NO: 1624 - DNA, 1025 bp, Glycine max
  Soy_ogl_6758 Gm20:34783601..34784625 Cluster 6
tttaatccaatttacttttttgttgtttcatttggtagttacttacggtcatggatgagttgttaatagactatttaatattcattttgcaatgacgttatattttcgtcagattttttgcttgaccatttttttaatcaaacaagaattacgaaataagagaatttgcagcaatttcctccaataacaacagctagagtcattgaaaagaaaaacacacatggaacgacacttataagttaatagaataagaattttttagtcacccaatatataaaatattatagctgggaaaataacttgttttaaataccaaggggtttatgtaattatcttttgtaaatgggataggtatcccttgtaccctctttaatgatattttctttggctgataaaaaaaaagcttgttctaaatacatgtccaacatgggttttgaaggcaataaggataattttatttatttttaattgagagagttatataaagtttataaaaataagtaaaagattataatattaagcttatatgtcctaatctaacattttttatttaaaaaaaattaaagaatatttatttaaaaataaattgccgttatttccattttccttctaaacctcaatttcaaaacatatatcccgtatctgttgtcaacaaatattggtttccaagagatatattctgcaacatttaaaccttatattatttcttttcaaaattggctagcttgaatttgaaattcatacgtatgttagcaagagcattatattgtactgtatataaagaaagtttgaacttttctgagcaggtgaatgaatttttaatttgttaagaatcgttgatttgatatattatacgtaaaaaaaaaaaaacaaaaacttgaagttttattgggcatcgagttagaactctaattttccatggattgctgatttgatataatatatgttaatgaaagtttgaagttttgtcaatttttggatcaaattctaatttatcaataaccgttgatttgatattttctctc

SEQ ID NO: 1625 - DNA, 1207 bp, Glycine max
  Soy_ogl_2892 Gm08:44670174..44671380 Cluster 6
atcattttcaataatttacatatactttccatatatttagtctgttattaggaaaatttagtactttaattttgtaatattcttcttcaaaattaattatataaccaaatttcgacatttctaaacaaattttttatgtttgggctctgtacctccacgattctttttatcagcttcacgattgaaattaagaaacataatgttgccgtgctgaacttaaaatggttaatgacattgtgtagcagtagcacttacttttcaaaatactattcattgtagccctgtagatcaatttcacagtatagaaaaaatatattaatatcacttttgttaccttgaaaagacagattatttgtgtttcttttttttgttgaatgagacagaattatttgtcttatgcaacatgaatatgctacatgactagttagtaaaggaaaaaaaaaacaatttagtgttttcctcattatttttcaacaatttaaaaataacggaacaaatatcgcggtaatatataacaagctaggacatttatggttttacttaatatagaaaaaaatgattggtgatactttttcactatacttctcattgattaatattttttgtttatagtgaagatatattcggtctattttttcatgttatattcacccgtcttttaccacttatattatttatcatatcatattacttaattatcattgcttataaaaaatctcttaattatcatgtattatatttctaccttttccttatttttttttattaagtatcatttctactgtgtgtttggtggctagaaaataaaaggaaatatgatgtgagaaggaaaagaaaatcatcttatttaataagtggagaataagttaaaaagaaactcacatgttgagtgtttattttaagatgaaaaaaaagagaaaggtaatattatataataaatgactaaaatatttttttattaagatgtttatttcatttaatgtgcgtacctaatttttttcttttcttttatttcatattgatgaaaatttataaaattatatatttttatttatttatttttctgtttaaattttttctctaactaatccattgtatggtagcatggatggaaatatataatatgaatgaaaataattttaagtgtttgaaaaacaaagatgaaaataattttaaaagttatagaatgcattgtattatttttaac

SEQ ID NO: 1626 - DNA, 1164 bp, Glycine max
  Soy_ogl_6913 Gm20:41826501..41827664 Cluster 6
agattgtcaaaattacttgcaacatgcaagatcactgaagacaatggaaataagtttcatttgtattaaatttttacaagaaaaaaaattacctttgtctttatttttatgggcttaactatgcctccgcacctttttcatatgttttatagacaaataaatagtaaaatacatatttaatttattaagttcattgctattaaaggtagtaaaggaattaatgtttaaaggaatcaatgttatgtatataataatataatgttatatgataaattgatttaataaagatatgtgaatggatcaaatcattttttttatttagaacacaaaattaaaacaaaaaaataaaataattgaaagactaaaaggtattttaattttatttaaatttgtaattatttaaaataaaaaaattataagtgataattgtgaatatgcatgacaatgagacaatggagacgagcatgtcttttgctgtattcactcaataaaatttaaaacaaaaaaagaaatcaaataagtaaaagactaaaagatattttaatcatatccaaatttgtaatatttaagacaaaaagatgtataaaggatgactctgagtaggcatgacaaaagggtagagcatggatgaatattttgtttcctatttcctttccggttctacccctcatatttgtcaagaataaaattatgtactcgcccctgtcctcatttgaggtttgatatattcgtctaatccacatacatatccaatctaaatggttactatttcaaaacaatatatttgtcgatattttttgtcttattttaaaattaaaactaattttagatgacattaaattaaataagtcataaaaatgtaatgattcataatataaactcaactcattacaataaaaatgatacttgtttgtctaactttaaaattaaaactaattttagatgtcattaaattaaataagacatacacatacacttataaaatactcgaatagagaactttatcgtccataataattttgaacaaaattatttttttgaatgatatttgtgatttctatcataaattagtatgtaataaaactatatttaataaatataatttatactaaacataaaatcaaatttatctaaaatattcattagatttaaattaattttaac

SEQ ID NO: 1627 - DNA, 1008 bp, Glycine max
  Soy_ogl_4162 Gm12:38779001..38780008 Cluster 6
gtgcaattatgctttgtattcattagtcattacgattacgtaagcccttttcttcttaaatcgtatgtacggtacccaaagaattctagggatcacaaaatcacaaaattgaagctaatttcatacgcagtttattttacaccggaaaagatatgatgggtaagtaacttccttcctattttggagtggatgaggtgaaggaaaaggagagacataaaaaattaaatgaaaggaaaaatgatttttaaaataaatatttttatatcaaatttttttaagaagtaaatagaatttgtctcttaaaataaatattttattaaaatagatgtttatttcaataaataaatttaaataaactgaccaatatctagtttgtttaaactatttttttttttaaaaaaagaatgatgtttatataagtgtttctttttaaaaatagatagaattttctcactaaaaaaacaaacaattatttattttaaataaaaaataatttagataatcatactaaaaaatcataaaactgtttattttattaaaaaacacacttatttttaaaaaataaacttaaacgatttagcccaattagatgtaagttaacaacaaccattttacactactatattgtaacctttttttcattattttaatatttactttgactgttaaaatgttttatttttttatattgataactttttatatctttgttttttttccaagtattacgacttttcaatgattttattttgtaaacatatattttaataattgatatatttaaagttaataatcacaattttagttttctaagatatttaatttacattactatcatgacctaattttgtatcataatccaaaatcatattgcaatatatattgtattctagtttcaaaactatcttatgtatttttattttattttacataaataatacctataaatagaatataggacgtcaattaataagactataacaataaaatcccgactggaataaaaat

SEQ ID NO: 1628 - DNA, 1313 bp, Glycine max
  Soy_ogl_727 Gm02:47882388..47883700 Cluster 6
aattatatttcgaaaagtatttttgcaaattcttttgaaaatggatgaatctttgtaagacgaaagatgagctttaacatacgacgaaagtacatgacgaaaagcgtttatataacttgaaatgttaaaacttaattgattatgttttcttttaaatatgcaatcaaatcccaagagtatgcacatgcaatccttggtacaccacaaaataattcacaaacagattaaaccgttatagatattctttaacacaagtctatgcaagctcactaataaatattctttttacagtacttttttcaagcaacttattcaagtactgttttcaaacaagtttttccatactctaaacctaagtattcttttaaacaaagtctctttaggattcatgcgattaattcacaaaattaaaaaggcttaagaataaatctcatagactattattttttacatttgaaagtagttattaagaatattttattgaaaaaaaaaactttttttatatgtaggaattgaagacactgttaacaaatttacaataattcatatatcatgtttaattaattatcatgttcaattaattgaattagattcacaaaaataaataaataatattttagcaattttatacaacataaataatatttgcttcgctaatataaaaaactaaattattagttaaaatgtgtataaattgaaatatttatgtacctctatctatcaattaaaaatcaaaggaataaagtttcaaattttaatcacatgagacaaactatgtcgtacatataatgatatagtacatatatttgattttttttttatagatcatatacatatatcttatgtgattagagattagttgtgtgaaataaaattattatgtatgataaaattttaaaatattttatgcaattgacttaaattcgaaattacttattaactgaaataattctaattaagttcactaattaatccacatttatttatgaaaatattggttgttaaagtacattactatattatattaaatattttaaatatacttctatttttaatcactattttgaaatattaattaacatttgctggacctttatagtttctattttttaatgttttggtctccttctgcattaagaaattgaacaagtacccgttccaattaaactaattgtttatgatatataattctattggcgaatccatgctcattattttccctcgtcattgatatatgcccgccggatagagcgctgtgaagtttgagcagttactatagcaagtgaaaactgccacaaaaaaacaagattaaa

SEQ ID NO: 1629 - DNA, 1240 bp, Glycine max
  Soy_ogl_2207 Gm07:5192222..5193461 Cluster 6
ataatttaaattaatttttattagcttattaaatatataattaattatgtatattactataatttttaagattcaaatatatagaatttattatcaagtacttttaagacaatgtctctgtttctcatcttctatccttaataataatagtatggactatatataatggtattatcattatataagcaacgaaaggcaaaataattattagtacgagagtatccacgaagaaaaatgataacatccattattgagaaattgtgtacacaatacagcctaattattgaaattataatgattacaaggacaacgatcttccttggtaattatgattctatgctgaataaattaagctgtaatttgagattttattgtgacaatgagcaggcttggaacatcatatcaatgttacgtgaaatcattagtactaaaattaatatacaaaaccagtggtagaaaagttgcttttgcaggcgtgctcttctgtgccctaatgattttatcgttttatttatttatatatcaatatagtgacttcttaacgtacacctcttttattttaaggtgcatattatttttttagttaattctattctcttcctttgagaattatttaaattatattttatttattttataatacgtactcctctcttttaagaaataaatatatattttatatttcaatactttatacataaacaaaattcttaaggacaatgaataattaggaaaatgtctcttaatgatattttagccttttctataatttttagtgtttcatataaataattttgtattattattgttagtgattttaatattttagaatgtaaaatgaagttttaaatatttttattattagttttgagtttttatctaaaaattttattttgtcttctaaactcatagaactgacaataaatattcaaaattagctaataatcatgttgagaatcaggatgcaagaaaaaaaaatctttaaaatgttcatgtacattaaaattaatttaaatatagcacattgatttttaaagggagtaaaatgtatagttttaaataagaggagagggaagtgtgattttagtctctcgagaaatgagaatgtaattcatcctattttttctttatgttattatcgaaatgatatggtttatttgttttattttttatgttgattttatgtcattaatgcatacaagttataagaagaatgttagtcacattttttttctaacaa

SEQ ID NO: 1630 - DNA, 1013 bp, Glycine max
  Soy_ogl_6921 Gm20:41941201..41942213 Cluster 6
cagcaatcaatggtccaatggctattagcagattgtattcttcactcaacgatccaacccaaacctaaactgaaacccaaaatgtgggtatgtttgctgctgagagttttggtttgaactgaaatatggatatgtttgttgttaactgagatgtttggttaactgagaggttaaaaagtttaatttttaaaaaatattttaattatacatggtctaaatggaaacatataatgaaattatcattaaaaatcaaaataataaaataataatgtagcttgattactattggttgaaaaatcaataatatcaaaaacctctaaattaatgggggtaccatagaaattctcaatttaaaagggagatttttatttactatatttgtctgatctcaatcaaacacaacataaaagataaagtaatctaataaaatctagaaaacaaaaagagatcgatgtttcctttattacaattattgatatgatcatcaatatagatttcgtcatgattcatgagatggttaggtttgctctagctagatactaaattttcaacaaaatcatgaatataatttatatacaagaatttttttaataaaataatatatgcagttagcgtgtaaaagttttttaattgatatatgataagttgtatgatttttataataattattttattataagttatattaaagatgattttttattagttaattatgtagaacttttacgcaaacaatatggacttgttaaactttcaatagaaattatgttgcaaatgtgtaaaaacttttacaaaattagtacattctttcttaaacattcaataaaattaatcttattatcacattattttattctctattttgatatatggtaataagataaaaattaaattgtaattttgtttcttctataattttaaatttatgattttagttcttttatttttaaatttaaacatttagtaagaaatttgataggagttgaactcataaccttttatttaaagataac

SEQ ID NO: 1631 - DNA, 1047 bp, Glycine max
  Soy_ogl_935 Gm03:37692501..37693547 Cluster 6
caaatcacctggaaaaatgctagatcagtagatgcattgaattttgaagcagcaactttttttttttcagtgaaacagcaaattaaaaaaattaaaatagaattatttttaattaaatcataaataagatataaatattttctttgataaatatgacttgctgattttatgtcttgcatcatggttatatatgacttgctgatttgtgtaaatcctttttgtggtttattgattttgcttattgcatttatttttgttgttcaaaattttaaacctttaaaaaatttataacaccttaaaattattaaaatacatcttcaacaatattttattaggtgattgttcctaataagttacatgattacatgtgattgtttaacagtgataactaattagaatgactaaaaacaataataattacaaattaagagaataagattaataaaaaaattattgagaaactaaaattaaatttcgtataaaaacaaaagacaaaaatataacttatccataaatttgatatgtgattgtcacaacatagttattatgttatccctcaatgataatatttaacaacaaggattgatatagattaaacttcatcaaaattttatttagcgacaaaaaataaaaattataaaaacttaatgaaaaacaacattttgcccaaaataaaattacgagccaaatacaataaaatcctgtaacaaatttaactgtcatgacacattttgcataatttctcccaagtcagaactttaggcgagttttgaattcagaaagagaaactatcctcgtgggcagtggctctgttatgttgatagaaatcacacaaaagttaagaatcttttgatattatgttgatactgttaggaacttcttggatttcgtccactcttgtcagagaaagtggacattttatgattccctttattcattttaaaatacatctaggacatctcagcttgtgtaattgttaaactcattattattgttagttcgggtaatatttatgagaatatatttgcacattattattatttactt

SEQ ID NO: 1632 - DNA, 1769 bp, Glycine max
  Soy_ogl_2990 Gm09:4474901..4476669 Cluster 6
catagaaaattacattaagaaaattaaattaatataatgcatgcaccccaagaacatcgcgcgatagagtgacataatgaaattcgtgagaaatatatacagcaattgcagtcaacggaaagagacatggacccataaggctatgcttcacgatgcttggaatatatggagtgaggaccacttcatttaatgatgaagaattgtctgaaatgttgcattctatcttcaattcaatcaatatcatgcatgagctcgtgtgtgtgtatatatatatatatattcttaggcttgactaagtaaaagaacaaaagaggaaaattaaaaacatataacataaaattataaatattacatagaaccttaagttatatataaatcataagattatatatatccaatgaaaaaaagaaagagaaaaaataaacctatttaaacactaatcggtttttatctatcacgtaaactactgatcttctaaatcttattctagcatctataagtgtatgatcatatgaaatttctttcaatatatatttgaacgaaaacatagcatactaaatttccatgctactgtaatcatattgttagtgtgaagtgagtcaaacataagaattaagtcatatagttgtaacatataatggcaaaacgaaaaatcttaaaagaacttgacatgctaccaatcctcttgaaagaaaggggtcaattttttttgttctattatcttgaggttaactataaaaaaaagttatatatttatataagtttcatacttgaattttgactgataaagaatttcatcttttttttaagttttatcttttctcctatcttcagaaaaaggaaataaatgtcttaatctttgttagcatccatgaaacatttattacggcatatatgtagtcaaacttaattttcagtacacagaggaatagaagtggattgaggaagggaaatctgacttttgtgtaatgcaatttacatggaaatcaactttgactagctactttcttcactattcttcgttgttgactcttctgcttgttcaattcaacgcacgccaaaaaaaaaaatactaattaccaatcagtgttgacaattatatttccttaggagaagtgtgcataatagtcatattatccaaagggtcgcacgaatgcatattggatatgtgagtgaagttcaacctagtggcgtatattcaattagtgtatgtttgaatttcaattaaaaaaaagtaaaattcgattaaacttaaatttaaaaattttaagtttagttaaaagtaagtttaaagtaatttgatttatgtttggagaattttaagttcaacaaaaaagtaagagagagataactttaaaataaacttcagtttgagagaaaataacatttaattggaaaagtaatttgtcaaataaacaagtgcaggatttcatgaaaagtaagagaaagataactttgaaataaacttcagtttaagtgaaaatcacattcaattaaattggaaaagtaatttatcaaacaaacaagtgcagtgccatatttcatgaaaagtaaattttagtttaagagttcaaatgtcaaatcaaacacacccttaaattaaagggctcacatctaatgtaaggtcatggtcatgtcatttgcatcatagctagcaagcaaggtttcaaatatatactaaatatgaggatgaatccttttaaagagggagggaaaaatatttcttatctcaaagttacatgttaggtttatgagtttaacctgattgc

SEQ ID NO: 1633 - DNA, 1098 bp, Glycine max
  Soy_ogl_3738 Gm11:5057701..5058798 Cluster 6
cgtgcaacaacaggccaacacgatttggttcaccatgtgattcacatctgcgtataattttgaataaataatacatatattttttaagagtaatccaatcataaataatcattatgtacaataagattattgattttaataattattatataaaaattaatattaaataattataatttttaattaattgataacataaaacttttaaaataacaatatatgtcttttaaattttctattttatacaggaatcaaaatcaattgatattcaaaaatttaaaataacaacttatacattattcagtcaattgagttaaatcctcttaataaatttatattttttctaaaattaaaacaagtatttattataataaagtttattaaatatgtgtaatttttaaaaaatatttaatatttttatcttcaagtataatgttattttttgtcattaatatccgtcgtaaggaggggccttagactatttttctcctccaaaagttcattcgaattggtgcttaaggtggaaaatttggcaatcaagtggttcactacatgaattgaactctcttttgctctcatttaactctttatttattaaaaaaattaggtgacttaaatcacaaaactcattaaaaataggataaagtggggtacttaaatacataaaaagatatttatagattattcattaataaaattttcacatataagaaaaaataaaatttatgagatcaggtcttgctagccacctcaatctttgttggctctcgtgttaacctttaaatcttaattattacgaaatatcattgctgcccaagacttcatcctgagaaatattcttgctttctctaagacaaagaaagttaggctcattaatgtcacgagtctcacagaagtaaacaaaaaagcaataggatcagcaaaattaacttggaaagaattgtgtagtgtaaagcaatctgaatgtgtatgtttttaatttaattcatatgcattgcaaaactttttttacattggtttcgagtaagaatttattcattgtgtcattattcgttaataagaataataatttctgtgtacagtttttttaggtacagc

SEQ ID NO: 1634 - DNA, 1021 bp, Glycine max
  Soy_ogl_1521 Gm05:15530..1558500 Cluster 6
ctttaaaccaattatctaataaatattatattaatatcactaatattttcttttactaaaaatattataacaacctagtattttcttttgttgaaagatatatttaaacaatctttttaaataattattggatgattttgggatgttacatattgcataatgttatgtgtcaactcctacttaacttttttcttgcttaatgtatcaattttctattttttaatttattagtttatataaattgtagaattacattgtaaggcgaatcttttaaccaatcagtatcatagtttatgaatattaagacaattgaaaaaaaaaaaaaaagacaagaaactagtttagcagagtttactaaattcagtaccaatgtggttttttttttatatatataaaaaaagtaccgttgacgttgattgatttctcgcaaaatatttgtcaggtttaattaaggcaaaaccttgttttttatataatcatcgtttagtaaacaacttaattaaacatttcttcttctaaaaaaacaaattgaacatttcttgaacaagtatttatcatgtaagtaattattataatttaatacaatttgctttactgatttgacgatttatgcttattgtcttactatattaagtcgttacagtgtttgtaggtatatataaatcgagttgaattttattatcttactaaatatttggtaagtagcatcaatcacaatatttgatgtattaatttatttggcttaaatatttataaactacattaataagtctatctaatatcgtgtataataaacaatctaggaaatcaattagtagcacgtgttacttaactagctaactcttcagaataatagtttcttgtctttttttatttatcatactaattgattaatggcatcttatatgttaacactttatttgaaatgagtaacccttcgtccatacgtactaaaagcccatgggatactctgaggtagacaatgaatattcagttgagaggtaggaaaatgaggaaaagg

SEQ ID NO: 1635 - DNA, 1200 bp, Glycine max
  Soy_ogl_2150 Gm07:3196401..3197600 Cluster 6
ctagacaggcaactgcattttcatttactaatttatttatatatgtatttcaagatgaaaattattttttttattgcagaatgaattggcctcccgtagaacagatgtagggaatatatcttcttgcttcttgtttctttaacttataataatttctaacatcataatccaatgagaaataacaaccttctgaaacagagctttccttcattttaatttgatatcaaagataaaacacaattaattaaattgttgtccaacttaaaaaaagttctataataattcttttgagacatcatgtttcgaagcttcaaatgataaactcaagcttgtcgatgctattgtaatatatcattttcaacgaatcaatgttaacaacataccaaacaattgctcattcattcatttttttttaatacctattaatttttaaaacccttttattcataaaaataggggagcatgttttctccttaaatcaagatggctatgaaatatactcaagtttctgattctggatgaaattagtcataatattgcagttgtacttcttataacatgataaaaatctattatatatgaacatcgcgacatatatcaaatattattcacaatatttgcagtggaatttaaaaattctataaaattctttatgaaattccatgtttcaaatcttcaagttcaaatgataatatatcatttttaacgaatcagtgtaaacaaccaaacaattgtgcatgctcgtccaggcatagtcattttggcaatacctataaacttttaatacttatttattaatttaagaaaaaacccaggggagcgttttttttctctccgtaattcaatatggatactgtagaaatagatcgagtctgttaattatatttgcttctacatgagcaatactctaaagttgtagtattattggatatgaagtgtacacacaaatttcgagttagcatttcaacatgtgtaggagtttctacatttccttcgattggcttttctcttgttaattactatgtgaatggttaaatatcctattattgtaggatcaatatatgtcttcattttgctaactaattaattatgttgaccattctttcatgatttattgtttggactttggactaaaacctatactagcaaacttatttgaatatgattttacaatatcaatgttcctctcttctttgccac

SEQ ID NO: 1636 - DNA, 1023 bp, Glycine max
  Soy_ogl_6602 Gm19:47020178..47021200 Cluster 6
ttaaatttactatgtatattaacaaaaatatttgttggtattaagggagttaagggaattagtttagttagtttgacacaatgtgtaaatttttgtatatcttctagtataatatttaaaatcctctgtttgaataaataaaaatcactaattaatataatgtttcatatttattaataaaaatcgttgagttaagggagtatattagggatttcatttctattaattaaaagttatagaagctagctaatttaatgctaggtgataaatgtaaaggcaacaaattaagagacatgtaacttgcctacaaaaagagagacatgtaacttaggattgaaaatgaataaatgattgacttaaagtttaatttgtatacattctcaaaatttaaaaaaattgcagacatttaataaaaattattttattaccacatcatattaatgaatgaagaagaattaaaaatcctaattatagtattgaaaaaacagaaagtatgataaccgaaaacctaaaataatatttggaaatggtcttaagaatactattactctttctatttaattcttttaaggaaaatataaatactaatatactttcaaaatctcataaaaaataaaatattaggtgattttagaccatctcttatctataatttcaaccaatcttcacttgaagtgtttgagttttttaatttatgataaaaaaataataatacttgataatatgttatgcagaggtatgaaaatcatgtgattttggacacctaataatttattctttgaaaaaaaataggatgcaagagaagagaaaataaattaatgaattaatttaaatatattgtcaatgtaaatttttacacatttaacaaattaaatatacatttttttacagagaattaaataataccttagatatgactttttttttttacgaaccttagatatgacttagttatcacaaaagctaatgattttaatttatatgtactaatgtactgtgattatataaccgttttatgagact

SEQ ID NO: 1637 - DNA, 1055 bp, Glycine max
  Soy_ogl_987 Gm03:39887301..39888355 Cluster 6
tagtggggcatatatgagactaccacttcaagacatagaggatctattctttcctctaatgatttaggtataaatttcataagtactttaggctgtatatgagggtcatacgattagagcactatatagccttatgatgccatttttaaaataatcagtggttaatgcagttaacatcgtactaaattaagaagtaggcatttgatatttttatttttattttttgtggtgtaaaggattttgaatgtcaaaatatttttatgatataatacaaaagtataatgaaaaatatgattttaatatttcccaattagtaaatcattaatttttaatctagatcacatgtattttttaacggagataacttaagtaaaaaatgattattatggataagaattttatttcttctaaatttttaaaatagatgcatactaaagtacgtcatcttattctaatttttaataataaaaaaatggagaagatgaactattgtgtaatggtggaagtttttgttgcattcacttatgatggcaatagaatccatgttcaatgttcaattcactattcgtgaaaaaaaaatggaccaatgacaattaagtatcatggatgaaattagttttagtggattaaaaaaattatcatgatttttgacctaagacaaaagtaaaatataaagtatttatcgattctatcaataattaatattggttgaaaaaattgaccaaaaactttcaaaaaatattcttttagttatgtttgttcattcacaaaaattcgaatatgaaaccttatttataaattgtctatttaagattgtaagaaatcaacctacccaaataactaaaacagatgggaaaatactaattaaggaattaaatttgggaacatgtaatttttgagcaaatatttaaaaatttaatattctaataatttaaaatataattattagtaaattacattattgctccattcatattaaaaaaatattttttaaataagaatacgaatcttcatttattgagttcaaataataattttaaggaatttttaattca

SEQ ID NO: 1638 - DNA, 1168 bp, Glycine max
  Soy_ogl_1723 Gm05:38038433..38039600 Cluster 6
catcgataccataccaaaccgaacgcactctaatggcccataaagttatcagtgggggaccttaagggagaaatttggggaaaacatgtgtttggtttcttggttatggtaaatccactggttgaggttgctaatatttgctacaaatgttacgtatgaaagataccgtgtctggatgagcttcctaattattcgctacctgaagaaaaatttaggcatcacctgtcatcaaagataggatgttcataggtcatcaatagtgccagtggtacccactaataagcgaatttggataattaaataaaattgtcgattcatatctcattgttaattactataaaactacaaataagaaagctatgctgaagtaaagagtaacattttgtgtatgtggataaaacaagcaatgcctagtcatttctttgagggactttctaaagcttttcttaatttgcgatgataaccaaggttcactcagaaaaacaaactcaaggctcaaggctcaaggctcgaaccaaccaaagtgtgctttgccaaggagagaaagaagtgaccacttgacctaattaggggaactattttattacgaggggttccaataattgctatttgtctccgtatggaataaaaatatataagaaaaaagtagagcattggctttctttaattatagtatacttgatgccgaatttagcaacccccatgcataccaccacatttttaaaatgcacaagtgcttatccacaaccctattgtctctttacctattttgtccatataattactttaaccaactacctttttattattataccattttttccacttctttttacctgtttttcaaagccctttaatatttaataatcctttcttgttggtcgtgagacgtggaataacaggctcatggaatattgcgagagaaatttttctaaagcagacgaacaataatattcttttgtgtgtgtaatagaatgcttatgagagattgaaatgtggtttgattcttttttttttaatgcctagctatgcttatctgtttgtcttttgtccgctttttctataccctaatatgttggaatctgatggtaatcgttccactagtcactgcttttggagtggttatatatgagagataagaaaccaccaatgtccggcattccaattg

SEQ ID NO: 1639 - DNA, 1500 bp, Glycine max
  Soy_ogl_422 Gm02:6720001..6721500 Cluster 6
tgttaagcaaaaataaaaaataattattaaaaattgaatatattatcctaaattttgaattctttaaaattaataatatatataaagtatcaaaataaatattaaatttatttattttaatataaaacagattggtccgtctaactttttttctcaatccattcgttggtggacaaaaatagagtgatttgaaaactttaattcaagtggccaaaaaagagtacataggggctggtctaacaggtcaagggtgaggaggagtgatttttgaactagcataaaaattggtaaattggtgctttgtcattttgcaagaagtgtttaggaggtgacattttggctgtttctgtccttgatttctcgtttgcaaaggaagcctgaatgcatcatcatcttcctttcctattggagccatcactgcattcatccatacatcctcgtttccatatattttctaaaatgcatcatactatatttttccacaaactaaaaaaatggttacaaatattttctactatacttttttctacatttatattattttctactatattttttttatacaaaataaaaaatgaaaaaaagaataataaccacacttaaaaaatcatcaatgcaaaaaaaggtactctctccttatagacttagaagttatttatatatataaatagttgaatgtaatttgttttgaaaaatataactttgttgaaagttgaaataaatcgttacagatatttataataattaggatgtttatttatgttttttggttcatgtgtaaattaacgtttttaatttttttatttctgtaagttaatgtttttttttaatttttggtctcaataagttcaatttttttattttagtccctgtaattttggttttgcaagtttttttttttctcaattttggttttgtaagctttttttctatttttagtgttttaagtttgtatttttttcaattctaatcactactacaatgaaaaattaaaatttaaaagaattaaaattaaaaaacacaaacttactaaaaaaaatgaaaagaaaaattacataaaccaaattaaaaaaacaccaattttgataaataaactcacaagagaaaaaatgaaaaaaaaaacattgacttacctaaaatttgaaagaaaaactcacaagtgaaaaaatgaaaaaacgttaactttaagaataaatctagttaagagtaaaaatgtagagaaagatgacacgttataatatttatagaagttatagatggcagtaatcccttaacaacgagatagtgttggtgacattggcactcaaaatgcagcgagtctcaaattacttatgaactgaactgagggaagagatcgagtgaaacaaaaggtgaggaggataaaccaaagtggcacgatactgagaactgaacaaagcttacaaattgtgtctatctcgggattcgaagatggcattgattctttgtccttgtaattaagtccctttgttttcccaactg

SEQ ID NO: 1640 - DNA, 1271 bp, Glycine max
  Soy_ogl_769 Gm03:369201..370471 Cluster 6
atggcgctttatgcaaagttttaattttttttttttaccactgaatatttgtctagctgcataatcaaggttcgaattttatatcattggttaagttagaacaaattacaccaattaaatatatgcgtaaaataagtagagtatcacaggaagtttacaaataattttaagaaaaataacgagattaattataattttaaaaccctaattttaatctgggttataatactactcgctaaagtggagcgatatctaagaatggagatagcatcggatactaagtgtgtttaatataaataattagaaacttatagttaccattgaatgattgatagcatatcttaagtgttggaatcatttttaaaaagtgattttgtcttttgttttttaagaaaaagtgagtttgctatattagccttaataatgataaataaataaaagtacacttctttaattaaaactattatatttatcgaaaattgtgtaacattttttcaaacaattaaaagtaattaatagaatgcagtatttaagcttaaaaaaataatgtagtatttaatattttttaatttcaatattaaatgactgtcaaaaaaatattccaatatcaaataaagtaataagccgttctaaaacataggtattggagtaatgtgtaatagtggcgtaggtgaaaactgaatctaaacataaaaagaaaaagaataatgaatctagttaaatagtataagaggaaaatctaagatgaattgtaaaaataaaagccggataacacaacagtaaaatatgcagatgtttttgtctcggactcacaatacacttagatttagttggtataaatagtaatttttgtcctaggatatgtagaacgtggataaatttgttcctcaaagataaaaattcaaattttaattcctaaaagtgaaaaaagtacaataaattcattagtatgttatagttaatggaagagctacgtgacatattcagagatgaattggtcaatattttatacattcatagataaaaatgactatttatttaaaatataatttaatttttatcttttttttaatcgttacaaacataacattataataacacttgaaaaaatagaaaaacaagcatagattaaaacaaacataataataagcataatattgattaataagcataatctatatgttattctaaaatttctaacgtttgaattaataaacataataataaaaataatattgattaataaatataatacacagtatctttgggta

SEQ ID NO: 1641 - DNA, 1300 bp, Glycine max
  Soy_ogl_1458 Gm04:47171201..47172500 Cluster 6
tctccacgcattggaatggctacaaactctccaagtgcacaacgttatttttgagctggattgcaaacgtgtgatagatggattaagcaatgaaaataaaggagctactgatttttatgttttattatctttttttaaagctcttatttatcattttccaaactttttttgggggagtagtttcatttaatttcattacgagacaaacaattcataattaacttaataagagtatcaaattttttgctcacaactaagttcatgattggattccaaattatatttactctatgattataaatgaaatggagtagtgctgttttctttccaaaaaaaatgtttatagacacacctacattataaaacttgaaataagatatattattcaaggtttacgaaatacacatgacacttttaattcatatgtttatttgagtgtgagaatttttattttttttaaggttttttttcttgtctttctaacaaaacttgctctcgatcaacgtgtcccagcttagccatgtttaaatgtgtgtcaatttctagttttgataaatacataaggattatgtttgaacattcttgtttcgcattttatattattgtcctttataattttcttatttatcgtataatagtgtagaaacacttatcataattctaaaatttacacaaaaaaaaaagaaatttgttttaccaaaatccaattaaatataaaatgcggtcttatgttataaattaaatataaaatttggaaaagttaaaatttcactctttttggactcttagtcatttgaaaaccagaccgaactagtcggttcgaccaaaaattaattacatattcggtctaatatttcataaaaatatgatgaattaatagttttccttgaaaaaatttgtttattatatatttaaattaaataaaaacaaacatgttttatatgtaattcacatgctagtacactaatagatctctaatattgagcttataaaaatatcgatggaaagagataagactttgtttgttaaacaaaaaaaagaagaagaaataaagggatagacttttaataagtattttcaagacattaaccaataaaattaacagcgaaatattttataaaaaatatttagtattatcattatatttcattaatattttgagacacccactaactaaaaataaagttttaaaaattatgtggaaatattaaattccttataaaaacttaaaaatgatttattttttagaaaaaaaaaggacaataaatgaaaagtagataaggcaaggcgttggagcgtg

SEQ ID NO: 1642 - DNA, 1143 bp, Glycine max
  Soy_ogl_6538 Gm19:43808358..43809500 Cluster 6
tttaattatgcatatgaacaatataattattagttgtattgacgcaataattgctcttattccctttctgtttttgttttggtcttgtcaatttctagctcatggtatgtccgttgttgcatcacgcatgaccatgaagattcacaaatacattcttcgcccccacctacttctgaaatctgaactgctagtcctgtaaaacaaaattgaaagtacaacaaggtagttatgggagaaggataggtgagaatgtgagacgattagatgacgccacctttaacattattaaacattaaatatccaaatctaactataagaaagttctgtcaggtcaggtgcacttggttaaaaagttttaatttttaactttccctattaatttaattaaaacgtcttgtttttgttggaacaatttagagatataaatctaaataaattttgcttctgtttgtttaagaaagaaaataaaaggaagatataagacgaatgaagaaaagaaaggcagtagaaaaataatataaaaattagattgtttggtaaaaaaaagtaggtaaaaaagatttataatttgtgtctcttatttagttgtgtaggaaaaaaataacatgtattaaaatgacataaatatttctaagaaaaaaaaattgtaaaaaaccaaagaaaattttatcattttatatattaaagcattccgtccttcacatttcctttcacttttagacagataactggtattgaccttcctaaatgaatagaataatagaatcgaacaaagccttagtaaaattcataatttatatgcaattaacttgtctcttttgcgtttttcttcaaggcaataccttttgcttttttcatcaaggcaataccttgggatcatggttgacgatttttgagtcttttccaactttaggactcctcatagattgcgttctctagcgttaacattgatatatcattaatatataaaagaagatatataatatagtttatttttcagtataaaaacatatagttgattcattttaacattttgaataagattgattctctaatcgtgtgtaaaataaaaaatgcattatcagttattaattgaaatgttggaagattaattaaatgtcaattaagaagctttaatttaaa

SEQ ID NO: 1643 - DNA, 1134 bp, Glycine max
  Soy_ogl_2663 Gm08:13565601..13566734 Cluster 6
attttcaacctatttctcttctcaaaaaaagaatcttaaagtattctttaaatttttctatcatttggattgactacgtaattaaccttcgatccaaaactttgttatatttaaagtttcattttcctgaacaaccttgccatatgcaaaatctttcttgttcctctcaaccaaccccttgggattgttgtttacttcttctatattgcgattaaaaatgaaattaatttcaataaaatgtaagtatgatttttttatatcatcaacttatttctcttctcaaaaaaagaatcttaaagtattccttttaagtttttctatcatttggacgactatgtaattaaccttcgatccaaaattttgttatatttaaagtttcattttcctaaaggatatgttttacttgaattgataacaagtcttcatctacaaaatcgagttatgttactcatcaagaagattttgatgtagctaacctgataaatgagcatttgtcacatgctatataatttctcacatcaaatgaagattttgaaattaagaagaaaaaacgagagaatgagcatttgtcacatgctgtataatttctcacatcaaatgaagattttgaaattaagaagaaaaaaagagagggcttgaaattaagaagtgccatttaatattcatttttacactcaaatttaaaactgggtaacgttggccaattaagtcaaagttaatatatataaaatacaaatttacttattttaagagtaactcttagagttattttttgttctcatcattcaattttttaagatcaaataataatgaataattaatcttaattattatatttcaaaaaaataaataataaagatcagaaataactctaaaaaaaattaatcttagttctcaaagtaattcgttaattaagtcatatgaaaatgttttaaattctactttaattaatcgcacgtaaagaaaaaaaaagtataatatgacactcttctaatactcggagtgcatggatcaaggtattttaagttataatttaactaatcttaaaggaaaacaaatgtataatacggtactctttaaatactcgcagtgcatggtcaattattgtagaattgaattgtttcagtagtattg

SEQ ID NO: 1644 - DNA, 1355 bp, Glycine max
  Soy_ogl_4110 Gm12:36106546..36107900 Cluster 6
aaatgtatttgacatagagaattataagtttttgtgctcacttacattttaattcttatttggagtttcatataattgcttttgagcagtcatgaataaatttaggttaaattattgatttattttgcattgaagacaaatatggctcttattaccggtgaatgtgaactttcaaacagaactttaacatggagaatcacacgagcatattcaaagaacacatgcacctatgtcagaggtttccaaggggaaagaaaacgatgaatcagctggaattgcagtcacagccacggccacgtctactcccgttagtcttatattaggcattagccacatattcacacaattaaacaaattaaatgtatccgtagggactaatttattaatagataggagttgaggaactaaaattttcattatttgttttttggaattaatcctcaactttccggaggtttttcattactgttttatttgtgttggaacatcatcataaccattaacttaagaaaagttgagcattttaattaattattggatgataattaatctgaaaaacagttttgcaattatattatacgaaaatgaatttataaaattatacttttttaatatcttgaatgatttataatatatattgcaatttttaaaattacaaaaattacgtttaagtgatcaaaggactatgaacaaatatatttagagaccaactttattgatccaattcttaagtaaggttttgtgttatggtttgagtattttggatgaaaaataattgttgagaggaaattttttacaaaaggtaactaactaaatttttaacaaaaattagttaaaataataactatttcgtcataataatatgattaaaaatttattatatattaagagactaattcagactggatgctcttagtccacacagcgtacaaagaaattctcaaaatttttaattaagaattaatacacgaagaaatggaatttccggtatttgtttagttgaatgtatactcagtggcagatccagatacatatatagctaattgccccacaataaatttttttatattcaaaatatatttaataattataatttttccccacaaaaaattagtgttgttccatataggaccatttttttaaaaaaataattaatataaaaatttatcattcaacatttttaaaatatttgaaaatatgtaggaggaaattataatatataaaagcttaagtatttatcatttatttttgtcataacattacatagtttgaaaaaacttataatatttttttctattaaaatatttgaattattttttctcccaataaaaatattcagtatcaaccactgcgta

SEQ ID NO: 1645 - DNA, 1314 bp, Glycine max
  Soy_ogl_48 Gm01:2303387..2304700 Cluster 6
ttattattaaaaacaaaactcgtcagtgtggaagcaatttccaattctacaaaaaagaaacaaataaaatgaataacttgaatgacagaaagttagagggggtaaatagattcccttgattatcatacataattatagtttttatattttatataaatttaaaagtatccatgcaatatggtacttgctgccaatgttaatttttttattgttttaacaaagaaatgacaatcaacccatggttttatcatccaaaacttttttttcttgagatgggaagatacctgtcgcgtacttttttttgaacatcttaaattgtcagtataaattattttatacgtcaatctattaaaaatctttagaaatgattctttttttctgaaaacaaaatgacagaatgaggagataccccaaaattattggacagttatgttgagactctcaagcagaaattcaccttaaagattattacatagacctgaattgtaagtaacttaacttaattataactactcagttattttctagatgctacaaagaatgtgaaaattagttctggatttttaatcatttgtatcattccatattgactttagatgtgactttaaaaatagttaccaaaagttaataaaattgtgcaatgcaatttttttatattatagtacattttaattaaattctttatgtatacagtggatttcttttattttcattttaaagtttatattcagcaaaagattacaacactatgctctttttccgtatatgtgttatcatccgctgtctaaattgtcttcatttccttgtgtttattttcctgttttcattgcataactcgctatccacagtgccttatattttttttattattattattataagtgccttataatttcgaggtcaaatcctatgtttcattgtaatttcataacaacaatagaaatgaggtgattacgaagaaagaaggaaagaaacaatgggaaagtggcagagacaatcaaatccttttatcatagtttttaccgtcatgcataagatagtgcgattttaaatatcacttttatggaatctttaattactctctatcaagccagagattattccccttctctggttattctagcctttaattccctttctctagtcccttggcgccttcgttgcatatgagatttttttttaaaagatatattgttagttatctctcatgtttatggagaaattttttttatgcaaacaacctttttttttttgttaggaatgagtttctgaatagaaatccaaaattcaaatttggttaacttcttcaatggg

SEQ ID NO: 1646 - DNA, 1419 bp, Glycine max
  Soy_ogl_372 Gm02:4184682..4186100 Cluster 6
atagtaatgacaatcgaggaaagttggcaacagccatgaaccttttatgccatgcctgtaggcttcaacaagattgaactatacatctaattcgttattcacaaacatatatgattgattgaatgctaagaaataaaaaaagagaagaaaagtcacatattcaatcttttttactaatacaaattggcattctaatagactaataacctatcttaataaaaagaaaaaaaaatgctaattcattactcacacacaaaaaatacaactaatttattatgttacaccgatttcttgtaaagaagtgtaaaacggttcaaaaaaccacataactgatttctaggacattggaaaaaaattaattaaaaaattcaatattgtgatcatcaatatatttcaagctcaatattataatgattagtaattatatttgtttagtttttaattataattaccaataaatattatttgtattattaaaattaaatgttatgacatatttgaattagtttatgcatatttttgaattttatgtgatgattttttttgacagaaatgtgttatgaattatgacttttataagtgaagtttaattttaaatatactgaagttataaacattatgttattattgtttatatttagtaatatattatattaaaattaaaataatattatttaattattactaactcaattatggtttaaatttttaatattataagttgtgaatgtaatggcgtctttctaatatatattacttaatatactatattaagatttaaaatagtatatattaagatttaaaataatattcacgttttgggttttttaatcaagttaaacctaaacttttaaatatattacttgagattgaatcactcaatttttatgttcttttttcaagtgatgcctaatttttttaatgtcggtatcagtttaactcatttacactcatatacttaagtctactagtatgattgtttttattttttatttttttattaggtgtctacctggtccaacctctgtactccatttccaccaaaagcaacattttcttgcttacttgttgtagtgttcattcatattgaattgtggcaaggttacaattttccaacggtctagctccccattgaacccttctcacccgttatcttcttttaatgcagtgaatacaataatgtgttgaatttttcattatggatcatccctgctattttttaggggtagtcctgaagagacgaagcaagatgaggtgaaggaaagagatctcggatcaacatagcaaaaatatttagctgtagacaaaagctgatcgacccaactaattaattatgatatactacgtggctacgtcctttttaacatatataagaaaatatggattccacatttatgcattaaggaagttgtaataatc

SEQ ID NO: 1647 - DNA, 1000 bp, Glycine max
  Soy_ogl_1169 Gm04:2000801..2001800 Cluster 6
acaaagtcatgtgccatttgaaatttcatcatatatgctggctaataattttgggttatatagtaatagtatttatcaactcacttttctacttcaaaaaattggtcccgtttttcatgagtcggtaaatttcgtgcaatgtttatttacaaaaaaatattcgtataatatttactattttttgctgtgacagaatttatatttatttttatttttagtccctttaatttgtagtagtacgtaaccgcatttattcgttaagagcaatgttcactaatttttcccaatttatttcaaagttaatcctcttattttatattctgtaatttgcaaataaagttaaattttgatatactattaatattttaaaaaatacaacaaaaaattacactgtcaatcaatttaaaattaaagcagcctaaatatgaattttaaagcaattcttacaaaatcattaattttttcatgcatgattataaattgttttatgaaggtataaaaaagttttacaatatatgcatttttaaattctgcctaacctaggtagttcttaaattgaaactctactatagtcatttcttgttgaattattgacggatctatcctatggctagtgcaagtgtgtaactcattgtagattgtatgtagctagcttctttttatatcaatctaaatatccagattagtaccgttctcggaccaagattagtattgtagattagtaccgttgtagattcaaaaaatacataaacttggctccttaatttttaagattcgtcatcaatctaatcatgttaattttcgaaccaggattagtaacatgtaaaatcacatccattcggtaggttgtttttgtagatgttcgtgtgtgtctttgtgtaatcatattcttagaatttagtcaagtttaagactctttatttctttttaagaaattatattttatgaaaatcaaacttatatctttttctactaagtcaacatatattatcaaacaagt

SEQ ID NO: 1648 - DNA, 1100 bp, Glycine max
  Soy_ogl_1374 Gm04:43864101..438290 Cluster 6
catcaatgttgattgatgatataaattgattattaattaaaataattaagaaagcttatattttactataatcacttgataattaactaaagagagaaatattaaaatgaagtggatataataattcataaaaaatgtgtcataaaataaaaataaaagacgtaactatatgagaagaatcgaagatcgaagaataagtataaaaattatttcacttcaaagaaataaatacttggatgataatatcatatgaaattttatttttctttctttagttgttcaaagtctttaaaataaaagaaagattttgaaatatatatcgtagacaaattttagttttctgcaaaaactactaaagaaaaagaagttttcttcaaaccattttgctttaagttttgttttcttcgttgataacggagacttggtcgacgctggcgatgctgagtcgccgacaccatttttgtttgcttcgactgctgactcagggattttgaatgtgaatttctaaagcaaacaagtagtctaatgaaaatgagggggcaattaacctctattttccccttctcaaaaattgataccgttgacttggttactagtaattcttcaagtcaacaagttataaggacaaaacggaggtaaagccaaatacactccagaaggcagtatattatatatttcacttttttcttcttctgtcgaggaacctttaactgataattagagattaattcatattagataaagttagaaattaattaattttaaatatgtgcatatacatgcagctttaaaaaactcacacacacacacatatatataaagtacgttatcaatctacagctagatatattataataagatcaatattatttatatgctagtagagatgacaaagtatatcaagttttattttattcaaaaaaatatctataagtattagacataaaattaatttagttagttactagaagttatttgaataagttaattggttactcaagttataattttctaattttgtataaatacatcaactttgtaatactttgttgaatgaatgaattgaatgaatcctaaaactacttttcatctatctttta

SEQ ID NO: 1649 - DNA, 1229 bp, Glycine max
  Soy_ogl_2505 Gm08:4709201..4710429 Cluster 6
aagaagttaattaaaatgcattttagagattaatttttatatactactagagaagaatctagtgttttgtacaatgaatgaaaaaattgaaaagtgagaaaatgaaagaagtaaaagagagtaggtgattttgagagaaaaatgaaaaaaaaagtgagttcaatgcatcaataagtgtaaataaattttacataattatatataatagatatttctaaatagattagtgtaaataaaatttacacggtaaatttacaaaaaaataaaattattagtgtatgtgatatttaaagttagttaatttaaaagtcaataattaatcatatataataatttgtgttcaatgttagtataaaaatattttaacaattaatatataaataatttactcaagtttttatattaatctaattatgaatggttatgtatgataaaattaacaacttttataataataataactttaaaaattatatttaagtgttttttaattagttggtaaggtaacatcttcatactaatatggtgtcaagaatatatttttagtgaatgatttataataaaataattgtgtatttttttaaacaattatttaattttttgatatatctccatagtttaatagtcacagtcactaatcgaatttatagatgaaaacaataaaaaattgaacgtgaaaggctctttatctttttttttctttctatttttctacaccattatcaacatttgaatcagatcagagtagcaaaatccatttcctgatgcaacgtcaagcatttgagttcacattattcagcaattaccatttctgtatgtatgtaactatgacctttttttgaccaagaagcagtccaagcctccaaggtgtcactaaagtattcacgcggtccactattatatacatgattacaccaacaacaaaaaattaaagtacggcttaagtttaattagcagtgtgcacacattgacagacgtatgcaacaaaagaaaaggaaagtatctatcatattatccctgccaaaaagcaaaagagtgtattaaacgttggaaccgtccaaattatataggcctactatggataatgttgggaagaagtaaaataatacgatacgatatataagtaaaagagtcatcaattcaaaatgccaatgtactttgagataaatatatagttcactgaaaaatcattttttcactctttaatttttatttttaactcagaaata

SEQ ID NO: 1650 - DNA, 1034 bp, Glycine max
  Soy_ogl_3282 Gm10:672567..673600 Cluster 6
cagatgctctaataaccctaattgaatcgtgatcaaactttgaaattgatatttattaacaaaaactaacaatttaataattaacatttatcaataaaaaatatcaaactcaaaatttaagattatgagactatggaaatataaaagaaaaataaatataagtataatgagcaaatcaattaagtctagttcaagttttgaagaaaaaaatagtttacttcaattttcacaataataactgaaaatcacaataaaaaaaatatgttttaggtttttttttaatcggtttaacctttttttctgatcggtttaaccattttaaatagtttgattcaggtttaaatatccctaaggtatatattatacctatttttgttttttttataagaaacagctgtactatagaaattcgttctacagtcaaaaaataaaaaagaaattagttcttgaaattgttaacttgttaatcagtttttttaatgaacttatattgataaacatttatagagattataataacacaaataataacttttagctagtgacgaattttatattgctaaatagtactgcccacatactaaattaaaaaaaaatattcacaaaaagagagagcctaattaacaaatcaagataaagtacaaaacgtacaagtttcaaacacaggcttgcttttgacaaatggggccacaggtagcacatataaaaataattttaccaatatacaagtcatacaagtcgaaaacattatttctttaattatttattgtactcatcaactttaagcttatatcattattcgagtcaaatcacgcgcgcacattttaatgccgataaattttcttttttctttttggtagttggcaacaaattatcttaacgcttatgtaacatgtataaaacaaaattatttgctgcaacaatgaataaaaagtaacatttgatggaaatatttcatagacttaaatacgtttttaataggtataagtagaatagatttagtttttttttttctgaaaaaatttacttgtaat

SEQ ID NO: 1651 - DNA, 1100 bp, Glycine max
  Soy_ogl_5277 Gm16:3694501..3695600 Cluster 6
attcaaaaaattatattttttatttataacatattgatctattttgcattgaaaacctttctattacaaattctaattatcaaaattgatatttttgacgatggtgcaatgatacatcattaggttaaaaatctatgtgtattcgattgatctcataattcctttgattaaaagttataacaattactaatttaaataaaaagaagttacaattatgattttgtcacattaaataaaataagttatttgtgatcgataagaatcaaatgtaaaaattatgaaaaattacatttcggttacttaaataaattttcatcgtaaataataatttatgtaaatatatctcattcttgatggtacattatatctcattttatgtagtagaagtacaaaattcgtgtacagaattataattgatgttattgttgtttgtcatttttttaaccttttaatagagggtgatgagaggctggggctgttgtgaaaaggaaagattcgtcccaagcaaattaaatggggtataatagatatatgaaaaattatagatgtggacatccaatatgcccatcaacacctaataagagaaagataaaaagtgaaaaaaaagtataagttttataagtaatataatttgacttgaagaaacagataaaaaaaattataaatgtttgctaggtgttaaaaatatgagtgttgatgtattattactctaaatattttacacattataataaaataagaattaatttttaaaatttattttagctttatttattgatccaccggtagacaacgtatttcataggtccaccgtagaatcctccaagctacttatttttacgaagaaatcaagacattattagaataaggagcttttgaataagttacttctagttcttggagttatttctttttgagaaagatatatggtttttatatttttgttttgaatgaaatttttaatcagttttataaattataaaaatcaatatttattaattaggatggtaattactgtttatttgattattcaaattaatttttatttattaatttggaaaaattattatggtttttatataataagttgattttatcaa

SEQ ID NO: 1652 - DNA, 1200 bp, Glycine max
  Soy_ogl_2917 Gm09:723001..724200 Cluster 6
ttcaaatgcaaacagtctcttcattttgaaagtcatgattggtattacaacttaaaaaaaactaaattatataaagcatatcttaaaactaatttcattaattatgatgaaattagttaaaatttatttatattttgaattatcatgcatgagtttagatttatttatatttatatccgcataaagtaacattcatcatacctaatgttagaaaactattaatttcagaaaaaatcagttacaatattttctctcagtcctcttatccttattattttgacacactcgatctttctatatattgtaataattttggctatggcctatgggcgatgccgcatgtataactaacagcaaacagtaatatgaagtagctcaccaactaccaacaaccaacaacaatctgagggcaaagtatcatcagcaactactactatattccacctacctcgaaccctgacattagtcttaaaacttcactttgttggaaccttactagctatgatacccatacccttgtccttgattttaaacgtttcctccttaaattagtgaaaacaccctgctagccaaagtgtaactaatttgcatattattaactggaagttcctttgtgagtcaaattccttttgcagcacagttacactggtcaatgattaaatgaaagaatttttagtttaagtctagatcaataaatacatatacagaaaatgtatatttggcattagagagggacgggatcaagttttcacatcaaacaaagttgtaaaactggaatttgattatattattctacaatttcatgagatgagagaatataccttctatcgggcattgaatagattaataaataatcaaaagaaaagtccgatttcaattacattaattagtcatttttatgattaataactttcatagttgacatattttataatttgtatttatacttaataaactagacttgaaaaaaaaagtattaatgtaaaatttaatgttattaatgtagtatttatataaatatataaataaatatattttgttgtttacaatattaattatatttgaatatttttttcacaagttaataattgaagtgtttgatttgacttgactcaataagtttacacctcaattatgtacttattcaaatgagtgttaataaaattgattttgattaaaattaatttgaagagatataat

SEQ ID NO: 1653 - DNA, 1074 bp, Glycine max
  Soy_ogl_6895 Gm20:40692927..40694000 Cluster 6
gccatagataaataaatcaccctgaagacaagttttgcaaatgggagaaaaaaaatattcccattgaggcctcaacaaacgcatgatgatgtgttagttaaaacaaatctaatagaaaatggcctactttgattaggcaattttcctgtctaggactcttactattaagaagtcgcatttagtcttaattaattcaaaacgagccatgtgcattaatttaagaaaacaaacttctatcctaacaaataattttttatttacaaaatttaaataaccccacgtctaaggataagtactgtttttttaagtttaactattttttaaaaaaaataaacgcggcacctataaaaaaacaacattgacatggtaattttattaaacaataaattaaaattatggaataacccttagcaatttcaaaggagaaactaaagaaaagaccccagccccattagaattaaaaaatctttttatgagaggtaaaaaaaatcatttttttttcagtttatgagaggtaatttgatttgagtaatataatgtaattattttttcttgcaagttttttcccaatatacaaagactcgaaccctatagtaaagtcattgattgtgaacaataccaagcacatggttaatttgtcaatctgtttaaatagaaactaaattgttagtataagtttttattaatatattaaaattataatatatcatattaataaatattttattggtataaaaattaatatattatattaaatattaatgtaaagaattaccctattattataaatccataatgttgatgttaaccgtttacttttttgttacgattaataacttttttggtgtttcttaaattaaacataatgtttgattttctaatacgatcactggtactgccatccacaatttgaaattcagagaccagtagaaaaaaaaatagttataatcaatactgaatcaaatataaggatattatgtggtcatatgcactaaaggttgaaatcgtgccccaaaaaagagttgataccgaattaacccacttgataagaaaattaattttatgtccaatatt

SEQ ID NO: 1654 - DNA, 1339 bp, Glycine max
  Soy_ogl_369 Gm02:4072362..4073700 Cluster 6
ggttcttcttaattatatttcatattaatttcctttgatttgatatgcatttgtattgttattccatgttgaaagtgttgtgaacacctactaacctcctaacctgtggggattattagagatgtaattaactacgcataagtgaagagtttgttagtaaataattactaattagttacttcttactctgtataagtcatatagtgtaagtgccttcctcatttttaatacaattccattttagttttatatatttaatttctattcttcttttaagctctgcatcccatgacccggcgagggcacgtcatttttaatacaattccattttagttttatatatttaatttctattcttaaaccctaaacgtgtttgaccttttttttttttgttagtttatgatctctttaaaaagggaagcaagaccaaacatttttttcttaaaaaattaagtaacttatctctatagaataaaaattgaaaaaaaaaaacattttcacataaattagttaggggccttttgttttcagcttacacagaaataattcaggtagtattctcttcgaattttatcacaacttaaaatgtctttattattattcagttttcactcacttcccaatatatttgagtgcatcaccgatttatgtattttggttcttatttaggatgtgaagaagaagaaagatgtgtttcctcgtctcgttcagtgaaaaaatgcgtcttccattttaaattattatttacttttactcggctaggtttttactatatattgtacacacaaacacttgatttgcatgtttggttcctaataaacactcaggaaaaggttgaaaattcctaattgaaaaaacacttattaactattattattattattattcaaaaaacgctttgaattttgtatagaattcagattaatgttttatgtttttttaggggaggtttatgttaaaaatatcacgttgcatttgccattcttcaataggttttttctctttggccttcgtaaatatggcaagggacattggacagacatttcaagatatgttcgaacaagaactccaaatcaagttgctatgcttaaaaaaatttccttcgccacattgtcccacaagaaaaattttcctatagcttattaatatgtttttaaatgcatttattattaattttttttaatttgttgaagtagtgtatttttattaaatagatatagttattaattattttaaaataatattttttattattttaaagatattagtcttaattatgtgatattattaaagatttgaattgattaaatttatcatatcataaattgagcactttggt

SEQ ID NO: 1655 - DNA, 1531 bp, Glycine max
  Soy_ogl_392 Gm02:5202996..5204526 Cluster 6
tgttaaattagttacatttgtttttaataaaataaaatcaaaatgatatttatgttaattaatatataatatatctaatcaatataagtacactttgactttttttttccttatgacataccaggacacaagaaaaatatataaatattaggttttcgtaattaattaaaaaaaatactaaagtagtcttctttttatcaaaagtgagtgtaatatttgcatctggtaagtttgttagtactatttgcatcattttagtgaaaaatctcacttgttccattctataggttaagactttgtttgtcgcaagtcttttagtttcttttattgtagaatttgcagaatacataaattctctaagactccaaaacatttgaagtagatcaattacatgtttatgttatttagaagtaatgacggtaaaaatgtttgatagtgaggttagccatttgtatatcatcggctaataactaatgcaattcaacctaaatgaattttagcttgattcggtgttaaaaaagatcgatgagtaaaatagtcattttatgacagctaacaactaaaattaccgttttaacaaccaattaacagctatttctgattatcggcagctaataattatttatgacacttagcgcaacaaaattggactaagaagcgattgagaatctgacctactttagggaagaccaagttggaggaaagttttacacatggaagctgcaggcagtttttgaaggctaaatacatttggagatagtggaaattaactgttatttgtctgcacattgcaaggtttaatggcaatgaattggtgagggtgaaatgaaagtagtggtggagggaaaggcacgaatggtttctcaaatttgctatgaatttcaagatgaacatgaacagactggtagaattttgaattgactaaaacaaacacaaactcattcaaactttcaaacttacaacaattggacgaaccaattccagcaattgacacacaaatttcaactcaaatacaaacaaaatagggagctaccattaacgaacctcgaatcggcaataggggcatgtatataaactagttcgaaccaaattgaactggttccgttaaataaaatcgaactaattttttaaataagtctaatttgaatcgaataggttttagaattgatttggttcatttaataacgggattgttttctcaaaaaatgaaattgttttttaaagaaaaaaataatttataaattagtttaaaattgattctaaaaaattaattctaaaatttaatttaaaaatcaaaccagttaaatcagttctgtttgattttttcctaaatcgattcttgcacaacgacaataatgcaccatagcaggggtttttcccccaaatttggtttaaaaatcaaaccgtttaaataggctcactcacaacaccaaatattgatatgcaattagcaggggacacacaaattgacgcaaagcatgaacaaatcttgaattaaatgacacgaggaacaagatgaatcaataaggaa

SEQ ID NO: 1656 - DNA, 1383 bp, Glycine max
  Soy_ogl_2494 Gm08:3812421..3813803 Cluster 6
tgaagactgatagttaaaaatactcttgtttgatataaagaatttagtctcccaactttgccatggtaagaaaaatagtcatgttaaatttaagagaaaggaataaatttacatattttaacaatttaaaagtatagtgattaaaactaaatttgtcaagaaatataagaattaaaaatatattattgaaagtcaaaaaacatgttttctaaaattaaaatatctcttaataagttattttccgaagttaacccttgtgtaatacataagtgaactaatcttatttattctattaattgttatgatttatacatgacatatttttttttgttttaatattctggtgcatcagaaaaggaaatctcgtctaattcaaagtttgataaaaaaaataaataaaatataataaaaatttattttcactaaaaattgaattcaaataatatttaaacaatttaaccttaacttaaacatatataatttagatatcacattttctttctatatatgatctactttttaagtaataaatggtcaattttgaataaaaaaaaaaactgagcctgtttatcttgaaaaatatattacttttttaagtgctcactgcaaaagtaaaaataaaaggcatttttactttaatgttgatagttaatcgtgtaaattgttatgaattaaatcgaaaatagacaaacaatcaagtcattcattatcctgtaagacgtatcgattttttgttaatccatgaactttctatcatccacctgattatattaatgttttcttatttgtgaaatgatatgagctcctttgcggtaaaaaaaaaataaaaaaaattgaaagcttaacaaattagtttaggcgaaatgaaagtttaattccatttttatttattaaatgaaaacaaacaatttcttgattgtaaatattctcatcccctcttataaaaagtattcttatccccgctactcttttgatgccaatttaaatttaaaaatccgagtcctatgtcatacaaaacaaacaaattaatggtagatattgatcacaaactattgaaaatgagttttaaggcaaggtttcgtttcgtgtccaaacagaagctgaaagaaaagacggcaacgaagcgtatatataataaaaccctgcctcaccaaggcaaaagccccaacatgtttaataatgataaattataattgttgattcgttttttttttctttctcctctccttaataaaagcttgagtacatgttactttacagatgtttgtagtttttttataatccaaaacctctcttgcatgtgctctaataatacccaatttacttattaaatatatattatttactcaatgcatgtggatctttctaaattttaatactaac

SEQ ID NO: 1657 - DNA, 1100 bp, Glycine max
  Soy_ogl_3301 Gm10:1393301..1394400 Cluster 6
agaatgcatggtttttttttttcagttaactgaataggaattattgcaatttattttgagagaaggaattattgcaaatgaaagttggaatttcagaaaatacaattattatataatattttttttagtggagtatacagtaatcttgatcgagtcaataattagttttacaacaatgttgagagaccacattagttatagataaaaaataataatagggcgtatactgtccctggagtgagttttaatgattttaagagcaaaagaagaagaaaaaaactattaaatccagacactttattttttattttacatctaattggtttagttttaaaattttacaatttaatccaatctaatttattttgactggattattttggattttccaagagtttataaaaattaaaataaataataaagactttaaatcaatctttttgttttacatagatataaatattagtccatgttttaaaaaaaaatggtttacataatcttgtaattaattgttgaaattattttgataaatatataatactcatcatcctttgaaatgattttaaatttaattgaatttaaaattaaaaaaaatatttaaaaaaataaaaaatgagataaaagaatgtgaaagttgtaagttatttttcatgtttgtgggaatataggattctcatccttttacatacatatacatgcataggaaaaggaagaggagagaacatatgtatttaaatttctaggaataaatgatgcttgaatttttttttttaaatttcctgtagaaaacatgtaaatgctacatttccaaatccatgctttcgaaaataattttgtaaaaacttaaaacaaacacacttattaaattgaatagagacgatgtctagggtgccttaccaaaacatacatataatgtaaaaataagggggataggcccatcattcgatatattattttataatttgaatagtttttttctctcctcacattcttcgacgtctccacagttgccggcgacaaacccttcatcatctctgacgaacaaatataagaaagcaagtattgaaaaatcaaaacacttacaatgacatgcgaaataa

SEQ ID NO: 1658 - DNA, 1100 bp, Glycine max
  Soy_ogl_3325 Gm10:2602701..2603800 Cluster 6
agtttgtgttaaatatgtagaaaaaggagcttaattttaatatattatcaactacttataaattttttaaattattactataaaatttaataatttttatgattagataataatataaaaaatacactatcagtatattttaattgaagtaagttcatttaaaatccttgtcgtttaatatttattgttacagttaattgctcatgttatcgattattttttttatctcctgttatatttttatgaaaagcacttctaatatgctcacttaaattttttggttaaaattttaagaagttggtcgagtgaaatcaaacagagtctttttgacaagtcataactttaaatattcacttgttttttttagttaaaataaatttaagtacatatataaacaatatttgatttcaaaggttttctagaggatcatcctctctccccctaattttcttctaaagaaagatatttttttgttagaaaacaaagtataagagataagaaactgcgaagtgttagattggttgagaatgttcaaatatacttatgtagccactattttgctctacttcaacccatcatttaaaaaaaaaaattatcaataaatgttaatcttaattattaatgagataatcaaaactttttctctctcttcctcctcttttaccacccaaccagtcttatagttcatctttcccaagttgtataaattataatttatcttaacccaacattttgaatgcaataacattctgacttatatccaaaactaaaacaattagccttgaacaacgactcattaaaatgctttagattatgaaatactcaataatagctataatggaatcgatgacgaaggtttcatatttgtgaggttaggcacgtgatcattacaccgtgacctggtcggaaataaaatactggactataaaaccaaacagcagacttcaaagttcaaacattgaactttctttcgtgcatgtttgggacgtttaccaagtcttcctcatattgttttcactttgcaatgacaatatcttctcacacacagaaacatcacaatctatttgctatttagaatcataaatttgagtagttcaaga

SEQ ID NO: 1659 - DNA, 1110 bp, Glycine max
  Soy_ogl_2989 Gm09:4471991..4473100 Cluster 6
ttatgtgttttacagcattaaaataattttgttactatcaatcttaattgtcactatgtgtaacaaaaaaaaaaacttagttgttatattttagttgaattagttaatatccaaattaataactcagtaatcgaaccgtacgagtgttttcttctcatttaaatataaagaacaatgttatattttattatccaaatattagcttggcatgcacttgtttagaaggtcaagcgaaatttccaaatatattaattagcaatatatcatattatcatgaagtgtttttgtaattatgctttacattataagatagatgtaaataaaatgaatatgcctacatccatttgtttttctataacgaaatggggaatttttagtaccaaaaacatgggaaattttaaatattgttgtagcttaatagcttttatctcatatttcatcaaaattaaggatgtatacgttgttgggacggatccagaactcacttaagaggaagttgaattttctattaattcttccttttctaattatttaagtatctaatttttaataatcaataataaattctgcaacattttactagttttacacataaactaaaactaatttttatttcaaacaataaaaaaaatgtaaaaggaaaatcatcaactaatctacccaaattgtaatgcatttgtccttgtaagcaagggtgaacacttcacttgttaagtgttgtaagttcaaccatttctctattcttattctataacaaagttctctgtatgatccaagagcacatgataatttcaaacttcaccatgtgatcatgcaataaattaattactttcaacacaaatttaaactatgttaactgagtcaaatactttggcttctgtttctatttaattattggattttattattgttattcagttattcacgtttaagattatgttgttaacgtgatgattgattaattagctatttttttggaaattaggtgtagtgtttttttttagagggagttagttgtagtgttttttaaatatgcactgaacatttattcttaaacatgcactgtaccaaacgcaacaaatctaacaaactttcctgtcaaatacatct

SEQ ID NO: 1660 - DNA, 1151 bp, Glycine max
  Soy_ogl_3782 Gm11:7061772..7062922 Cluster 6
gatggtgcggccaattaaataggtccaaacgataagatacactctgattatctacacagaactgcggtgacaacgtgatgtcattaaatagtaactacagtagaaagtattctgtcttcttgacgaatgttttataaatattaagaaatatttaatttattttattaaataattttaagttcttaaaaataaatataaaatatgtcatttttatgcagtaatattatttaaaaaaattacgaataaggctgatgaatacttgtctttttttattaccaataatcaatgtcttatttttaaggaataaaaaataatcttatatgaaaataaaatatataatataaaaaaatccattaattaaaatccattgatgagcaacggctagtgtgaaattgtgtgcgttgaaattaagataaagaatccaaaatggttcagcttcgacggcacggagcagttctcatttaatcactgattaatgagtgactgacaaacaccttgttatgtgtgacttctttcaaaacatgcgctgacaaactctttgcaatttcaaaattaaaaatctctttgttttttacttacccaaatgtgcttctctgcttctgcataatcaacctccactttccctaacttcattcttctacttcccatatattaaatgtctttttactcttttgtattcacttgttaaaaaaatcatcaattatgaattacgtgtttttggaatttaataaataataagtgatctaaaagtttattaagattaaatctcactcgtttcattctctttatatttatcgaagagttataagattattttgataataagagaaaaaaaaaggaaaaaaaatactttcagttcaaatttttccattaataaaaaaataataattaatatttactgataaaaaaatcaagtctcgttggataatcaacttatttgatatgtctatattgttaatatcaataaaaaaaagtctatcttgataatgttaatcataagcctaattcatttctatagatgagaatactcgataataatcacttaatgatcaatttttaaaatcattcaaccgttaatgtggtaaacattaaatttacatgaaaaacaattcactaatctataattaattttttggataaatatgaccaag

SEQ ID NO: 1661 - DNA, 1243 bp, Glycine max
  Soy_ogl_6451 Gm19:39266258..39267500 Cluster 6
gatttcttaacctgtatcttacaacacaggtcaacaaaactccttaatttttaatgtagttttcaaaatttcctattaattaattataaggtgctttttttcttttacttcaaaaataaaaattttaatgaatatcgaatattcttgtatagactgaaagtgtcaaagatctcgactagagtgaatattatggttttgacttttgttctgccaaacccttgatgaaatagtagaggagatggttcggagattacgagatggatcatacaactgtaaggctgactaaactgttggggtcaggaggaatttagaaattctttgtgtgtactatgcataattctgcaagttttttttttctttctaaagttcaattttatataatagctttaaaaatacgtagaaactaatatttgaatagtaaagacgaatcttcatgtatattagccctagcagattcatatcagtccaagtacatgatgattgtctatgggacttcattaatttaagtgcttaaattgttgttatgtaaggacatttcccatagccaaaatttaagatatctactttgagtatcttaaagtgaattaaattattttttatttttaagaaactttagagatgagttgtttatataagatatacaccacaaaacttaaaaaactcacaatgttaattggacttctctgacaacaaaagaaaattaaaaaaaattatcctaagaaacttattaaacatacatgacctaagaagttaaccccagaagaaggataacttatcagtataaacttagaaatgaataaatttaaatgttgtctttcaaaaaaattaaacatttatagaagattatcttctcttacatcaaaaaacaaaaaataataacagtcacttccgacacaatctgcaaaataatcgttaaaaatgacatataaacacttttgtcatcattttaacatagttctaaaaaattgttttagaaaaatttgtttttatatcgatttaaaaatctttgagtttcaatattggttgtttatatcggaacctttgatgaaaatttttattgtagaaatttgacaagagtacttggttttgaaaagaagatatgattacatgctttatatcatcaaatactgagaaaggaagacaagcagtagtatgatttatcaaatctttcgtgactattgttggtatataaaaggcattaaatgtagtatttaaggcgcaccaatgttcaaattatgaagga

SEQ ID NO: 1662 - DNA, 1000 bp, Glycine max
  Soy_ogl_2581 Gm08:9631801..9632800 Cluster 7
aaaatgatgagagtcgttttaagataaaaatatatatataagagaaaaaagcttaaagaaaaaaaggtagaaagatacagaaagaaaaatgagcaatcttttgtgttgtagttgtaggaatcaaatccaagcaagagctcatccttattgaatgagtagttcattcgacagcgtaatttaactgatttgtaaggttgtgacagttttaattgttactagcgaattagtacttttaaaaataaaatagtaaattaatacttctcaggtttcgtaataagacattcctaaaatcaagtgattaatacattagaattaaagttaaatcattcgaataatatttgagtttgattattaataagaaatgattttttttagattttacttaaattttattaaattctggatcagtaagaatcttttcatcgtaatgaaaaagaattcttattttatatataactctttcaaaatatcttttaaacattatttactcataaataaaatgagtttacaataacactttctacaacaataacagtaatgaaaatttgttatcagaagttaaaaaaaaatgttgcctagaatacaacaccgatttttccacatatataaagtcacaattatgttggatgatataagagaaggtataaataacacttatttaaataacagagtaattttgttttacaaaggtatgggtaagaagtgatttttgctaaaagtaccgactaatttttgtagggaattataaatgcgtataaaatagatatttttttaacttcttgatttatttcgtatccaaaaaataatcagaatttaaattctaaaatacttagttaaaaaacataaatagttatgatttgtgtgaagttgatataactttgtattatagacttccatccaatttaaccaattaaatttagtcgctaaccagtcggtgggttattttaatttaatagattttttaaaaatcttttaactaaatagtattattaatatatga

SEQ ID NO: 1663 - DNA, 2300 bp, Glycine max
  Soy_ogl_3473 Gm10:40336301..40338600 Cluster 7
tgagttatatgttgcaccagttagatccaatgatgagatcatagcttgctcgcatcaaccaaaattcatcaaccagatcatgacaagtttgagtcagccaaagtcaacgactagttccaaagacgagaccgtcactaatttgacttaaccatgacaaaaattatagataagtgagtctcgtgattgctactagtttgtttcactatattgtattttttattgtttcatattatgatagacttattttgtatttgaattgacaatgacatccatgtatgtgcataatttattttcaaaattcaccacacaaaatatgaaaaaagtatttttgatctcaccttttcattttgtgtggtgaacaacaaatacgtgtttttgtagaaggtatttttgtcacaaatacccgaaagggtgtatacatagacaaatatggggtgtcattaacaaaacacaaacagtatacaactaaaagcccttttttatgttgaaagcctggaaccaacattctaagtactacaaaaaatattgttacttggttctatttgaagtgtttaagtttgtaacataaaattaaaaaaaaaaaaaaaaaagatacaataattttgttaaaaaaatatttttattatattatttatttatcataattaatttttatcatttattattcttcactttttctttaatttcatgataaagatataaagtaattgaaaaatgcatgaaataagggtacatataattgatagtaaaaaataattaatattgtattaaacttttaaaatgaaaaatagaaaacaaaatcttttaaaaatctgacacttagaaaataaattaagataatataatctttgatcctttataaaagaaacaaatatgaatttttttcttaattataagaaatatagtacttctttcaattgtatcactttttaattttattttatactgtgaaatctattaatgaaatattcattcatttccaatgaaagtaaaagtattattaatttattaacaatataagtcatatatatactcattgattgaaagaaatatatttcccacggataaaaaaaagaaaaaatatttcttaaaatatatgagtaatgtcattaaataataactatcacttaaatcatttaattctactagtatttttagattaaattttgttttaatattattaactaaaattaactaacttaactatttttattcatcttgatatactattatatatattgtttcttataagaataaatgcagtaataaacattttcaccatggtagttctcatccttaatgcattgggcacgggttggaaaaaattggaatgtccagtttaaaaatctcaccaatcatcatagatgttcctatctttgatatattgaaatttgagaaaattagactgatattccttgaaattttgtgagattgtatagactccttctgtttttctttttttaatgtttatggcaattttacaggaggacacaatgtaatatttttaaataattaaataaattaatgtaatgtagaaagatgttatagtaatatttttcaaagaatcataggagttaatgaagggatggatctacgttgtggcctttggaagcatttgctcaaactaactttaaaatttttcttaacgtaatatacatgtgtaaccataaattattccttaatgacggatccatattttttttaatgaaatagtttatagtattttcatagagaaaaagtattataagcttttataaaaatacacaatcttataataaaaaattaaaatatttaagcttttacacatttaaaagagtaaaattagtatcaatttattttttcttttatcttttataattttttatattcttttttaaaaataaattttatgaaaacaacatgtatgaaaacaaaaataataattatttaatatattcaagtaaacaattttctttgtggaacaattattccatagtcaccaacgtacatctgtccatgtccgtaatttaaaatgtagtataaaaaatcaatgtatattatgagttatatcccccacaaatttatgaaacatatatgagtattgttcccataacataatttttttggatttgttactgggttaatggatgggtggaaaatataggagaattttgtgttatctcacaaaatcttagagaacgtcagttaattattaaatattaaaataaaacaaaagctgagatttcatctggttttttcaaaactgaaccttgcaaatctcggctagcttaagtgccaatagttctcgtcatcttccaacc

SEQ ID NO: 1664 - DNA, 1960 bp, Glycine max
  Soy_ogl_4363 Gm13:30551341..30553300 Cluster 7
ctaaataaaaatgggccaaattaataggttatacgtccaaagaacaaaatagttcataagattcgttgaatataagtattgaacaattgaggtaaacatacatgacattatataaaaaataatgcataattttagtacattaaataatagtatagctttaacaaatccaaagaaaaaaagtacacaaatgtatataatttgcaataatgatttcatacagttatatttcttataactccatttttccttaaaaaacaccttttttcctttctttatatttcttttattttctttctcatcaaatcttctattacatctcacattttctatctcctcttcctatcttttttgtcattcaagatggatacatatcccaaaagtatataactatcattttccataaaaaatttaaggcctctctattttcccctataaatgatgtttcttaataaaaaataaattaaagaaatactacttcattgagatattttttaatcaaaaaatataccattctggttatccttagttttaaaaaaaattgttttaacaaaattgagggtcaattatttttattattgtttttgttggaagaagtcaattatgtttttaaaactttaaacatgatatcttaatatgataaagttttcttatcattataattgttgtgatgaattttaaaaacttgatatgttttcttatgctacaatgttacatatttcttttgtttagtttatataattttgatatttatgacatgaggccaattattataaatattttagttgtttatatttaattaactttgaaatcataatttaattaatttttatatttctcccctcaaagaaaatttttcttatccagaaaaatcaaagatattaaagaaatttctttagctatgctccttttatttatggttgacaaaatattatcaattcaaattaaagcttatatatttttgctctttataattttctacgttttagctttaattcctttacaatttgagttttaatttatttttatttttgttaaaaaaatcaaacacttcaattaagtgcattatcataggtccattacatgttgatataccataatgaactaattattttttttttttggataaacaaaacaatttattgataaatggataacatcaggaaaaaagattaacaactaagagagtgatgccttttaatcacttgacatttttattgggataaaataagacatgaaacgtggcgaaatttcaattaatttataaaaacaatctaagataatatagaaaaccacttactgcataattatataaaccttttttaattttttagccacttctagtcttatattctatgccttgcccctccagagactatgcccaacgtggaccttatgccaaacaaagaatatttttttaataaatggttaatttaatcattgaatttattatctcattgttattttagtctataaaactactaaaaaacttaaataagtttctaaattctttttatggtttaagttaagtccctaaaattaactcatttttctcattatggtcccttgtctggagatttaaataataacataaatttaaggatgaaaaacgagaaaagaggctaatttcaaatacttaaatgaaactctaacaaattttaggaactttttttgtgattttcttaatattagtgattaaacttacagtgaaatacaaattaggaatttactcttcttttttaaagaaaaagttaagtttaatatcatatacattgtgagtttgaaattttttattccatcatcaaccaataaaaaataccatcgatagatttttttagttattaaaaagtaaaaaaaataaaacttatcttaaaaggtgacttataattagaagaaaatgtaaatatgagtgcttaaattatttactcctatagtttattttttcttcaaaaaatttcttgat

SEQ ID NO: 1665 - DNA, 1568 bp, Glycine max
  Soy_ogl_6141 Gm18:52634052..52635619 Cluster 7
tctttaaaattgaatttatccaaaattatttacttatagtcatgctaaggttgaaagtgtgagctaatgaagggagaaatgaaagaaccatgagtgtaaaaaagaaaaataatgcataaactaaaagacattgtataattgttatttatattaggttatagtagagagacattaattataatatttaatatagttttaattgtatcagtggttacaacatttttttatgcatagtgattattataattaatttttttgaatactaaagtattgaaaaatggttttttattttattttatttttaaactccatttttctatttttacagtagaacagatagaaaaaaaatcttataatataattaaagcaataaaaagtaaaaaaataaatttgatatgtaaaacatacttagagatatgtataagtaaaattttgtataatttttccttcaaaaatgatctacacttatcattatatctcaatggaacaaaatcaacttgatgaaaaaaattataattggttacatggatttattttctatttataatgaaaataataaggtatatgaaaataaaatcttatgtattacttatctaccaataaaaaaactgtaacatttcaaatgacatttttttcttcatcctaaccttttcatttcaccctcacattcatatattattttttcttccatttactcgtacattttaatctcagttattgaaaaattactatgaatatgtaatgaaattacattgtttcatatatttttttcttttaatcccatagttgttgaaaaaacctttccatccagaagtaaaaaaacattttatctttgttgatcctatctacctgagacagcaggacaacacacgcttttcctgaacttccaaaatatgggtcttgtatttgtttcgaaatgtaactaaacaaaacttagcttcgaagagttgaaaaaactaaaattagttaaaactttaataataaaaacaaacttaaaaaaaaataaagattatccaatttaaacataatcaatcatttaaaacttataaatgaagaacaatacaacatattcaactaaaagtgccaacaacagaaaataggttaacattacaacatgcatgaaaaatatattatgattaaagtaataaaaaaataaaataaaaattaattcattataaaaaaaacacttacaaatacagggaacacgtataagtaaaattttatgtaatttttggtaaataattttttaatgggtttttcaatcgattaaagtttattgcttttacatcattattaaatgttagaaaaattaatattcattgtgcttttagaactaaataaaaatacataatagaaacgaaagtgaaataaagtgaattgaaatgctttgtaattgaaaaaagttatacttcttaattctttcaaactctcactctcattatagttggtgtattaattttttttttaatgtgaaacttgggaaccaacaattattatttataaacactcaattgacattctaccaaaaatatttttaataatcattacacaatgatcattaaaaattt

SEQ ID NO: 1666 - DNA, 1400 bp, Glycine max
  Soy_ogl_816 Gm03:3176401..3177800 Cluster 7
aaatattaaattgaaaagcatgtatgttggactgtcttttcaaatttgaaacattcctaccaattgttttactactatattgcttgttgaagacttattgtatttttgtaaagtacttttatttgttataaaattattaatttacagtctggatttgtttttagtagacatattgacttcccaatgtttctgaatgtatatactatttgaaaatactaatggcgacaaaaagtattggattattattttcaattatcaaatttcaataatcatatttaaatgtccataatcaaatttcaatattattttaaacgtccataatcatgctgtcaaaagaaaaatgtccaatatcatatcaaatttaactattgggttttaactgtcttttcaattattaatttagtctccacaataatattcaaaaattcatttgcaaagaacaatgttaagaattttatgttcgattttttcattcaattccataaatcttaaaattgattgatggttactctagattgatgcatttcaatcacaacatcctcaaatttaggacaaaggaatgcctagatcgaaagaattgagtgagttatattatacttcatgagttgcaaaaaaaaaaagggtttctccaacctagaaacttggcctaaatatatgcgctctctttcattctagatcataatgaaaaaattttgaatatgttgtttgcttaagagaggtgactcgaatttttcaatcaattgtagaaagcgtgaactcaaagcatagattcacacaaaattcctcaattaattttcagattcattaaactgtgtgagagaaatcaaacacgaaaattctaacgttcttcataaataatttttaatttctataatttttaaatattattgtagcagctaaagaccatcattttaataattacgtgtgcaaaaacatgttcaggctcacaaatattttttgacaatttgtaaccacaattatgttagaattattaaaaacaacaattctaaattgatggaaagactaaattaaataatatttaaaagataaatgactaaattaattgttttaaaaaataaaagaccaaattaaatctaaattaaaatataaagaattaaaagtgtaatttagtattttgtttaaggtaagtctatgattgttatatctgagttttaattttttttaacaaatttaatatattttttctatcataccttttttttttgtatgtgtagttttgactttaattaatctggaaatttaagttttaaaatagtggtgaccatttgttcaacttgttaaaatacatctttgtataaaatttgtcgacataacatttttaatatttttatacatatattatttttcgtttgtaacaacaggaaaatcatctacaatca

SEQ ID NO: 1667 - DNA, 1376 bp, Glycine max
  Soy_ogl_6489 Gm19:41423125..41424500 Cluster 7
tcattttgttttctattaaatctcgattactttgaaaaaaaattgaatatatgagtacttattttaagaatttaatttttatacactatcattataattttttttacattttatattaacctatttaaaatcacactaaattataagttttaaaaaaagtcagcaatttaaaagaatgatccgagacaagtagacaacgatgtgaatgtcatgatccaactaaattctttattaaaaggaaataaattcttcacaacactttttattatttatttataacggtttatggaagaaaattcatattgtatcttactttctcctcaaatttaagcaacaatttcttcttcttcttttaattttttttgctttaaatgtaaccaaatctcaattatataagccttatttaatgagactctctttaaaatattcttcattgaatttttttatatatatgatatcaacttctaataaaagaaaattttaaaaaatatatttaatttttaattagaaatgacacgatttaataaatttaactaattttattaataaatttacaatatgtctttttttaataatcaaaacaggaggaagtatatctttattcttgggatcactgaatatatcaacaataatatgtttttctttataatttgttataatgttagtgttgggaaatcgaaggataaaatattgggggagatttttactaatcaacttgttcattttaccttcacatttatactctcaactttcttagttgctataaatgtataggacaaggatttaaatttttctaattactgtaggtacgatgaataatgatttaggcttttctgacaaaaaaaatcatttacatagcacaagttgtacgtgtcgactgcccacaacaacccagagggatgattattataattatgataagagaaatactagtaatagattaacttacacacttatatatgttagagagagtgttgtaatactcattttaagatgattatttatcttttcctaattatcctaatttattattttttaatcaggttttacttgtacaagaatgagatatatacatgtaaatatcagtgtaaaaaaaatcatttcttccacatacgtaataccttttattgtttaatatttataataacttcttttattgagagtgtcatgtaatattttcaaacaacatcaagagagattaatataggaaaataaagagaatagtactattgtgtgtaattcaacaaagctcagtggttcaagtgtaagcttttcaatatataaagatataaggacttgattgtataataaatcagtaataaacttatgatttaagcccatgtcttatactatggagagaagagagattatatata

SEQ ID NO: 1668 - DNA, 2200 bp, Glycine max
  Soy_ogl_5938 Gm18:5190101..5192300 Cluster 7
atctaaataaaattagaggatgaaatcaactattaaaataaattagaggataaaaaattaatttaacccaaaagaaaagtcaactgtttttttactgattttttccaactggttgagttttgtaaaaaatttcatagctcaacattgttatactgtaacgtttaaaactgagaaagaaaaaaaaaaccttcttggttaacattaattaataattatgcattctcttaatcatatgcgcttctgacacatgtcatgtggttcaaggcatctcgcattcttctgagatctttaacagaacaaataaaagcatttgcttgaaatggtcccatggaatcaaaattcactttggattagatctgaagagaactcatgttatttgtcaatccctaactaattaatactagtcatcacaatctgacaaaattacaaccttatcaactttggtctaattttcaagtgtagaattattgaattaaaatttattttggattaaatctggacaaaacttaaattgtatgacaatcacttactaatagtcaaaattaacaattaacaacgttttcaagtcaagttttatctctaaaagtttggaatgacttatgttgatgagacaatttcagattaagtcatgagatgtcacattacacaggttgttgcctcgttgaaaaggattatgcccatttaattaaatgtctcaatgctcaaacattacattacttgttgagagttagttaaatttgaaaaataaaaaggataaacaatagaggctagcatattatataaaacaaccggtggagctacgagtaagagcaacaaaaacttaattatcatgattcatttttaaatcattttctctttttttttttactcatcaatcataaatgtcaatagtgtacattatgattacaaagtctatgtttagaaaagtatctgcactggacatttctaaaacttttttgaccaaaaaaaacctattttaggaagttgtaaaaaaatattttattagaatgagctaattcaactatgtactaaatcttataattcaaatatgtactaaatgtgataatattccaagcaacaccaccttacttaatcatgtagtctgctgatttacatagaatagcttcgtgaactgtaaggcagatagaagcttctattcaaagctgcaaaacattgaatatcttgtaaaatgcatccatattataattattgaaagatggtgacttatgaagagatgaaacagacaaattcaggtgagttcatttaacataatagagagcaattaactttctctcaagcatgctgcatcctaggctccaagctctgattgcaaaaagctcgacatgaagataatttgcattataaattgtgtatataaaaaaacattttgaggtgttcaaattgagtttagtttatataagtatatttaaattatattgtccattcattaacgtttcatttaaaaagttatacttctctttattgagaaattaaaatatgcagcattttaatttattttaatttaagagagtctttttattttactgagtaaattatttttctttttcttttaacatttaatatcaacgactactaattttgagtgacatactatgatttttttttttaaatttcagtggatgaaaatacgttttgaagacttagctttgaaactttactcaaaatatttatttcatcttctgaaatcttacaattcataataacgattcctaatcatttcgagcataaaaagacaaaaatattttactataaggaatttgtttacattaaaatagaataaattgtaacacattaatctctcaaggaaatgagtataatattgttaaataagagacaatgagaatgtagtttaagtatcttaatttaaaaaaagaggagcataatttactaaattataaataatatattcagcgaaattactgttaaattgtttgaagcaaaatcaaatcttaatttgagtaaatttttttaaaaaacgctttttcattgaaccaaataatgatttacaaagtataataacgataatttggtcagattaaatgtgttttgacagtggacggaaccaatttgataaccaattctcggtcagattaaatgatttggtaaaattttgattatgtttttttttttttacaaaaagtttagataaattgaattcggtattacttattaataaaaa

SEQ ID NO: 1669 - DNA, 2180 bp, Glycine max
  Soy_ogl_548 Gm02:14286001..14288180 Cluster 7
agtggaaaaaaataaacatgacaaaaatcacgcttaacactcccaaaggactcctacaccatagtacatataagacctaagttgagtttaggatcaacatcttcatactcttgactcgtggggaccttgctaattggtttagtagctaggttaaatcccctatgaaaggtctataagaatagtaaacaactaaatctaactcatatatattttgacgaagattaaaagtttcagagtaagtgaagcttatcccaaaagtaggcaagaggagtttattagttattttaaaaattaagatagaaaactcatcaatgtttatacttgatttaaaaaatttagttataatttcatggtgatcgatcgaattacattggttagaaaaatgacaagatcaaccaaaacatggaaacatgatatgcatatatactctaaactttgatatcaagtctgattcttctcaataagaattacaaatcataatccattaaatggcaacatggttgggtcaatgtcacttaatcaattattcgtatgtcatcaatttgtgaatatatataatcgattagttgtatgcatttaatcaattatatattcattttaatcaaacacattcttgtggcacaaattacttgtctcatgtgctaaggggtcaaaagtacttttaaatgttcactatttttttccttcatttcattcaaactaaacaatctcattattttttatatttcttttaaatcaaacaaccaaaatgtcactctatatattttatctatttttctcctatttgcatctagtatatttccttccttaataccaaatggagcgtattgataaaagagtaaaattgagaagaaatttcctgaaaccgtcaaaagcattatttttatgatgaattatgagacaaattgaggtgcatctctaatgggcttcaatattgaaaaaatatgttaataaaatgtcggtaacattttaatacatctcatgtaatactaatgatttgtcaacaatttagcacgaaaatttcgcatgataaaaaatgagcttcgtgttagacatttatgacatttaagtgatcttattaatattgcatagacttgtataagaattaatgtgataaattttgaggaattagctatcacattttaataatcctcttatgcatagaatctatacatatgtgatgagttgtaaagaattacaagttaattattgttgtcatttgttattatttttcgaacaagtcgcatatttttatcataaataaaactctaaatgtaatataaaatagttctatcaattagacatagatgagcctcctcaacaaagagttgtatctcaaccattacactattattataaaactttttttttatacttcagccgtcactctatagatgagatgattgagaaatcttcttacttctcaaatactaagactgtttttcatattaaaattttggtgttatttttttaatcttatattttcattcagggtccgtattaagttaataaagaaggaaatctagacagttaactcttaacatttcttgctaccagcctgacgaatgagttgcatgagggtgaaattggtacagaaccagttacaatattttttttatggtcttacaatataactacacatgaaaatccaaaattgatttaacctgcaaattgttttggtattgaatattatttcgggtctttcaactgctcggttagttatactacagcccaataaaaatgaaacagaggggattttggtgggatgtccaaatcaatatgtgctgtaaccagggttaaataaatttatgtggaaaaatgttgcaaatcccaaccgacatcacaagatacttattaaatagaagttgtttttaaatacttaattaaatttcattacttgatagatatattactttataggtagcggaaaataacatataaaaagtcaaaacgcttcaaaattaatttatataaacatctccaaattaatgatcaacctcgatctccattcaaaaaaggaccctttgtcatctcaaaaaacaataggatgagttgaatgattaaaaaacaagagtacaaacatgaaacaataaactattcaaacttaggtatgagttgaatgattaaaaaacaagagtacaaacatgaaacaataaactattcaaacttaggttacactc

SEQ ID NO: 1670 - DNA, 1500 bp, Glycine max
  Soy_ogl_895 Gm03:36245401..36246900 Cluster 7
tggtgtgcttgctgccaagtggaagtggggttcatgaaatgtacagtgatttgttattttagtgcattccagcatttaagacctagttgttaggttggccaaagaaagtaagagcatattctaataattctataaattatttttatcaaggggactgagtagtgagtaccatgccactcttgaaaataaataaattagtattatattaaatatttatttatttcaaaaatgaatttactttaaaagaattggtaattatttttcattctcctacgtacatttgttgttgtaaaagattaacgtttctaatttccaaaaaaaaaataaaaaaaaattaacgtttctgctcaacctaatgttgtagctctctaagctcatattaggaaaatgtgttaactatgtttcatttattaataaatgtatgaatcaattcatataaaattattttgccttgattaatagtttcatgtggtgtttgattatataattacataagagaaaaaattgttattttttatttataaatattaatttttatttttttgtcagcagtagaaagaatcaaattcatattttttttctttttctaattattgaaccaaccttatattttcatttgtcgcctatagtaatttttattgaaaagggtgcatatttgagtcctaaaaaaaggtttcacttaattttaaaaaataattactttttgtctttccaaaagaatttttgcaagaatattttttttttgaaaaaaattacaacgaaatttaatggctgaaaacctttaaattcggtttatgatatttttatataatttttttatataaaaacaaagtaatcaataataaagacttttttctcattgggaccagatttaaaatatacattttattttattgcgtaaataaaaaaaaagtaaatagaaatttaactatattcgaatatgaaagattatacatatactatacgtacatacatgcacgaaagtgcatacagcttaattatatataatcgaataattaatacaattaacacatacagatacaattatttgtgcgtagcatttttgttgtaaattactagtagttgcttgaacacaagggcatcttagtcacagactcttggcctgagtctgagatcttttcacccaaaagctgctatcctctttctctttcaattcctagggctagctagacttactcggcttggctccaaagcctatataatatatatatgtactattgtgcaatgtgtaggtcttttattggtatatgatttctcatttttttaagaaaaaagtatttatcattttttattaatttaattactcatttagttataatattataacaatttacaagcttaaatacttacaaatcattcattttagttcctacgtatactattttaatctttttggttattatactctaaatttatatagactgataaaaaaattaaaaatagtatttatattataagaattatttttaaatgtataga

SEQ ID NO: 1671 - DNA, 1923 bp, Glycine max
  Soy_ogl_1290 Gm04:8009737..8011659 Cluster 7
aaaaataacatatttgttgattttttaaaataactaatgtaaaaactgacgttttaatacgatttaaagattgccgtttatacgatgacagatttaaagacggttggaaactatcatattaaaatcttttgaggtttactttatactttcctaaagaatgaccgtgatttttgcttgtctagtgtacatattagataataaaaaacggatttacgagcgcattaattaagagaatataatagtattaattagtagagttgatatttatatgagtgctttttttgcatagaaagcattctcgtgtctatttatgaaaaatacatcaatttattgacgtatttctgaagaatcatattgtttattcaacgaatagttagttacaccatttcatctaatgtctcggtcactttattctgatgtgagcctccaatgaataaacatacaattttaaataatatatattcatgtactattaattaatgacatcactttagttaatttctatttgtaacatgtttataactaacttgtatcgagaattatatcaattaaataaagacaactctttaatttaaatagtaaaacagaataattcttcaaattgaacaaattaacacaactattaattgacgacggttcaagttcattgaatcgaattcattgagctggcataaatattatggggacactgaccgcggtaaggcagtggcagaccttatctttccccgactagacaatacggacccaaagttttttttccctcaaataaaaatgcatattggcgaaaatagacaacttagtcaagtcaaggatatatagaactcacacagggttacacatacacaaggagaaattattaacttcaataatatatacttgtgatttaaaccaaaaaataaactattatcatataatctgtaaacaatctctaagaatattatggggaccttacaacatactagttcacttcaaatttaaattaagccaaatttatttctcaaataaatcaagtttagatttttcttaaaacctatttaattttaaaaaaagtttggcggagttatttttttaaaaaaacgttttaacttaataaggtgactgtggaatgagcttataatatgagaaggatgttatttgcgttgatattcataacatacatatatttcatatatagaatacatgacgtttgaattttaaattgattcttaatattattttttgattttctccaatctattataatgagatttgacaattttattaaaattattcataaattaactcctctcataaatggtttaattttattgtcttagtaacatatttaaaattaaagattaaaagcatacgaattaaaattcaaaaaactaaaagtccaattaagtcaaaatgcatatcaatattaataattttgtaaaatatctttgaaaaacataaatataaatctctttactttttttaaatcaaaatgatttttataaaaagatctgaataaaattcacaaaaactataatgcaagccgaacttctaatgtgaactccgtttagccgcaacaaaaaaaaaaaaaaaaaaatctttcagccgaaaaggtaaattgtgagcaatggcataattaaggagttatagaagaataaggttttattatttcaacttgtccctctgttgctgctttattcgacataactcccgacccaaagaggtttttagagccacaatcttcgctggctatgcaagtagccactcactggtagtactaaaatgactttttacatcgtaattaataattttaaatctaacacgtctaaaataaagaaaattaagtcgtggaagtaaacataaacatataaatactttatacatataatattaagaaaaagaaatctctgtgaacgcacactttaaaataaattatcgcgattagct

SEQ ID NO: 1672 - DNA, 1142 bp, Glycine max
  Soy_ogl_1383 Gm04:44073701..440342 Cluster 7
aaaattctgctaactaaacagctgtaaaagacgtaattgctcaactctcgtcaatgtgcatgtttataacgcacgatgcatgcaccgcacagccatgatataagacatcaattcaaattctgattaacgcgcatgtgtcacacaccttagtgaaatgtgtttgactgaaaaaattactggaccaaccttgggatactaggatttggagtgatttgaggtatttgacattacattgatgaaactgtttgtcaattaagtattgtaagaaaatttaagttaggatcttcgttgtcattattgtaaactaaaaaagaaattaagtgtaaaatttaccctttttaagtaaagttttttaattgaattttgtagataaaaaatattgttaaaagaaaatatttcatattaatgtagttcaactaaattttctaattgagattattaatagtaaaatagatgaatattttatacctataattagtgacgggtccaaaaatttcttttagtaagggagaaaaatttcaagcttttagattatacataatgttatgacaaataaattcaaaatacctatattttttataaattataattatttttttttatatattttcatatttttaaaatattgaatgattttttcattttcaatgttataaaaaaaattagaaagatacaatgataaaattaataatctctcttttatctcttataattttttacattcatttaaaacattatcttatgagacaatgctaatttttttatcaagataaaaataaaaattattaaatatattcatataaaaaccaaaatcctgtgggcgccccatttccttaagtgtagatccgtcaatgtctacaacacgcagtggaaaacatactttctattctgtgtatgagaaaaaggattatgcaatcaaaatcataatacaacattaaaaatattttttattttatgtaaaataattttacataataatctcatcacatcttatcatatataataagtttattaacttttatattaaaaattataagtttattaatttttatattaaaaattatacaagtaattatttaaaatattttcatactataagtgcatcatcattaaataataagaaataaatttttgtattttgg

SEQ ID NO: 1673 - DNA, 1296 bp, Glycine max
  Soy_ogl_3001 Gm09:4877405..4878700 Cluster 7
gtaatgtagttactaaatgaaacgttgttgtatgtgtggatatctgttaaagtagctgaaacattgaaagtttaagggataaaataattaatttagtattaatttatcctctattttatttttattaagttttacattcaatttttaaaaaaaacaccatattaggataccaaattttttatggagacaaaaaaatattacaatacaagtaaaaaagaagtatggtgtggggacaactatcacacatatcaaatatatgatttagtgcatagcaccgccccctaacgtggaaggtgttgtcattgtgtcttctaatgtgacacctcttgatattagtactttaatattatttttagtgacatttgacagcaactaaaaatgtatggtttcaaacttataagcataatgtcaaaaaaaaatattcacggacaaaaaataaaataaaaaaatactaaatcacacggatggaaaacgtaatcaaggcttatattattatgagtaacattagaaattgcttcttgaaaatacaagtgttgatgaattcaactttaaagtaatataaattacttcttaataatttaagaaaggatagtcaatttagcttataatattattaaataatggttattttaatttttaaaattataaaattgcaaaactcaaataataaataactatccaatacaaaaaagattattactctaccaatacttctttatatataattttccttcttatctagtctttttctaagttatcgtcacaaccatctaaacaagtgaagcctaaaataattagaaaagtttaactgaacaatatttattagacatagagtttatgcattataccaggggaagtactatttaccattggaatattatacgtagaagtattaaattgttgataatatattacttgtgttctgtaattctcgaatgaagttttaatttgagacactttgtatatgggagaaaatatttttactagaaaaatacaataatatttgttttctgtggcgtgttggccaacataatctaaattttacaaatatcttaaattcttgttgtgatgttttaagaaaaataaatatcaatttataggcaaatcatgtttgtaaaatacattgaattcatcaattaaattaattgtgcatgaagatcttcacagttgttttatgtcatagatttatacataattataattaaatgtaaaatcaacgacttaatgacttagtgtaaaattatagtatgatttaactcattaaattgactaaaatataattgaaataggaaaata

SEQ ID NO: 1674 - DNA, 1022 bp, Glycine max
  Soy_ogl_4946 Gm15:9316201..9317222 Cluster 7
cagacaaaaaaaaaaaccaaacacattttctaaatttaaaattttgaaaatggaaattatttttacaaaattcttttttatcattttcagtttaaataatttaattttttaataatataattttacaaaaattactaaatgagtcttataaaccattttatatttcatcaacatttatttttatttaaacctataattataaatcaaacttttaaaaatgaaaaaagaattctacgatactttcatatgtttttaaatttttaaatattcattttattttaataaatattttattgaaacatcactttctctcttcttttcacaggcttccgagcttcctttttatatttatgaatccttttgagttgtgagcttctgcagaatatatttaattcaccagtcaagacatggcgattctggatccgtggtgatgttgattgatgaggctggggttgacgatacgatggagcaaaccatttattgatcattcatttatgtgataagcaacaattatggctccctttctccctaacttatgcaactctatttattcttgttatactactatatacaatgaatctttatgcttttttttttaaaagcaattcctaggtgcaatactagcatctcttaggagatgcttatataaattaatattgttttggtaataacttttctttttgacaaaaactatcataatttaaatgaaaaatttaaaaatgaagaaatattcgtatatttgaatatatctgtcaggaggagatgaaagtctatattttaacataagcaggaagaatggtataatattcgcactgggagaatgtaattaattatctctaaatttatatatattcatttaattatatagattaaaaccaccttattgtattattttcataaattaatttgttataagaatttaataataatataattataataatattttagaaacaacaagacttcttagaacttaaaataaaataagatttaatttaaaattaaagatagtaacatactcg

SEQ ID NO: 1675 - DNA, 1000 bp, Glycine max
  Soy_ogl_5482 Gm17:3551601..3552600 Cluster 7
tcatatcataattggggaattattaaattacgtacccagctaactatttggtttaatttataaatgttatcctcgttattttaattaaaaataataattgtaattaagacagagggggggggggggggggtcgttatttaaaagatataaatttgtttagtaatatttcattattttgtaattaaagaaataaacataataaaaaagaaatatgtaattcattccttatatttgatgtaaacaataaacaaaaatgctttagatcaaattacatccaattcttacaatacctttatcaaaatcatttattttttgtcgacattttcttttccttatttttcatatttctttttaaattcaatttttgttgataatgattatatgacttacaaaatggccttttgagtataatatagcaattacaagatttttttcttatgcgttatttgatgaatataaaaactattgaagttggaaatattaaaaattatagaataattgaaaagagaaaaatcttattctgtaatcatatatcttatggtagaactaaataaaatataggtgtacgtatatataaacctgtatgcggtttatattaatcggtagtctatattcaggtccaaaatccaaaccacattattatcgaaactatttttaacagaaaaactgttgtgcaaatagtaataatattgagtatgtccaatatgcattttattgtaaatttaaatataaacatataattattttgcaattgaggcagcgtaacgatgcacataggtccgttcttgcttattaccataatcaatagtactttctaactatttatattatttgtagagtttaatatttatgttatttaatcatagtttattatttgaattaatttaagacattttaaaagataataaatttattatatatattaagttgtgattaaatcattgacagaatattttttttattttgaatacaccgatacatgattcgatgattgaaattt

SEQ ID NO: 1676 - DNA, 1631 bp, Glycine max
  Soy_ogl_6473 Gm19:40515624..40517254 Cluster 7
tatgtaatttataaccttacacgttgatcattctcatatgtgtgtgcacttatgtgcttttaaataaattttttttttaaaaaaaaatattttaaaatttatttttttgtaattgaatttttttttattagatttgggtttctatttgcaccaaaaaaaagtttgggtttctatattttaaaactaaattattttagcatctactttctaccgtaagttgggtgacttttgataagttcttttttatcagctaaacaaaatcatataaatatatattggcaccaggggtaccaacccgtttacgatagaatagaaataagaccaccaaaccattgtgaaaaatacatggatgtgacttttgataagtgtcggctaacatcaatctgatcaaacattaccatacatatcttagtcattactgtttaaattattataaatatcttaatatttagttttagcttgttcttagaaatatttttgttgggtttagatctcttaagtgaattatttggtctcttaaatgattttgctaatagtaggttagctaattattatctatgtcatcattatctcatgtaccctggtaactcagtgtgtcgcagtgagaacaaaaacgaaaaggaacatatgcatatattcagcattttttccctcttttttatataaactaatgaaaaagagggaatctctcctctcatccccgcatcttcaactaaattaaatattaaaaatatattttacctttttttctttctttttttctcattaaattttggaaattgttcttaaatgtccaaaagatgtatacactctgagagaaatagaaaaatagtagaaataagtaattgataaaaatatgacatgataaaaaaaaagaaaagtagaaaaaaaatattgttaaagtattagtaaatgatgaatgtctaaatatcaacactcttacaaaaatttatgtttctcttattttctttagataacggaaatcaataacgatgagcaaagagggaacaaaaatagaacatacaacttctaaaaatgtctctcaagactcttatatccaactatgcaacttaatcattttgattctactaaaatgaaatataagatacagaaaatataattataataatttattattattattattaaaatattaatgattttataaattttattatacatccattaatatcatgtctctttaaaaacatttgtttttattttataaattagaatacaaaacttagaatataaaattttcgctctcatcactctttcaataaaatatgttcaatattctatctttttcatttataggtatttctcaagttattttcgtttataattggcaaaataattcatctctcaactatttcaaagtattcatttggcaaaatatgttcaatatatatatatatatatgattttcttaaccatctatatcttccaatttactattttttaatctctggcactacatcattttttattttttttaagaaattattaataattaaaattaaatttatgtcaaaatttagattattataaatataaaatataatttttatatttaaagatatttatttatcataatataatttagagttttatggtcatgtaatgttaac

SEQ ID NO: 1677 - DNA, 1400 bp, Glycine max
  Soy_ogl_6817 Gm20:37754201..37755600 Cluster 7
gttgttaataaataataaattatcatatttatgtattgtaagtttgttattttttatagtaattattttaaaaatcttatcaaatacgatttacatttaattgattatgtaaatcttttaatactgacatgatcattaaactcatacagtagtaacatgcaatattaataggcataatttgcaataaatttaaatgcatgtgctgcaagactcaaaaagcacaattgaaacttaagtaatgtgcacaatcgtgatatttgagtgattaaaagtacaattaaagctgagttttttttttctgtcttttatatattgtgggtataaaatattatatttgcaaacattaataaacatttattttattaccatattataattaacaattacttaagggttataaagtttgaattctcctaactaacagtaatcaacatttacagataaaaaattattattgcttaatgtcacgcaatgcattgcaattgtgtgtggcaacatacttttgttatttaaaataagaaatattaatttatcggggctaaaaagttgaattttgtgagcaagatgagaagggaggtagttcaaaggtcatcgtccatgttggttctacgtagcctagcagcagcatgtgcgaatggtcgatcaggccattatatttttggtaggctgtagccatgtgatttatagccaaattaaaacagcttgaatttcatagctctagtacatttcgaacataatgggtgctaagaggttaaattaagtagtagaatgagataccactattatctttgattaattataatgagcattttaactcattcgttaagggtagcaatttcatctatttattcaataattgttctatatatatatgtatgtgtaaatctagcaaaattttctagctatagaataaaatttaacgggataggtaaactagactaataattatgactagataacaaataattcagtcattgcattttttttaaagtaatgagttggaatattagattattaggtcaatagtagtcacatgaacaaaaatttattacaagtttttcttccagaaagagagaaattttaggtcgagaacttttgttgaccactaaaaacaatagttttttaatatattttaaatatttatttatctatgaaaaattatttataaatggaataattttttaatatatttttaacagattataaatgaattaatttttttattcaattattataattgaattgaaaatttatctaaatcgtctatttatgtgtttatgcaataatgggatagatcatctgtctccgtttttaatgtattagataatggatgcttgacagtttttcagttttagacgaagttggagcatacatatgtagttgtattgtgtggatgacga

SEQ ID NO: 1678 - DNA, 1129 bp, Glycine max
  Soy_ogl_125 Gm01:39639501..39640629 Cluster 7
catcagacatttatattttcccttaagagtttctcaaaataatttacaattttttttgtttttctaaatgtgagttttgttatttgcttataaaattattgagttgaaatcgagtacaaagtttttttaattgaaataattagtttaataatttgtttaatttttgtatttttcttaattctatttttttaaaaatatgtaaaaaaaatacacaacatgattaaattgtaaatagatggaaacaataattttaataataattgtaatatttttaataatattttttttcatcccgtgtaatcacatcaacaatttgtgctcagttagcatccacattaatgttaatgatggaattactactatgttgttaggaagtacactggatactcggatccattttattttttaactcctcaattaattccctcgaatattaaaaaatagatgtcatgagatggtatgattctttcatttttttcttccattttatattttgtaacaataatttaaaattgttaatttagattttattatttatgttatcaacagttaacaacatctcaaattatgtatgcaagaggaatttgaattttgatattattttacttcaacacaaatttaaaatattatggttataatttttaattcattatttttataataaaagaatgctatctctttgtttttaattcaattatatataaacaaaatgttatcttttgtttttaattcagttattttttgagaaaacctgagcaattttttttgttttgcctttttacaccaacctaaatatttttttttataattatttgatttaaatttaaatcaaaaagaaagaaaagtagtcagtaaagaaagaaaagactccaagaagagtgtatcaaggaaggtgaattttactttaaaaagttaacaacagaagagtaacaaattgaaattttaaaattaaaaaaataggcagtttttaaataatagcattttggaattttaaaaataaaattaaacaatcaattttcaaataacagcgtctattttttaagaaataacaatagagtaatgagctaatgtggttcatcctaaatttttttttttatatattccatcgaacaattaaaacatgtgaagc

SEQ ID NO: 1679 - DNA, 1400 bp, Glycine max
  Soy_ogl_126 Gm01:39689701..39691100 Cluster 7
tttctgtgccaacgtatagcgctttgacttttgttgtctcactgacttgccaaagtcaaattttcctacagagtttgcacatcttattcatagtcttctaatcacaaaatttataagtcttgttacgagtgcaatacaaaaaaattggggtatattttaatcttaattaataggggactaccttaattattcaaactatctagcagtttttgttggtgcaatgggaagttacaggaagaatgaaaaagtggatttttgttaccagatgaaattcaggcattagcaatatattcgtgaagataattttcatactattcaatcattaattcttaaaataaatatagttgtttaatttttttattattctctaattagaatgaaagtttcatctcagagacttaattattctactaatctttattcatacagaaaaatttagggtgaggtgacctagtccaagtcacctatattaatttgtaatacaattttttttatgtacaaattactattttttttcaccccaaaataaagtgttgcatttcatttttaaatgtaacattaatattgttctttttcattaatatccttaataaatgttattttagtttttgaatataatatttatattgatctctttcttttatttaataagatttgtcttgtaaaattactattctttttcatttatttattgatttttcttaatttatataaaataacgataacacttattttgagagaaaggaagtaaagtaaaacactaattttgattgaaaaaaaaaacatctgctatattttatctttctcaaaaactcattctcattttcttactacatctctaatgaccaaaacttaaatacccactttaaggattttagaacatattaaattattttttatttttaagaaactttgaagatgaattacttatataagatacgcaagccaaaacttaacaaactcataatgttaactagacttactccaacaacaaaagaaaataaaaaataattttttattttaaaaaactcatcaagcattttccattggtgatggcctcagagcccattaatgtgccacgacacaagtgacacaactttatgatgagaaaataacaaactccatgaaaaaaaatgaagaatcactatttaaataataaaaatagagtgcagtttcaacgatttcataacttaaaagtaaacttccattttaattcttaaagttgtaagcatttatcactttaacattgactttataaaatattcaccttaatcctgactatgtaatttaatagcatttacttctttcttcttttttatatacagaaaatagcatttactttaatataaatgaaaaagaattaaaataaattaatgattttttacaaaatcaactattaa

SEQ ID NO: 1680 - DNA, 1707 bp, Glycine max
  Soy_ogl_859 Gm03:5320762..5322468 Cluster 7
aagtattttagatgatatttttttattatttaaaatattttgtttgctgtgtttaaagtattatctaaaattctttaaagatgaaaaataaatcaaatatatttcgcaagaactaaaatgaaaaaataatttacaaaaaaaattaaaaaaaactactaaattacataaaccaaaaatatatttaatttttttattacaagtaacatcctcaaaaatattttttgaagtagtgtaaggataaaaaataaaacaaacataatttataaaaaataaaagaaaaaaaatactaaattacaaaaactaaaaaaatatttaaacttattttttattcttaaaaaaacattttggccatcactaaaagtgttatgcattttgaggtgactcacatttattgtgaaggtatatgtgctgataaaatgactaattatggttttatttgatgggagtaggagactctcccttgttttatatgtgaagattataaccataatgggatacgattaattacctatgtatagattttgctgatatttgtttctaaggatttggtttggtccatgctcgatcttttctcttgctttctttatgaaataaattgcggacttcttgttattttgtacccttggtgccgacctaatgaggatgaggattaataggattcttcaataattaatctagccttatttaaaaaaatatgtatatagtaattcctattctaggagtataatacatggctaacgagacatatcaataggtgatcaataatggaaagcattaagaatatacttagggactcaaatgacataaataagatacgaaaataatgaaagaagtttattacataaaagtttaagaataattgagagaatgatgagaatgagatagacattagaatttcataaaaagtccattaaccctgagatggcttttaatttcctctatcgttcatccaaagtttcttcttttttttcttcttcaaattttcgtattcatatagacaaaatatcaatattctcatcgcacaaaatttaagtgtttatatatatagggacaaatccaggaaatcaccaaagagtgactgattttttttactattacttaaatatttaacttctcacaaataaatatttaataaataatggtttttataaaattatttattatttttacacgtaaaattaaaattaattttgttcaaataatataagaagaaaacacatgtatttataattcatattaactttttattttaaattttgaaagtttttttctcacaaacacaataataattaaataaacaataatctcagtctcacactaaaaaaaagaacaaactcattaaatataataataactaaaagtcatcaaaaattttaactattatatattttataatcttaataataattaactttaataattaaatatataaatacataaatgagacttataataatacacaaaacataatttagtcaagatttttttctgaataattaggcaagataataacaatcaataaaaaaaaaagtcataaaatgtcattattatcatatctattaattagtatatatatctttttgggttagattataattagtggtagtaaatattattaaaaaaattagtataaaatcaatgacagcatatatatatgttattaaatttattaattagtatttctttattattagaagtagttattat

SEQ ID NO: 1681 - DNA, 1721 bp, Glycine max
  Soy_ogl_1369 Gm04:43769301..43771021 Cluster 7
tacaataatttgtaattaaatggtaatgtaaatctcattgcataaactatttagtcataatattacgtataaagcaaatgtaatattatgttatattgtcattctttaacaaagtgtttaaacaatcgtttatatactttttgtgatgggaaggaaaaagttaagggtgtgtttagtttttttacatttaatttttagttaagatattttcggtgatgattatatcggttttaataattgttaattaagcaaatagaaaaaaataataaaaattcatttatattacatttgtattttcttaaaataaaatgtagtttattttgataatatttattaagtagtagtaccaattagaaataccaaacaaaaactaaaccaaacgtaaaatcaaagtgaaaatggagcatcttctccctcccccatgattatatattcccacaaacatcgctacctgtttactggactttcaaagtgcacttcattttctctagttctgcaaatgcatttcgttcacgcgtaagaagagtttctttgtgatgaaaacataagtgtgtgattggggcggtcttttatcaattaaaactccttcattcacactcttttccacacggatttggatcttttagagtttaaaagaaaaaaaaaatccagttctttttagtaggtcatacaacaggttttacatcaatagcatttggaactatgtatataggaaataagatattttagtatacacatttttatatctattttatccatacaactatatttcataagttattgtcttatcctttactttacaaataattcagtaccttctattatctttctccttatttaaaaaaaaaatgaaaaaaacagttaggcacagaacctagacactacctgcatgttttccctagtcttatatgatatgaagtgattgataaataattttgtccattaactatgtgagaaatgatttaattccaaacctttgggtataaatattagtccttattatattttcatattacttaaatacatgatttcattgcaggtaatataaatcatctaagtaaaattacaattatgacagaagaacactacaagaaatacttatataataatttataattaaataacagtgtaaaattatttacacattggatgtgcataacctatttcctgaagaagaaaaaactacatctatttttttctctcattatacaataaaattcatactatatatctcacctcttatatatctaattatcttcttatctcgtatcaatcagttgtataacttaatttaaattagaataattttatctcttagcatcttagcttgtctcttatcaattagacgtacataaactctataaatatattctgcaatataaataaaacgtaattgagaaatccttcaataatttactccaaaccttccgttggttaaataatgaggtcgatttcacttggcgaacggacactatacgtgcttgtcatcgccgggtataaaaaacatattgaacaaaatgatatataagctggaaaaacatgaaaagacacgtatgcctgctatgcatggaaaatcttatccttgagaacctgtttcgtaaagatcaacaatttttctttgtcatcctccttttgggattacatacgtctatcaataattgagatgtcatcctccttttgggattacatacgtctatcaataattgagaaattcttaagaa

SEQ ID NO: 1682 - DNA, 1000 bp, Glycine max
  Soy_ogl_2832 Gm08:40917401..40918400 Cluster 7
taatcatcttaactttttttaattattgatgattaattggtataagagaatttgactatttgtctttagaaagatattcatttttaatcatttttttatttataaaattcaaacttaaaatcttgaggtttatttggagtaatttttagtcgaatttcaatttttttaaaaacaacaactaatagtggccatgccagagatgttgctagtgatagagacaatgttagttagtggtaacaatattaacggagataacatgctggtgatagtgataatgctgtcatggtagttataacaacaacaatatcaagaagaagagaatattgtcaaacttaagaaatgtgctttataaagataaaaaaaaccaaaatttcaattttatgttctagaaataaatgtaaacatattttgaaaataagttaaaaattagttaagtttcatttttttaaacgtgttttgtttttaaaagtacatttaaaaattaaaatctttgtaatcacctcaaacaaatccttaatgaaaagattcgaatctacttttactctgttggtattgtcaaccttatttaagaggaaactggtattatcatatgttaatgctacctttgttctttaatcaaaattattttttttataatctttacatattaaaaattaatatgtacatattaaaatgcatctatatcttttaataatctgtacgtgtattaaaaaataatatgaaatatggaaataaaataattgtttttaataaaaactaacattgaatctagatttttatattaactatgcttgaccaaaattgttacatttgagataataaaatatatattctgataaactataaaaattagttggatttttcatgcgtaaattagtttattttttttattcatgaaaatcaatgacaattatgaaaaaatttataataactcacacaatatattcaatcagtgaattataccttgatttggaatttgtaacaaggaggaggtacacat

SEQ ID NO: 1683 - DNA, 1900 bp, Glycine max
  Soy_ogl_2834 Gm08:40968401..40970300 Cluster 7
ccttaccagttattttatataaaaaaatgaatatatttattttcccgaaaacaaaaaaaaatcaataccatcctatttattcatattcaattaccaaaaaaaaaaaattagtaagaaaatctaacaagatttataactattgaaatgatattttttaattcccatcctctctctttaagaaaagttgaacaaaataagtggcgtcattaatgagaaggctcatttcacattgcgtatcatgaaaaaatccatgtaataaatatttggactagggaaccctagccttttaatttaggaaggcaaggagacaacatgaaacaaacgtcttcccagcacgttagatatatgcaggtacacgtggggacttatacggtgattgcttttaaggagactgtgaccactagtggaccggccgtcggagaagttaagttgatatatatataggaagccctaaagaaagaaagtggaaaaacaagataagaaatcatggggatcgatggggtagtgtatgcagtaatcgaggttttaaattcgtacacagtcatgtgtgtgtgtacaagataagaaatcgtggggatgggtagtgtatgcagtgaagttctgtataaatagctagatattaagatatagatatagacaaatatctaagaataacttttgatatatgttttcttttaaaaaaaattataagattcaattaattaattaattttgtaaaaaatacaaaaaaaaaatagttagtttctttagtagcattgaattaactaaacataagttttaattattctagaaatataaaaaataattttaactaattttaatatttagccaaaataattgtttaataatatccaagaaatgttattcccatgttatattctcaagaaaaaaatatattttttggactaaaagaaattgtcaatgaaacaaacatccccttagacatccaaggagtataagatatagattaatgtgttccatttattatttattcaatccataaaatgaatcataattaagggtacgttttttttttttgaaaaaataattaatgcatcaacccaaaaaaaaataatgattgaagatatttttatcaaaaaataattaatacaagaaacgttatgaattaaatcttataataaagactcaaaggaaaattgaatttcaaccgtgaaacggttaaatattttgatattatcgtaatgaccatatgcataccaaattttagataaaccaaatatttgtagttagctaatcttatatagacaacatttaattatattctagaaaagtatattatatgttaatttgaatttatttaatgacgaagtattaagtagtgttttaacttaccaatatatgttattgattttgtgtgaaattgaacttagatttcttaagcaatatggggacttaattattgtcttagcctttccatttattggtgttctatttttttagtcccgaatttaaattttattttttagtttctaattttttaaaattatttttaatattttctatgatagcttgataacttgaggtggtttttagttgtcataattttattctttaatttttaatcacaagaattagtattttaaaactatcacaaagtttcaatttattagatgagggactaaaaagtataatttttaaaattcaaagacaaaaaaaaaataaattttagggactaaaaaaataaaattcctaaattaaaggattaaaataataattaagttcactaaaaatgattagtcaagtttctttgacaaattaattttttaatgaatactttgcacctatcaaatggtgacaaaacaaaaatagttagttttcaaacttaataacaatgtgtaaacatgatgtgtttattcaaaacttttaatttagtagttga

SEQ ID NO: 1684 - DNA, 1787 bp, Glycine max
  Soy_ogl_6024 Gm18:12017401..12019187 Cluster 7
acatacacacataaaagctgtcttactttaccaacaactagaaaattataatgtctaaatattttggggtatacattgtttataatggttggcttgtcttgcagaaccgacaacgttcatacaaataagattgtagttccctatatttatagttcataagaaagaatattgagcaacagtaaaatggtgattgctccggtacttttcaatatttcaatattaagagagtattattatcttttgtacactgaatcgatgaaaaaaaaatcattttatgtattataatcatattataaatgagttaaaatttagtttcaatagaattttaaaatttataattgcaacgtttattttatggacatttatttcaattttttaaatattaaacataaaaaatagacaagtatgggatttggtagaaaggagagaaataatattaaagaaaaattttatattttttttgagacctacaccttttacatactttaatttaaaaaaaattcttctattttctttttctaaatcaaacatacccagtgagagaaatgaacaagaaaaataatccttaagagtcacttataacaattaaaaaaaaagtttaatgatgatatattaattgttttatatggacattcaatcataaattataattatagtttttaagataattttataaaaaataataaatttatcataaataataattgatgattgaataaaatataattataataatatctctaaattttaattcataattatttttctcattaaaaatgactgaaatgcttattccaagcagttatatctctaatattatattgtgtttgcattcccgttgaaaacatgattttccgcgtctgatgtgaaggtatgcaatatatctttcacgttttaaaccatttggatgtagtttttctatttccaaatttaatccatgtccaaaattacaatatatgacacttgcttatgcagttaacagaaagttaaatgaccatcctatgttgcgcaaactactacacgtggaaccatattaacatgtgataaatccaaataatttctaaatttttaaaataaatgttcatttatccaccttaaaatgaatgttacgaaataaaaagtagtgatttcaaattttacagacatatcgataaaaatcaaataaaaagttttataaaaattaaaatttactcgttttgtaataacttttttttactgcctcgttttacactgactaaaaaaatggtcttaaattttaaagaaatgtttttttttttaatttacaaaaactaaagtaaaaacttactcattttataaagattaaaatcataattacactagactaattataaatatataatcactttatcttatatatatatatccttttctttttatattatcacatttatcattttctctcaatttttttattccttcttatatttctcttcttccacccctaagtatagttaaaaataaggtgaaccgaacgtttatattttctatgaataaatggttcaaaaggtacatcataaacacattacagctagtgcaatatgaccgatagcaataagtagcattaatatgcttattaatgattcaaaatgaaaatactaaataaatataatattctaattgcctaaagttatttttatatttgatctaattggctaattgtaagatacttgttgacgaatttttctaatattataaaatgcataatatttattttacattaattttgatttaaaatcttttaaagttcaataaaataaaataaatag

SEQ ID NO: 1685 - DNA, 1877 bp, Glycine max
  Soy_ogl_6073 Gm18:19629790..19631666 Cluster 7
attattgcacaggattgatttaatgagggactggccgcataaaactgaagcaatgaaagtgagagatattaggtatcaagtggttacataaattatgagagatatacggaataattatattcttcattaatttataagggaaatggtagcataaaacagaattatatagaatttaaattctgtttatacaaaaaattgcgggagacgcaaatatttatgctaaaaatggattttattcataacaatattctaattagagtttcatagaccaaaacaaatgcatcaagtagttattttcgtaagtaatttttctccgtcaaaatgctattagtttatttttataaataattttcatttttaatctcattatgactacctagcatttgaattaatttgtttctaaaaattagtttcatgttatataattctttaaaataaattattttggacaaaatttaatcatagttatatgtatcaaaataaacgtgatacgaagttattttcataaataaaatttggttcatgtaactaatattttgagtcaaaattaataaaatattcgataatatacatgaataacttttaccaccttattcttctatattaactacgtactaacgggaatacgccaaaaacaaaaggttaaacattgttttaatatcaaattttatgaagaatatataaaatctcactcttagaaatttatttatacatatagtgagagaagaagaaaagtaaagattaaaatagtaaagtcttttctttaattatatcaatagaattaaatgttattttaatgttgttataatacataataaagtgatataatatttatttcttaaaatattgatgtggaaattaatggtaaatatctatattttagaatgattaatattttcaagtaagaagctaattctgtcatcataaaagaaatattttgtatttaacatatttaactacttttatatgaatttaattagtaatttgttttttaatcattctatctagtgtatattctagttggataatataacaaattgtagtatattttataatataacaaatttgtacattagatttggaaggataaaagtgagagagaaaaatattaaaatattaaagtcttttttattttattatatagatagaatttaaaggttataataatgctatattaataaataataatataatataatattgctttcttaaaacattgatgcgctaatggtaaatatcttaatattagaatgatatatcttttcaagtcagaagttaataatgtcccaaaagtaatactctacaattaaaattttatgcatacttttataggaatttaattttttaatacaattttaatttttgtgatgttttatgattatatttatgctttatgaaagatctttgaatgaattaaaatttaattactatagtatttttaatcaatttttcatattaattaaagtgcatgtaacaggtattggtatgggcatttgggtaccaacagaaaggggcacgcatattaaatttactatccagtgggaataagtctgaatacatagactttttaacagtgtaagtattgggatggtactatagtaccatatccaaacctacatattgccatggttattggtatatatatgttgtgtacggtacgcgttatttgaatttaggtattaattcaaagatgtgtagttaaaatgttatttcataaaagaaatcatactcaattttaaattaaaatcaatataaatggtaattcatgtagtcatactggataccatggatgacaatggaataacaacgatagcagctaataggcacccctcacccattctataccacacgagtttccgtgaagcaactattcacaa

SEQ ID NO: 1686 - DNA, 1100 bp, Glycine max
  Soy_ogl_6210 Gm18:56786001..56787100 Cluster 7
aggcatcttaatttattgtttaagattttggttttgcatttgaattccatttcattcttagttccatctaaattcaaaagagcatggaaatattcacacattcaattctcttattacacgtaacacatatacggcttaaaaggtaaagtcggtgagtttgcatgcaccatgcattcatgcttcttataacatcggcatgtcggctttctatatatcacgtcgttgatttatttatttattttactttcacttgagaacgccattggattaattatatttaaatcagccaattaaagtaggcattgaaatttgagccagtcttgacgtatagagttggtgtggctggtttagtttattattcattgtaacgaaaaatatattattttcttataattttgtcagcaacttctacaataaccgaaagataaggaaaaaaataaaaccaaaatacgatccaaaacaataggatattactaactaatattgttatggcattgatcaatggactaaaaaaagaaaatatttattatataaatcatataatagtaaaaaaagtcataaataatataatttttcgtctctcaataaaaatatttatattttaagttctttaactaatgtccttaaaacactggttaatatttatcaaaaaataaatattataaaagtgtcatttgttataataatatattaatgttttaattttttaaaattattgatgttttgtaaatctaaagaatcattcattagttattttcacctatagagtatacttatctttctttaataactgctacaatgataatttatcataagcaatgacatatttaataaaaatattttagtttgaatacaataagattttactcttactgtatacattaatcttaaacctcaattaatacgaaacagagaggtagtaattcataagaatcctttaatattatctttgtctgacccaaatttatgcctgtcgtgacgatttaaccaccgtgaaataatttgcggaaatagcgaaatgccgaaatgtttgatatattgtcatgatgaattccattattcatttaaaattttcccatgcccagcgtgggtgagataaa

SEQ ID NO: 1687 - DNA, 1419 bp, Glycine max
  Soy_ogl_1579 Gm05:3512001..3513419 Cluster 7
agccttggatttgaatatttgagaaggcactcaagtcaagtgatgatttataaattataagaagattttgtatattgtagaatcatggatatcaaattaacatttatatagataaactaagttaattatctagtattaaaggtttattgctttattattcattttgcttacgataaattattatagctttcattgaaggaaaaaaaaataaaattcaagcattggagatgtcatttataaaacctgtctaatcatactgtttcatgatctttgagaaaataacactcaagtattgaaatattaaagaaataaaaaataaattaaacttacacaatatatgtgtatataaagattatacaaccattaaacaagttgattaactgatacaagattgttacagcttagtctcaaatttaagttataaatatgcaattacattaaacactcaataaataattttattgcttaaagtgattatatctaactcaaataagattttctctactaaaaaatatttgtaatttataaaaaaatggtacaagtaatcaaaaataacaattttttattgaatttaattagaatgtaacgatggtataagtttttatacatttgattataaattatcaagtatgatataagattgttaagttttataataattattttaaaaatcatatatataatgaattttaattggtttgcaatgtaaaaaaaaaaccatgcaatcaatgcatgaaaattaaattatttgcttttttagatcatagatattcttcacataaaataatcttgttgaagtctcgtaagactccacaaactcttgcattcgtaaataattaaattctttgtttattgaatcatgaatgttttttggtaattatttatcacttttgatacaatttatttttatgctacaaatgctacatatcacactcatatagttgaaaacttgaaataagattcaaataatcattgtacttataagttttatatcacattttttaaatatttgaattaaaatcacttttaaaagtggctccataattattgttattaatcatatttggaaatcacttttaaaatcacgtattttaacatataaatcaatcaaatcaaaattaatttttgttaatgtattatggaaataaaaggtatttctatttgtttttaaattttaaaaaaatttctcctattgttatcaacttttttttactcaattacatatcaacttatttaattattgatacttataattaccccaaattaaattatcttcaaatatacatttctttataattttttatttacttgttcgccttttattctccaactgtacttgaataaaaaaaatagaaatattagatactaataattttcttgattaagtacagtgattgtaaaattatgttcaatccaaag

SEQ ID NO: 1688 - DNA, 1100 bp, Glycine max
  Soy_ogl_6338 Gm19:2326301..2327400 Cluster 7
ttttaaaatagataaagttagacatgcattttaaatattgattttgtgtatggtatgtattaagctttatttatgacaggttatgagtgagaagtaatcaatttggatactccaacctgtaatacaacggttaacatttattactttaaataaaatcttatactagtattcttttatcattatcttataccagcttaatataaggggatagaatttcaaattttagttaagaaactcaagtctcaataatcactttttgatatattgagaaattattttaatcactgattattttgtatataatgtatttccagattgatataaaatataaaattataaaaaaagtcaataagttatttaaaataatttaaatttaaactttaaactagataaagaaatcaaaatggtacgtttcatttttttaatgaaaagtttggaccattctttaaattaaaaaagaatactgaatttatgatatctcttatagatttaaaaaattattatttttagcttttaagtaaatcactagaagaaccttttttatattttttttttaaaattatatatagctattacatcatttttaaacctttttgtaattaacaagaactaacagatgagttaagcacttgtagttaagaaagtacattctaatttagtatataaagatgtgtcacttgaaaaaaaaaatatttaacacttgatataattaatatttgcataatatagtcaaaggaaaaattttatgctcgattaagcggatgaacagggaactaatagaaaattgattacctaatttaagtaaaattgtgagttattgatcaaacaaacaaattaaaaacacccatctaataatatatagacatatagttattaattgttgttattgttacaagaatttgtcatttttatgttcaattttatttataaagaagacaatccctcatcaaatgctaataagtatcaatataaaaatgccaataagtatgatggagtggaagtttcatactttcattggcatggcccaaaacatctcttctatcatttgaaaacaatcttggtgtttttctttttgggttcaaattttttgtctattaaga

SEQ ID NO: 1689 - DNA, 1469 bp, Glycine max
  Soy_ogl_1893 Gm06:10505225..102693 Cluster 7
gactgtgaaacttaagttattattattattattatctaaaaacaaacacaactaccttctacaaacacgaattatcatcatccccatgtttatgagatttgattttaatttttcttttccaaggaaaaaaggaaacaaaataatttacgtaccacttttctaatatctcccctaaagatatcaagttatctgatagtattaactatgataaaaatattattcaaaaataaatttaaacacaaaatgatttgaatatgattttatttatataaaaaaatatttgtaaaaactaataaaaattggaatgtataattgaactatatacttatttaaattgaataattcaattgtgtacttttttatttttagttaaaaatttataaaaaaaaaatctcaacataagtgttatattagttttttttaatgtaatattgattacttttctagtaatactcctaataaatatcactttaactttttaatgtagtattaataataaaattaattttgagaaattatattctcttttcatctatttattaatttttttttatctgtataaaataacatgtttattttttgtacgaaagagtatatataaataaagtatcaaatctaataaactagattaaatgtagtttaggtacattaaatttaccagcctaccaaatatgcacagtaaatagtcgcaactaaaaactcttcaatacattttattaatctagtgttcccaactcatgtacaataattaatacataattaaaaattaaaaatatttaatatatatatatatatatgcaatgttctcaatttaagtgagagattatgtaaaaaaaaaaaaatcacaggcacacaatatgatcacggtggagggagagagctgtcatacttgcatctttgaggggatagtgtaaaaggatatttttgataatttttttaatgaaaactaatgaaattttaacagaaaattaaaaaaaggccatatattttaatctatcagaggtgggaaggaaagtgtgtttcttaaaataaaataggaggataatgttatatccatgactcttaaaggaggagtgtgcaatttattataaaaaaatatacaatttaaatagaattttattactttaaaataaagtacttttatttcaatatcccctgatttccacaacagaaaaacccctatttaattttttggttttacactcttatatgtttttaatttttagtcgctcaacagccgtcaaacaatgactaattaaatttctataatttttaaaaattaaaaaatttaaataagaaacaaaactaacaaatgctttttcttttcctgcgagagggctaacaatccggcatctttttttcgtgaataacaattgaaaagctactctcgtgatgcacatgtcatgatccttaccctccacgaaagtcgaaacattattgagcagcgttgctacaatggcacttggagt

SEQ ID NO: 1690 - DNA, 1400 bp, Glycine max
  Soy_ogl_5750 Gm17:37750101..37751500 Cluster 7
taattattaaaaataagaatataaatttttttatctaacacaaaaattacttaaagtaatatcaatatagacttaaatttattccacaaaattatattaatcaaagtcataattaaatttgattaactctgtctgtactgaagtttaaatttgatgatttcaaaggtggaatcaaaccagattcaaatttgactaattttgtaaataattgggacggagtatataaagaaaaggtggaaaagtgagtaatgcaagtatgcaactcgattttggatgattttgtgagaaaggaaagatttggtgacagagagaaatgacgttttgaaattaccacatcaatatgtcttatttgggaatgaacaatgagcatgcacagtgacaatgtgacattcgaggtagtaaatttctatgtttgaagtgtacggtcaaatcagctctgtcttctatttattacgtttgccattgtgcgtggggacctttataacggaaatgtccaatcaatcatttcattttgtttttcatactaatactttttttttacacaatttacattgaaaaaaatgcgataaatttttatgtataatattcaagattaagatttttagagcattatttttagttaaaattgcaatttttttcaataattataccagctctgatcctttttatatggagtaagaaataatagtatttttatgttaattataagacataacagttgtatttcttagagagtgtaaatatatactctcctaaaatctaaactacactgtagagtttatcaagaggcaaaaaaaacatgttgttgctcattttcttgcccgagtggcaacaagttatgcaagctttcaagtttttgaacggactcctttatgtatttacaattgtatttttaatgaaatgagttgagtttgattttgtaattttttttataaaaacatatgacttttaaatatattaattttactttttatatccttaattttattttgaagtactcaatattaatgagagtattaacaatgtggtcttcctaaccagtgtttttagttttgaagaaattaaaaaatgttttattgaaaattatatgagagtgcattttaaaattataaaggagtgtaatttttttcatctcaataaaaatatctcacttttatttcatcaactgtctttaataatataatataagtcatgtttattggttgaaaaaaattattcttaaatttcgagtagtgttattaaatatagctattaatagtaatatttaaaccatttaattttatgtgtactttctgaataaattttaaatttattacattattgattaaaattaactatttttattagtcttatgaattaggtatttactttttatacaccgaaagaattgtgaatcttta

SEQ ID NO: 1691 - DNA, 1025 bp, Glycine max
  Soy_ogl_3047 Gm09:7878176..7879200 Cluster 7
aaaaaaaacaaacttatttcaaatttgaaggctaaaaatatattgaattttttcaacaattaatagttaaaagggaaataaattatgatcctgaataaattttacctgtaatattagaagtttaattgctcgtgtgtttgagtatttattttaaattatttacaattaaaatacatttttaaaaaatgataataattatgaaagtttttaaataaaagtaaagcttcaaaaagatagtatttagtcttttttacatttttttcctctctcatcaatgcacccattgagattttcgtaagatttcataaactttttcatttttttttcttctcctacattaatattcttaattttttgaaaaaatacattaacacctcctaaattatcctatttccttaattgtttaaaaatacatcatgtcccgtataaagaagattattgtaaatgttaaaaagtaaaataaaaataaaaattgtgagatgataatgaggttatatcttcactagaagatgatgaccatttcccttacccacaacacagctaaaaattaagaaatctcatgaaatgtcaagggtaattcagtctttcttctatctcactttctttatccacccgaatttcggggtttgttgtgcattatttttaagaaaaaaaatgaaagtgtcatgaatcaatattcatcttcttttcaaattaaaaaacaattaagtttaaaattagaatttaatgtttatgtattgatggtataaaataattttacattattaatatttaaatttttttctcttaaaagtaaataaattgttagtacatagaattattatgaattttagtttttatacattttcattccttatatattaacaaattcaaacacatgtttttgttttcatttccgatcgaggctaacatcacatcatcacttttagtaaatgtagaaactaataaaaagcgactaattctttttataggaaataattaaaaattgtgatgttttttaaaaaaatttgaaacattttaaacct

SEQ ID NO: 1692 - DNA, 1400 bp, Glycine max
  Soy_ogl_2997 Gm09:4621001..20400 Cluster 7
ctaaggagaataatattaacattcaacaatattggataaatttttttcatgaagttgacaatgtgtaatcttatttggttatgatgtttgtttagaatccaataaatacttatgtttttatgctgagctataatattaaatttatttgtgttgtgtatatattaaggttcaatgactattagaatttgtttagaatatttgagtagaatttgcttacatgcaatgagtatatatgtattacatttgttttatcttttgtgtggctttgatatttgtttacgtacatttagagggagataaataaataaaatgtattatataaaaaaattaaacattttaaattggttttgacgaacaatcattctaattattttttagaatagttaaagaaataattattctaaaaagagatttaagattaattaagttcaacaattattttgaaaagtcactttttagaacgatttttttcactaacaaatctaaaatgataacatttttaaaatggtcctaatatgaactgttctaaatattatacaaattaacacgggattatatgtatagggtatagtatactttgtatatatatttctcatttggctgagaactgcttcacttcttgtgacttttctcaggtttctttaatatgatattttttctttgctgaggaaaaaaaaaacattaccatgagttttgtcaatcaattctcttgacaacctttttatggataccttcatgacatatcttgtaatgctatatatgaaatagagttaagttaattaacagtaattttttaaaatgcactacagaatttaattgttttgatttgattaactaaaattaatggttcatttatcctttcccagaactgaacttattttcctttaaagctttcttcaaattggagttttttttggcagatgatgcaaaataatgagatgcaatgtataacctgggaaaaaacagtcggcaatatattccaggttgatatggcttcatcttgcattgtttttgctagttttctcttgttaatggcctttataatctaatggatattatgttagaatttttctgctttatacttctactgattggttaatctttttattgagggctcagataattttgtgtcggatcatagtatagaatcaagtatcctaagacctacgacgagtaaaaactagctagaattactaatattattataagttaggattcccgttactttcgaaattattaggcgatcttaaattatcacgtgtccataatcccaaatccacctcattttataacgcgcgagaaaaaaattaataacattttttaaggaaaaaattaataacacatattcacgtgttatgtaaatattagtagaaactatgatggttcaaaactacctatta

SEQ ID NO: 1693 - DNA, 1135 bp, Glycine max
  Soy_ogl_3003 Gm09:5004366..5005500 Cluster 7
gtcaatgttgtatacacataattattttgaaagaatgctagtaatatacattctcattttcagtgaattgaaccatctagaatctctttctagcacgcatgcatataatttcatattttattgaggcatgcatgcccaatggatgaggcgtgcattttatgtacgtataatgcacgattcatatgttggatatatttttaatattaatattaatattatttattttttctttatatgaaaatgtattaaattaattatttgtcaatgttatattcacataattatttttgaaagaatgctagtaatatacattctctattactcttcagtatattttctcttattacttgaaattcatgtgtcccattaatttgagaataatcaaataagaaaaaatgacatttctcttattaaaaaaaataatattaacaacgcactttatagtagattttctttatcacactttatttattaactaaaaatgtatttagattgacaaaatcacatgcaaaacttgttaaagagagaaaaatccatatgattttctaaagaaattacagttcatgataaatcattccttagaaaaattgcgtcaaagaaaatgcttttaaaattgatttatcaaatcactttatacgatttttttctaatatcttttcccaacaaacaataaattaaactatctaagctagatataattaatggcttaattacatttttaaccctttaaatatagcgtatattttttgagtccctcaaattaaaacttgcgttttaaacttattataatccctcttttaagattgtgtttgcatgttgtggcagttatttcatgacgattttttacggtcaaaatttagttttacattttaaacttgaaagataatttccaacggctataaacctcaaaaatgaaataaaataaaacaaaaataaaaacttagaatctagttctatcatctttaactaacccttcatcttcaattttaaaaaattcaaaactcaatctaatattgtaaagcctcaaaatcaatcacactaactacttaacaaaatctcccaaagtgaaatttaaactgagaattctcccagctccacgagatattggtggcaacatcaagagatgaggggggac

SEQ ID NO: 1694 - DNA, 1500 bp, Glycine max
  Soy_ogl_3030 Gm09:6241101..6242600 Cluster 7
cttatatacatgcgttaccttataactcatgtaatgtggattttttgtgtaaaaaatgtaatgtggactttttaaggtaaaattctagaaaagcttcttgcaaaaaggaaattaaattcaaatcacttttctaaataattatgtgactattaattcatcgttgtatttttttttaataagtcatcattgtatctggtgatacataagagtgaaatcaagtccttttgagtcaataatttgtttatgatagttttataatttatctctttattgttttatatttttttaaaggacaatgtaaataaatattttatagttattagttttatgattatgtgtgattctatattctcattcaatcataaattaatattatataatttttatggtgattattagttaacaagttactatacattctagtttgtagtttgtaatgagatgatcaatatataacatttttatcattaaagttacatcccctttccttccaaaatgattgcagatttagtttttgaaaaaaattctaaatttattgatgtttttagttttcaacgagatatttaaatatttattacaattttatcctttaataaatattgttatcttgaaagacttaataattataataaattatagaaaaaagaaaaagaatcaaaatattttaataaaattatcctctaacaaattctattttctagaaatatttttttaatctgtaaaccttaagtataagttattttgagatataaagtatattataaaattgcacaattcaacatgagatacgatttttttttagaaaaagcggcgtagggtattatcgctttctgtatatatccgtaaagattcccaaattcaattctttatttttttaaaggattttccatatattttttccacattaaattaaattttgcgacaattttatttttccttttttttattttcttatatcataccgtcatgatgtcagttgcaatacagatgtagtgtattattgttcaaataatagtatacaataatattctgtcaaaaaaaatatacaataatatcaacagtgttaagttgtttgattttatttttaaaatatccaaataataatatggggaaaagttacaggagcgaaaaaaaaaaaaaaaagaggctctaaatagttagataatgaaaaccatacagttgtataatgactcctattatattatttttttcttaatttgcttatattctcttataaggatcttccaaattggtgtctgtgcttctacttttgatcaccacacaaagctgggcgaaggaataacacgtgattaattggtagctgcatgtgcttctacttttgatcactgaaaattagaaaattgggtcaattctttgggcaacacaagactctggtcccaggaagaagactattggtgagttatgactcattggactcattggtttgtctggaattggtggaaaagggatgttcacggcggttagcttcagatttagaaa

SEQ ID NO: 1695 - DNA, 1800 bp, Glycine max
  Soy_ogl_5168 Gm15:49015001..49016800 Cluster 7
tatgaatatttaacatatacagttaaaaatattttttatatatcttatacaatttaaaatctgtccgcaagtgtcaaatatttaatatatttttatttttttgtgaggtgaatcttgaagattttatactgattggaaaagcaaataggtcaaaagtagaggaggctaatattgtgataatagttttttttaatgttttaaatatgatcatatacatatatacaacatgccacatgcaaccgaataagcacaaataaatttatttaaatcttattgtatgtaaaaatatttgaaagatcgaggttgacacgtcttcaaacaaatcaaatgaaaaaagataaattgataacatataaatcacttgcctactttgaagatggtggaatacaagactctactaagttactgagttttggtgttattagtataagggttgtgtcactttagccataaacatacatgccatgcacaaatagatatattgtattcatgttaccacatattatttatcaattttttttaacattcttattatcttaaaaacacacaaaaaaaatctaaaaaaaaacatattctctcacacacattttatttatcccgtgtatgggtcaaaaatttagtaataataatatatgattatagaagacaagaaatatactttaataagtaagaatgtttatttcttttggattgacattgtcttaaatatggcaatgatgatgtggagaaagttatgaggaccttatatatgtggacaatttcaaccgtgagagtcattcctcacaactactatcattagaattcctcttgtccaccaccatgatggcacggcaataatttgatccctaacactaatgacggcacatttttctcatgtcaaacttttatgatgttcaagtaaaaactctatacttctgctctctttgaaattatttcagtcacgatcccctccatcagattccactggccatggatattaatttgttctaacgggaattaaggaaagtggctttgcttaatgcattaaaaaaaaaggggttgtaatgaagtaggttaatttagataggggcctcaacctcgatccctcactaccgcatcttttttttctcattcatatcttgatcacctccgaaattgtcttggtgtacatatgaaagaatcattatattaatttgaagttgaatacatattacatgtatttaaattgcattccacttattaatcacttgagttattcctatataacaggttaattttcttctaaatatgatcaaatgatcttttcataatgtgtttttttatcaaattatgttataaactgtctatcaaaaacacaattattatattataaactcacgagttattcttatttcatagcatagttacattatgtgatgatcaggttaaacatgtcaatgctaatgatgaggaatatgtgtgtgtaattaaaaagtgtcacaaatataatcccaccatcattcggacttgaatccttaccatttagcttcactctttaagagaaaaaaaaaaaagaaaaagagagagagacatgagatatgaatatgatctatttaattacctctccttttctcattcctagtaaacagtgaaactgtaacaaagacacttgtcttgagggcattcgactaagacttttgaagtaagtgaagaaatgtttgcttattaatggataattctagcgactgtgaatgagtcaagtagcatttgacgttcaatcttaatttgtaataaaagaaattgcttaaatctaagtactttatttaaatcaattaaatttaa

SEQ ID NO: 1696 - DNA, 1137 bp, Glycine max
  Soy_ogl_4063 Gm12:24397564..24398700 Cluster 7
atattttttggtttataaaagaaaataggatatggaaaatgtaaattaattataataaattgaatcttttagtataattctttaattaaatctaaagttttatgttgacaatatatgatgacctttagcaaggtgaaactctaattttgattaaaaaaggatcaaataacttatttggtcctttatcttatttttttgtttagtttggttctttaatttttaaaaggttcaatttggtcatttatcttaatttttgtttaatttaatcatttatcttttaaaaagattattttggtcatttatcttaatttttgttcaatttagtcatttatcttttaaaaagtttattttggtcatttatattttttttgctcaatttagttcttgtatccatttaagattgacattgataatcatttaagaatgattttttttttaaaaaaaatgaattggaggggaatgggagaaaaatgaactaaaaaagttcatttctaaatgattaactacatcaatcttaaataaactaaaggatcaaattgaataaaaaagattaagatataggaccaaataattttaaaaaaaataaagaactaaacaaaaaattaaataaaggacaaaattgtactttctaaaagataatggaccaaattgaaaaaaagaagataaattaccaaacaagtcatttagctataaaaaaactattacatagattattatcaagataaaactttaattttaatagaagaacaatacaaaaatacttaaggaatgtaatgtccttcgttacgataacaacttataataaaagtatattttaaaaatccataaaataagaatttaaaaaattcaatgattcaaaatacttcaaatattataaataaatgagtccttacataaataaacaaattttattctcaaatatggacatccagaaagtttaaccactgataagttaagtttttaattctctcatctcaaaagtttctttcttgaactttgaaaataacacttttaatgagataataatctcattgaataaaacttgttctaaaagagtttgtacacagtgttgtttatatttgtagtaaccgacaaattcaatcatggtattcgcaaaattaaattaaaaaaatatat

SEQ ID NO: 1697 - DNA, 1378 bp, Glycine max
  Soy_ogl_5660 Gm17:12944523..12945900 Cluster 7
aaatttatccacatatttataaaatcattaattttaataattcaaattattatagcatcttccgttcaaaaaacactattataacatctaaattatttaataaattattgcttttaagaaaatatttgtccaatgataaattttaaaattattataagtttaggttagagtgaattagatcaatgattaacataaaattaaaatttcaatctgacaattctgaaatatttaaataaattttatatatatcaacgatgatgattataaaattaaagttttcatccggagattcgaagttattcaggtaaactttacataagataagatgtagatagatttgatttaacccgttactcacccgatttttatattattttttaccatagtcattgcctgttcgtttcgatgcagtattacctatttttattatatatatagaaaaacacttatggcctgcctgaaatgttattgaatttgaatatgtctgcatctatttttttattaaatattcgtacacatatacttttttagttttttggcgtccattgtataaataaaatataaattttcaagatctgcatatctccataattttgttatcaatcagaattttcgagctacatagtcgatttaaccaatggacaataaaatgttgataactaaatatttattataaaatttaaaactagacaaggataattacagaaaaatgttaccttatttttaagcttaattgcatattttaccaataagttattattatttacaaattttattactcaaatttttttcacacattttactgatatattaaatgtgtaatgaatgatcaatgtgtccctaaagaatgatatcattttgttacattgatgataaaatatgtaaaaattaaatatatatatatatatataatatgaaaaaattgaaaaaacaagatagtaaaatgtgggtaaaaacttggaaagtaaacttcatcaaataatgatagttaagtgataaaatgtataaattagtttgatttttatttgttttctatttcaaaacttgcataggaattactaaaaacgtattttttactgttttttttatttaagttttgaaataagataatagatttaaaatcacatatgaaacaaaataaaagactttaattatcatacaaatttcgtataatgtttttacattggtcaatttaaagttatcctaaatgtatcctttgaaaaacttattataaaaactaacaatcatatcctatctaattttttttatgtcaggatattttaattaaattcaaaataaaaaatattttaaatattttttcgaattacagaagccattattctttccatttaaactataccctttacacaaagaacaa

SEQ ID NO: 1698 - DNA, 1363 bp, Glycine max
  Soy_ogl_5985 Gm18:7639201..7640563 Cluster 7
gctaacaacaatataaaattgcttaacttaaaataaacaaatcattatttagttttaaaaaattaagattacacataacttaaattagagagaaaaaaaatataattaagaagagaaaaaacgtagtcggcaagtaatttgaggggagtgagtgaggatgaggtggaatcttttgggtgacgtaatggattacataacgaagtcaaagaaccattgaatttgaacggcggctattatttactctttaccttataatgcccactttcaattttgtttgttagtcctatattattttatttatgtaagacgtcattgcaaatgtaaattgtttgtgagtgttaattatgttctcttttttcataaaaaaaaaaaaagtgttggaatagagttggattcagatttttaaagtaagacgtaatattcaagtttcgtaagtaaataaatgaaattagggaaaaaaatattaaaagtgttcaatcaagtttttatgaattattaaaaaaattaatcaaaattttatatcaataaataattataaaaaatgttagtacatatttaatcacattaacccgaacaaatctaaatagactttggatcaaattaaacctagtatttttttaagacgagttgaagttatacattagatgatcacaacttagtctaaagtaatatatatatttttttaaaaaaatattatttccaaaaaattgtatgttaatcataattttttaacttaataaataatgcttgcgaaaatgtaatataatattatatttatattaatatcatttatcttaaaatatattgtaaaatacatttaattgtagctatttctttagttttactatttaattatatataatgttaaggttgttatcaaaatttctttttgacagattaccaaaacatatatataatgctaagttaatatgttgtatgataaattgagttgatccagttttatttcaaatattttgagttttaattaaatcggaaacaaattcaaaaacttgattctatcataatttcgagtcaagtataaatattagtaaactcgtcccagtggaatgaataaccctgtattctttttactgatagtatcttcgtgtgtcacatttcacagttgaaaaatattattgtttttttaagttgaaagattatcaaagtaaatgggcagttttccaatattctttatttttttccatacatacgattttaaaaaaatattttattgatatttagatctaggtatctatcagcttagttaaattttgggggtgtcgctgccataacaccatttatctatgagaaaattatatttatcgtaaagaagattaaaagtattcttttatatgtaattcta

SEQ ID NO: 1699 - DNA, 1000 bp, Glycine max
  Soy_ogl_1963 Gm06:15593801..15594800 Cluster 7
gtttcaagataatttgtttagtcttaaaaaaaaatcttcagaatataacatgaaaatgtcatttttggatattattaaaaaaaagtttggttaactctttgacttggttggaattaatttttatattgttagaacgattaaaacatgtgtttaattaagttatcttttcttacacccctcgtctcttccccatatgttcgaaaattgaaataattgaacgaaaagtaaaaattacctattaaaaaggagcattagagggaaagaaaaaattatcgtaaaatatatgaatgaaattaataatcagtcaaattacaagaatatttattgaaaaaaaattgcgagattaaaaaaaatttaagcacatatcttgaaggaacaatgagaaattagtgatgagataatggttatatatatatatatttctactcatgaagatgtattcctattaagtggaaatattttttctcgcattttttatcgggactaaatattagtagaacgtgaaattatatattttttagaaataaaatatattcagaattaattttttatgatatcaaaataaacttgagataatttttctggtttatatattttgaagaataacaaaatagtccttgaaacaaacgttgtgttattgtataattcttcaaatcaaggatttattttgagcatgcaggttgttacgaaagcatcagatatttttatttgtattataaacaaaatgtttttttttttgttcattagcttttttttattgatgaaagcttcagattgattcatcataacttttaccgtaccaattcaattcagcgtgaccaataaataaccatgtatattttctcccgtgcttttctttcagcatatccatttatcataattcacagttaataatatagtttataaacattgctcaaatgcttagagtgcatggttgatatcaccatggcattaaaaagtgatatcacaaagagaatgatggaggtagtcatccaatcaa

SEQ ID NO: 1700 - DNA, 1564 bp, Glycine max
  Soy_ogl_1983 Gm06:16220001..16221564 Cluster 7
ttaaatcaatcaattaatatctactgcaataattttttgtgggcacaaacccaataccttattcttaaacaatcaataaaaaattgacaagtgataaaatataaagaaaaatattcatcatttattaaatttgatttgatttccttttaataaggatacgatatacttagcttcatttgagaaagatttgattttataattttttatataattaaaaatttcaatttctcttattatcttttgtttatgtaaataaactaaaatacataataaacttgcttataaacgataaattttataaatatatttttgtgtatttttaataattttgtattataattcaaatttttattaagagagactgagaaggaaatgacatacaaggcatgtataaagtttggagagttagtcacgtatcttaaaaaataatcttaaataaatttaagtttttaaaaattgttaataaaataatgtaaataaaagacaaagtatataaagattgtagggagatgtcaaatgtagaaaaataaaaagagacgaactatgttttaatttgtttaagaaaacaaaaattaataagagattattattttttattttattcttgaaaaaatgattctcttataaattttaattaataatacaaaatatattaaagaagatagagagtatatttataaaatttctcattaagttgattacatattttattttaaataaaaatgttcatgtgaggtaaagcacctttacacacacaactaattacaacgttcaattttgtcgcatcacttttattatgttttaattaaataagaactaataaaaaatcgatacaatacgttctattaggttcttcttttttcattcacataaacacaagataataagagaattttgtaaaaaaaaaaaaaacctataaatatttaacatatcgtcattagatcaattttttcatcaaagaaaaattatatcataatccttattagaagtaaatcaaattaaatctaataaatgatgaatattttgttttatattttatcatttgtcaattttctattgattgtgtgtaagaatgaggtgctaagtttgtgtcccaataatatctcattaaataatatttaataaaataataatattaagatgattaatttttgtgtagaaaaaaataacataatcaaatttaatatcattataagttaatcagtataaatatttgaatttgaatctgaatcaataaattaatatctgttgtaattatttgaatcaatcaaatattataacaaatttaaaatattttccaatttatatatgtaccttattttataaattttttcctataaattcgtggaactttaagcccaaaaataaacaattaaaagacaataattcggggagtagaaactcccacggaatcacttgcattcaaactagcaaatataaccagagttgctagaaaataactaactctaacttgatccaaagatccgttattacaaaagttgacaactataagctgtaaatcccagccgggaataaattcaattgacaagtaaaagttgatttt

SEQ ID NO: 1701 - DNA, 1456 bp, Glycine max
  Soy_ogl_3232 Gm09:40475845..40477300 Cluster 7
gttcaaagcctataaaatattaacttgactatttagaggagcatgcaattttgaccattaattcaccatgaataaaacaacaataaagattaaattttgatcatttcatttgggagggatatttgcatgagtgagttcttattttagctctctctgcttgtaatagtttctggtacttctggtaaccatgcatattaatacataatttgattttccgataaaaaaaataaagattaaatttaaatcaaaatatgtttaatcattaatacttatttgtatgatttatattaattccttttacttgcacttccgacgcacacaggtaatatatgtattttttttcccgttaaaattaaataagcatcgaacttaactttctttgttaaattgccaatctaattattaaaaaaattaaaataaatctgttttataaggaaatcgatcttatcaaaaaacaaaatataagttttgctaaactacatattatgaattgaattgggtagcggcatttatgctctcaagaggttaactttgtttctgtttttttttttttttgttatcatcctaaacatgtcttatgtttagcttgatttttaatgaaattctctttggcttgttaaaaaaaaaacatattacgaattgaaagttgtaattcctatatgaaaagtactattaacatactcttcaacaaattctttattatcagtttattctttaaaagtcattattttattttttttgaaaatgaaacctagttacaagataattggtttttttccagaaaaaaaaaaacaatgataaagagaaggccggtgaaatttttttgttgtaagtattttcattcccccacataaatgttgtaagtttgttgtgccatcttaatatatgaggttttatttggctgataaaaaaaattagtcctcaaaatattttaaaaattaatagcatcaatgatatttgattattgcgtttatatagggcaaaaaaatttcatttgaggatcaaaactggagttctttttatttttataaatagttaagagattttagtaatcaaagcaaagaagaaacaataggctccttattggatttataaaatccagtcaaaaaattgaataatttagtatgaatttatattgcaaatggatattattattattagttgcgagtattgttagtccttaaacagtccaaaaagatagatttcttttttaagaaaagaattggaatttgttttttgcctctcgattaacgaaattaatcttagaaagttgtccgtgtatacctgcaacactttttttccctatgtttttctgtgcaagcaccatgataataaatattgttgctattgttcttggttaggtttgtagcctcattttcaatacatagtttacggtcaaaaacaaaaccatctttcagtaccgttgaagcccaaacgggacatgggctacatttgt

SEQ ID NO: 1702 - DNA, 1083 bp, Glycine max
  Soy_ogl_3347 Gm10:3308596..3309678 Cluster 7
ccgtcatattaattttaaataatttgtacagtacctttttaaaaaataaaataattgataaagtactagattcactcaacacttataacacgagtttttttttttttttacaaacacacgcacatttaattagatgctccaaaaatctttatagatttttatttttattttttaatataaatataagtgagaatataacaaattcagttatgaataataacatttgttcaactttttgaaaaattaagaatattcttttggaacaaattttgtctgattaactttactttgcttaacttacaagcatcagattttattaattcaactgctaatttttttttacgaagtaggcctaatctgtataaaaaaaggttgattaagtggaccaaatctataaattttcataatttaaaaattgcttttttacttaatcaatcaatttgtttcaatggataatatacttttaacaaataactatgtgaaattacatatgtatgaaatttcagtttatttaaaatttgacatatatatgtaccatcatcgagatgatatcatataatttaacagttagattagtcaaatttataatttagaaaaagttattgagtatttataatttattaattttaagtatgtggttacagcttgttgcgttgacatttttatcaatattaatgttttctttttcctttcttatttttttataaatatgtaatatagtataatatttttcatttacttatattcaaataatttactatacattaagaataaaatgatgcaatcaagtattaactaatttttaaataaaacgagaagtggtatttaaaatttaataaagtgttatgttaactgattaatttatttttaaattattaatctaagagttagatttataaaatataattttcataaaaagttacaagatgatgttaattacggtgtgagtctcctctcttcttttctcacattttagtataaggtccaatttaattcttgattagcattcattgccatagcttattaatatctacagttccactgatttggtaattgttatatataattaaatatgtaacatgt

SEQ ID NO: 1703 - DNA, 1415 bp, Glycine max
  Soy_ogl_1190 Gm04:2637701..2639115 Cluster 7
attgttcgtaaattataaaaatataaataataaattttctataattttatttgaattttttatattatttaaagttttgtgaagacatcaaatcgcaatttttttcattcaactatgacaaagaaaaaaaaactgaaataaaacatggattaatattctctctgtctcataagatgaatatcataaggtgatgttaacttcttaagaaaaatattaattatagaattactatcataaaatgactctctgataaaaacacacttattcaacgaattagcatgtcgttaagaatcaatttaaggcgagtttagctcaatcttttttttttttcccctgtttctcaagaggagaaggtgagcttgacaaatttagagaaagactaaaaaatcaagaaacttagtttatattaaagaaaaggaggaaaagtaggttttaaagaaaaatttattttaaaaataatctgcacctgttaattttttctctctctcgttctaaattaattgatgtgagacaaagaagaaaaaaaacttaaactgctaaacatttttctattttaaaaatattccttattttcaattttaactttaaaagtggattttaagctaaaataagtttgggtgaaacatcatatagtaagatgaaatatcaatagatgaagacatcattggaaaaatattttcttcattttctgaagtgacaaacattttgagataaaacaaaacatatggggatacgtgtaataaatgtgaaaagcagagagtataaaaattgaaacaatattttaatattggagacaaaattaaaaattagatctaagaaaatagacaaaattttcttaaatttgatttttataccattcttttttatataaaattagtttgaacaagttttctgcctccaaaactatgaatttttgcattccgtattttttattttaactttttcagaaataatcaaattataaaaatatgtaacttggtttaattactttattatttattattttgaatattaaaaagtataatattgatatttcatgtccagaaatattagaaataaacttagaaaagaaataaaaaaaccattttcattggattagatgaaagaattgatgaaaaaaataaatagattggaaattattgaaaaatataaatatacaaaaaaatataatttaattttaccattatttgaaattaaatttaaaacgtagtttaaacatatttttgtctttaaaattataatttggagcagattgtttggcaaatataggtgttttggccgatgaggagttggttgtgcttcaagaacctccagcttccctgagggctagctcttattttagtttgttgttttgtttttttctctcctgtaaccaaaaaatatattctttaaaattataattgttttagttcatt

SEQ ID NO: 1704 - DNA, 1346 bp, Glycine max
  Soy_ogl_2998 Gm09:4644671..4646016 Cluster 7
tggataaatatattggaaaaatataaagtataaaaatcattagattgcatgatatctaaaatattatgattttttctatcattttaaaactttgtaatttaatccttagtttatcttttcatcatgtaatccctttgtttatttttcgttaattttgtttattaaataacattttttatttaacttttggtatattaaaatatgaaaaatttaacttactggtctagagttcgaatactcaaattgagtatggaacaaattatgcgggaaggaggataaattctccataaagtttctctaaatatcaagatttttttcatttactaaattttaatctagataattttaatgcaataaattatggcatattttattttcttttacatttatgtcactttaatgtttcttaaaaaattgtaatatagatgtttaatacaatttcaatttttatcgtaacagagataattaaattgtaatgcattaaaaaattataaataatttcttaattttttgtttcaagagtttaattttttcatagcaaagcctatctaagtatcaacagtttcactcagaaattcataagggcaaagtcactaggcagttttcataacatgtgcatggacacttttgtttttatcttagcctttttataaaaataaaatcaaacacttaagtacaaaataaaaacttagagaatttcacctaaagaattcctttattggttcaattgtttcttcattcgatcctttgagctttttatagtgagtgttgatttgaatgttggaggtttattgttttagaagacacacatgtacgtatttatggacgaccatgattcttggtgctggggcattcgtggtagatcttatactgctgctaaagcttactctatggcatcttttcgtacagtttatatttttttatgctggtttattggtgaaaaaaaatgtaattatccttgatataaagtaacacttcatgtcctttcaataaagttcaatttttccttcaaaagaaaaaaaccgggcttttgaaatttaattataacatcctactttatttataaacaattaaacaaaaataatttttacagagaaattaataaggacttatatatgcgaataaaaaattcgtagcctattatacaacaacaatagaattttatctccctagataaaattgactacatgaatcacactattaaaaacgtatttatttacctacagtaatattttgttcttcagccattatgggcaagattaacattaatgtgtaatcaattaacacaaaagtcctaagattttacataagcaatagactaccattttgtaaatgattagccgtgg

SEQ ID NO: 1705 - DNA, 1445 bp, Glycine max
  Soy_ogl_1227 Gm04:5259001..5260445 Cluster 7
gaagagagctagctagctagagataagtgattttcgtattctatagtataaattatagatttgcaacaattactattattattatatttattatattttcattgattttagataatgaactataaatacatactctatatttattatattttaactagttgacaacccacattaaatttatagagaagcatttagattagatattcacacaatacatactctatatttattatattttaactagttgacaacacattaattttatagaaaagtatttagatttgatattcacataatataatacgcttgaagagaaacaataaattttgagtgtaattaagtttcagatcaaagtaaatattataatcgaccaaaaaataaaaaatgaaaatattagaatttcactggaaagttaaaaatctaaattagaataattaaaagaaaaaacatcctagaaaaatcaaatctatagaaaagaaagtaaccatcccatttctttcatttccaaggtttaaaaaaaataaatgttactcttcatgtgtgtatcatttttattttatttatttatttatcaatgaaatgaaagaagtggaggaaaaggaaagagagaggatgctaactcaacttacacggctagtgccttagcggatgctccacggaacctacacctctttcctttgacggatagtaacctaatcaacatcaatcacaccaacgtcaaggagagtcgaatcaaccaaaagaaaatggtgatttttctaattagaagaaacttcatcgttgtttcattaaaaaatgcaaaataaataagtaaataactaccgatgaaaaaaaataacaaattgagctaataaataagtagtagactatacgagtcacgagtgtgttgaaattctaacaaatacccagggattacttgttaagaacacaaatgtgaacgttgccaataaaacatatctgttatactaaaaatatgaaaaaaaaatgtttaatattgactttttagataatgattagttattttgagatactcattaatgagtctaatatacatacttgtaccaaaaaaaagtctaatatatatacttgtacccaaaaaaagtctaatatatatacataatccaattaattaagtatgagcaattcgttttatatgcacatattatctcaaatgatttttttttttataaaacagacttaaatatattttaagtttacaataaattaacgaatttaattttaattgcctatttaaaaatttatgttcaattcttaataaaataaaataaaaactgtttttgatacttggtattttattttagtcttttcaatatatttttttattttactccttataatatttaattcactttgtattagtctttttaaaaaatatttgataaatatttataacaaatgatctacctattttgtggagaaattca

SEQ ID NO: 1706 - DNA, 2119 bp, Glycine max
  Soy_ogl_2432 Gm07:39104401..39106519 Cluster 7
ttaaagaaacctgtgtattcgaaaaaacacaatgtttcattctgattcctgaacttcgcgtgattgagacattttatggaagagttagaagatttgagagtgcataggaatcataacttttcgatgagacataatgataaaggctaaaaaactcttcaaagatagtagttaattaaagaaattcaaattaaaatgtatttactgaaacacaagtgatgttaatttttagactttaaaatttgttcatggctagtataaagatttttatattatcaatcaattaaaattaatttaaatataattttaagataattaatgtaagaattaaaagaacttattatataaagtgatttaagattggataattgtgtaaaaaaatttacactatcaatgaattctaattaaattttaatttcaattttatgcaaaaaattaatatcataaaaatgatatttataaaatcttaaattaatctaaatttatttgataactcatacataagaaataatgtaatatatacttttaaaatatacacaaataataaataatatctaactataagacttaattttaagtccatgaaaaactttcaaaattttatatttagttcctaataattttttcttaacttttaaaatatttacacaaataataaataatatccaattgtttttcatgcatgccgttatatttactttgttaactcgaaacgtcactatgtgatggtaaacatataaccaattgtgataaaaaaaattcaggaacaaaagaaaaattcaaaaatattgtaaggatcacttaagaaagctaatttagtaatggtaacgaaatacaaaataaaaaaaaatagggaccaaaggtcaatgtttttattacgaaccaaatttaaaatctaaaaaaattataaccaccaaaaacatatttaaatctaattataatttaatgattaaatcgagaaaaaacataatttgtataaaaaaatattgatggaaaatagttaattaaacctataccaatgttcctattgtgtatttttcttcttttaattaaaaaacacgttatatttttagaaattcacgtgggtttggaattaaatggcattctaaaagctttattttaatcacctaaaactctgaaaggatgtataatgcatggtttttaaaataaattatttatctaaaatttgtacatcatacaatttcatatagatttaagaacttttaaaaaaaaaattctaacgttaaagtgaatatttaacttaattttcctattttttctactaatttttggaagtacctcttttattgataaaaaaataattaagaaacattacttagataagtaacaatatttgtgcatgaaatgtcacgtcaaatactccaacaacaaaaatttgtgcatgaaatgttacgtcaaatgtttcgacgacaagttttgttatgcaatggatattatttttaaaccgtataagcaattgcattatagttgctcaaatatgtttcttaataaatacaagagaaatactaataatacactcttttgggatactttctctttaattggttgaatttttttggatactttctctttaattggttgaattttattgaaatgacaaatattagtggatcacacattacatttaatgattttgtatctttattttatgaatttcaataatttttaaccaatttaaaagagtgtgattgaagaagcttgatagtatggtttttaaaaccagaccaaaccggccgattcaatcgattgaattgagaactagtcaagtgacctgttcaaagatccaagaaaattggaacatttcagaacccgtcaaaatagagtaaaattgaccaaaatcagtgttaaacccacataaagaatcggggttgaatcgatctttttaattatttatagttttttttatttttttatttaatctaaaatatttttaagataaataaaaatacattcttaaatatttcatataataatcaactattttctcaactattattagtttttatcttttaaaacatataatttagtcatttatactaatttgtaattgttttagatcctaatttttttaattatatattatcttattacttaaaatatt

SEQ ID NO: 1707 - DNA, 1100 bp, Glycine max
  Soy_ogl_932 Gm03:37647901..37649000 Cluster 7
caaatgcttattcatttgacattttaaattccttctttgataggctggagagtatggaaagggagaggtttggttggagagaaagaaaaacaatgagattcacagtttctcatccatatccgtttggaaaatgtgttttgttatttatattatctatggacaacttaaactagttaataataattatcattttatatttaaaaatcatataaattatttcatgttacaattttttaatgattagtcaacttattttctgtatgtgaaatttacccaaatatttcccctataggattggggatgaaagtaaaataagattccatgtgtctattcatcaaaaagcattattaaggtagctttttgcttaattttttctaatttttttccttaaaaggaaaagttgagacaaacacgtacatttaaagaaaagtttttttaaaaattaatgagcatatttttttatgaaagaaaaagagggatataacttttagaaaatgttaactaaagtgacttttaaaaataagttccacatctttagttccccttcctttcatcatcataaactaattgatgtgatgagacaaataaataaaacatttatcttcaaagaacttaaattaaaactaacaaacagattattttatttttaaaattcttatgttgagttttaaatttaaagtatcttttaagtaataaataaattggaccatttgaaactaaacaaggctggaaagcttttttttttctttttcttctcatcacataactaatatcaaacaacgggatgtaataatcctttctatcattactttatcctttttcatattaaacgtacacggccaggtcaaatagctcattaaattactataagttactctttacattgcaaaatataagttgatttacagaaaaaaaattgttttgaaatataagtcattttataaaattaatactatattaaatattttttccaaaattatacttccttcattaatataatcgtctttttagttttcgtgaactttttttttttctaatctaagtcattagtatttacttatatatttatatcattgattaattttaaaaattacttaatt

SEQ ID NO: 1708 - DNA, 1429 bp, Glycine max
  Soy_ogl_5293 Gm16:4386401..4387829 Cluster 7
taagagaggaaccctagtgattttatttactacgagtggccaactgaatcagcatcagcataattaacaccttataaatcttccaaaattgacgtgagcttcacatggatacacgtgaaagagacagaataatggtagttagttaaagctacgtactttgtccacatgcgattgtgaattgtatccattaggttttggtactcacttgttgtgtggcctcgctctggacacatcacatatgaccctaaaatcacaagtcatttctttggcagggacactcctgccagtttctaatatgttcatacataactttcaaaacctgttgactggccaagtaaatgcttttcattgtctaactaaaagacaggacttaatttggttatatgttttttaaattggttatatgtaacattatcttcaattaaatttaagttttatattactaataagtactaaaacgtctagctcaattaattcatcaggatgcataaattattacaaatattttaatatttgctacaaataaaaaaatttattattaataagtactttaaagattatatttttctaaattttggtatatactattaaagtaaagttatatttttttttattgaaaacagtatcacaaacacttacaacatctaaattttatccttagatgtagagataattgttacacgcctcatcaagattttttttatcatttaataccttatcaaatttatcatcattaattcattaaaatctttactcattcaattaagattaatttggtcacggattaaataatatttgaaagacattttttttaaatgaataatacagtgatgattaaaatctttgaaagactaataggacaacatatataaatttggaagatagaactgagctgttgcttttctaaatataaatatattattgtatcttttttttttttgcagaaaaagagataaaaacaaagaataggctttctgttagaaatgtttgattacgaaattcaaatatttgatacactattcacattttatctttctcacgccattttttttatcattaccctttgtaaaatgtaagtttgtttgatatattagtcatttctcatgcttaattttaagttttgcttgtcattacgattctaaaaattggacaaaaccattcggtttaactagaaaaccagcgaactgggaaggtgactgatctaatataaccttatagttagagcttttgaaaaccaataaaaaattactaatttgttcattttcaaagtacaaaaatagcattttaaaaatatatatacttctttgtagacagcataaagatattttatttagaaaatacaattttacgaagagataaaattttatatattaaaattaaataaacctcaattttatattacaaataaattaaataataaaaaataaat

SEQ ID NO: 1709 - DNA, 1400 bp, Glycine max
  Soy_ogl_169 Gm01:45175201..45176600 Cluster 7
aaatattataggaacactttatatacaagtattataaatatatttcattaaaaaatagacacatgattttattacatactaaatattattttactcatagatacgtataaattaatacaaaatattacatctaaatagattgttaactttttggaagaaactaaaattttattagctttttttttttttattttcacccagaaattctcaatcgaaagtcaaagtatgattcctagatagagattgtaggagtaggttttacctctttcaacaaaataaattttatattctataatggttggataagttgaaattttagaattgaatgagttttgaaaaaatcaatatgatgaagttgttgccaaaaggtaagaaaacaaccacaaaggtcagcattagggaaataaaagtattttttataatatattggttgaaggtagaaactcaaactaacatcggtttacaaattggaggatgaacacgtataaaaagtaataaagcataagagtgtttaaaatattgtagcaattttttaaaatctaacaccgttatataatgtatcaaattgtaacaatttaaatgcatacaaaaaaattataatattttttactgtttattgtaaccgccagaaaaaaacagtaaatacctacttttggtattgatatataaggagcacatttgatgattttttttggtcgctgtaacactgatatgtactattcatgattttttttataattaattttctttctaaaatttgactggcatttttagtagtgttcaaagatggaattactttaaagcttgggtggccaacaccaccagatttttttcccttttttttatgagagaaattagttccccaatattaggatgattatttctataattatataaaaatatccaagtattattttaaaaaaatattttattctctatattttttattgtgaaaataatgacacttatttatttttagataaatattttaattctcttttatagtctttttactaagataattatattctttctcattttagataaactatatgaatatcatttatttttctttttactagtatcttccattattgttattttaaaaactataaataattacatttacaaaattttaatagtctttcttttatattgatttaaaaatattggctataacagtgagtaacaaaatccatttgttagaacataattaataaaaaaattcctaaaaatatgattaaggtgcataaatacaaatgtttattataaattaatgaaagatctttattacatacgaaactgatcgacatttgtaatcttgaatttttaaaaagaatgtctaatttatcttctgtttaaatatatttttaattaatgttttggagaaacaacttaat

SEQ ID NO: 1710 - DNA, 1029 bp, Glycine max
  Soy_ogl_502 Gm02:11834672..11835700 Cluster 7
gtctatttttatcgacacataattttatcgaacaaatatgatttaataaattaagttttcaaatttcagttattagctattagctagttttcaattagattagtcaaatataatcttaaaatattatatttataaaaacaagctccaagctaaatagtaattcgatttttcaaatcttcataaactatatgttctttggtacacaatatacgtttaagataaggaaaataatacttattatcattttatttaatgccatccagcttttaagtttcaaatatttttttattttattttatattttagtatattgaataaactaaacaaattgaactcaagtttcatatttttcaaataaagtttttagttcaaactgtacattccacttatttaaaaaattgaatcaaatttaagcattacatcatttcattaatcaaatttaaatttcaagtactctaaaataaatccttccacaaaaacctagaatatatctaaaataagtgaaataagtcctcatcacaaaaatataatatactttctgctgaaaaaatgttaccatgtttgataaaaatcacggtgctcagtagtttcatagctattattagtattcgtattttagtattattctctggtactgctttcatttttatttataagatttaaatttaaaatgatatttattcttatcataatacttaatctataatgttatttatattaattatttttagattaaaaatattatcattaaaagaagagaaaatatattaataaacaattaaaagagaaatgagtattaacgagaagaataatttttaaaaaaaattataaatttaaaatatatttactaatataaataaattaatatttttcttaatcttaatagattaagtaattgggtttagagaataataatattgtgaccacatggtttaaggaagaaatttggcgtgcaggctcattgggctgtttagagctaaagcgatgataatattatgagctagcacacacgcgtgtcttgcgctagcg

SEQ ID NO: 1711 - DNA, 1490 bp, Glycine max
  Soy_ogl_1993 Gm06:16795801..16797290 Cluster 7
tccgtaaaggcatattaaaatcatggttataaatagagaatttcatgataaatttaatacttttataatgttaacttcacttaaaaaaatagaaaaaaatgttgatacgtaaggaacatgataaaaagaaagaataaagttaatataaaataatagtaacataggaagtgaaaagttatactttatttcatgctggttacttttcaaacgatggagtggaatatttgttctattctttaatgaattattcaaataatagaatggtaattttagtccaatttatttttttttcattatattttgatccattctgtttaattatctaccatcaatccaaacatagtcaaagtgataactaagtaacaacaaccacatttatatactatttattatctcttttcaaacgatggagtgaaatatttgttctattctttaatgaattatccaaataatagaatactaattttagtctaattcatttcgttccattatattctggtatgttatgttctatcacctaccatcaattcaaacatatagcctaagtgataagtatgtaggtaaaaacacccacgtttatatactattactttacagcaaatcttttatacattttccaaactaatttgatatgagtcaatgttatttagtgaaacttcattcccgtgatcaaagcacacctagtttaatctttctcttggggcttttgcttctcgctcaagcacatggaagtgataagaaaattgggttttatcaacaagagaggaaatttgacaaattatggtgcatcacttgtataagttattgtccctataaacatggtgtgttttagattcttagttacgcacgcatgtaagttgtttgatttaatttatgctattgaaaagcaatcacctaaattatacagtccaatttattatttaatcaaaatattaatgcttttatatatctttgctaaattaaaaattcatttaaaaaatattttaatcatggaaaaatctttaacatcaattataaaaatttagttttaattaattttgttaagaaaatccaggtatttgaccagaaaaccaattgaaaaaaaattaattgtgtaatatattacaatatctttaaataattttaaatataaagctaattacaatgtattacttaccattgtgattgttctaatctatatctatagtatatagatacaagaatattttctaaaaggaaggttgacatgtgtcattctctagaattgtaaaacaattaattattttttaattttacattgaaattaaaaaatatatataataattagtataaatattaccttatattaatgagtattaaataagaaaaattgatttgtgaatttgatttcaaggcaatgatttattctctaattaacctgataaacacgattcaatttatgattgatatcaataagtatttgatttcaagtcaacgattttttctctaattaaaccaataaacatgattca

SEQ ID NO: 1712 - DNA, 1036 bp, Glycine max
  Soy_ogl_2426 Gm07:38498765..38499800 Cluster 7
gaagtgtctctctttcgctcctagtaataatagtaagaagaggagaacttcttagtggattattactgtgcattttttaaaaaaaaaacccgacgtaggaatatgtttaaataaactttttgaatatatacttatgaggacagagattaaaataaatttagaagagacagagtgaatctttttagtacgagtgttcttactcgtgggggctagagctaggggacttttgacaggttaagttatatttggggtgtcttaatccatcccaatgttatatattattttaaaaagtacattattttaaataattatatattaataatacaattttttgacttaataaataatagtttatttaaaatgatgctatacttataatttgataatatttatcttaaatatatattataaaatatatcttaatctaattgtatttttttaattatatattttatctatttaatatgttatgattaatatattatgccaacaagtttaattaaactggtcttgttttaaatattatggagtcttgatcgagtcaggttcaaatacataaaattgaccctaacaaaattttggattgggtaggaacatcaaggtcgcccaaacgacaggtagggtttaaaataaattttaaaagaagtattttgctttgatgaaaaaactctatattaaacttttttgttaatatatgtgacatttttctaataaatatgtttttttgctttataaaaatctaaaataaaatattttttttccaaggacctgaaacttatgttttatttattttatccttgaccgatacgaggaacataattaatccgtcccaactcaccctacaatttatcacaaaagttaaaaataaatttaatcacctcgatttatgcatttctcccctaattcatttaacctgaattagttatgtatacttcatttataactttagtttttctcttaaacattaatatctttttattagaaaatatttgttcttttgtttctctttatgtctattttgctacagattgtgttt

SEQ ID NO: 1713 - DNA, 1137 bp, Glycine max
  Soy_ogl_2659 Gm08:13394828..13395964 Cluster 7
taaaatcgatttttttttgaaaaatatgtattttgtggcaattgaaaatcacttactataaattacataactaaaaaactaatttaacctaaatgttactataaataaattagttcattaatagaagtggtgacaattgcaataatcaatatattcttcaccataattaactaacatttaactaatatgaactgcactataaataattgactatattagactggatgataagattaaaaaatgtctcaacaagttttgataatatagggacttaaatttaaaacaaaagaatagtctttgaattagtgtaataataaataaataatgtaaacaatgagcaaacattttggtccaaatacaatattacaagcatcttaacaacgtaaaaaatcatactcgatgagaatattgttttatttttaacatagatgagaatattgttatgatacatgtaagatattttaaaaaatatgatgttatgcaatgtaaaatatgttagacaaggaaaacacaataaaaatttgatgtgaaactaatttcggtactaaatacaaaaatctttttttaaaaaaaagtctcgtgtgaccacaaaaatatacacataataatatatgatactaaaccatcaataaattttaaaatttatcactaatcgcccattagctaatctaatataccaacatcaacaataactttcatgttctatttaaatactggattgtttagataaagaatttttttcatttaatttattattttagacaaataaaaaaatgtattagttatgttttaatattggtatatgttttcggtctttagtataagtagaatcaggattttttttaagaaagtagaatgagatagaagattgatggaatcagaagataacctagccaaatataactatattttcttaaaattaagggtacaatttaatgctttactaatatttatgtgaaaagcatcaaataatttacattttaaaggtaaaacaatatgtgataagaagttgtgaaaagtttgaagatcgatagttgtagctagagaataatatttgtgtacaattcaatcttttctgtgatatatttagacaagaaaaaaatacgttctttcactatattatttttttaatatttt

SEQ ID NO: 1714 - DNA, 1064 bp, Glycine max
  Soy_ogl_5058 Gm15:15309201..15310264 Cluster 7
tccaagagtagcataaaatgcctccgagttcttctccttagagcaagtcacaaggtctcctttccctgtatataaaagccacatatatagatgtattaatgtttatacgaggaaaacaaacattagatactaaaatataaaaaaaatatttacaaagacgcaaacaaacagcaaaaatgtttacaatcaaaacgagcgaaataaaccttttattttataggtataattagatttttttaataagataggtacaataagacatttaagcataagacctgataaattttaatataccatgtatcagtttatttatacttaaaatatcaattttttttatattttatgggtataattagatgttttttttaataagataggtacaataagacatttaagcataagacctgataaattttaatataccatgtataagtttatttacacttaaaatatcaattttttaattataacgtatcttgagtaaaaagttaatgattaatcttgaagatcgagattcatttaatacattgattttttctaacaaatatttttccatatgcccaagttagagatagaattctcaaccacatgcttaagagacaaaattatttatcaattatgtcacatcatattaataaaataaaaaattttaaaataagtattttttttaaaaaaatacttatttaataagcatataggatttacttttaaaaataagtagaaaactatttttttaagcataaacaattttaaaaaacacactagctcaatattcattgtaaaattgtatatattgtattatatgtttggtaattatacaacattgactagataaaaaaaatgtaattagcactttttaaacaaatatcattaactttaactatatattaattagttttctttttctgtcagaaaactttatttatgattcatataatatttaaaccttctttttttacccattaatctccaatggaaggtttaaatattacaagaatcataaacaaaataaaaatttatatgaattacaaacaaaaaaatatatatttctagggtgaaaaagc

SEQ ID NO: 1715 - DNA, 1500 bp, Glycine max
  Soy_ogl_6713 Gm20:30910401..30911900 Cluster 7
ttttttttcgcacccctttctttaatttgggtgttagacacttagaatatttttttttttccattccaagtttccaactcaccacacggaatatttttttgatttagttccataaacatattttttttcttcttaatctcatatttctcatatgtttatgtaaccatatgattagtgttgattggttatttcatgtcatgtggacatggcatatttttttctttttgtttttgaatacgataataattaatctttcaattatgatccgcttaatattttttattgtacatgtaaatatcaaattaaatctcttaagtcttaataatattttttgcatacgtacaatttataaaatctcgagattaaattgaatatcacaagctcaaggaattcaaactcgtcgaactaaaagtgatgatttcttgactaaatattagtaccttgttccagattttatttcaaaattaattttatgtattttttttctctaatttttatgtgtttcaacaattctcgatttctcctcaaagacacttttcagtttgtgtttctttttagatattttaaactattattttagcacgtgcatcacataaactaaatattttaaatatataatttataaaattccatctaactacaaattaatatataaatgaaaaaggttgattttttttggtaaaaaaaagaagaaaatgattgattttatttttcaaaattcatcacattcaaattatttctaaatgattgataatgtaagtatctttacacataaaaaatgttttttttttatcaaacttaaattcaattgtacagtgttttattaagaaagaaatttattttacttttttttattttcacataaattggaggtcttcatgtttcatatttagtatctattttaaaatataacattttcatcaaagaacttttttgctaattcctttttagctaaattttctacaaaattatactcgtaacaaaaatctaatttttcaagttaaaatacatttttaccacggtagtttaactttaagaaactctattagtcatctctcaaccttaatctataattgggttggttaatattatgccattcttattaaattatctaatgtagtaaataattaaagtaaatatttaaagatattctgtttctctttaatttataaaaaacttaaataaatattttcaagaatacttatcatcaatcaaccaaatttaattcaagggatgtttattgggattcaccattatcaaaaattatgttttttagacataaataaacttttcttatactaaatgctcctttaattgcctaaaatcaatcccaatgttaacaaaataatatttttatcataatatatattttctttcatgtgaagtgagaaatatatcataaaaaatttagatcaattattaatatttttgtcattttatatttatcaattattttaacaaataaatttttatcaaatatttataatttaataagatact

SEQ ID NO: 1716 - DNA, 1568 bp, Glycine max
  Soy_ogl_80 Gm01:3306201..3307768 Cluster 7
tagttataattatttattaaaatagtttataaatacaaaattacataaatggacaaatgtttagtaaaattataaacaaggttataaatttaaaagtttaagtaaactcatgagaacttcataaatttgaatgtcaatttgtaagagtttagttagtataaaaataataataaaatatttataagtaacatatcaattaaatatttttacatcataataaaataaaatagtaaatcataaaattcacaatatttaaataacaaagtctaataatgaatcattattagataataacttacataagtgatagtagcaggagtatcccaatcaaagatttgatatcgttaaaaagtaagaatttgatattattagaggcaaaaaaaaatttcaattcaggaaaacacacaaaatagaaatatattgaagtctaaacgcatagaaaataatatgtagttttttattataataaaactataatattatgtttttaaataatattttatttgttgctattattattatttaattaataaaagttcgatcatgattgtactattgaatcttgaatgagttcttttaccagttgaaggttttaaaaatattaattgaaataatttgtttgatagtgtatatgagagagaaagagagagaagatttatatatggagctaaggggtagccgggcagggaaacttatactacatgttttcaatgaggctaatgcttgttgtgcgggttatccccgacacctcatcctccattattctatgtctagaatccaatgtaaatgaatgaggagataaccaaaacaaaagtttttacaattataagtaataaactgataatcagtttagctcattcaattatagtattattatttttaaaattactgaacgataattagaatttcaaaaattataaaaattgattagaatatcaatttttaatatactcattacgcattctctgcaactttttcatgtatcaatttatgaatcatcatcctagccactttgtcttaattttctaaggagccaggttttgaacgacatttttgtttggccaggttcgggatttgacgtttgtacgtacgataaatgttttaagaatcttcagaaaatcaattatgtgtagatgactagatgccgtcatatttattgaatttcatgcacaaattaaactactttttgttaaccattacttttagaattaagaagttgattaaaataatgtaataataataataacattttttgtcaaaaaaatataatatttaatgtgattaatataatttaattttaataaaaagtatttatataagatatattagttattttcctttgtaaaataaagtttgtcttataattgatcaatttaaaattactacaaatatatatttaagataatcattataaaaaattaactatgatattagatttcttttataagctaatattatcatagtttaatggcaatgcattattaatataattttttttttacatttcctatcaaccaaaaaatattttatactaatttttaaggtgattattataaaagttcataaat

SEQ ID NO: 1717 - DNA, 1871 bp, Glycine max
  Soy_ogl_3731 Gm11:4701230..4703100 Cluster 7
atggtcctaattccttgcatacgtgtgcagttgtaccgccgtaatacgttaagatcatgtcgctaatttgttggcaagatctatctttccaattttatattcttacaccgccaatcccacgtccaacttatctgataatgataattaaattaaccaatactacttcctttcctttttaattatctcagagtttttgagaatttttattcttatttatctgtcacttgtaaaattcaaaattacattagttattattctatcaattatactctcacttgtctcgtaatttttaattaatttatttatgtgtttattgtaaaatgtaaagagaaagaaataaaaatgaaaaatttcacaatcattttattaaaataaaaaatatattatatttgttgatttctacataataaccttaaaaaacatatagaaagaaacggaaggagttttggaaatatttatgtatcatttgattatcgaataactgatgtgaatgactaatgtgacattgttaatcagtccactaatttaaaatattttttttctacaagattacaagtatttttcatgggagatcattttattcaagccaattatattaggaatgaaaaaaaatctctctttcactatatatgaaacaattttattaatcattgtctcccacattgaagtattttttattagtaatatatcatttagtattaccctataaaaaacataggtattattaataatttttcgtaagctaagtatttctaatcatataaatgtttaaagctaggtgagtacaatggataacacaacaaaaatattattaatatattaaatatcgtgattttcatttcataaaactttctacttattaattatttaatggctgtctaatgcgaaactttaattaaaaatagttaattaatggttaatttattattagtaggtgcatttttttattattgagcacaagtctcaaataattcccctcgccagtcgccatcagcttcaaagaaaaacactcatcatctatgtacgtgcatgtgcgtagaggatatatatatatatataaaagaattttatttgtttattttgaaaaaattaattactctatcttttttattttttttattttgaaacaatttaatagaattcacactcttcattgtattacattttttttaatatcctaatatgacccttataattatttttattttatctataataagtataaaatatttaaaaattaagtatagataagaaattctgtcaagaaaatataaataagaagaaattattagttttgtatattttttcacttttgaagaaatttattttattttaaaattttaaaatacattaattattatttcctcagtcatatccttataaaagtgcagggaaaacaatagtgtataatacgtcataatagaaatagaagactaagaaactacaaacaattttaaaaaaaatggagagattaattatattattattcttaatctatgcgctatcatcttaaaagataggataaacaaatgaaataatttaaaaatgtcaattatgaatgtttgctttaaatttataaatagaaacaaaaaatttattttataaataataaaaaaaagggagtagtatttaatatattgaaagcaaagagtagctgcggtgtctttgatatatacacgcacgttccacctttctcttgttgtttaacaagagatgccacgcatttgtccttcaatgtgttggaataatttacagtttagcggctgcttatctatatatccatgttttcacttttcactaccgtactaatcaatatatataccaccaacaaggagtgttgtggactctggtcatgcatgggtgcagcaacg

SEQ ID NO: 1718 - DNA, 1261 bp, Glycine max
  Soy_ogl_6415 Gm19:38285840..38287100 Cluster 7
ttaggggtgtaagtaataggggtgaaattatataaatggtgttatttaagtgtaacataaaaataagtgatttaagagttatttattttttctactttttaacaaaatattttattcttttatagtattttttgaagagatattatattttatttttttagaaaaaatatttgagtaatatatatttttctttctaaacgttaatatgttattattattttaaatgttaaaataattagtttatagtcaaatgactttattagcatttcatatatattaatataagaatttaaatattatttattaatctttgtccatggatcaaacttacaaacactttataagagactgataagttaaattttgaaacatatctataatattttatcttctaattatcattattttatattctttttggctttattgtctcgtctttgttcttcttgttattgtttgagagatttcaacgaattttttggtcacgagtgcaagagttcaaatacatgtactatgtaattcttagaaaaatatattatatatcaagttgcatcaaagataagttgaattttaccggtaaagttgtaacctttgttatgacaacattttccttctatttaccaactatctggaagtaaattattttcaacgttgttagctactattgtcgtaaaaaataatttagttagtagcataatttattaattccaagttaatggttttttaacataataagatttttcgtaataaaaatgtttaacataaatactattttttattataaattcattaagattcttgatggcacatgaaattggtgattgtaatttgtaattttgggtttttaaaaaatgtttaatttatctattatgaaaatatattttctattatagttcttagataatttagaaaaaatatataattatgattattttgtatgaattttgatatgtgctagttaatatatttattatatgaattttaatttttatatttggccccgtcattagatcatggatttgtctctggttggtgaacatcttgtgatatctgaaactttgacgatgaaaaagaaaagagaggaacaaattcattgtgcaagtacaatattaatcatgcataaattgttaatattaaagttatttaagatcgaatcatttaaaaaaatctaaacacaagtaagatggttatatgtaattatttagaataaaattcaataactaatatttattttcttattctcacgtaaaaacaaattaaa

SEQ ID NO: 1719 - DNA, 1276 bp, Glycine max
  Soy_ogl_3921 Gm11:36155025..36156300 Cluster 7
actgcagaagctaacacagagagtcaagggaaggtcatggcaaaaagtcccaaaaaacatctctctatcaacattcattctcaaatatgaagtttgcattggctaaatggatactaataacaataataaaaaaattaaataaaacctgatataggccaatatagtaattactgactgtgataatatgacattctgattttcatatcattatttaatctcaaaaccaaaaaattaaaaactttcagatagaaaaataaaagaaaatattaaataagtaataatttgaaagaaaaaaatagtatatctcagataaaaaaatatttaagtcaaattaatttgagtttaataataataatgataaatagaggatttttttaagtttcagacttcttaaataatatgttcaaaatttatattctataagcatatcatttttttattgtaaaaaaagcatatcaatttttgttttaaatttttatatatttcatttattttgatccctactatgttatctgtttcagaattatcgtcaattagtcatatacctaccattagcaataatatatatatataaatttaatacctatacactgaatttgttttttagtggccgtaaaatttaacagtttgtgttatcgcaacagaaacttaaacaaatgacaacagatattataggaataaaaaatgattttaatgaatacgagttcaatcaatacgtattatcaatgaaaacacttttatagaattaattaataagaaaataatatgattttttaaaagataattattataaaaatacataaatttattatttgtaattgaataaaagtattaaactactttcagtattcatgcctagtctatttttttataaagaatttaccactactaaaataaaaagagagaaaaaattaagtatcgataatataaaaagtttctgcttaaaaaaaataaaaataaaaaaatattaaatttattaatttttataataataattatcttaaaaagttatattggacgataatttataattataaaataaaattattttatattattaacgtattgtccttaaattcaaataaaaaatactttaatgactatacaataatgtaaattagactctcaatcaattaaaaatactataatggaaagttttatttgttttgatttaaatagagcatgcactttgtggtatatattttaactggagtacgaaatgtgttattatggatggatgttagattaagaggcaggttcggtagagttcttgaaa

SEQ ID NO: 1720 - DNA, 1100 bp, Glycine max
  Soy_ogl_4132 Gm12:37773901..37775000 Cluster 7
gacttgtcaccatccaacgaatttcggattccctgggcctatcactagaagggcaccgcataggctattatttaataatgtatgagttttttttgttttttagataagccattgttatttgttgtggcaaaataagttatgttaatatatggtaatagtaattgcaagtaaatcatcttaattaacttataattcaaatactaatactgtcagtgtcattatttatgttcatctgactttatttttatatgtatttatagacttaaatatattattgttttgtttctcaaatttaggttttattctttaaattcaaattatttattttttttcatttaattttaaaaaatactcctggtagttttttatgcagtaagaagttgtcgcatattatgaatctaaactacaaaaaatcagttaaaaggaactataaaaattatttttttaaaattgaaaataataaaaaataaataaatttagagacaaaaacaatctaaacttaaaaaaatatttcaaaacttttttatattacgttattcatcagattttatttttcatttttatctttctttttttctcaaaaatgtatatgactcgacggagagtgaaattacagcccatcccccatgcgtgttttgaggggcaacgacattaatcccataactgaaagggtccaaaagaataaaaaaataatgagagaaaaataattttcaatttccttgacaatgacttaatcgatctagtcggctttcttaatagcccttttctattactaattaatttcaacttatttaagcattatatttaacaaaattttaatttcatccaacaaattaaacatctttttgcatgaaatattttgtatttgtatgtaatttttagtatagaaaatcttttttttatctgttatttctatttttttatagaacatatgtttacaactttatattctacattaagcttaaatatggttttgatattttaaaggttactattattatttttttcataaattgaattttttttttacacccctcaattttaaaaaatgtttttttaggttatcttgattaatttttggcggaagcaaaatttggaag

SEQ ID NO: 1721 - DNA, 1263 bp, Glycine max
  Soy_ogl_4426 Gm13:33471901..33473163 Cluster 7
ttatattgtgagcttaaatatgtgagcttttcacagtagtggggggaaagtatatgattacttgttatttttcttaaatttctaagctttccacagtaaaaaaagataaatgaatttgtgagctttaattattacgtaaatttaagaattctatataaaaaaattgaccttaatcattaagattgttaaaatgagtaactaacttaaattttctcatttttctgctaattcttggtttcaaaaagtaattttttattgataaaaaaaagttaaactacgttgcctatataaatcatggtgattcttgagcaactagcataagtaactatgttttcaatgctcttaaatttaaagattaatttaattaaaaaatatattaaagtgagtttaacatcttttagtaaaaaaattgcatatacaattaaaagttaaataaaaataaaaaattttaaatttttatttatttactaattatatcaaactttatcaatcacactagttgagttggagaatcgcacaagtaatcacaattacacggcatgaattctttacgcctagttttcaatataaatattttttagagtttaatatttatcatctttatgaaataattttatcctatcatttaatatatagcattatttgaattattttaaatattaataaatttattatatataatagattgtaatgagatgtataactatttttcttgtttaatttttaatataaaaatgtaagactatacatatatacataactgaacccggtttctcaatcaattcaacactaatataaaaaagtgttttccattctcattgaagtacgagaaacaatgaggatggtttagggtgggttttttttttcttgtttaaatcacaacatatatttttattttatttatttataggaattgaatatgataacaaataatttataatattctcacatcctttttaatcagttaatcatttttatttaagctgaataacaatttttttataaatatttaatgtaattatatatttaagacttaaatttatatttgattaaattataataatctcaaattatttagttattctcgtttatttttttaatggtaggcttagtttggtttgtttaaaagacataggtgtaaaaaattaaaaaccaaatctaattctatctttatctgaggtagaaaaccttagggaaatctatttaccttttaaaaaaattaaattacttattgtaattttaaataaattatatattaaataa

SEQ ID NO: 1722 - DNA, 1685 bp, Glycine max
  Soy_ogl_5037 Gm15:13259501..13261185 Cluster 7
tttgggtttaaacttagaactaaagtctctaaaaagaccacgtgagatgaattaagaattgtagggataattggtttaaaattttcaaattattttatttttcaaatttcttaccgtaataatctttttcttgtcacaaatcattgttataaagatttctctatttccattgattattttgaatttattttaaattgatcgagagtgattttaatttactcaaggattcaccatgctttcatttttttgttagagttgaatggtcatatattaaaagtgtaaattaattattattttatattattattcaatcacaaattatctttaaaataatttttaaaataaattaataaatttatcatttatgataaattcacactgtcaatgcatagttttttttttagtatgctaaacatttaacatgtatgcattgtcttgtttgcatgatgagtagttgaatattattttaaaattaaaaataaaaataagaaattctttgttataatactttcttgtcataattgttttaaattctcaatttactttcatttttttctttatataataattattttgttatcatgaatctaattgttttaaaattatttcagatataattgattgtaattttgattgataaaaaaattgctttattatcaatttatcatcatatggaatactttacatttatatattatacctgggagatgagctaattgagcgtgattctacaatttaaataaactaaaaaaattaggaaatagaaggttatcttgtcttttaccttacacataaatagaatgtttatcttcatcctatgtcacattttcagtcacgtgagactagtcattaattatataatatacttataattaaaaaaatgaataaaaccaatataaaaatataaataattgcgtaaaaattaaataagatcatatctctttcaaatatcaaatattcaaagcttattaaataaaattttaaatgcataataaatcaacaaaaactaaataaaaagtcacatatgctaaaactcagataaaaattcaagaaaaagacactaagttacatatgaaaaaatgaattgatataatacctttttataaaataataaataacatgattcattcacaatttttctccatttttctcataaaatttctacctttgttaactacagaaaaaaggaagtcatgaaaaaaatgatgtataatatagttgtttgcatgtaagataagatatgggcattcaccaataaaaattatgtaagatatctttttttataaattataagtatcctctccatataggttggaacaactttgatccatcccaattgatctacgtattttgtacttatgtaaaatatgttttaagaaaataaataaaaataaatatatagtgaaccaaaaaaaacattgatttacttatagtttattttctgttttcatcaatgatagatatgtcgcaaacgagtcatatttagataaaaaaaaaaaaaacactaaacaatgagtgtgcaatgattgaagaaaaaacactgaaaggaagaataatatttattagccaaaattattataattaattcaaaactacataattactttattataaaaaaatcttaactaccttaattaaaagcatatatgtgttgatcataattaaattaattattccaaatcaga

SEQ ID NO: 1723 - DNA, 1100 bp, Glycine max
  Soy_ogl_6861 Gm20:39328101..39329200 Cluster 7
cattaaatatttatttatttacttttgtttaagatcacatattttttacatgaatgacaatctcacttgaaaatataattatcataaacgataaaaaaatttattttaacatatatatacaaggacggaaccttgttaagtgctacagcggcagtagccctcatacattaacaaaattccctttacatctattttcattactatatatttgctcccttctcctggcagttggcattctatatgctaatattacctttcttttactatgacacaactattttaccatgttgatacatttattttaattaaaaatgtataaggctgcatggcagcacaagccagtgtcattttcttcttttacttgttgctgttttatttttaaaaaaaagtttaatagttatgcttgataatttaatattataaattaattaaaaattattgtcaataacatttaaattaaatattatagaaataaaaaacttatcatatataattatttataattgaataacaatgtaaaattattttaataatattattagtgtgtagtttttttctgtttattttatatattttatttatagcaatattcatgattgattcatgtgttaaatttttggtcccaaacaaaaattattcgtttcatttctgtttctacacctaagtttcaaacttaaaattattaattaagctaaattaattcatgatagttgatttacacgtgtatatattcaacttttttttacttatattgtacaatacacatttagaagtaaaatcaacctttgacacatcaaactaagttcattataatgaattaattaaaattaaatgtaataaataattggttagacgaaataggtaaatcattgtattaatttatttgacacatgcatatttcgatccaatctggtatcattttagttagattttaatcagatatttattgcttattattaaagtcttttcatatctaagatcaaattcgatagctggattaaaattaagagtttatttttccttaaaaatattattattacgactttataaaagataactactgtcccaaaataaatttcgtcctaaattattttacatgc

SEQ ID NO: 1724 - DNA, 1400 bp, Glycine max
  Soy_ogl_6919 Gm20:41911701..41913100 Cluster 7
tcagtttgaatttaattttctatgcgttatttgtaaaaagaaattattacattgtgaatccaataaaatttgaataaatacaaattttatataaaagacaataaactaattaattaagaatacattgctgtgagtgtataaactatttagtcattcaattttataaatagaggtatgatttcgttttgttcttggaccagtgaaatgagaaatgaaagtggaaatataataaatttatttacattttacaatggagatgttatttgtttaagggttaaacgataattttatcatattcattttcttttacttttattcaattcaaatgaatacatagattttcttttgttaaataaatttttccctttatttttttctgtcatttcaaatattttaaaaattaatctattttacattccttttatttctttccaattttttttcatccaagcatactataagttctttgtagtgaagaaacttcttttatttatttatcttcattccagaaactgtattttaagctttcacaaatcacaacttttttgtagtgataatttcattttctatatttttcagatgaacaaattgagtataaattaaataatatagccataaaatattcatttatttttatttaatacacggcagcttccttctcaaaggcatcataatatctttttccctttacgttgaaaagatagttatcaaaactttcagtttgatctgatgcatggaaatgtatgtataaaattacttatcttatattgaaatctcactttttatttagcaaaattagttggtcgtgatcgaattataaactacaaacaattattaaagttcaaattattattaagtgaagtcttgtgaataattaattttatactacatctctaaatatgacttcacatagaattttctacttctagacaatcctgacttttcttcaaataacttttttatggagtgctcaagagtcatgactaataatttaataagaaacaaaatttaagcgaaaaaacatgcgctgcatttgcaattgtaattaaagtaaacttatcataaatgaagaactaaaattgaaaaatcgtttgaaaagaaaaagagatattatttaggttacaaattaaatctcatctaaaagaggaaatatttatttatttatttcgttgtaactttttatttataccatattataaaaagcaaaatgctgactaaggtgttcgaaaaatcatattcacatcatctcatgctagatacgtgaaaaaaagaaggatgacaaaataaaataaagcaagacaagcaaagttcaaaagttacaataaataaagaaaaggttattgcgagaataaaaattatacttgtgggagttccaaagtttgtagttaactttataaagt

SEQ ID NO: 1725 - DNA, 1004 bp, Glycine max
  Soy_ogl_3280 Gm10:481058..482061 Cluster 7
aaaggtatcatccgtttatattaggtgtaagtataaagttttacattaaatctacaccattaatatatatcaatcctatgatttaaaatatcttaatagatatgaaaactttaatatattttatgataatcaattacttaactttaattaataaattagatcacttgatttttctaataaattatttatcaaaattactgacaaaaagtaatatatttttgtaataaagtttctttatttattattttcataacaacatgcagttttttttttcctttttgtgattcgttataaattaagtacacttattggaaaatagaaaaaataaaataaaataataatgtaattaaatttaaacttatttataaaatttatgatcctgtattctttattttatgcgttttattgtaaaagcattatgtaatatttatttatttcaatatatatacactatccaaaacttttcattttcaagttttattttctcacaattaattttaaaaatttgtaagacaaaaaacgaattaattattaacaaaatatcagaatatatttattgattatatataatgaaaaataaaacatgcatgataaaaatatatttgttaattatctttctctaaacttttaagaacagtagcaacctgctgtattggttcttaacgaatcattaaaataagttgttttgttttactgacattaaaatatgttgttaaaaacgaatcattaaaatatatgtatattacatgaaaataatacatacatcattacgtgaatttttttaaaaaaacattaatttgttaatatttttttttataaatagttaaaccaacaaataaaatcaatcaagtaatttaattgattgattatacacttatatatgattaactaattgatagtcataaaacatgtcaaagttatcatatttattaaaatactataaatcataagattagcgtaaattaacggtgcaaatttagtgtaaatctatatgaacacgcgct

SEQ ID NO: 1726 - DNA, 1429 bp, Glycine max
  Soy_ogl_5162 Gm15:48760172..48761600 Cluster 7
cgtattaatactttaaatttttaatgaggcatcttttcattacatgttaacttttgcaagaatggtgcaacagcaagtgagatttaaattaaatttaagagaaatttacattaaatcttttttaccatgaggtctttttgttattaatatatgtgactatttttgctttatagaaattaataacaattttttttttgaaggatacactattatttatagtatgagtgtgttagcaaattattttattggtgcattttaagatattctaacatactcatataaaaaaaataagaatgtatatatattaacaaattccacaaacatttattaacatattaaaaaataaggatatatattagcaaaacccacacacatatattcaaatggattcttataatttaagttaatagaattttaactactattgatgagtaagaactcaattaaaattttagaaatattaagagttaattaaaaaatcaaaaagttaaattatttcgtaaattttttaactatttgacaatttttaattatgtctttgagctatttaaaaaaaatgagtcattgatttttttaattaaatcatttcgtctatttgacatgacaaaaaataactattaaagcataattaatccttaaatataatattgtcacctctacatgttctaaatcaagtattctcaatctagttctttaacatgtattatcatccgtacaagttcattcaacttaaatattattttataagtctttccgctcgaggctccactctacaataatcttgttgtgaattcacacaactgtctcaaacaattaattttatataactacagttagatggaaggacttaatttaaaagcaaatacaaatttaagaattcaattaaaaaaataattaaaggaactatttaatttttttaaatagttaactaattaaatttttttaaatagttcagagatctatggagtaatttaaacttttttttaaaattataaagatatattacaaaaattagtaaatttgttgtaacttatagaataacttaaggactattaattgcataagtatttattatgtaagcatttactcgtaatttcattttataataaaaaatgaaatagagttaaactattttcctataagatttagttgttttcatcatttataccgaaaaacttgttaaaataagttgacgacaacttatgaacatattataaatgatttttataagttattttaaatatttatacaactactcgtgttaaaagataaattcaaataaatcataaatatattctatatatcaaaatgaactatttaatcttacttttattagtaggtttttgtaagtatttaagtaaatcatgaagtgtggtgaaatgcaaatttagatatatgttttatgatacttgactcattttataagcag

SEQ ID NO: 1727 - DNA, 1800 bp, Glycine max
  Soy_ogl_5409 Gm16:32164001..32165800 Cluster 7
aaattctagttgtgaatgaaaaaagatatataatcaagaagtaaatatgtcaactggacacgtcaatgatggatttgctcatcaccccatccacagtaaaagataggctagttcgagttagatataaaagatgggatttgaattaaattttaacattcatcctattttttttttttttttatcgaatttctatctgagttcacataaacttgtgactagcccaccacaccatttatatggtttgattttttatttttttataacggggaattatatatagttttaatatatttatatatttttaaataacttatatattaagttattaattatattaaaagttaaccatgtattgctagattaatttacatcaatattttttttcatagatgcatataaaatttatctattctacttattattgtacttctataatttggtcaaagtcaataatcttatttcaaacacaaaacgtattatgttttttctttttgtttttttttataatgtcacttataaataaggttaatctattcattgatagatgtcactaaattttctcatatgtatctttttttccttaaattataagtattttttattaaagttaattttattcgaatcaagatataagattactatggtaaaaaaaaaaaacttttcaattatattttcatgactcaaacatcaaaataatatattaaattgaaacaaccacctactagttaatcttagaaatagctcggtaatcatttgatctcttatatacaacttgaccttaatgtccacgacccaataaaataagaaatctagttcacccaaatctacttaattattgcaataaacacatgaaatctcacttttccctcttatccgtatctaaactaaaattatcaccaagctctgggctcaccctaatctactcaattattatactttttggttgatctatctagctaacaattaagaataatcaaggtggcaagaacagaagaaagcatctcttcttccacatccacggttatagagagagaaagaaagttgagtgtagaataaagtacataacataattcaggaccaaatatttagcataatttttttgagttaatgcataaaaattgtattttaaatgactatttaacagaatctctaattgcttaaaaaaacaaaacggaatctgtaatcatataattaattgttacttaaaggtacaactcaatgtaattaagtaatcatattaagtttttttaattttatgctgagtaatcgtatcaagtgatgtaagtaatcatattctaacaatttttttgttataatgcatacttaaaagttatcattaaaatattaattcgtcatagtctttttctagtagttcacctaacgtatatattttatctgatacgcgaacgtcaacaaatataacattaccacgtcaaaacaacatatgtcaccccgttaacggcaaaggttatatatatatctttacccacccccacgtgtcgttaccatattgttccctcaaaatatcatactattacatttagaattttgtacaacattacaaagatacattgatgcaaacatattacataacagaagattgttggaataagagaagtggctagttcctcacaattttattttgcacacataagcaagctttattgtattagtaaaaacagattgatataattaatatgatattacataattggtagttaatttttgtttttttaaatatatgatgatgaggctaatttttaacttgtgtatataaaaaaaaacatatgttaaagagaa

SEQ ID NO: 1728 - DNA, 1013 bp, Glycine max
  Soy_ogl_4958 Gm15:9540801..9541813 Cluster 7
ctaatatgggaacatgatacaatatttttcaaataattaagggatagtatagcgaggggcgagggctagaaaaaaaaataaggtatgtgaaatctcacaaaattttaaggaaatcaagcttgattggttgagagtgaaatatgtgagtgttataaattctttaatacttatttttaatttttataaagaaaattgaggataaaatatgtgagtattataaactctttagtacttatctttaattcctataaataaaaaaatcaccaaatttcaagtggtgttgatataacccttttttttaggaggtacatgttagtataacttattctttttaaaaataacaatatggtatgtgaggaaaaactaaaggtaataatttataattatcatttcatttattatatgtaattatctacaggtacaaaattgataatatttcaaaaaatattaatttgtaattatcattaatatcatgtgagtgagcgggcaggcaggtaaaacaaaataggtgctttgtgcaatttaatcaaattttaagggtgtgaatataatttcctctttttaaaaacaacaatatcatatgtgaaaaatgaaaaaaaagttattaatttataattattatttcatttattatataattttctattgggtacaagtttgataatattttgaaaactattaatttgtaattatcattaatatcatatatttagcaaattatatgtcttatataattaaaaataaacaaaattatataaaaggttttagtatgctcatgaattgtgtgtctcagctggcatgccggtgggtaaaatatattttcattcttttaaaaaaatttaattttaattttagtctctcgaaaaaaaattatccattgttcgatttagaaagactaaagctaaaagttaaattttttaaagcactaaaaatattttaccttatatatgtaagatttcaatttaatcagttgaaattgttaattatataaaaatatcatatgtttctatacc

SEQ ID NO: 1729 - DNA, 1328 bp, Glycine max
  Soy_ogl_824 Gm03:3514601..3515928 Cluster 7
tgatagaatcttcttatttttattgcttatttccttattatctttctataattaattgcaactcaaaccatttttgctcaaattcaaattgctaatataggagaaagttctaataatatcaaagaaagtaaaaaatataagcatttgtggattgaatgcaaaaattgttatggattaaattattaaaaaaaaaaagaatttttgtgaacactatgaatatcatttgaaaatggatcattcatataatttcctataaagtaattattttggaacacaactaatctttaggatataatatttggacttaggttcatgatactaatgtgtaggacacacttacttttatagaatcttaatttaggcatcatatttcttaaatttaatcatttatatcatatttaataagaaattcattcagaatttcgtacaagggtattgagtgagatactaaagatatcgtgatcttttcacaccattccaacttttctttgaactcgaaatagttcaattctaattatccccatgggaaattttgtgataaaaaaagagctaaaaagcatatgtagggagcaatttctttttattacctatcagacatgggaaacaaacatttcaaatttcgaacgttagaaagttaaaaacattctcccaccaaattataagagtttaattttgatgtgatagtgtagagatttttatatttgaaaaatgaaacaaaactgaaaaatgaaatcacataacttgaagcaaaactgttccttagttattgatgaaaaaattgatagttaatattacacaagtacacgtataaatcatgcatgcatgtttttaatataaactattgactttttcatcaacaacttagattattaattttacgaattttagtaaggcctgtacaatttggatatataactgaagataacaatttggatacgccacgaaaaatttgccaatgaaaggacgtactaaactttgaacaataaaattaaaacacgttttttgtgataaggacgtagatatgcagctagccaaataattcgaacgattgattaaccaatcacttacaataatactaacgattgccaataacatgtttttccatacacacagtaataaaaagacaaataaaaaaatatccttatataaatcaaaaaatatccttatatattatatatttttttatttttgtcttttactactgcgtgtataagaaaacatgtgattgacaatcgttagtattatagtaagtgattggttagctgcatatctacgtccttatcacaaaaaacatgttttattttgtaataattaattttaacctaata

SEQ ID NO: 1730 - DNA, 1100 bp, Glycine max
  Soy_ogl_921 Gm03:37247601..37248700 Cluster 7
acttttatgaacaaactctattgctcatttaaaatattcacctgagatttcaattcatcgtctatacattttgttttaatgaattttgttggtcctacaaaatatgaagccaacaaatctcggctctgcttggtaggagttttttttcttctttaaaaaataaaataaaatggcaaaacataattattctattagctaatttatctctcttcctaggtaaattgccaatatgataaaggaggaggattcttacaatttctttgactcggttagttaaaacaaatttaatttgttcttacttaatcaatctattttgtttggttttcagacgtgatgattcaaagtaaattaaaaaagtaaaactaaaatattcctttgtttgattttcatttatatctgattgtaaattaagttgtctcaactttacgctaaaactcattctaaaataaaaaaggaatgaaagattactttaacaaattcaatttacaaaataaaatttatttaatcttaaatttgtaaactttaatataaagattactttaattatatctgattgtaaattgagttgtctcaactttacgttaaaactcattctaaaatacaaaaggaatgaaagattacttttacaaattcaatttacaaaataaaatttatttaatcttaaatttgtaaactcttcactataaagatacatttaatctcttaagctaagttagtatagtgagaaaactttgtactagtctggtcatgaggacttgcgtaaacaactacattatttttaactttttaatatatttttattattttttattgtgatccaatcaattaatcatgtattattttttttatatttttgctatcatttagtcagtgcaagtgaattaaactcatatatgttgacaatgttatctatcactctcgagataaaactatgttattgttttaaaacagctgatttgtttaaaaaaaaaattaactgcaaatctgatgatccaaatcgaattattatctgttttccattgagttaattcggtttaaattaaacaaacaaaaaatacagaaatttaaatgaaatcaaaccaacaaaaatcaattaattc

SEQ ID NO: 1731 - DNA, 1003 bp, Glycine max
  Soy_ogl_2410 Gm07:38120101..38121103 Cluster 7
caatcctagctttgttccatggaagctgaagaacaaatagattaattgtataatattaatgataagattaattttataatattattatttttcatttatttattaattttttttattttaaataatctagaatcacaattataaagggactgtgagagtaataattttctgttgattagtgcgtgatcttccaaacatttttgcattagaatatgaattgcattgcattcatttcaattatcaattcttttccgaaaaagggttgtttgtttctactttcctttctttttaatggaatattttttgttggacggtgaattagaaatacaaatatcctccttctgcccactttccactaatagatgatttaatttaccaacaaagttagtgttaataaaaaaaaatatcacaaaaaatgtaaaattgattattattatggatgtgagaatcttattagtgagtaatttataaatatttgtgtgtgtgttttaaactttgcaaataaaggaaagtgaacaggtcatgaatcatctctcaggtgacttaaaatagaactactagttgccttcctatggtggtgtagtatatttagtagataatcatactcttctaatatgcaattagagatttgattttaaggttcatgtatattaaaaacaattattaagtgtttaacttcttaaatgggtttgaatatttccaaaaaattaatttttgactctaagagacacattggaaaataaaattattgattttcctcgctagaaaaacaaaaagagaaaaaatcatttcatctacgttcagaggagattctgttcaagtttcttacctttgtatcggtggatctaacttttagtctgataaaaataataaaggttattgttaaaagaaaggattttaatttttatgtattatcagtaaaaaaaattatagtatcaatttaattgaaattatgaaaaatataacttttaaaaaaaattatcaacaaatattaatttgttag

SEQ ID NO: 1732 - DNA, 1400 bp, Glycine max
  Soy_ogl_4152 Gm12:38611401..38612800 Cluster 7
tttgtttactgaatgcctgcctagtgttatttggtcacacttgggtaatcaaagaatcattagctgaaaataatatgaaatatcatggcatctatgtctagagaaatcttttgccatcaatgttgtcaaggaatcctttgatgtcatgtacactataatattcagataaaggttggaatcttttattctcttgcatcaacactgcatgaaaaaataaaaggttctactttattagaacttatataattatgaattatgaatgcttataattttcttctttgtggatgaaggaaatcacatggtcgtctcgattcaagatcatcacgtactgacgtacatatacaccatattttcaaaatgattttcttactaatattgttaggttaattagagtaaaactgtatccgaattcttaaacaatgttttgaatttaaattttgtgggaaaaaaacataactaaaaggagagattatattttttttaacaaagattaataattgtaaaatgggtgagtactccaacttataaagtgatacaaaaaaaatatttattatgactagcttatcaataaatattaagtaaaaaatttatttatagaaattaaatttaatatttttttattaataatgtttgattttatgaattaaattaatcatcattactaatgctaacttacaaccttgtaactatatcaattaccacctgattctatttctatccaaagaaaacaattataatttatcaatgagcatgttgttcccgaataacccataacccattaaattacaatgactaacatgactcctaatttactatatcattttttttagaagataattgatttgatgtttaatgtatatttgaattgatttattttaaaaaaaaacatttttcacagcatgataagatttttcatgaaaaaaaatattcttataattaatcttttcaaacatgctctaaatatcacttaatctcgtcgttaaagataaaaataggtcaaatcgttgacagaaatttatgacatagtttacggtaggtcaagatcatattaaatctttttcaaaaaaataaatgagaccaaagtttttagtgaaatcattttgctaaacaagtcactgcttacatcattcaaaaagtcttttatgttaacatgttgccctatttaaaaatttataaaaaaaattaataattgttagtctattattatattaatttgttataattattaaaatcttacatttatttatattttttaatctttgatcaacataaaaaataaagctaaagtttatagttaagtttattgaaaaataattttatgccatatttaaatgttttattgtgaaatatatttttaaataagagtgaatgttatattaaaccttaaaaatatgtttagt

SEQ ID NO: 1733 - DNA, 1644 bp, Glycine max
  Soy_ogl_5023 Gm15:12804977..12806620 Cluster 7
cttaaaaattttttgttttagtccttataaaagtccttttaaaaaaaataatgttaactagcattgacatggcactaatatatgttgtgttgtcaatggcattaatgtatgttgtgctttacatagtctttatacttatactatgttatgttttggtcttatagttttacacttttccttttagtctctatataactttgctccttctatttttctaaatctataatttttgttctcttatttcaagatagacatttaatcttctttttttagaaaatgcaaagtttaatcctcaattttgcttacatattttatttcttatattttaattaattaaatcatttattgatgacaccttaaataaatatattaggtctaagatttaatttgatcaaaataaaaaaaaataaaacatatgtaaaattaaaaatttgactaaaattttaaattttttaaaatatgagaatcaaaattacagattaagtaaaagatgtgatcaaaattgtatttaagaagaagaaaaaaagtaaatcttagcaaattcatatttagcctatgtagttaatgacttttttaaaaaaaaagcaagtaataaaaaattatgtaacaaagtacaataattttaaaactatttacatggattgtttttgtcacctaggataatagaagatgtcattgtcacttaggataatagaagatgtcacgtaggaaaaatcatcctatgtttttgtttttgtattgcttgtttacatttgttatatttcaaccaatgtaaaaaaataagacaaaaacacctcaggtcctaagtatagttttaaaactagtctactttggtgcataattttacaatagttatatttcaatcgatgtaaaaaaacaaaatgaaaataatgcatgacatttaaataattttaaaatcattctactttgttacataattttttttgtttgtattacttgtttcgtaaatagtcattttttcaagccatgattacagtattcacttttagaaaaccaattctgtgttacaataattgaattcatattcaatccacttattagccatgtgtaaatcgtcatacctttattttatacgcccgaagtcccaaactcatgtcaaacccaactctcttattgcctgtttgtttattagtttgctacacatgacacacgtttccaaaaaaattggacaagcgtaatctagaatatgatgaatgcatggaagcaaattcatcatgaattagcgttcgcctaagccataaaacaaatagagccacacaaaatggtattcgtgagtcaaatcaaaagtttacatcctttaccagccgtgtggaaattccccaaacatgtagaaggaaacgcgaaaaaccaaggacaaagaatgcaccaaccaaaaacacatacattaagattttagttgtgcattgcgccagtaatgaaaaaccaggtattaccacattcaattaacgataaacaaatatttttttttaaaaaaaaagtatgataatataaagaattttcttatgttaagaaaatcaagagagagatgagggaccaaaacattaaaagagttacttcttttcttcacttctcatctaatgagtaactcattttatatttaagttaaaagagaataaaaggtga

SEQ ID NO: 1734 - DNA, 1130 bp, Glycine max
  Soy_ogl_5335 Gm16:7181719..7182848 Cluster 7
tttctcatttttatcatttctttcataattttaagaaattaatctattttttaacttttataaaaataaaataatattctctctaatgccattaaaactcaattaattttcaaccaattaaatttaacaaatatatgtacaccttttttttagtaaactaatccgtaaaacaaaagaataatataatagtttttctaaatcaagtcaatgtacgtttttcgtctaattgttatatacttattatattaatataatatagaaaataaaattagtattaaaataaaataatattctctcaaatcaagcctgtcaataaaactcatttaattttcaatgaattaaaattaatacatacaactattttttttagtaaactaaaccgtaaaacaaaagaataatataatagttttttcaaaatcaagttaatgtacatttttagtctaattattgtattaatatattaaaaataaaattagtatcaaaataatttgcaaagtatcttctcacggtataataataaatataattgatgtaatatattaaaaaaaatattattaaataattaatagtcaaaataatattttataatcataatatgttagctagatattttgttatatttttcatagaatttatgtacaattataacgctaatgctttatgtttttttctataaccaattattattgtgttactatatattatcataaattttaaataattattctgtatgtttatatattgaaatgttttataaattttcgaagcaaatatacatgtatgtatttatgtgttgtgttgtgtgtataatgctagcataatttcttgtaatataatattacatagtagttagtcgaagcccttgattacatgtctatataacaagagtttatatatatatagttgctatgttgaagaagaaaaaaacgtgacagagactttgatgcttgattatacatgaataaatacatattgttttgactatgatgtctataatcatatattaattcaaaatttattaattatatcattctcttttgattgatcattttacgttaatcacttgtattcttaattaaatagtacatgagactgaaatcttcaatgcaaattacttgtattgataaatt

SEQ ID NO: 1735 - DNA, 1071 bp, Glycine max
  Soy_ogl_87 Gm01:3647801..3648871 Cluster 7
tatatttatttatgaaccaatatcaaaattatttaaatatatgtaatgctaaaaaatatcagtgtcgcaaccgcaatcaaaatcaataaaaacgtcctcttaaaaatagaaagttgactcactcagttaaatcttaaaggaagcttccgagagagctgctataagctctttttccatttattagtttagaaagagtagcttacctttcaggtatgttattcctttcctcaaatgatgccatgtcatatatattaaatgatgatatattatcactttcattaagtgaacaagtaatacataaacagtcagaaaaaaaaataatacataaacaaagaacaaaattttagtaaaaagaaaagcaaagaacaaaattgaagtgaattttttaattaaaaaaactgaagtgaattttttaattttgaggactaaaatgaaaattgaaatgctagaaatatatattgagaaagaaatcaaatggtaggtacgtacaaggtatttaaaaagtaatgttgtaatgcataaaacgttttgtattatatataaatataatttttattaataattataaaaagtcagattatttattctccatttttaatctaaaattaaaatcattcttaatttttacaattccttatgtatatatttaaaaattggaaataaaacacattactattattaatgaaacaagaaatataaatataaaacacgttaatattattgccaatattatgatagaattgaatttgaatccattaagaaatgtctcagagttaagtatactcataatttaataaggttgaaagcagaggaatgatttaaagttgatcaactaaactttttgacatatattaatcatcaataaaggttataaatacttcagactaataatataataaaaaaaataataaaaaattgcgtagactccttttaagatgaggaaatattcataaatttttttaattaaaattttttcaattaaaattttttccttttaatcttgtcactccaacatatattaggtgttcttttattttctataaactcaatacactattattataaatcaat

SEQ ID NO: 1736 - DNA, 1183 bp, Glycine max
  Soy_ogl_164 Gm01:44839901..44841083 Cluster 7
agcagtcgtcattttttatagtttttacttctcatttaataattttcttctaatttatattaaatcaaaaataaaacctattagaatggatgattttcaataaattataatcaatgataaagaataaagaaagcatttgatagaaagtgtttttaaaacagacttttagactctgttctttaattttttttatatactatttgccgttatattaaataaccctaatctctaataagctcgaccaaatatgcattatattaatgaataatatttattatttatgataagaattcttaataaaacatagtttatgatttattcataattaatgcgcatttaattcttatgtgttaaaaaattagaaagaaaactatacaaatatatttttaaaaaaggtatcataaattgttttttttactgcatatcataaattgattgaaatacttattaagtgaaaataaaaaaaacttctgtaaaaaagtgaaaatgaaaaaaataaattatataaacactattttagcattcattttattattagagagtcatgattacattttgttcattatggattagttaaattctcttccttataatgaactgacataaaataaaataatgttgctgaaatgataaaataatatagctaaataaaattttgatatgctacttttattctctaaatttttatattttatatttttttcaagaagataatatgtggttatattttttaatgcttacctacaaaagtatatttattaaacatttagtggagtatttattaaattatctaatatatacattagtattattgaattatgttcaaataaattttttaaccttctataaatttttgtgaaaaacaacatagcactttttcataattcttcaatttatttaaatgattttatacataataaaatatttataaataatatttaaaattaatttttaattaatttttttgggttttgacagttaaaaatttcaaatgtaataattaataaaataaaataaaatattatcagtaacatttggaaaattaataattttacaatttttattctttaaatctaatttttatttattgaattatgttttaaatcattttttaaactttaaaaaattattaatggaaaatagtatagaaatttttgaatattttatcttttgtgagtaatac

SEQ ID NO: 1737 - DNA, 1300 bp, Glycine max
  Soy_ogl_319 Gm02:1962301..1963600 Cluster 7
tgtaattttcacggtggtaattagtttgagacgagtaaaattatttatgatcgactagaacttgaaataacttattatgttgaaataatgttgtgtcagataatctatgctttcggtgatagaggaacagcaaattattaactttaaaaagattcaattattattttaaacattaaaatgcaatgctaatctccctaatttggattatgtgctttttgatctccaagttttagttatttaagttttccaattcttaaaattgagtataaatttaaattatcacgatcctttacttaaaatcctcaaattgtttattttcttccaaatatttaacggtttgtgatggttttgtgattgaaatagttttgaaaatttagaagaaatttagtataaaaaaaattgataaaatttgaggaatttcataagatgtaaaattaaggtcttcaaaaaacaacgcatcgggtgaaatatgatattttgttaatttggtgaattttgagtcaaagtcaatttaatttaaaaattagtaaaaataatgagaatttaaggattttaagtacaagtaagagaccaaatttacttaatttttaaaaaagtttaataataaaaaaaatatttttttataaacaacaagtattacttattgtaaaaagagtatcttctaattgagacaatcatatttgactcaagtaaaattattgtatagatgataaaaaaatttctttaaatatttaacacaaatgtaatgattaagttgaaacagcattacaccaattgatctataaatttggtggcaatatgtactctaaagataacagttaaaatattaaaaacattttttattaaaaaattttataatgtatttttgcataatttcaatgcccctgcaacatatttttcgatatatgttttagtaatttttggacaagtattttttatcaacgttaattgttaatttgttaatctttattagtaagaagaatttaaacccatgacttttttcctatcttttctccctttaccaagttaaccttatatcttttttctttttttacaagtatattaagtactggttagtaaaattctcttcaaaataaagcaacttaattaatttataaaaaaattacaaataaaatcacatataatgtgcactagtggaaccaaaaaatacttttaagcatatattataccattatacaaaagcttagccaccagtccaaaacatataaaaagaatatgttaaaaaatattttatgttccaagatcgatctttcactaacataaatgaaagtgtgatata

SEQ ID NO: 1738 - DNA, 1095 bp, Glycine max
  Soy_ogl_846 Gm03:4606879..4607973 Cluster 7
caaagtatgaatagactcacaactgataaggaaaaatttctgtccaaattagcaaaacaaagtggggtagaagatatctctacttttagtttcataaaaaataaaaaaaatataacgtaaaaataaaaaactaaaaaaatagttttttgttaaaaaggaactaatagaatgatttttttaattaaattttatctttttaaactatcattaaacattcttcatatactttgtttatttctttcataggcttgtttcttataatttttgtaaagaatcattttaattttaaaaccttttcatgagtttatttaagaatttcaaaaataatgaaaaagaatttaaaattttattaaaataaaaaaataatttaaatagattctagtaaaatcatagattcctgtttaagaaaatgatttttataatcataacaaacaaattaaattttatttatttcaaaatttctaataatcattcactgtaaataattttacactaatctacactatttgtaatttaattattcatattattcaaataaattacatttagaggcgattaataggaatttgttacatattagaataatcataccactattaattattcatattatgcaaataaattacattttgaaataaataaaatttaatacgaggagtttgttacatttagaataatcatatcactattaattattcatattattcaaataaattacattttaaaataaataaaatttaatacgaggagtttgttacatatacgaggtggattaaattgaataatatgaataattaataggatttttttaaaaaaatttccattacaaatgctattaaaatttccattttaaatatgtaacaaactaggagttttttatataaaaaataaatatttattcaaataatataccaaaaaaaatctttacaccaattatacactttactgtaacaagtgtgaaatagattcgaaccgatttttcacttgttttattttttttcagtaattaagaaattagttattggaaatccatttgtaaatattcttttaaggtcatttatgaaattagttgttgggaaacggatttcataactg

SEQ ID NO: 1739 - DNA, 1491 bp, Glycine max
  Soy_ogl_863 Gm03:5522500..5523990 Cluster 7
tttaaatgtgttactataattatatatttatctttatcttgtttattatataataaagtagtatataacaagccaaaatttttctctcaaaaagatgagatattttagtaattctaggtgtaataaaaattcacaacaatttaaaataaaattttaaaaaataataaatgtatttttaattgtcatttattaatttatcccaaattggtgtaacaagattattttggattagggttaccacaactcatatcctttgatcaacaattgagccagatcctttggtttatcctttggtttatgaataagtttaaaaattcaaatcttatttttaggtatcgagagaagaataatgaattttaatgattttaatattggctacctgaatttttgaatttgtttattatatttatgaatttcatttttcaataaaaatatcaaatatataaaataaaaaatattttattttcactattttgattcttaatttaaaataattttatattaaatcacacatgtccttattatttacatgattctgaaaagaaattaaaagaaagaaaatacaaaattatgctcacaatataaagttttttcctgttataaaaaaataaaaatgagactattaaaattttgtatgataaaataattaatattaaaattatttactcattcttttatttatcattattttaaaaatatataaaagtcatcaaacataaatatattatatgctcttaattctaattttcttttttaatatctattttgttaaatttctctttacttccaaataaatagtaattgtcattgtcaaaaaaacaaaatgaggtgaagagatgattttggaaaaattagtaaaatttgagataatttttttaattatataaaatttctaaaacaaaattgtaaatgtttatctattattaattttctgaaattttaaatttatttttttaaaatagaaaaaaaaatagtacttcccaatccccatatataatttgtcccgttcatcatgccgaaacctgcactagtactgctaagatagtacgaagttttgactttatctttaattaatgaatgaatttagattctctggcaggagagaaaaaaatgaaattaattgaagtcagatccgagatttaagttttacttatgatcaaagtttgtttaattaaattgtttcggtaaaatttgcatgtgctgaatgctttaacatcaccgtcacagaagatgaaaatccaaacacggcctcgacagttaatggatctacaattaaagcttttactgtgtctgtgattgagtttcccaataacccatcgcggtagtttttttttttttgggtataaaaagtgatataaatgataaactgagactgttagtagagactcaattaattcttaggccacaggtgatttccctatgacagacttaatgatttaaacaacatcagtattaatttaaaaagacttgtataaatacagacaaaaataa

SEQ ID NO: 1740 - DNA, 1257 bp, Glycine max
  Soy_ogl_899 Gm03:36355244..36356500 Cluster 7
ccttagccccaagatatttacaagctcaatcactaagcagttatttccagttgtcaaattattagcatgttaaaaacattaaaaaatgtagttcaattagtttcgttaaaatcaatcttaaatatcgatgttaaagaattaaaagtaaaaaagttattaaaaatataattaattaactaaaatcattgaatttttacaacaaaacagcttctaatgaagatcaatatttcaaaatgttgacaatttttgtacttagagtgtttagagataatttattttatttactaagttttttcttaaaatcatacattttctatattcaatttcaaaaactgcactgtatataatatttattttaatcaaataaatctataagttaattgaaatggttaatcaaaacatactttaggtagggtcagtagcaaaaaatggatgaatataaattctttcttttctcttcacatgctctctcgaatttcctatctttttctcacctcaatttatttgtaagctccggcagtaatatgcatagaattaccttgataagcataagattcatttctattttgtttttctaacttcttttatgatatcttattaaattaattttctttgtgaggaccaacggcggttaaatttagttaaagggacaaatttctcacgtgataaatcaagatttaaattcttacgaaaaatagtcatatttaatattaagttctgtttcaaataaaattattttccaaaatagatatatgcgagaaaaaaaaagtttgtttcgtgagattccacacaaaaataatttttctcttcaattttattcttttttaaatataattaggaattaggaatgaagtcccataaataaaatgtttctttctctctctcttgttttcaattaaattttaaattattttttgtctttattttatttcaagaatttaattttttttagaagattttaagcattttatttttggcgttgtgtttaatttattgaattattaagctttataacttcatgaacaaatattaatccaaaataaggtcattacagatctgaaaataaatttaaggtagcatttggtgtttgaaaaaaaaaatgaaatgctatgctatgctttgtaccattttggtagaactgagatatttcacgttttaaacttcaattcgtattctattttatttttaaaatgcatcaaatgaaaataaagtcaaatatgatatttcattttattctctcacttctatcaaacgata

SEQ ID NO: 1741 - DNA, 1665 bp, Glycine max
  Soy_ogl_1956 Gm06:15108436..15110100 Cluster 7
tagagatgttgttattatttattttccccgaaggtaaatgctcgaaacagtgaatttcttccaaattgtgaaggcagatgataattttaagtttgaatgtgtttggtacatatttattgagaaaattaattatcttttttataatttttaggagaatttataaaaatatttttaaaaacacccaatttattaaatatatagtttaaatcattcaatttatttattaaatagttttatatttgaatactgtgagacagaaaaatgacaaaccatactaattactaatatccaatttgactcgtgttaaaagtttttactttgtagtctaatatcttttaatcttttccttgatcataaactcgttatgatgttaattgtagtgatttatgttgtttctctccaagctaaaaaaaatattaattatagaacatgtttctttatttatatttttaaaataaatatatttctaattttaattttttacgaacaaacatataaaatcaaaataatataatcaactaacttcgtttttttcaaaatttcgtaatatctcatttattccagcaagagagagagagagagaaatcctggaatactccttcaagtcaaattcaaattcttttcgaaataaaattattattaatgaaagtctaaaactgcaacagtcactaacaacaaggtgttagaattcttttcttcttctatcggtgcattttttattattaaattatggattataatgactcgatatattatttttttaaaaatcaaatttcattaagtgatttaattttataaaaatgtttttttaaaactgctaaattcaacaagacgaaaaaatgaattgcatatgagcgtgcaatatgaagtgtgagaacaaattaaagtacaaaatacaattttactatcttgatactaattgagtggtaatggaggaattcaagcagcgtacatcaacgagtgcggggaagaatatcaagcttgtaggctgcaggacaatcacactaaatttaaccccttttttttacatttttatttttttattaaatatttgaaaaattaaattatatacttattaatattaatatatgaattaaaaataaaaaaactgcattaccacgtcacctacgtcacaatcaacacaagcataaagacttgacattcaaccaattaaacttaccgttgaatcaaaattctctattaaaaaaaatacaaagattacatgtctcaatttttaatgaggaactggaattacaatggagtaaaataagaagatgaaaattgtactttaattaaataaatatactttttcattggataagatggttttaattaaaatttaaacttttaaatttttttaccaaacaacttttaactcaaaaagaaatttcaagttaaaaaaaaaatgaaacttaagaggactaacggtggattatactagagtttggtttagagcagagaattttcacgacaaaacttttgatgggtggtaggctattgctatatccacttctcgcttttgctaagtatacttcccttacttttttttaaagtgaaattacttaaataatttttccttttcagacctttctctctccctcgcacatcccctctttcatagcaataacacataacctctctcttttatcatacccctcctctctt

SEQ ID NO: 1742 - DNA, 1064 bp, Glycine max
  Soy_ogl_3840 Gm11:11032291..11033354 Cluster 7
agatatgtatttgttttatttgcctcaatttccatcatataagtataattttaaaattattaatatgtttgtttggtgaagtatatatttatatatttcttccattttataatcaatatttttttttacgaaaattagtaaaatatattaccaaacaaagttttttaaaatatcaattatttagtatttggttattttattctaatcatacttatattatttgtcgaaatatcttcattcttaatttatttaactaatttagtattatttaataaagaattaaattcctcatattagttatatttagtataaaatttagataattattttaataatatatgtttttaaattaggtttatgcacaatagttgactgaagttaatattatctaagtaactgctaaatgatacaccttaattttatttcattttttacataaaaatgtttaccatttattttaatttattgacaactgattagtttttacttttataaatcttaaatgttgttaatttttcttttcaacaatttattttgaacctaaatatatttaacgtttattacttaattttattcaaatcttaaatgttataataataatataaaaaaatactttcatagcgttcaattataaaatattgtataattttaatgattttaaagaataaatatagcatattaaggaataataaatactcataaagtatcataaaaaaaatcattatagagtatataataatagtgtaattattattattaataatatcatctttctgaattcactaaaaatgaaaaaattattactataaaaagaaataagataaaaaaatagtaacatgtaaaaaagtatagttaatatttttatatacaaacagtccttattataattaaattagaagatataaagtctaaatcatataataattattatagataaataactttaaaaagtaaaagtaatgaaattaaagtcaaaaagaaaataatagtaataacaataatagacaaatcttataatttatgtcatgatgaggttaaacaattcaaaatttcaacaacataac

SEQ ID NO: 1743 - DNA, 1255 bp, Glycine max
  Soy_ogl_4068 Gm12:33482501..33483755 Cluster 7
taatatttgtttcaattgaacacaaaaatattaaaagagatgagatgacaggttaagaaaaatatccaaaaacctttttgtcaaagaggaataacaaaaaaatgatttttttaaaaaaaattaattactttaatttatatatacagaaagatttttaactcttttccagaaataatttcttttgataaattaaagttaaattatttcggtactttaaatttagttatttatcattttttacaattaaattattgatatattcaaccataataaaaatttgaattaaagaatattttttaaaaaacgacagaaaagttttaatttaaatagtaaatgcaataaaaggtaaaattaaccaaaaaagaaaagacaacaaaaggaacaatccctaataaagtgcactagtataggtcttaattgcagtaaggtcatacaatcacgtcacaacagaaaccctagacggtttgtatctatactataggtacctatacagttgcaggtgctggagcctggagcagcatccaaaccatttcggttccaggccctcccttgcgcgggttagtgtaacagtacagttctcagtgcgcatgtcactatcaatctttcttttcttttcgggcaaataacatttttatcctttaggtacgatggataaagagaaaaagtgaaaaataagtgaaattaagataaaatttttggattaaaataagatgtaaaaatataggaattaagtgtcataatattttttttatcttctttttctataaatgaacggagttttaatgtgtaaatggatgataacataatcctttaaccaacaaaaattttaatttaattttcgaaagataaaaaatgtgataattaatttttagaacgtaattttaaattagttctaaacaaatataattaaatatcaaatcatgattattgaatcttaataataaaatagttttataaaattaaaagataaaattgcgtacttttacatatgtaataattaaatcaaaatttttattcttttatatattaaattatcaccattttaatgcatttttaatttacaattaaaagttaaaattattatcatacacatcataatactcatccaataaaaaaaaacgaagatgatgatttttttttaagaaaatacttttggtaaaaaaaaattcctattttccaaacatactctggtaatctggtattgaggcctaaaaaaccaaaatagtcatttatctcgtcttttcttcctttgtca

SEQ ID NO: 1744 - DNA, 1801 bp, Glycine max
  Soy_ogl_6128 Gm18:51587380..51589180 Cluster 7
aaattaggtttgaatcacacatgattgaaatcaggtcacttttcaaggtttgatggttcgtaaaaatttaattcgattattaaatatattattatatatgatataatatgaatccataacttttatcctcttattttaaaataaagatatttgatcactctaatttaaaaaattagcattttttttatcttcaattttattaatctttcattttgattcaattgaatcctatacctaacatatttctttaaagtatcataaaaatgatttaattaattaaaatataagaaataaaagaattaaaatatagttaaaattgagaactagaccaaaataataaatttttaaaataagatgacaaaaactatgaatttttcaaaatgaaaggatcaaatgtatatctattttaaaatagagagtttaaaattgtcgattgaaaataaaataagagacaaaaattaataaactagagaataaaaacaataagaatacattgaaatgatctaaataaattttgaccaataaatttgatataacataatgtccatttatcttactttattttagaaaaatagtaacttaatatttaaatttttgagaaatttttaaaactagataattatttttaacatttaaacatttctagacatctacgtaatattttacttcattgaaatatttaaagataaattttatatagatacattgacaatataaatgtaatttttttatattactgtctaattataaactgtcgtgtataaaattatttaattttatataaatacttcataaaagtaacattattttaatatatttgtaatatctaagataatttttatcttttaaaaaaagattaatcttaattgattaaaaaatgtaattttttttccattaacagtgtatacaaaaaataaaatattaaaatattctcataaaaagaaaatttagaattatgaaaattagaattaataaaaaaggtaacattaattatctatttaaactatattttaaatgccatttactatcgttcatttttttaataaaaaagccaaactataattcatatatacgttataaaaattaataatatagtgaaagacgataataactaatatactacttaattaaggtcacatacatttaataacacaagataaaaagaattaaaataaatgaaacatactttagaatatattatataataaatgctaaaattcatttaataataaacacaaactaaaatattcagatctattcgaagaaaaagcacccaagatttaaaaaaaaaataagaaaaaaaagaacaagaagaaggcaccccatgaaaaaaaatgtttaataattatgaaaaataattacatatattctaataaaaagtttctgattaaaattaatttaatcacatatattaaatgtttggcaacataatttcaaacattatcgtaaaaagaaaagctatactaattattaaaattagaattaaatttaaatatatttaccttatagttatatatttaagcttatttcaaaatcttttagtaacattgattatctatttaaattttatatttcaaattctattagttatcgttcatttttttattaaaaaaagtcaaactatcaattcatagaaacgtaagaataattaatatcatattaaaagaaagtaataaccaatatacttaatgtaacatgcatttaataacacaagataaaaagtattaaaatatatgaaacgtaaaaataattaataacatattattaatatggatttcttattctattaattcattggtag

SEQ ID NO: 1745 - DNA, 1025 bp, Glycine max
  Soy_ogl_150 Gm01:43473976..43475000 Cluster 7
cctaaacggataaaaataagaaaaaagagtatttaattttcttaaactttattttcttataaataagcactctaaaattaaaattaggataaaattggtatatatctataaaaagaggaaaatttcaaggtacttaggttatcttttcccattatagcaaataaacttaaaagtcgttggcatatatattaagctagggaatttctattgtgtcccgttaatttggagtattgatacagttgattttttcaaccactagtaatcaaactgtattattatattattattttaaaatttaatgataatttgaaaaaaagaaagttacttcttttaaaaaaaaacaaaatattaatttaaggaaaaaaaacaaacttaatctctttaagtttattttctttttatgatgggaaaagatgtgactaaaaatacagagagtgataaaaaaaaatcaagggtattttttatctacaattttgaaattttaaaagattaattttttatccccaattttaaaattttgaattttattcttaacttttttttaagtctttgtattttacaaattttaggtattttaaatgattctcttaaaagttatatatgtcaattttgtgcttttcaatttttatataatttaatgtattttttatatacaaaaggtatatataattctctttaggtattttatattttattttatttttcagtgttttatcaattttttttgcataattttaacgttttaattaagcaagaaatataaaacaaattaagaattaaactctcaatataaaaaaaaaacataagacagatatataaaatatctaaaattcaaagacttaaaataataagaatgggattcaaaattttaaaattgtgaatttttttatcactttcttgatttattgttatatcgtattgcttgttattatgctaattagcatatccttactctctctttttttgctttaaattaatcttttgttaacaattttataaaaaaactaaagtttcttttttcaaat

SEQ ID NO: 1746 - DNA, 1200 bp, Glycine max
  Soy_ogl_254 Gm01:50704501..50705700 Cluster 7
gacaccgcagctactctttggtttcaatttacatagatgatttgagctagctaatatatattactcccttattttatttgatgatttttagagaaaattatgtttctatttatgtgtttatttataaatttaaagaaaacattcattattagaatttttaattctttcatttgtttatcctatctttaaagatgatagcatgcacatagattaagaaaaataattaatctcctaatttttattaaaattgtttgtattttcttagccttttatttctattatgactattatacactattgttttccttcaatttttataaggatatgactgagcaaataataattgtatttttaaattttaaaataaaaaataatctttatcttcaaaagtgaaaaaaaatacaaaagtaatatgttcttatatatacttaattattaaatattttatactcataattgataagagaaaaataattataaaggtcctattaggattttttttaatataataaagagtatgaattctttttaaaccgcttcaaaataaacaaataagaaaagttagagtaatttattacagctcgtaatatatatcctccacatgcacgtacatagatgagggtttttctttgaagctgatggtgaggggaattatttggggcttgtgtccaatagtaaaaaaaatacacctattaataataaatcaattattaattaactattttagttaaagttttgcattagacagcaattaaataactaataagcataaacttttactaataaaaaccacgatatttaatatattaataatagttttggtgtgttactcattgtgctctcctttaaacatttatttgattataaatatttagcttatgaaaaattattaataatacatgtttttatagggtaatactaaatgttatattactaataaaaatattttaaagtggacattatatataatcaaagagcttcatcgttcataattgacttgatcaaaattatctctcatgaaaaatacatataaacttgtaaaaaagagaaatttattatagattaatggactaattacaatatccgttaatcaaatggcacataaatattaccaaatttagttatcattatcagataagttggattgaaggatggcgaatgtaaaaatataaaattggaatgatagatcttgccaacaaa

SEQ ID NO: 1747 - DNA, 1500 bp, Glycine max
  Soy_ogl_503 Gm02:11843101..11844600 Cluster 7
atagatatacgggacaaatcacttaagatcaggtatattttaacaaatttaattatattttttaataactttttaaaaataataaattttatcaatataatatgataatttactcaatgaatataatttagttgacaatgaatgctaagtttatggaagaagacctaatttgatctatgcagaatgcattcttagaaagaaataaaaactttaaatgcgattaagtttcacataaaaattaatcttatatccaacctaaagaatccaagtttataaagatatcttagaatctcatttaaaagataaaaatactaattataataattaaaaaaatctgatgtgaccattaaattatttttttataaaattgattaatttacaaaactttataaatagtttatacaattcaaaaaataattacatagatttcaccacaacgatctattttaatgtaaaatatattgtataaaatataaataaatatttattattaaaatatacatttataaatttctaaatatatatttcttaaaataataccatgacataatttaataattaagttgataattttatcattaataaaaatagaaaattataattttattaagacttataataaaactccattttgtgtcgactgtggatggatggctttggagtacaaacgcaaaaacgaagttaattaagagggacacggaaacttgcttttgtctgtttacgaagattcattaagaatagcacttttaattaaattaaacttttcagatattgtacctagtatttaactagggtttagctagccaactcctcaacctccttttctccaaaaacttctacacatgcatataacggagtattaatagtttttttctttcttttaagagatggatcgagtattatttattgagtcttaaatggtattttaaatctccactgttctaaatttaaagaaatgaaatttaactaacgtctatttgttatatatttaaaagacttctatatagaaattaactttgttcgaagaggaataaattcctagtgattatattacttgaattcgcagatgttaatttgtgtactgatatatattataaaatgtcattataaaatatctaattttgatttttgaaaaattaaaaaattaacagtatacgtaattaaaattagtcaaatttgatttgatttagaaattcattataatgtttggaaatgataaaaaaacatctgatcatttgatttcgaaattaattttacatttataatgcattaataaacaaattaattttatttggttgttttgccttctgatccttataccatctatatattaaattctaatttaattaaaattcaactataaattactacctttcatcctctatataagaaacagagatcagtttttattttaattataagaaacataattctgtagtaaagaaaaaacataaacttattttttatatttgaattgcttggtttcttttgcaccattaa

SEQ ID NO: 1748 - DNA, 1100 bp, Glycine max
  Soy_ogl_794 Gm03:1642001..1643100 Cluster 7
tttaggatacaagaatcacaatagttggatcaccatgtttatatgtataaaagtatttatggaaaaatgttaattttttaaatgcatctaaaaaatatttgttgagaaaaatcaactcctttaaataaattccgttatttaaaggtattattagtctaacaaattcctgactaagagatacctaggttcaaaaaaaaaagataacaatatttaaattacaagtttaatacaattttaattaaatatatttttatgtaaataaagataaaagtaagggaaaatgatagactatagacatgcaaggagaagcggcaacattttcaatttatttgatgctattttttaatttataaaagatttagatatatttttaattcttataaatgtgacaaattttagtttatagtcattaataaattaggtttaatccccatatatatatatatatgggttattatcattatttattgatgatttgtcatgtatctagacatgatacatatatggcatgtgacatgacatgtctaaatgtatatcacctaataagtaaataataataaaagccatttttatttttttaaatgtataaaaacggaaaccaacaaaaaattgaaaaattaaacaaaaattgttatatttatcggaacaaacacattaaaccttcacaaattattatttaattcaagcttaataaattcatgtattttaattaaaattatgaaattaatttttaagagtttgttaatggactatttattagccttgtataaaaacgacaatttaaaaattagacaaaatttaaataattaaaagtaaaaatacgaacgcagcagcagtccaaattaaattatagtgatgggctgatggctaatattttaatttctgtggtaggcactatctaccaataatcgcaattttaatctctgaggctcctacagtgatgatggatgttttaattaagaagtcaaatgttccctacgtgatgtaaattgaaatcgaaagattatctactaaaaaaatcactgaaatcaaaacaaaaattatttggatgcatatacattatagactattttaagttttcctcttttctcagttccttt

SEQ ID NO: 1749 - DNA, 1185 bp, Glycine max
  Soy_ogl_2002 Gm06:17176451..17177635 Cluster 7
agaattattaaaaatggatattaatctaaattaggtaacattaaataattaatgactcttatggtgtataatggtgaacccgttaaaaaaattgatatgcaaaagcttaaaatatcttttgtacaatagtttttgccaaaaaaaaaaaagtatctggagtataatttagccaagtttttttcaaagtaatgattacaagcatttaataaaatattttaataaaatgtatttaatatttgttaacatgtaaccgtggactttttttaaaatattttgctctcaaatataaataaaaaatatttttatggatctgatatatatataagaaaattttcaattaatgttatctgatttaataatttatctctaaaatatcatttatttaattgaaaatttagatttaataactttttttttcattcttaatacgtaatactcctttcattctaaaataatgatcttttaagactgcctcacacggattaaaaagcatctaattaatataaatttagataaacatatcttaactttttaactaactatcaataacaatacattttactattcatcaacttatttttatgacaaatgtctcttttcaatgtaagtattaattgatcattttaattttgtctaggtattgttggaaaaaatagtttgaaaaagctaaaagaactagtattattttggaaaaaaataaaaagctaaaaagaacattattttaaaatagagggagtaccaagtttcaataaaagataagtaaaaaaaaaatattttcaattaaaattaatataattaaatatggttaatttttaacagcataaatcattttttcattaaatattatggtggtatttattgttgacggaagctaaaatgactgttgtacagtaattttgtcaatctccaggatgctcttattatttttttattacggaagatgctattattttttattactctaaaattaaaccaatattttatttgatgtaattactacaagcatttaagaaaatctatctttatattaaaatatacttaatgtttatttcttttggacggaatacatttaatgtttattaacatattaataacacaaacgtttttttaaccaagcattttaaatattattaagaaaaaaaggtcaatatttttatcatgtcaaacaaatataaatgaattgtt

SEQ ID NO: 1750 - DNA, 1199 bp, Glycine max
  Soy_ogl_2045 Gm06:41019101..41020299 Cluster 7
taaaacttgtagaaaaaaacatatgattaaacttaatttaaatctgtggttttgaattgtaatttctgaaaaatcacagacttttcaagttaatagattaccaacaaaatcctaattatatttttagggatttaatttttaatcatgcaaatagagaaaattttattaaaaaaagtaaaatttacttgagtgatctttatatcttttaaaaaattctcctactatcaattgataatatatatcattggttagaaaaaaaacaagcaaaaaaacaataactttatattgtggccaactataatataaagatgttcttgtacaaaataaactattggcaaagatgacaagtagtttttttttttttccatcatgatgtgatggagaaataattattactttggttaatgattaatatttttcagaaaaactaacttattatttttagtaaatactattttttcttctaccattttttttctatcaataatgctcaaaccgagacctttgttaagggaataaaactcaattttactatgaaaaataatatttttgtttaaagtagagattaatttagagatactttgtacttataatatagtataaaaaatatattatttgaaaaaataaaaataagacagaaagaaaatcaagttcgtttatttatttaaattatttttttctgaatttgtttatttaaattattagaaagaaaaaatagtataaaatatgttaaattatttatttatctttatagttatctcctttttaagatttagtttttgtatgaaaaaattataaaatgtatttcttatatatgcataaagttaaattttactaaaaaaaagcaaactttttaatctattatctttataacatgaaacaattgaatattacttttaattttttatgttataaagaaatttatttaactttgtaagaattaaaataaaaaatgaaaagagattttattgtccttattttatgccccaggagaagttatcactcgagtttggtagaaaaaactttattttccccattttattaaataaacagtggaaatttagcagtttatttacttttctatatttcatcctctattttgatgtgaaagaaagattgtattaataacaaaaacaatgacaaaaatatgttgatttatttaggcgagttaattttaaaaattaaagttgatatagtta

SEQ ID NO: 1751 - DNA, 1233 bp, Glycine max
  Soy_ogl_2234 Gm07:6415968..6417200 Cluster 7
cttttcagcatgcttttttaattaacttaaagcattaaatgaagtatatttaatattttttacactgcagtgtgctgtaacagatagtagacatttaaatggtaaaaaaaaagaggtagtagacaattcttagtgtcaataacttcatcctactttttttttttttgctgaatataacttcatcctactaataaactcaaaagaatattgtaatacattcctctaattatattttcttattaaagagttcgccttctatatattagtgtacaaattttatatttttttatcaattagaaattatgataatatatgactttatatgtaattatcgtaaaaattaataaatttgtaatacataaaaatttctaatcagtagtacactagattttttttcccttattaatactcttaaatcttaatacatcttttttttcttgttaaaatttaaattgattgaaattgtaaaaagtttcacactgatgattgtgtatcaaaattaattttcaaaaatatttaattgaaataaactataggtatattttcattttcttgttggtgattgattttggtaccttgtcactataaaaaattacattatcatttaatatgaaatcacactaaatttttttaaaataattatttcaatggtcaataatcttactatacacagatttttagttgaatgacagtagaagtttttttacactgttaatatattttgatgatgataatcttattattttataatttacattgttagtaaaaatatttaatatttttaatttagctattaataatatgtcataaaaatatttagggttaatgatactttgtataaaattgaggctaaaatatacttttagatttttatgttttttattatatccagtttgactttttatctttaaaaaattaaatttagtttttttaaataaataaaaaatgatcattttgcaacaatgattatttttttatttttaaacataatttaaaacttttttttattaattcaagaggtaaaaattgttcttttatattcacatacatgaaaattataaaaccaaaattgtgttttaattataaaggaccataatatgtaaaaaatgaatttcatggaaattgaaaaaatctaatataaaaattatccaaaattgtataaacttataattaattttggattaaaaatcagttaactttttctgatgtaaaataaaatatgtaaaaacctat

SEQ ID NO: 1752 - DNA, 1100 bp, Glycine max
  Soy_ogl_2395 Gm07:36464001..36465100 Cluster 7
atattcaatattttgtaagtataattattaaaagcataaaataaggaagatagtaaaaaacttatatacatttttttaattaaaattgtagttttctttaataaatatgtatgtgttgatttaagatgattctttgggaaaaaaatctatattttatagtttaaaaaatatattttaagttaaattagaaaatttgttcataaaaataataagtataatttttatttacaatctttataaagaaattgaagatttatctgtgtatctatccattattttaatataaaataaattttttattttctattttcaattcatgattactattttacttttaaattaattaataagtaatttaaaaataaatataattattacttacataaatgtaaaatatatagttaaaaactaataaatcattggtccaaatagtattgaatttggtattcttaagtataattattaaggacataaataaaaaaatatagtaaaaaaattaagtattttttgtttttattaaaattgtagttctatttaacaattaaaattatacttatcaattgaaattatattttctattttcagttcatgttactatgctaacttttaatttaattgataagtaaatttaaaaaataagtataattattacagacataaatggaaaaaaataaacttaaaaaacttatgtatttttttttattaaaattatggttctatttaacaaatataaaagaaatatagttaaattaaatctttggcaaaaaaatattctctatttatagtttacaaaatgtatttgaagttaaattaaattatttgctaataaaattaataagtataatatttattttcaaccatttatttagaaattcaagatttgtctgtttatatacacattatttttagtttaacagaaaatctatattttttatttccagttcttgattactatgtttatttttttatttagttgataagtaaatttaaaaaagaagagtacaattataaaaagcataaatgaaaaaaataaacttaaaaaacttatgtatttttttttattaaaattatggttctatttaacaaatataaaagaaata

SEQ ID NO: 1753 - DNA, 1569 bp, Glycine max
  Soy_ogl_2618 Gm08:11890432..11892000 Cluster 7
ttggtcagatagggcggcggaccctccttacaaaatgcccccattttcacagtccactttacccatgttgccctttcctcattcatgaatgctcactataagcatatcaaaggtgcccaaattttgagacatttagtataatgcattcatcttattttatttgcatcgtttttcaacgaatttggctcttttcttgttccttctcatgttttttccgtgctgatcgtaactatattaatatttaattttaaaaattattaaaattatataattgtaaaaagaataatacaagcagagacaacaaagaaatcacatcctttttcaactactttttaatagtctttccttttttagacaaaaaatgattattttatttcattagaaataagatgaaagatataatttagaaacacaattttccaacgaattacctattgaatactgtattttatatatatatatatatagtcacaatttataatctctgaaatgctggcgacatttcttttgatatttttttatgaataattaaaatttattgtaaataataaattttggtgtattttacatttaaactaaaagagataatctttaaataaaaatatgagccaccaaaattgatgaaaaatttcagtaaatcgtaaaaaattttagaaaaagtgtttttaatatttctcctataatatacatgtagtagtaaaaaaaattttttagaataattattttaaaattatataaaacttttgtgagtgtaaattaattagcatgcaatttttctttcttaattgttaaattacataattatccaaccctaacaatattactttcactaaaagatacacgtgatttatataactttttatttttaaaaatatttttttaattgattaattccacaaagaaattaggttcttacttaatacattttttttataattatacattgaggagtatataaatttcaaaatctaatatatactagatgtacaaaacaaaaccaataacgattactacaaggtgatgggaacttgtgataatgtttcttaattaactaattttaagtttgaattttgaatgatcattaagtatgtaataaattatttattgaaaaaaaatattcacatgcgtttataattttgatgaaaatcattacttttggcgagtataatttttttttatcaatattgtaataaaaaaaagtaaagaaatgaatgagatatggttttgttaggttacgatttttagcattgggaagggagtggggcatgcatttcagcaacatcctagtgtttaaacatggttaaaaagaaagttgcgttaaagtgaaaaatataacttttacatgaaatttgacgcaaaaagttttataaacgagttattttattttaaacctaattttgtttaaaattaattttatcaaattgagatttttttgtatagaatagtaataatatttaagctcaaaatttcatagaaaatttaaatatctaattattggaccgatttcagtggattataagtttaagataatttaaaatcatgacttaaatattctatttaactatttca

SEQ ID NO: 1754 - DNA, 1299 bp, Glycine max
  Soy_ogl_2802 Gm08:34817802..34819100 Cluster 7
catcgatcgactagcattgtctctaatagataataataatttatgttaataataaagaaaatacttccatttgatgtacatatttcactagatcatttttttaatttcttaaatttttattacttctcttctaataattaccaacctcttatgttgttagttttttttttttttaacttcaaagttttttcttttatttttagttaaaataagtaaagagacactgagtgtctctctccactagtaataataatgtcaagtgtttaaacaataagtcaataatataatagaaatgattttatgttctttcatttttataacaatgtctatttttcattttgcatcaatttaattaatttcaattaatactcaaattttgtacgtattaaactttcaaataacaagttatatgcatataagattattaagaaaacaaaaaaaaattatacgttaattactttacaatgcaaactattcagaaatgaatttgattgaatttttttcacttacaaaacaaaatttagtttagatttattaaaggttaaaatataattttggtttccctaattttataaatttacgattttcagtttctttaaatttaattgagatatttagtccttgattttgaaaaatcaggattttagttattaacaaataattatgattaaaaaattcattaaaaaattataaattaattaaaatcctaacctcttcccctcaatctcagccacgaacctcttttaatatcactgctgtttggaactatcactatataatgaagagcgcaaataatagattctttaacatattttttctatttcattatctgattaatatctattaaaatctacaaaataatgagtgaacatattaaataaaatgtaagatcaaaattataatttataatcatttaaaataaaatattaaaatatatgttgctaatatttctcatacatgatttcctaagaatttcttctggagttgaagaatgggacgaggcgtgagtcgatgtgtatcctcaatatgcactatttttataacgtgttttgagaattttcaaagcatttttctgaataaaaaagttgactgttttatactagtactttattgtatgttttatttaattaatttttaacgcgtcaaagttaattaggacatatattaaatgattattttatgagttatatccaacagtcaattggttattttaagggtttaattacattttttattcttaactttttaattttaaagaattttatctttaacaaattaatttagcacactttattccct

SEQ ID NO: 1755 - DNA, 1386 bp, Glycine max
  Soy_ogl_4045 Gm12:15371101..15372486 Cluster 7
gattaaaaaagatattatagaagatatattaattttttattcatcataattttttgttataattttaacggttgatttttcattttatgcattataatttatggttatatataattaatacaattaattaatatcattaattagttaaagatcatttgcaaataaaattttaatttaataggaattatcaattttaaaataaataaataatttaacggttatgaaaacatgtttaagatgtattaaattattaaatttgcttaattattatttaatcatacgttagtttaaaatttattttattttttcagttacttaggtaacatttatatgagttaaatgcaatttttatatttttaactactaattataattaatatttatatgatttatttaatactttaaattattaataatagaacataactataatttatcattttgttcctttcgttaaagtatttgtataatgttaccaaaagacttctctcaacaaaaaaaaattactaaaggactaacattttattaactatttaaatttttaatttttaataattctactagcgtaattggctattgatatataaattcaataattttattaattactaattcataaatgaattcaataatttatatgaaataatttatagcacatgacgttacataaccttaaatatctaacataatatttatttaattactaattaattaaataattcaaaattttaaaaatatttaaaatacatactctttcaacatctataaattagcaaactacaaactcattcaacattctcctacctactattcatttaaatcaaatttattgtatggtaagaatttcaggtaactaagtagacaattatgttatgaatacatttgaaattcatatttcttttaaaatttagttaatattttattttatctattattgtcttccaacgtaatggctccaaatattttcttcattatcacaattgatcctgaaaaaattgaatggaaactacaaaagcaaacttgagtacaaccaaccaaacgatattaaaaatattgaaatgatactagtcgagatgaaaatgttattagtctttattagtgttatttatatttatctcagcttattgaaaagaaaatagttaaatttttaatattaattattttttatattcaaacaatatggaaggattcaacatttgcctaaagttggacataggggaagggaagaaatgtagcgccaccgtcggccctcaacaaagaataatgactagggaggagaaaaaggttcaaggaacagaggaaggagataatatgattaggagcaaaacaacattgtctaaaattatttaattactgaaaattaataaaaagattaatcttagttgt

SEQ ID NO: 1756 - DNA, 1300 bp, Glycine max
  Soy_ogl_4224 Gm13:23511301..23512600 Cluster 7
atgcataactcatcattttgaatcactataactaacgatcaacgtaaaattatataattttaaaagttaagaaactaaaattacatatttaaaaatatgaagaaaaaaataacacattataaataatacttagttaaaattataatttatccaaagtatttttatcaaataattttttattttaaaaagcagaaaacaaacaagctactcgatcaatactagcctactagtattagtttgtaaaagctttttggttttcactccaattattaaatattactcctaggtctatttataagaaataataagttgtagtggtaataagaccaaggatggagataccttcgggtttgggagaccttggccacgcccccctagcttcttttcttcttcttcttttttataaaaaaaattgcaatatacttttatggtttttaatttatatgatatcttaatattaaagtaattatatctatttggagttagataataacgtttaagattcagcgaaaaaaaaaataacgatatctaagttttattttttttataaatattttgttcttttttaacagtttttattataaagataatgatattttttcatcctcttagataaatatttttttataattttttagacattactaaaaaattatatttttacataaaatattcaaatatcatttatttttctcttcaatcgtattttcctttttataatttatcattgctattttagaaatgatatataattaaatttacaagaatttgttagccttctctttatattcatttgaatataaatgatttaatagttaaaatttatttattaatatttgcatatattatataagatttgaaatttttttagtataatgattaaaatatcattttcaatgattaaaagtaattttgatcaataaagaaacaatgtttaacatttgaatataaaaaaatttgtaatcaatgtaaatattattttccatataaatatatttaaaaatatgaatatttcatataaaattcgatgcaaaaatgagccttagttttttcagatggccccctaatattttaccatggctttgttccagataggactggaggtactactattgaattatgtacgtgatggaccaaaaatggcaagtttccataagtggagtaatttttttttaaaaattacatgaatcggtagatcttgaaaatattataaattatgggtatttttgagttttaaaacataactctatagaacattataattttaaaaaaaaaatactgaaattgtgtcttgaatcat

SEQ ID NO: 1757 - DNA, 1700 bp, Glycine max
  Soy_ogl_5155 Gm15:48225301..48227000 Cluster 7
taaatattaaaatgatatggtgaaagcatattatttttacttgtttaaggataacataaaaaagattgaattgcacacaattattattctctagctacatctcgatcttcaaacttttttcacaacttcttatcatgtagtattattttcatattaaatataaattgtttaaagtttttcacataaatatagtaaagcattaaattgtacccttaattttaagaaaatatgattatatttggttagattatcttctcattctacttatactaaatatcaaaagccaatagtaatattaaaaaataactaatacatttttttattggaataattaagtttttagtccattaaattttttatcttccaatttttagtccctcaaattttttttttatgaaaacctttagtcctccattaatattttgtcatcacttttagtcattctaaatgtttttttacatttttaatctctcatttatttttattgctcaaaattaattttaaatataaaataaatgagggaataaaaatgaacaaaacaaagtaattttgaataataaaaataaacaaggaattaaaaatggacaaaaaaaattagaaagactaaaaacacaaacaaaaaattcatgaaggacgaaaaatcatcaaaaaaattaaaaggattagaatctcaaattttgaggaatttaaaacttaattaaccattttttatttgtaaaaaataaaaaaactaaatggaaaaaattcattttctaaaaaccaagtaattagaaaaatagaaaaatatatgaaacttttaatgttggtgttggtatgttggattaactaatgggagaatgcaaattatatgattttctacactgttaggatgcttgcaatattgtgtttgaaccaatggtttaaagtgtctgctcgttcttgacattttatttattgtttcgttaattcaaagtactattcttcaagtgcctatattatccaaacatgttgagacattttttaatcttataatacggtaaaataatatggtataaaatgtcaactgttgtgaagaatatattaaattagcggtcaccacttttattaatgagctaatttatttatagtaaaatttatattaattttttatacgtgagagtggaagacagttttataataattcacatattttatttaatcaattaagttaaatctcttaataaattcatattaattatatatcaactattgtgaagaatatattaatttatcgcaattttcaccacttttattaatgagctaatttaagtaggtattttacacatgtgaattatgcttaaaaccatttttttttatatattacactacatctatagttaaattaatttttcttatataaattaattcatctgtcaaattaaaagtgatttaaaacttaacatatactaacatgttcattcaattaactgagttcgggtactttaagtaaaatctcatttgaattttattatggatgaaaaaaatacagttagaagagcataatcaactaaagtgtataattataaaagaaatttagtaaaataaaatatttatagctaaattaatatgaacaaatataaagtagttataacagttgacgcatatttttctataatgtataaaattatcattataaataaaatttataaaagtaaaaaaagagtaaaaatattgtaatattt

SEQ ID NO: 1758 - DNA, 1263 bp, Glycine max
  Soy_ogl_5651 Gm17:12272938..12274200 Cluster 7
aattttattatatttgaaataaaaaaaatgtttttttctcttgtatttgagacctgatggagtatttgtcaattctccttttactactcaatcaaataacctaaacacaccatgtacaaaagattctttattttcagtaaataaaaaaatgcaagcaagggcaaaaattacctattttgatggatctaacttcttatttaataattcttttttcttatttaaaagtagaacctataaaaattaatgatttataataaattttaatcaattaaaagaagagtgttagaaagatagtgttaaggagagtgtcattataatttttttcaaaaaattatcttatgtaaataattataatcggtacggttgaaaagtaatgaaatgcgtagatgtctatgataacaagattggggatcatgaataaacttcttaatggttaaagtatttgacataacaaacacaattaatatttatacttaaacctatgttttttaaatctcttaaacgtataatatgtcaaatttattactaaaaaggctcaatataagttgttgcttttttaatatatattaaacggggccaaaggcccagcacaagtcgatttttgtgttttcttgattcaatgttgtatattttgtcttgttaaacaatataaatatatagttgaacttgtatataactatcaaaaaagatatcgttaacttgtatttgttaaactaattacagttacaatcgactagtactgaatcaatttcttgttggagagtcaaaacaaagtttgacttttaattgttttagagttgacttctaagatatttttgacaaacacaaactaccgacgaaaacaaatatagacaattaatgctagttggtctatgcactataaagtgaaaaggaattatttattattataacttagggatctaaattgattgtggagtgtgtaacttatttaactcaatctttcaagaaataatcaataaaacttataattaggtctgtaatatatatagtgagttttgaaattataattataataatatagtggtatatgtaatttatgttgaaatatttgtcatagattaatagtatcaatcaattatttgtatctatgtgtcattgtttcataatttttccatcaatttgttcgataaatgatctcatgagctagccaatcgaattagattgctttggtaaagaaagtgaaagagcatcagcatcgaacccatcttgaatacatctaatatcttgatcaccaagttatag

SEQ ID NO: 1759 - DNA, 1000 bp, Glycine max
  Soy_ogl_5741 Gm17:37301701..37302700 Cluster 7
aggaaactagttcaaaaattatttattatgaaaatttaaagaaagttatcaacaatgcatttttgtatatctcaaaaaaataatttaaaaagttatcaataatataattttatgcatcttaataaaaaattagtttattaatcaatatttcaagaatattagtcctcatctatcaattgattttttattataaaaagaaaaagtcattgatttttctcctggttctagtgcaagttcacacatatattacatatcttctctaagaagaaagtcttgttgacttccataaaaattattatgaatgagaaaatttatttattatagttttaaattttcttataatattttttcttaatttttaattttttgtgtggtaagtattaaataaaatttttatctttaagatattaactagaatgtttactttttcataaaatattattaaatacgagaaaaatttatggcaatgtatataaagtgtgttctttttcatatatatttaatattcatgttttgaatatttttatgtatttaatataagagtttaattttaaataatcttaattacaaaatttaataattttttatagtatatgatatgtgtaaaaaaagtcaaactattaatatgtttcaattagatttttaatgtaatgtacttttttattttgaatccgagcttactttcaatctatcagagattaataattttgttcgtgatatttaatcgtgaaataattttttttgcaatgtaataatgtatttaacagtagtactttttatattacccttcaataactacaataaaaaaatctcttgtattaagaccaacgaaatgaaaaggaaaaagcaaggtgttgtgaaattattaaactgtacttgataaccttagtagcaaggagatatgatgagaattgtttttttgtttatttttgtttctcttttggggttgagaattcggatggtgagaaaagaagaagagcgaagaatgacgtaggaataa

SEQ ID NO: 1760 - DNA, 1511 bp, Glycine max
  Soy_ogl_6040 Gm18:15226567..15228077 Cluster 7
agctatttaaacattatgaaaataattgtcgatcaacttatatatgatttagttttaattttaaataaagcttgaaatgtgaaaaaaatattattattacttatttaatattttttttagagattgaccaacaaagtttgataattatttaataatgaatataaatattgtcattgatttattaatatttttataatttattatttataatagaaattgaagttgatgactaatatagtcaattaagtatcttattgcctaaataaattaagtatcttctattgcaaaaattttaagtgatataattgtttttaattcattaattgctgtccacatttattcggatatctttgcctaaaatatatttatcgtaacataaagcttttttttttttacagcaacataaatctttattctttttctatattttgagtagtgggtttaggaaaatttaaatccatatttaagtgagacaatatagtatgattatatttcacaaatatattttactctttaattataacaatgcatgcttataattttaaaaaatagagaattaaatgacctaattatatatttacatgatatagatttggataaattttttttaatgaaattagattaaaaaaatattgtagccagttttcttatgcataatgatatagtcaatagtttattaatatagaaatttttatttaatataaaaattaaatgttgtataaaaaatgttttttgtaatgttttctctattcaaaagaaaaagctgattcgatagataaaagattaaaccactcatttttatctatttgtatcaaatagatttacgaattaagttatagtttattatgtcgataacatgattttttaattaaaatttaaatattaaattaaaattattaatttcttttctaacattgcatcaacatgaaagtaaaagttgatgaggagtactatcaacacattttctaataggcactctttctaacacactctagtattgattaaaattgattggaatgtataaaattatgaaaaaaagtcattaaatattatatagaatccactatcttttgtatttaaaaaaatttaaccaatcaaaaaaacatgttcaaaagaatatattattaacatttttcaaagttgattatctcgccttgatgtaggatgaaacaatgacaaatggccaagtagttttaaatggcaagagaatgtgaaggactcagacgaaatcatcatttattttgaaaatattagaaaaatccaataacaatttatgctactatcattaattagatcattttgttctatctgtagttgtcatttgctctaggtgattcatgtagcttaactacaattttttttatgctctatatacaaattactatgacatttttttttatagaaattgtaaatatgctactaaagtaatcttatttcgtagttattaatatagattcatgtttccttacagtacttaaacaatttcttaagacattatcatatatcaaatc

SEQ ID NO: 1761 - DNA, 1300 bp, Glycine max
  Soy_ogl_6208 Gm18:56779501..56780800 Cluster 7
tcaatatattcttattttgtcgattaaaaaaaactagttaggaaaatgaggtagaaatgaaaattcgctaaaattttataatttttagaggtcaaaagaatgaacttttgactgtttaagaaattactgtactagttttacgaatgtcaaaaattatttttgatatttataaataactgatagtatttgattagaatatgataaactcgaatctaaaatcgcagcaaataattttcttagccgtttaaaatttgacggccaagttctgtaaaaaaaaaaaactgatggcttaacaacaagtgttaatgatgataataaattattgtaataactttcttggcaggttttagaccgtcacaagttgtaagattaggaaaaaatttataaaaattaaggacctcattcatcaatcatcatgaacagcctcttactataaattgttttaaaaaattgaataagaaaaacagcaattctccaattttgttcacctatataaagttaaactcagctttcatcatgtataacttttacaaagctgatataaaatatgttatcgtagtacctagactcttactataaattatcatttgatcttgtctaaataaattatcattttatcttgtctaaaaccttgtcgtggaaaaaaggaagatcaatatgaaactttaattaacctagactctaggtaatgattattttgatttaatggcactgacggctctaaaaggagccaaagtatattaattagagggtaaatcccgcatattcctcaatcataaagaatattttaaagaaagtattactataaataagttcaaatgcaatgctatatttttgtatattaataagtttttgtatttttttctttctgaagaaacaagattttgtaagaaagaacgtgcttctgcttcctaatattccaaagagcaatgctatatttttagcaatacttgtggtacaaaaatgcataccaaaggaataagaccaataggaggaatttataaccatacacggttgatttaaagataagttcttgttaattaatgtctttgaggtaaaattatgaacaatgtaattttttacttttcaataaaatcatttttacttaaatttttttaatcaatattcttaaggtacgagttaacatttgcttaaaaatataataaagattgtttgcgttcaaaaatatgattcatgcaggtttctggcttgcatcattttattcgtactatccaacattattctaatccaaattaagttgataacataaatcattgttatgaatcatttttacatttca

SEQ ID NO: 1762 - DNA, 1200 bp, Glycine max
  Soy_ogl_6327 Gm19:1913201..1914400 Cluster 7
tgaatcttgcaatagttttagcaaaaatgtctcatagttgttaaaatatcaataattgaatgttcatatatatgtaaactatatcaattatgtattttaaaacaacatttggtaaatgtattacaatgcgaaaaaacataactttatgtctttttttttatatttgatgtatattaaatataaaaaaaaacaaaatgagaaattaaacgtggtacattttaaattcaccgaaacaaaaagaaatgaaatgaagtataatgttctgtttgttttgtttgtgcatcaagtgtggcttgctgttgaagtcttagatagaatttaaaattaataaattttctataataaaaaatattaccaataatttagcaaatttttttatacaataatttacgaagtaaatgaatttaaattaaagtgtatggatgatataatattttttacattgtcttgtatccataaattgttatgtatggtaagtatattgatttttgtaataactattttaaaaattatatttaaggtaatctatagttgatcgataatgtaaaaatatttttttaaaaaaatagcaaactctaagaaatttatataaacatcaataaatttagtatgatctagaatcatgtacagttcatgagattaattcaaacaaatagtgattaaatttcttataaaatttatctaatgctaacattaaattatctcaaatataatgtttaaactaaataaaatacatacaaattgattcaaaatggaaatgttagatgaaccctaaatgaaaactacttgcaaatttagtttaagttgtttaacaattttaaattaaatatataacccatgcatatattttataaatttagttatgatatataaaaatagataatattcaaaagatcgaaaaataaagatcaaagattcataatatttgatatttctctttattagtacggttcaagtaaaaaaataggcataaaaatatctgtcaccgacaattaattgacaactaaatactagtattgaataaatttattattgtagccaactgctttatgagggtacgaaattaaactaaatgaaatattgtagcaaagaggaaatgagtggtcaagttaattatgaattttcttctatcataagttttttttttatgcatatagtatatttaaaagaagtcataattggttctaagtacaagaaaaa

SEQ ID NO: 1763 - DNA, 1728 bp, Glycine max
  Soy_ogl_5248 Gm16:2172145..2173872 Cluster 7
cgagtgtattgggttaaataacttaattcagtggtatttattaagttctcatcttgtaagcacttacgtgtatatgtaagttaattttataattgaagagaaaatcaggttaaactatttttatatgaacattttataaacctccctcccaaatatttatataagtaattaagtcataatataaatctaaataaatcataaataaaatcttctaaatacacccattaagttgaaaagtagtattaattgatatattacaaacttaaattaaaaaaacaaaaaaaaacttctatgtaaaaatattttttctccagaaacgacaaatataaaaaccaaagagaaagtagtatatatttaattactttatttcataagttgttatcacccgtgtataaaagccctccatccgaaaatattgactaaaccaatgacacaaatcaggtgtatagctttgaaatttgtttttgactttgaatcttacatagttgtttttttttcttttcaattatcaaaacggattaacacactaaattgtaacataaatgtttacttttgatttagatatttttataagtctctttcagtaattctgtaattgcaaccttaatttgctacatcatccctcaaatgaaggttgaataagaagaaaggaggagagaacttgcacacgtgaaatttgaaggagtcatcatgacctaagtgagaaaggtgctcatgcaccaattagcttcttggaaagtataagaaattaccattgtccacactcaacgtagcaaacagttgatattgtggactatcttaacatgtttgaaaattttctctgcaagtattttttttagaagacaaaataaaatgagttttttttataagtttaaattagtttatgtataaattaatttgtaaaaaaattattaacttttcttaaagatatttttaacttatgatataagcaaaattttgacttatgagaagtttatttttttcttatattcttctcctataaatttatatgtaattatgaagaaatttattcaaataaatcttaaaacactgactaatgagaaatattatacaaaggatagtgatagaaagagagaataattattgttgtgtctcaaagcttaagttgacggttccttatataaggctagtttgtttaaatattaaaaagaaagtaatttaaaaaaatgtttttttataagcgcctatttaagaagtagttaagatttgtttctttaaaaaacaaaaaaaaaaactgcttatttttattaagtatatgcagtttaaacaaaaacatcaaaaaattataaagctacttattttgttttaaaaagtaattttttaaacataaataaactagcccataagaccataatgttagtgtaagtttgtcccatttgcaaatattaataatgaatagttcataattcctaaataaatataatgaaattaatataaagaaaaattatctgatattgatatgagtgatattgagtttgaattttttaaataagattttgaatttaagttttatagattaaaaaatataattaaaagaaaatatcacactaattgtaactatagacaaatttattagtgaaaattaatcattgacaaaggtaatagatacttaatactaatattataatgattaaaaaataataaattgtttaaatataaatgcaattatttgacgataacaataaattataatagaaaaagactttt

SEQ ID NO: 1764 - DNA, 1086 bp, Glycine max
  Soy_ogl_110 Gm01:4500401..4501486 Cluster 7
taacacgagatttattgacatattttcttcactaaatgatgaaattcatatatattctactaaatgatgcaactcaatctcatattgtatttaatgacttaattatttttcaaataaaataaccctcataaattttacttaataatcaatatatattaaaaagagtatgcgaattgtgaacacaagttaacattcttcaaatggaacgatgatgaatcctataagatttttttcggaagcattgattttttatttattgtgtattttacaacatgttgcactgggtttctgtgacaactaacaagttataggtatccagaagaaaaaaaaaagttataggttggtaggtacgttctacagtgttttcattttttttacttatttaaaatatagtaattaacaatttaacatccctaatgattcctaccactaaaataatcttagtctttaaatataatttatcaaagacttaatattttcgggaatactttttttatagctaagaagttaatttttttaaggtagctaagaagttaattttttttaaggtagctaagaagttattttactgatcggaaagtttgttcaaattttgtatcagaggcttaaatattttcggtaatatcttagtatttaaatttatcaaagaattaaataaaatatagctttttttcttcttacagagtcggttatttaatacagtagtttatagcatttttgaaatgctataacttttcagttttgtagaggaaataaagtaattacatctcattcataattttaatactaatataagctgggatataattgaaatcatgagaacgagtataaaatcttgaaattcttactaatttatgaattatattatttatttatttttacaaaactcaactagagtttaaaatagaagaaatggaaatcttacatctatttaaaattgaataaaactctgattttcctgtagaacaataaaattttcagttaaaatagctaaaagagttatttttattctcggtactttttataatccatcatttactcatttattttaagaatctatcaccttctcacattcgatacttcttg

SEQ ID NO: 1765 - DNA, 1000 bp, Glycine max
  Soy_ogl_544 Gm02:14226701..14227700 Cluster 7
atataactgttttcttaatattaaaaaagtttgaaaatgatattagttcgttgtttcattaattaattttaaaaggttacattcatgtttaaacaaagtttataaaaaatgtatattctcttttaattcaagtgtaaattattgcagtaaaaataagtgtaaatcttttttttttgtgagaaagttcaggtgaattattcttaaaagctcataaaaaaaacatgatttaattaacgaataactcaaaaattttcctccacaaaaaaactcaatttttttagataaacccaaaattaattgtaagatatgtttcagtaaaaaaaattcaaaagtaattgtatgatatagaagtgtgacatagtccatgtcatttaatgtagccaaaatgcataagtcaacatctttattgcaacatgagaaggaggtagaaaaaaaggaatgtggaatgcaatagacataaaaagcattaaagttagtttatttttttatgttgaagaaaagttacgtgggttcgtcttaaaagctcattaagatcataacatgtccaagactttaacgcttacataatcacatacaaattgttcgttaacaagatccttttataaatgagtctaattcttattttttacaactgaatcaacctttgttaactattttagatttttttaaaatcaactatttcagatttttttaaaatcaactagatggtgatccatatataaatgttttcataatattcaaaaaatttgacaacgattttagttccttgtttcataaattaattttaaaaggttactttcatgtttaagcaatatttataaaaacaatatatataatcacttttaattcaagtgtaaattattgcagtaataacaagtgaaaacttttttttttaaaaaaaattaggtgagttgatcttaaaagctctaaaagaccccaacatggtttaattaacgaataactcaattaattgtatgacgatacaaaataaattaaaaaa

SEQ ID NO: 1766 - DNA, 1249 bp, Glycine max
  Soy_ogl_194 Gm01:48120704..48121952 Cluster 7
gtgtcacgtatgctcttttattaacgataacggatgaaagttaacaaatgtataaatttgtcgcacttttttttttacttttgggtactaaaatttaaatttttatctttcgaagacgaatttgacaacgctctatacatttaggaataaaaataaccatttatcctttttttttaaaataataaattaattacagtatttgatacttgtgttaaaaccttaaatgtcatatgagttagagagagtactatttataatttctgtgtatcttcattgtttgaagtaattttgtgactcattggacgtattttaagtacatccaaacaagcaagaagatcacctcaatctctatatttatttatataagcatgacttgtatattctactaaaaatactgtatttttcaaggcggtgtcatttgaaaatttgaacaacttttctacaaacttttttttattttaaaaatgaacgtgaaagtgttttaaaataaagttaaaaatcattttagttacaaatcttgttttgaaagcaaattatggactgattttgaaagctagtacttttcattgcttttctatagctagacaggagaatgttttcaactgatacctttcttggccttttgattaacatgaagtgacaaatgttttcaattgaaaagaaaaaaaaatgttctgtcatcaccagttcagcacttacctgcagcatactggaatactatatttcatgacattcattaattagtatataacgtgacatcatatactaagaatgaattttagtattgaaaaaaaaagtgtataaatttttctgagtttaacagcgtaaaaaatactatctaaaccattttaaagataaaaaataaaataagcataatttacaagtattaaaataaattaaaaatcacaaaaatgaaaagttaaaaaatgctaaattacaaagattaaaaaattatttaaatcttcaaattttatattatttataatcaaaatgaattttaccactatcacctataatgacctttaataaaaacatttattaaaaaaattataaaactaaaagtaaaactttaattttgattgaacaagctaaaagtatttaacaaacgtactgcatatatcttttgctgtttatcctttggtctgaattaaaataaaaatattatggaggaaaattcaaaatttaggggagtaactaaagtcatattcttcatctccaacaaaatttcaacaaagcaaaagataattac

SEQ ID NO: 1767 - DNA, 1154 bp, Glycine max
  Soy_ogl_3480 Gm10:40761501..40762654 Cluster 7
actcaattcacaatatatgttaaatttataaatttataggagaatatctatatcttacaaaacatatcattaaggaggaataaaaaactttgagtgtgattaagttctgaatcaacaattatttccataatcaaactcggaccaagggattaaaattcataaaaatacctcaagatttacaaagttaaaaatcttaattacaatgattataaaaaaaatatataaatcaaactaattataattgatttaattatcatacttatctctttcaacttgtgccaacttttatttttggaggaacctgaaacaacctaatcaatcaataaactatttttttttttaacttttagactaaaacattttaaacttttagaacttaatttatttattttttcttttccatccatttttcttacggtcttgtactaagtatcttaatttgatcatatttgttgtataattttttcattatatttaagtaaagaagttaatgatatacgtaaaatgatacatgtagaaaaataaattattaagtaaaacaaataattagcgcaaatgcttgttggcacgaagcaaatttcttattaaaagtacgaacgtgacttttttttttttttcctatcacacggttcccgtttgtaatttttttttcttttcttttatattgcaaattcttctttttctgacttttttatttatcaaaattaggtgattttataaaattatatattaaatttggtggtaaatcttttttccttttttatagtacaaatgcttctttttacaactcttttttttttatcaaattaagtaattttgtaaaattatattaagtgatttcaaaattatttatcaaacatgaatgattttaatatacgaaaataataataattgtctatatagacgataatcacaaccgatgtaaagtgacttttttacatcacgctaatgtaaaaagtaatttttttatgtgaaattgttcttcttgattattggaagtttcagattgaatcaggaatttttttattttttatcttttaaaaatttaattacacatcagaaattgaatgtttttgtgcgatttgtgttatttggtttcgtacaaatggcattttgcagaataattagttattaaaaaaattatctgtaccttc

SEQ ID NO: 1768 - DNA, 1000 bp, Glycine max
  Soy_ogl_1293 Gm04:8099701..8100700 Cluster 7
tttaatgataaatatactttagaaattgtaaatttactattcattctagctttttaatttttaatataatgagaaaattttatcaaatataaattttaatattacattaaataacattgttcttttctgcagaagacagcacgggtactttaaaactaatttctaatattcattttcatgaaataatttttttaatgtttaagaaaacacatgacagtatataattaaaataacatcactcaatataaactaataatattatatattttttttattttaggttaatttttatttaaaattatatatgttgaattgctcaataatctttatcatttaacttaactttcaatatattttataattttagttttctatgaaaatattatacttatttaaaactttttaagtaatctgatactcaataaattgaatttctattaaatatttttaaatttaataagcataattagtatagtaggttaaaaaaaataaaagaatattttaataagtagaggcttaattttttaaaggtatgacaatttcattaaaacttatacttttttttttgagaaataaatactagacttttattttagagtggatatgtgttttataacaaagtgcaatatttattaaatacaatattattactttatatcaataaaaaaatggtataaaaaagtatttttgtaaacacttttgatctatattaaaattatctattgtttatatatgtatgaaatgttttttatatacaatttaatttgtagaatattaaaaatattattttaatgtacaaacataaattaacggagtaaaataaggggcaaattaaagtgcttttaattaaactacatgaagtttaagtataacttatcttcaatatatattatgattcaaactgggttgtactgcataattttctgttatagagctggccatagttaagtaaggaataaactcaaaatgtatagtatcctacgataaggaatttataatg

SEQ ID NO: 1769 - DNA, 1101 bp, Glycine max
  Soy_ogl_3144 Gm09:36917101..36918201 Cluster 7
atattagtaattcataatattggtttgaagagtctatttataagatataagtatttcccttaattattagctatcaataattaataacttatttgtttacttttcttatgaagaaataatattaataattaatagtacttgatcttacaataaaaactttactaacaaatatactttgatcctctccctctctgtgtgcgtgtgttgttagtccttgtgagaagaagaggcctaaagtcattgctttaatgacctttaccatgtggctgaccatattaattttattttttttcttttgggagcaaagctttttgacacacagtgacaatacttccattttttaagtgcttattaatttggggacttgaattcgtgtccatccttactagtacagcaatggtaaatggtgcaatctaacaaatttaataccactatctaggggagatattaagtattcttaatttataaaaaaagcccttacagtttacagattttattaaaatagatacacgaggaaagctagacaataaagtgtatattaaattttatcttatgcaaaaaaaaaaaaaacttattcatttaaatttgtaatgatttttaaataaatatatttgttgaaaatattatttaaattaatttaagtcgacaacaatttaaatggcgtatttgtgatagtatctcgtagtttcaaaagtttaattgcatttgtacttttatttttttgactggatactttaacttaacttatgtaccaaataaaatacactttcacttatgtgcaattataggttttttaactcaaattgtacacatttatctttagagttttacagatgttaaaattgagtatgacacttccctttttcattcaataattgataaaaatgtaactaaaaaataagttggtgtggttaataaattccaatctatctatatatcgagtcgtattaaagaaaatatatcagtcaacttactcaattttatagtatttttaaaaaattatttgataattttttcaaaatgtattgttaattgagagctcctttcttatatattattttacagaaaaaaataatctaaaattatctgatatgtccttta

SEQ ID NO: 1770 - DNA, 1062 bp, Glycine max
  Soy_ogl_4774 Gm14:44322096..44323157 Cluster 7
gaatgtcatgattatatttctaatttggtagcaagttttttctcttaagagtgtttcaaaattttcaacttgattactccaaattatacattgaatctttcctatctgtataaaaagaaattaacatggatgaatactttgaattcataaaattaggtgaaagaaaattggtttaaaacatattttttaatccatgatgaccattttgaaaaatgtgattgcctaaaattaaaatgtctccaaagacgaagaactcaaatttggaatttccatacattttctatcattttttaggttcatatttgcaattgagttgaaattgagagacatgatatggggacaaacttagtgctgggttggcacctaccaggaaattggtataaaatacatgcatgtccttattatttatattgatagttttttataataaattaaaagttgtcaatttttggtttatattgatagttattttttttacagaatttatattgatagattatatatttaaaagaggaaatgataatattagaggtaataaatcaattatataatattttatgcacaaaacatattgttaataattgaattaaccgatcaattatttattttttgactatttatatacattataaaaaatcaagtataatatatatatggaaacatttatttgttaactaatcaactagaaatgttgattttagatttatattgatagtttgtatatttaaaaatggaaataattataatggtaatcaatcaattattatttatattgatattttatatctttaaaaatgaaaataaaatatttttatgctaaacgtttaacaataacctattcttaaatttgatttttgtttcgcagagaaataacactttacatcatgtgataaaagaatgtcacaaaaaaaaaattaaatataacacatatatataagtctttataaataattaatatttcttaaaatctttattaaaaatatatagcttgtattttattttgcagaatatatttgttaaactacatggaataacatttacttgtattttttaatattttta

SEQ ID NO: 1771 - DNA, 1058 bp, Glycine max
  Soy_ogl_5683 Gm17:14041801..14042858 Cluster 7
tatttattattaattaattaattaagatagtaaatctaattttgaatagagatacgctatatcttttcattatatatttttttaaatgaatatatatttaatattttaaaaacaaaaaaattatttagcactttaattctaaagtaaaaataataattgaaagatattatatcactattgagaatatttatttaagtatactatagccactgtttattcaaatatttatcatttatcaatccttttaacgataataatattgatgtttatacctagtgaaatccattggtcagaacaaatatatatttttgtttttaattcaaagctaggggtaaataaataaataaaatctatccaataattatatttgattaatttttatataaaatatttataatttgatgttccaatgtgttaaatcacattaataatttatcaaaccacttaacgtcttatcacaataaaatacataacatcttttcctttatgttacaaaaataattaataattactaatttttcaaagattttcttttcaatgtatactaacaaacatttgataaaataatttatcttctatcttattatgaagggtagtcttattactaaaacattaaatataaaatatgaaaaattaaaaatatattcctttagtgtggtgcagtggctttcggtctttgtcaattgatattcacagtattgactacaacaaggattgattgtgcattttcatattttagaaattataacaatcttcgatcaatctaatcatacttgtttatatcagattttttttatcatcaattcttgtttatgtaagatttgaaaaacaataactccttatgttgctagaaaatagattaacaattaaatattaatcatataataaataaaatttaatgaaatataatattagatcaagtttcttagaaaaaataacattaccattaattttgtaatttaaaaaagttaagagataaaaattgattatataataactaaattgataagatatattgagataagatttcttaaaaaaaaaagattattgattttata

SEQ ID NO: 1772 - DNA, 1039 bp, Glycine max
  Soy_ogl_805 Gm03:2019468..20202 Cluster 7
gtgtaagttaattatttggatatcaatgcaatttaattattaaaaatgcaagctaattatttaatagttaaaatatgtttttaataatttaaatatgtttcacactcatatttcattgaataatcattaaaaatataagctaattatttggataaaatatatttttagtgatttaaaagaaccaaaaacatattttaactattaaataattaacttatatttttaataattattaaaaatatgagtgtgaaagttataattttagtcctccaaaaataatttcattggatttgatccctttagattttcaaaaaaattcttttaagttctgtatttaattttgctaagttttactactaaaagtttacaacattaacattttcagcattaacatttaatgtggccagcaatagggggaaaaaagtcagattacaactctgctattcccaaaagtaatacaattaaactcaaattttatctttgttggtggttttttttaaaggcaaatgcttatttgatagaatgtttagtttttgttagcagaagtaactcataactttttttttcccgtttttttaatctaatttatcttatatctattacatttgttggtggtgaaatttgcctctggaacaaatatcaacaagtgcattgacaacaagagtttgagtctaaaccacattgtctacaacagatgggagtaaccaatatctaatagaaaaattaatggagttaaataaagaacttcaaaatttgaaaattccatatatgcaatgaaattgtttttagagaactaaaaccaatgagtcaatatttttggagtaccgaaatatctaacagacttgagagtttttattattatttttctctaataatggtaaacactaaatgaattgcttaaaagagtcccacgtaatcgttccattaaatgattacgggtttagaaaatatattttttatcatttaaaatcaattaagtaatgtttatataaatcacagttgctcaacgtatttttttctcatcataatattgttgtag

SEQ ID NO: 1773 - DNA, 1344 bp, Glycine max
  Soy_ogl_4714 Gm14:6368614..6369957 Cluster 7
ttgttttgtttttttatcagaaaacataaataagtatttaaaattattaaatattgatattatttgatcaaataaattatttatttatgcaaatgttttctattgttgtcatacatatatacaagaatgtccttgttaggaataacgaggcggggacatgcccgtggatataaattatttattaatagctacccacataaaaaacctgtcgtgtccggcttgttactcatcaggtgcccatttataaaactacatggggatataaaaaaaaaatacgtgagtctttatggatattcacggatacctttaattttttttttaaaaatcactttagccattttttacgtctttttctcccatactaaaactgtataaggtttgttatatttttggaaacaaaattattagaattatctaaaagttgctttctctaacgtataaaattatagtcgaaaacataaattatttgcagacatatctttatattaatcaagaggacacttgagtaaacgtacattagcgcgggtacccgagtgtccgagtagtttgatatccatcccatcctgtttatgaacgggtataaaaaaagccatttaaattatttgtggatacctatttagatatccatttttatttgtgaccaattttacccacaaacatttgtgtgtacagatttttggtcatcctcaattcttgttttgtacaacacaatcaacatacaaataaattatgctccaagtgtcatgcattgccattcgatacatgattagatataactagtaagaataaaagtaaaatagaagaagggaattaatttgttgtattttaaaacatttacaaaaaccttttaggcaaataaaaaattgttttaagcatagatattgaaaaacgaaaacaagatgatacataattctaattgtatctttttcatcaacaattctaaattgtgttgctgatacaacactaggtttttatataaaaaatagaaatacaagtatttttttagaaataccattttgacacaacattaattttgttttgttttgggttagcctagacaaatttaaagaagaacgcatagtgttttatattgattcgcttgttatattgaaactattgtagtcctttgttatgcaccaatattttcaccaacacaaattgttaatataggaaaactctagttcctcttaatcaaagtatcctccatgtttgcctcaattgacacttaatacaagtattgtttttctcaagcctagccttctcatgttcttctcacaccctacattgataatgaacgagtttgaataaatacttaggttcatagttacaaggtttctctcacta

SEQ ID NO: 1774 - DNA, 1900 bp, Glycine max
  Soy_ogl_2693 Gm08:14757901..14759800 Cluster 7
taataaacaaaatactttgatatccacatttaattagatagtcttatccttaaattactttttaaactttcaatttttttttccaaacctatagtaatttctcactgtttctatattattaggttttttttaattctgtcactattttcttaactgtatttaacttttttgttttttatttattatttaaaaaatttagagagccaagggagtgtctctctttccccaatatagagtaatgattctaggttttgactctttttttttcaaattattttcattattaaaaagataacaaagaaaaaataccagcttgttttatagtaattgcatataacatgattatttcattgttaatctacttatgcttctagatttatttttttgtctttgctcattaataatttgagtaattaattattttttgcttcgtgagtaattaaatttacattatagttaattcgatctctcaattggatagagacaaaatgcgtgtctacgaaaagattgcatgaatttcataaatcgacactcacgtttattcattatttgtatttaatttattccaaaaatctcatttcttacaagacagtttttttgtttgttttttttttcattcttaactcttttaaatatgtgctgctacaccaactcttttagaaaaaatatacgaaattatatattcagtttagccattaaattaaaaaaattataaagtataatagatttataaaatttcatgcaaataataataacaataattcatcaaactactttattctgatagatagtataatgttaaaatataattaaatgtcaattgtcagaatatatgaactaatgttcaatagtttagaaatttaacatacatgattcgaaaaataatattaaatggatcaacagttgaattagttaaatttgtattgtacaaaaatgttactacctctagcgcaaacatattttttgtcctaatatataaaaaaaacatataatcactttctaatgtcttaattattggttttttatatcttagcttattaataaatattcacttattttccataatgtgaatgtatttatttgactactaacaatataagttatactcattcgttggttgaaaaaaaaatattcttatattatgagtgacatcatcaaatacaatctcaacttaaatcatttaattatgagtatttttttaaataaacttaagtttatggcattattttttttttaaatgtaatggacatttggaaggggagaaaattttcatgctcgataatcataattttttagaatcatgaatcttgaaaattatatttgctggaaataaaaatatttgtttaattaatcattaagaatttttagataaattttttaagaattaaaaaattatgtgatatttttactattaactttaattatttaccatattaaataatttaataaaaataatatgatatttttattatagtaaaataaaaactaaatctaaaaaagtaggattctcacttccttcacggaaatgtttttgtggggatgttagttaaaaaggaatattaggaatcatagttttccaataatatattttttaaaaatgtgtattaaatatgagaatctaagtttcccaatttaggattataggaaaagtggagatttctttccttcaaatgttttcttaatttttgttaataaagaaaatcatgtgatctttattttattttaaacatttaatccatcttatatctttaaatttatgacattattaattaaatatatttaacttaactattatcttgattaggtatttttttattatatataagattgaattgagcattaagttgtgtaagtgtaaaattttgacaccttatgtcaattaatcacctctttctatcac

SEQ ID NO: 1775 - DNA, 1000 bp, Glycine max
  Soy_ogl_1605 Gm05:5313701..5314700 Cluster 7
tccaaaaatcttttcttacttataacaaacataataatattaaaatcccaagtccatatttttgagaatctaataagatttcataaaacaaacaccctctataaattatctctttcttactcttatgagaggattggagaatgaaaaaaaaaaaaaaaaaacttcattattattattctttctctatacattaattatttaagaagactttaaaaaaaatattataattacataaaaatttgatgttaattattaagttaactaacttttttaatatccatgaattagtttatgatgtcgtatgattaaaaatggataaaatattttataacaacataatgtttggttttaagggaatggaggggacggaaggaaaggggagtaattttttaaaattataacgatacaaaaagtaaagttgttttaaaattcatctcccctccatttaatttttttttctcttctctctttttctctcaaccaaacataatactttatcaaaattttactcttttttcctttcaatcttcccttctttattattttttctgatctttattataagacataatttaaaagaaattaaaagggaggaaaaagagatttaaaatatttcaattaaaataattaaaacatctctagttatattataaaatttaaaattataacgatacaaaatgaaaattattttaaaatccatctcctctccatttaattttttttttctcttttctcttttcctctcaaccaaacataatactttatcaaaattttaccctttttcccttccgatcttctcttttttattaccttctctgatctttattataagacataatttaaaagaaattaatgggtttttttaagacatttcagaatttttatgaaggatataacatgtttttcattattttttaaaatattctaagtatttgtattttttattgatagtgatgcataatattctttaactttaacatttttaatcactcataacaag

SEQ ID NO: 1776 - DNA, 1000 bp, Glycine max
  Soy_ogl_2654 Gm08:13363701..13364700 Cluster 7
caagttttcaaggatcaaaatggggtcaatccaatatatttttaagcccaaaacaaattttgagatgatattttaagaatttatgctaattaaattttgtgagaattaatatattaagaaacaatctatttaattacaattaatgactagttgattttaaattttgtgagaactggtatattaaactatttaattaaaattggtgataattaaaatattaagagacgaactatttaattaaaacgagtgaataattaattataaatttggttagaatttataagttaagtgatagtatatttaattaaagtgaatgactaattaatttttaagtgagagagaataacaaaaaataaaataaaagccttaaaaaagtaccaataataaacaactttgggagtaataggtagtaacttattaaatttaggaacataggtgaaatgaattatagtttttaagacattttttttttacattttgttatatccaattaaaggattaaaagcactgcagggattaaattagtcatatattcactttaaactttattagataattaaacagttccctatcaattatcaatgcacacacaaaataattaataattaactaatacctacagtaataggtaattaagtgacctaattaatggaaacaatcaaatagtcataacgaataggcaacacctctcgtcataacaaataaaatagattaattcaattatctttgaaaatgattatactcgaaaaacattataatgcccacattctacgttagtagtataagtaacaatgattaaatatgaaattaatttagtttttatgattaataaagatcgtttcgtagtcctttatgtattaaaagcacataacttttttccttttaatttaaaaatttaagcaacattttgaaatcacttattttttttttttaaaaaaattaaccttaaaaattaacaaaccattcgtttttttacgtgtctttttttgtttaaatatgt

SEQ ID NO: 1777 - DNA, 1300 bp, Glycine max
  Soy_ogl_2655 Gm08:13366601..13367900 Cluster 7
cttaaggtgcatttcctttttgtttcttgataaactagtttctgaatgtcttgtggtgtgagtctttgcctcattttcatcatgttttgtgtacgtattttttttttaaaaaactcacttttctggttaaagttgtgacatacatgtttttggagaactacttgtaaaaatggaccaaaaaaatttatttgaagtagaaaagaacacccttgaagagcatgaccgtgttgacttttagcatggtcctgcgaagttcaatttgtaaccgaagttactcatgaaagagaacaaccgtcaagagtagcactttcatgcttcaatttacaaatttaataatcaacatctaaggtttcaaagaatggtaatgccaccattagtacaatcgtgttgccttttgcactaggaagacatcaacctcataaaattctaggaacgatcatgctatattaaaggagtttaggacatgcttataaatagtcattgtagctcatgcttcatatatagtgtcaccatattcttgtcggatgttggagttttgcttcctaagcttcttggttttcgaaggtgagaagaatttctctaagaattgaaggttgttgacacaaagcccaagtgacaaatgtttctttgggtgctttccttatctttgagattgtgagagaacaagatgaccttcctcgtattagagacctttgtttcaaaaatttgggtctcccttttctcctagaatcctacttatgttaagtgggtatataatctagtttagatgaattgaagttgtgcatttgtcgatagattatatactaaaccataacattaataatagattaaatcctaataacttctcttgattgattgagataataaaagaaaaaggattgatttctagaaattgtgtaagaattataacaaatttatcaaagtataaaagagtgtatctttaaatggaacatcatttgatgttttttattattatagttagtggtgtctaaaccaatttgaatgaacttttacactcttttcaataaaaggcatgcctatcaatcgtgtggtgtaagaatacaaggatatctactttattgttttcacatcaaacaaacgaattgaaattgtttgaatttaaactagagagtgtttagaaattgagacattttccgcctacaaatatcttctttggaggaaattctattagaggtattatcgaatatttaatgttttttagtgggaaaaaatatttatattgaaagagaaataaagaacaaggtgtacccaatctttacaaacttggtacatatatacg

SEQ ID NO: 1778 - DNA, 1000 bp, Glycine max
  Soy_ogl_28 Gm15:16975901..16976900 Cluster 7
atcctctaattcacgcttcaaaaaaatttagataagtattcttattctaaaataattaacatttaaaaaggtttagtctgttactattcttttgttaattaaacctatatttctttttcaagttatataaatttttcatctaatattactctgcatagtttatttttatttaacattttcatataaggtaatttatcatatagttattttcaatttgacaactcaaaccgtagttcaacggctgatctaatgaatagagttatattagagattagacaactagttgagtaaattgattttctgttgaactttggctcttctagtccaaaagaaaaaaaggaaaagaaaagggttataaacttataatagagtttgtttcttttttgtttttctcagcaatctctctcctcacatcttcaatatgtaacaagtcaagctgatgtcccgtaacttgcgtatgaagttggatgctttttttacttttggtgaagaaattggattgctttggtgcccttatttctttctcttaaaaaaagtaaattataccaactatttcgaaggttttatgaaattacaaaactttctattgtttttatctactcttatactaatcttcttgatttttaaaaaatatgcattaataatcttcttaattgtttaaaaaatactacatgtacttcttaaaaaaatataaatgtttatttaagttgttaaatgtttcttaattgttagttatatttaatttattcataaacaattattaaaaaaactaattttttatgtatatatggatagttaactatcatcacattattaatcgaatagaaatcatattaaaatgtaattttaaatattctaattagaataaataatatatgcagtgtaaaggttttatatttttattatttattcataaattattatatatgataaacatacttattattgtaataattatggtaaaggtattaataaaaattatttctaattaattcacatt

SEQ ID NO: 1779 - DNA, 1400 bp, Glycine max
  Soy_ogl_6041 Gm18:15238501..15239900 Cluster 7
ataatttgagaagtttgcaaatatagttcttgtactagtgcatggaccgacattttcttagagcgagagctcacaaagaaacctgttttctacatatatttatgcaaaatcttaaaaaaaaaaaaatcacatattggtcatattttataatgatttcttaaccaattttttttcttattaacaacgggctcaatctttagtatactattaaataatcaataatatataaccatattttttcatcttattttgaataatttttccatttgtttatctattgttctagaacaaaattttatttttatttatatcttattttaaaagtttgatataacaaatatttttataattataaatctttctttataattgtcaagaagagaatgaaatgtcgatgtattaaataaaagaggtaaaagaaaaacatattcaaatacgggctatatttcttttataagaaatatagaaatgtaataaataattttatttttattagttctatttttcttgagcgttgatttttttataattgaaaaaaatatttgtgattttaaaagctaacccaatggagtattaattattattttgtcaattttagcttcccttacacaattagtaagagattaaagaataaataataataaatgacaaaaaataattaataaaatatactcaaaagcatatattttaataaaaataaaaacattatttatatttttaattcttctaatatatcatttatctttctcactcttttaagaactagatcatattggtcggttcaattggaaattgatttggtgaccaatccagtcactccaaaaaaattgaagcattttagaatctgtaaagaactggtccaaaatcaatgaaaaatcagtgcaaaaagccgattagaattggtattttttattttgtaaaatttttaatttttaatttaatctacaatatttttaatgtagataaaaatacatgtttaaaatattttgcataagtataaaatattttttttagctattattaatttttatcttataaaacatataatgtttcatttatgctaatgtataatttgttagttcctcattcttttataatttttcttattttatcacttaaaatatttaatattaaaaaatataaaactaattcaacaacagttaaattacaataaatcattaaactttaaacaagtgtctcccctgttttagttaccgatctaattttataaacaatgatttttctcattgattgacttttctatcattgactcatgtattactcttcattcctcactctttaatatcatgattaacaatgacaaagaatgattaataaaaatataccaaaaatcatatagttttaataaaaaacattatttttaatttttttaagaatta

SEQ ID NO: 1780 - DNA, 1400 bp, Glycine max
  Soy_ogl_3379 Gm10:5363701..5365100 Cluster 7
ttttccagttgttttcttatcttgtagatattatatttttcttttgttagtaaaataaaatatttatagatttgatgttttcatattagttttaactttatattttagctaggttcggcttttccaaccatcattggaccataatgagatagcatacatattaaaagttaatttttattttttaaaggtgtataaatctttttttcccccgaactaaaactctttgttaaaggtagatatctaactttatctttgttaactctagaaatagagtggaaaagctaaaataaaaataaaaactaaatttccattatttatttaagaagaaaataagaaagaaataagttatttcttttaagaaacttattaggaaaaattttccttgcagaatggtatgaaatagagggaatgattttttttttatttacgtaaaaatttcttaaaaatcaaataaatttttagtaatttaattttgttaaaaataatggagtaaacgatattttaattaatataattttttacatatatatttaattgatttattttcacaattttatttttcatttaaataagtaaagacattttttctttctttcttatttctattcgtctaaataatgtttctctttaattatatttttgttccttttctctttcatttctaatttaaataaattaagaataaataaagaaaacttaatgaagtgtcataagtgctaattaagtggagcaggaaacgagacacaaaaataagaaaacatatttgaatccctcttgtatatattaagaacggaaaaaaaaaatgaaaaatgctaattaattaaggtcacactctctcctttaaacacacctaacttaatgccattaacagtagatcacatggcattgacgtttagtacctatacaaaaaatctttttatgttttactccctatcaagtatctcccttttattttgtgttccctttttgcttcattctttcctttttccacatcaatacctctttcctctttttattttgtgtgtgcgtgtgtgcgtttttaaaatcatcatacggctaattattcgagctaggttgcagagtttagatgcactttttgaataagacaaggtagtttaatttgcaagtaacaatttgtattgatagtattccttccggtggcaggacttgttgcataaaacgtttggaaacttattgcattaaaatgcttggttattcttgtcatgttacttcatttactttagtctttaggttctctaagatttccacaaaacgctgtcaagttttttttttataccgttgttaaattgccaaaagattgaaaatgaaaatgcttcctccatgttagaggtgcatggcagatgcattgtgtgatgtagaaaataaattaaatgacaatt

SEQ ID NO: 1781 - DNA, 1200 bp, Glycine max
  Soy_ogl_1366 Gm04:43742701..43743900 Cluster 7
tacaatttttacagttaagatatgatatgattggaaggttttagtggaggtgtattttgactgcagaacgctattttgcttttgggatcctcatctatggtcggtgcaagagtgattaaaatacatctcaattagaaattatttgtctcattttttcacaattgagataggtgtgaatgatacattgaattccttgttgtgggtgcaatgatatagtccagtagttatgcttcaactttcactttctgaaaatggaaatgacacaaacaaatctcataaggaaaactaagtaagatacaaattttggggtggggtgaaaaagatgggaataatgttgtctttttgcttttttctcttaattttaatctaaaccattgaaatattttaataataaatcaaggacatataatgatgttgcaccggtgcaacacttaaattgcaaaaacccaaaatccatgaacttagtgcaagtcggagtccaatattccaaaactcttggacacagccacaatgggtacccataaaattaccaaccattagaaaagaattagccacgaaataagtctaggtattggttatcggttcttatctacattcatatttaagcctttatttgtttcatcgtgagtgttcataaactttatttttttattaatcttcgctaaacatcttgaattacgtttacaagatttgaatatgagattttatttaaaaaaattaaattcatttctactttgaataaatagcttgttgttggttaagtagaagtattttagcaacaaccttcttcatacttgcattttgtttagaatattaaatttgaaataataaactaatactacgatatatagccttcgcacttagttcttggtactagactaaaataacaattgttcaacaaaaaaaaaagaagactacaataataattactcctgaaagataagtatttacggtattttggagactaattctaaaaatgaaataaagtaaactaattattagtgctgttttgattattgcatataattaattcgtatgaataaatttttcgtgataaaatttatgagttattacataaacttgttatattatttgaatttatttgagttatttattacaaaaattgaataaatattatagcatataaataagaaattaatgaattattttattacatcaaatttgatttaattaaatatt

SEQ ID NO: 1782 - DNA, 1418 bp, Glycine max
  Soy_ogl_2228 Gm07:6080246..6081663 Cluster 7
attatttatcaaacaatcaaataattttttcacctgataaaaaaactaaaaactaattaaaatgttttacctaacatagttataatacttttgttgtagtaccgtcattgcttgaggatgtagatctcatgtctactttttcaatacgcacaaatcaaaagacctaaaacttaaaacttgtcaaataattcaatcaacataaatagatggtttcaaatagaataacaatcttgtataggttggctttctttagagagaggagaaagtatataaagaagacacaactcaccattcctttccctatttaaattagagaagtgttggtaataaacttttcaatacacttttcttaatacattatcttttatttattaaaaattattaaataaaacttaagacccacactttattttaattttaaataaatttcaattaataatagagaatatattcttaacattttcctttaaattaaccatgcatagaccttggtcctgagggttgatttgagaggtgacgacattattaatatccaaaattaataatattggatatttatttttctcttcttgtttatgaaatttgtgatcctctttttcactttttttaggttggtttttcttttattttcctttctcttttctctttgattgattttaagtgcaaaacacattagctaatttctttggattttttcttgtttgcctttttatgtcctttccactgttctttgttttaagttatttgatttgttgttttggtcatttcaataacgggtatacatgacaattttagcatatactgggagcgtgtggtttcttttatgtctgtattatccaaggttgtatgattatttattcatattctgatttaatgcatccacatgaagcatttttatcagattggatagaaaaatattaagaggctttgggagtatatatgaagttcagctaataatcttttgttgaagaacaaaataaattgaagtttaaatactactttttctctctaacttatatatttggatatgctatttttcagtattttatgtatattttcctattatcaatttattttatattttttacttaaaatgacaaacctttcttgatagtttgtagagacaaaataaattgtagatacttatgaccaactttcattttatgtagcaaaatttgtgcaaagtgcttaagaacatttgtaaaaagatatcaactatagcttagactaatttttgtatgtcttagactaatgtgtgaaaatatatcaactataactccataatccgaatgagacatccaaacagcttgaaaatgaaaagcattgttcttctttgtcttagtccttttcaatgtgtatatatctacacaaatcagtccttaaaataccaagactaatttatgtatgttcattttgtg

SEQ ID NO: 1783 - DNA, 1100 bp, Glycine max
  Soy_ogl_3467 Gm10:40179201..40180300 Cluster 7
aataatttcgtaaagtataacactgttaaaaaagtatatactaataaattagtttttttctctctattataattaacatatttgacttcttaatattactttgaagaatatctataaacttcaattcttaagattgattatgaaactataatagagaaaaaaaaaaactaatttattagtatatacttttttaacatttatgtaataattgaattcatgtcattttcttacaatatcaatgtgttatcaaccgattaacattcaataatttttttccttggaacatttaagatcttctaatattatactcctaatttaactatgccatgagttagagtaataaatacatttattaaatacttctaatttaacaatttggttttcttaagagaaaaaaaaaatttagttaatatagacaaacttatacgttaaaaaaaaaaaaaaacttagaagttagttgacgctgaacacactctcctttgacttattttccataactttcaaataaataaggatatgttaataatattttgttttacacaaaaaaaaaatgcagctcagctccttacaccatgcacacattaaaatgaaaaacatgtcattgaaattaatttaaagacacgttttaatggttcaaaattaatattatcaaattttatattaaatgaacctaaatcttctaaaataatgttgattttttttctttttcatatttagtttatgaaagtttatcccaggattttttaagaacacaaatttgtgaggttttgaggctgggagtagagtgtcgagagacaatgtcataatttcataacaaaatcatttttacgtgaccataatgtttataataataataattaaaacgtttgaaatattggtaaaataattttagtacgaatattactattattttaatacattcaaaatttttaaatatttgccttaataatcactgcactcaatatttgaccaaactgtaatcaaatgggtataattcaaagggtttcattcaaagttcagaaaatttggaagtggatatgcttgtattgtaatttgtaagtgttgttgtttggcaacatcttttatccgcaaagttaatt

SEQ ID NO: 1784 - DNA, 1800 bp, Glycine max
  Soy_ogl_732 Gm02:48309301..48311100 Cluster 7
aaacctagtgaaatttagtgagtttactaatgactgcaaagtttatataaaactaaacctagtgaaatttagtgagtttattggatcttttcaacaggtacgtgtagttaaaatgaaaataaacaaataaataaacctatatcaacttataaacagggcggatatgagctgcaagcctgcaattacctattaaatgatatgactaaattatcctacctatataaatgtagttgtcctgtttgtttcatcctcattatttttcattccttgttcataatcactttacatgtatgtgaaatttgttgcgttgatatatatatttttcttccaattaagtatatactaaacttagaaaaatgtattttatatatatatatgccaaatctaatggataccggcatgacagataccctatagatatatagtgaatttttattcacaagaacaaatagaatgtaactactactcttactatctcactagctctagtgacatttttacactcatatttatctctcacatatatataaagaaaaaaatagcaattgaaacatttttttgttacataaaaatttaggaaaagggaatgaattgaatagtgtttttagactcaaagaatatttatataaatatttatacttgtctcatcataagaagatgagtgaaaacttgaatacacaatctgtcatataaacatttcttatgacagaaaattgtaatttattttatattatatttaggttctatatgataatatcatgttgcattagttgctaacacgatgcatcaaattattgatattactttaccataaaaacaaaaagatttttgggtgaacatattcctgatgtgaaacatctgttgtcttcgtcgatctttattttttagtatataataacaacattaagaatcaaatataagttcttatgcatctattcataccactaagtcgatcctaatagttctatcatcttaatttgcaatgattactttcattaaaaacaatttaactaattacttttagttgaattttttttaatcatattttctttacttacacctgaaattgagatgttgtgaagaataacaagtaatgtctttccctggaaaaaaacaaatagtgtgtaaagatattaattaagaaattaataaatatatattcttatataatattatatgaatatgaataacataacagccaaaatataatctgcttcttcttaagtcaaaaattaggattcaaccaacaccattggaaaactgttagctggtgaagcagagaccataattatttaagttattgaaacgttgaaccgaaagtcttacttttgaccattaaatttaaatcactcctctgcaaggctcttttaaccattccttattcgtcaaacctctgcatatcaatccaagaaacattcacttttatgagatattctagcatgcagatattttaccctgctgggaaatcgcaggccttttattttcacccatttgaacttttcctcattctttttattttcggcacaagaactagtcctttttaattgaagaaacaaattctagtaccttgtaattctatcagatggataatagagaatcaagactcacttattgcatgtttattagattagaggagcactaatttacatgacacacaaatttataagtagaaacgtgacatttttttacttgcagttaaaagtaaatatattatatttttctttcttttttttaagtctttctttatattatataactttatcataaattattttataattaaaaattatattccttttc

SEQ ID NO: 1785 - DNA, 1045 bp, Glycine max
  Soy_ogl_2205 Gm07:5127801..5128845 Cluster 7
caaaaaaaaagagttatatatttaatggagttaggtccaaggaaaataaaggattaatttttaaccaattaagatttaaatctctacttactaaaaaaaaataatacatttagtgttttttcttattatcattatattggtctaaagtattcattaatttttgttaagaaatctaactaaaaattatttttattaatcatgttaaatatgagatgccttaaacatcgtaattcaatacattccaactaatgatataatgatacattcagaatttgattgtgcttaaataatattttttttataaaaatatctattaggaaagaaaaagagtcttatttattataaattttttatatattcttgtgagttacaattaattataatattttattttattaaaaaatgagttaatattatgatttattttatgatatttaagtttattaattttagatacctcatcctgattagtgtgaaaaaataacatgaatttaaccattagacctataataaaatgtgtctaaagttaataaataataagattagatctcatttatcctatgtagcaattgttcataaggatttctacatattgtgcaaggcacatgttattctcattttcttgattatgttttcaacaaataagtagcatgagggtattctaaactcataaattcattcttgataaatttacgctatcatttaaagtttatgttgattttttataattgatatgggtgttccgttccgtccatatattatataacccatgtgcatgatgaaggtcgaagaaggagaagttaactaaattcccccgtcgtcactgccacgtcactctcatccatacaaatgaacccatgtgcatgaataaataaaaaaggcgcacttaacgttaatgtgcttcttctctttaatttgccttgtccattcagccggaaaatctaagaagcaaaaagagactttgaattaatggctcttcatcttcaaaacccaccatcactactactcaccggccaaaatgactgcataatattctaccccaaat

SEQ ID NO: 1786 - DNA, 1500 bp, Glycine max
  Soy_ogl_4011 Gm12:7652401..7653900 Cluster 7
ccattatgatagatattcttggatgccaagagtggaacgtttattatgatagatattcttggatgccaagagtggaacgtttatctaggtgatccaatgtcctcatcaaataactcttcagaatcttaaattattcgtaatttttaaattttataatatgcccttataaactttagtctctttaaaatatactttatctatccctttgttgattatatttcttccaacttgtaacaaaaccaagttcacgaccaatgtgtcattgatctgactgaaaatagactcagtcatagacaaccagtttttaagtcaaactaattttaaaatcagttttgaaccaatttaaaattttgttttttatggaaaaatgaatttagaaatggtttttagtcataatattagttttaaaacatttttttaaccaagccatttgttaaaacataatcactttgatttaaatatcagatttaattttaaaatataatttggttcaaattaatgttttgatttgctttaacataggtttctttcaaatccttaccgtcgagacgaagcaaattaaaaatgcctactctttcttttttcctcttcttattttaggttgtcagagctgttgatatcatgatatattgcaagtgtcgaacaaattgatggctaaactgaagagaagccaaaaataaataaataaaagcacgtgagaagggtgagagagagagaaaaatatgaaagtataaaacaattaatacataggacaagttggcagccaaaaaagatgtacatgcacattctcatgttgtatttactcccattatgaagctagctgaatattcgggcacgttacattttcattctagctgctgtataatttattagtatgttaaaaagtgaggaagttcactttagatagtaataaagtctaataattgtttattgtagaaaataacagttatgaatagtgataaaatcaaagaattataacaatctaagcttaaatataattttaatagttaatttcttaattaattgttattattatactttatccctctaaaataatttgtttcattttagacgagttaaatcctaataggttatattatttttattgaagaatctaattttcatgttctctaaaaaatataatttttttatacaaatgaccaataaaatttaccataaatataatttttaaaataattattatatattcaataccatacatgcttatttattaaatgttgttagcatatttaaattaaattatacaataattttttatcagataatatttcaaaattcattattaagttaaaatttttatcatataaattacaataaataattaatagattacataagtttgttaaattttattataagaactatatatcgttaataaagttttttgattaattcacagcataaaaaattttatgcagatagtacatgtcaattaaattctataaattatatttataacattttatattacttcataat

SEQ ID NO: 1787 - DNA, 1589 bp, Glycine max
  Soy_ogl_6239 Gm18:58085919..58087507 Cluster 7
atagtaggaacgtacgtactacgtaggaaaagatacatgcatgcctccactctttcggaaaatagtaataatataattaacgctaaaaggtgctgataacggaggacaagatgctgcgtaagcatacgttaagttgaaacaaatataatttatcaaatggagtaaaccattgcgttcgattcttttctatccattaacaactaacgccaccgtgttttttaagatctgtgctcattaagaaaaacaaagcaacttgctgaaaccttttatccacatacatatatggttagttaaccttaatccccattgctcaagcagatattaaatattctttgtgagcactgagcagccctcatatgtttatgtactgaaagatcaatattacttgttagtgataaagactacttaagggataagaatgaacatagctgcaggaatattcttggttttttttagtactgcacaattaattctgtatttatgtctctctttagtctttttcggctttccatcatgcatatatctaatatttactttaaatttattggtatctttttttttttactcttcctgaattttatatttcatacattcttttaattaaaaaatgtctgacaaaattacttctttaattcgataacataaggaaacaaatttacgcgtcgtcaattattttttcaaagcaatttctaggaagttgacataaccatgggaaatggctttattaaaagttcaagttatgcaaatttaattaaactacatatggttataagttgcatgaagagtctagtatacttaaactgtcagatatagagtgcatttaattaaatacacttatataataagcttttattaaatgaggctttattcataaacttaagtataaaacttactgttgtaaaaaaatataaaacttaatgaactaaaataaaaacaacacattttacttaatttcttcataaaattacccattaaaatataataaaaaattaaaaaaggtaatgaataatttttataagcaaaaaaaagaattttaaatattcccattatgtatgagtaattttaccatttcttaataaacttccgctataattttgaaaacaatagtatacttctttttgaagaaaaacataatagtatattttttcaattgtgtataaacgttaaattacaataaccagtttcctaaaatcaaattgattaaaagacagattctaaagtatgtaagaaaacaaatacgaagtgttccagttgattaaaattttaaataaaaagtgctattataatgttttttttccttttccagaagatatttcagtgtgttttaaaaagtataaattaaataatttatatattttcattttctaatatctaattatgatcatttttagttagtttaaaatatattatttttatcaagaaaaccataagaaatgccccaaggtctcatccccctctccattgtatagtccaatattaacataaattattagggtagaaataagtcaaatcaggtacctaaacctaacatgctttaaatttttgtggccaagcttggcatggcctatcttcatagcttgtttattgag

SEQ ID NO: 1788 - DNA, 1000 bp, Glycine max
  Soy_ogl_6910 Gm20:41188668..41189667 Cluster 7
tagtttttacaaaatttcaacaaataaatgcattaaagtatgtaaaaaaatctataaatctacgtatgttgtagatttattaacaaacataactatgttactattgttgtgattattttcggtcactaaagaagtcaaagaatgtctaatttttttttaaaataaatcacatgaaaatacataccattatattagttttcacaaaatttcaacaaataaatgcattaaaatatgtgaaaattctataaatctacgtatgttgtattttatatgaagtcttagttttttctttttattaatcaggtataagtttaaacttcaaactatgtcaccactgttgtaaaaaaatgctagtatttcgttagagcaatggatgtaatttaagtaacacgttttaatttatttactttatcttaattgattcttacaatatatttcatattataattaaacaactcatatatattttattcttataatataattttaaataattttaaaattactccctaaatgatccttaaaggatataaacaaccattatttatacaagtaattagaacttaattttaagtaaccgaatataatattagatcagttaaaaaaaataatatctaaaaataaacaacttattaagtaatgagctgttaagatgttattataatataccatctatgacttacatcaatccaataatttttttataaagtgcacctataaccaataatttgaaaatggaattgcaccaatccagtacgtaaaaaagtctatatgcgccttcaaattcatatactatctttttaaaaaaaaaaactttttatcactcgtttacaacattaacattcactttgtactgcaattttggctaagtgagtatttcttgtactctcaggaccatgagtgctaaaaaaattcaaacaactataatatggggagaaaagaaaaattaattcctttcggtgataatgataattttattttgttgacttttctaaaactc

SEQ ID NO: 1789 - DNA, 1000 bp, Glycine max
  Soy_ogl_815 Gm03:3174101..3175100 Cluster 7
ttcataagtagttttaaggggggaaataagaagataaaatgaattaaacttcttttagaaattaaaattaatttctattcttaaattttttatattttttcttttaatttcaccagaagttaagataatctttatcttttctgtttatatttagtgtacataacacaagacacttctaaattattcatcctacttatttttcttagtagataaaagatatttattgggataaatttattcataagaacgtatataataagaaaaacacaagtaaaataaaataaatttcttttaaattaaatatatcccttattttttactaattttttttatcttttaagaaatacattttgattttacatctcttaaatttgggtaaatataatgtttgtccttctctaaaataataataattttttattttgaaacacagctttaaacttttttttaactaattcaagatgtaaaacttatatattacatttatctacatgaaaactaccaaattcaactcatgtttgaactgaaatggattataaacatgatgaaaaatcatgtgagaagtaagtctcacaaacaactggaaaaagatttgatattaaaatttttagctttctagttgcttgttggtatcgcttttcacattacttttttatgtgtttatgatcatttttatttcaacattagtcgagtttcatttttttcatctagataaatataatatttaactctttaattattaacctataggataaaaaaaatattataatattttctaaatctaattaaatttggattttcatttatgtggagcaatattgtgtgcttcttttttcgcagttttttgtttctacttttattgtcatattatttttctcaaagaacatctttggttggaatatgcattgggctgccgtttcttgaatgaccaaacacaacgacgtaccaaaatttggtacccatcaatttttattttattttgtaaaggtgacggagatga

SEQ ID NO: 1790 - DNA, 1442 bp, Glycine max
  Soy_ogl_1258 Gm04:6595059..6596500 Cluster 7
caaaaattagaatttgagattaagacaaaataactccgcagtaattgatgcattgatttaatgagtcgtgcttctagttctagttcagaattgtatgacaaatttcaatttaatatacacaaaagcaaaagatgtactcaagcttgtacaagcagtatctttcgatttactctttttgttgaactcacaactcaatctatctctttcacggaagttaacaattaattagttttatatagagagactaagtattctttatgggaattcgatgacaatcttgctctttttttttgttaatttgcaaatgatacctttttgagtgaataatatatacactattaattagtgcaaatatcttttatattctcttcaaatcacaaccctattcacaaccgtgtccaattataaccatgtgagtttgggtggacatttataaatttgattttaattaaaattaattttgagataatgtaatttatgtttgaatatttttattttaacaataagctagaagaaaattttaatatataatttttaatctaatacaaaaattacataagctgcttcaagtcaaaattaagttcttaacttgaaattaaacatgtaaaaatctatctaaaattcagttcaacgtatattttaacacgattttgaattatttgacgtgaatccgaaacatacacaataatattctaacatattaatgagacaattcagaggtgttatataattataaagacatatatttttaatgagggttggatcagagctagtcctttataatgtgaagaatcaagttttgaattcttaattaacgaaatagatgtctatatttagtgtgtgtttgtgtctcaaattaaataggattgtttctgaaatagaatacttgtgataaaaaaaacttacatattaacttaactaataagtcaacatttatttgagtttatagtctagattatttttttatttgagtaagtgatttttttaataaaaagtaaatttattcaatctttttattcccagtcccgccacactctttttttttctcttacttagccgcattcttgccagctgccaccccgcttccactcaattcatgccatatctaattaaatttggatgattaatattgattgaaaaaggctagtataatagcccctccccctttattgggacaatatatatgagttgactaataaacacatgtttaaattaaaagtgttttttattaataattatttttaaatctcaataattttttagtaaaaaaaatataagataagttctcaactaaacacactcaatataaataaagaaaatacacaagttcagtccgcttttttattttcctctcttttgttttatttgtgttgtaataattaattggcaactttatccctttcttaatctttagctctatcccagttggttgtcattatatt

SEQ ID NO: 1791 - DNA, 1360 bp, Glycine max
  Soy_ogl_3387 Gm10:6296230..6297589 Cluster 7
tattcatctccataggcagcctcctaatatttctcctaatattcatcaaaattagtaattttaataaattttcattaatcataaagaaaatgttagaaaaagaatatcaaatatagtgtcactaaaatttcttacataaaaataaggattttttttcttcaaaataatacttatcaatttttttcttatattgttttgaaattagtttctttagaactattttaaaaagtaaatttaaaaaattaaaaattaaaacacaattaaattggttcaaaatatcattaataaaatgaatttaatccgtttttgtctctatataatatagaaattggataatttgaatcctaagtttttcattggtaattttgattttcatattttaaaattatacttagtccatttattaacttaacaaagatagttagttgagtaatgcaattttaagtgatgaactttttaaatattttttgttaacacaactcgaccatttttgttatattttttttattgaacttctaaaaaaatcacaacttagaaatataaaaaaaaaaaaaagaagcgtgcaggctgtggggttcgaacccacgcgcacttatgtgcagaagatcttaagtcttcccccttaaccactcgggcaaacctgctacaattgtccacttaatggtttattatatataaattatttatagtattactgtcaaatacaaatgttttgacacaattatttattgccggttcattctcttattagcaaaagtacaatacataataaatgcataacaaaaatactagtaattaatagatttaataaattttttagatttaattaagtatgtaatttttaaaaatagtttaattatatcctttactttaaaataatcaattagatttcttatgttttaaaataggtttaatttaatatcattttaaaccaactttggtcctatctttttaaaaattttggaacaaattgaataagaaaatagaaccaacaaggttttacctattggtaaatatttaggtttctctaaccgtatgtatgaataagattttgttaagagagataaaattaatttatttttactccttaagaattagtataaaaatatcttattttttaagagaaaaaaaaattcaacttattttacaacataataatctttaatggaccaaccctcggaatataaaatatataaatgagcttttctcactttttcatcccctcttgaaactccctcatatacaaattgtgtattaaagatttaatgttttaagagtaaggttctttaaactgtatattctaatttataatataaaaataaataagactagacatgtctacatctttaattagttgttc

SEQ ID NO: 1792 - DNA, 1278 bp, Glycine max
  Soy_ogl_4013 Gm12:7700701..7701978 Cluster 7
atataaattaatacaacataaatagaatatataatagtttaagaaatataatttttcaactttcaaataaaaaataaaggatgttttgatataaaaaacatataaacatcactcatataaagattgtttacattaatttaaatataaataactaagagtctcatgacataaaaaacaaataatcataaaaaaaattaatcacccaaatgaaattctctaatatgattatttatatgacagatgcatataaatattgataagcacaacataaataaaatatataattacataaaaaatataatttttatacgtccaaattaaaaaaaaacccaaaggttgttttattataaaaagaaattatataattttttttaaaaaaatataatttttatatttaaattaaaaatgagtgagatataaaatagaatttaaacactattcatataaaaatgtatacattaaaattatatataaatatataaaagtctcttaacatcataaaaccaattattataaaaaaaatcaccgaaattaattttctctattatgaatatccatgcaatgaatgaatataaatatgtattagcataacataaaaagagtatataataatttaaaaaaatataatttttatactttcaaatgaaaaatgaaggatatcttaatataaaaggaaatttaaacatgattcatataaattttatatacattaaatttaaatataaatatctaaaagttttgatccatatttattaaaaaaaaagtaattatcacaataatgaattttttctaatatgattaattgtatgacagaggaatacaaatattgattggcatagcgtaagtaaaatatataataattttaaaaaatataatttttatacttttaaattaaaatactgaaggatattttgttagaaaaaaatataaacatcattcatatcaaaaattgtatatattaaatttaaatgaaatatatttaaaaaaaattaaaaagtctcttggcataaaaaaataatgattattaaaaaaaaattatatatatatatgtacaacataaataaaatatataatttttatactttcaaactaacaaaataaggatgttttaatatataaagaaatttaaatattcttgatataaaagttgtatatattaaaattaattataaattagtgttttgacataaaaagaacaatgattatttaaaaaaaacacaaattatattttcctattatgaacatatgtgcgatagtgaatataaatataggtaacac

SEQ ID NO: 1793 - DNA, 1100 bp, Glycine max
  Soy_ogl_5029 Gm15:12935701..12936800 Cluster 7
gaccttgttttgattattacctttcatttttctctttacaatgatgattattattctttatttgtctcctctctcctgagaagtgtggaaattttcttgcacattttgcgcatcggattgaattcttgcaccccatcttttttgtattttggatttgctatttaactatgcatgctatttttattttttttggatgctttttggagtaaaccaaagaaaaatgcaagagccatgtgtagaacacactccaaattaatcttacatcttctttttcttttatatacaagcaatgaatgcccctttgatcgagagttgagcctcattgaactgttatattcttcatacaatttcttgtgttcaattagtttcacccacaattttaacagaaaagataagtttaacatctaattgaaaaaaaaaatagaggatttcaaactggttaacaagttcaattagtttggttaaaaatctgaattcatttcggtctctaaaatgaatttcaaactggttaacagttccattttttatatgtttattttcaggttagaagattttaaaattaattctgagttttgaattgattttgagttaaaataattaaaaataacttttgtgttagattaaaaaattatattgaattttatttttaacttaattcaataattaaaacatctaaatataaattaaatcacatcaaaattaattttaatcaaaatcagtttcattcaaaattaattttatcaatgttcatgaaaaatgtacttaatttaatttcaaattttagacttaaatatgttattagtatttgtaagttaaactttttcatttatggtcttttaagttcaattttttttaattttagtttttgtaagttgacatttttttttaattttagttcttttaagatattttatttatttatagtcgatgtaaatttatgttttttttcatttttgatccatttaaatccgaattaatagaaactataaatgaaaaaaaattgaatattaaaatgactaaattaaaaaaagtacaaatttatagggattaaaaataaatagaacttgtatgcaccaaaattaaaaaaacataaaatgaac

SEQ ID NO: 1794 - DNA, 1054 bp, Glycine max
  Soy_ogl_6168 Gm18:54257447..54258500 Cluster 7
ataaataattttatcaaataattataattcaataagataacttttcaatttttaactatcaatcattttttcaattcccaattaacttttaagttagcttttgtcaaatatattcttagtaaaataaaatgtattgtatttattatttaacacttaacaatatttatggattattgtcaccaaaagatggtatttatggtttaatttttaaatgtcctaaaattcatgacatgaggaaaactaaaaatttgtgtccaaaatataagttggggttctaaaaattaaagtaaataaaaattgaaagaaaagctgcagcagtgtaatacaaaaagaaagatgatttagttcactgattaggtcaattgaccaggaaattgttattgtagcaaaaaaaaaaatgaggaagttgttatgtattatgattgaagtacaggcaattatggtaagacaagtttggttttgaaaaggacaaaaaaagtacatgcagcatgcaggtgcaagagcaggtgcgttgcatgcatgcaagttgaatgctaaggcaacaagacacatgtctcattcaaccttcatctgcaaactcttatcctgctatagtgctatttacttatatatatttcatctacattttaacaaaattatgtttaagagctcatgaaaattagacaagattaaaattttgtcttactattaagtaagtagtagtctagtagatagtctatcttaaaatattttctccaattaaagcaaattaatgctagaaattaaaaatattttttcactacatgaattttatttctgatataaagtttaaagcttcaactcttaacgaaatgtaataacgtacttaagagatgctttttcttcttcttattttcaattttaatttttataatttattattaggtattagtcatgggaatgtgatattctatttagaattgcatgtttaatatataattgaatgtttatgtttatattttttcatgtattcttattctctatatttgattctttagtttaaaaaagcgaaagaaaaaaatattttttatctgac

SEQ ID NO: 1795 - DNA, 1300 bp, Glycine max
  Soy_ogl_955 Gm03:38995201..38996500 Cluster 7
aatggttagtcaaggcaacaaaaaaaaaaccaaaagaatcagcctgcaccatcgcatgaacgtattggcatggtcactattattgttcagaaacaacgtagaaataacaggaaaatccttgtgttgtgcgcagtgccgattgtgagtgtgatctcatctcatctctttgatttaaatgcacaacccggtggaagaagaaaaagtttccgatgtgaactcatggattccaatgtcagcctctatttattttggtggggggacattacatttttattttatttggtcatccaccaaaatgttttttctctctattttatctggtcaggaaaactctctcgaggcttaatggtggaccttttaaccaaaatgatgtattttttttcataacaaaatggatagattttaaaataaattatagaaatgaataaatgatactttcaaacacgattttaatatgaaaaaatcatacttctaaagatgatttcacttttctagtttttcttattttattttaatttttattacataagaaacagaccaaatatgcattttatgggcactaaagaaaaaatttgtaataattttttaacggctacaatttatttaaaaaataaataaataaataaactggaaaagtaaaatattctttagaagaatgatttttcatgttggaattatctttggaagcacgatggatacatttctttttattaaaaaaacttaattaatatgttttttttcctaaaatagagtcacattttatttttggttcttaactttttttacataatttttggtccttatatatttttttaatccttgttctttttgtttagtccttctaatatacatctatttttttgtttgtattagtctctataatacgcagaatgtttgcttttagttcttatcagatatttttttaaaggaaatgaacaaaatattataggaactaaaataaaaaaaaatagatttattagaatgaccaaaacaaaaaaacaagaaggaaaatttcaaaaaaaatattgggactaaaagttaagcaaaatatgactatatttcagaaacaaataacatatttaagctattttaaaaaattgacttaagttttttttttttgcaatcaacctaataaaattaataacgagtttaataaataagtattaaatagtttactttttaaagtgtggaatagaaataggcataaaaggcagaaaaaataaaagttcaaactatactgaaaggatcgacaaattcattgaaatatgttaaatataaaactgattttatgattttggca

SEQ ID NO: 1796 - DNA, 1000 bp, Glycine max
  Soy_ogl_1735 Gm05:38675601..38676600 Cluster 7
aatattttgtgctctgcccatagttgaaaattttgaatgtttggggcccattccttattatgcacatgcaaaagtataaaacaatgctcagagatttctcttaaaacaatggttaagcaatactagtaatattttaagaaaaaaactgatatatgtaagatgtttgattttttttttatctatggaaatagaagagtgtgagagatttgtaataactatgtataatatatgatatttaatataattatataattcacatgatatattaaaaaggtgaatttgaagatataagattaacttaatagtaaaggaaaaatgaaaaaaaaaattatgggttcaaattttttactagcaaaataataaataatatttattgataaaaaaagtgaatttattcataaaagttttgatgtaggaaaataaaaaaatcaaatttaacatataaaatatataattaaattaaaaattacatattcttaataattcttaattacatattttatcactcaattatcattattttatgaattttattattggatttttttttacattttaccattatacttttaatttttttcacattttatgactcaagtttctccacacatctcacggtcatgtttttcaatttttgtactttgtatattttatcgtcattttgataacaaaacgaagttgttcacataaacatatgacaataaaaccatatttcattggagatatgtctggaattccttacacatttaagaaactgatataatgtgcaaaaattaaaatagatgttggtaaaatgtgagaagaaaacttaactgataaagttcaccaaatagtgataattaggagataaaataaaaaattaaacctttttaataaaaattaaagttcgcctttatcccaaccgaggaaaaataagtttcttacattttatgaattgaatctgatatcggataagaattaagatgacagagaacttgggaataataactgctaatatcat

SEQ ID NO: 1797 - DNA, 1400 bp, Glycine max
  Soy_ogl_2256 Gm07:7662001..7663400 Cluster 7
cataagtgcccctgtggaggaaataatggtaaacactgcgatgatcactttacactagaattcaacatctaaggtaataatgaacagtgttgtgctatagagacatcctcatcccagaatttgttgttttcatggaggaaggataaaatataaatatagtaaattcagtttattttaagaagattagtactcatttaaaaaactcacaaatctcactaaaaacttataaattatctgtcaatgaaaaatcattaacaaattttatatttaagactatttttgttattgctattcaattttattaactaggtcaatatcctatattttaattagctttatatattttaatattacccacttattaatggtgctaatcatttcttttcttttcttttttgtttttggtgctaatcatttctgttatgtaagatcacgtgcaggatcaaatttcccatatgttatttcatcaaataggggagaaaggatgggctaaataaaaaacatggcaatcaacaaaacgtagatgtaactttttagcctagaaattaattaaagaaacgtgttccatgtcatggttaatttgattttttttattgatctgacattcccgtccacaaaactacgatttattctcaggctgagaaggccatttggtatcttatttttctactaaacaatgactcaagaatttgattacaggtataattcataatttccactgcgaccaagtggagttggtttgatttcaactttatcgaaatatttgagagaattaagtgttccaaaatttactagactgggtgggaggcacactcttcaaactcttcagagaaggattttaagcataatcaaaattttactcagcctgaaaatattcttacttaatttaaaaaaatgatgatatacaataagtgtcttttccaatgctaagagaccaaattaagctatgagcatggttatgtattatcttctctaaactaatctcacccgcaaaacgtatttatagtaaataactgaaataagttgtaagaaaagagatcataaaacattgagacctgtataattattgtaaatgatgtgataagtgtcattggctatgttgaatatatagctaacctccacattctctcaagtaaataaactaatttatctcttggagaaactaagtagtaacgttttttgacaatttattaaaaagactttcaataagatataattaattgttaaacataattttagtccttataaatactgaaaaatttatttttatttcttttactttaaattattaatttttagtcactgtaacaattgaatcctattgttgactcagtcaactaagttaacaatgatttaatttttgggaataaaaaagtattaaaaaatacaatctataaatt

SEQ ID NO: 1798 - DNA, 1100 bp, Glycine max
  Soy_ogl_3754 Gm11:5627801..5628900 Cluster 7
tatgtttctaataatgtaaatcatgaatgagttaaaatatttatcattaattttatgataagtaattgaaattatttatttttatctttacttattttagaaaagctaaatctatacagataatatcaattattaattttcttatcaataactaggattgctaactttactttctaaaacgattaacatcactcaaatccaataaataataacatatattaaaattaaataacttaaatatgtttttaattcttctaaaactagtgagttttaattttagtctttctaaattattattttttagtattcatcctttaaatagttgaaattttatttttgaacccattttttaaagaattcttttgtctaaattattatgagacaatcgttacttatcagcttatatgtttaacaaaaggtcaagtgtccctctcatgtaacacctgtagctgtgggtaaatgtcaatatgtgaagtctaaccgtgggtaaatgtcaatacgcgaagtcttcaaaaaaaatttattgatccttaaaataaatattatttttctatattaaaataaacttttaagaacaaaaatagtgatttggaattttgagaggtttaaatcaaagaaaagtattttacagggaccaaagttaaaaataataattttaaacacactcattttataggaattacaaatatgtttaagggaaattcaaccaacaatttatatatatatcatgtcactttaatatatggtgaccagttcagtactacttttacttgtacttaaaatttaattatctctgtactaacatgcactcattcgtcaccggagtttcactcatttagttaatgtttagttcatgaatcatgattccaatccagaattttttatcatttttaatttataaattacccccgacattacaatgaggataaataaaaatagtcatgttcatatttaatattaaaatacgtaatatatgtagagaatataaatttgtaaatctgtgccttaagtaagttataataatcaaaatacatttcattaaataatcagtaaattacaacccctattgtacgagatgcaagttaataattaaattttat

SEQ ID NO: 1799 - DNA, 1316 bp, Glycine max
  Soy_ogl_3913 Gm11:35895047..35896362 Cluster 7
tcttatttaaattattttaacaagtatttttattgttttcgtaggattaatttttaaaattaattaatctttaaagtcaaagtacaattcccgactttaaagtcgcaagataattagcgaagtcatactgtcccatatgactttagttcatttaattttaaaaaagaaacaaaattaataaaataacaaaaatcataaaatagtttaggacttcattaaaaaaaattaaaaaaagtcccgaaaatcatatgacttctatatctcaagtcgtaaccatccatatgatttatctccaattggtaaataattcaaaaattattcccatttaataaattttaaaaggtaaaaaaaatggttgttacaagtatttacctttattttgtaacccaggttaccgaagaggagtagcactgcaagagaagataaagcccaattagtagaaatctatatctcagctggagtgattaattagtttatcgctacttgtatggtgatgattagagaggtaaataagtttaagcttaacagtaaggttaaattaatcaataagtcttgaattattttagcatatattgtctttttttttcacatctatcttatttctcttctctctaccaaataggggttaagtgattatatattgttttagtgaagtggcaatgaaattttatttttcattgtgataagtttcattttacttaaaattgtttaactcaaaattaattctagatacagagtcaattttaaaatattttgtaacataaaatcaaacatctaaaattcaatctaaaatcacttctgaatccaaaattaattttttaacataaaatgaaacacacttagttttcatgctccgtcgtcaatatccatattgaaaaacctttccaacaattcgagtctaaaaattaacattcatattatactcaaaccctgtccataataatatccttccatagaaccgatctatcattttattttatatatttaaaagtgcaatattatggtaaaaacatgtactatatataaattgtagcaactatatagctgtaatgttgtcacgtgtaaatctaattaatattatattgtagtgttttctatttcagaagtgaggaaaatctcacatcaaaatttggcagaatctcatcctgttagtattcatgtttcgagctttagttagttagatgtctgctaaagttgtgttctatacttctatcagtgagcaaattacgaaacttgacttttttctgaaaggagaaagaaagaatcaatttcgaaacaatagagttgtagaaggttgtataagaaagatagtaatt

SEQ ID NO: 1800 - DNA, 1297 bp, Glycine max
  Soy_ogl_5036 Gm15:13240218..13241514 Cluster 7
gaaaattaaagttgttatttaataaggtatggaaccaaagacaatttttttagatataagtaggaggaaggatattataaaagaccttacccaggttagtataaactttttgtcatgtaaaatgtcctcattttatacgaaatttgtagggcttaacttaatcattaataatttaatcacaaacttgcttttgtaatttaataaatgtaaaatgtaggtgataattaattatatttcagtaattaaataaattaaaatatttttatgttgctatcaatgttgtcactatttgtacccaaaagaattaattgtcattataattatttaatatccaaattaataagtcagtactcgaaccgtacgcgtgttttcttctcgtttaaatagaaagaaaaatgttatattttattattatacaaatcttagcttggcatgcacttgtttacaagatcaagcgaaatttccgcttatcatgttaattagcaatatatcatattataaaaggatttttttatccattgaaatcaaatataataaatttataacaatttattatttttacttaatccattaagctaaattcatatgtcaacattgtttatcctaatcaatattaacttcaagcaattgttatatatagaaacgaccccaggtcaccataactaataaaatctaagttaaaagacaaaattaccttaagtaacataagggccaacattatgcttagctcgagggatacttgcacttaaataatgaacacttagacatatggccacatgtcttcttgtacgaaatgcaacatatctaatgagttctcctgccaaacacatttatattgagactcttctcagctatggataatttcactcatttctcattattccttggacactttctgatttgaagatgctaccactagagtagtttgagattcatgaagatccaccatgtgtcactaaccagaatcctatctctcaggttcacattacaaaatacacagacacacaaatgagaaattagtgaagataaaaaaaaagaaaaaaaatccaataacttataagtaaattaaagtcattataaaaaataagttaaaattactaaaataaatgcatctactaaatatatttatttcaaattaacttattataatactgtacactttctttcattctaatacgaatcaataaaataataactaaattataattttaatcttcttaacgtttttgtagaagttgaacttataaatttttatttaaagacataacaataaatcattaagtcattttttctattc

SEQ ID NO: 1801 - DNA, 1385 bp, Glycine max
  Soy_ogl_5190 Gm15:50380101..50381485 Cluster 7
ggaaaaaaacttaaattttcggataacttattatgtaactaagaaaatctgatgtttctatttaacaataataattttttatattcaaactgtctgaaagaattaagcaactatcaataaaaatattattgatacgtttgaaaaaatcattaaagaagattctacctacctaattaagaatatgatggttgttgatatatataagaaattcaagccacaacaaacacacaagttcaggttgactttcttgaaattcacaaagtgtactaagtttcaaatggaaagtataccgaaagtatactttgatttgttaccatttccaaagatattggtcagagaatattttgcttttttttattcaattagtataatggcaccaaaagagatatataaaagtttgggaaattacattttcttttttttatcaaagagaggtagcagggccgattgtgctccttgggatgaatttgctgttgacattgatttccatttttttaagaacatttcaaacaatccaattgtaattatactacaatttgtgtaaccttcaatatttatcactattttattttttagtttgtgtaaatttcaaccttgtggttttaaattgataggaagatgcatcaacattaataattattttgttaacaataactcatgttatcttttattaaattgaattattttttattgttttacttaatgtatgtcaaaacaaataattgaataaaaaaacttcataatttcttttaattaaacaattatattatttgataaaaaattatcataaaattacaccaactatctgctatcccgtgtatcacacggtcaaaaactagttggaataatgaattagaagagaatccaatctaaaatagaattttttttggtacagatagattattcaatttaattgaaagagttttatgattaaatattatattaagtcttttgttctattttaccatactcctaacattaattgtcatcctttaagaattgacgttttttgtactcgtttcttctacagcataacttaagtatatttggtattgcaccttaattcaattaatagacagtctttttgtagtctaattctcaattaaaacatcaatagttaaaacttaaaagataagatgagagtccaaatgtgcttcacggtgatatcttagaggtttttaaaccaaatgtgcttcacgattaattagccaagtttgcgtgtatagctaaagatatgcatacacgattaattagccaagtttgcgtgtatagctaaagatatgcatatattgtttagaggattaccatcaccaaatagccgatgctattcttttggatgtatagaaccttttttatctgaataaagatccaaattcttacctaaa

SEQ ID NO: 1802 - DNA, 1200 bp, Glycine max
  Soy_ogl_5193 Gm15:50418501..50419700 Cluster 7
tataaaaatattgttccgactaattatagttgtactattctttttttcttattttagttatataatcaaatatatttttctttcttattttagttttacatcgacaacataaataacactatttattttactacggctggacaaaaaaatatcacaatggataatttgtgctaatggaacattagtcctttctagttattaacgatattgttggtgtgaagaataacattaagcattattttcttcataaatcaagattttaagttgagttctgtgagattgattcaagtatcgggatatcgttttttgggttaagtaattgcataataaatctagaagaatactgtaaatacaaaagagaaaaaacaaatttgaatgagaaacccaaataattaatgttagggaaacctacactcctgtaaagttttataaatgtaaattttccaaattttggagcaccaaataatatacttcctctatttcatttctttagttgttttaacttttttttctcaaaaaaattgttgttttagatcaattttaaagtctaattaatattttttcttaaatatattctcatttattacccactattaatagtgcaattagtattaagtatttcttccgttcaataataattgtcatgcaaaaaagaaaaaacaagtctcaaaaaataattttaattttaatttttcaatgtaacattaactagaatatatgacctgtgtcatgtatggataaacattatttatgaacatgaacattactatataatattttaaataataaatattttcttaaatttatattagaaatatttacaattaatttttttatttaaatttgaaacacctatttctttatcattcatcgaccccttatggcaatagaggtttttttttttaggcaaatccatcttttttctcttcatggtgttgtcatctttctctccctttactcgtgtgcacaaaccaaaagttgataggttaaataagtgaattccaatgaaaacattattaaaaaacatgcaaattagttgaaatgaatattttaatgtcaccaaaagaatcgaataagaaagaaccaacggaaaacaaaacgacatcatatcataaaaaatgacaacatatcatagagttgggaagaagaggaatcaaaagtgtgaaaatggaagagaaagagcgtatgatatgaatgaat

SEQ ID NO: 1803 - DNA, 1200 bp, Glycine max
  Soy_ogl_6332 Gm19:1997601..1998800 Cluster 7
cactgttcatgccagagaaacacactaacttatgaatactaaagtcctataagaattaaaattttcaataaactctaatatgtgtaatttgtgattaaaggaagtcacaactattcattgactatgctatttagaaagtattacattaaatctaaaaattaaaaagagttgatagtttcttatcttagtttacaaatgttatggtatgttttattaggagacaagtgaattaaattgctcactctctagttacagtctctggattttatgttattcatcacgctttttagcatatgtcagtatgcattaaaagtcttattattaatgagatgatataagttcttttcttcctcttttttttttttttggttgaataaataaagaaatggaaagaaaataaattgatataaacatttttaatcaaagtataaaagtgtgagtctaatattattttattatttattttttttcattatctttctcttcaaatgatgaacacatgcacaatgtgaattgaatcataaatttgaatttctcctgctaacaattaacctttatctgttaaaatgacttttaaaaataagatatctacttatattctattcaacaattgatgatgcttcaaatattaaacctgattgacacgtatactacttaatcaattaatccataataatgagatagtttgcatttgctaaaacatcaaccctaaaagacacatgcacttgctcaatccaatgattcacaattggacaatataaccaaaattgtaccaattcgtgatggttttgctatcctaataagataacatctaaatccattatttgtgaacctcccacctctcttttgaatttgtcctatgtcaaagtgaatggagaggataagcaatccacttatgtctctaccttgtgaaggtgaggtgtcttattttaaataacttgcagcagtcaagtttccaccaaggcatggttactaacctttagtttgcatgccctttagaaatccaaatgagacacgccattacaaagttctattttattgttttttaaaggcaatggttttttatgttttgtttctataaattttaattcaccttgtgtaagtaacattagtgaaactcaatttgaattctttaaataaaattttatgttagagttttgttaacaaatagaaatttaattgaaaatagaagtttttttt

SEQ ID NO: 1804 - DNA, 1074 bp, Glycine max
  Soy_ogl_6442 Gm19:38899427..38900500 Cluster 7
ccaaacgcacataacttattaaagtacaacactaatatataagtttttataattaagctatttttccaaatgggccctaaacaaaagataatgtactggcaccgtaaaacagctttgcattatcctttcatcgttaatttaagataattatttttaaaattaataaacttatcatgtgggttgtaattagataattgtgtaatattttacattatcaatacataatcatttttcttgttatgttatcattcaactgcaaattttttttatcaagatagaagaaaattacaaattattatataggataaatttattaattttaaaaacaattactttattatgatatttaattgcttttgtacaaaatttaaattttacactaacatatagaaattacattctacattgtatttatttaagggataagtttgggacaaaattattttagttcctgaaagtaagtataatgtattatcacaaacgtcctagaaaataaagaaattctaaataagtttctaaaatgtcaaataattctttgaactaaactattttatatcactttaattcttaaaaaaaaccctatattaatgttataatttaagtcacaattgttttaagtttgaacttaagtgtttgatagattttactttgagacttttttttaaattttttattttcaggtactaatgtaacatccttaaatactttgagagactcaaatggtattttacgcggtaactttgattcatcattgggatactttcgtaccattttcggaaaaaaaaacatagtcttatagtaataattcaagtgttgcacatgtaatgtaatgctttttccaattcatggttctttcacataacacaagattaaccatccaaatggtttatagatttgtttggatacaagacacaaatatgtttgagaacttccctactaaatatataaaactttttctactagaaaagctttgaaaagttcttaaaatatatacatatataaaatacctaataccttattttgactatatttgatatgtgatatggttttaaagggtgaaatgaatagtttcaa

SEQ ID NO: 1805 - DNA, 1500 bp, Glycine max
  Soy_ogl_6523 Gm19:42959401..42960900 Cluster 7
tcaatttattcaaacatgttttcctcttaactcagtattttaaaatgttttacttcagtatattcttgacttaaaattattctaaaatttaaactagtaataatttagttaacttttttcttgaaatcacattagtagttaaacttgcaatgggacttattaattatgctaggtctttctttaagtgtttgttatcattttatacaaactgatttttagctttgcgcatttagcttttgggacgaaatcataattctttcgggtaattaaattttagagttaacaggaattaagtcaccctttatataattacgtatgactttataaaagttcaattaaataaaaaaaagagaccaaaatttcggaagcatgtgtaattttctacagatattattgaaaaacaatgttcctatcaaaagtttggacggaaaaagattagcagaaacaaacgtcgacaagtcttaagtacccatccattggcatccaatcgagtccaaacaacgataattatctttataatttcttgtcattgaattagtgaatagggaaaacaacatcagccaatagaaaaagagtatatattacatctatcaaaaaagttttcatactggtcgacatgctatcgacaatttatcattcatagacgatcaaatttctcgacttggaccatcacggatgttagatgtatacaagcttaattagacgacgatagagagttttgtaagcattaagcacatcgcataaatgataaggaaaataaacacaagttatgaaaatgacagcgattgtgtatgattatatatacttatatactatcataaaacggcattctccttttattgagtacttttttaaacttacattattaattaaataaattataaacacatctcacaaattaagtacttaaaaattaaaaaaaaaacaaactaaaaaaaattgagcatcatattctttaatattatgcatttaaaaattaaaaatacaatactatggggttattgtaataaaatgtaaatcatggggttatacaaattttattcaggtttccaaaatttgaagttgctactttaaaaaagggctttatttaattattacaatggttcaaagattagttttaggagtttaattttgatttactgttaatgtaaaaaaaaaatatatgttgccaaccaattaatcctactacatcttttaatatataattattataaaaattaataaatttacaatggatgacaatacattctaattagtttcgcatctatctgcctacttaatgaaatatttggtcaaatataaattaaaaaattagaacagcagacagtagttgctaacaatcatgcactaaaattttggtatgatcaagttcaaaaagctagaaggccattaagatggagtttgtgaaaatgatgccaccataatctataatcaactaggtatagagaaagcaatcgctatcacgaaattccttgtcacaataataagagatgcaatcct

SEQ ID NO: 1806 - DNA, 1244 bp, Glycine max
  Soy_ogl_6888 Gm20:40607201..40608444 Cluster 7
tgcgacatgactcaagatatgcttcttttcttttattcagatgacacttgttagaagacatattctttcatgataccaatcattggaagtatgtgaatttcactgtgacccacacatgctgtaaaaaaaaaagaaggaatcagggaagaattttgcaagcggctcattttatataaaccattctttttctctctttcttttctttaaattatactattcatataatatttttttacaatacttttttttgtttttctagtatgattgactgtttttaattttatattttatatctcttctctcacttctcttggattgttaaaacttttatacacttatgaaaaaaaatgttttctctcttcctttttcactttcaaatgatcatgtaactattaacaatgatgattatttcatttgatgtattatttttttttatatttttaccatcaactgttataaattattatcgttttttattttaatttctaataataattacatcttttcaaataagttacactcaattacatatataaacaactttcaaattcaaatataaaatatcttttttgcactagtttcaataatggcatcttgtcatccataattccatacaattagtagtttacttagtgtatccattagtttctgtttttcaaggccttaaaaaaatttatatagattacaagtattattaatcaaagacaaatatgttttaattgattaaaactattatgtatgacaaattttttcttttaaatatttaatgttataaattcaaatcactcgttaaagcccaaacaactttgtgtctatcgtacttcatagttttcgtcttaatcatacatttataatttttagattgcatttctatgtttattttgtttataaactaccttttatttataggatttccttcctttttttttcttttttttttcacttgaaattcgtacatccgaatagatgttaaatggtcatttgtgattttacttttgaaacacatttgttcgattgcaaaattaatataagcttatttaaaagtattcataaaacttataggattatcataatgatataagattatgttgtaatgatataagattatgttgtatttatatattcatgtaccatctattcaattagttagagaacatttatgacctttgatccaagacaagaaaaaattatatgaaataaaataaataaattaatggagaaatttattttattttttattattt

SEQ ID NO: 1807 - DNA, 1200 bp, Glycine max
  Soy_ogl_4203 Gm13:22218901..22220100 Cluster 7
aataaatttgtgactttatttttttttgtttttatttaatttaagagtttaattttgatatattatcaggtaaatatttttattttatactgttaattaaataaaaatcattttatatttaatttttaaaataattatcacaaaatcagaaagagatattataattaaatctttaaacaataatggtaaatgaaaaaaaatagttgcacaaaaccggaagaacaacataatattggttagaaaaaagattggtggacatcaatctctacttaagaactaaagaaaaaagagacaaaacagagaatcagatgtatcatgagtaatataatgtgacaaacagatagggaaaaaaataagttcctgttaatagtgtgtataaggtaaaaaggtatattaaatttacttttttattgttttcttcgtaccatatattttgtacccaatagtaatgtttaacagggcataggctagcgtgaaggaatagatatatttttaaaatatcaaaggtgatgggtaagtcatgttttaaaataaaactttagaacggtaattttttttaatattgaaattgtgttttgaatcacgactttaaacattttatatatttttaaaaaaatatgaagttgggttttagatcaaaactttaagtattttatatttatttttttaaaattatgacgttttaaagttgtgttttaaaacacaattttttttaaatatgaagttgtgttttaaaatacgatttactgataacttataatattttcaaaatctacttatcttgccatttttttaaaaaattatcattttcttataaatttgtcaacaatcactcaattaataagatgacatggagattcaacataataattatgcctcatacattaaaattaccgtctttaattaaattaaaatgattagattatgataatcacaggttatctaaagacttgattccttccatgtcacgcaagatcaaccaacctaaacatacttcttgacattataccaaaaataatgttgtataccatataatctgaatgataagagacaaagtagaaacttaactttaggaataaaaaataaatatcctcatatccggccttctggcactagttccaaacttagtgaaaatatgtattttttttaaaaaattgaaataaataattttgaaacatatttaaattaaaaataaattaa

SEQ ID NO: 1808 - DNA, 1300 bp, Glycine max
  Soy_ogl_5146 Gm15:48063001..48064300 Cluster 7
ccagaaaattggattttgtcctataatgtatattaatatgtttgttttttacattataagcattagaagaaaaatcgtttgttataagaaaagtattattaatagacaaaataaaagaaatgctttaaattgattttataagatcaatacatataaaaaaaacaagtgataggatcaatacatcaataaaagaaagagcatcgagtactactcattagtctttaaccaagtctgcgatttaagttttataagcctaaagtatcattaaaataataataataaaaaagagcaccctaaatcataatattattgctcataatcctagtggaccatatctcagcgtgtcaaacaaggtgactttaattaagaaaacagaaaaaaaaaaatatcatgttaaaggtgttgcaatttataaaggaaagatacaaagttaattaattaagagtgttaaaaagatattaagaattataaatgttgaatggacattattaagcgtacctgttgaatgaatgtttaactgtgacgatataaacactatgatatgtattaaaaagaaaacaaaagagaacttagtactgtttagattttacttaggttatttaaaaaagtaaaagatgacgagagttgacgtgaaaatttcgaaaactccctcattaattaaattttatgtgttataatttataatagaagataattgaaagattttcaactttttgtatatatttctatagttttcatccttataacgaaaagcaattgaaacgaatattttctctgactaattaattaaaaccaaccatgattataatgattataatgaagagttataagattagtttgagggttaaaaaaagaaaaaaaaaacaaaagtcgtatatttgaatcttttctattatcaaaaactaataaattaataattaatattgaccgataaaaaaatgatgatgatcaaaattaaagaaatttcattacgaatttataatctggcaagaaagtacgagcaaatctcacagataaaataaaaaaattaaattgaagaactaacgcgaaactttgtaatacttttctggtcagggaaacttataagaatcttggtatgtcaatggtagtcgctttatactatctaacatgactggcaagtgcattgctagacttttggccccatataaattaaaattgctatgattgcaaaattgctatgagtagtgaaccatatacttcagtgcttgaggtgtaaatatatgtggtcaccgaaagaactttctaaattggttacaagaatgttgtcctcatattttgg

SEQ ID NO: 1809 - DNA, 1000 bp, Glycine max
  Soy_ogl_61 Gm01:2655301..2656300 Cluster 7
aaaaactacgatgttgacaattccgtaatttatcattcgttaagaagtcatacataatagttgcatataattttttttagtaaacttgttttaaattttttatatgttcaaatcagttaataatatcaaattcattgataagggattcaaaaatgtaatttacaaaaaaaaaatacatgtaaatggtctgttagattccttaataacatgataaattattgaactactaaacttactagtatattatcaattaacattattacttgacaaaaagaattaaaacaaaaaaatcttaaattttatagaaactaaaataaaataaaaattaaaggatcaaaataactattttcaaatgaaaaacatatttaagcgtaaattaactaaattcaacacataagaaagcttttatacaactaaggagttataagaataatttaataataataaaaaaaaaaggcgtgaattctaatctctttaccaataaaagcaataattaataattaatatttattgataaaaagatatacagctaacctgataatgttttaatcttaagaaagtgtattgtcttttttaaaaaaagcttttgcattttccgtcaaaaaaaaactttttcattgctttccttttttttttttatcaataaggaaaacagtttatttaaattttatttttagcaaggatagaaagtgttggggcttattgtctccttgtctcgattctatgctcaggaaaagctggtttctgatggattttattatctgactccagatttctgcttctgcttgtcgtgagaaatctattaccgtcttctttttggaatgctcactcccctgttgctcctgctccctcagttcttcaccagaaaaccgtcattttaattccttccacggtcgactttttttccttttttatttttgttgattatgtgtgtatgtgtcatcttcattgatgtttttgtgccaaaaaggtttgtattgtcatgacagacagttgggtt

SEQ ID NO: 1810 - DNA, 1300 bp, Glycine max
  Soy_ogl_1346 Gm04:42315201..42316500 Cluster 7
tttattttacattatttaattttaccggttaagtcaatccttattaacatcaatagtaaatcttaaattatatttcaatctaacgtatttatagagtcatgttttaagtatatgtatgttaatggcaattaaaacttttaaaatttcataattaatataagaacgtacgattagtatatcaatataatataagaataataaatacagtatttactagcttacaaaaaaaatttaaaaaataagtcttaaatactcacattgtagaataataagagactgtttacccttgttttctcttaaatacagttttcggaagacgtgagttttatcaattttaatcgttgaattaccacacatataaaatagtaatatgttgaaatatcaacttattttaaaactttataaggttttgagtaggtaatatataagataaaatttttaataaaattttgatttgtaataagataaaaacagttaagttaataaaatttaataggaaaagttagtattttaagaaaatttataaatcttagtatgtgtttgatttgttaaaaatatgatattgaacacgataagaaaaaataacatatgacaaagatataggataatttttatcaaatagacaacaaaaataaaataatataaaataatattaaacgataacgcagataacacagctctaggcccttctaatagttgaatctctcactcaatttgcttattcgcacttattacctttctacaactttttttttactaaaccactcttagcttggactacgtgtagaagttagttattgggaaacaaacactagagtacaatgtttgcctttaagcgtaatttttcacattaatatatagttaatcacatgatttttaagtgattatataacattaaatctctactatttatatatgattttttgttaatatttacttcttttttatctcacacgtgcatacacaccttaagaccatagggagtgaaggacattaattttgcctagttgtacaattatatatatagatggttaaaattagtttaattaaaattaattgtaatcattccattttaagttatttggtcaaagtgtagtcctcctacaatctcatcttccacctaatgaaacaatgagaagtaaaaaaaaaaaaaaaactttgcacaattgtacaattatgtataaatagttaagattattttcattaaatttagaatgtgtttcacaagccactttagtaacattttagttgttttgactaatttagacattgatttgatcaagattgtttaatacatcag

SEQ ID NO: 1811 - DNA, 1400 bp, Glycine max
  Soy_ogl_1586 Gm05:3804601..3806000 Cluster 7
ctaggccattgggaaaatgaagaaaagtagaatcagcgtagactttttcaacgatccgtgtacccagaaaaaaaaacaatattgtattgtatgcaagaaactattgcctctttcttaattagataataagaaaacaaaatagggataatataatttaggagaatcattgatggacattaaatgtgtcattaaacagctagtgagaaaatgataaaagaaattaaaaagattttgtgaatatttgacagatgtttaaaaagtatgactatatgagtatttgtgtatttctttttatgatttataagcatttgtttatgattactctataatttatatacagattttctttattataagtatttgtttatgattactctataatttatatacagattttctttatgaaccgcgtacacaatttattgttcaaatcagtttttaattttcattggaatatgtcaatattattctctaagtacttgcttataatctaacaatttatgaattgatttcatcttctcgtttttttagactcatctctatatcttctttctgaattcttatatctatactcgaagtttttgtccaaatatattcagaataagtatagaaaaaacaaaaacaatatgcatatttacataaacagaactactgtctaacttagctaaaatgattaaatggaatgatacaaaaagcgtttgtgtactttgtagatttttcccaagttttggattatgagactgtgcattgtccagggaaaaatacctatgtacatatgagctacgttgatgttaagtgggtaagctaaaattcaagtcaattatacccacttaaacatgtatatcatgcaagtgtgaatttagaaattaattaatgtttaattagtgcgaaaatatacacactgatgctgacttacaagtgttatatatatgtttatattaatatgccatcatagaatgaagaaaaatgttatagtttttttccccttttgatattgaagcatttagcaattaataagctcgtcattctttgcgaaaaatatgcatataattgccctcagcatgaggtcataatctattaatagtattcttttatgtcaagataacatatcctttaaactttcagtaaataaatcgatctccaaattcatatttcatttgatggcgcttaaagataagttggataagatattttagttgatttttaatttttttattattgaaaaatttgtttagttattttattaataattttttaatagtttctaatatttttttaaacacttaggaagtaatattttttaaaaaactagcttttaaatttttaaatttttcatttttatcctcaatatatttattgaatttttttattacattttttaaaataaatcataattttat

SEQ ID NO: 1812 - DNA, 1279 bp, Glycine max
  Soy_ogl_2050 Gm06:41329222..41330500 Cluster 7
gtacagctatatatgtcttatagatctttacattttctctttaaaaaaaatctttacattttaactatgtcttaacttgcttgttacaacttactagtttcgcaggtatttgttataaaatcaacccgcaagttataatgcgaagttatattttaaatcttcttgaactctaggcgacaattttgaacaatgcagttctgtcatacacaaaattggaatcatttatcttataaactagattattattgatgatgaacaattacgtgtatccacaataatttagttcggttttataataatttttttataaaacttgaaccacatatatatgaggttaagttaattgaattggataagcattccttttaaactaaaacaacgtcattttacatatataaaatgaaataaaaaaaattgatttaaatcaagcagcattcatatacacatatagctaaaaatgaagtaactagtagtctagctataatgcttttctttatctgtttgtattttgttctgatgtctctcaatttactgaattataaactaattaaacataaattatcttattaaacagtttgttcttctatatgtgaatagagtaaaatcttactatgccaatcgtgtgtattttttctttgtatttttttattcaacactgatattatttgtgttgtattgacagtttaatatatattctcattatcgattaaaaaaaactaaaaatgaaataatataaaaaggtagtatttttgttacaaaagttagttggtataaattgtttgatttggataaccatttttttagttgcttaaaaaaacctgtctttttagttgaaaagatatcatattgtgcatataagaaaaaaaataaaatgacatattttgaatgattggcccaagtaatgagttataaaaattttaataacgaaattgatatatatcttcaaatcacatatgattgaattttattggtttggaccagaacaaataagatattgacccaattaatttaacttctttcgtgtggattttttcggattacttcatagtcttaaataatctaatcaataataccattataaagtatttttttttaaataacccttataaaggatgtttaaaatgtattaataacaaataatttatgaatctttacttatagtaatttttatgctaaaaaatattaataaaatttaaactttcaagagaattaattcatggtataatataaaaaaatttatgattaagaaatctaaattttggtcatcattatccgtttc

SEQ ID NO: 1813 - DNA, 1715 bp, Glycine max
  Soy_ogl_2057 Gm06:42672186..42673900 Cluster 7
tttcatgaagaaaaaaattgtaaaagcatttaaaattcgtaatttttttttatcaaaacagggaaataaaacatatcaaatggcaataacgcagggaaataacataccttaattgttttcccaaatgacaacacaaaatttgcatagttggtaataccagttgatttcctgattcccacactatgtatacaacatgcagagagtttaaaacaaattgaaaggcatagaaaaggaactgtagatatgaacttgaatcaaaaacagaaaacaggaaaagactacctttgggggaagcaaattatgtcccaatgagaaggaagagaagaggagtgaagcaaaagctagctcaaaagtttgtacattcagccaaataaaagctcaaaagtttgatatgaacttaaataaataaaaaatgattaaatattcaatatgatgcattcaattgtttaatggtgtggcaaacgtaattcccaaaattagtaatgcaaaaaatatttaaaatttgaacttaatttgccaattaatgtaaatattttggtgaactatattttgggaaaaatcccaatttaattagttaattaatacttaaaatatttaaaatttaccttttttaaaccgggagaaatttatacaatggttattttcttaattttaatattatcttacgtaataaattagtagtgtttatcttagccattgttgttatttttaaaataatttaacataataatataatcttacgttatcttatgtaataatatattttaacattatacggcaataaaccaattattttcttataacgcatttaatcttgttcttattcgaggtaagtataataataggttggaataaagttgacttacatgatgttaatttcgttagatagtataattttttatgattttatcttaatttttcttctaatgataaatatttttcagttttatgagatatttttaactctttagtaaaagatcaaatttttcccttaccttattcaattctataagattctctaaataccgagtatactaattgatcgaccctgagtcatgaataaaattattcattgatttaactcaatctttttaatctttattaattgtacatgagtgataaatgataaaatattttttaaaatttgattttgaaaaaaattggttaaatagattgtgaccgtttaaatggaaataattaggatccatttgttatcctttattacatgacaacgtttttcaatatttttatgtgctttgtgtaattgatctcaaataaaaatgagttaaataattccgtctatgaccaatagaatttaaactattttcatatattttaaattctctcattaaataacttcgtctattagtaatatgtacattaatttttcttaacggtataatcatatatatgctataaagttataataattaacgattacatctagaacatcacgagagaactgctgcgctagtactatatttatccgaacgttgatattgacattgaatttctgcgaaagaatcagtcaaataacagatatatgtatgatgcatgggataatgcttttgcatatagattcctcaatactggctgttaattaacttgtagttttggaagttaatggaggctaactgtggactgtttcttgcgcagacacaacactaggaaaagaggaagtgaataaaagaacatatgcatgtcaacaatataca

SEQ ID NO: 1814 - DNA, 1200 bp, Glycine max
  Soy_ogl_2782 Gm08:21903901..21905100 Cluster 7
gtaacaataaattgttgtttagagtgaaattaaatttcctttatataaaattttaaatttaaatcttatgaatgaaaaaatataaataaaaaaaatttactaaatataattagtcaaatagtttcaattagtgaatattttaaactaatatcatgttaacctaaaaaattattgggtaagaaacactgtttgtaaagtgttatttgaaaattttaatacaagaatttagtttatatatattttttggtgttatttttgtttacataaattagtaataagaatttaatttgccattgcgtcattctgtttaaaaaaaaaattcactaatacagaatgcatatacattaaactattaatataaagaatgttctaatattgttgagaaagtgacttaatatacaagctttacatatagaagataataaatattttctaaacataatatttttagatactaatttgtaaaaaagtatattttactttgataagtggaaacagttatttttttgcaataattgaatataagttaatattaaacattcgcattgaatttgactctaagcataatatttttttgaagaaaataaataaatgacaatcaaacatattttgtaaaatttcttaagaatatttattgaaatgtttactctgagaaaagtaatttagtttggaatatttttttgcatcaaacataaaacccaacttacaactaaactaaagaaattcaatgttataataaatattcaattacttgattttaagtttgtatttctatatcagttgcatacacaaattacaattatgtatgttgctgcaagaaatatttttgcaaggattattgattaggaattttgcttaattcctcatatgattttatgcatgtagatgattaatttatgtgtagcagtgtagatgaaaaaacttaggtaagataggaagttttgatgaaaagaatgattgcgcggaatattgtgaaacatgtgagaaagtttacgggcgaatattcattacacagtttaatatatttagattgtagtgctgttagtgattgtgatcttgttatgaactttctaacaataatatttttaatttagaaatggataccattggtagctaaattagtagttaattataaatattcatgatccaagtaacttttaggctaaattttaattttattcttagttaaaaatttatgat

SEQ ID NO: 1815 - DNA, 1100 bp, Glycine max
  Soy_ogl_2786 Gm08:221291..22166300 Cluster 7
ttcagattttttaaaacaattttttccttcattttaatgttaatacctcctttcttatatataaaaaataaatggaaacattttttcctaaatataagaaacatatgatcaccttcaaatgtattaattattaatttctttctatatccttatttattataaaaactaccaatgagataagttaaactcatttgattcaatgactatttttgaaataaaatttaaatttataatactattaattaaagttaacaaattaactattttttatgatcttgatgaattgagtatttatttttttatatatagtaacaaagaggttgtataattcattcatttctttaaaaataaatcatcaatttggttgtcacaacattattcatatttttttaaaatagtcctaaaataataacttacataagtgattcctcatatattgaatattaatttaaaggatattcaatagttgaaagactatttaccataattttttaattttataggaattacatatatcgttgctttttctttaaattttgaaaccatttaagagagtaacttgtgctttaagaataaaattgctatttttttcattaatgttataattctcttttagaacttaaaatatcatgtgtatatttttttattatctatatttaacttgaagcatgaaatttcctgtgtggctcgtttaaagcaaagcaacattaaattgaatttgtttctattaaatatttttttcatttataaaaagttttaaagtattttttaattttattaattaaatatatttgaaaaatatttttatattaaaagataaaataaaattaagaagataaggagaataaaatagttgtttggcaaaaatagtttataagttagttaaaagtaaaataatatttctaattggtacttaaaacttgttaagttagtttactgaattataagtaaatattagacaatttgacacaaaagaattcatataaaggaacgtgtttataatgcctttacaaaaaaaattattttataaagaaaaatagaattttaaatgattatatgtttaagttttttagttaagatatgttaaagcatgaatggtt

SEQ ID NO: 1816 - DNA, 1174 bp, Glycine max
  Soy_ogl_2820 Gm08:38646627..38647800 Cluster 7
ggacgtgcctttggaaggacgatatgagagagttaaattgaagctataaaagtgaaagtaccaacgttgaaggaagaaatgaagaagaacacggttaattaaaaaattatgccacttgctgacattattcttacgttaattaatttactttaggtacttcatttttcacttcgattttccgttttttcacgctaggactatgctttgtttggtgtacagttaattttatttttcttcttctatggttaaattccctttattatttgtgtacggtttatgatatagttatacagaagccaaattttattttctcatccgaattattacgtttgtttcaaggaattttgatgatatttttaaaaatcaatttccatggaacaaggcttttatcaaccaaattttggcgactaattgtttgctattgtctcttactctttaattcagttacttttcaaaaaaaaaatttacctgatttctctttatttttaagttggtatttttctccataaaaaaagttagtacttttaaaaagaataaattgtatctttgtttttattcagttatttttcaaagaaaaaaactgttatctcttttgtttttaatccagtttcttttttaataaaaaaattgattgatttctactaagtaaaaaaaaaagagtaatgaaacattgatgtgtagactagaataatgaattaattgttatatgatagggtcattttggtgattaattgtttgttattgtctctttttcttactttttaaaaaattacctgctttatctttatttttaagttggtatttttctccataaaaaaagttggtatttttcaaaagaataaattatatctttgtttttattcaattatttttcaaagaaaaaaactgctatctccttgttctatgttttttaattcactgttatctcttttgtttttaatttagttgtttttatatataaaaaaaaaacttgagtgatttctaccaagtaaaaagaaagaataatgtaacattgatgttgtatactggaataatgaattcattgttatatgataggtcacttcattcaccttttccttttccctcttttttaggttaatcaatgggagagaaggaatagtacacctttttttttttttttctttcaatgcttaatggtggattatcaaatagc

SEQ ID NO: 1817 - DNA, 1500 bp, Glycine max
  Soy_ogl_3036 Gm09:7040801..7042300 Cluster 7
ggtgtttcagcatcttaggcatggcactataatattaaaggaaatgcatatgcgtacaataattaacgttatgaacttctctagctgttttagctaagtgaaccaaacagatgctctcttctgtcccataaaatattcagagaataactttcaaatgaaggaatttggcctctcatcatataaaaaaaaaaacttaactaagtttggcctatcatctaattttatgcttgtcatttccacaagtatcttgtatatatcgcaaaattatattaatatcatttttattaaaaaaaaaattaaatgcattgtttacaaatgattctgtcacttgccatattgagttaaattaatacataagcaattgagatttggtcttctaatttatttctatacaaagtgtaatacgattaagtttaaattacacatgtttcagcaagcagaatatatatgcttacattttgttccaaaaataagcaatataatttattttgttgttgtttatcactccaaaaatccaaattatttagacaaaataataaattttacaataaataattatcctcgaatttataaattttaccgaaataatagtttattttattttttatattatgaatagttgaaaattttaattaggataaaatataatctataaaataataatatcgaatcatcatcgtcatctttaatgattgtattgtgtattggtatgcatggtggcttgtgggaatctataaaataataatatcgaatcatcatcgtcatctttaataattgtattgtgtattggtatgcatggtggcttgtgggcctttttttttctttttctggtgggggtctaaggtcttagtaaattaattagtggtgaattcactgaattgaatgatcttatgatgcaaagggatcaaatcaaagacaactgaaatgttcatctccaaccactataataaacaagcacttgaaatggaacggttctctcgtgtatataaagtcatattgtctttaatgatcgattctagtgacttaggattttcttcaaaaaagtatatattaaaaaaaactcttcgattttattgaaattattatcatgaatcccatagtaaaaattataaaataaataattaaaattaagaatggttaaaacttaaaactatagattattatataacaaaagttatatattttattttaagtttcattacttagtctataatttaaaagtaaaaataaaagaagtccaaaattaaatgctgcttacttaagcaacataaaaagaaaaatcatttaaaagatgaaaagtcaaaataattaaaatttgtaaaaagaaacataagatgggagtatatgatatgacgtgaatacttctgcataaatttcatgccatggttgacgccaaagattatgagtcaaaattttgcctaggactctgtgaatcgagtaatctgcattggtaatagcgcatttggcatactccttttttatttttttatttatttttct

SEQ ID NO: 1818 - DNA, 1329 bp, Glycine max
  Soy_ogl_3427 Gm10:36744801..36746129 Cluster 7
ttttatggattgattatgtggtggggagttatatatatagtacaaaaactcaataactccatggttacaacaatattttcgtaagaagaaaaaatcatcatcaaaataaattattttataatatgtaataggtaaagcttgtctaaaaaatctctgccgtttaaatgaaagtatgaaaccagtttcggcttggtcgagaatcgagatatacggaagaacattttacgttatatcaccatatcatcatttaaatatgaacattcaaatacatttactcttgtatcataaattagaattttttatttataaaaataaaaaataaatataaaataatttacaacaattcacactgtcatgcaccatacttacataattgagctagatctctaaatagttagaacatttaattctgatagtaaaattctcaatcttctcacttttttaattagtgatacattctcctcatcatctttcttccatccttgaaaggtatatatcacatgttatcatacaaagatctttttcagtcaactcaaactattatctagtcttttatcaacaatttattaatgtaagtggtactcaattcaattttcttaagtaagatcttgtaataaagtttttggataaaaataatataattagaaagagagaatctcatttattaggaaaggttaaacataattaaaatgaatgatagagctaaatattattagtcaaaataataattggggtacaaagtatccttatataaaaggaagctaaagaactctacaatgttatcttctaacaaactaacaaatgtcctaaaaaattaattatgaaattaattttttatatatttacacatatagtatattcacatacaccaatatcattaaaggtcatcaattaatttttcgccaaaaattaatcattgacaaaaatgatgaatactcaccaataacatgatcatcaaaagaaaatagtatctcttcaactcatcaaaaactactatcttttcatctttatgcatatttatttattttaattataattaaaattattattatataaaaatatatttatcaaagtgaatttggatggctaaaatactaattatgtttggatggtgaattttaagaaagaaaattaaatttaagtaaatttaaaataccctacatcaaagtgactttttttggatatcaaattcaaataaattttaaattatgagaatttgataggagatgtttttatagcaaaataaaggaatttcaaataacacctaaaatgaaagaattcttttggtgatcttaacttgaatactctaatctcaaaactttgacgtgt

SEQ ID NO: 1819 - DNA, 1000 bp, Glycine max
  Soy_ogl_4069 Gm12:33488301..33489300 Cluster 7
tagagaagtttttgttttgtgaatatggtgaaaaccccatgtatttcgttcccttaaatataaaattcagaatttgttttataaaattttaaatacttttttttttcctgaagattaaaacatgttactttattattcgaacctagtttcagatcaatttaaacccaatgataattttttttacattagttttacatctaattcatataaatgtaactttttttttaaaattatatatataattgatgtaaaaaataatatagtttagatatctcgatcttactttgggtcaaacaataacaggttttaaatttataaggacaaaaaatattagacattttgtagtaaaatattttaaacatttttatatttataaagataaaaaaatataacttaaccgtaaaataaaatagtctccattttggaaaagaaaaatatttcataaacaccataattctatatcacacctggattgagagaaaaaagaatatccctatgcaaaatttatgatatgataaaaaaagaaaaataaaaaaatgaaaaatatttgtaatgtgtttaaaataaataaatatctctttgcaaaattcgttctcgctagattcaaacaaaaagaaaagtcttacacgtgcaagacttcataaagtctttacgtcaagtacgctagtatttgtcttgttccaagtatggatacacctgcaaggcttcataaagtcttttaagtcatgcacgctagtatttgtcttgttccaagtatggattcagttttacgttgtcgttagcgacatccggaactaattatttcgttagtttgttaatttacaagcttataactcatttgattgactacaagaaaagttatcacccacggactatggaacatatttcgaatgtctaaattaacgacggaatgaatttcatgagaaaatacatgaattaatgacgaaatttattcacaggtaaattttccatcaaaacgtaaacattaccactaaatttt

SEQ ID NO: 1820 - DNA, 1100 bp, Glycine max
  Soy_ogl_4223 Gm13:23505201..232300 Cluster 7
aggaaaccaagcatccttgtaggatcatcatcgttaaatattcgatccacttgaaatattctttttatatttataacctttactcattaaatattctttttatattaaagaaggaaaaaagcaatgatataatataacctttactcattaaatattctttttatatttataaattgtgtcggagaacatcatcatcgtttggacatatcaaaattcgatccacttgaaattttgaatatgccccgatcaatactaagtacagctcgatcaatgtcaacatttataaaatttcataataatcatcatgtaaaaagaataaatttatcctaaactaattattattttaatttttaatataatattaattatattttttcacttatatctcatattaatattatggatgataaaaaataaaaataaattaatattaatgagattgattttatgaaattgttattttatttatttattaaattttattgatttgtgtgaaataacataagaagaaaattataaatttataataagacgaagaagtatatatctttgacacatcaatgctttttactaattgaaaagatttatttttattatttaattttttttatggattgatgttaatttttagattattagttggaggaattataaccctcgatctttttcttcctctttctcgtttcaaccaccatattaattttataactctatttatagtgactttaataataaatatactcaatttagttctagttataaacataagttagcttaaatgaattttgactataactatatatataaattgaacatataagctagcctatgtttaaataaataaataaatttctaaaattgtcgattaaatatataaatacatgtatactacaccaaaaataattttctaaaattattgattgaatatataaatacatatatactacaccaaaaataaatttctaaaattgttgattgaatatataaatacatgtatactacaccaaaaatagttttctaaaattgttgatacgtatcaggttttggtgatttttatttattttagtttttcaataaataaaagtcattagccacaacct

SEQ ID NO: 1821 - DNA, 1256 bp, Glycine max
  Soy_ogl_4278 Gm13:26326501..26327756 Cluster 7
aacatctctacatacactattttttttattatgatattattagtgcaaaaaatctattattttaatatttatgtttgattttgctgatattttttttgactcatctctataaggactatatatacttttaactcgggaaggtgactgaattctgatttagtttaaccatgtataaacattattgtcagcatattttatttttcttttacgttgttacctaaccaaataagtagagagaaaaaattaacttttttacttagacattaataaaaagaacctacaactttaggccttgtttgtttattgttttcgtaaataattttcagttctttgaaaaaagtgtttgtgttttgaatacatttaaaatatatttctgttttttttaaaaaaaaaaattatccctataatagttcatcaaaatgcttgaagaatatgagaaaatattccccaattgtttttttttaattcttgtgtttaaaaataattttcaaagcttatatttttggatgaaaatttatttgtcgagtagtgtaaaattatttttaaaatcagtttataaagaaaaaaagtgaaaagagaaacaattatttacctttgatttattttctcttctcccttatctctttccatgttacttttttcttctacacatttttctacattcaagcttataataggaacttgatatttttgaatcatttaagaaagagatgcttttatttttttagtttaatgattataaattttttattgtaaaaaaaattacactatcaatcaattaaatcaattaaaaattatcagttgcatgatataatttttaaagtacttattgttaaaatgaataaacttatgataaattataagttttgattgaatgataatataatattattttatatttcagtgtataacatttttttgcatgctaaaagatgattttaatttggggggtgtttttatggttacaataattagactagatttataaagaaaaatattttaaaaggttaaaataataaaaaccagttttcttaattttaaatatctaattttttcttgactgggttttatctttatgtttacttttatataataaaacataataattactctaagagataagatatcttttttttacaagataatcggttatttatttattttaatgttgttctagaactttaaaattatttattaattttaaccttttatattaaaaataattttttaaaagtcttagctaaatattacatctc

SEQ ID NO: 1822 - DNA, 1400 bp, Glycine max
  Soy_ogl_4769 Gm14:44219401..44220800 Cluster 7
taaaatgaatcaagaaaaattatgaaaacataggtttcgtgtataatttattgtaaaattttacattattttataaagaagcttttacattaagtaactaaattgttttggaatttaaaaaacattttttattactattacaattttataaattttaacttaataaaaattattttttaaatcaaactcttaggatgaacatttttattaaatcaagtaggaaaatttacatttaaatcatcacggaaaggaaaattttatctaaaactactttaacaattaaattatcgggtgaaaatattttttaatttacttttattgtttttaatataaataaaatttccctacttactaacgtgagacttagttaatttattaaatgtgttattttatctaacatgagataaaaaatttcttatgagatgaaacaaaaaaattataaaaatatagacttgatgtatgatttattataattttaagataaaataattactacaagtaatattatataagtacgtattatttaaaaaaattaaatttttttaattatatatattattaaatcccatacataacaatggccaaaacaatgactagtttagttgtaattgcaagtttaagattatagtcttgttttttgtgtgtaatttgttaaagacacgatctaaggggttcggtttctctggctaggtctctatagctccctgcaacaatcttaacagtattatgatgaggcaattttaatcattcgcttgtgtagttgtatcctttttatctgttatgattatagagcatccattactactgtgataaatttattcaattatatttatattaaattattttatttttattataaaatcatttaattttttagtaatttaaaaaaaaagaatgtaattatcttcttaataaagagtgtgaaaaaaataaaatatttatctaaaaagatgaaaaattctcattatttttaccataaaaactatataatgaaactttttatggtgcggtataaaatgagactaaaatataaaataaatttatttaatttttataaaatggaatatttagatttatacataaagaataaatgaataaataaaatccattcctacaagaatgaataaactcatacacgtttaacagatctgaaataaaaaaaaatctcagctaaaatataaataacaaatgcaatagataaagaattattacaaaagattggataaagaaagatttaaaatagagaagtattacctagttacgttagagtaggcgctaaattaaaatacaaaaaataaaaaaataaaaaaactaggcgctaaataaatcgagatgaagccatccaagttgcggtacggaatacatttttttgacgacaacaagaaagaaagaaaggttta

SEQ ID NO: 1823 - DNA, 1100 bp, Glycine max
  Soy_ogl_5655 Gm17:12780501..12781600 Cluster 7
aaataataacgatactttagtaaaattgtcccttaaagatgttattagcttgatatacttgttttttttttattaatctgagtgaaaaaatcttatacatatacttcctttatttcttttgtatatgtcttttaagctattacataaaagtcaagaaatacaataattttttaaattctaataaaatagttgagtttttcttaaaaaaattcttttttcctttccactccataataaatgcatttgtaaattaattgaagattagagaataagtaaatgtataattgataaaagaataataatgtgatcttgaattttataaatattagatgaatataatttttttaaatctgacaattaaaaaggaacatagaatatcaatttgggatggagtgaatatataaaaagtgtttgaatatttattgttgattgataattggctctttgatattttattgtatgtttaaatgatggaattttaaaaaagattttgccatcacttaattaatagctgcaaatgtcatatttttagtcggaatcattattattttttatattttcattaatttgtagtttttctctttaaatcttaaaattatttttatcatggtgtacaagctagcctctcaatccatcatcattaaatttgtaatgccttataattatgaaaaattcttgaaccaataatattttattaggtgattattatatcatattagtagtttacatgattccacataatctcttaatagtaatatttgacgaatatgactaaaaaaataacagacaaaaagggaggggttaagattagtcaaaaaaattgttgatggactaaaattgattaagaaattattttttttacaaaaataaataaataaaaataaaattattaaagaactaaaagtgtatttattataaatagttaaaggactaaaaatacaatttatccaaaaatttgacacatgattgccaaatcaaattaatagacaatgtgacatgttatatatgttatcaatgtgattatcacatgatcatttaataatagtgatatttaaggtaaaaactaaaaatgtaaataaaaataggaattaacactagtc

SEQ ID NO: 1824 - DNA, 1154 bp, Glycine max
  Soy_ogl_5686 Gm17:14379901..14381054 Cluster 7
gttttgataataacttaaaatgtaaatttttataaaatttaatactataaaattgatttaaaagataaaaattatccaatatgctatttttaccttattacttatcaacatgagatatccggccattgacatgttctgaaatataatttggttccaaattgcgatcttgggagaactgaacaaaagctacttctccgttatatgaaatcaaccattgccaatcataatctgacataatttggttccatgcatccgttttgtttgctacattcatatttcataggcgaatgtaggagagtcgtctcatgaatcatgattataagttctatttttgcgtcttaatctaaataagaaagcgttctttgtataatagtcatactgatacaacactctcaagacttcgttaatagcaaatttcctatctcgttgttaattttccctctcgtttatcgatccaaagtaataagcatgaaacctgcaactagccaaattaactctttcagaaatctgcaactttgaaagtccacgcatgctcccttgcatctttccttcctgatttgaatcaaaattctaatatattttttcaagaaataatcaatacattttaatagtttttttttataaaaaataataaaaatcacatgaactacagaaatattgtcttttaaaatagaaaactttttagtaatagaaatttttattatattttttgtttttttcatttaaataacaatcagttaaaaccaataaatatttttattgaactcattgactatttgacaaaactaattaactaaaataactagttggaaactgaaaataaacttataaaattataaatgtttagtaaaactaattgaagtacttaaaaagtgttataaaaaagtgaaaataaaatttgataaatatattaaagataaaaaaatataaaaagttggaagttagaaattagtatttcaaaaataataaaaaaccactgaaaatttattataaaaagcttatttattcaacaatcaagtcaaatgaacttttcagctaataaaaaaattaaaaactaattaaaatatcttatcaaacatatttattatttttatttattgaataattatttattagaagtgtaatgtttatataattgtaaaaaagaagaagag

SEQ ID NO: 1825 - DNA, 1600 bp, Glycine max
  Soy_ogl_6146 Gm18:52911601..52913200 Cluster 7
caattaattaattccatgtacatgctaaaagaagaagaaaagggaaacaaatatgttaaagactgaagtgttgcattgattggtgaaggttcacataaaggactgatacaagatataacccactgtcaaaatcaatagtgttcaattaatgagtttaacatacaagatataagagaagaaagatgaacaaatatattaagactcgattattgattcattgcggatggtaaattaaaggttttcatataggagtttatagaatgatttttgtcagtatcaaacaatcatgtttaattaatgaatttcaagatcatgatagaagaagaaaagggaaattaacagacatgttaaagactcaactatagattcagtgcattgatcgatgaaggttcacctacaagagcttatataacactctttgctagcatcaattaaccgtgttccattaatgtgtttaatacacagaataaaagaaattaaaaaagaggaacaaaatttgttaaaataagatttagttatatgttaattcattgcacctattgaaggctcacatatggcttttataacgctctatgccagtatcaatcactcaatcgtattcgatcaacgagtttcatgtacaagataaaagaagaaaacggaacaaatgctgtgcaaaaaaaaaaaagaaaacggaacaaatctgttaaaaaaaatcattgattaattgcgttgattggcgaaagttcacatacatgagcttatataatgcttttttttgtccctttaaaaaaaaatataatgctttttatcggtatatatcaatcagttgataacttgtgatcaattaacgaatggctgttgattaatctctaactaccaaataatcaattaacaggaaactaattcattgataactcttatttaataaggtgtcattttgtaaagtacacgtaaatatgaaaaattaaataattcaaaaagttatcttactaatagtacgtaatatagattacaatttataaaaatcacaagcatttaaattttataaattcatttaattcataaaaattaatttataaaaatttcaatgttttattaatatgtatataatgattaacaaaatatgtatggaattttaatgatgttttaataaaattggtatttattaaataatgagaggaattaaatgttatctttaatggataattaattaaaaaaatgtcaatttaatttgatataaaaattcataaaaatatgccgtaagataaagatgatacacgactagacaaaagaaaataaatactaaagtcattctaatttgaaaaaagatatataataaataaaatattttctagcatacagtaacataataacatttataaaacctttagaataaggaaaacttttctgaggtatatttagtggtacattgattccctcctttccatgttgtctaattattcaaaataagctggaaattattttatggttatgctaagttatatattgtcatttgccagcatgtttatctattttagacagcacagtataaatgaccttattttagcagtagtgatatacttatcttttttaaaccaaatttcttctttcctcagaa

SEQ ID NO: 1826 - DNA, 1389 bp, Glycine max
  Soy_ogl_6412 Gm19:38148412..38149800 Cluster 7
tttttttatatttttgcaccaagaaaatattgttttttttccttatattttagatcagagaaagtatatgttaacaaattttgacatatgctaatataaatctattgacagcttagaattactacttaaagtaaacttataactttgaattttttttaaatacatccaaagtgtaacttgctaatatacttctttttataaataagtgagtgtaagttaataaatctcataataagaatataatttattgtataattttaatgtttagttacttgatttttttttgtctaaaccatttatattcttaactaaagacaatcttacttaagttgaataaggtcatatgtaggataaattttttttccaagtatttaatgtagttatatgcttagaacttaaaacataatagttaagtcagaaaaactctggatgtgcatctaagtgtttaatggtcaaataaatgaaagtgtctaacatatttttttaaatatgttctttattgtttgataaaataaagataatttcagtaaataacataagagtcactcattaattattgtgttttatttactctccatttgttaagatttcgtgtattccactcaataataaataaggttaaccatattcttaatccactaaacattgaaaaatttatttttagtttgtctattttaaatcgttgatttttagtcttatctcataaaatgtgtcatcattaaacctagtttccaactcaatcaagtgaagttaacaataaatttataataaaaaaaatctacaataactatttttttattaaaaaaagacccaattagttatgctataaaaatccattaaagtaaattttgacaaatgacccgtacaaactaatatttgatttactttttcaaattttatataatgatgtttagacttgtaagtcagacgtagatcagaacctaaccaacaatgataaaaagaacaaaattgagatgagagaaacaaaaagaatataaaaataataataataaaaaagaatagttattggtatgtttcaaaattaaagttgtcaattccttagatagtgttcataaacttatcccatagataaatgttaataataagtagcatttaattcctcaaaccaattatagctaatataaaaaagagaataataaagtcatttaattgtaaatgcaaatattttgatattttatattttaaaccatcattttcattttcttttaatgtgtaaacaaattcttgtatgtgtaagctcacttgacagtaaataacgggactgatatttttaagcatgttacgtggaggaagtagctgaatcgttctcaattagaagaattttctttagcgtcttttatcaacatagatagatagctagacaactta

SEQ ID NO: 1827 - DNA, 1484 bp, Glycine max
  Soy_ogl_62 Gm19:42310717..42312200 Cluster 7
ttatttttatttatttctatattgttattcatattatacctttgttatgctttcatgatttttttataatatatcaaatttttgtaatatatcatgaataattaaattaattaatttaaaaaaaaatatagatagtgtcagccttttaattaatttaggatcaacttacttaacacaaatgtcaatgtgaccttttttgtatttatctcaacttttacttatagtgtcgtaagtcactaaaaagtcaacacttaatattagttttacaaaattaattttagccaacaactttggcacaaaatcagcactaaattaatatttagtctcgatttttgttgattaacgttggcttttggccaacatgcactattgatggattaatgacttttaataaataaaataattttatacacttttggcagataaaaaataaattagtaatttattttttaaactatttactataattcaatacaaaatttacgtgttctatttatttgacacccgtgattcaaacatagtttctcgattacaataaccttgtcctttgtttgaacgcgttataatcttcacactacaattttttatccacgaaattgaggtcgacagaacacgttacatactaggttttcaaagtgtgtataattaatgattaacaagacaacttagttagacatgaaaattgtattttggttgaccacggtacgtgagatgggatcatccgagtatctcaacgtcctgaattctcatgttatactaagtattaacaacttgaattggcattatttgattagtgtgaggtgtagacaactccttaacgtgataatcatcagttttaatatgttttttttttatatgtaaaaaaagaatcataaacctgtcaaataaattgttatattttatttggatcagaagatgaagtgtcttttacaggataacactctatttttttcggatgaaattagtcatttttcatcgtcaagttagccctaataataagatactagtatttttaagtaaattcatattttggttacaaataaagttaacctatataaaatttaatttgtcaataagtcacaccttgttaattagattaaaatattggcttgcgtttatgtactattttacacatcatgtataagctactactgaatagtagtatatataatttttgtttgaataattcaaattgtacagattttgggggcataaaaagtaatttttgtttctagcaaaaatctatatatgtaatgtgtatgataaaaatagtattgaattggatgggtgtcttgtctcaaacccgggacgcaataatggcattcaaacaataaaccattaaagcaggctagacaatatatttaattaaatgattaaaatattaaaccaggagtagtatttaatatagtaatttacgtattttgtttgctacggcttgaaactgaaaagagacacgtccatagagtcaatgacaagtgttgcca

SEQ ID NO: 1828 - DNA, 1100 bp, Glycine max
  Soy_ogl_3381 Gm10:5379401..5380500 Cluster 7
ttaacaatttttttaaataaatccatttacaataatgaagcaaatgcagaaagaatttataaaacaaatcaaagtacatcatcaactaatatgaaagaacaaagaattaaaaatataatttatcaataaaaattccattcaacttcttgataatgtaattttacttaaatagtattttacttgaataatgtaagtctcatgttatcactccatcaattaatattttacttgacactattaaaaaaaagttatagagattaaaaaacaggaaatattttgttttgagatcaaaaatgaattttagtaaatttaacttttatttcatatattgattgacacgggtacttaataacatatttggttaatgtgttgaagtattaacaaataacatatttaacttttattactgataaaaaaaattcataaaattcatatattgattcactcgcgtacttaatagcataattatttttgtagttttatttattgttccttttgggtaagcactttttttttgtgttggtgacaagcaaacattgaattgaagccttgaagttgaaggatgctttgctgccttgagttgctagaaataaccgagcatgcaaaagcgtgtgagtgacaaagtattaaaaacaaacactaataaatttgtttctcttccaccttctcgtacaaaattgaaagaaaaaacagaaagggaggtaatttagtctatgtgattgtgaggtggtgagacataagaacagaataaattaaacctccactgtcaaggagttttattccagttgactaattatgtgaattgttataaatttttgaatatttgtttttgatttttacaaataagaaaaaaatgtaaaaatgtctttaaaaaagaaaagagatttagaaaaattcctaaaattattattttgaagaaaaaaaattaaaaacattttctttaaaaaaataattcctaaaaatgttttgattcaaaattcaagatagctattctaattcttatatattgaggtttgtaaaatttattttagttcatttttattgatattgaagattaaaatcaatattttatatattttgtaaaatcagaaattaaagta

SEQ ID NO: 1829 - DNA, 1300 bp, Glycine max
  Soy_ogl_1973 Gm06:15812301..15813600 Cluster 7
tgtttgccgttatcaccatgcctagatttgttttggcatttccctgcgtaacaactaccaaatcatcatatagatctgactaacacaattaatatctatgacatgttcaaaattagggttgaatgtgaccattgtcaagcatttgtgttcgaaccatatttttttttattgcgttagtcactgttggtggattaactaaaacttcccatatatcttcattatgtgaccataataaccatacaaaactaagacgaagtttgattgaaaatacatgaatgcaaaaacatttttccttcaaattttatctctccttcaagtaaaaataaaataaaatttgtttctagctagaaatcaacttttctctgcattttctttatattttctctctaatttaaaaaaactaaacaaaagaaaatactttgttatttgtgttttttttcctctctattttttttcctcccactttctctccaaccaaaaacacttagtttttttttacagcaaacataccattagtttttggatcacgttgtaacataaaattaaaaaaatattgtactatttttaagtatgagtcttgttaatcagaatattcttaagacattgattatggaactaaagaaagaaaatatttattatacaaattacaagagaacaaaagaaaagttataaacaatgctattttgtgtatttcaacaaacaaaaaaatctccttttaattttttaatcaatatcttaaagttattaattgatatttgtctatttacaaatattcaatgagacatattaaatgctataggcaatgatttacgtaaaagtacgattatttattgcagcaaattaaaagaaaaaagtatttgtagtagtttttttaagtgtaaattatttgtacttttgtacttacgggatcacgattttatgaaacacaaggaaaaaaaacatctaaaatatttcactaaaaaataaaattttgataggttacgttattttttttatttattgaaataagataagaaactaataagcagttttcgtgttcaaataagctttttaaatttttctaaataccgtcttaaccttaaatgaactttgggccaaacttggtggggtgctgaaacacccacattaaataagattattgctaaaatatgtttcctacgtacacccaattggaaaaagtagaaattaagaaactaagatatatctagatcttaaaaaaatagatatatctagatttttctggttttcttcaattctagtatagatgtctacgtatatatggtctaacatgaatgccaat

SEQ ID NO: 1830 - DNA, 1100 bp, Glycine max
  Soy_ogl_2675 Gm08:14194901..14196000 Cluster 7
tggtgaaatgaaaaaaaaaatattaaaagttaaatgataaaatttgtgaaaaaaaaacttgagtgataaaattcgtgaaattatgaatatttggtaataaaatgtgtgaaaaataaaatttatataataaaatttacaaaataataaaagtttgatgataaaatttgtaattaaatctaaataaatataacttaatttagaaccttagattctgctcaggtttggttgtgtgtccttcgtcaaacacgtttttcttttaaacttattacatgggcaaaaaaaaaatatagcttgaattggccgagtagaatttgtcctgcaaaaagtggggatccttcttaagtctttttcgttttaggccccacttctaccgtctttgtcaagtgaattttccgtgtggtatataatttttatggaacattaattatatgtagaaatttcaaaacaaaactaaaaataaggaatcaatatatattagaggtgggtatatgggtccgatccgtttaaagtcctactcacataagattttttaaagatttatatctaattcataaaagctttcaaataaatcactccctgagatcaaatagtaatctaaaaaaagtatgttagagttttttatagaaaaagatgaaatgtataaaattagaagaagaaaaattgatttcattttttaaactaaaatatatgacacggttaagtttaatatactaatacaaattaaagaaaacaataaaattatgtaagagaatattttaaacttaactacattttaaacataataatctatctcactaaaatttcattttatggctttcaaacaaacaaaaaagaatattcatttcatgacacaaaacagagaatggattgatcgtttcgcaaattattctttagatcaaatcacaaatcaaattttacagttgctttttgggtccaaagaattttttttcctttaatcagagcagacaaaaattctaaacgacaccaggcccatgaccagtaaacaacaatgccaagaaataagagagtttctatttgcacctccttgctttacttttcacatcacctttcccattctcttaataaatttaatataaata

SEQ ID NO: 1831 - DNA, 1300 bp, Glycine max
  Soy_ogl_3841 Gm11:11036901..11038200 Cluster 7
tactaagaaatatttttagttacatgtataattctaatacaatcttgatttatttttctttattttctttgataaaatgtttgggacatgtgaaaaaatattttttcaacaatttacatagatttatcacttgacaacaataattgttttgcatcaatacatgttatcttactttattaaattaaattatttttttaatattttacttattatatgtcaaaacaaataattcaataaaaaaacttgaataatttttttcgttccgcaattatattatttaatataaaatcatcatataactacattataaattttatcccaaatatgacacgggtccaaaactagttattttaaaagagattgagtagttcaatatcttagtatagagtgattatgcaagattttaggaaaaaaaaagatttgcccttttggcttatctagttatgttaaatatttagaaagaaaattttgatatctatgcttatctcatgtgatttgagtagaattatcttacaagatacattttttttagaagagagcacatgttgagtatatataaaaaaatttatttgcatacaattgtttatacttgtgagtaaatagtgtataaagagttttatattattatttaataataaattaacatgtataataacttttataataataaataaattaaaaattatatgaacaataatttcaaattatttaaccatataatttttaacgctaaacaaagcgattaatgctgttcattattgtttcttctagtattatcctatgattatttgacgttcccaatgttttaattttttttatttggtatcactggaataagaatgataaatttctcaatgtattctcgcgggaatcgatcgaattcagattttttttttagactttgaacgtaggttaccaattcagttacactgattgaatatctaattttaaatcatttctaatattgtattgacagtatagtttttgaaggattaatttctagaaaattaactgaaaaaattgttgctaagtgaatccaaagttaatgaaggaaatatcccaaacttccttaattataagacctttacagttgatatgcatatgtcgtcacatctatctaatgggagttctgcgaagctaattaatgcaatcaacggactgctactctaatgtcgtaacgttgctttcttattaaaagccaaaagctgtatccttcatcatcttcacacatctccttcatgccaaaagccacagctgtcatgactcatatattaataatgcttattaattagatattggt

SEQ ID NO: 1832 - DNA, 1220 bp, Glycine max
  Soy_ogl_5393 Gm16:31416381..31417600 Cluster 7
ggaaagtattaaaaaaaataactattttgttagaattcttgatgcaatagttttcttaatgaaagtgtaccatataaaactcatcatgaatcacgtttgtttagaatattttcttttctttttctacttgaatatttctgtttacgcgtaccccagaagatgctgttctattacaaagggaaaggctatttttccttactgattgaaatgaaacacaaagcatatgctggaggatataaagtttgataaaatagagaaaattgaagtgtttatgagttagaagtgcttactttattaagtctagactttttggacaacacctccctaacataaacactacttagactaaccgcactctcgtattgggctctcagcctctctcactttaaaaaggtcatgactctctctagtaacttaaaagatttcagcagaagaaagaaaaacacaataaatttgtgaaacaaacccacttgtgtaactaagttccacaagctcattgtgtctttttctctccaatgaaaatttttcaattaatggagaagagtttcccactttgcaaatcaattggtataaagctaatgatataagaatttgttccatttatgattatcactgggatttggtttaagtgtgatatttatttattttaaaatgtggagctataattattaataagaaactaaaaatacttactaatttttgacataaatatatttttagtccctctattttttttttcaattttgtgaatttcatccccaatttcttttttgcaaaatttatctgtctattattttaatagtataatttggttcacctttcaacttagcatatgatatttaatgaaaaaaagcatatgttatttaataaaaatatatgtcacactaatgcatttccatgtgatcatgaacgcatccatattgatgtggcactcttttatattgtcatattaacattcctattaaatattaaatattagatgtttataattaaaatagttgacgataaaattgcgggaaaaaagaatggatgaaatttataaaataaagaaaataaagagacaaaaattcaattaagcataatctattatgtatgtacacggatttttataatctcaaatattatttttatagcatgtttggaaattggttaaaaatgaaagaattacatttagaatgtggaaactatctggcatgtttggctcaacatcttctccctca

SEQ ID NO: 1833 - DNA, 1200 bp, Glycine max
  Soy_ogl_3791 Gm11:7981101..7982300 Cluster 7
aattttacttctaattttattttgtttctgtccattagattgtatttaaacttgtattacaacaattttaactacaaactaaatatgcattattttataacagcaaaatgctatttttataacaataaaatgctatgcatgtgtaactgagtgaggagggttattattatttttttctttttactaatctatttttatattataaataattaaattctattgattaatgcattggatgtttcaaatggttaaattgaataaaatacgtttcgtaaaaaaatacttatgagaatcaccttaaaaagtggaaataaaaccttttttgatacgtaaatctaaaattattaaacttttcgataataattaatgatagatatattattctaaggaaagatgaataataataatataaaatttacagagttttctaaaaaaaatattcctaaaaatatcattcgttttaaaaataataatttagccgtgaatgggagattttgtgtgcctaagttaccttattttccattaagacatttataacacgagtgttttttttatattatattttatataatcacgagtgtgtttttttaactgcaagttcacgagtgttctaaggaattaaagattatattttttttattaaaaactttcaatatatacatggataatgaattaaaagtaagatttttttatttattgaaaaacgttattcatacatccatgatttctaattcaccatcaacatatttaaaaaatatatatttattgtttctttaaatcccttaacctttggccaatgggtattgtttctttaaaataatgtttgattatttggttatgtgaggtgacaattccaaaatcattttcttcaatattatttattatattttaaaaaaattatcaatccataaaagatcaatttaattactttttttactgaataaattaattactttcctcaattataaacttagtttatttattttatattatcaattcattttctctttatttgtaactgatatttattttggatgaaataagttcggatcctttaagatttaatgaaaattctctttctctcttacattttaaaacaatagttttggataaaatatattttaattgattgattatcattataattatttccattgttaaatatataaactattattgtttccacttttaaatatataa

SEQ ID NO: 1834 - DNA, 1588 bp, Glycine max
  Soy_ogl_2605 Gm08:11310376..11311963 Cluster 7
gtagaaatagtttaaaattttttatttaattaaaataaacataaaaaaataatttactgaataaaattttattgagtaatacttttaagcacatgaaacaattgatattgcacgaagttgtttcaatttttttagagcattttgaatacgtgaaatttaagcaacccattttaagtttttttcttatattaattgatctctataatgtcatatcatagttaaacaactcacatatattttactccaatgatataattttaaacaattcttaaattattcccttgaatgattttcaaatgacaaaaaaatattttttttactcgtaagcaatgattacgtatatcagctggagacttaattttaagtaatctaacgtagatcatctccaatgataaaaaaaacttaaataacagtgtctaacaataaatcacttgttaagcaaatagcgttgaagatattattaatgatcttaaatttgagtcttaattaaaatataatactgtgtttaatattttaaggaagaaaccgttcaagataatgttatgtgactcaaacaaaattatttcacatagaaaggtattatataaattagttaaatatctaattcacttaaatctaaaaaaattattatctaaatttacacatgagataacataatatcaaattagttacgttacagcataaaaaaatagttacgttaagttgcattcaaattttgggataaatatataatgatatttctgaggtttaaaattatttaggtaaatatattattactattttttaaatttattttcatttttatcatttttttcaaaagttttaaaattttagtagatttctctatagcaatttttttaataaaaaatttgttttatctcctatgctctatattttggttttaaataaacaattatatatgcaaatcattttataccatgtgtagaggagagcgtgacccgtctgaatggacattatatatataaaataataattaccaaaactttcagcgataatctaaaataataattttgaatactgattcacatgaatggttcaagatttgaattttcaaatcctgattactttttgatatggaatataattgtgcttggcagaaaaaatacttacttaaaaacgtttatgatttctcaccaagattacttattactctccagtagaaatacttcatattaatattatgattaaaaaataataataataataatttcttataaattatcaaaattatcaacgataatctaaaataataatttttcaataaaaaataaagtgcaaataaattaaaaagttgaaaattattagattagatggaatttttaaactaaattaacatatataagtataaagtatatgacaaaacatgatctcaagtgaattccaatccattaaataaagtatcatctttgagctttattgataatttttttaaaaggaatactttaatgtgatcaaataagttcaacaataaagtattattgaaaaagataataaataattcgtaccaataaggtaaacaaacaatataggtacatgattccaacataagcttgtatctatatacata

SEQ ID NO: 1835 - DNA, 1100 bp, Glycine max
  Soy_ogl_808 Gm03:2243701..2244800 Cluster 7
attcttattaagatattttttatttttcacttcatttaatcttttttttcataaatgtcatgttttcttattttaaaaaataggaagaccaaagttaaaatttagtgcctatatttttatcttttcttattcaattttgaatttgatttattatttaatttttaaaaaaaaattcaaatttttaatcttgatacaatatcgaatttaagatatcttttattagataaactgaactttgagatgaagagatatatttcgtacgaatttattgtatataatcttaaaaaatcttaatctaaatttgttttttaaattttgacgcaacacattaataaattttattaatttctcttaatttaaacaatttatatcaataaattttatcttttttaagttatttttatctaataaaataaaataaaaaagtattattaataattttatctaatattctcttaaacttgctttaaattattagttaaaaatatttttgttaataaaatttaatttaaagatgccaagtacaaatttactagttaacattaaaaggaagcagccctttttttctatttaaaatctttcaaattcagagtttcatagaaacatccttttaagtcttaaaatacgacaaaaggacttcatagcaatagaaaatcaaataatcctatcatatattgaaatagatacaatccaaaacacttagttaagatataatttttctattatatcattaaatactagaagagatatattagatactaacatatataatcaaaagttaattatcagataaagattttcataacctaccatatattaaaatagtacaaccgaaattatttagattcaaaaagatattatctatttatattttttatatcattaaatgctagtagagatatattagatacaatcaaaattgattagataaagatttttcttactattaacagaaatcctatcatatattgaaaaggacatttagattcaaattaagaaagtgatagcaaaagttgtcatcattaagttctcagagataatagatagagaaattaacaaataaagataaagatttgttatcgaaaaagaatttcaagcgc

SEQ ID NO: 1836 - DNA, 1119 bp, Glycine max
  Soy_ogl_1807 Gm06:6622993..6624111 Cluster 7
tatttttaattaatattagaaaaaaggatatcatatttctttagaaaaaaaaaatcagaagcgaatagtaccttacactaagtagaaaacatctctaaattcgaagaatatttattgaaatttttaattttacttctttcatgtatgatgatctcttacttcattcacaattatctctttaaaaatttatgaaaagtagaagacattaataaattaaggttatatatccagtatatgaaacgatcgatgtacaaaaaagtttccacatatcccatttaaaattattgttgatttgtaggtattgtttccaattaaatttgaaactttactttggtaatgtgtgatgacatttaataggttcatttatttcatataaatttatgaggtaaaattttaaatctaatcggaaaataacgtcaataaatatatttgataatgtatataagttttgtcctatttaaaattatcttaggattatctcatcttattataatatatattttatcaattcactatttatatttttttttatcgatttagactacggttaactttcttaaaagctagtcatcggtgaaccgattcttttttatgtataatgatagtttattcactttttttaacaatttaaaaacatgttaattatttgtttttcaggatcatttattctctgctctcagtctctcacctctttctttaatgagattttagatccaatcattcttcttcttcctttctcatatctaggaaaaactaataaacttattttggtaaacattagacttgggtaaatatataggttagatcaacttattgaaaaagactaaagataaaaattaaaaatatgaaaaaaatgtaaaattattgttttacggtaaaatatttttagtgcatgttaaaataaaatttgaaaaataagtatagacaacaatattaaaaagaacactaaaatatacttctcaagtttcattgattttatttaaaataaagtgatttgttaggcaacttctgaaaaaaaaataattaacttattgttacatgttaaaaaaagtaaataactcattattataggtaaagaagagtgatttatgggtgtcttatttttgagatagttcacca

SEQ ID NO: 1837 - DNA, 1100 bp, Glycine max
  Soy_ogl_2250 Gm07:7475001..7476100 Cluster 7
ataattaatattttaatagttttattttcattgatctacaaggataatcttaaatctttaaccgttaaggtatttaattcagttgatagaacaatgtgagttatcataaatttttaacagagtcttcagttatcacaaatataaaaaaaacactaaacctttaacttttatttgcaaataaaaattttaaagaatttttatattcaaaaagcatttttattctatttctaaaaataaataaaaaaatatttctatatttactttccaacatattaaataattcatgtactaatcatcacgttatatattgctgggaaggctagaggttcaaaatgcatgcagaagcaaaatgaagaagaaaatccttcaaaaccttggcataagttacttattatttggcacgtccaaagcagacatgagtctcagtcggagattcagttttatgaaagctatctatttctgtgtatcatattaatttccacatatgataaattttatcttttgtttttttaatatatatatatttcacttgcaaacggatcccaccagatcctagttgtaatttggtatctgtaggctgtaactctaggttagatcttccttcctaaaggtttttctaattattattgattttaaattttgcatcatatcctatccatttaccttttttcttcatttatattttactattttttaaaatctgcgtatcttttgcaggatcattggtttttctcttagtacttaatatatatgagagcaggaatattattgttattattctgtcctatacgttgaatatagaatcacggaagttaattatttgcattctatctcacactttcacgtgaatttttttattcttcataatttttaatgcatgattacttttactggaatatattgtaactaaaaaagaaaagcaacttttcatttatattgatataaataacctgcaagtttgtttaaacttaaaagaaataattataaataagtattttaaaaaatgttttaagaaatagaaaacatttatttatgaaaaaaaatttatttattttaaataaaaataatttacacaaatactacaaaaaaattgacaaaca

SEQ ID NO: 1838 - DNA, 1498 bp, Glycine max
  Soy_ogl_191 Gm01:48064403..48065900 Cluster 7
caattatcatcttaaaactttgagaactttaaatctaaatcacacaactaaaagactaattcttatttggtagtcacatgactatttaagaaaatcatatttcattcaaataaagtaaaattattcaaaatatgcttatattttaatctatcatacatttaaaaacacttatatttgaatctaaaggaaattcattcatttgttatatataaaggaaaaaaaagtattgagttagttaaaacaaacctctaaaaatattaactctttctgtattactatatcattatattataataaagggttaaaatttgtgcattttaccctctaaactttagagaaattcaatatatcctccagccaaacgtaaagcacaactcgttggttgaaatatgacgtttgaattcagtgccacataatttctgaatgaagtattaaattagttaaaacaaacctttagaaatattagctctttttgtactactataccattatattataatacagagttgaaatttgtgcattttaccctctaaactttagagaaattcaatatactgtccaaccaaacataaagcacagctctttgcttgaaatataacgttcaaattcattgtcacataatttcaaaatcatgtataaaatatgaatatatttatttttgttaagtattggtataaaataatctccatctaaaacagtgattaatcttaatcaaagataataagaacatataatataaatatttttcttctaatacgatttattttatacccaaagatatgttagaaattcacatcacttggttaagaaatacatactcctaccacgtgtgtcaaccgattcaatggctcataactttgaaaacatttataaaataggacaacataattttaaaaaaagttacatgagaacctattatgttatttaatacatagagagaaaaatatataaatataataaaatttataatgtgataaaaaaaataaaaaatattaaaaaggtatttaaaataacgaggtatttatatatcattattcaattttaaaaataaacctttcctcctaaacaaacaacatacaggaaatatcttgcattaattcaactctttcgtgcatcttttagccgaaaagaataattttcaactgtaaatcatattcaattttaaaaataaaagtacataaacctttcctcctaaacaaacaacaggaaatatcttgcattaattcaactctttcgtgcatcttttagccgaaaagaataattttcaactgtaaatcatatcaaccgaaatccagatagtaacacgagaaatcaaatgttacacctctaaagaatcagaagccgtactaaaaatactgtataagaccattttctgtataaaaaagaaaccttttaatttagagttcacacgatattcacaaaaatacgtaggaacatcaaattcttacatgctcataaaattcacgtgctaataggatatatttattatcattaaaag

SEQ ID NO: 1839 - DNA, 1366 bp, Glycine max
  Soy_ogl_1872 Gm06:8849014..8850379 Cluster 7
caattaatttgatagcaataaatatatcctaaatttatattttgtttcaaaattatttagtaattaatatttctcttttttaaatggttgtcaatacaacctttcacttgttttaattaggaatatttttgtcaaaataattaatacattaaatattatggattgagtttcgtaaaataaaatatcactattaatttagttcttataaatagaaatgaagaaagtatattttggttataatggaaaagaaaaagtaaaacaacaagagaaatctagctaagagaaaaatataaatatgatcattttttagctaatgtatgattttacttctataatttttttaataaaattcatcatttacatattataactatttttttactattactttctttctattttaaaaataaattctcatttttttattcaagatcttcataaagcaacaaaatatattttgacacggtagttaaaagaaaagaagagaaaaagatagccagttaatattttttattaacaaaaaataataaactaacaacacatatttatcaataaaagacaataaaatatattaaatatcttctaaaatgagattttttttctcctctttcattcctgatcaaacgtcatattaaattattcaatgtttactaaacctttactcgtgaatttataattttattttataccataaaattatcataaatgtccaattatttgaatagaaaatataagattttgaaagttttaaatatattttttataggtctccactaaaggaggtcctataaggtctcctatttaacgcatttggcagctgaaaattttaaatattaaaaggacaagaaattgaaattgaatttatttaattttaaaaatgaaataaaccccaatttacctgaaatttaagagattaaaatcccatacaatattaattaaaagattaaaagtgtaattgattttttttagtgagaatatatctatcaagtcccacatgattcaatagaagtggatgtacggtacataggttgaccatgttaaacacattcggcaatcataaacattttgaatcaacagctctatttattatggataaaaaaaaagaagaaaaagaaactctctttacttttgtttattttttttgctgaattctctctttacttttgtgttactatgatatcctcaatcttaacccgaagatctgaaagataatagcgtcttgatcataggtataggtaggcttatagtgtacccttttttcttctccaacgtgtatgaacgtaaattgattgatctcgtctgacatgatatattcatgtgctgataggacaagttcaattggaacatgagaaaaagaatttagatc

SEQ ID NO: 1840 - DNA, 1171 bp, Glycine max
  Soy_ogl_2819 Gm08:38613730..38614900 Cluster 7
tgttatttattttttaaaagagtatttaataaatacaactccaatttgacaatgatgttattttcttgacatttttttaaaatagtatataaaaatacacgagcttcgcccacatcgcacagacgcactctctcttcttaagataaagattatttaaaatcacaggacaagatcgatcaattaattgacaaaagatattaaattcttacacttacaccaagttaaaactttgaatataatatatatgaaattaactaatctaagtgttgaaatgaaaattcttgtaaaatagattcaattacaaacttacatttttttttaaaaaatctgtcatttgattgcactatttattataataaatattatggtatttaaaatataaataaatgtctattgttagataacatgggtaccaactaattattgtcgaatatatatgaaatttaatatacatataatttaaaagataatatcaaataattccactattagattaattaatttcatattttaaattcatgtaaaaaaattcatattttaagtaaaagtattagatataaatataaaagtataacatccaatatcaattctcctatctcatgtcatgtatatttttcttttgtatagaacgaaagtattttttatatattagaaatgatcattcttgacatagatataattattatcaacgataaaattatgtttttgaatatttaatgtaactgtatacttaaaatttgaatataaaattactaattatattagaataattttatactaaagagaaattcacttattcttgagaataactttttgagttattttttttttatctttataatttattttcttaaaatttgatcgttaaaattagttactgatgaaaatgaattaagtgaattccttctcttttatgttaattaatctataactattatttaatatatacacgggacacgggacttagcaattaaataacgcgcgggaggcacactctcagtttccattctccactctctttatgttgtccgagaatctggacatgacttaaaaaagagacagaatgatttagcattttaaataaagtacacgtgtttataagaacaccccatttagtggtcaaataactctcgttatcataaacttttttatcatcatccttctaattaat

SEQ ID NO: 1841 - DNA, 1289 bp, Glycine max
  Soy_ogl_6139 Gm18:52609370..52610658 Cluster 7
taatcacagtaaaataatatgatataataatctttttatagatatatataatcgaaccagatttagtatttgcataagaataaaagatatattatatgttaaaataattttttcatattctaaagttaaaatttatatgtcaatgttaagaaagtttaactcggttaaatatgatgcatgagaatttatattctttcaggataattaatctttagtcatgtatctattataaaaaaaattaaaaaattaagaggaacaagtaatggcccacccttactagttgtcactctatattaattttaatttttgtggaaaattataatcttaaatactgcaatgttatatatttcaagtatattaatttttgttattagtataaaaaattgatcaacctggtttcctaatttggcgaaggaattaaaagaaaactgataatcgactttatattatttagaagtaaaataaagaaaaagctctgtatatatatcatcattattaatcaaatcaatatttcagtatatataaatcaatatttgttagtgtagagagaaaggattcaatttttttaaagaaggattcaaatgttttaagtatgtgtggtcttgaattcaatccttagatcgatttatgtgtatgaaaataaaatactattgagaaaggcctttagcatttaaccgtgtttcaagaaactaatctcaactattgtaccggaagataatcaagatattcaacaaaatatatatttttattatataaaaggcttttttttctatatataatggatttttctgataaaagtctttgagttaatataagttctttgtgctgtctttgaattttacggttaaataaaacatttcatgcaattgatatgccatttaatgaacatgtgttaattgaaatagaattgttttagtttaattaattaatggtatttgaatttaaatactaaaaaaaaaatgttcgcctacataccatgattctatattcgatttagaaaggatttcttccatatgatatcgtacatcaaaaaaacttactgaatataatacttatatataactaataactaatgaatttaaaaggaattgacaaaaaagaaaacttaatttaaacttgtttgtatatcattagttaaattatttagacagcaattaatctcatatatcatatatgttatatgtggatccaccttttccggaaaagtaatattaacgaacaagaaagtataaaaactaagtatcctccttttgaggatggacatattacattcagtactgatctatttg

SEQ ID NO: 1842 - DNA, 1516 bp, Glycine max
  Soy_ogl_2067 Gm06:44073401..44074916 Cluster 7
catagccatctgatcatattaccggtcggggatttgactctgactttagaaggtcatagggtgagagacacgtgcattgatgagtgctttgagcaaatatgaagatattgggagttgaaattcttattcaattaattctattcatcattcttcattttattattaaaattataataatatatatacagtatataaagcatatgcatttggaatgaaatttgagaattcgaatgtatgtataatcccgggaatttagacactcgcaacaagttggaaaaaatgaaagaccttctgactgattttcgttttaaattattttttgagatatgatattaacataatatatgtctaatatcaccttcttaaatggcttttgataaattaaaaaaaaaactgtgtaaatatagatttttaaaacaaaaaatttaaaaacgaatcaacaatttttaagaatttgtagacaagggaattttttccattaactttgatttgtagttttttcctttttgtatatatgactttttagagatagtttctatctgtttttaaattgatatattataatttggaaaatataaaagttaatttattgccttcaaacccatctactaatattgatacttaataaaatgaaagaaaaataataaaatgatattttaacaaaatatttctataacatgttattttgtataattaaatttggtactttagttaatgaattgccttaaatgacagaattttaaaactgaagaacagaaaaattgtctttttattttagaagtttgaggaaacctctacaattaattcatattgaataaaaatatttcaaacaatgttattctttttttaataattaaagatgtttaacaattttattaatgtttacggaatttccttaagtgataaatttttagaactgaagaaataattgtctttccattatagaagtttgaagcaatttctagaattgaattatatttaatttagtaaactgcattatctagatttattttcatttagaagtacctttgtaatgccagattcgctgtgaagtgtgaaatgtgacatgaacaaaagggagtttctttaattttcacttgttcttaaaacaaaagtatttttcttttttttgtctaggtttttttttttaatatttttggtctaggtagtatttttcttatctagtacactacaaattagaattccttatttgtctttaccaaaaaaacaattcctaatttgaaaactccaactctcattctacctattttctcaattaaatatttttaatattaacatttttttatctctctctttttgcttgaaggtgcatttcatacactatttttgcaattaataaaaaaaaatctatttcaagcatctttagtgactattttattatctttatttttatatgtttttttaatcatttatctatttcaatttaaaaataattctatatcataatttttttaatctaagccacaaggatgatctccactagagacaattctat

SEQ ID NO: 1843 - DNA, 1569 bp, Glycine max
  Soy_ogl_523 Gm02:12940801..12942369 Cluster 7
ctggtgcgttatagtgggacatgtgaaatattaatcatttattttaattgcattatgataatgatcatacgaataatatagccaaattagatgtgtctcttgtcattttactgttaaagatttggctttatccttttggtctcagtcttttgctcttattcttcacatgagatggtgaaattaagtcatttcatgacgacccttctcctactccacgtactatgtctctggaaatcaggaacacctttgtcaggtttcgttcattcatgcatgcagagggaaaaagaagacatattttataataaaagcaagcaagaaagaaaatactaaaggatacatgttaaagaaaaactaaaaagtatttattatattaattaaaaatataaaatatattatttaatacctttttaaattaattaaaaatattcggtagaattgattaaatatttgtttatcaacacatttaaaacacttattaaaaagagatgactccttcgaatcctcatcaaaagtagttagacaaaaagggagttgtggaataatagttgatttgaatgatgtggaaacatgtaattgtagtagttaggaagagagtttgatgaggtatgattaatgtaacacttttagggttattttaataaattattctagaattatgttagattacttttctttttattaagttgatgatacaataagagacttgttttgtagtatcaaaaaaatggaaatcggcaattaatttaaaaattggtgaccttttaattttactttgtagattattcgtaaataagaaatgtataaaaatatggaaataaaatttttcttggacacttatttgaagttcttacattataaattttaaaggtaatttttttcataaaaatgacaaaacagaaaattatattttaaaattatatgaaaaatcagaaaaaatctttttcgattgggtgttgagaataaaaatatacaaaacactttcttcaatttactttttatcattatttaacaattatatattaaaaaatattatttttatctaaaattttaaaatttagaactactttttttttcttatttagtccataaataataaaatatttagttttattccttaaaagtatcttaatagggactaaatgtcatttatttagttaaataaaagaattgtgaaaaatataaaaaaaaacattaattctaaaatttgtaattttttctagtcaaaacatattcaaaattttaaaactataatattaatattatatactacgagtatttaataataacgcacacctacacctatgtattaagagcatccattacttgaactttgacataggttcttaggttacttgttttgatctcacactatcatatacttcaactgttgataattataagatatttaaaaaaaattatttgtttcttttcataagaattttttttaatttctagacacgtaaattgttttttttttcttatatatatatatattcttacttaattattatttctccaaacattaataaaaaacaagtgaataaaaataaaataaaaaaatatttaaat

SEQ ID NO: 1844 - DNA, 1000 bp, Glycine max
  Soy_ogl_2013 Gm06:18985701..18986700 Cluster 7
atctttcatgaaaaagcaacaactacgtagtacacaagggaaaaattcgtctctcgtttttcccttctgccaacatttatgtttatgtataccaagcattactttggatagatatatgtggtgagaggatattgtatacatttcttttttataaactgcgactatacgtactgtacatgtgggcaccgattcttgacaaatattatatattaggaaaataatcaatctcaattgaaaaaagaaaaaaaaatggagttataaggtgataaaaggagaagaaaaatgagattttccacttacaaaaaaaagctaacaattaataattaatacttttataaaaaaattagaaaaaaaaacttaaattctgaagtgtgggaagaacttactgttaatttttttaggatactattaattcttttaaaccatcattttacaataaaatatatactccatccattttaaaataagtatcatatttaagcaaacaaattattttaaaataagtgaaattttaccttttcactataaaattaataataaaattaattttataaatttttttatctatttattaattttttttatctatataaaataacaagatgacacttatttttgaatgacgaagagagtatcatattaataaaattatttaaaagactgctatttgatccaatgatcgataatgtcagggaagaggatccatttcctcaattaataccttcatgttctagtcagagtagaaacgagatataagtgtatatgttataggaagaatgagatggaaagaaatgattagtattagtatagtgtttaatatatagtagtgtttgtatatctttactctatatcaatatgttattcataaaaacaaatttctcaaattaacaaataaattttttcccttaatttttagatggaagtgtattgaaattagcacacaattatctgtcaagagtggaatttttaccacttatttaatttaaaatatttttattac

SEQ ID NO: 1845 - DNA, 1170 bp, Glycine max
  Soy_ogl_3410 Gm10:8440431..8441600 Cluster 7
taatccataggatttatttaacaaataaaaataaattatcaaaagtacttttattttgccagaaaaagtgcgcaaatatgaattattggataagtttgataacattaattaattttatttcctaaattggatattttattttaaaattaaaaattataaatacaatcaataaatgcattataatcaattaatgaatgtacaaaatcaaagactcattaataacaccactaaaatatattatcttacctttaatattaatattaaatgcacattaaaaactcaatctctattaaaagttcaactaattaatatagtttataaaataaattgtctaatgtattaacggaaaaaagttcacaaatatgtattaatggataattataataaaatttattaatttgattatttaaaaaagatatttcatttaataaaataaattttataaaatacaataaataaatgcataataatcaattaaggaatacaaaaatttaaatactcattcataacacaattaaaattcattatcattccttaaacactaatattaaatgcacatttaaaacccactctatattaaaatttcaactaattaatatattttataacataaataaaaagaaattttttagagttccttgactttatagcacaaatatgtattaatggatatgtgtggtaaaatttattaatcctattttttaaataagatattatatttttaaaaataaagtttaaaaatgtaaaatgaatgcataaatttaaatactcattaataacatgatataaattcattatctttcctttaatattaacaataaacgagcattagtaacccaatctttataaaaagttcaagtaattaatatagtttataaaagaaataaaagaatttgtccaaagtaccatcactttgtagaaaaaagtttcgcaaatatgtaaaatttatgaatttttttaaataaaatattttattttaaagttaaaatttgtaaatataataaatgaatgcataaaaatcaattaatgaattcataaattaaaatgttcattaatagcatcattagatttaataactaaagtaacatttattaggagtattgtgaaagaataattaatgttacattgaaaagttaaatatgacatttattttgaaatatatattttttt

SEQ ID NO: 1846 - DNA, 1200 bp, Glycine max
  Soy_ogl_5154 Gm15:48214401..48215600 Cluster 7
atggaatcatgaccaatcaattaattatttcaatagaagaacttttaaactatgaaatagaaatagacaatatttaaaaaaaaaattagatatataattacagtacatgaaatgtatgttagaatgagttgttctctaatattttttattttaaaaatacaaaagtaattgaatactaaatattgttattttaactaaagaatttttaaatcaactttatttcattttagtaaaatattttagaataaatctatttaataattggaatatgaattagaaaataaaacaaataacaaaaaaaaagtcagttatgaaattatttctcatttcataacatagttttgaaaaaaaacaaaataacacacatgttatgaaattaattttccagaaatcgatatcataatgtttatataaaaaaaacaagtgagaaattggtttgagaaacagatttctcacttattatattattttgtatgattaagtaaatattttttgggttatatatttggataaatatttttttttcatgtaaaaaaactcatcgatggatacgatacgactcttcatgtggaaagaaaaagaagtaacggaactgtactgaaacaaactacggaatggggcaccttcaatccttcacgtcgctgcctttcactcacgttaaacgcatttattccgtcattcattccttttcttttcttctttttcttttttcaaatttcaactctatcgattaataatctacacgctaatttatttactataaattcattcattattaattacataacaattttaaaatgttatcttttatcttttccctttctcatcaatgtttggacaagaaaaaaaaacatagacaataatttttttatttagttaaagaaaaattaataaataaataaatataaggaatgtgaatgttgttgaccttttaaaagtattttttattttttcttggagtccctttctttcccatttcattttctttcctccaaatcaaatagaggtttattaccaacttcctatgataattgtcttatgacaatgcttgatacacaaaaaaaaaaaattattactgtcaattgttattagactcgaattgattaataatagagatcaaattcatattatggaaacgtttaaaatattttatatattaaagccttctagttgtccatgccaaaggttaagaaatccaac

SEQ ID NO: 1847 - DNA, 1200 bp, Glycine max
  Soy_ogl_1889 Gm06:10245101..10246300 Cluster 7
cattatctcagtcaatagtttgaggcgcgattgaattagtttatatttgaaaaagaaatactttctggaaacatttttaaattaattgtttttcaagaattaaaaaaaaacaaacttattctgttaatacatacttttatttaagacttaaatatttttaattccttaaatttgggtcaagttttaaaaaaaattaaaagtgattatttttgtcccttaatttgaaaataacacacttttgattcttattaggaggactaaaatgatgacaaacaaaacttaagaataaaagtgaactattttcattttttttttgctgaacaactatttttaaattatgaaaactaaaaaattaattcttttaatttggataactaaaaaaacaaatttggcctaaatttgaaaaaaatattataagtctttattttattttaaaagtataagtctttattaagtattataaattgaatgaatttttcacaaaaataaaaataagaataggatgtgattatatgaattgtacaaataccatcattccgcaaggccagtgtgtctgctaagatcgcaatactattgatcctcatcgtataaatgtggtatcgctttcttacgtaacgcgtcacaatctattaaagtattaattttaggaagccatgataaagacataatataatattttcttgtaatcattgtgttattgactacccatgtcgtttgggtgcgtttcgaaatggaaggatttaattcttttttttttcctgaaggatgaaggatttaattcttttttttttttctgaaggatgaaggatttaattcatcagaaatttacaaatgtatattttatgagtttaatgttgataaaaacatattttaccaatcaatcacatatcatttttttttctgaattcaatcacatatcactaatcaggaatcacaaatcaaagttactataatttttaaattaattattataacaatcaataatttcacttcacataataatttgtgccaatagtataaaattaatttataataattatctaaaacttttttatattatcagggtttttttttttgacttataaaaatgtttaagttgctatctgacttgggatgacttgaaagctgaacgcacgtgacaaagatgggttatattcgtacaaatgaaggtactactcctaaaaactagaaagaatttta

SEQ ID NO: 1848 - DNA, 1000 bp, Glycine max
  Soy_ogl_5971 Gm18:6735901..6736900 Cluster 7
tttgtatataattatttagtttaatttaaagtaaaagtttctagatctaatttgaacggagcttctcactattagggtggcccctgcagtaagaaaatcacacttacaagaatgagggatatttactaatatgttgtatttatttacaacaaaaatatgtttttattatttttttcccaaacaagattttgtatatgcaaagctcaacaaattattaaagagactttaaatctcacagaaataataagattaaagatttatatccaagaaagatagcaacagcaatacaaataataattcacataattttgatatgaaaataaataaattgaccgcaagtacttccgtacccatatctaacctacataaatttctgtttcttttgagcttgtaactatttaatttaagaaaaaaattgttataagccacaaatatttatcattcgagatagttatattcaaacctgttactcgagataattctattttaagagcagaaacattattataaatcccaaatatctatcatccaggataattctattatttgttattaagataaccctatttaaattgaaaaggactacttataagttgtaatataattgaagactttttgtaaagacgcgcgtgaaagggatatatgccgtatattcaaataataatactatataaataacacaatatacacatttttttaattaaattaattttcatagaaaaaaatgcaaaataataattccaaaaaaaaaaatactaatatgatatacttcctcctctgttcttaaaaatataagattatttttaaaaaaatccttaaatacaaggcatagtgcattttaattattaacaattattttttatataataaattgtaaattttttctattttaaataatcatcataattaaagtttttgactctataaagctcaatataattttaaaaatttggatctttttgagcaaatcattataatgttgattaattttcatgggata

SEQ ID NO: 1849 - DNA, 1300 bp, Glycine max
  Soy_ogl_4282 Gm13:26530501..26531800 Cluster 7
ttaagggatgaggattgatgtaattgattttgaataatattaattttaaagtaatatgatttctaattagatgcttttgttataaaattaagttttaagtaaaatttaatataattttttttatctaatataaaagttatttaaaattatttctaacttaaaatcacaaatataaaactaattctcaaatcttctttaaaatgaaattaaatatataaaaaacatataatatcaattatagacttgaaattaattctttaacataaaacgcatgcaaaagtttaatgccgacgatgcagatccaaacgtatagtaattaaattttgttaactatataaaaaaagtcataggtcatttcataacttttgtttctcttaaatgcaaattttatttttctttgaccaaaacctaatattacaatgtcctctgttttgagtgtccagaaccagaagaataaagtagatattagatagggaaaacggaattcgaatctgtaccccccggtcagtgttccaggtacaaaaacaaaggcaaattcttgtagactatgatttggtggataagaaaaaaaaaagtggaataaagtaacaaaatactattaaattttattaattaaattgttttaaaaaataagtgatatataattttataaaacatttttttactttatccaatatttttaattttaaaagtaaaacgaagtttagttttattttgaaatatgaaagcaataaaataaaagataaatcaaatttattttgggaaattttgaaagatcaaaatttttaaataaaagtcattttgtaaaatctctaagagataaaaaagaatttgtatgctttatttatcatcaagatgaatattatatagtttttatatgtaaaaagtgtgataaattaattaatcttattattaatttaatgataaattagttcttaaattttttaatttaatgttaaattgataataaaaaatataattaatcattgatctttaaatattatatctaatctcacaaatttaaatataaaactaacttatcatatatatttttcacattcaaaaacaaaatttatattttaaatcaatttatcatcacattccaccttaagaggtgaatttacctatttattctaaaataaatttatttcatttcatttcgctcaatgatcgtatttcaaaacaataaaaaaaaacacccacttgtaataagttttattcacttccaatcttcaagaaaagaggggatatgaaattagtcctataaatatagaggcattgatttttgtgaggttttcaa

SEQ ID NO: 1850 - DNA, 1000 bp, Glycine max
  Soy_ogl_505 Gm02:11857401..11858400 Cluster 7
gcaccataaattgtgacgaaaggaaaagaagaatttcaataatataagggccaacctactcaatcagtgcaagttcgatgccaacatatataaaatttaattacaatcatgtaacccaacttcttcaaactgttgttttcctttcatatggaaactttatgttctgctagttttttacccgtgcatcatttgtttgtgtaattgtagggtgactttatattaattagtatatttttttatgctaaaaaaatcaagttttttttattcaattatttgtgttgacatataataattaaaagaatgaaaaaataattccaaataataaaagtaatataacatggaaagatgaatatatttcatttatgatcaaattatttgaaataaaaaacatatatgacaaaattaacgaaaataaagattactgtatacaaaacatttttttaataactaaataatttccaaaaacatttgtttaaaaaaatatttaataaattaaaacagatttgataaattattaattatttatgataaaattatttcaaatagtatcctttaacaaatattaaaaaagaaattaaggaaataaataccatttatgaacaaattaacggaaataaagattccgctaaaaaacggaaataaagattactgtataccattaattcaaacgaattaatttatttttgaatgtatatcatttaagatcccgttcaaggaaataaaaaatttgttattaatcttttagtcgtccattttaaataataatttcttaaccattgcttaaagataatatctaatgcatttattttaataagttatccgtttttatgattatttttatgaatcaatttaataattttttaattgataacaatttcattatatttgattttttatgataaaattaaaccataattcctttaatgtatttaattaaactaattgtccatttttaagtaattattaaattaagaagttaagatatgctccaataatgaca

SEQ ID NO: 1851 - DNA, 1147 bp, Glycine max
  Soy_ogl_1679 Gm05:34959901..34961047 Cluster 7
ttctttgcttatgtcggaaagaatgaaagagattttaatgagttgtatgtgaaacgtatgctctatccctaaattgcatgaagctcactttaattaggtactgctcctgctttgatgatccaaatctgtaaatgccatatacgaaaaaatgaatccattcaagtggaaaaactaaatgtattctcttatattgcaattattatatatatgagcaatcatgaaatgaataagcctttgtcagaggattttttttaagaaaaataaaaactcagtgatacttataattaacaccttgttactaccttcatttttaatctttagttgtttaagatttttacacgtgttaaaaaatatatttaatttatacaactttatatctaaatttcctcatttattattttacaaatttctatattattttcaactacttcttttttcaatgcaaattttactacgaaataatattaatgcttcatcacagtatctcgtaaaattaaagttattaatatttcactaaaataatcttaattaatacttcaccatatgtaagggcatagttagaagaggaaagagtaaattatattaatcaatctctaagttttatagaattacataagtccttcttgtttttttattcctacatcaactcctttaattatttgaaaaatatattacaaataagaaagatctttttgtaaatgttaacaaaataaagagttttgtgtaatttcagagacaattagtataatttattctagaataaaatgtacagttacataatggaattttaaaataatcaaagttttgaaacaaatacaaaatactaaaataaccaaagattggggaaaaagagagtattagttatagttttttaaaggatcaattgaatgtgaaaattcacacccaaaatcattaagtcatcttgtaatgatcatcccctcaaagttaacagaatgagtttctaattagctacaataattaactatttctaggatttttttatcataagaattatatacatatatcagaatttataataaatcacgcaccattttaatatagttggacttccattaggaagcattgcttatgttaagaataattacttatgttaataaggcagaaaatatttttataatacatttat

SEQ ID NO: 1852 - DNA, 1118 bp, Glycine max
  Soy_ogl_526 Gm02:13069583..13070700 Cluster 7
gtgctttctggtcttagctaaagatcattaagtacctttttctttctttttaggctataaaacatgaaagaactttcatgtttaagtgctaactgagaaatatgattgtgggaaaaattaaagacgtgagctttctctttcttgataggattataattaacagtaatttgattttgttttagtctatctctctttatatataattttttcataaggctctctttatttatataaataaaagtatattataattctgggaaatcttactctaattaaccacatataatatttaaaccttaaaatagaaagattttttttttactaaatcagaaaagtatggcaacaaattttcgataaaaaataatttagttaacagccctataaatatgcttgcgagacttacatgaacatcctcaaaattaatcacataacgaaaaaaaaaacatgcaaatgtatatttctctatttctcaactagatttctgaaatgccatgcaaatagtatatccatatttaactattgaaaatgattattaattatatgcagctaataagagatatgggaagaaaaaagaatgtgatatctaatataatgtaatatgcatcattatctttagtaatatttgatgaaatgttgtgaaaggtaatatttacttatatttgaaaatatttgttaaatgttgccaaaagttttttaaaatatttttataagtgttcagaaaaaaaaattattactaaaggttaaatgtgtattttaacgacatggactatacacaacatttgataaaatataacaaaaatatattaataacatttattcatatttaaaaatattttttaaatgctgccaaaaacttttagtaatatttttttaagtgttatgtaaaaaaatattgctaaagatcaaatgtgtaatagtgcatgaagagtacagagagaaactaagaaagaagagagataaaaaaaatacttatgtaaataccattattttattatcatttcccatcattaatttttttagtttctactatgtatattaacaacacataagaaatgttgaacaaataaaataagttaatttataagtcttaaaaaaagttaaagaaaggaagtcaaatg

SEQ ID NO: 1853 - DNA, 1200 bp, Glycine max
  Soy_ogl_887 Gm03:35826701..35827900 Cluster 7
tgtaatgtcatccatcatgcaagtaaaagggtaatgtctaaataggaaacatatccgaaaatcacaacaaggttctttatttataaatagtcagacaagattagtgttaagcatataattagtttaatgatactatttaaatgtcatattataagttataatatcaatattaataatttaattatcatggtaacatttgggtcttagcttctatgatgtactttgtatttgagactcaaatattatttaccttttaagtcaaatatgaatatgatctttgattcttattttttttttatgtattttctgcttaagggatccttcagatcaaagtctaatcctaacattgataaggaagtaactatgtatcgagatcctcaagtgggcacaatacataataaaataatataaaaatatatttatttaacctaaggaaataggacagacaatatatttcatttaaatattttagactagatcgtctttacataaaaaaaaactttttttgtatagatgtaattttttatagaacagtcatcaaataaaaactttattttaaaaactaattaaaaaagaatttggttttttaggcaaacacgaaaatgttaatacattactacgttttagtgtactttaccaacataaacagaaaatactaattattatgattaggagatgaaagtagtgactggttacagggtgttgtgtgtatttttaatgtatttagtggagtgttttttttatttaaatgaaaaaaacgtcttagaaattaaaaaagattaaagagaaacgatagaaacgtgtatcgcaatgaaaaatgaccgggtgatcacgctgcttaggacacacaacacaacagaatgcgaggaggcggcaaatggcaatggtcagatgcggcgctctacaagaagtgggccccacacgtcttaagaataagaccggaccgaaaatgtgatgattttttcgccagattttacgttgtcaaatgtcaactcaggaaatccgacggcgaagctttcaacatgggacccacgtctagattaaactcgtgatttatctatcactgaataattgaatatcttttctttttagggaacagacaacgaataattgaatatcttaagaatatagattaattttaaatatttaaccaaagctcatattgaaaatgtattaaaagttactattatttttaatttc

SEQ ID NO: 1854 - DNA, 1483 bp, Glycine max
  Soy_ogl_6881 Gm20:39954501..39955983 Cluster 7
ttaaatattcaatagttaaacatctcacaaatgcaacatatatactcaggaatgataagaacgtaaaatgtaagaagagataaatttttatttaaaacttacataaacaattaaaatcaaaattattaacgtgagactaaaagatgagtatgtttggtagttcaattaataactatatctctacgcaactggtgttagaaattaatagacatggtctgtctttaaagagaccaccaattctacatggtctttaacttttggggtacgtattagtatatggtgccatttggcgtagcgaaattgactcttggacatagtggtttgttcaatggccggtccagtttggctacagtatatatatatatatagggtgtaaaacatggatatggatatgctacagtttttgcactatggagggaagactccagatttggtcccatggagccaccttggaccattttctactttggtggtcttcatttcatatcctattaaaattatacacgttaaaaaatatatttataagaaaaatatacaccgactcgaaagacacataaaaaaatacaaggtatatatggaacgagaatataaataattaagattaaatattagttaatgtattcttttgcttttctctcagtcagatattctcgaatattgatcttttcattagagaaattcacttgacttcttacaccataaccgtgcctaggaatctcgaaacaataactaaaagagatatgatgagccgtcctgagaatatagagtccttcagattcactaaatcatatatgagctatatgctaaacaaattacatgttatacttaaatactctaggatgatatttccttactctcagatatgatctagctaaaaatacgataactataggattgcttaaaaaaatagtgtgtatttattttttaaacttaactagtttggaatggcaatagataatggataattggctcaatgaatatcaataaaaatcatgatgtttaagttaattattagtttaataaatataggtataaatgcaagcattatgatctttgaataccttagtacacacttcatcctatacttataaacacaaaattataataacaattcaaaagttaaacttatagagtaatcgactactgtttttttttttgggtagaatatgtttgccttataaaaaatttaaaaagtattaatttgatactaataaaatttttcatattaattcgattcttataaaaataatgatccctaatgataattttattagccgatttccttatatgatcaaaaggtttaattatttcttttatttttctaaatacactaaaaaagacatcaaattatatatataagtctgttaatcatatcaaaattatcatataaaaaaattatcgatgtgttttattttttacagaaatcaaattaatagaaaaaattatacggatcaaattaatatgttttaaattttagaggaat

SEQ ID NO: 1855 - DNA, 1200 bp, Glycine max
  Soy_ogl_2088 Gm06:46255001..46256200 Cluster 7
tgggttaaactgattggtccatcaacttacttaaaattaaaaaaattaatataaaatattcaatagaaaattattatttcaaaaaaaaataataaattcaatagttagtagaactttaaataatcaaggattgcatttctttttaatttcatgagtttaaaaataaaaaatatttagctaaaatcaatcttccactaaatgtatctaatatattttttaagataattgcaaaatctaaaaaaataaataaattccgtccggcccagcccaaattcatgatgaccgaattgcccgtggttttaattttcaatgcattttgacagctgcaggtggaaactctgcatgatattagacacgtagaatacattttgagtagtagtagtagaaactagaaagtgttatttacacgttgctaacttggacagcttcaccaaacatagtgctctttctgccacgtttactcacatcttttttgttgaagaacacattctacttacttaaaatttgaaaataataataataatataacttataacaattatagtattatatttaatatcaatattgtttgtaattttattaatattttacaaattaaatataaatttcaagatattacaaaatgaaaaaaatatatgaatactttaaatttttttaagaaaatctaaattttttatatatttatttaaatttgttagaatttttcctgaaatttttaaaccaatagaaaacttatctttggtatttcttgaaaatttatctgttgatttttaagtttgcagcaaagttataagcgaattttaaatctgcaaaaaaatacctaggaattttctacagttttttttccaaaaaaaaataaaatttattgaaaaaaaattgtaagaaaaattatccaaaaaaatcaaagaattaccagcagattaaaatctacatgaaactttttttaaaaaaattatactaaattcgcagaaaaccttcacataataggagaaatttttattattatttattttaacatgacactgtcgcttactacaataagacttctatatagttttttttttttaaaaaaaaaaacttctatataatatcatgacattataaatatctcattaaaaaaaatgacattgtgaatattatataaagtcaaggtgtataagtactgcaacatcgtattaattaaaacatattataatttaa

SEQ ID NO: 1856 - DNA, 1006 bp, Glycine max
  Soy_ogl_774 Gm03:688701..689706 Cluster 7
taatttaaatttaaaacttgaactccttgatatgcgtctaacatgcatcatgaaacaacaatgagaaagtaataagatagtaattaataaaataatatatatgaaattttacttatgaagacgtattcttatctcatgaaaataaatttttttcctcttctagggactaaatacaagtacaatgtgtgattatatctttcttagatataaaatatacacaaaattaattttttcttatctcataataaatatgaaatatttttttctgttcctgtatttctaggaataactaaataattcatgattttccaatctccatgatgtaccatagttaaaccattccaagcaaacctacttgcaccaaccgaatgcgctcattgcacttgcaccaatctctctaaaaagaaagcatactctagaccaagcatatgtactatttaccttgttattattctattatttttcctcaacttaattattctagtgtttttgcttgtcaatattgcaaaagacctataaattagttttgtttaacatcatggactctgactttattgtacataaactatattctcttgctttctttttaaggaaaaaaaagttagccacaaagatttcatgtgcatatttctttgagaaatatttttactctgttcatattcttttttttttttgttgaaaaactctgttcatattctgattcatcttccattaacttcaattatcacgcgtttagaacatgagaagatagagaaaaataatataattggcaaattgatgacctagaattagttagagttggagaaactaaaacatgaaagttacatttgttgaaagacagaaaacgagtgcatcataaatagcaattatgttaagcaaaacctttttctaaaagtaacattgtggtgatgtgtgcattcgttaataataacaaatcgttaaaagaaatgaaggaaacaaaaataaaataacataaatcaatatatgtgtatatcatattgttctg

SEQ ID NO: 1857 - DNA, 1257 bp, Glycine max
  Soy_ogl_3800 Gm11:8577923..8579179 Cluster 7
tgtgatcacagacttttagaagtgacagataaataaaataaaaacctctgaaaatctcataattaaaaagaaaaggaggtggtagtatttaaaatttgaaaaaagtttggtttcaaaatagtttgtaattcactggtcaatatttattccatattccttacaaaattacgtggaagatatagtaatgcgtgtatatgtaacttttttttctataaaaaaataaaattatttccaatatttattattttatactttctgcttatcaaaaatatttttttatacctattattgagaaggaagcaagagagaagagttaaatttcaggggtgatggtgttctccagaatgtaaattaattgcctccagatagagtaaaggaaatctgaatatctatttttaattttatttatggatcgtcaagcttatatgcgtcacagtaagtcctgctcttattatactcacatgttctatctttttaatctacttttatagtgtacagtctaaaagtatgattaatatttttatttttactaaaaatgttttatttttaatatatatctttacttattaattatcatttcccttttttattactctattattatgattatattaatatcctatttattagtcaattctcatataacgtcaagttaattaaaaacaaataaaaaccagtaatagtaagtgacgttatatcaaatttttaaaggggttgatcaaggaaagactcaaatattcaaagggggtaaacgaatagaggtataaagaataataaaagtagaaaaatattaacagcacacaatctagtctctcatacgttttctattattatctgaaatttattactaccttcattaaaaaactctgggtgttttactttttaatttttattttataacttttgttggtttagaatttcaatatgtaattatgcaaaaaatttcaattataccctcgtatgtagttgagtaattaaaacttttttagtgttgtattgataactttgagttttacaaggtacttataatagagtattaatgttaatgcagtacagaatattttttcttaggagaataaatggaattgttgaaaatatcatagaaaattgtaagacaataaatgagaataatttagtctttttttgggaaaagaataatttatcttaattataagaaaaaatgacatactaaataacaaagaaagttagttaatcatgtttaattttattaattttaattaaaaaattgtttttttt

SEQ ID NO: 1858 - DNA, 1408 bp, Glycine max
  Soy_ogl_5555 Gm17:6916201..6917608 Cluster 7
ggtagcagatgaaaatgaatctcgttccatggttagcctcgatctgcaactgcaacgcatgggtccaaattgtcggggaaggactcttcgaagatgtggctaggggagagcatgggaattgaaagttataacaacaaagggttggaaagtgataataaggactaagtgcagctgcaacagtcgtggactacttcctaccatctctttcttcttttatagtgtgtttggattagatttatagtaaaaaatatgtcatagtgaagataaaatgataaataattaattttaatttctcatgtaccactataattttaattttattaagggtaaagttaattcttgatattatcctaacacactattagtcaggtgtgattgtgtatctgaacatggaatcacagaattattggtattaattaagtagtattccagtttgtatattataagtacaagataaaaaattatacataaataaataataaataaatattttgaatatataaattatgttcccttattcttaatataaggtataatttaaaaaaattaatgatcttttttataagacattttataattcctatgagacatttaatttttttactagttgtcattataaatactttaagcagtcttagaatttaataattttacatcatccataataaattaatgattattaataagggtaaaattgatacattaataatactttttaaaataaaaatcaataaaatcaatggttcttttttataagacattttataattcctatgaggcctttaattttttttagtagttgtcattattaaatactgtaagtacttttagaatttaataatttcacatcatcaataataaattattattattaatgaaggtaaaattgttacattaataataattttaaaaacaatcaataaaatcaattgaattaactatttttattggtctgtgtaaatttgacccaaatgcattacattaaggaccagctggagagaatatattttatatgtataatgaataatttaattagtgatataagcttacttttaaattaaaatagacagatagttaagaaaaatgttagcaacatttctatcatttttttattattgtcgactaaaatttgttgaaattacaaaaatagtgtaagtctcactctctttttttaataaatatcacccatgattttatagtgtttaatgaattttaattgataagagaaaaaaaaggagacgtgttaaagagtgtacaacacttcttataagattagagatcaaagaagataatttgagatgattgcgagaaataaatttttgcttgcaagagtagtgtgtgaaatatgtctttcaaggagacaagagagtataaattgagaatatctataccaaagtgagcacaatgg

SEQ ID NO: 1859 - DNA, 1027 bp, Glycine max
  Soy_ogl_524 Gm02:13012401..13013427 Cluster 7
aatttgttttaattttttctattcactttttgataaaaaaaaatggcatcatgggggatcgagcactcacctcggataatgtcaaaacaggactaagccactagacttcgctttacaagacatattgtatgtcatataatatataaagtatcagaataacttatattttcatcatcaacctcgaatcagatatttagatatggttataacccaactgtagactctgatcgtgttagtatcaattttaacatcgaatagaaatattttgaaatcagaaacttttccaaaacaatttctatttggtttatggtttcacacgtgcataatatatatgtacatgtttcatatatatttatctcatttttttacggaaaaaagaagaatacatttatctctcttattatgtatagggttttactatgattttatcccgagaaattcaaatataaaatctattcttttagctatctcccatacttcaaaattaaagttcattttttttgccgataatttcttcaaaagttaatcttacttacatatcatttttttaaaactacattttttttaatttataggccaacaaataatattaaggggagtacaaatatgctccaattcttttatgacaaggtcatagacttgccccctcaaaaaagaagaagctcatagacttgctattgacttaaaatcccaatgcaattaatgaaacgacaacataatataaaaaaacaacatattcttataataaattagtagcaatagtcaaatcacacctagatataccctcttttacagagaaaaaatatttttcttgtattcaagaaaaaaccttattttttaaaacccacctttgggaggatgtgcaaagattaaattatcttttcccaactaaacggcaactttaatcgtgcaataattaaactctaaaaataacttcaagttggcgacattccatactagctcaatttctcttatcccctcttggcaatcaattgatctatttatgtgctgctcgtgatcactatat

SEQ ID NO: 1860 - DNA, 1448 bp, Glycine max
  Soy_ogl_1327 Gm04:39742301..397433 Cluster 7
cttattaaattattttatatggtaaataattgaagttaatgttaaaaatatcatgtaactctttaatttctaaaaaatttatttaaagattgttaatgatcaaccaaataaattttcttcattaaaaaacatgaaaattatgattgcccatgaaaaaatttctacctaaaagcttaaatttgaagaccggtgacaactagatcaaactctaaattattaatttagaactataaaaaattaacaagctgtgagtcaagattctttcatttcatttttttaatcatgtgatgtgatttcatatatgcattactttaaattatcattgttaggtttacgtgtacaattccaaatcaccagctagaaagcgttgtgctgtcgaacttgttggccatgttcaccgaatgggagggactaagaagatggggctaaaaatcagaaactgcatacccctttgttttagtgctttgtctatattagacatcttatagtacgtggtattgaggtaatgaatattctatattcagattagtgcatgctgattggatggaggattggctgatgtacagaatttacattttttggtggaacagaattcacattttgattcttatattaaatcatccaaaatatattttacttctaaaaaaaaccttttttttgtactattttgttttcatgtaaaatatttattaattttatcaaaaaaaataatttcttctaaaaaagcacaattaatcaactttattataatctcttttcttaaatatatttgttatatttaaacactcgaattaataccttagaggaataaagttcagtttcacttgaaataattatgacgagttagaaaaaagcagaatataattgcagtaaaaaaaatagaatataaatatataattaatcatgtcaccataaaataattaatgtctggaagtattttaaatttacattgaaaaatgactgctaaagttaaaaaaaaatgtcatctacagtttaatacgtgcctttttttttctgaattgatacgtgcctttcaatatcttacttattataacattagtaatattttaaaaattattatttgctctttttataacgtttaaaaaagttataattggcccagttttttatttgggacatgtaacccaattttaattagtccagcttaaaatcctaggtcaatccaaattcattccctactaaacaaattgcattagacgatttattattaaaaaaatcactatatcactactcactagttgggatctttcaccaaagtttcctttgctttccttttccaaaaaaaaaaaagagattttgtcaaaaaaaaaaaaataaacaacttgaaaatgagataagaattgaattgttttagtataaagttaaatttaatatttcgcttgaatggctttcaagtttataagttaactccacaattgtcttactcg

SEQ ID NO: 1861 - DNA, 1024 bp, Glycine max
  Soy_ogl_2811 Gm08:36036501..36037524 Cluster 7
tttcatatttggtctcacaaaaaaaattttctaactccatcattattatttatttatcactgataaagtattatttcatatttaagcttatatatattttattctttattagtatactaatttttttttctttacacgttacatatattttattctttatactaatttatttgataaagtatcatttcatatttttatttttctttatcaatatatcataaagctaaaaatttattcaatatgattctatgattttacacgttagaaaaactaactaaaagaatgatatcttttaatcacatatcatattttaatttgaataaaaagagatataaaataaaataacaacttcaatttatttataaaaaataatatagaaaaaagtattacaaaactataactttttcttaaaaaaacaaattataccctttttttagttgtgagtttagtgtcgtcataattccagacaacctgttaataggattaagaagatattacgattaacactttttctataagatttcaatattatttattatgctgattaaattagaaagcaaatattttgattaattttataactataatttttatttatttattaaattataaaattttattttaataattaaagatgattttatttcttattatcatcattcggtcgcgacttgcatccgggaaattttataggtcaagaagtcatatttaattgatcctttcttccttaggaattgtattatattgttttaataaatcaaatataaatactcaattttcatggttatcgttatataacactttaagattgtatatgattttatttttttattatcgttatcgttattacttcttttgtccttatttacaagatgtaattaactaatccatgtttattaagaaattgattaaatttaggtattaacataaaatttgtctgcaattataaaattttcccaaatttattcttaacattattgagagtttatgtatttattttcttaaaaaaatatccaaaggaatt

SEQ ID NO: 1862 - DNA, 1200 bp, Glycine max
  Soy_ogl_5059 Gm15:15405701..15406900 Cluster 7
aagcgaaattgtttatcatttttacactcacaattttgaattgagacagtaaccataaaagcaaggtcttctctaatgctaaacaaagattgtggacatgtgaattatgatcttttaagttaaacacatcccaaattctcctttaaattaattttttgaattttttagggaatcttttttttttttgtaatacgcacatgtcataatgatacatcattatatttttgtaaaatgttattacgagggatttgaaaaaccaaaccaaatcaaatttaagtttttgttcctaaatggaaggggacttagctccacagccaagagataaaatcaataagtgtgcttggtaaaattagagagtttataagttttttttattagttaaaaattagttcgacgtgtgtttagtaaaactaacttacaagttaactgaataattataagctatccgattgaattggaagtgattaataagattagctagctcataagttagttgataaataatgacataaaaagatataaccaattatttgattaaaaaagattaaaaagaatctcaaataaaataatgaagataaaaatgaaaaaagaaaaataaagtagtttatttttgtaagcaacttatgaaaatgaacaagaaactactaaagtaaactcttatatcaaacaaaaacttcagataattaatattcctatattgatttatatattttggttcaaattgaactaattaataaaattcatgtcatattttttcaaatattaattttagctatgattcagaatttgatgtcacctaaaccactcaattcgaattatttcttctttttatatgcacaatataaagttgtatttaaaaaaatggatatatcaatcgacctaaatatcattctatttttttttttaaattatatattgactgaaatgaactaaatcaagccaaactaaactaatatattttaattaatttaatttttctctttagtctaaatcaacccacccgtggttcctcgatttaaaattagaatgtctctaatatgatattaatatcataagggaaattatacatcatattcatgtagataatttcactttctaatattcaatttctttataaagatttacaacaaattatattgatctctcttgtgtttagaacttattatcctcacactctctccccttgaaatgcatttcttt

SEQ ID NO: 1863 - DNA, 1110 bp, Glycine max
  Soy_ogl_23 Gm15:16612101..16613210 Cluster 7
gcccttgatcatagatgacaagaagacttatatcattccatgagcactcaattttcatgcttgaacctagtctattggtatctttcttccaatatataagaaataaatgatattatttttttaaattataagaaacatgtaatcaattttagacgtatcaattattaattttcttttacatccttatcttatttaactgtaaagtctattaataagatatcactcatttccctaatataataagtattttttaaaaaattataaaaataagtaaatggtactttgatatacgattttacaatgaaaaattcatatatcaaaacacgaatttatttttcatttgtttaaaatagttttttctctaagaattaaaatcgtattttaaaatacaattttagttttttttcctttttctaatcaaatagtatgataaaatatgatttctaaaacataaaagaaaacatgctgaaattgtatgttaaaatatgatttcaacttttaataataaaagaaatttaaaaactgaaattgtatatgtatatacaattttagtgtaacaattttctaaaaaataaaattgtattttgaaacgtgatttccttatagtaaaatcctatttcaaaatacgatttactcattttcgtaatttcctaaaaatatattcattatgataattttttaaaaaattatccattaattctttcagtttgtttgattcgtgatttctaatgttttgctgacatgacaacatgttttccgacggagatttgtcatcaacaaatacatattttcgcatcaatgtcatgatgaagaaaaaaaatacaatcttaatttatttctctaacttgcttaaactttaaaatttcaaaaacttatcaaaaagattattttattctagaagtattatgatatatttcttaacttgttttatgtctacaattttttcctgaattttcaaagtcactttgtataaaatcacattatccgccttgtatttaagtaaataggtaattcacttaaaatttatcaataattagtaaaatacatatattttgtaatcgcatgaaatattttcagaaactaaaaataatcctcttgaagtaagaatat

SEQ ID NO: 1864 - DNA, 1086 bp, Glycine max
  Soy_ogl_5347 Gm16:26472501..26473586 Cluster 7
attataagaatctttttaaattatttttgccctatttaatgatgtcatccaaaaaatatctttcaattaattaagattttatttattaactactgctttttattcttcattccaaatatcaatgacggatattttagaaaaagaatttaaaatgtgattcataaaaattaaataatatttattaacttttttaactagcaccaaaaagtaattaattttgtgagtttggatggagtatttgtgaacttgtattgtttaggtgttttaaaaatgtttgttactccttcctattctttttaaccgtcatattttgaagaatttttatttttatttatttattatttataaattttaagatcacattaattattcttttatcaataatatcctaacttattatatagtctttaattaatttacacatgtatttatggtgaagtgactaagaaacggataaaataagaatcccacaactattttattaaaattaaaaaaaaatattatatttttttatttttatataaataattttaaaagaccgataaaaaggaacataggaagtaaaagattggggaaaatattttagactgtattttgtacaagggaaaacatttaatgccaaataaatgattttcagtactcatgaattcttgaaatcataatttctaggaatggttaagtgattggttgtaattttttaataatttttcatagacagataaaaagaatcggggaagtaaaacattaggaaaaatattttagactatattttgttctagggaaaaaaatttatgccaaaaaaacatgattttcagataaatcatgactctagaaatgatcaaacagttagttataaatattttatatttttttttttggaatcaaatttttttttaaaaatagaaataaaatattttcttgcttatttttaagagaactttctcatggaattttaattatttaccaaattaaataatataaatcaaagtaacgtaatactttttaacatgtaaaaattgtgtatttaatatttattcacgtgttttacatatttttaattaagttacaagttactatattattata

SEQ ID NO: 1865 - DNA, 1000 bp, Glycine max
  Soy_ogl_6045 Gm18:15659901..15660900 Cluster 7
tattaggatctgaataaagatactttacacgttacttactaataattttttaataaaaatcaaattcacattcttcttatatatgaatttgtttttttgtttttttataaacttgacaaatcattgacatgttaaataaaatactaatataaaaagtaaatatctattcactcaaattatttttcacacttaagatttatttaatgcatggaatagtcacttaaaaatttacataatgagtattattccattttgttacctggtggttttaaggactgtttaatatggttttttgaaattaaaaatttgttcataaatataaaatgcatggtgaagggtgcttcctaaaactgagttgtttataaaaattatactacagatataaggaatttaattctattgcatttctttcttttctaaaagtaaaatgataatgcatatatgttattctaatttaaattatagaagtgctatatagaatcacattttctaacatatttcttattattaattaaaatttattgaaagttataattctttttatctcaccatttattttatgattttttttcttctgattttgcattttgttgaataaactaattataattgatagaatgtattagtcaatgtctcaatacacacttaccatcttagaaaggacacgttactatcttagaagggtaaaaaaaaaactactcctaaagtatctttaatttatagagaaagaaaaaatgcccctgataatataataaaagaaacactattctaataaaatatatttaacctatatcaaactggtattgactttcctttttctgtctgctaggcacaagtttgctattattatttttgttactcattaaagagtatttggtaagagattttttttttatgtttgagaattatgaatatttaaaatcatatttccttgatgaagaaaatttgtttgattgatcgttaaaaattttagataatttttttaggaatcaaaaagtta

SEQ ID NO: 1866 - DNA, 1000 bp, Glycine max
  Soy_ogl_5644 Gm17:12049001..12050000 Cluster 7
ttataactcatatctacattgaccctaaaaataatatatagtaaaataattcactcgtaattaataatacttattttacttttttaaaatattttcttctttatcaataattcacccttaaatgtagtaaaagttgtacgtaaattactatatacaaatacattattggatatagattcatttttttctatatataataagttcattaatttattcgtttctatcatataattcagtttacaatacacattaattttgtgacctatcttcaaatattattgaagagtttaagattctaattacggtgatattaaataaaaaatcattaaattccaaaaaaaagttttttttacgtttaatttattaaactattgagatttttatgataaaaaactattgagatatcttaaaaaaaaaacttgagattttttatcattattatattaaactattaagattgagatgacggttttttttaaaaggaaagattgagataacaatagagatcgaatctttgtgtaaggtcttacactcttacgtttcaaatctcataaaaagaaaaactatatataggaattttcaatttgcaaatattttaagttgcattcaaatgacagtaattacttccagacgggtaagatagaattttttagtactttatgccaggccacttgcgaagagtttggataaggagtaaatggatctgcataattatcgtctttatgattttattgtgctattttaagatagtttttgtacaaagtaaatctttgtcattatttgtttttgaagtgtagctttttttatttcaagaaaaaagtactattacatgttttaagagtttggacaacatatgttttttcgtttatcacttaactttttgaatttaggttcggtatcagtttggataaacaacttaattaatatcttattctacaagttcctattatgtaatagcgttgtaagattttaaaatttaatatgctacttgcgtttggat

SEQ ID NO: 1867 - DNA, 1083 bp, Glycine max
  Soy_ogl_4074 Gm12:33610401..33611483 Cluster 7
aatatctcctttatctccgtaaaaaacgagacccatttatctatcccgtattactatgtttaactgctagctttatgaagttgtttcggttgccatacctatcaccaagtacgaacaagattggtgagtaactaattttgaatttacgccacactacctgtttcgatgctatgaatgttaattagcataattgtttgagaggcatggataaagtctgagaaaattgatggagaaaaaatttagtaaggtgaatttgaaattgattgaacggtataaatttatgtacacaattcaatgacgagcttaatagaaaaataattaatacctttagtaattgtaagttgtgtttttagacactacatctattgttcattcaaaataattttgttggatcctaataaagttattatgactctccattcaaatatttatttaacagtaacacaagtatatgttaatgatttaaactcaaagttactaattaaactagatcaatcttgctcaccctaaaaaaattaaaaactagaacaatctcctatgtattaatctatgtgcttgaggtagtaatgataatctatgtttggttagtaagaaactgagaaaagaaagaaaaaaatatagataataatataaatttttattttattgaaaagaaaataagaaaaaaagggaaaatgatttttagaaacaaaatttcaaatatcattttcaactttaataatttcgatgcctcaaatttccctgtattattaactgattctggcctttggagggtagtcatattttttttttattcttttcggcctttggatggaatgtaatagatttctaattttgctaaatggaactgatacgagcccatcgacatgagagatacagatctttagtatttgtcttatattgacaaaaaaaaatggatttgtattatcctactatctcgatttagtatataaataagtttgacaagattttttaaaattgatgtatttttcagataagtttgggttacactttacaattttacatttatcagtaattatataaaaataataaattttattaatttgataaaataatattagg

SEQ ID NO: 1868 - DNA, 1108 bp, Glycine max
  Soy_ogl_6342 Gm19:2453893..2455000 Cluster 7
aagctttagtaaataacatttttgtttttgctgactaaaaaaaaactaatttctcaattttacaacttccatcacctgagttgtgttcagttgagaaaaattaaaacacattttatttctatgcatccatattttgatcaaattatgcacatgcaaataagtttcaaaattttgatctcatccctctgggttgtcattgagaggaagattctcgccacatattttgattttgtccggtaacaaatcgaatttgatatgcagtctatgcatggattgattatatcagggccttactaataacatgtttcatcattatatctagtaggtttgcttacttctgagaatggaaaggctatgttatgtttgtcatctattttggcacatttgtggtatgatctaattgaattatgtgtaacaaaattgggttccaatatattccttttgagtttaatgatgttttggagttgataagattagaacttagtttaaggcgaagaaatttagtgtttaatgttctttttctggctgatgtattaagcctataaagttatctttttctatctttttgacatgtcgcgagatttttgtatttacgttagattttttcttataaaaaaatatcattttttagtgtaatttcttatgaagatgaagtttttaaaacatatatattgtggatcttttagtatagattataaagcgggggaaatcatatatacgccttagacaaaccttcactaaaaggaatttacgcaatttagtaacattaattatacttccgataccaaataaaaatcagttttatttgacagataactaatcagtattaattcctacaatgcataaaaatgtttaattagcataaacaaatcagcccagttcaactataactatataaaaaaaaaagagttcgagtttacacttaattttttaaattgtgtgtcaatattacaatcaatttctaactacacaaacaaatgctgtcaaaaaactacacacacaaattttattactatttggaactcaaccttgattaagtcaaaacttaaacaacatagttaagaaagatatcataacgtttaaaagaattattaagataaaaagttaa

SEQ ID NO: 1869 - DNA, 1138 bp, Glycine max
  Soy_ogl_3481 Gm10:40763663..40764800 Cluster 8
aaattctaaccaatgtgttagaactaacataatggcccagggactcatgaagaggaccgggaaagggaaaaagaactatcatggtgtaaattcattttaatgtaatcaatgatattatatatttatttggtagtcataataattgtaaatctcatttttggggtgtatataagaaacgagagagatgaccaataagaacctgacgcaaaagaagaaatgcatagatgacaaaaagtaatatttaacctttattaaaatttgttaggaccattggtgatgattcccgaaatgaaagaatataaattggaaacgaaattgcacttttactatttgagtggggataaaaaatgtttagggaaaaaaattaaaatagggaatacaaaaaaagttttcaagtaaagaaaaaaatgttggaaactttaaataacatacttttttgtttctgcattgtttctatatatgaaatataaacgaacgtgttatataaactattcataataattgtaaatctcatttttggggtgtatataagaaacgagagagatgaccaataagaacctgacacaaaagaagaaatgcatagatgactaaaagtaatatttaacctttattttattcaagaggatgccttctacaatagtcctgcaaagttgataaatttggtggatacataaaagatattcttttttttccatcacttttgacatgtatgaaaaaagattctgaaatttcattatttataaaaattttaaatcaattatttttttatatatggaaatagatgatttcatcgtttatatatccttacaataatggaaccctcaattcaactttttttttttttaagtgaactcaatggaacttttgtttttgccaaggaactcaatggaacttataaactgttattagaagttaaaacgattttatatatctaaattttaattttttttaaaaatttaataattaatttacttttattgctatgaaaaatatcttatttcattttcaccctttatttcaacactcttcctttactggcgacctccgttccaatgactcgtggtgacagtaagtataacttgctgaacccgtgaaccatactataggtattgatagtttatctcagtcattcatttta

SEQ ID NO: 1870 - DNA, 1557 bp, Glycine max
  Soy_ogl_3166 Gm09:38033280..38034836 Cluster 8
tttgtcacaaaaactgaagaaaggacaattatataaaggggtacttggtgaaattaagataggacatgtgaccatcctcagtgtgagattatcaaatggatgggacccttaatggtttggggccattagactttagtgtgccaatgccctccctctatatataatgtcataatgacagcatttacgagcatatatttatgggcaccccataccatattctctacacattcattatgttaattgttaaccacttgagggggttccggcagtttaatttggaaagctcttatatggcaaacgattattaaaattcttgaaacattaattgattaaaaataaaataaaattttttatttattgaaatatataaaattatattacttactatttttttacactatgatcggtataataaatactttcttttttttactgctttcttgctctttcactgtttgcaaaaagagaaaaatcgtaaacaaggaattgaacgcggtggtggatccaacttttttgtttggttcttacaaaaacatgacggaaatgataacagcggtggcagagttagcatttcagtgtgtgcagtgtcccaaggaactcagaccatccatgaaacgaattttttgttgtcctttcccatattgttttatgaaaataatacatgataattatattaatatttaatgataatatttaattttaaaaatcattaaaattatataattttaaagaagcagcacaaagtgagacagcaaaaataatcatgaaacaggtgttagagacccttgagggcataaggaaaggaacatggggattcaaccatataacataatcttttatgttttttcttagcgaggaagaatggcgtgtgcaataggtttaaacttcaaagatcctgtcatttaaatttgttatctatgtttcaaatatttagaatgttgtctagacttaaattattattattttgtcttaaaatttactttttcttttaagattaggatattgttagcatttgaattttgtattacagtttagttctgcatacaaagatcaagaaatgaagtttttttaattctttattacaggttctattgttcggtagttgataatttgaaattgtattcaattagtatttatatatattagtgattattttaatttacaattaattaagagattctattttataaaactatctgttatagacaaaataataaagagtatagtaattaatgttaataataaacaaaaaaaaaacaaatttaatttctaggtcttaacattacaatcccactgtttgtttgctaaccagtaaaaaattgtgaagaacttttccgtccatagaaattgaaagggttgacataatgatataaaattctattgcattcatataagtgaaaatgattaatttaggaggagaatctgcatttcattcccgtcttgtgtataaaatttttggatctgaggcaatcatacactgcgaggagggttaacctctgattcaacaacacccataatctcaaatctaggaaaaaaaatcttgaaacagaaaataaa

SEQ ID NO: 1871 - DNA, 1800 bp, Glycine max
  Soy_ogl_2967 Gm09:3442401..3444200 Cluster 8
ttttgacggtcaactacataggtgctatgttgatgatgacaatgcatgcttcagttttgaaatcatcattattccccagtcaaccagtagtagcgagttttctctttaaaattgttttctatgataatgatattgtcaaagattaaaaaagaaaatattggttgggagtcgagaaacaagacctagaacatgtgtagaaaatgaatttgttttgttattgtcaatccaaaggcagtaacatactgtattatatatgaagttactttatcggcagcagagaaacatcgtttggtgcgtgcacctaccatgacacattcactggtttcccaaacataaatataaaaaatgcatgttgcggtaaattacgcataaactagactaggactataccatattgccatttctgaaataatgatcaagtcctcactccttttttccacgaggtagatatattacatgtgtcttttattttacatttgacaaatttaacaccattgattaagttgaattagttaatctaggtgtttgatgattttattgttctctttatattttttataattaccataatgaagatctttgattttttggtggaattatgagatatttttataaacttttctttagactgactataggaacaaccttctatttaagatttagttatacttaatcttctattgactaattatttcatatattatattacatcatttattatatctatatttttttctctcttttaaatatcatatatagatttggagtgtagtgtgttgatgaatttccttttttacctaacttttttttaacttcttctaagttaaaacttaaaaagtattacttttttggttaactttgaaagtactactttttcaacctacttcttaaagaattttatttttggtaccaaggagttatttgattctactttgcaaaaagtattttcaaaatttgaaaatgaaagaaaaggaaaatatatttatttgttttccatatatacattttgaaaattgttctaaaaataaatattttaaaccaaaaaaaaagtaataaacaattcagagttattttcgtactttttttttgaagatttatgatattttcatagaaaatcaagtatataatatgtaattgacatatgtttgatatcccatattttcatgtatatgttgattatatcatgtagaactagctgaaaaagtaatcaaaagttaaaaaactaattgaaaatcaaaaatctaaatggtagttaaaaactgtcaaattagattattaaattttaaatatttgataaaattatccgttgaaattactgaaaaatataaagatgaaagtgtacatatttatatgatatttttatataaattttaactttattttatggataaaaatatattttaaggtgttacaattttagtttttcaattaattttaaactcttataatttttattcatatataaattattttcaatttccgttacatttttagtttcaattttttcatattaagtattatactattaattttatactaatcttaaaatatctttaatcaagtttaaaataaagtaaaaaatatatactaagatagatattatacttttattatgttaattgatgtaatagttaaaataaatcatctaatataaaattatttaaaaaataatagaaaaataaaataaacctaacatttattactgttgatttcaagaattataatgttaaaataataaattaaatattataaatagcgtaatataaaaaatatataaaaattagtagtactatggttaaa

SEQ ID NO: 1872 - DNA, 1705 bp, Glycine max
  Soy_ogl_1938 Gm06:14056996..14058700 Cluster 8
ctatatcttcttaaaaataaaaggaagataattagaaatgattcagagatagatttttttagttaattacaaagataatatgtaaataaagatttgaaaataaaatatttttggtctatttaacatttaaataactgcatattcaagactcaaatgtaagatcattggttaatgaaccaatcacccttagttgatctatagttgtatttaaaaataaaatattgaaaataattaaggtgataatattttaaattatgtattttaatttatattataaaaataaataaatagatttattatttaagaaatgtaaacaattacctgactgagctaagctacaataagggatgtattgaatctaaacgtgcgcaatgccatatatattatggaactcatgctttcttgtagtgcccttttcttaatgcacagtatttaatagaatctaaacgtgcgtaatggcaattatattatagtaaagtgtatgatcgaaaaatcgaagatatagttcatccggaatagtgtggcaagcaacgtgtttacgttcatctgtgttataccttgcataatgcatattattcttttcctaccaaatcaagcttcctgaaccactcatacaataatgtggtgacttggtgctgaaaaatattagaaagatacttttttttaaaaaaagaaattagaaagatatttttactatatcacgtaataataattatatcaaatttaattagtattttaatatatagctgcattatatttcaacatatttattacaatattttttaattataatgattttattcgtttaatatcattctacttgccttagaaggtatatgtggtctttaaaaagaaatcagagggaaaaagtactgaaaaagttttagatcgttaattaatcatgttttattatattaaatttcaaccatctcaagttgctctctttacctttatttatatatctaatttttttattgctttactcttttaatatacttttcttagtctaaaataattgtatatcacaacataatttgttatttgtaaatctaaaaacaatttatatatttaaatattttatttaatgaattcaattaaaatacactttgtataaatgctttttacaatgttattcaatcataaatgttatttaatcataaattattatttgtgatagatttattgacttaaataataattaccttaaatatttttaataatttttaattacataaaaataaatattaaactgtacatagtaactaaaatactagttcatacttcatagtaataagtatttaaagtatataaatcatattgtaattaaaatttataataaatgaatatatttgaaaaatcacttttttctggtgtgagaaacaatattgcatgagatgcatatctaatagagagaaaatagatctctctatgtataaaagtgtaagacttcatccactctcctcactttataaattggtgaacttcactctcctctgacacccacctaaaaaccccttcttatgatttcagtagtaatatttaaaattaaaatacactcttaacatgtatttgatataatctcttatgcttttgatatcaattaaatgatttaatttaacttttttttatctctattaatttatcattttcaatatgtttaatattttataaaaacattaataatttaaaataataacatatagca

SEQ ID NO: 1873 - DNA, 1100 bp, Glycine max
  Soy_ogl_2278 Gm07:8138201..8139300 Cluster 8
caacaaaaatgctaataatagctcatttgttagattatatttaaacattacatcaagcttaaaagttgactatataattattacattattatctttcacaatcaatccagagataccataaatcaatatacgtgtacgtatcgacgaagatacacaacataatgaaatagcttaaaaataataaatatatagagtagaatattttaataaaaaaaaactgcgccattcgccacattaaaaagactagtagctaaattagtaattaattaaaagccaaattcgatctcaagacaattcaagcgacgcattagagtggggcaaattcatctcccataaatcatcaaattcttcgaaataatacatagttacctagatgtgtatttttactctttgattattctaaaattagtaaaatatttacttatcaatttagctagaaaaatgatcctttaaaaaaaactagaaaatattatttgtacatcaaagattttttttatatgttaaaattaactaaacttgtaaagaaaattttgaatttcaaatatttaaatttaactatataagtaacttaaaaatttaactatataattgactaataataagaagaaggagggattacattcacttttgattcttgtattttagtaattgtaaaattttgattttccaaaattttctattacacatttggttcctttattttttaagttaattaatgttggttcgccgaaaaactatcatcaaatttttaatagaaattattgtcattcatgacactttaataataacataatcctaacatggtgtggcttataacacatatgcttatgtggcactgtcatgttgttggtttattgaatggtgatcaaaattgcacaatataatttagtactaaaattgaacagacatttaactaattttgtacattaattgaatcatcatttcttaaaatttcattcttaaattcttatttttaaataatgaaagtatttttgtggattagcatcatcttcattatggtaatatagtttcttctataattttatcaattaattactatgtgataggttttaaatatttactaattctattaataacta

SEQ ID NO: 1874 - DNA, 1400 bp, Glycine max
  Soy_ogl_3512 Gm10:43148901..43150300 Cluster 8
aaagtctaggacttttctctctttaatacaaatatctaacccatgtataaaagaatagagaaatagaggattagtgattttttttttttctcttctctttagttatttggagactccatgtggaatttttgcattttctttctaagagctctacagtcgtaagaaggacgattaaattggaagcttgcacctttttaaacatttacaaagtactcttttccttcttcttcatttattgttattttcttcttcttttttcatgtctcgttaattaattccttctttgttggggttaggtcaatttgtatgtatcttacatggtttttgttgacaggaatgaactatttagcgtttttgtcctcaaatgagtgatgattatagggtgaaaatttaccttataataatcaatcgtttcaaggttcatatatatagatcgaggaccaaaactaatgcatgcaggtttgttgaagtcccttataatataatgcatctagatgacattccgtggggtatacatcctcccacatgtattccgaatggtttacaattccgtacacgcctgtcaaatatatatataatgttacatgtgaataaatattattttagaaattgaaattttttagctttaatgtttggaaaaattaaaggagttttaaaaaagttgacgagatgaattatcgcttaaaggatttttttttccggaccctattgttgtttgaatttttttttagccccttcagtcataaagtttgggcaggcgcaccgtaaaataaatctagggccagcctgagctaagtgagagcacaagaaatgctcactacttagtcaaaattgcagggtggatgtggatgttgatgttgtaaatgaatgataaaaagttttttttttaaaaaaaaggataatgggataatatatgaatgtgaatgcgtatatagactttttttacatactggattggtgcaattccattttcaaattattggatataagtgcagtttataaaaatattattgcattgatgtaagtcatagacgttatataacgaaatagtagcattttttttacaacagtggtaacatagtttgaattttgaaattcagaccacattaattaaaaaaatacaacatacgtagatttatataacttttccacatattttaatgcatttatttgttgaaattttgtgaaaactaatataattgtatgtattttcatgtgattcatattttaaaattttgagacattctttgacttctatagtgactgaaaatagttacaacagtgatatgtgtccgttaataaatccataatatacgcaaatttagagaacttttttacatattttaatgcaattatttgttgatattttgtaaaaattaatataattgtttgtattttca

SEQ ID NO: 1875 - DNA, 1093 bp, Glycine max
  Soy_ogl_6174 Gm18:54606908..54608000 Cluster 8
agtttccgtcaccaaaatgatattgtgggtttttagagaattaaactataatataaaagtaagttgagagagagaaaataagcatatatatatatatatataattggaataaaatattttagaaaacacacagttaatttaataaacaaaagatagataatgtgattacaactaattatagttacctaacttaattttattaatcatcgtcttaattgttaaaatatttttaaaaaaaatatatgtaaaagattgtattttatatttatatttatttattttaatcattgcccttataaggctaatgattagccacaccgaacttaaatcaatggcgaagattttttatgggtgaaagcattaattattcctagaacaggttagaatttctattgaagaactacctgttttgaaatataatttctatttcaagaacaactacaagacggaccttaatcgtgattttttcatccttttatttagcatccatgggaagtttgtagtaaaaatgtaaaacactaatttagaaaatgaatgtcgttttcggaccaagcggcctcgcgtgaaacttaaatctttaataattttaattttagttttgctatctattatttgaagggtaatagttaagaaattaaatgtaattttttatttattaaaagggtcacatttaatgttattagtacattttaatcacaattttagtaaattttttctattgttgattttttcaattattattattcttgactgagaatcaaattatccaaggaataacttttaatagttattgagcaggaagataccaagctcatctcagtacttctaactagttattagcttttggttaaggaatattctgattaaaaaaaacaacttttaatagttactatgtttactaactctttgtgtatattattttttaatagttcatcgttaaatcatttttttagtaaattaagtctatatttttttatttaaaaaatttgaagttatttgatattttattaaataaattaatttataaaaatacaagaaaatgttcatgataagattatttagttacaagtgtatgatgaaaaatatatagtta

SEQ ID NO: 1876 - DNA, 1520 bp, Glycine max
  Soy_ogl_2566 Gm08:8825581..8827100 Cluster 8
agacatcatcttcaaggaattaccgagatagcatcctagatgatagagagaaaaaacgacaacataagatcctgtgtaacttttttttggcagtaagatactgtgtaacttagttagagaaaaacatggaaatacatcagtaatgttggtcaaactagtattatttatatatattttttattgtaacatggaattacataagataatcttttaatgtgattttactctaaatgtaaattttggatttgaaatcaaagacgcaaaaagaagaattagtctgatagctttcaactataaaagtacttgaattaaaaaaaaagttttttaacaaataaaagattacgaatttgtccttatgtctatatgatttaagaaagggaagttggattggtggagcagggcggccatgtgctggcacccactaggcattactgctgcttacaattattagcagacaacgaaacaaaataacaccacagcacagtagtacttggctacttgcttcgttttcagtttcctccttcttgcatctaaaactaaaatatctctatttcttcaattccaacaccaacctttatacttataaaacagaacgcctcttattaaaagtaatgttaaagagcatattaggccatttatgtgacagtttttgtttaagtaaaaatagttgcctttaaaagtttttaatactatttgttttaattcttcaaaataatcacttaaataaaaatctgttgaaaattaaactttacaaacactgtttaacatgataactttattccttgacttatatcgtaagttcatatatatgaagaaaaaattattaagatatatcaacttcttaaataaattatagtatgttgaaaaattagctatttacttttgacttgaggataccttagattcattaaaaaaaagttatttttaatagtaatttctaataaaaatcagttgttttactttaaaagttatttttatgatactagtatgcaaactctttttagtttcttttttaaaatcttttgaaaaattaatcacttaaatttaacccgtaacaaatgggcacttaatatattttattaaatgtgttcaattatttcaaaaagtaatattacataatacagtaaaaataatattaaattattttgtaataaatgatactactatgcttttttataagatcattattaattattttaatacttttaaaaaaattaaataaaaaagtaaatataattaatattttaaaactaatagtaatttacactaactattcttaatgttttgagaaattgcacaaaattttgatgcttttatctatttctacactaatccttgttaattttttttacaacaatcctcgttaacttttaaaaaatatacactaccgtattatcctgtaagggggtgttaatgtaaatgtaaaaaaaaatgaaaaattgtgtaatttcaataaatcttagccgtgattagtgtaatttatttaaaaattaatgcaaaaatgtaaataaattagaatg

SEQ ID NO: 1877 - DNA, 1600 bp, Glycine max
  Soy_ogl_1943 Gm06:14372901..14374500 Cluster 8
aaatttgtttccaactcatgtaaaatatgtttgttttatttttagttcttaaaacattttagttaatactttgaataatgtaaaaatgtcctctaaaacattataagaatgaaaaataaaacaaatttaatttgtaaggactataaataaataacaaattataaaaactaaaaatgtatttaagtcttaaaaaatgaatgatagatataacttttgttgtctaaaaagtaataaccaatcttgttttaaaatattactttagaatatgaaatttagccaaacacattttgtatgattttttattttttacaatttaaccaaacacttttgttgtctgaaaagtagtaacaaatcttgttttaaaaaaaaatattactccaatttagccaaacatattttgtttcaaaatttactttagaaaaacaaaaaatcgcaactactccaaattagtcctaaaactatcattattttaataagaaaatataataattaaataatttatattcttataatataatgataatttttttaattaaatttcttttactttcatttttaactaataaaccatacatatcattgtttgtcgttacttttttcgaccaaacatagcatatgcgcatcataccttccgctaaagaattcttgaacccattccaaaagtggtgaccaatcgccacttccctcccatgtgagtttggagatacaaagttcaaaatggaaagcaaccaaaaaaaatttgggggcatgatttccttgtcgtacgacacaccaagccaatggccaatagggaaactacaacacacgacaattcataatcattgtactcatttgacgccacctttgctttactattcaagaataatgacacgtacctactttgcaaactaagaaagggtctaagacccaacaaccaatgactaccttaattagttaattccccctacccctagcatctcttgttgatgaaggttattatattgtggatagggatagtcctaagctttgaaattggagttcgaatgatacaataattcgggcaatagctaattaaggatataaatcatataaagtatagctaatttgcatgcaaaacttggtacaaatgaagcaatcacagtcgttggttttctaattttctgattggtgcccactttaaggagagggagaatctgctacaagtgcatgatgggttgatgacgccaccaaggtcaaggtgtgatttgaatatcagccatattcaactagggcaatggtttaaaagttaaatttaattttttggtgtaccatgtaacaatttaatcgatttaactaatgaaatcatatcttaattattttttaattcaattattatttttataatactgattcctttgttcatgattaaagtattattatatggatttcaatttgatatagaaaaagaatgttaagtagtgtttttaagatattaaaaaattataaaaaaaaatattactgatatatttttgtgctttttaagttaattttatcataatttctaagaattttttttatcatgaaactaaatcacttccatgtaattaaaagcttttggattcataagaagaaagtttaattg

SEQ ID NO: 1878 - DNA, 1372 bp, Glycine max
  Soy_ogl_5616 Gm17:9722329..9723700 Cluster 8
cactcaactaccaatgtttcagagcaatcatttacaagataatttttagaagaataaatgagtaaatttttttataaaatacattgtttaaatcggaattcacccgagtattatattgtaaaaaataattaagtgaaaatattcgaaagattaatttcaactacacaaatatgaatcataaatatcattaatatttaaatacatgaaaagagaaaaataaatattttgataaataaattaaatctaatttaatatatattttttaattttctatttggtgtataagtttaaaaatcttaaatacaaatggttaaatactttcattacttaaaaataaatcaattttgttttaaatataataaatgtttatatttttaagtgaaaagtatcttgttatttccttaacatatacacttgttttataagataaaaataattactatattttattatttgtgaactaaaagttacttaaattttattttaacaagaatttaaagatcatgttttaattttcttatgtaaaatgtgaaagtaatcaatacttagttattttattaactgtaatgattattaactcttatatatatcttaaatatttatatttttaacattttctcattaccagtatggttttatcttaaattccgttaatttttataataaaatactttcagttaagttaaaaaaatataattaacacattttatgttttaattattttaaattgaattttaccgtgagatagggggggatttgggttcccttttgataaaatcagagagactgtattttaaaaagtgtttaaggttgaatttatgaaaataacttataaacaggctgatccaatgttatcagattaagatcgattatcaactcgaaatattagatcaggagtggatccaataaatcatcaattgattcatatgacccagacagtcaccagactctcatctttcatcacataattcttaaggtctaaccttgtgaatgtgtgtattttctgacagtcgagaaaccggatccgagatagggtgggtatatgctagttcgggaagaatattattaatattattaaccaaaaaaagctgtggacacttattgcaataatgaaaaaatgactaaatgagaccctacactagtactatcccattacccatgcagacaaacaagaaagataaaagggaaagaatcctttcaggaaaatcatacataaaaccagcagtgtcttactagttactgggttgtggactttgagtgaagtgaaactatggacatgaagcaagttggtatattgggtgccaaaatttataaaagaaatactattgttttaacttaagaatactactattaaatgactattctgaaatga

SEQ ID NO: 1879 - DNA, 1000 bp, Glycine max
  Soy_ogl_6427 Gm19:38542101..38543100 Cluster 8
tatggaaaatagaataaaataataaaataatattctatatattttaggtcacaaaattatttttctagtaatttaggtagacttccaaaaaaattgagaatgactatggtcccactctcttcctcgtgcatggtcaccttttccctctgccgcatagatatcgatcgatggttaattagtattgtctgaggttatgttaaaattttattttgttagaccaaataaaatccaaaaactttttttagagagagaataaaatccaaaaacctaattataggttggattttcaattatatgatctatatattggaaatcatatgacaaataaattgggggaattagacttatacatgtgtccttttcgctggaaagagacagacgaaagcatgtatgcttcgtttattttattcaaggaatggagcatcaattcctcctaactttatttctttggtaaataaattaatatttttattttatttgaattagtgttaaattttatgacaacttttatagttcactctttttttaaaaaaaattgaggtatttcaacagtttatttaatttaaatttcaattattaattagttttttttttttacaatttaactaggagaaaacagacacgaaatgtctaactgtttttccattttttatataaaaaaagataatagaaattagtggataatttataaatataattatagaaacaaaataataatttgtgattgtaattctaggaataaaattggtataaagatatgtacaccaaaacatcttatttcttttatatatagttacaattttttttaaacattaaaacatattaaaaaatctcaatccaagaaaagaaaaaaaaaagagaaatgaagatagagcagcgttgttattcaagttcttttgattttctttatttttgtatatatgaatctagtatggatatttgaatttaattatatttggaatgttttgagaatgtaaatgtgttttatacttcacctaat

SEQ ID NO: 1880 - DNA, 1100 bp, Glycine max
  Soy_ogl_2285 Gm07:8223401..8224500 Cluster 8
cgcgtccaatttttctttaccgccaaatcctgtgataacaactaatatatatttgttcatgggctgagatccaaagagaaacattaaaaatgagtataatatctgttaataagtcagtatagaactacaaatcataaacacatatatcttgaccttaatagagagagtacacctgcctatagttttttatataaaaaatgtgtttatttgtattattactggcaatacttaataattttttcatgatcttattttcatatgaacacaaaaaaaatggagttgcttaaattggtttttaaagttaagtaacttaaaaatatcattggaacaaatgaattttatagaaattgcttatataagtaattatcatcaagattgcttaactatcaaaatattttttttttaaaaataaattaaagttattgtatgaataaattaaaagataaaataagacaccaaaaataagttaagaacttaggtttagcttatgattattcataaatcttattatatgacaacaagggattcactaaaatagagttaagagctcatattgaattcttgtgttgaagatgcttttaattgatctaaacaaccaccaagttcttcgcatcttgaatgatagtattatttatgcattggaaactaccttttaagttattaactaattcataagtaaatcatcttttttttttaagaacacaaataatcatcttataaactcttgtattagtatacacacgagattccaaactcaagcaactactacaacctaatacttcaatatattagatttagactcgcaacatgaatactttttttaacttattaaattaaaatagaatatccaattggtcaaatatattataataatataaaaagattatcatgtacagaggttagatggtgactaaatttttggtcaattagcttaataggtctgatccatgtaataatatatgattatatgttatgtcatgacactttttaatataacgtaaaatatttttaagttgctagctaacacaaaacttaaacagatggaatgattaaaaattatagttttaaagaataaattactaataaatacatttttcaat

SEQ ID NO: 1881 - DNA, 1800 bp, Glycine max
  Soy_ogl_3946 Gm11:37300901..37302700 Cluster 8
catcttactgttctgtttaggaattttcaaagtaacgccgacaatttaagattgggctaaaaatcaaacatggtgtcacaactatattactagtatcattaattatgtgtattcatgttgatatgcattgttatgttatcttatgaactaattaagtttccaaattcatgttcgagagtacaattaacaagcataggcaagagaaaatttgacatgtatgataacgagcaatattatatttagagttcaatatttagttgatgactgatcagaaaatcttctgtgtcagcctcttataatttatatataatacaagaaacaattcagatttagaggcacgtgatcgaggagcatacaaaactgaagtctaactctgcttacgtacgtcacctaataatttatcaaattataatatgtttagtgtttcattgtaatctccaaatcattatttaaacaaacatttcgattcgtacaaaaaacaaattaatctgacaaccatcataatttggaatttttcaaatgtaaagccaaacacatacttggggatagatgtctgtaaaagcttttaagaaaatttatttggacttatttcattttaaaaaccctgaaatttattctgataaatttataaaagatattgaaataaagtaaataaattatatgagtcgatatcaaaagtcattttttttaccttaatctatcaaaacaatcttaataaaagcacctatatataacaaaagctccttggttataaactcttatcgaaagaattattagttaaatcattatcttaattataaaattccaatgttaagacttttatatacaaaaaataataagttttattaagtttataagtgtttataaataaaagttatacgatttttagagagaaaaaattaatgagatttataaattgattttaaattatgccaaaatttaattaattaattttatgtcctttgatcatttaatgttcttctattatagatttatgatttatccaaactcttatttatttgggttgacaaacaaaatgaaaaggaagaaaattcaaagatagaatttagatagacaaaaagtagtgaaaaaataagtaaattaataagttgtttgctatgagacaaatatgaaaaaacttacaagaaagaaaagaaatattattttttctatttatttgatcgaatagaaatgaaaggaaatgaaacagctaacgatgtctcaaaataaatcaattttataaaaaaaaatattagtagaaaacaaaaagtggagaagggtaaatatggaaattgaaatttgaaattctgctctctaccttttcataaacattcttgctaaagatggaaagaaaaagtgagtttggcctaatttattttccttctcgtctaattttctataaactaattaaaggataagtcaacttctctctcccttcttttactacatactaattctctaatgataaaaaaaaatactaattctcctactggtccccctccccccgaaaaagaggtgtcgacacattaaaacattttgattaaagatcataatttttaattatatacactaaagcttaacacacgtaaaaacataaaacataatcaacaaaagtatacaaataataaatgtataatcataattttatccattttgtaatcattaattaaaaaattatttaaaaataatgtatattgatcatatatcatttttaaatttagctgatgtaaaatagcaaattatacatgtatcttaattttaaaagaaacagttttgcttgaaatatatatacaactatta

SEQ ID NO: 1882 - DNA, 1705 bp, Glycine max
  Soy_ogl_4467 Gm13:35936796..35938500 Cluster 8
ttgtgtgtggagatattttattaaagggaaaatgaaatggctattgcctattattgattgtaaggaagagggaatcataataagcattcctgagaacaaaagtagaaacagataatgtggttgttggctgtcaatgttccatgttgcgtggcactatggcgtgtgatcttcttttttctattagtgaggagaatatgtgataatattaaaatagaaacatgctaccaggtaataacaacagttgtaattttgttcaaagcttacttggtaataaaaaatcggcttttattaattttgttcaaattatgttgtgtataaaaactgtttaatatggaatttttaaaattataatatccatttttaaaacaaaaatgttttaaaattaaagaagctatttaaaaaaacagttttaaattatgttgcttgtaaaaattatttaattttctttttcttttttcctttaatataacgtaatagaaataccaatattgaagtgtgacgcgcatgtgtcttcaccggtacaaataattttgattaaagaaattagagaaattcaacttaatatgccgaattaaagaaattcaactatttataaataaatatgaaacttttttatataattttgattaaaacaaattagatttattccatgaaaatccacaagaacaactcaacattaatgaaaaattatattagcttgatattttttatattttaaatttactttgtctatgaattagaaataatctcaaatattggaatttaaagtaattataaaaaatgattgtgtgatgaaaatataaaaactaaaaaattggttttagtactaattaaattacatatggtatcaacattttattattcaaatattagaattggttaaaagaaacttaggctaattttacaatcattgaaatttgatacagtgagtgactgtctgacggtagctaggaaaccagtaaagtccacaatatgctgagctcgcttcgctactttattattattattatttttaattaactaagtttttactcttagctaaactgctaatggtgaaaatattcagaactggttttttttaattgaagggatacgaggatagcaaagaagtcaatatacactcaaatattaatattacgaagataacaaatgatgtctatctatttcatgtaaactcaagttgaaattataattataaatattaaaaatcacagactaaaattactcgtgtaataaaaatgtattacaacttaaattagtgacttgtttttttaatcttggtacaacttaaagcaaaagtaagaaatccattatctttttattaaataagcttttcttgtttgttttgactcgtcttactaaaaaaaaaaaaagttgccatattttggcaagatgctcgtgttggttgatagttctacctaacctttaaaagagagagagagagaaaatgacgattgaaaacaaaagacaaatgactgtgacaaatacatactattactagcaaacaaatcagcagaacaaccaccctcctaattaaccctctttatttatacaaatttctgacaactatttttttaaaataaattatttgatataaaattttattttgatatgatgtcagtatagtttttttatacagtgaattaatgaaaaattattttatatatattaaagtcattattaaaaaatatttaattacacaata

SEQ ID NO: 1883 - DNA, 1100 bp, Glycine max
  Soy_ogl_4494 Gm13:36885801..36886900 Cluster 8
tctttaatattttatttgaattagaagtgaatagaaacaaaataaataggaatgaaaaaatagaagagaaattaataaaatataaaagctatgttgtttggatgaatataaataagaagaaaaaaaattggagagtttctcttcatttgtttagaaaaatgaaaagagagtataaataaattaatgaattatgtaaaataaggatgatataatatatttttatatattaaaaacacttttacgtccttaatgagaatagttcaatttataaaaaataaattaaatttgtgaaagaaaatttaaatttgattctcatgaaatacatttatgagaaaaaataaataatttaaagtgtaattaatttaattttggatggaagattatttcatatttgatcccaaaaagatcaaaatttatgtgaagactttagaattacataaaagaagcaaatactaattatggtgcttaaaaataaaacacttgaatgtttctaattttcagataaagtgaaatctacagctacttataaatcaataatgtggtgttgaagcaaacataaaagtatatataagcagtggttggggcaagggcagcatggatatgattgaattctgtacaatcacaagctggcacaaacacagaccgaacgcgtggacctctcaaaacttgtttcaatatttaagggatggatattcagagacatcaaatctttggtgttcttattgaggcgcacatgcattggctgctgcataccacatgacctgtcattcattatccgtacgtttcacatgcaacaaattttgtaattactgccacattttctacttatatattgctactttcctactttattaataatgttgttgctgtgccctgcctaggtctttcatccaaacacgtctctcaggcccttaaatgctacttttgctacaatgctccttaccaaaatgttactccattgctggatccataatatttctttttggaaactattttttcaaacaaaaaattgtataaattttattaaaaattgtcaaatttaaatagataaaattagtatcaacttattctctatttttatatttatcttatttaaaaaa

SEQ ID NO: 1884 - DNA, 1067 bp, Glycine max
  Soy_ogl_4994 Gm15:11331901..11332967 Cluster 8
taacgacaattgctttgtggcacaccgttgtatgccacaagctaagcacacataatctaatgctttgtggaggtggtatattcctaattagttatcattatgttccaaagagttagtgctgcgagtttggctcggctctttagtcttcttcaaaatttcaaaatcaagttctaattgcggagtaattaatagttcatggctgtcacgaatgacaatttgcaagttttaacaacatatttatcacttttcatttaattaatgaaaactataaagagagatactcaaatatctaggcatcccttatttaatccattggcccctttaaaggtcaagtgatattattcattgaaaaatactaatagttgttttaaagtactggttaagaaattaaaaaatattgaaatatgtaaaattatatcatccataattttttttaatgttttgttttaatcttcataataaatatatatttttttaaatcttttaatcaatattttaaggatactgctttacaagttggtgttcattttatacttgttatgtttgatagtcaaattaaaataaaaatagatagtatgatgaaaaaagataagagtagaaaaacatctaacgataataagctcttgtgtttttttattctattttttggaaaaatagaatataaaggtacttttataattaaggaaaaaataggattaaaatattttcgtataacttgtaagttatttataaaagttaacctgaataaattattttaattttagccttatatataagttacttttataattaaggacaaaataggatgaaaatattttcatataattaaattgtaagttattttcataagttaacctgaataacctattaaaataagttgaaaataacttattataatatcataaattattttcataaaatttcctaaacacttaattaacacaaatgtgtttatcataatatagatttaaataagctttgaatatactctttccaatagactttttttctcgggaaaacaaatattttctcttaactcatataagcaaaattaagtaattttacac

SEQ ID NO: 1885 - DNA, 1137 bp, Glycine max
  Soy_ogl_6739 Gm20:34249824..34250960 Cluster 8
taaaactaacgtgtaaactaatttgactagctatctgaggtaatctaagagatctcgagccatatttagattgaatggatctttgaatgatagttaaactcaataaaatataaaaaaagggagttgtacttacacaaactctaatcaatgataaagttaagaaagattttaacataataataatataggtggaaagaagatacttgcaaggaaaattaaccctatatttatagataattaagtgtggtaacaaataccaaaattagtaccaattaacaactatttcttgatatttcaaaaaaacaagaactatttattgatttcaaatatggaaagtcgtaggatatttactactaattccaaaatcaatgacataaatatatggtttctgtttagatccttaagatatatggtgtgacaaagtataatgagaggtaaaaaatatagtgtttggaaacttataagaaaatttattatatttgttgttaaaatcatccttttaagctatatatattaaaattataatgtgaactaatctgactagttatctgaggtgatttaagagatttcggatcatatttaaattgaatgatagttaaattcaatgaaatataagaaaaaagataattgtacttacacaagctctaattaatgatagagtcaggaaagattttaacataataataatatatgtggaaagaagatacttgcaagaaaaattaaccctatatttatagacaattaagtatggtatcaaatacccaagttagtaacaattaccaactatttctcattaagaaaaactatttgttaatttgaaatatggaaagtcatggatacttactactacttccaaaatcaacgagatagatatatggatttctgtttagatcttaatatttggtgtgacaaaagtataatgagaggtgacaaatatagtgtttggcaacttatgagaaaacattatctcttaaatatatttagattatttttgcaaagtttttatgtcttaatttttaggagggatggtcccctttagatcgaaacaaggcagagctgcgcatgttaataataattatttcaaagttataatatttggtgtaattttaattaattataagtgtaaatatatttaca

SEQ ID NO: 1886 - DNA, 1697 bp, Glycine max
  Soy_ogl_5028 Gm15:12928604..12930300 Cluster 8
caaacatacctgtgtttattatagaaaatggaagaaaaaaataatgataaaaaatatttcttttttcttttgtttaattacttaatatgaagagagaaaactaataagtgaaaccctaggggatttctaacactagaatatattttgggttcttaatacgcattttatggattcattagtgcaacatataatttaagaactttcaatatcttatatttcaattctaaaatttacactaatatgagttcttaaattattttttattgaaatttctttctttctctctcctttgttaattgcttttatgataaacacaagttcttcaaggtttttgtggaagctatggtttttcaggtgaatgctaactcatttctctccaatgcatgattgaaataagaacagaatttgtactttaagaacctcaacaagaatgagtgttggagatgcccttagttgtctttctaaaatgaaaagaaaaagaagtataaatgttgctttatatattatatggttaatatatatgttattttatatacttgattagttttttttttttaaaaaaaaaaaactaccatacaacctataaaatcatcaatttttcattcatttattttctttcattgtcttttctaaaccaaagataccattaagttatttgactaatttaaaaatatatttcatcaaattagacttatttgataaagaaattatttaataatttgataatatgtaacgtttcaatataagttctgaaatagtattttaggtgacatttgaatttagaaatctctaattattatttttatttttatccttattacctcatcacaatttttttcttttacgtctgtttatatcgtttttcacaattccacggttcgttttattaataattttaagtccatcatataatttatcaactttcaattttcaattaacttgttcactaattttatcaaccacatcctttataaaaaaaaaagtttaaatgaagaattatgtttttctcttacgtacgtgtaacattttttctcatgtcggagagaaaatagaaaaggaaaaatctcacaatcttgagcaataacgtttttatcaccaaaaaggaaatgctgtttgcaattacgcaagaactttttctaagtagtgttaagctctaggccacaagatttggaaaatgattgatataaggcaaaaatcacttgtccaaaattgattgtccactggaacttacccttttctattttaaattctccctcgtcaaattttgctctttttccttataaaaaaatatttccggaaaaaatagataatgcatctaatagattgaattaattaaataattgtcaattgagctgctaaagtaacagtagaaggctagtagccataaatatcacacgaataacataaataaaataaagttataatcactgtgatctttaggttggatatatttgtctaatatgattatatgacaaggtccattgaaatgtttaaaagtaaactcattataatatttcttttgcgtgcgaaaactcatataatatataaattgggacctagaagtagggaaatgtgcagtaaaaaaagtagagggaaatattagttcaaataatttatcaactttcagttaatttttattttttaatcaagttattcacaaaatttatcaacaacattttctgtcaaaaaatttaaat

SEQ ID NO: 1887 - DNA, 1049 bp, Glycine max
  Soy_ogl_714 Gm02:47325001..47326049 Cluster 8
tgttgtaaaaaaccatttttttctacaattccattatttcaactgtggcctgcaataagaaattaagaatcatttttatggactgacctttttcttcatgcaaatgtcgtctacgggtgcataagcatcgcgtctctcttttgaattcaccaacaaaccttttcatctatccgattaggcaacacaagcgttgagttttgaactttgaacaataaaagccgtttcttttctattttcttttttgtttttagtgttataaaattaactgaaattttacccatgctttggttgcaaagaaaagaaaaaaaaatcaaagaatttttttttttatttagtgtgaatctcacacccctctctctagtttaatttcactatttttctcataattctatttttattcattttccttccactcaaccaaaccatgccttgtcgtctgtcttgacagatataaagtatttattgcaacaaatagattttgttgtttaattaaaaatagtactatatcattgaagcaatcgttaaaaaaagtgtgcaagttgtatgatgtaaattgtaaaaagtattcaaatgcgccaatatcgccacttgcaaattcaacattttagagttgtctcttatcactagccattggcaacttcaatagggaagttgttaaggggtttgactattatcgttgattattgaaaaacatatatgtatttgaataagttattatttattaaatttcttaaaatattatcatcattttaatatttttattctatttatttatctgatggagatgtcaaaaaaataaagtaattataaatcaatactattttgtctaaagatatttaaaaaaaaaaggtttgaataataagtcatcaagtacacagtattgttcaatttctatccgagtatatatatcccactgtttcaatatgtgagcatgccatttaagctagtttttattttttagttaaaaatctcattaaataatttttagttttttttttaaatgctacttaaagtagtatttttaaaaatattagtttctaacttttaga

SEQ ID NO: 1888 - DNA, 1049 bp, Glycine max
  Soy_ogl_960 Gm03:39101401..39102449 Cluster 8
tgcagttaaaaactttggggtaattaaacagcgaaaagtttatatatgactgaaaaaaaaagtcatttacagaaaaaaataattaaatttaatagtcatatatacatcgatatccattcattaatcacaaatcatgattaataattttaaaatacttatatgttacattctaattaaatgataatgtaaaagtattaatgtataactatatataacctattttctcaaataatttatattaactaataatttaagttattttgaaaagtaagaataattaataaatattttttaatcttaattaaataattgatattaaaaaataaacttaatttttgtgaacaagagtataatactaatttttaatgttaattaactatatatttatatatatggtcaataaatagtagttttcgtgttcatatttatacatatcgaagttgttcagcgcattcttaactaatatcttattataccatttcgtggtgcaaacaattaagttcatctttcatcccgaattcatttatatatacttatgtttctatacaataatttggtggcataccgttttcaagaaactaagagtatcgaatggaggagtgcatggcactgtttctagagcagctggaagagagttagaatgtggcatttgaattttcttttttgactgtgtttactagtgttttgttctttattctcttgtatatatgcaccaactttattatttttgtgacagtgatgatactgaccagaaaaaggtctccggtgtgctgtcacgagtgtgtgtaacatcattggacagaaaaagcttttaaattctaaatagacatgaaagtgagcgtgtgtctggctgccaatggaagtcatgatcacattctttcatatgaacaaaaggcacatcgatccttttatatattccctgtgaaaaaagaggtttgtgaaatgaaaaagtatattcatcagtctcatccattccagattccagaaatccttagtttaagagataaattttgtattccttttgagagaaagatcgagaatcgtgctat

SEQ ID NO: 1889 - DNA, 1100 bp, Glycine max
  Soy_ogl_1848 Gm06:8123801..8124900 Cluster 8
taggagacgtttattttaagttataatattatattatagggaattatatttctgcgaatgttatgcttgaaaatagcattttaataaacatatttagttatcattaggaattatagaaaataaaataaaatattttaattaaatagattttaaaaataaaattgaaataagaaatgtgaaaaaaaaaatggaaatagataataattgtagaaaataattatcattcccatggaaatcaaagatatttatctcttggcatcagaataaaaagaaacaaaaacgtgtatattttatatttatttaaatcaatcgaaaatatttttacaaaacttaaaacaaacttgaaaatatgatatttttaagcctacattcttgggaattttgctttataacttaaaataaattcctcctaaggttcttttaaaaaatatatatgcctttggaaaggttagattccgctatcgccattcatattgaattattatattaatcaattaaggctttttgagtgatataatttcctacttcagatggatgatatcaatattaatagcaggatatcctatcctttaataattgcatttcgttggagattaaatgtcctcttaatgatacaacaagtccttgcatgaatgcatgataccaaaaagataaagattaaacaacaaccaccttcctaacggaaaaaggaatttaatgaagagaacaaaattccacagcagcgtgttgagcaagttcaacacacacacatacatctaaagagttatgtttcacacatttgaaatattttcaacggtatggaaaattccacacacatacatataagtgatataactaatgttgtttcgctcatttgaaatcttgaacggaatgtcaaattattatgtttattggcgttcatttcagttaatatttataatcgtgtttttatttttattttttgtattgagcagaggtgttcgcattatgggtattagaccattttggatgattttaaaaaacatttcattgaattgggttgttgtttaaattatttttatctgtcatagttaatttttatattagaactgagtgacatcacccgtactttcctgtttatc

SEQ ID NO: 1890 - DNA, 1000 bp, Glycine max
  Soy_ogl_2271 Gm07:8042801..8043800 Cluster 8
gtgattattttattgaaacttaaagtttttttttttgaaaaaacgtggagaattttgataaacttatctagcagtttcattaagcgcttaataaagataagcatcaatggctgttgatggttaacattctttcgaaagtgataaacataaggagtttcgagagtattttagaaagcaaatagtagtaacttttaaaaggtgtggacactggttttgaaatgattatacgtgacgacattgacctaataataacataatcaaaataaactttgataccatttaatttaaaattctgacttagagcttaacgaggtgagtctcttacgaatatgagatgttggcaattaacatgcaatgtaagatttttttttatccgaaaaaaggaattaatatatatatataactgggtacaaggaaaaccccatagtttagaaaagcctttaaatagactattatgagttagattacgtactaaaataaaatttgaacagctagatctattatgagtatgaatactatatgtttatgctagcgtatgtaactctgctcccattttcttatcaagtttatagttttctgtctttgtttagtctggacgcacgttaacttgtgttgctttagaatatgaatgtgaatcacgtactgtgtcggcggctttaactgcttctttgtttgcagccatatagagcctcacaattaggtgaaagctacatcatgatttgcgttctagtttaatttaataaaaaggtcacttctaattgctctccatttcataatttaatgttactttgacctttaaagcttccagaaagttataaatattgttgatatatatttgtggaacattaaagaaagtctctcaccatcttcgtgtataaacgaaaagaggatgcaatataagctactaactctttcgcttgaaataatttgtctttgaattgaaattttgatttgattaaacagcattattactcgtacaagatcctcttaattttattaa

SEQ ID NO: 1891 - DNA, 1500 bp, Glycine max
  Soy_ogl_5297 Gm16:4703201..4704700 Cluster 8
tttttattgtctaaaatctcttaatatatataaatgattatttaagcttttaacatacaacatacagttatagattaaccaacccagaaaaggagaaaaaaaatgtccggactttagcacaaaaccatataaatataaggaagatcgaagtataatgagttccataatgcctttaaaaaaaaaataataataacgagttccgtaacagaataaaaaattcaacttgccgttgcaaaaaatattgttcctaaatagtccacaatgtccatatgagacaagaaaccaaatagaacaacgagcttgcttacgtagaatatagtatacttgtctgcatgaaaataattttagaacctcccaataaccataaatgaagaacccgcctccttcatttctaatttctcacatcaatgttgtgaggaaataaaagataggagttttcttttttgaaggataataaatgataggagtatttgatctccattatataacataacacacacacatataatatagtcattccacatgcaaatgcaatatttagtaaaatatgttactataaaagaaaaagtactccccaagaaaaaattgtatataaatgattagtgattaattaaattacctgtaaaacttttcatgcttttttatattatttttaataataaatcaattcgcatatataagtcttagtgtcatgaatgattattctgtttttttaaagaaaaaagaattgttggtgaggtaggaatatagttcatgaaacaaatgaccaacactgatgatcatcaactatacattgttcggatttgaataagtggtgtactttccatgagccaacgtggttgttgacgagaaatatttgaaacttgaagatcaaaattaagcggaggacccagcagccacaatttaatgaaatcacaggcttgttacatgtccttatagtttcttttgattagtttacattttgaatgatctccaacatgcatgcatatattcaattattaataattgaaaaagttgatttaatggtataagattttattgtatttatataaatttaatttttttttgtaaattttttttagtccaacgataaatatgtaatgcaaacgaaatttaatagatgggaagacactcatcctctcttagaaaaaaaaaatatttaattattaattcatccggaaagataaaagatagtgtaagattcactcttgggccttggggaccagaaagcgaaaaggtagaaatgtattcaccacatgaaagtttttagatacgcaaattttctctttctcactctctcgctccattatttttattgttttcaaaatatttgatcaactttctatcattgaggcaccaaaaccataaattgcttacatgtggtgatatatcattaattcccagatacttaaactctattctttatctttttttcattaaaataaaacttaattagggaaattaagtctagctttatcctgctgtttctatcttaaaaaa

SEQ ID NO: 1892 - DNA, 1065 bp, Glycine max
  Soy_ogl_4147 Gm12:38258501..38259565 Cluster 8
ctctaattctcacaagagagagaatgttttttatcatattaagttatcgtattattttttattaagtacaaaacttgtaaaataataaaagatatttgattaaaaacaattaatgtaaaaagtaatctaaagagagtcttataagaaggaagtgaatttttttttttacatatagacaggatgtattacaataacaaagaatatatttaaaattaaaaaaaaattaaaattttgttttcgtgtcatttatccagtgtaattctggttttgctgtaatctaacaagtaatccactgatgaacctggcttttgggtgacgacagtatgataggatatgttcatgaacactttcttttgtgcaaataaataaagcaaaaggaaccttgtatagtgcattccatgtaagagaccaaactatgaattgacaaaaaaggttttattaaaaaagtataaattaaaatgtttgtatttataattttaaaatcaacttagctgatataatttgcttctaagatattggtgtatgaattgaaattgggatatgaaccgaacctcaaatccgaaagtcataagcaacgttttgatggatccaataatttaataacagttcaatagcaaattcgaatctgtaatgcatttaatgttccgtttgatttttaaagcaaattacaagttcaaacttcaactagttttcaatactgacaaagcctgatctgacagtcaataatagttgggtccttaaggagtgaactctacgtatagaaatatttttagtgcaaaaaattaaaatactttcagaaattgaagttaaatccataatccttatacattagtgttacaaaaattgtttataggaatttcatatgagtttaataagaaaatttaaaaaataatgcaatttaaaagtcatataataacgtcataaagtaaatagaaaatactcttgcttgcattattattatatgtttgtgcaaacctaccaaaaagattatatgtttatgtgacattttaaaaattaagctctacaatgtaaacactctttatttcaaaaaaaaaatatcttctc

SEQ ID NO: 1893 - DNA, 1000 bp, Glycine max
  Soy_ogl_5308 Gm16:5075601..5076600 Cluster 8
atatgaaaaaaaaggtgactggccttgggaatggacatatataagcttacaaatttagctatatgtatgtgttttgtgtctgtgatactaagtaagattgtgatcgatcaaagaatatctaaagttgacaaaagttcatttatgtcatgagttattctcagctaaagttgattgaatttaacgcagaagccgcccaaataaattaaaaatacagattatctaggtatatataattgtaatagtaaaattttaacaaacactggaattttaggatcctggttgatatgacacttagattaggcagcatgtaataagtgggaccctctcttccattgcatctgatcttcttctcaacttttgggttatccatttgtcaaaacattaattatatcgtaattatgaaatcaaattaaagtagattgtgccgataagaaattcagaagactttttcagagaaaacgcatataatgaatttaaaagattgacaaaaatcattaaatgcgttgataaatttctttaatgcattttggccttttttttaaaaaataaatatcagcattgtagcttgatttacgtaatatttttttttttgtagtgatttacataatatattgaacaaatataagatttgatactactgtattaaaataatttggatatcggattgggagttggaatagtgtatataagatcacatattcaaacttcagtttgattatcatatataaaaaataaataacttcaatatcaatagtatattaaaaattaaagtcatataataaatttatgcattttgatcaattcttacattactttaacttcccttcatccatataactataggaaattaaaaaaacattatgttatcaggaaagtatataatattatgatgtttaaaaatcgagataaatttatacgttatcctttaaaatacaccatgctactctaacttaattatgttagatcatgcgaaaagtaatttatattactcgcacgtatt

SEQ ID NO: 1894 - DNA, 1115 bp, Glycine max
  Soy_ogl_4474 Gm13:36121601..36122715 Cluster 8
taaactatcaacgtaacaaatcaaagttccatcaattacatccaaaactatgagatgctatgtttatcatagaattcacttacaagttgaggcttagcagccttggaaaatcctcaaagggttaagagaagatagtagtgttgtaaacccgtcacactattctacaataaaaagcaacataaagtttagttacaaataatttaattttcttctccaataactaactaaactcaaattgaatattgaatcttaaaaataattaattcgatatgtgaatttcaaaatataattgtccgtatatgctgttcttctttcaagttacaaagtcaatttcatgttaatgttggttaatgaacatttaactgattttcaaaaaaggtagcatcatatagaaggactgcagagctatcataggtataagaaaagatggctgggattttcctgatgtgttttaaaattattgctaaattctcatcagccacacattttaatattatattaaaaacattttatccttcaattggacaaccaatttttgtgacgtggtgacaaccgatttccgtcccaaaaaataaaaaataaagatggtgacagggtgtctaaaaagtaaaaatgttaccaaaccctctttcctctttcctctctcctcttttattttttaaagaatcttgggaatcaatcatgattattagtcctttcaaattaactgacatgattttttatttaaacaatgtaactttaaaaactaagaaaaataaattgaatggataaaaataaagaagaaaaaaacagggcctataaaaataggtcaaaatagaataattttaggattgtttgatttgaaagaaacaaaaaaaaagggtgaaatagaaaaaaaaaactatgaacggtcaaatttttttccttctaaaatatttttttttgtgatattcatatatgaaatttttaaaataacagaaaatgtaaaaactttaagaaaatgtcctcagctaaacaatttttatttgtttctattttcaatctttcggacacactccatttattatctcttatatttttttctctctatcaaatatactttattcccccctaaaaaacacccttatcttctgttt

SEQ ID NO: 1895 - DNA, 1000 bp, Glycine max
  Soy_ogl_4687 Gm14:5551501..5552500 Cluster 8
cagtcatttaatttaacaaacattttatgatatataaaatagactaattcaattcaaattaagattgtttgatattttggaccattgtaaatcaattatggatttttatttagttttttcaaattacattacttgtagtcttatgcctattattttagttgaacatatatatacgcattccaaatagttgccattttctgacccattgaaagtttaagtgataattactctttgctttttttaagttttatttgttcatttaaaaatttatttctatctattagtttatttaaaaatttaagatgatataaattattaattattatttttaattatatccttatttctacatagttttaaatactttactaacttattataaatgagaaaaatagtagttgattttgtgtactaactatcttatgaaataataaaaatagaagtaaaacttagcatggtacccttgttaaaagagcgagaagtttaatttgttttttttattatcatccaaataagtatagcagggatgagggaaactagtaatcagcccttaaggcattcgagacaaaatcagaactacataaaacaatacaacttgagtattacagacccaaacctaaatatgcagttaaatttactaattagatttcagacttgaaatgcatctacaaaaggaggtgaaaattattcatatacaaaaggaggtggcaatgttcacagcgcacacacagtaaccaacatgacactaatacccccactctttttgttcatttcacctgtaccttctaaatacaccaaatggactttcaattcaccaatttcgtaccattattttacccttgaaaattcaaatcctttagatggtttagatcacccttattttttattacattgatgaacggcctaagtaaaaccattcttcaaggttgttgggtagatatgcaaattaaggttctcctttcagtcccaaccccactgccaacgatagaatgttcttggt

SEQ ID NO: 1896 - DNA, 2008 bp, Glycine max
  Soy_ogl_5279 Gm16:3781631..3783638 Cluster 8
ggaaaaaattcattcattttaatatttttccactatcatttgcaccaaaaaggaatgatgctttgcaagctaagggactaaagtaatgagtttaggaaataccattgcatcttttggcgcataggcttggtaatcttggttttggatgagggttactttgtctaaacaaggtgaacaattgtcataagaattaactattttcttcaatataacaatagcacttacatggcatataaaactatattcaatacaacacttctaagggaaagcatgcagaatttcatcacaacttagcctatagtaattgctataaattgtttgaatgaccacatattgaaattttgtatgaaaaaaataaaaaggaatgatctagcacctagaaggcaacagcagataaaccaagaaatcaaagtaaacacatgttacaaacttacttctacaaatagaagagcattgagtccttcctctaatgaccccaacaaataagcatccttttgaagaaaagagagtaaaagaaatggaatcagtttataacaggtaggtcacattggaagaactattagcaataacaaacttaatgaaaattaagtaactaagttatccaggcctaccaatgtgcagggaactccacaaaaagaaatctcatgctcacatcactagttgaacgctcatagaaagcaagtatccaaattttggtgtgaaagatatgtctcatatcaccctagatccatatataacttttgaagtctcacatgttgttttgaacaacgtcctcgattgcaccacatcaagatgcccaaatgatacaaaaactacttattttgcttctaataggcgtgaggagagggtgacagagtttacgttgcagatgatatatattcctaacatacacttagttaagtagcatatgtgataaggataaaatattgaattacgtcaagtattgaattatgtaactctacaagcaaaactaaaatatagtatccaaaattataaaaaaaaaaaaccaaattttgtgtaatgctaaaagaaacttctctaaatttacgaaccaaccaaaaaacataaaataatttgatgtttctttaatcttcagaaaatgaatcttaaatttcttttggaaggtagagtcaacatttgtactttttttttaagtttgagtcaacatatataactaaattgaaataaaaaaaataaaagtaaaacaaatgcagaacatggtatgtttaagtatttcgggaaagatgggagattttaattcccaaaacgcagtgatgatttaaacattttaaggccaacatagattcttgttgttgcagattgtttggcattattcagcgggttttcatttgctattgctgcggccacaaagctattttatctttgacttaattatatattttatcatcaaattattattattttgtaaattttaagtattttttataaattatatcattcagatttgtaattcttatgcattttatcaaataagtttgttttttccaaattttatcataagatttttttttacattttatcatcatattgatattgaaataatatcatttcacaaaaaaaattataactttttttaattcatcatcatccgtaaaatgtaacaaaaattgaaaatttagataataaaattttaaaaataaacttagatgataaaatatataaaataatgaaaatttgataataaaatgtgcaattaaaccttttttatcttaaatataaatatattagtttattaattttttaacaattatctttaaagtaatttatgattagataaaagtacaaaaatattttatattgtcagtacatagtcattaaattctaaaattaattatgcctaactttaaaataaatcactattttcttatttatataaatataattttttttttcattttgatctttataaattttaaatgcttttatatataaaaatctctatcactattttctaatgacgagtataggataaatgtttgaataaagt

SEQ ID NO: 1897 - DNA, 1700 bp, Glycine max
  Soy_ogl_5532 Gm17:5545301..5547000 Cluster 8
gtcctttgaaagaaagatgaaaaaaggtttattagaaggattcattattcgtatccatgctgaccaagacctcaggctcagggtaacacatacgaacccttttttctttacctaaattgtcccttgcgaggctaatatgctatctaaaagcatagaaatgagaaagagattagttgtgaagtattattattgtcaacatgaagctttttcacgagatatttatgagtagtgatttgtgtagtttcttagcttatgaaacattcaagtgtgtgctctctcacacacgcttcgtgtctgttggaggtccccagcataaatgagttttgtcaaaagttacgttgaaatgtgtgttgagatcattgaatcatcgaccattggaggagtcaatcagtttaaattttcccgttaaagcagctattctttactgagatttgccaagcattatgacctagcttttcctagattctacgtaattaactaataacgaaaaagattatggcgtaaattctacatttatatagatcttcttaattattattttctactagggttattttgaaaattaagttaaaagacaatagtactaaattataaatcctaaattttatagtatttcagattatataaatacgataaataattagtaagacttatatttttttttctatataatagttttgaagttcaaatttaagatcttattcaaattatctaaatctcttgtgtctagccttagtaggttcaagacttataacctagttcacattaaatttaatttacttaatttggatagttttattaaataaacttaggagttgttttaaaaaaaatattcaactaaaaacactaacttttaggttaaaaggaagattttataagcctggtaaggtgattcgtttgatttaatatacacatgacatgtcattattattattaaatttgtatcgaatttctataagtagtttgtttattggcttatttttaaaagatctattaatttatataaaggcttaatctcatttttttttaatttaaaacaagtttattgattattttaaggtcttgttttgttattaggtctttagatgtatttttaaatttaaaaattatcatgcaaatctatcaagaatacaatttggatgtactatactataaaatttttaatatattatccaatattaaattatactatgcatagcaagattgttaatttaggtaatactgaattgctttaaaaatcatatatgaagtattttttttaattgattattaatgtaaaaatccttacgttgatcatgtttgaaaattaaacttatatatcaaatttaaaccttatatttagaagggaaaaaaataacataatctgtctttttttaaaaggaccaaagttatggtatttcattccaaaaacatactctttgttaaaagcttaaatatacgtattaaaaaacacattttttttatggttttcactttgtatttgatgagtttctatctttttttgtgtggaagggattgatgaattgctatcttcattttgtagtttttaataaaatttaattaatatataataaaatgcgtgttcaaaaaatgtgctgttaactctcctctttcccttattgaactcatctttaccctataattaaggacccctgttgaatttaaattgcaacttggaaaaaggtgtcgacaaaatgaac

SEQ ID NO: 1898 - DNA, 1400 bp, Glycine max
  Soy_ogl_6439 Gm19:38812201..38813600 Cluster 8
cttttataggtttaattacttatttaactagttcacaaatttatatttgttattatacttacaaagcattcatttcagtctacatatttttcaatttcttttaatctctataaataccattttaatcctttttgatttctatattctaaaaaattaatattatgaaaggggtaaaaaattaggaacaggaggacgtaaatatacaaaattaaaagagacaaaatctacccaatatatcaacatatttatatgtaatttttttttaaaagatgcacccctggttataaatgtggatcagctcacaaagtctgaaaggattaaaaaaatagtatgtataagatgtaaaatgaatgatttttaagtatatgaacttaaaggtataatttatataattataaagactaaattaataattaatttttttatatcctgttatgatttgtctctaatgtaatgtttagtttaattatatttgggtgaatttgtgatgaaagttttgaaaattgatatagattctatatctctatactctattttagtttaaatattttacctctttttaaaccaaacgaactctaagagacacaaaaatttcttattaattgtgtccttttaaaagataataaaaacaattgtcatattttacttttttttcatccgccatcatattttacttgtaagaatactaatagggtgggaaaaaggcacaaattcattagttttcttctctcatgagcaattttggtatataaatttctttttggtggaatgttttggtatatagatctcattctcagatgttagctaagttagataattcaatgtgaatacagacactctatattgtaattcccattatttataataagaaaattttccatttaatatgttacatatagagaggcccaatcaagtgagaaatcttctaattataagaaataaaaattataaatctaagtcataaaatatgctcagattaatttggactgatatttttatttttatggagagagattaaagagagtacttttcaaaattgaggaattaaaaaaacatttaaatttggaggaattagttaaaacaaatatgatccaaatttgagagataaaaaaacatatttaagtttatgttcaaaaacaatctcttttaataataattttttaaaagtaccctttaaatcaatgagtcaaatatatttgaaattagtatccgtagattctccatgacaagttattagttggattaataaacttaattccaatcattaaaacatatgctcttgacttttgtttggcattcaaaagtgtgtttttgaattaatatatgttagcgtgattggtatgccacgtacgacaattgcatccttatcttttctcatatgcacaataataattcaataa

SEQ ID NO: 1899 - DNA, 1008 bp, Glycine max
  Soy_ogl_3332 Gm10:2949593..29200 Cluster 8
cccttaaaaattacagccaaacgtaaaattgtcaattttcaatttttgttgtcgtttcaatccaatatagtgaagatatcatattttttaataatccgatttctattattttagttgtatatttttgtttatctattaacttgattccaatatttaataataatgctaatttttttttaacatctgtgttagcactctgctagatttttttttaaatcagtaaaatatgtattaatatataaataatggtaccagtggtagcgatatgattacaaaatataatgcagaggcattcaatcagttccgatgatcaacatttctgttaaactgtatctcaatttaatatatgaattaaatttgcacaattaaagtatataattagagatcaaatttgaaaaaaaaactaaattcaataaatgacgataataagaacactaaaagtatataattaaccattattcttttaccaaaaaatggccagccaacatatttacactacttttgcatgtttcttaagccaaggctataaataaaattgaaaacgaattaaattactttgtacaatagctagcatatttaaatgggccaaagtgctaaatttttgggtttgtgtctgttaccccatttcaagttttttttatgaagttattctaatagttttcttaaattttggtagcctacattacttgggcaaaagtcataagggggctattgttacgcacactcattaattatgcgtgatttccattttttacttttataaaactgatattaggtaatttgtaagtttcatatatagaaagataaaattatttgttattttttgaactaaaaaacaaatatatgcagtaattactggtttgtaggcatatgcatttaatttttctctccctgaactttacattaaaacaatcctatcatatcattaaacgcgtgacttaatggacatgagattcttcttatttattcaaaggttttgagtttgaattttgaatatatgtgtatttg

SEQ ID NO: 1900 - DNA, 1900 bp, Glycine max
  Soy_ogl_2689 Gm08:14665901..14667800 Cluster 8
atcgattttatatttctatttcattttgttattgaaataacattcttttgttgtagtttctattattttcaaattcctcattatcttagtctgaaaccacaatttaatactggtatttaccatttgaatttttacatatacatatagttggtcatacttatagaacaggacatgcgattaatctccattattagcctggatcaaaaagaaatatccgttactagacgtggacttatgcctgaagtcctaaactcaaccatacttgttggattcttttttcaacgtcagttactaaaattaaagccgtaggtttgagttcattcaatttaggttatagtatttgtattaaaaattggaaagtattttttatgaattttaatatacaataagaatttcaattatgtaaacgaagaagaaaatattgttacgttctagaataaaaaacatttttaaactcctctaactttattcaaacatatacttaattaattgtaaagaccgattaatctgctatttatgccgcgtttattatcaattatggatattaggaaatagaaacaaaatttaagactctttttttgataattaatatatcattccactacgacagtttaattaagatcgagttgaaacaagttttattaatataaacgtgtacgtgtatagcctatacaggttgtagccgaatgatgaagaaaaaaagcgattgttcagcagttttataagtagtagctacctttaaagttagcactacttttcaaaaaaatgaggaaaaaaagaaaaaacactaaaaatgactttattgtgggctcccatgttatttaattattttttgaaaggcattacttatccttcgggcatgctccatctccaaagaagaattaacatgtttacaaggcaattatagaaaactttatagtattagcttttcaatattttttcattaattttaccctattccttgataaaaacaagaaatcacttatcagttcacttatatataacctctttttttttggagtacataacaattgagaagtaaagagcttatgaaactaatcaaccatacataaatgaaaaaaaaaacagtgaaaagtttcactggttattgaaataacactattaattttctctaaagatcaattggtttacctaaagttaaagtaaataatatgatatttaaataacttccgtaatattaaaaatggaaatattaaaggggttaacttaacttcacttccgtgttgggacagaatatgtaatattaagaaaaactttttactaataagaaaaactttttactaaaatgttgaggataaattaaaaatagaaacataataaatcataagctggttaggtattatttctagtagtattcggaaagacattataatataagttttttttggtgaatacattataatataagttgttacttaaaatcacacacaaagtattgaaatgagaacaaacaaaaaacactacactatggaataaaaaagtatagaatttagatgatgtgacatcacttgtcaatgcacacagtaacacttgaacaaaaaatattcttcattttttcaaaataaattaaaagttttttatagacaaaattaaaaaatcttcctcaaattcattgatatatcaccttattacaaacccatgcctaaattactcaagactcaagaattaccacaaatgataacatttttctttcataagacatgctcttagcctcttacatctcttctacctggacacatcattgtcttcatcatggtgtctcttggttttataatggcatatatctattttatagtggtggtgactggtgaatgacttttaacaaacttagcttttttggataagcaggagtttagacccaattctttaccttgactta

SEQ ID NO: 1901 - DNA, 1378 bp, Glycine max
  Soy_ogl_2931 Gm09:1549803..1551180 Cluster 8
tataattctttgtccccaccctccaaaagtttctgcattgcttgcaccaccttgccaataatatagggcctaattttgttctccatccccttgcaaaaaaattcaacaacacaatacaatgatacattattaagaatataaaactatttgaattttagtttaaaatctatgtattgaatatataaaaaatttaacctattagaatcggcctagtcacggaagttggaatgatatgcttgaatctcaatacaattattgaaaaaaaaaatagtgtaaaaagctttaccaattaaacaatcacaggttatgtgaactataacttttaagttaattattataaaaataaataaaattataatatttttaaaaaattagcgactgaagatagaaatttttatattattaatttatatgtttaaaaaaatattagtcatactctttccaatattctctttttaagattcttttttaattgttcaaagttttttgacaatcataatttttgtaggatttatttcttatttaatgattttttatcctaattcgaaacaatacctaaaaaaatgacaattttgataaaatcaatcataaatggagtcttagaaagataatctcgctagcattccttgtatattattttcttaaactgatttttattttaattaatcataacatttttatgataattatcttataactaatactaaatcaaatatgatttttgattaattgaaataaatttattcatcctaataattcacatatgttaaactcaaaattcaattacaccattagctagcatatataaaggtgagagcagcaaaattttaagtactcggaataaatcaataaaataaacaccacgtttgtaacattataaaagggatgccaaatcaaggataatcaatgctaaactatcgatagttatgaaaaagaaagtaatgattcttttattgtgtttggattaaaaaagaataatgtaacatacctacccgaataaaataaaatggggaaaaattatttcatatttacaccttacttttgtacttgggcattgatgattgaatctactagttatagtaagagatatcggtggataggcagtgatcgaatcagtaaaaatttagcaaaatgtttacaaacctgtatctacattgataaatattcttaaatctttttttaatattaaaaaaaaaagttcgattctatttttattatagatttgataaattttttaagaagatagttctgataaagtttgcattgttaataaatttctttatttttccgtaaaagaaataattttatttatttgttataataatttatcaacctaaaacattaagttgaaatagtgcgtctcattggatttagtaag

SEQ ID NO: 1902 - DNA, 1200 bp, Glycine max
  Soy_ogl_5186 Gm15:50139401..50140600 Cluster 8
ttgactagagggattggtttggctatataaacatcacttttttcctttttaaaaaaaataaattacaattcttttgactcaaatggtatgcggttgtgcaaagtctatggatacgggagattgagtttgagtgaacaattttgaatttttgacacatattagatataaatatataatagttagagtaacattgtttagtttaatgtcccacaattaaatgaatgggagaagtgatggcaaatgaaaaataactcaaaataatttagttatgatattttaagttaagtttaacttctaatattttgaagatttcaatattatattatttttttaatattatacttaaaataaaataaaaattatttaattattaccggttcaatcacaattaaattattaaaccttaaattaaagtaccttaccttttctggttcaatgactaagctagttttaaaaatattggatttttcaacgaaagagtgggtatatttttctaaggattagagggatgtttttcctattttaaaaactagaaggtgcttattaaaccagaaaaaaatattttaaaaattattttatcattaccggttcaatcacaattaaattattaaaccttaaattaaactaccttttctggttcaatgactaagctagttttaaaaatattggatttttcaacgaaagagtgggtatatttttctaacgattagagggatgtttttcctattttaagaattagaaggtgcttattaaaaatttgactgtgaagaaaatcaaccgtcttagaaataagaataaatcacaattgtcaatttataattctacgaaagtaaagtaatagtaagacattgttggatgttctataagaacatctacagttgagtacttacatgaagtatttaattttatgtaatgttgtttaattttttttccatttaaatacataacataaaaaataactattgtttaaaacatttattgtataaataatatattttttaagtattatacgacctataaaaataaaattagtcactcattttaacattcttaatattagagtgaatttttgtgtaaaatatttaaatttatgtaaaattataagaccaataaaattaaatgctaaagcgagttatctttttatacatttccttaactattttaattatcatataactttagtctatttttatccccatt

SEQ ID NO: 1903 - DNA, 1221 bp, Glycine max
  Soy_ogl_6945 Gm20:43194180..43195400 Cluster 8
acaactgaacacttatttaagacgacgggtgacatcataaaggaggttatcaagaaaatgctgtccaaagtgtggcaaacaatgcagcaaattacaaggcagcaagcagaaatattgatagagaataaagaaaagagtatgtatttgaacttatcttaaaatacaagaacttggtaaatagttgagaaaaagttatatgcccataaacagatttaaaattgtttcaataaaatttttaggatagcttatgaaagcagcttacagcttataacaaaattgtttaatcctatttgtttttcagttatagaaacaaattattcacaaatgcttacgcaataaacacttattcaatgaatgtttaattaagttttttttacctaaatatgcaaaagttcctaaaaaaataccaacaaaatttgttttctgtaaggaaaaagaaactaacaaattgctttaatgaaatagggttctttctaccctagccttttcatgtgattgaggggcttgctaaggttgtaatttaattataaaatctatctgtactaaatattattgatgatagatcacaacacgattaggtattgagttcagattaaatttatagttttacctgaaaggacgagaaaactatcttcttggatttttaaacagataattatgttagtacgttaaacaatttaagtaaattattccaaaaataatattgattctactgttcctacgagggaaacacggaaggttgtatggctaatgtcttttagctacatgacaaatatggatataaattataactaatgattctctgacgattttgtcttgcgccaatttgtacgcagggtgtaaaaacattatattctgttacgtcttacactggttttccaaaaacaataatatatttttcatctttaatttcctgcttcaattcagatatataactccatatatattcttaaccaaaataaataattattaattaaattttatttatgtttctatcgatattttgttaaggtcaaactctagatgaataagagttaagaccataaaaaagataacccttcaataattgggtttataaataatctaacgtgcggttgagcacaaccaaaattagtcaggttacttatttcaaagtaaattaaaaacttataatttgttgagttcattttgggaataacctaattatagatttattggataagatagtctatattaggattg

SEQ ID NO: 1904 - DNA, 1608 bp, Glycine max
  Soy_ogl_1367 Gm04:43753593..437250 Cluster 8
attattctacaaaccttcaaataatactgttaaattttaaagtataaatttttatcagtgtggcactaaccttgggaatttattgtttttcactatctttttcatatattttctccactggtatcccatcgtccagaacatcaacctgactctttgtttgaaatacatatctgtgttgcttaataaactctttatcactttctttctgctctgatatggccatcctttgggttcttaaaacctcattctcaacatgaacagtagaaatataatcaactttaaaatctgatgaaaaaggagtagatgatgtagatgaagtagggagcatcacttggtgtttctccattgattgaaaagtaactagagacctgcagctagcactagctagaaagcaatatggcaaaaaaagtgatgtgttgtatatataatggaaaaaggtgatggtgatgcattaattacaagcctacaagattaaatttgactacagagaaactatacatgtagctacatgagagatgatacgcttgataaattcgccgtatagaatgggtaagatgtgtccaaaatagtagggaatctaattaaactatatgcatttttatatgtcaaaagttgccgtagatggaaactccaaaccttcaatttttgtgttaaaggatttaaaaaagacaacattatgaaaaaaaaaatagaacaattttgcttctttttccttttcttttattttttgtaaatgagaaatttacttagaagccaaaaccttctaggaaaactaataacaaaagcaatatttatttcttatgaatagttttgctgcttttaccttgtatgttatatgtttcatgttaaactatactactatttctttcttttctaatgaatttttactactaatctacatgcacaaaaagggaaagatgccgagggtatatagcaatgtatggattacatttgcttagttattttcattttggatttaaataattaatttcaaaccactttcaaatgtattaacaaaaaatatcattgatttgagtagatgtgagttggaattctttaaataagatatctaattcaaatctttgtgaataaaagaaaaaatatgattgaaagaaaaaattgattagttaaaagagattagtcatacttttttattgggatcaattattgttaaaatcaatatatatcctacactaataaccactattacatatgtgacttttaataatagttttttgtctaatacttaataaaaatgttattaaaacctttgacaacattaaataaaattattaaattatgaataaatatttctaatatatttttgtgatattttattaaatgttaagtatatatagtttatgttgttaattaaagtctaaaaatatcaaaaaaaaactctagcaatatgaactatacgtaatatctgataaaatatcacaaaaatattattaacatttattcataatatcacaatatttcttggatgctaccaaaggttcttagtaatatttttattaaatgtaaaataatattattaaatatcacatgtgtaataatggacatgttttcttaaagaaaaaaaaagtaattttaaaggttgttcaa

SEQ ID NO: 1905 - DNA, 1500 bp, Glycine max
  Soy_ogl_5326 Gm16:5611101..5612600 Cluster 8
gtggtggtaaaatgtgtaaaaattaaaaagttaagtgataaaatgtgtgaaaataaaacttggatgataaaataatgaaatatgagtgataaagtttacaattaagtcaagaaattaaattaaaaataatttataatgaaaaattatcacaaatgtgacataattaatgaaagagagagactaaaagtaaattttaaaaaaattgagaaaataataacagtttttttttagaactaaaaaactaattagccaaatttaaagaactaaaaatatatttaaaatttattttatttgttgtctctccttatttttttaaaacggtaaaggactattataaaaaaatacatataatatttctatttattgacgtatgccacatatcaatggcaattatattttctataattaatattgttgatgccaatccactcaaagaaaacgtataaaatataaatggcaattttaacgaaaaaaaattacatataatatttaaacgttgaagggcaattataacaaatttttttaacatataatatttctattactgtcgtatgacacatataaatggcaattataaccaatttttttataatattgttgatgtcaatccactcaaagaaaatgcacaatatagtaaaaatattttttaaaaaaaggattttttttaaaggtaggtcctactttgttataatagccccatttaacgattattaaaaaaaataagaagaggcaacaaataaaaataaaaaaggagtataatttttcagtgaaaagagaggttagtttgtgaaatcaatagaagagagagaattttttttaagaaaacataattgattaacttgtcaaaattgattaaaaatagataattaatgatacgtgtgcatagttgcacatgacaaagaaaaattataaataaaatatctaagtcttgatgtcaaatctatcaaagctataaaaaacccagataagtaaaaccaagcaaaacataaacttgtgcatcaagatcgtacaaaaagaaaccaaggaaacaacatgaaacatgaaatatattaatgatgaaagatattaaaggaattcaaactagtaataataattgaaaaaaagaataaaagcatttctcattaatgttacggggtatccctaaaaaattattattggggtaattttgaaaaaaagaacatacttcctccattatattttatacgacattttaggttttgacacaagtattaagaaataagttaatactttaaatttcataaaatatacaatgtaacatcctaatatactgtaacaacaatttctattaagggtattacatggggaaaaatatttaatgcttcattagttttttaaaagacaaaatcctgctaaattaattaattgtgtctcataaaagaagatctaagagagtattacgtttgggaacacaatatcaacttgtcaacttttttgtagatcaattgaaaaacgtctaagccttcaatatttagatataat

SEQ ID NO: 1906 - DNA, 1100 bp, Glycine max
  Soy_ogl_2551 Gm08:7975001..7976100 Cluster 8
atagttcataaatgtgcaaattagtttaacctttatttgtggccttaccgaatgattttcactttgcgtttaatttctaatttgtttattgtcttgcttatcttaaaataacatgatatgagtaaaatcgtctattatagtaattaaaattattttttatgtatttttatataactatttaaattaaggaattgtaaaatcattaaaaaaattatttatttgagaaaaatttatgtgattccataatttttcaacgatgaattgtaaaaccacaaaaaattcaattattttattatatagaaaattacttattgttatatgttataaacacatcaccttatatctaggatatgtgataaaattgtttattcctaaaaaaaataatatgaaattagttgtcattaaataataaaagttaaatataaggtatatattaattacatgtgtaagtgtatgttggtagttgtgtaataacaattatttgagagttcaagctcttttattgatgtgaaaatatatgatttatatagtttaaaaagttctaaagtagtaataatcaatcaaaatgtatggtatgatattcaaattttaatcaattacaattataaattttcgcgattgtatttctaaacaaagtaacatggttgacttatttaattttaatatcttttgtaatattgtttttcttacgttataattgaagagttaaaaatggaaaaataaaatggtcaaaattccaggacagacaaacagaatcatttggttatgtgcttgtggatacgaacaaagaagaatatataaagtattacgagttggtgtcaaaattggtgaaaaaaggtagactaattgcatatgataatacctcatggcatggttcagtggcaatttctgaagatgtaaaggaagatattataaggaagaacagaaaacccttgattgagttcaacaacttaatagcaaacgattctcgcttggaatcagctatcatttctattggggatggcttaaccctctgtagacgtctctaatcccaaattagtataaaaggaataaaaaatgcaaaataaaatgtcacttttaatatcgtattccccaactta

SEQ ID NO: 1907 - DNA, 1700 bp, Glycine max
  Soy_ogl_4156 Gm12:38649801..38651500 Cluster 8
aggctttgttaagtttaattgatttactcagaaacttgctagagagcttaattagttcaaattttgaaaaaacttaggacctttcgtgatcaggaatgttattcctaaaaatatttaaaaacacatttggttagatttgagcatttttaggaatattttttaaaaaatttagacaatcaaaaggttggataaaagttataattagattagataataattaacatgtcctattcttacaacaataatacaactttttcacccgtagttataagaatgagaatgaagtaaattatgatattattatgttttttgaaaatagaaaatactagaaaaaaaatttcaaaactcacaagatacatgagaatattacatttccaaattcatatgttcataactgaatttttaatccgtgaaaaagtacatttaaaacgatatttaaaaacttatgggaatcataggtaaaagtaaaaactgaggggcattgtaattttccaccgtataccccatatgaaattttattccgttacaataaataatcttaatttttgtttcgggacttacgtgaaaaacaatcatcaatgtcggttcatcattgcacatcataagagttgtggcatgtatggaaaaccaacagccagccatagcaacttcggattgtctcggcttcaacatacataacgcacgttttatgaaatgaaaaagcattccatgacgtcacaaaaaacgtacacgattgtagataaaaataaaataaaataaaactatatatttaagaggtgaaagtaaaatgaaagtttcaaaaaaattgtgacatgcatcacaaaatgaggtgaataacaatgaaatatacattaaaaaaaaaaaaaaaactaagaggaacggttgttttttacgttggcaaaattagccctcaaagcccctcttgaatttccagctccaccctcttaaaaaatcgagactatgtgcactgttatatggtatataatcgtttatgcctttaatttttaaaaatgttttctgaaagacataatcgattatatgtcattaatttttttaaataggtttcttaataaaaaaataacaatcattatttttgttggggataaaatgaaaattttattaatgattaaaatattttttcttttcttattttcataatcactttaattcaaatattttatcttttttacactttttcatatcaatcaaataaccttactttttcctcttttcaatgattttcattattcacactttttattccttttcttatctctctttcaaacacaatgtcaaggaaagtattcaatttcttaaattgagattttcaacttatcccaaaattattttggtgattatcggttcaaaatgttcttatgaacatgtatattttacaaaggaaaaaacttaaatacataaccataagttatgttgttctccaattaaatttgatgtttctccttagtaatataccataacatttaataaattcctttgttttgcatacgagagaggtgaaactcaaaatctgactcgagaacaacacctacaataactatgataatgtatcttaagtcttatccttttacaaaatgcttaaaacacttaaaattctcacttctttaaacggttgacataaataaatggggccttggcatcataggacgaactcgcgtttcttcttaatggtttattcgaaa

SEQ ID NO: 1908 - DNA, 1319 bp, Glycine max
  Soy_ogl_3377 Gm10:5358561..5359879 Cluster 8
ttgggtaaattttatctcaaacttttgtctttattaatggataaatggcataaataaaatttataaatttcttaaaatatggaaattaaatatgtcaaattaatttgttgaaagtaaaatttatcaaaaatggaaaagttaaaggtaaaaagagactatatttttttttccttacgatttaactcttcattagcagcggtttggaaaagtgtacttgcgaaagatagtttggtatttagttatcaaaggagttcgtgttaccttcgtgatcaaaatagtataaagagtattagtttaaagttttttttaatactatcaattaattaccctatttatatatataaagtcaatgctggtaagtcaagaaagctaaggtcttcctaataagaaaagtaatttctctggttcgataaagaaaatgagcaagtgtgattttcttgtaatcatatccattaacagtagataattcattggataaagatttttaaaagtctttctagattatggtccacaagatgtacattttgaagtgaaaaaccaatcatttcaatgataaaaaaaacttgctgtttgatttgcatcaatttgaaataatatcaaatctaaaataatttaaattgaaccgatcatttcagttgttttcttactcttttatatttttaaagggatcacatgtttatttatttttagagcatttccaatgagagttgtttagctatattataccctagtagttttgtaaaaacaaaaccatatttttttatgtcacgtatttttagattacttgaaattaaaaagagttgcttatataataattattctttgtggattcttagcatttttagagcaattccttttgtagttgctatcctgagagcagcaatattagtaaccaaaaactaaaatttgcaccattggagagttgtgtgagatccacttaagctttgggttactccccatagcaatcctttcttatctctaaattgtgggttctgagtaaaatatatcattataatattgcttggagtaaaaattatatagattcatttgagaaacattagtgaattttttgattggtgtaaaaattattatatagtagaaagtatgatatgttgttatagaaaagtgtgaaatattattaaaaaagatgtatataatagataaattcatttgtaaatataagagagaaaatatgagacgttgaagagagataaaaaatatttgtaagttaaacaagttattgatagaaagtgaaaattagttaaattcattaaaattgagataacatgcacgaatccatttaaagaaataaattgagt

SEQ ID NO: 1909 - DNA, 1193 bp, Glycine max
  Soy_ogl_2281 Gm07:8161447..8162639 Cluster 8
ttggattgaggattttcctttttattgtaaaacaactgaattttaaactcttctaaaattgttttatattggtatctaggtatttaatctgatgttcgtataaattttgttaacttttttctcatctttaactttataaaaaaaaaatagttgggtctggtgttataataaaggtgttatcctaaacatatactaccaccgttcctttttatttgtttttgttattttgtagaaatcaagaaatacagtaatttttcttgattttaataaaatagttgtcaaattttttatttcatctctttctctttttatttcacaataaatgcatttataaattaatgaaaaataagaaaataagcaagagtataaatgatgaatgagtaattaatgtaattttaaattttgcaaaagagatataagtaagaataaaatttcttaaaatatccaacaattaaaaaagaatcaaggagaatataaaaaaatatttttattttattttaaaataatttgaaaaatgaaatcaataattatttaattacagatcgaacacaacatgattttaaataactcaattcaccactagtttgagttactgaaaccaattggttaacactattttattaaaatatgtaactttctattccatgtcattaaagacccataagtagtagacatgattaacataaagtaatgtcataattatcatgccaagtgacgtaaataagcatacaatgtcactgtgtaatcactttcctcatctctcacccctcaccttctattatctcctttcaaccctctcccatctcaaccctagtaaacaatcaagcggtctcattttttttcaatcttattgaattcttaatcttaacaatcaaatatgtaatctttatcaatagagtctagtttagttgattaagtaaaatacatatattattacaaattgcaaatatctatcttcaattcttacaaataaaaaacattaatctttcactagtcctcaacaaaaatcaatatgataaaagctgagatgttttttttttaagatttaatctctcatcaaatcagcactcaaaggaattttcttcaccactttatacttttataaagatatataattagtatgaaatagttgacgaataactttgtctatcaaccgtttaatcttcaagtttgtatatatgtattaaaatatg

SEQ ID NO: 1910 - DNA, 1000 bp, Glycine max
  Soy_ogl_5617 Gm17:9741501..9742500 Cluster 8
tatcttaggtttttttaggatttttgttcataattgtagtttttgttaataaattgtataaaatggtcttgagaacttaaaaagattgtttttagtatttttgtgcatattttcatattatagggacaatctggtcataaacagaagtttttgtagtcttagttcactgtagaggaatcaacttttgccacaacgagaaagtgttactttaagaacacaaactcaaggtcaaacaaatcaaatgaagcaatgaaggcttgctatagcaagtgttgtcctcaattgagcaactattctgcagagatcaaaatgcataaataggattcttgtgacagtttagatagcctttggctcattaattcagtttttgaatctttggtccaattttctattttctttatttttggagaagctctgagggtgattttctctccctcatcttctccattataggttagaatcttgtaactttcttactttcacgttggattcctccatggatctttgtaaatatatttttgttcttgatctaaatgaagtggatctccaatatttgtgattcattttcggttcaaatttcaatttatgaaatcctttcaactcatcttttagggatttgaattgtgtggaaacaaattcaaatctcatatctggagtagaatgtgtatgaatttattgctaggaatagagtaggtttatgcattgttgcaaattttgattatattccaatttctagaatgagatatcctaagtaattagggatttattctagaaattaaggatctcttacctaaggaattaggattagattgctttagttaaatatcgattatgttgaaattggaagtttgatcgggaatcaaggttgcatatgaaggatatcattgaattaagatagcaacaccttctccaccttgttttcattttcaattcgaaagaaaacaaaacatattatatcattcactgtagcaaattgacatctcgctatagcaaatgtatg

SEQ ID NO: 1911 - DNA, 1098 bp, Glycine max
  Soy_ogl_4495 Gm13:36918001..36919098 Cluster 8
agtgtgacaagagaaaaacatatcttgaataagggggaaaaggtacaaattaatagttcctttggatgtattgaggaggacaatgaaattatttaaagcatggtacactttaaaagtatatatgctacttactgctctgttaacatatttatgaaatagtgaataatttttatttaaaatttcaaagatattggatctaagttcttttaaaagctagggtttaattagacttagattagcagtaaaaaaatggacttagattaagtttcctttaggattttgaagaactcaatttgattgtgtcctattataattttattttatgttttctattttctaaaaatttactggatgtatttttggatagataatcaattttctcctcaaaagtttgaaacgttgtcattttaatttctaaacgtaataaaattaataaaaaaatcataaaagtgtaatttgtcactcattttaatccaaattaaaattcaaaaagttatataacttaaatgataatattaacactttcaaagactaaaataacactaattaagtagttaagtttaaaaattaaaataacaatatagaaacttattttaaattttgttacttttaagtactgatgtaatactagtattttacacttccataactaaattggtggtttgccctttattctttcctttcctgaagtattattcaatctatttgagaatatattaatacataaatgatgattatgtttataaagatatttcatctaatttttttatttactagttagaaaatttgtttagttgtttggtgaacaaatttttcttaataatttttgagttttttgaaaatgacttcaagtaatattttttttaaacgttagtttctaattttattatttttttttctcattcattgtttattaaattttctttttaatctttttaaacagattaagattttattattattttttctcttcttcaattcataaggtaggattggtttacttctttttacctcttttttattttctttttttacatatgaccgagtttctcatttttattgttttattatataagatattgataatgaaaggtaata

SEQ ID NO: 1912 - DNA, 1000 bp, Glycine max
  Soy_ogl_4179 Gm13:21066801..21067800 Cluster 8
ccccttctttgatctttttttctcttttcctctattgaacttttcgttgggtacatttatacttgaaatttgtcaaagaattaattaagtacccaattgatcttctgatagtttaaattcaaaagaatgcatttaagccaatgtaactttctctatcaaaaatccaatcatcgtggttaactttttactgtctattataccactagtattagtagtatatagattaatattgcaagtgtttttttttattatatattaataagtaaagtacactttttttagaaggagtaaagtacacttaatcccatcaaagtttctctaaacaaagaggcatttcgagaaaaaaatactatccattttagtctaccatttaattattaatttagttgtcatacatcattcaagattggcacagtgtatatttaagctttaaataaactttaatataagagtattttaaattaattaaaattatatatcgaaatcaagataattacattcacatactcttaaaatttaaaaaattcatttaatatctttattttttttcatttatacactttttcttttaaattatataataacataatgttatctctgacaaaagaaagatatcaaatataatttcattaattaaatgtaatgtaatttatccttgaaacgattataatcatatttttaactttagacttttaacaaggcaagcctaataaagatttaaattttaaaagaattataataagatatttttaaaaactaattaaaagtaagacgaaagactagttattgtgcgtttttctttttttatttaccatattgtataattaatattaaaagtggataaattgtacatttcattaaaacatagtgtcattaattaattaagataacaataaaaaaatcatttgacattttcaaatatttagattacacgtgcttgtcgttatatgtcacgtgttgagtctgttgtttacacgttcaaatcgagatgtgcaagcca

SEQ ID NO: 1913 - DNA, 1300 bp, Glycine max
  Soy_ogl_6889 Gm20:40610301..40611600 Cluster 8
agatgcactcccttatctttctctgagttttacagtgtttggtcaaattccgaagtttataaaaacgtggctaattttttctatataagcataagaataagataaaaggccaattgagagcttatgaaaatctatgttttttttttaagattatgaaaatatatgttgttttttaaacaagtaaaatttttcttaaaactttatttagttaaatgaaattaagcttcaagtgcaaacaaaaaaaatgcaagcctataataatagacaaatgcatttaagtaaagatacatcgaataagatgcaaagtagattatttttaaactcacatacatatagttattttaatttattattataatgacgtgtaagcttcacatatccctttgaggcatgaatcatgaggttaactgaatggtattgttttgtgtttgttgaaagagtccgttgttggataattattcttgttagatttatattatattagtaaagcttttttttgtaataactttatatatattatatttgctaacttatttaaagtcttaaaagttcaagttcattacttaattttaaagtttaggttgatgcataattattaactaacttatttaaatattttattaacgtttgaataatttttttagctcaatcatgctagccttttaataaaactaatcaaataaataaatacaaaagataaataataaattacagatgtttaaagcaatgtttctgcttatgtaatttctatccccctgtctattactttgttatatctgataacaaaatacttgttgaaagaatcaaattcaagtaaaacaaacggatagaggtttaagagcccaattatctattcaaacattggtaaacggacccaaaaagaagacaaggatcttgcagcaacaaaagcttattaaacgaggcacgaggcgatattctgatgtccacaactaggaatcatttcatttcattagtaccctagctttttacttcaccgtaatcaagcacatttggttataaattgttggtttacaacactacaaccatgagaaatgtaggtgcttgcgtggtgcactacaaccataagaaatattgtcttgccacccccgttagaaagggacttcttgggctcaaaacattataggctttttaggaactgttgatccatgtagattactccacgaattcatgtacggatgaaacattatttaatgcatgatgttaccttattgaccccctaagaaattatgtcactaaaaaacaatttctgttttgcttggaacaaacaaaatttataaac

SEQ ID NO: 1914 - DNA, 1856 bp, Glycine max
  Soy_ogl_608 Gm02:42508045..42509900 Cluster 8
ttttgctctttttttactatcttttttcacttaactaatttaatgagcattttcctactgtgggccacaacacctaaacaacataagttttcctactttcttttataaaacaaaatgttcctcccgttgtgttatattttatacataatctacatatcaatctagaaaagaaaattaaaatttattcaagctaaaaaaatcttaaataattattttaagtgagaagataataaataagaaatgaataattagcctaaaaatgattttagacattttacatagagaagataataaatattacatggttctattttgaattttgtttgagcaagccatcaattttcacccttaagtattaccatgtctcctaaataatccttaaagtaataaaattctataagtaatccataaaatattaaagatctatcaatttagtatctacattggtatattttactaacatctatgaaaaatttgaaggattttttaatacttagagtaacatttaatataatttttaataattgaggatttgttcatacaatttgtttactttagggataatattaattttggataatcatcacactgactcgacatatttattagatttgtagatgattaatatgcataccatttgtcatcttttaagaaagtgcttctctcatgtatatatcaattttgacaattgaataagagtctaatttatatatatatatattgatgtaaaaaaaattatactgctaattaaataaaattatgattaatatggcttttaaaataattactataaagtgatcaaaacccgaggtaccacattaaggtggtccatcatgcactgttttttttttcatcgttggattcatttggtgctcattaatactatatattatccacagtggttctcaccctaatattatacttcaaaagtggttaaaataactataactgattatctatttataatcgattatataactgattttacatataactgaagatcaatgtaagggatattatttgtgtatggtgtaccacctcctctagttttaactaataaacttatcatatcatataatgatttacgatcagagatatatagtagtataaaatctttttatagtgcttaaactttttctcaatgttttgccaaattcttggaaaatctaaaatcaaaataaaaatctttaaatagctaaaaaaaaatctattttataggaccaaaaacttatgtaagtaaaaaaaaaaaaaatctcacataatattccattcttgaggattttcctcagcgggccatcagcagagagtcctcacttgtgataagcctccaacattgcttccctaagttttaaagcttaacaatgacactaaatccacgaaaacccattcaatcaaactcatttttctttgactaaaataggcgttcctagcacatccaatgaattctgcagttattatccttcgattccccgccagaatatgcccatcaaagtttctattaatttcaccataacagccttctgagattctaatagcaactcactttgtagtttgaaatgccctgtgcgagaacctcctttccagcacgtcagaggtacatcaatatgatttttatctaattaaaaatcattattttttatatgaatatcatgtatatcgacatttataatatatataataataatataaattaatttttatattaatcgattgtttcttgttaaataaaaacaacaccgatgaagataaatacaatagcaaatgtaatttttgagcatataaaactttttagtaattgtttgtactcgtactctttaaattgatgcaaagtatttgatccagatacgcaactggaa

SEQ ID NO: 1915 - DNA, 1156 bp, Glycine max
  Soy_ogl_5424 Gm16:36983001..36984156 Cluster 8
tgccagaatcataattaaatatcacctttcatctgtgaacttttaagaagaaatcatatatgtacatcacaggtaatttatagtaatattcttgaatgcctaggtcaaaaataaaaatctcaacaattcaaattatattatactatttatgaattaattaattattaatgtttgcataaactaaatttaattgttatttattaataagctttgctaaaaaatcatatatatttatattttagtttctttatatactaacatttggagtattttttttcttgttataatgactttctttttcacttaatgaatatatacgctgtttttattacaaaaactatgtttaaacaagtgttactctgtaaaacaataaacacagtagaaatcacaatgtgcgatggaaaatttagtttattcattcattattaatgtgaattcggatacaactttttttaaaaaaaattatagagggagagaaatatccttattttaaaataaaactaatacaattcacaatctagttaaaacaactctttatttgattattaactataaaaatcacaatgtgtgtggaaaagtgaaatttagaaagactcgtcaacatatgaaaataatatgaattatcgttaaaaagagatgttgatatttaatatatgatcttatgtcgaataaaattaattagtttcaaagaaagaaacacctacaaaacataaaagataattgtaaatattatagtataaaatggttgaaaattctgtattgtaaagtaatattgtgacagctggagctggtgcagcaattgtttgtaacttacacagttacgtgaagaaagaagggaggaaaaatccagacacagtaacccccatcaaccaccaagatgaaacagtggtaccaacaacacttatttttaaatgcagaaatacactttgatataatttttaagtgtttgagcttaattcacgcatgctataaaatcttttcacaatattaacaaaaaggattattaattatatttttaaacgtataggaataaatttcactttcattttgtgatgtatacatgtttaacttatactaattttcatatttaattgatacttttaagaaaattaaaaaaatcaagtataaaaatatttaaatttatatttaaaaatag

SEQ ID NO: 1916 - DNA, 1100 bp, Glycine max
  Soy_ogl_4991 Gm15:11299101..11300200 Cluster 8
taatatttccattttatttattatctgaaaaggttgagaaatggaataaatgatgagaaaagaaaatggagaagatacatttccctccatagtgaaaagaaagaagagtgttggcttgaaaaaagaaattaggccagaagagaaaggaaataaacaaactaacaaggtaagggctcatgcagggtgatatgaaaggggattaagaaaatcacactcatgacctgaaccattttctaatttttgtttttatttgtttagttggagtgttataaatcataagactaatttgtattaacaattcaaatttttgtgcccgcgcgtcttttttcatttatttagaaattagtttaagtctttagaagatacttctagaatcaattgaccctccctctcttttctttctctacacacacatagatatagagtggggattaagttattttagcaataattctttaaatatatttcctcccgtcctatgtataaaaaataaatatctaatttattaagatcaataaaaacagtcaaattagttaattttaatttatatattatcatgaatttaaattttattttaaaaatactcacaaaattaatcagtttagtaggtggttatatataatgagactattcataatccaagaagtaattttttaaccattgaaaataaattatattgttaatagatcaataaatacatcatctttcatgaaaaattagtgatatatcatcaatcaatagacttttactaaatcaagagtataaaagaaaactagcaactaatacatttgaaagtagtcatataatttattatacttgaaaaaatactgttgtttgcttcttatataaaagattgaagatattattaagtttcaatgattcaattattaaatattttgttattatctgaaatacatattaaattttgataaattgaaaaatcatagttaggaaatattatagttaataattacttacattttaaaaaggtatgctataaaatatattaaattaatttaattaagcatatcaactacttttaaaatcttgtaaaaaaatttagatttggctgttcaataagaatttttaatttataatac

SEQ ID NO: 1917 - DNA, 1100 bp, Glycine max
  Soy_ogl_4284 Gm13:26611001..26612100 Cluster 8
aagtcaacattggttaaaagtgtatatctccacatcaatacttgaaagtataatttatttacaaatttacatcttcaaattatcaatttataaaccattttattccttgaaaaataattcatgcaaacaagaatataaaagaacaaagtaatttaaattgctattttttaggattttattatatattaactctttcatttgatatattttttgagagggaaaacaaataattttttttaaaaaaaagcattatacattgattctatacatgaaaaggattaaagtatgaaaaaaaataatagaataaaaagatctaaagaaatagaccataaaaaagtattatgtttagaattttttttagataaaagattttatgtccttcaatctatatgtcatatatatatatataaattaaatataaattcttccgttaaataaatttttttctatatataaataaatttttttttacactattacattaattccataggttaattatgctttgattctttgtattaaagaaagggtaaaagtaagaaaaacaaaatagaacagaagattctattttcgtatcccatgcacatgttaagcattgtctttttctctcacctcttctcttgggtcaacatgaccgcaaactaagccgaaaactgggaggccaacaagaaatgggatttcattgaccatgacgaggaaagggatgctaaaagctaaatgtagctctttaagtacaaacaccatcatctccatatatagttactttttttttctttctttttgggtgtcaaaatattctgtaggctttcccacttcaatatttgacttcaagcactattaaccgacgccaaattcccttaaagcggctcatcatattagatatcaaaatcataataataaacataattacaattaaaatgtaagttagcttaaatagtttggaatttgattttgtgtatggaattctttttattccaatagaaaaaaaattcacttttgtgattattgaggattattctcatgactttcccttatgaaaatatttcgttttcagaagaaaaaaaagttcaatataaactaaatataatgttaatttatta

SEQ ID NO: 1918 - DNA, 1200 bp, Glycine max
  Soy_ogl_4396 Gm13:31906301..31907500 Cluster 8
tttttataaaacaaaatacttaacattgcacaaatttgagtggcaaaagcaatgcatgacttcctcttttgctacttttttataaattatgaaaaatgttgcattccaaatgcagtaggtcttcatctacgttctctttcccaaagaatgagaaacaacatgaaaaatcaaaatttagagcatgtgatttgagaattcgtctcctacgggttgtcaaagttattactttttcctgataataaacattgtttatacaccattttcccccttttttataaaaaaaatagtaatacaaatttactcattgtctttctcctacctttctttcattgaaaatgattttttttgcatatttatttttctttctttcattgaaaatgattaatatttacagttttttttttcagtcgtcatttgaatttttagagcaagctatctttttacaaagaaagtcactatttgtagctacttcattaatttagatttatacatgttttatattttatgattcttattttctaattttctcctattttatatttattgttttgtatacgaagaaataattttaattttgtattgtagctgaatgtaacatgttattgtaacgtagctaaagtatacataatttttatcacctattattgtaaaaaaaattataaaataaggatatgctccggatttggtgaaaggatcctagcagagtcatggctatgggaaggccaacgaagccattgcctaagacctcctccaagctcttagttcataatagtttatttttgaaaaataaattaaaataaatatcatattaattttaaaatttttagtaagcatgaatttaatattaattatcttaaatttgtttgtgaagcaaacttatttaaagaatactaacaaaaaaaaatcaatgttttattagcaatattaaagtatattaaaaaaaatcatttttttacatgcctccaatgtttacataatataatattattaataatactagtaattgttttcattcttaaaagaaaatcaaaattaatttatttaaattagcttgagataaattatattacaaagatattggttaaatgaatgaatatcaaatgagatgtttaaattatttgattattaaattttaattaatagttttttaaatacaaattaaaatttgcctaagccctaaagaattttagacatgaccct

SEQ ID NO: 1919 - DNA, 1700 bp, Glycine max
  Soy_ogl_904 Gm03:36503001..36504700 Cluster 8
ggtagtaagaacaaatgagaaaaagtaaagggtgttaaaataaaagtgggggagtcagagtcacagactcacagtgtagtcctagtccatttgcattgcagcaagcagggatatagcataaaaggatgcaacaaccaatgggttactttccatcatcactttggtccctaccactgcttctatagggtctctgccattttttacatgcccagagagtcccagaccaagatatcattatcgggatcctgtccactgaaacgttccattgttatttatgcctatatatggctatggattcccttccttcttcacaggtcagacacattccacgcccattcttcaccctctccacttcgattgagtgatttatttcatatactagggttatttttatttcacaactcaccataattacgttgtgtttggacgtgaggaaataagagaaatataaaaaatgaatgaaaagaagtgaaaccgaacatataagtaaaaaaataaggttgtttgattataactatcatcatcttttatttgttaataatgtaagattattttatattagtgtaattattagtgtatgactattaaatgcataaaaaatattacataaaaagagtaatgcacaaagtaaataaaatagtaaatagtttatatacaaatggtctaaagggttttcacatgactatctattagaaattattatttattgatttttatactaattattttaaaaattatatcaatcataattttgattagttggtaatataaaattttcatattaataatgtataaaaattaaacttttggtgagatttaatttaaatttattatctgtatgtgtccatatatctatgaactatctattaacattttaattatataatatcatatattttttaaaaattacatactatcatgttattgtacaataaacatgtatgtcatattattttagtcacaatacatatattatgatcaattatgtaaatcaattaacatgagattgttgtaacttaataaattagttcaattttactttttgatttataactaagttaaatacttagaaggagaattttatcattcatagtggtatagctcaagtaagattgtcttcattagaggataggtctatatatataaaaaaaatcatcataaatactaaattttaaataaattgtatatccataaatttgtaattttgtaactaatataaaatagattttaaaataaatatattatttgttaatataaattaattgataaatcttatttataattacatgcgttttaatagatttaattttttaatgaaaaaaattaataattagattaatgaaatttgtagaacacacaaaaatataatataagaagttcgaattgcatttaaacaccttttgcaaagcagttctcaaacaacatatagaatgtaaaacgattggatggtcttgtaaagatataaaacggctttttaggaaacaagttctcgaacaacaaatgatatacacaattaaattccctagttaaagacaaataaaaataacataaaggaaagaagaatgatatcaaagttatattgattcgtctgacctaaagactatgcccactcctaggtttaatttgctactaagaattctacaaactgtccaaacatttttaggagtattctttctttcttacctcttcacgtgcacaaa

SEQ ID NO: 1920 - DNA, 1891 bp, Glycine max
  Soy_ogl_988 Gm03:39898410..39900300 Cluster 8
aatgaagaagtactagaggtaggagataacaaatcgggcaatagaagccaaaatgagcagtaaagctgccccaaagtttaccttccccataactgcgtgatttaagctagtgactgctatttctgatgaactaaagaaaagagttcctccaatccaagggactagccactgaaccctccgaactctgaacccatctcacgttatgtacagtattttacagatccaagtgcagaattcaccagcaattattgcaccaccatattcaactgcactccaactcaacataccccttcccctcctaaaaaacaaccaaagaagacgtcaacaagctattctattgctatgcatgtcaaaattatatactatactatgcagtatgcatatatacaaggaagcattaattactattacaaattaaaacgtatataattcatttttttaaatattacattacccctttcgttaataatgttggactctaaatattaaaatttaaaagtgtattttttaaaatttgagaaactaaaattctttttttcaatttgaaaaacaaaaaataaatttactccaaatttcaggaattaaaatcataaacaagacaaaggaataatatcctagatttgttataagattgaaaacatgcgcaatttttttaatatataatttcatttcttccgtttttctctcctcccttttgagatatctcttttatccaattctcctctagtatgtatgacacaatactcctcagctccgcaagagccaacttctatcttttaacatataaaattagttattgtatttttttctataatgaaaacatatcttctaatgtagaaatgtgattcagatcaattaaaacataattctatattatatttaataattcaaaaacaatttgactgaaattaattttatctaattttaaaccaaaaagatagtaaatgtaaaggtgcaactaaatcccccttctgtcaaacagtcaaactttgacgaaggatctaggccgttcatcgctgataattgggataatactgctcaattttttactctcttttttgaattataattttaattagacaaggaaaaaacacttacccgaagtaggacatatgcaacctttgacttttagatctaagaaaccccttttactattttcgaagcgttccaatatttttgtctctgtaaaatactactatatatatatatatatacaaaaatgtcatatacaaagaactattttatctttttgaaggaagctgcaaaatttttcaaacacttttttttttggtttttggtaccaggattgctttataaagtatatatttgataaacaaaagaaaaatttattaacaggttacagactacagttctttgttgtgatattaatcattaatgattccaaaatttgccgttatatgtatctcataaaaatttacaacattgggcgactgaaattgactataagaaaattaaaagagaaaaaaaaacaaacaaacaaaacttcagctttaatatacagatatttagtaggctcatgtatacctataaaacttttagcttccgcattaaagtattaataaagaaacatctaaaacacgtgtttatccttcgataaagaaagtttctgaaacaatgaattgactgaaaaaatttagtgctcaatttcctggggaccaatatacttttcctccgcattaattccaattaattacacaatttgaaacacctttaaatagcttaattgctcgcaattttttccaacatgcttccccaattattaagtgtcatatgcatgctgtaaaatataaaattcagttccttccttcctaaacttaaatcttaaacactgttttacacattcagtcagtgatcaatctctctgctacca

SEQ ID NO: 1921 - DNA, 1500 bp, Glycine max
  Soy_ogl_5562 Gm17:7327001..7328500 Cluster 8
gagtactagaattgattgctccttgagataggaacaataaaatcatttacgggaattctatgccattgacccgaacgtattatattaatatattgtttaaacttaaaagtggtgtttgatttaagtgttttttttttcattttctgaaaatagcttttatttctaagatttagaaaacatttttattttaatttataaagaaaatatttattatgttaccatcgtgtttttactttaactaagccaaaaaaattctgtttttatttctttagaaaaaaattgaaaatgttgatatgttatttttaattttgaatatatttttaaagaaaatgttttctaaattttaagcaaaggtattttcacttttattttatgttttcattgatgaaaacaaaaaacattctcactaataagcgtcatcaaaggatttaggaataaacttaatagctatatttgggagtacttagtaatttcttcttctgggaacaaggtctttctgaaaactgtattgaacttgttggttagtataatcaaattatatatagttatctctactaaaaaaaatatttttttatatacaggtatataaacttagttataatcaaacaataaaaaaatatataaatttaagataacgtgtatgtggatagtaacattgatttatttgattgttctttgaatattctgtagcatagtaacaataaaatcatttaggggacacctatggcattgacgctaacgtatcatatcatattatttaaatttcagggtcaggggatataaaaattaactataacttgaactataattaatcatatatatatatatatatttgcttatgatatttgtttttttaaaatttataattactgatttaatattgaatttgaataattgtggaaccgaaccacgggatttatataggggaaaaaataaactgtcctaaagttttgcttctttttttttaaaaaaagaaaatctatatttcattattagtatcaaaacaatgttcggtatagtgtgcatttatattaagtctaaaaaatatctaataaataattatatttttctttttattttgatcgcaatgtattcgagtttttcccccttaattaacttatcttgcgaaaatattttcgtcttaaatagtatttgcttttatacgattaattattaaagtaaatctaaaatgacttttaaccatattatctgttgtaggatgatttttttttgtcaaaggtttgcactaataatcaaaatttaattgtggaacatcgtaacacaatgatttaattgacttgaaaatattcgagggattaaaatcatatataatttaaattaaaaagacaaaaattcaattaagtcataattttaaatagaaagtatgttttaatgaaacaaaataatctacaactttttaaatattattttaaaaactttatagaaacaaaaagtgattatctctaataataaatcaattctaaacctgctctcacgaaa

SEQ ID NO: 1922 - DNA, 1421 bp, Glycine max
  Soy_ogl_6504 Gm19:42303580..42305000 Cluster 8
aagatttattcttttaaaacaacatatttacgactttatttaataaaataatgtctaactaatccagaaccatgtttttaaatatatatatatatgtatgtattgttttaaaatatgattttataaattacagtttaatattcttatttttaaataacacaaaatctaggaatcgtccctcatagatctatgcttaattaataaactttggaccacttaatccatttgattacaaaatatattggattatgtattatatatccaataatagatgctaatatagtctaactaaagcattaatttttttagtaaaataaattaattgaatttatacataaataaattagatgtttaataaataaataaatttatcaccccactttagaagaagttcaattgtaattatttggtaagtaaatggagaaaaatagcacggcagaatatatagaaagagatggagttttactctcacattcaatcacaaataaatttattaaaatttaaaataatcatttatgattgaataaaatattaaaatcatgtatgttttttctttaataggtgggtgggtgttttttcttttaattgtgtacgtttttctcttcattatgcttcccacttaggttggctatggtggtccacatatgcaatatataaaggtaattataagacgtgttttttattttaaaataaatgttatatttgatttttgaatgtaatattgttatttttttttaatatctttaatagatgtgactttagtttttaagtctaatattaatattattgtttttcatctattttaataaatttaattttgtaaaattattattattttttaattatttactaatttttcttgatatttgtaaaacaacacccaagataactcttattttagaatagaagaaataatcacttagttatgagtaaaaattaaagtcgtatttaagtcttactggtggatttggttttctccaaacaaatttacctaatcacacgattcaaagtagaatagaaacctaggtttggaaatgcaaacagtcatttgggccataaacgaacagggaacaacttggcacttgaagaatatgtaaaagaaagaagcgttaaccagccattcatcttctttacttttctcttttgcctttgaataaattctgtcagggaggcctgtggctgtccttgatgtccaattccactattttaagtgtcttctcaatatttattttatatatatgtttttattttttatttgctgggctgaaattatcataaccgcataactgtattgtgtaaggatacaaaagcaagtcttcactctatattctatacaatataaaacggatcgaatctgtcatatgatgtgagctaatttgacagcttctaacaaacatgtttccgaaaaagtggttccaaag

SEQ ID NO: 1923 - DNA, 1144 bp, Glycine max
  Soy_ogl_3136 Gm09:36658757..36659900 Cluster 8
tgcatgtgaaatcaatactatattaaatatttttcttcccaaaattaccctaaatcaatatttcatgcattaatataataatctttttaattctgatgatctctttttgctaagtcgttagtatttagtcatatatttatatcatttattaatttcaaaaatcacttgtttttccacaagtaacatcggatataatagatactctgtgattagttaggtgaagtgaaaatgttacatcaaatatatatgaatttgttattattaatgagaattttgtgtagtgagaataaatgagtataagtattatttaatttgatataaaataatatatcaaaaaaattactaatatttttttataaaatttaacaaattaattatttttcttaatatctgtgcaacaactttaaatgaattgtatttggagcagtatttatttatgtctaataaagctcccactatttctttaaacacgaagtccgacgctcattttctaatgcatcaaacctagaaatcactgaaaaaattagtgttgaattcgaggaaagaatgaattcatattgaataaaaacaacaacaaacaagtaatcaaatttatcacatttcatccatttaactagaaaagagatggttcgttctctgtttaaaagtaatatgtagaatagaattttctaaatcagttatgaactattaatgcgattataaatgtaaaaaatcattttttatattagttctaaaatttcaactttttttgttagctaattttatactagtttgtagagttgatctaaaatgttgaaaataaataacgttaaaagtattttttttattaatgagttgtaactttttattattattggagtatttaattaatgacaataattgagattaacttaaatgataaattatataaagtaagaacaaaattacaaaaacatgccaagagttagaatagaaagttattgaacgaactgcgtgattgatcacgcatatttgacatgtatttttgtgtcaatgaagaaatcgtgaaccgtaacttctacttaaatcaacaatttgacgtaaaatttcacatcagtaatgtatattcaaacacatttgaaaatgacaaaaatcgttgatgtatgtttgatatgtttggaacgtg

SEQ ID NO: 1924 - DNA, 1400 bp, Glycine max
  Soy_ogl_4245 Gm13:24212601..24214000 Cluster 8
acaaaagttacatgataaaaaagaaatgagaaaaaatatttttaaattaattcagaactgataaatttaaataagattagaatattataatttaaatattaagactataaaaattagattaaagtattattttcataagtatctacatgaactaatatgagtgatatggtaaaatcaaataaaatttcacatgtacaaaatttgcattagtttttataataatatctgaaattcaataacgaaatttgggttttctcaaattctagtttcgtttttgttagtaaatttatttttttattcagctttacaacttatatgaaattgaattattttatgaatatttttatttatttcacatgagtaaattaattttttcacaatgaacatattcacatatttaaatttggataaaggttgcattttttccttccatatttctttgtataaaaatagaccgacgcttggttttggtttattgatttgcgtatatttaatatttcgtttaaattttttatttaaataattaatatatcattatatttatttaacaatgtgtaattattaacaattcaaagatttatacgttagttttatattaatttttagaattaatatttatttatttcataaaaggataactttccgtgaaaaggtacggtgcacacagcaagcttagtcggttagggtattaactttaaagacttaagaaaaccagcacatgggtgtctccgattttcttatcataataacatgctacgtaacttggtatgtaagttacactcgatacgtatcataataacttgttttttttgccacacataaaaaactttttttaattatatttatttttaacccttgtatctttacaaatattgttatataattaatcctttaaatactatcataataaaaagttatcacaactaaatttttttataaaaatattcaaacaatgatttattgtatgcaaatattatttagaatataaacaatcaattcgtcctgaaaagattactcaatatacttttttttaaaaaatgtctctgcggacactgaacactttaattatttttctttctatttttaatatctaatagtgaatatatatcaatttcctaatttagtccttaaaaatcactaataatttaaactagtctttagaatattaattgaaatatagataaagaaattgttttataaattttttaggaagcttttgattatttaaatagatttgtcagactcaatttaaattattcagattctaaggttattttccattacgaaaggtccaaaggaaaaaaaaaaacttttataatcgcatgctcataatcatataaaatatataggaaaaaataatcatcatgtaaatagtgttttcattttttttaatgggcgag

SEQ ID NO: 1925 - DNA, 1070 bp, Glycine max
  Soy_ogl_6438 Gm19:38809631..38810700 Cluster 8
gacttgatgtttaataacgttaaatttatattatatataatataaatgtattaaaattaatttactaaatatatttttattttaaaaaattgttttaaattacatcatcaatgacttgtttaattaaatatagatattttttaaagtagagtccagatgtattataagcaattttaatatgtttatgacatataatattgttataagtccttcataaacaaattgttgaaatatttagagaaaaatattatttttaactcaatacattttcttctgatggataatattaaaaatttataagaattcatcttacccaaatacttactaatgaaatataaattgtccattatagaataaaataataatgtataagtattcaacttcatagcggcggatctccaccctgatcactccatcctcatcagcttccctttcaaaatatatataatgcattgagcagaactccatctttcactgttttaattgcttcttccacgctaaacacaaacccatcttcctcctctttcaccaatgtcactcaccctcttaagcaccactctcaacggaggagagaaaaacaccacgagtgatgttggggttagaagtgtgcttcaagtctcttaaaacacagatctcttaaacttactaatttgaatggaaatgaacgtaatttatctgaaaatttaataaaagtacaaatatttttaaaatgtcatagaaaaagtatgcgatcaatattaaacattcataattttatataacaaattgaatcataattaaaattttcattttaaattatttgacattttacaactttaaaaaaatttattaccctttttataacttcaaccttctctatctaaaatctaaatcgacgttcaacattttaaaaatatacaacaattaatttaattttgtattgtagtgacttttttaatcttcatatagtaaccctaaaatgacatttatttgaaacgacaggagtaaataaaatggccaaattaagtatatatccatccgccccacatgtatttattcacgtaccttgaaagcagaacgtgtcaaatcgt

SEQ ID NO: 1926 - DNA, 1467 bp, Glycine max
  Soy_ogl_1946 Gm06:14619401..14620867 Cluster 8
gtccaaatttgcaaattctgtaacggccgtaataccggcaaacctttcgctcctgaatttcgtaatacattttagtatagatcagagaactagctttgttgtgtcatgaccaataaaaaaaactctatgaaattgtctcctaaataagaagtgcaataatctctagtagatttgcacaaccacatcatatattagaaacaagagccttgaacacatgtacattaatgcatgcatatatatcaactaaaaaggtgtttctaggatcatcaaggtggagtatttcatatcaaaatcatcactgaattctccatcctcattttttaagggtatacctagctaactgacttaagtcccaacctatcttattggcttaagcagcaattaaaagatcgaaattgttataaggttttaaaaaacggtctgcgacggtaatatgagccgcaacatcaatgttttttaactgttttggatcgtaatttgtctgtaatttaccacgatatcaacaaacgcgacaaatatttaaaacttaattcagaatccgaatgctcttatttcactcctcaaaagcatatttgaatgatgagaaaatggcaaaatcttttacttcagaaccaacaacttttttgttcaaaatttctttcaaatgtgtaaagaagtggaaaaaaagaagaaagctaaacagtgtaacaaaagtaagaacaagcttttaatttttacaatctcctagtaattcaggaaaaaacagcagaataaaaataaaataaataactacttaccggtctcaaaggtagacttttgtcattgaggttgcatggaggtaatctttcaatccaactctttggatggtgaaatttacaatcagatttgaacttgcagtgcccggtttttaagaaatagctgcattcgggttcaccaggcctttctggaagctcttcaatttgtttattatagtgaaagtgcatataaattgttgaaggtggacgcagattcctcctagattcgaagataggtggctgtacaaaccacaaaatatgatcaaattgctgagaaaacaatcgattataagggatgattcacaaagatcaacattaggtttcttgttttaaatccaatacatcaaagccaaccccataagaatcaaaacaagcagcaaaataacgaatagtgaggatttactagaaaatagtaagccaagaaaatgagagagcagaggaaagggagggaaaattacaacttggcatgacagcacaatgtgagttgcagaatacttaggccctagaaactattgattaaactggagaaactagcttacttagtgtttacatgtttaaatatgttttttaaatctatcttaacataagtattatttgttttaatttttcaaaaaatcattttcttttttatctaacaaaataaacaaacaattttgtgaaaaaacaaatgtcacacaccatgcacatttttatg

SEQ ID NO: 1927 - DNA, 1010 bp, Glycine max
  Soy_ogl_430 Gm02:7027627..7028636 Cluster 8
gtcaaactcaatggcatgcgtgtggttacgtgtcatcgttaggtcgattttcctttaattgacagtttacatgtataataactaactcatcaaaagttaatcaatttcttaatctctaatgcataccaagtggcaacatatcaagtgttgattgactttttcctaaaaagtgattaaacccggaatttctggagccacccgaatattttgacctgtggctatgtgacaatgaaagaaaagataattgtgttccacctaaatggctaaatgtcttctctattctctacaacccgtacctctaggtcctgtgcattttttctcccagaaaatccacttcgaatgatagcttgatattaatcaatttaaatttaatgcgaagaaaaggaatttacgagaccatgaataaatttgaaaggaatcgatttatctatctaaatctatgtacacatcattaaagtgtttccactcaaattaacactacattatagtattttattagacttttatttttatatgttttacaatccaattactttttttttattaactagtcaattgtatgtatatgtttctttatccctttcatgtttccaatctttaatttcaaattttaattttgaaatttttagttatttgttaaatttttaaatgataaaatttaaaataattatgtttaataagttagaaaaatatttactcatgtagactaatcttaaaagaaaaaacaaacgatacttattcaattaatactcattatttattattttccactcatttataaatggatatttgaatttcccctttacttcttagtttagaaaaattctaagttgataaattaatgaaagaaatgaaaatttggaaaagtagaaattacaaaaaaaatcgaggaaccagctagccacttcaaataaaatgatcagatattaaaaaataaagagagtgaaattggaagaattttaaaaataaaaaacaaaaaattgtgtgatagttttagtaagaaattttat

SEQ ID NO: 1928 - DNA, 1100 bp, Glycine max
  Soy_ogl_5930 Gm18:5045601..5046700 Cluster 8
aaaaaaaaataaacactagggtttagctttaggccagaaagagaaagactgctaccctcagaactcgccattaaaaatcgaactaactcattactcccttcaatatctcttttcagaaaacaaatataaaaaaattcaaaagcaataattcagatccctctcagttagtcactcgtatctttttgtgtatagcacttatcagtcaacaggtcaaggctcagacagtaactggcttcaaaatatgcgttacgaactttttagcagaataggtccttctgaagaaaaggctacagattctagatcagtgaaccaggcctgtaacaattaatgggaagggggaaaaaaatgtaaatatatcaaagagagaaaaattataaatataaaggaattgttaatcaatggtttttagtatatgaaaaaaattaaaagaagtaattaaatatttattgtaaaaattattaaaaactcaaataatataagcaatacaattttacacgtatcaataaaatatttgttacttgctagtatttgtgtaaacataatactcaaggttttaaaaacatccacgattaacatttctgatatttaaatttgagatctatttctttatttctctagtttaaaatttatatttttattttaaattttatgaaatattctttctagtctctcgtgacccattttttttatgatctgaatatatataatttgtgatgattttttttattgaaggaaaaactacaaaaaatatttaaagaattttaagattaaaaaatatacattttaattcgaggaactaaaatagatagatccatagatttaaaagactaaaaatatattaaaatctattctgattaaacatattacaattgtagccacatttatttgtaatttttccaatataaaaaatatcaaatcataattaagtttgcaatttaattaaaaccttataatacttgaagaaatttaagaatttttgtacaattaaattttgaatctataattatataaaactagatactacaccagagagaaaaggggagagaaagaaaaagaagagaattttcaagggtaacatacaatttctcaaaaatgtatta

SEQ ID NO: 1929 - DNA, 1035 bp, Glycine max
  Soy_ogl_6671 Gm20:1240651..1241685 Cluster 8
ttattttcttttctaaaatgatgatttgagagctttaagtagacgggtacttatgaaaaaacttaattataacaattaaaaaaattaaaagataatatttgagttaaaaatattaagagacttaaatagaataattgttaataatagtgaaaatataagtattatcaagtaaaaaaaagtgtacaacttgtgagtatatattttgaggataagggtttctttataaagttaatatatgcatgtacttatttttttaatattcataattaatatttatcaatagaatttatgaaaatcttataaatttgtctggttatttttgaattgaatatctatgtaatctatttgaattcttatgttggtagacatttgcttttatttttttcatttttaatgaaaattaaaagtttgtgccaaatttcaaaaaacagaaatgattgaaaatatgaaaagtaaaaaaaaaaacatggataaaataaatctctcgaacttgcagtaaggaaaggggaaatgagacaaaggtaggggcagaaataggagggtgaaagaggaatgaatttgcctggaagtttcaatttaactttcaagtgaagcaagcaaaatttctagtcaagcataagaatgggggtaagccatgtaagcataatattaactttaaataaaataaaatataaatgaatcaatgattaataaaatttaaaagaaaactttatctacatcactcaaacatcaaataaagcaaaaaataatatccctgattttttacataaaggaattataaatattcaaatactaagaaagagaatatacactacacaagtagcaagtagtagtaaatatctaaatacatcaataaagctataaaaaataatatttaaaattgcaattgttatgtgagttgccccattaacttgagaactcaactcatttaaaccacaagttaaatgaactagactgaataattcatgtttaaatggatcaatattttaattagtcttaacttgtatggtatgcagattgaagaaactgtatatc

SEQ ID NO: 1930 - DNA, 1500 bp, Glycine max
  Soy_ogl_536 Gm02:13870401..13871900 Cluster 8
taggatatctcagtgttatcagtcctttaatatcatattctgcttataaaaaaaaatttatttaaaaaatttattgttatttttgttttctttcctttgaaacgggaagagacttgttgatgcatcaaattatagcaaaaatttatggaaaaaaacaaatctaatgacgaagggcaaacccatgattgttgcctctgtttccgtcatagtatggagtttgttttgtctgtttatttcacagcaaacatcgcccatgcctttgtttaataatctactttacaataataacaacaataaatgaaatattttcatgtggtgtacacttttttttgttaaactatcttgttctttaacttctttaaaaaaaaaaatcgtattctttaactactctaaaaaaatcagttattagtctctcttagattcccttagtaaagataaaaattaaagctttgcaaaaaaaaaaaagataaaaattacagtgatttttttccttcaagataaaaaactgttaataagaacattaaattatatcaaaagattaaattatttttatacaaaataccacttattagttttacagttgttattattgaaaggattttctataattaaaatgatttaaatctgattttaatcagtaatattataagataaattaaataatttgattttgagaattaaatgctgaaattatttaattgtaaaattctaattaataatttcaaaactcaaaaaccgaaaattaatatcaagtttaataatttatacaatactacattacgttttcctaataattttatctaagatttgaaatttctgggtacgatgtggaattaaataatatttctatttttatataataattactattttgataaaatattttttaaatttccattattaattgccagacgttagtatttgtcgaatattgattggaagctccacattattgcgaaaaacattatcagacattctccgggaccataggcagagcccccctccaatcaacaactctcattagtcatctctcctttctgtctcataaaaataacattattatattaatatttaataataatatttaattttaaaaattattaaaactgtataatttcaaaataacagcataagaatagtataagaataaataacagaaaaaccagatccgacgacaatacttcccaaacagatgagttaatatgtcacactaatcattttgtaatttgagagtaatttactaatacgtagtactccttttggaaaagaacaaataatatattattttattttataaaaaaatgctccaattatgaaagattcttcttcggtcattacatgcgtttcatttatacttgacataattaatttatttaagttaaaaataattttaaagaacaaataatatattataaaatcaaacgtaatatgatctaacttgaatccactcatgtacttagctttttgggttaacgatgcttatattcttaaaaaagagtc

SEQ ID NO: 1931 - DNA, 1173 bp, Glycine max
  Soy_ogl_2424 Gm07:38486328..382100 Cluster 8
caaaaagaagttaacaatttcattttttcaatgatgggaaacatgaaaaagatgatgacatattttgaggtacacttgtttgattgatgtgttatttgcattatttgaaaattaagagaaagatctccaacttatattacacactagctatctccttagccaaaaaaaatttccttctaaagaatcaagttccaagcatttttaataggggaatctatataatatgattccctttggtaggctacatctttcaagactttcacgtgattgggtcccgtctcccatatatatttagtaatttttattttgtgaatgaaaagtacaactaatgcaatgaggtataccctaatgcttagttatatatacgaatttaaacgagtggagccaatatattcagtacgtatactctataaatgcatggcatacgaatttaaacgatctgagagagacgtagaaattatttgaagctcaagacttgcctaaaatatatgtttcaaacttaatatctaagtttatttagtcgagttaaattaaaattttaaatttgactcacttcaaaatataaaatttaagttgcatccatttaatttatctttatttttttattttacgtattttcaatccaaatttatttatttttatatgtatatcagttctagtaaataactatgctaaaagattataaaaatatgaatatgattaatatattcttctcttagataagttataagtgatacgtaaaaataaattatttttcatctactaagtaatcataaaacaaaatcaatactatatgtaaattactgtcatgatgtgttatctatattcttaattataaattgcatactttttgtcattaaatatgttaattgttagccccataactggatgacccacaccgactagaaagctttgggtcggttttgttaggatgcgttttttttttttttttttgcactggcctagttaaggcagatattgtggttcttattttttaaaatatatccaactttttatgtttatttaaacttattaagaagattttttttcttttcttaaaaaaactaattaagaagattttttttcttactttgtgcaacgtacgtgccatatatcctacagattaactcaaactttttttattccctttaggtagagaaagatcgtttttag

SEQ ID NO: 1932 - DNA, 1900 bp, Glycine max
  Soy_ogl_4428 Gm13:33479801..33481700 Cluster 8
cctcaacgctttgaaaaattattttcttccatataaagtacttgatatgtgaattttatataaagtatgaaagataagtataattttaaactagtaaaaagtgtctggtataataataataatataatatataagcttaattaagttttttattctataaaaaattctgatttttttatttgatctcttatttttaattttgtttctaattagtgtaaaataaaatattcttttccatcaaaaaccaacaaatgcactattcgataaagaaaaatgctttataaatgactcattttaaaaaataataaaaatgagagatcaaatgaaaagattgtcctttaatagacaaagatcagactcttacatgaatatttgtatcctaagggattaatcattcctaggtcacgtaaaaaatgagaaaaaaaatatttttttttagagataaaacctaaatcctaatacataatgtaaaatatattggtataatttatagaatgagagggtaccaaatataaaaaatgtgcgcaatgtttatgaaaaataaatgcaattacttttttcttctttcaatgattattaattggaaatagcaaacaacacttaaaaaaacacaggatgttattaaaaagatcactataacagtgtacaacagataaacacgataaaacagtgcatgacggatgtaattactcctttaaattaatatttatgcaccatgattgagtgatttgtttaggcccaataaagcaattctcttggggggtcaagattaaagcaagttaatacttaacatgacaaaatatcaagttggttaaataccttaatcggcctaaacaaactggacccacctgtttaacagttctagttgtacacgaatttgacttgctggtttacaggtccaagtaaactcaaacgaaacgatttccacaattacgtatagtatgggagtgattatgacgcatacacatgaatgtcgtttaaatcgtaaggaaatgggttatcaatgggtatagaatcgaagcaatattcgtgtatgcataaaagcagatagtatgtttcagttcttgactttataaggaactactttattgaagctaagtaagaacccactttgattttgttttcaaacctagcagaaatagttttatgggccctgcgaatctgtgtgggtgggattgccttcatccaaaattatattttaagtcaaactacgcgcagcctacccctaacaagaacagccgctagggcggctattttcaaattatacacacaacgaatatacacccatgttttttttctatcaaggtgatgctctctatgttatagtattagaaacagctgttgctaataaaaaaataaactactcccttagacattgtttgccattcaaaagagaaataggatatatggaaataaataaagatatttggtcgatcaaagaatgggaaaaacaatgggctgatcctctaacctttagaatttacttgtaaaatgtaataattatcacgatcttcgaatgggaaaaacaaatattctgttgacctgttcaccaaaaaagaaaaatactccatagacctctttgatacatcttattattgtctgttcactgaattctatttgggcatttggctctatgtttcacgtgacctgaattcatttaatatataaatttcaatttttcactaagaataatgcaattttacttttcgaaaaaaggttcaaacatgagcaaattacgaaggttatgccgtgtaacatcgatacacatgggtgaaatggacttatgcaatttaaaaataagtaatttgttattttaaattcaaaagttagataagttaattatttattttattttattttaaaaaaatatattttaatcatttatttttgaaaatttcct

SEQ ID NO: 1933 - DNA, 1000 bp, Glycine max
  Soy_ogl_5240 Gm16:1927401..1928400 Cluster 8
aattataattttagtactttttaaattacagttttaaagtcatgttttaaacacaggacttctttatataaaatcatgttttaaaacatgattcatctatattatgtaatattttcaaaatttacctatttttataattttttcctaaaattagcccagttatgtaaatttgctgaatatctgagatactattaactttgttaagataggacataacatcctttaaaaaaaaaaactttgttaaagatgggacataacacgtgtcacaaaattataattaagtcatagtatttgactaatcatactcaactgactgtttcagctaatggatatttgagtactattgtactcaaatttcaacatttatttgtttacttaaaagaatcagaatatttatttcattttatttgtggtttaaagtagtgtatatgttaaaaaaaattaattgtttgaactgattcttgcgataaaataattttatctgcctaattgtttaattgtttgtggttatacagtacaattaccgttatacatctattagtgcatttatttcttgaaagtattattagaaaaattaattaatacttaaattgaatatatttttatatttttaccattagagtataacaataaaatgttgttaaaatatcgagaataaacataaaaattgttacaaaatagtaacatatgaaaaaaaaattataagataacgagataaatctatttaatattatctgtttattttctggcaaggttataagataacgagataaagctctttaatactatttttttttttaaataatattatctgtttactttctcatattcacaaggctaaaagtccaagcttataaaatacaaagggcttttttgtgtaaacaaaaaaaatgggctaaaagcctcaatgttgggcatattaccattgggagctaagcccaatttcgacgctgatttttaaggaaggtgcttacctaagtgtagggactttctgcacctc

SEQ ID NO: 1934 - DNA, 1500 bp, Glycine max
  Soy_ogl_92 Gm01:3813201..3814700 Cluster 8
acttcatagtcaaaaatgatatatttacaaaggtcacatttatctcccccagagagatgagtgaaaacttgaatctataacttgttgcaatcctctatcaacatattttatttaaattaaattctaaaataaaattacttattttttattttttataatataaaaattagaaaataaataatcatttcaataagttaaaccaaacgtgtccatatattttatttaactgtaggaaacctacgtcatgttcagattgacgacttaaaagaaattatatttgaatatttaaagaagaatgaaattataaaatattttatagcaaaatataataaattattatttgattatgtaaaattttatgatgaaaggacaagaaaaaattctattatttcacactcttaacttaaaaagaaataaagaaaaatattcgatgagtgtagcccagtgagctatatatgttagatttgtggaagaatgacttgaatttgatttacatataatataatatactcataaagaaaaatagtaaattttaagtgtgattaaattttaaaacaaaaattaattttatagtcaatctatttagattaaaacttttctgataaactttaggatcccatcgagccaaaaattctagtggtgattaaaaaaaattgtatggactcaaattagtaaatattttatgcattgcatgaattatataagttttgatatctgcatcaaattagagaaaactttctattagtatgatatcattccactgcctttagtcgttataaatccatgaaaattaagtaaaatatgtgaattattgtaaagtacttttatagaaaaaaaaacgtaatgcataatttttattctctttcttgtatggagaatataacataaaataaagacaactttgaatagtttaacctacttaaattttgaaattattcacttgaaatcaaatttgaaaacgtaattcaatatttaaagaagtatttaattgtccattgaagcaacctgagtgtttacaaataataattaattatggtgaatttggctttattatgatgtctccttatctctgtcattaattcgttaactattattttaataatttttcaaccacatgactggttaatcagatcagtaacctaactaatggatgttttaattaaatttatttaaagtgacaatgcagaatgatggaaatgatatttcaacaaataagtaaaaagaagacctcaattactgaagagttttggtggaataaactttattctttttttgtttggatttgaatgaatatttattcttgaaattaagtatattttgagatgctaaaacaagaacaaaaattgccccctaatttagaggtaggctccatttgagtctgttctaatggaagcatggaaacttcaaacaaaaactagacatcaatcattatcttcaacactatctttctttgtttgaagctcatgtacggttctctaattagtcacctaaatggacagc

SEQ ID NO: 1935 - DNA, 1041 bp, Glycine max
  Soy_ogl_2999 Gm09:4846301..4847341 Cluster 8
catacaaaaggatgatacgtataatctgataaattggcttagtgtagattacctttgccttttgtttttcatttgatgaaaaatagaaatacaaatctcaattacttcttataagaaagtaattatcaatttatagcttatcatcttttaattatgctttgttctccccgtcttcttattttttaggttattaaacttgtgttcataatcaacatttcaaaaatataccaattgttcacttgttgtcactcttagattaaatgatcttgataacattccaaaggttggtgtaagttcaattctaaatgagaacggtctatttaacaaaatgatttgtttttaatttttattatatgtaaaaaaaattaaactagtgataattacatattgtaagtaagattaacttttattacaatggattgagggatgagtgtaatctctattaacatgagacaaaaaaaaattatcaggttcactattgtgcttgataggacatgacattgatttaggggtgacacttatcaaagtttttagagtgaagcttgataattcttttttcatatttattaaatctttacagtaaaaataagtagttgtgtggtgaacatgccatgtttgtattttcatttgattattcgggccgtacatgttgtggataacttggtacaaacttaagtatgtgcacttaccttctacaaaaatacctacatgagagagcattggtcgtcgaattatattaatataacctattgaagtcaaattgatgttatataatataaaacatagtatgaatgaatctgtgcatcacacgggatttttgcaagttttcttcttaaattaagagtcattgaatatctcttttacttcccttatttacatactagtagtcctttaaggtttgttcactccaataaagaacacaaacaatttatttttgtttttaataaaattatattttctcctattctaaccttgtgatttcactctcctaactttatctttatgcaagaaaatatttattttttcataatatcaataatc

SEQ ID NO: 1936 - DNA, 1147 bp, Glycine max
  Soy_ogl_535 Gm02:13833354..13834500 Cluster 8
tgtttaatttttttacatgagacaatcatttttgagacgaataaaatgaatgaaaagttcttactccaactatttaatgcaactattttttattacttatttttttcttttaattaaaaaaaatgttatcctattaaatgtttacataaaaaatgatgaattttttatattgttttaactatttcttataaatatatttaaaaataacaaaggtatttttttctcaaaataagtgttaaagcaaaaaacgaaataaaaacttttttttcaaaaaaaataactccttatgtcaatagatgtagataattatcggtttaaaaaaagatataaataattcgatataatgattcctaaattcataattttttttttatagaaactggatcacattaactcattgataaaagtctggacaatacaagtaggaacataatgataaactttgaatctagcatgaaatattgccccccttgcaatagagtggacaacatcatttgattgcctcataataaaatgtatcctaatgtttggattctgcacaagtaactttctacattcagaaataatggaccatatctttgtactatctatagcagtattatttaccttatctacaataaccttgcagtccatctccaaaatgacacgagttaagccaaaatcaatcaaccatttaattgattcctaaatttgtatttgaaaaattatacatattgatgtgtcatgcattgaatataatttatgtttcctattaatattcctttttttcttactgcaactaacattctttttttgagtgtattcttagctttattttgtagtacacttttagccatatacaagaatgtgtaataatcaatgtcattattatacttatttatagtgggtaatcaattgtattaatttactattttaatcctgtcaatattttaaagaatccattatctttacctatccttgatcatgacaatgagagttgaaaggtgtgcttattttaatttgattagtgaatttgtttattttctactgttagtacttagtaaagagtcctcttgaagagcttaccaaacatcattttcctaattcctagatgaatttggtgtcaattaatctgaataacattttgagaaacaagattacaaattcg

SEQ ID NO: 1937 - DNA, 1100 bp, Glycine max
  Soy_ogl_4924 Gm15:8778401..8779500 Cluster 8
ggttaaactcttgattttttgttggataatccaaggctaagctcttgataatatgtaagtattgaatttgaattttgtgtgcaatttaccaagggttaaattactgagggctaaacccttagaaatacgagagtaaaatgacgtcaattttttttatctattaatctattggttactgagggccgacgtacagttactaaagttgtattcctcaacaattccaattttgcataaccaaagactttaaccctcgcaaatcgcaatggtcatatttttaatttaatattaactaaattaacaacattttcttcatatatcattgttccaacaatcaatataaataaatctaaaccattctgtcaaaaaaaaaaaaaatctaaatcatcaataattagtataaataaataaatctcaacactcatttataaaaaaaaaactattttgtatcttggatttaaatataaataaatctaacaaattttatctttatttaatgaaatcattctgaaaatacctttcatttaattgcaaatctattttaagaactttattttattcatgatatcaagttttagtgaacaataattttgaaataatctttttttttagattaataaacttaaatgatttcaactatccttcttaatcaatgtaaaaataattatttttacttatatatgagttcagaggaaatactaattaaataatagatcaaagtcacaattaatattttctctaaattcatgtataagtcaaaaaattatctaatatgttagacttaaatataaacaaatataactaattttatcctatttaatattatcattcctaaaacattctttatttaattctaattctatttttaatgacccttttatttataatacaagtttcattgaagagtattttagaaatatttttttttcttgagattaataaaattaaatgatgttaattaatttttttaattaatgtaaaattagttatttttacttatatatgactataaagggagtgttaaacaacattaacattaatgaaataaaaagtatttagattgcaaaaatttaaaataaaaacaagggcggactttacttcaa

SEQ ID NO: 1938 - DNA, 1807 bp, Glycine max
  Soy_ogl_5946 Gm18:5551548..5553354 Cluster 8
taaaaatatgagttttatttcattttattattgttaatgcaggtttcactcaattttatctctttttcacctacataagagagggtaaaacaaaccatgaaatgtgtaaatgctgtgtagtgcagttggccactattgaccttgatcctattgaaactaagatttttgccaagtcatccctggccataatgagagaaaaagggtcaaacactttcgccaatttcaaattaagaaacttgtgcaatgcacatttgttcgaatcacattatattaatgaagttggacttggaatgtgtgaaatttgtgcggtatagaaatggtttcatgtgctaatatattctcattatatattaatcaggttctggttgtatgcagctataaaatttaagtgcttaatttttaccaatgatgatatgactgatcatctatttcaacttttgggaaatgatgtcttttttcccccgagtggcaagaaaggcatcaggtaagaaaagctcttttttggagagaataattttctatcatatctttgtacttaattgctattctagttttatacatgacttcaattaaaatgcttaaaataaatttctatcataatgtgtcatattttttctaataattattttgaaagttatatttaaaatatgttttaattaattgatgatgaataaattttcagtcacaacatgaaatgaaaattaaactctatgcatgctacataatcaatatttttttatattccacattactgtatgtttgtttcttatttttaaaaattgcttactggttttaaaagcaggaaagcaaaaagatttgtttgttaagattagtttttgaaaactacttccaaatctaatacattttttttcagtttttaagattgggtatgaccacaatatctaggcagttttgacattcagcaaaaaaagaaatccaggcagttttgactttttattttcaattttctattttgtatgtttttccttatacttttaagctatgtttggattgtggtagagaatgaaataaaaatgatgataatgatatgatgtgatggcatgaaataaaaatgccattctattatttgagtattttataatgaaatgaaacagattttattctattgtttgaaaaaaaaaatgacagaacaccaccaaatgatgcatggggtggatcaactagccaggaggatatttgtagtttaggaaaaaaaagatagaacaaataatttattaattactttttaattctcgttatttttattttaaatatatttttcttaggaggatgatgattaagttaaatttacaacgataaattatagtcattttaaaatctaaaagttgttatatcaaatgcatcctaaattatgttctatttctaaacaatgaaataaaatgaatcacgatctgtcttcttccattatgttctatttctatttttatatatcaaacaatgaaagtacttcttctattctataccttttcattccaccatgcatctaccgtcaatctaaacatggccttcatgtcttcttccttcctttcttttctctaaacatcagctcctaaaagtatttatataatgagtagttttgaaaaattagagataaaagcacaatcaagcaaaaacacaagcaaactaagtatctgcaataaaattagctgatttttttatttaacttttgccaacgtatagcattacaggtctctgcaagagaaaattgtaaacaatgctgaacaagtgttgaaattcatgaactacgtacaaagagcatgaatcgacttcaaaataattgttttta

SEQ ID NO: 1939 - DNA, 1041 bp, Glycine max
  Soy_ogl_30 Gm01:1698260..1699300 Cluster 8
gtaaagtaaaataatattagataagagtgtgctagtaaaccacttaacactttagaagcattgtcctcttacttgcatattttttaacttatgtctaactacttaacgtggacccgttctcaactaattctcctaaaagccaattgtttcgacttagttgtgacttgtggcttgtttttcatttttagtttgaacttgtattttaagtttgggtctcaaaagtgtagggtttatcttcatttataattaaatataaaaaaaatattttctaaaaccgaataaatcttgtttttattttatccaaagttcaagttaaagacgtgaataaataaagtaagggaaagaatattgcacggaaaaatatgtaatgtacaggtcaggagagtgtgaaactaatggcttaacggtttaaaatttgttggattaattaagtttcaattattaaacttttttaaaatttaattttcggtttctaaataaaagtttcactagtcacgattctttaactttttttcttttaactatttagttcctaaacaaaagtttaactgataaagattcttaagttttttttaaaaaaattgatttttagtcttgtaataaaatttgaaatccattatttttaataatccaatgaattttaaggtctaaaaattgaaatttttataagtttagagacattgagcagttaaatttttatctaagaactataaaatttaataggaaaaagttaaaaaattatgataaatcaaatttttgtttaagaactaaaatccaaatttttaaataatttaagaactaaaaatttagttaacctaaatccttttaagataaaattgcatttcttcttataaggacatgaatcacatgatgagttgaaaatgtccttggaataaaaatggaagaacatgtcatcctcaaagggtaacatataagaacacctttgtttcataaaatcttcttatatttctatgaatgatattcttagaaatatagcatgaaaatatcattctcaagttttttttttaaaaaatatatatt

SEQ ID NO: 1940 - DNA, 1210 bp, Glycine max
  Soy_ogl_5000 Gm15:11473101..11474310 Cluster 8
ttttgtttatagcaatgtgatattgttgtctgtcaggaaaattaaaatgattaaaaaaatgcattgtcgatgtcagggtgaactagtgtaatgaagagagaccaatttttaagtaaaaaatgcgtagcatgggaaacgagggaccacgatcgtggtccgtgaacccttgaatctctaaaaaaaacaatactacaaaacaggtgaaaagttgttctaagtttcttacgatcttaattagctttaatggattagaacgtgttgcgtgtgtaattcattccctgaaatattttattattattttctcttctatgtattatttttctgaattcgaaattcttttattatgttttgatgtttgaagaaaaaattacagcaaaaaaaattaatgaactaataaatttttaagataaataaaatattataatttcttatccagtagttatttagcatacaataaaaataaggaactacaacaaaaataacaaagttttggattaattgaaatgatttttttaagattaattaaattaacgtttaaaaaacaagataaagtttaagagataattaacataaaaaaataggatgtttatttaaaaaaggataaattttaatgattaattaaaacgaaaataaagtttaaagtgtctgttataaaaaggataaagttaagggagaattaattctctttccctgaaaaagtactcatactttaacctaaatgcatgtaagtaacaggtaacaactttaaaatcttgggtatttattatatactcatctatgaacttgtacgtattttagttacctttttttaagttaatattttagttaacttgaacatggtttcttataataatttggtttgacaaatcaataaaacataaatgctattataatgctatagcattaacgaagaaagatcaataaaaaaagaataacatttatttttttagaggaaaaatagaatttattaaaaatagtatataacttaattggaaaaaaataaaaataatataattcttaaattatataacttcataaacagaattatctaacttaattaaaaaattatttaaaaatctttcgatttctaattacttaatataataaatatatcatgtatattagccatatctttagtcgtgtggaatctcagccatatgatccaattgtcctcaattattactaaggttaaatattacttttttatatc

SEQ ID NO: 1941 - DNA, 1394 bp, Glycine max
  Soy_ogl_2274 Gm07:8105507..8106900 Cluster 8
aaaatttttgccacttaatcctttaagtaagaaagtgtccatcaatatcaattttgctgcaattcagtcagcccatcaaacatgaaaatgcagcactaataaccgtctaactaatcaacatatataatgtcatttcttcttcctctccattgttagagtttgaaaaggaggtgagggggaaaactttttggtcttcttcctcgtttcctcttggtcttcactctccattatgatttgaaatgatatgtgacatatagcacaatggagacgcgttgcctcttgcgtctgtagtgtttggagtttgtgatggtgcgaaacttatttgcactgtgggtgatagttgtgatgaattgtggctactttgtggaataattaatggtaattgggttgcagtgtagaggatgtttaagaattttgtagtgaacacctcgatcgtcgtcgctttcaaattgttggtaaaattattaattacccacgccttcaagaaattttagatgaaacacgttctgcttttttatttctaaattctatatataaagataaattgtaatactattatcatctaaattttaaaaaagaatcctaaaataaattaaaacaaattgataaaatctttaaatataaataatgttaacattatttttttacgttaaaatcttgaaacacgttctaacgatttgaaagataaaaaaaatccctaaaaataactccttctaaattttcactcactttatttacgttgaaatttgaattatttttccaactttaacatttattattatttttatccaaacacatcgtattatttattatacttaattgcttatttcttttccttctctttgttaatctttttaaatgctttgtttggcggacaaaaaaaattgaaaggaggggagtagtagatagaatatattgtttgtttggtttagaagatttagagtagaaacaactttaaatttttttagattaccagaatatttttttttgcttatctttctatctattttttcatctcttcagtcaaacacattttgtttctattttatttcttatctatttttactattttatccaacatatttctgtgagcataagtgtcaacaagacttcacgcgtccacctatatcattttccttaagaataagagaacaaactatatgttttcctccttaattttccctaccctacaatgccatttgacgatcatgtcaacagtaattatcattggtttatgccattgcatatgtttgttaacaagagtggcagagtgagaggaccacataaaattcttcgcattaaagcatttttaattttttcttaaaaaaagaaggttacgtacgtaaaaggccaaattaagtaccattttcaaccttttttaaaacatggtgaac

SEQ ID NO: 1942 - DNA, 1022 bp, Glycine max
  Soy_ogl_3516 Gm10:43436833..43437854 Cluster 8
gggaattggctaacagttattttttgtttatttaaaaaatatgtttttataatattatatttcaatgtcaaaaaattactttgaacttccataaatttactaaactatttttttctttaatttggttcaccaaacaaataaaaaaccagtttatgaaaatattcaagaatataatttttaatatctttcttatataaattagaatagttatcttgaacaagaccataaattttaattctataattaaaaataaacatttattttgcaaaaaaatatccacattgatcatgacatggtttggagttaattttgtgattcatagctcgccacgaatttctcaaggttaccggaaatcgggacacagcttctgatcgagttctgaactgttttatttttttttcataggagtatatatttttgctctttcttcttcaacttcaagattagagtatttatttgtcacttcttaggtgatgcatggcccatgggattctgtgtctgttgttggcaatagtaaaatgcaactcgttgcatttgcatgggccacaactttactttcatacgtagcttttgttcagaaattaacaaactaattctgcacctcgtattgaccaaaaaagtaaagaagaatatttttcatttgaaaaaataaaattatagattaataaaatactaatattgaacaaaatttaaaattaattaatgctcatatagctattttaaaaaatatttcttttgctgattaaaaaaatgttgtatattcaatattaatttaaacaagatttataatttgtatttgctattttatttttttgcaataattaaatattctcatttgaacaactttctgtatttatctatctatctactgtgttcttaaaatatcaattgagttattgtgttgaaaaaatatatttttttggtatgtgttgaaaaatgttaaaaaaagcttttaccaagttgtggagtgaaactcacaatttccttaaacttgcattaattaaaaataaattttctgtacc

SEQ ID NO: 1943 - DNA, 1100 bp, Glycine max
  Soy_ogl_5259 Gm16:2791801..2792900 Cluster 8
tttattataaagtaaaatattttttttttgaattttataacatagcttttcctataattttaaatataaaaacaaaaataacccatcattgcgggtggaattatagtattcttactatttaattataattatcattttaaattattttatatagacaaataaaacctaataaatagatgaagaaaaataataattttataaaattaaccttattcatcgttaattcatttttagttttcattacttatatcattaatattataagagatataataagtagaaaaatataattaattatattaaaaaataaaaatgacaaatttttttacctgattatcatatgaccgagggaatattaataattaatacaactatttgtcactattatattaaatgtcaaagatgcagtatttaaaacattatctgttcaaaccaaatttttcaactaacatttaatttttagattattagtagtagttttaaaatccacttaagaataagctaaataaccatcttatttgtttcaagagggaaaaataataaaaagagatgtgagtaaatttttaattttatgaaagagtatttaatgtagtaagaggattagtatatgttttcaacgcttgcagacaaaaaaaatattgataaaaatataaaattatatagattttattaatatagagagaccaaccaagtaaaaaaaaaaaagagatcaaccaatcaaatggtaaagagttaacacaagtataactaacattaaatgatttttaattttttttgacaaaattaaatgattcttcaataattagctacaaatttgcaattaatataatttctactatgttgaaccaatcattgggcatcgagatcctgctttgagattttcttacgtatttggttcatcaatcttgatgatccagatttcgtcaaacacatttcccagtctatataaacggggtttcacatgtctggatatattgcaatcaacttttctctcttatacgtcaaaccatattattaaagctattgggtataatccaaagttggagccttacaaactaattctgaaaggatatgatggcaaacctctgctgctagttcat

SEQ ID NO: 1944 - DNA, 1400 bp, Glycine max
  Soy_ogl_5625 Gm17:10045101..10046500 Cluster 8
aaaataatatacgtgagaacaagatagaaacctgataaggtaaatgtttagaacggctcagctaggtgcacaaaacatatggaaaaaaagatgtataaaatttgctgagaggtattttacactttattttttcttttttttatacagaaaataaattgtataaaaaattacctctctgcaagcaaattcgtgtaatactgtaattgcaccatcattatgtaataataatggtatcttatatatatataggcgaactgcgaatctcatctcacattaagtggtatggattttaggcgatcgagaatattatatcctttccatatctttttgtatgttttagttttttttttctttctaaaacaattgatattttagaatttttggtagaataactcaaattttaaaattcagatatctaagatatttttttttttcgaaaaaatatattatcttatgtttaggatttgttaaattttaaagatactatttataaattaaagatttaataagatgatagttagtgaatttaaatatgagaaaaatcattatcattcattttttaatgtgtgaatttaaagatctttattgtgaatccaaggaggagaactcaaatcagattaaatttaaggtaattatttttttattatcattcatttttactaaacataccgcccatttttttttttaattttgtttttcttttgaaaacacgccacctatctcatcacgtcatcacatgcctctcaacaaaaccacatcctcacttccattaaccatatatttcccgtttctttgataagaggcaccccaatttcatgcacacagtcttagacccttagattagaaaaaaaaaatagtactatctatctacttagacaaccatatattatttttgggttgttaatttttattgaatttttggctagttgagctgctaatgtatataactgacgaccgaatgcatcacatgttgatcttggtccacttttagaattcccaccagtgtaatacatttaattgcgatcgtaatttttccaaacacaaaactatgttctccataaaaaacacggaatcatcatctcccgactcccattacaaatcacctaataggatttccaaagcgtacatgccagaaggatttccatgtgcaaaattattcaagcttttgttgtataacctcttggattgtcagttaaattaataatcaataaattttgcttcatactactactgagttcaataacaccaaaggtgacaaagagaggggggggttaagtagagatcgagagcaagaagaaaaccaaaaaaagagtgtattctcgacgatagagttttcgactttgtttgatatgcaagaaataaaatgtagagttgaggaatgaaggaaaaacttcaaaatt

SEQ ID NO: 1945 - DNA, 1003 bp, Glycine max
  Soy_ogl_6873 Gm20:39612598..39613600 Cluster 8
tcatgcaatacaacttactgcacaagccaccaaaagttgttatccgcagacttttccatttcccttcaatttctaatacgatggatttaaggatagatttgattacgtggaagataaaagaataaaagaaaattattaagaaatatttaaaattaaaatagagagaataattaaagagatattagactcaaatcatacttattagtatatgcatattaaaatatattaatatcaattattaatattatcatatcaaatcccaaatcatacttactagtatatacatattacaatatattaatcttaatgataaatatatgaggaaaatcaagagtgtctatatgaattcatctaaagattcatgatagtatatgatgaagttaaaaattataaatttttgtatgaaaataatagagatattctttggttcagagttgaaaaaaaaaatcaaattaattaattttaattggctcaaatttttaaaacaaagaattgtttaagttgaatcaaaccaatccaatgatcaaccaggttagtttgattagatcattgaatatatgacaaaaaagtaaaataaaaaacaattttaaaaaaataacataattttatcctaaattgacaaataataatgtcataaaataatacaagcaacatatttaaatgtaattgacttatatcaactaaataataacaaaattataaaaaaatagcacatgaataattgattaaatcataaaactctatctatatataatatataataatagaaaggtaattgtgtgagagggtctctccacttatttagaaaaatttagtttgataaaatgttttttattttcattttatttttaaatttctttggtttttgaaatgaagctaaatggttcttgagatatcgggttaatggtgatacaaggcacaaactagaatgtgaaattgaggaaaaagttgaacaagatgaaaaagaaaaaggcgagaaagcatctctcaatcatttttttta

SEQ ID NO: 1946 - DNA, 1008 bp, Glycine max
  Soy_ogl_713 Gm02:47271360..47272367 Cluster 8
tactataaattaaagtaactatccttatctaatataagcctaataaaccaaaatagggataaaagcttatcttgtttctattctttaatattttatcttgttatccaatatattccatcatgatcaccaaatgaactcatttttaattggtttattttgtgaaattgagtaaaaatgacaatttaaaggtgtaaaaaaaagggttagaaagaaaaaaaatcaactatagaatcaagttttcttaattttaattttcaatcagggatacttaattgacttgaaaaacttgagaaatcaatttactcttaattggtcaatagataaaaaaatgggtaacaacttctttctctttaattggaggaaaaatatttaatataattataattttttgtatttaattaaataagagaataaaaactgttttttttcttgtttatttttatctcaacagtagaagtgatttggtgacgaaagagtggttaattcaattaatacatgcatgtcttccttaagcaagtcgtgaattcgaattttctatacataaaaaactattagaagagttaatttaattatattgtagttcttctgaataataaggtttagtgcaacactttcgaaacaaaatggcccataatacgaattggctctgaatcccaaatatagaacagttcataacaggtccattttatcttcatcataatgcaaatattcttaacttcaataaaattaacttctgtgaagaatattcatagtcctcgatcaaaagaagaccaataaaagagaattacggatgcaataggttcacatcaaatatctattactagtatgcagtaaaaaaaataaaataatatttcatccatctttaattataagatcttttaattaattcaattaattatattataatcttaaaattattcttttcttatctctctctccacttaattattcttaatgaaagtttggagagaaaaaattaaataaaaatatataagaaaagaattatta

SEQ ID NO: 1947 - DNA, 1107 bp, Glycine max
  Soy_ogl_1716 Gm05:37797694..37798800 Cluster 8
taaacacaccacaattttcaattgaattaattaagtataatatgagtgttactttttttttaaaataaataatatctatatatattttaaaaattttatattaaacgtgaaaatatatattcctaactttactttgtaaataacaatttgaaaatttagattttaaagttcaccatatgaattttcaaaatgtcaaagtttaagattgtcactttttttttcttatttcacatgcgtatcattttcgtcatttaattatatatggtcttattaaaaaaaattgcacacttatatttcaattctttgaccttattaatgtgatgtaaaagaaaatcaagtgtttgacaagataattagataacatataatattttttttactaatgataacttataagttaatcgactatcttatttgacttttttaataaactatcttactatttgactaaaaataatattctatagaagtgtttgattaatagttcttaaaaaaatactactagcttacgaattttctttaaaaaaaagttataaaattatcccaaatgaaagagaagatagaaattagaaacgcatagatacagacaaaatgtaataacatatatattaaaatcaaacatttaaaggctttcgttattacatttcccgtcttcattgatttgttcgttggctctgcactctctctctctctctccggcgacaactgtccaccttgtcttcttttttctgcttttatcaataatttatttttttaatatattttctataaatctaagatcatcatgacaaattttggccagacttggaactatatacctgtccttttcgatgagcattttccctccaaatactgtgtccaaacctctgagagttttatattgtttgtgacttcaattgactaattatcttattttgttggggagcaaattttgctgtctatggacggtgaatgcatgggttgtcatgctagactatttcaattgataaaacaagacagaattattagactattttgaggaatatgcaaaacagtcaaagattgtgaaatgtgcaccacaaatgctactgctaacctgaaatgaatgaacagttgttattgtgaaaa

SEQ ID NO: 1948 - DNA, 1220 bp, Glycine max
  Soy_ogl_3314 Gm10:2099781..2101000 Cluster 8
ctttgttgaaagatttagttgatttttagtagaattttttttaataacttttttttcatctacttgaacataaaatattgtttaagggatctgatcccagataaattcagatcaacttaatgtttagtcacttgtatgaaatgattactttaaaaaatcaatataaaaactaaaaaaattgtctcaattgttacacgagataaaaatgtcccatggttaagaaagtgttttccctattttatttaattattcaagtaattcaaaaggccaatatgtaaaaaaaaatactatgtaattcaaagtttatgtaaaaaaaaattaattatagtaaatacaacattttaacatgtataaaggggtgcaccctttagctcgttcaatgagtgattttgttaagttaacatttttttactgaatttgttaagttaacacatgaaaggtgactttatgataattttaccttaaaattataaaagaaataagaaagacataaatttttttcatttgtttcttgtataaagaattggaggtagtaattttttttaaaagcgatgatttagtgtctgttttaattattgaaaaaattatttcaggtcaaatatatttttgctctgtttgaaattttcaaatttaagttttagtttctaaaaaaatttgtcaattttttgtccatctaatttaaagtgtccatttttcattttaagagctatttaaatcatttttcatccctcaagtcctatctaaagcactatgaaagaccaaaagtgatgaccttcatatttaaaggatgcaaaatggacatttcaaatttagaatgacataagaacagacaaaaaagtttagagtgatcaagaatatatattttaaccacaagttaattttactcatatatgaaccaagatggagagtattaagtcattaacaacttttgtaaaaaaaaaaagtcattaactaacgtaaaatttatccatatattaaacatcggtcacttactacaaatgttgtatgttaagactaggttgttatctagaagtaatgtgttatatgacttgatagtattaaatgagttaaagttgtaattatatcgatgtccagatatagtgttaaattagtaaaaatctttatatttttctagacaacccaagtaaattaaagaaattacttaagttatgcaagattagattctctggaatattagtactatcacaattaaatttatg

SEQ ID NO: 1949 - DNA, 1100 bp, Glycine max
  Soy_ogl_3505 Gm10:42929901..42931000 Cluster 8
acctgatttaaatgttgtgtttaagtaaaattagttttagaacaattttgtttttacaaaatttattttcaaaatgaattttaaacaattgagccaattttaaaataacttttgattttaaaatcaattttaaaattatttttcaattaaatattgttttcaaaatcaattttaaatcaaatatggctttgtctataaactggaaaccgattcaaaatgagtttttgtttttgtttttttgttttttacgaaccacggatgtcttctatagaagacaattattttgaaaccaattaagatcaccattccaaagtgtttgataaaaagtttaacttattttgaaaaatagttttgtttagttttaaagtttaatcaacatattctggtttggttttatacaaaaccaaattgtgcacacacttaaaagaggaaataaaaagcaccttattgaatttgtaaatagaagagagagaaatataaacattatattattgtatctttataaatattaataaaagaaacaagaaataaaataaagtttggaacgatttatatatttgtactttaactgcaaactttgactatatatctgaattgaaatgaagtaaaaagataagttgcatagaattcgataggttgagacagtagttgagagctaaaccactgacaatgaattaaatgattgtttgtattatttgatgaatgtagcctgcatatataattggtggtatgcatggatggattaggattatgcttaaaattttcttggtggctataattgaaaagtttgggtgagattctcttctcttattatattatgggggggtccacaaaaaacagaagaaaaccaaaaccatcgaagagaaattcatcaactatggcccaccgtcttgagccctcgggtttttatcaacttgcctatatatgtggtccattccaatgcaatgctataaggactcttccgtacatcttctatatgcccaataatacggaactttgttctattcaccacaaaaaaaatatatgctaactcggatttcaatttcatttttatagaatactatatattacattactgtgtcatgctatgattgaaactg

SEQ ID NO: 1950 - DNA, 1300 bp, Glycine max
  Soy_ogl_3742 Gm11:5070501..5071800 Cluster 8
atattttcaatcagattcttcatctaaagtattctcacatctacaaatctacctatcacaaatattcttttacaaaactctttagactttgtcatacaacctttctacaaactcacaattgattcaaataattaattttgcgtaacaacaatttagaaggacctgattaaaaaaaaacacctttttaagatactaaatttttaaaaaatagttcaaatatctaattaaaaattattaatgagttcaagaagttacggaataatttaacctaatatttattttctctctttgattatattctcatacatgatgcatcttttatatttactagatgataaagtaaatattaataaaaaaaaatgaagtaatatcaatcactagtgaaaaaaatcaccactgaagattaaatatacatacttaataaataaccaaaagttagaacattagttactaatttgctcattcataattaagatttacttatttactttcctctcactccattaaaagaatttaataaaatacactttacatatgtatataaccaagatataattattttgtaaaaaaaaaatataattacccataaagacaaaacacaatacagattttgtttttaaaaaaaaatctgttttcatttttcatcagaattcgtaattgataaagtacttttttgaaactttaatccaaacataatattagttatccgcttgatataaataacacagacatatataagtaagtatcacttcaacttcttgacagttcttgtcaccagctaccatacgcgctgcaatgagaatgaaaaactaagttagtagtctaggatctctaatgagatttgagaaacaatttctggggtccatgcccaactgaattattttctgtgggttccacgagtgcccatgaaattaaatgttatatgtttctactatgttacatgcagatcaaaattcattgacgccgacatatgattaagcccgtgactggtgctgtttacaccatcgaataggttccgtgcagtttggttggaccacatagacaaccaactatgtatatttcgatatgtgtatctcatacactgcaaaagaaaatattatatactattgaattgatctccattagtataatttttatctatcaattcaattattaatataaatatcacgtgtttaaccatgttagtaaaacaattcattatgctaacaaaaaaattatctatgtactaatagtttaatttgtgttaaaaaaataatttaacatattataattcattaaggttatgtttaataaagagaag

SEQ ID NO: 1951 - DNA, 1158 bp, Glycine max
  Soy_ogl_5536 Gm17:5665401..5666558 Cluster 8
tacgtgttgtacgaaaaatatcatgtgaataaatagattgaggaaatcccaccgaccaccctaccttctttgttgaactgtccacaatccaaccattaactagccattcacattattagctagcttttcctaaataataattcaaccacttattaacacgccagtttaaattaaatgctaacatttatatatccccaaagttacattaattactccattctttgccgcagctccctatccctttcagatcttctaatttaaaattataaatatttatccaaattctttttttatagtttatccgaattcttaatcaatagtatattttcttaatactaatatatattactcctcaatttataccttataaactcttttaattaattcacattcattaacaaaattaattaatataattaatagcattaaatttattaataatttgtattagtttattaaaattattcttaaaattattaggactcataatttttcttttttcatttaattattttctcacctaaaattaattagtatgtactagtctttctattcaatcattttaagagaggtaatgtatttattttttaatatataatatttattgtaaagtaactaatgatatttgagtaaaaaaataattaatgtaaaagataacataaaaaaatcttataaaaaagactaaaaaaatttaaaaaaaatcttatatttaaggtaagagagaatagtatataaaaaaataatttatcatgtttatcatagtagactctagttttttactatcatgcgcatcttgactaagtcagcattagataagagtcaacatattttttaattgtatcattattaaattttcaaaatcagtaaatgctttatttttctacctctttttaaatattttttatgaagttcatttactctttccatttagtagttgttcttttttttttcttcttctaaaaaagtgaaaacattttcttttctaaaatgttcttaccatcatcacattttactttacaatcaaacattgatgaatttacattattttggtaatgtgagaaaagaacgaaaagagcagttgagaaagaaacaaaaacataactattcaagctggatcaaagtgccaatagaatccggaactaattaacaacagagtga

SEQ ID NO: 1952 - DNA, 1032 bp, Glycine max
  Soy_ogl_566 Gm02:15329269..15330300 Cluster 8
ttaaatttattattacgttacaactaaaaaagtttattgatttaaaatgtatgtattttttatggtgagaatccttcagataaaattattatgaatgataattttttttcgatgtatttaatgtataaaatagtttattttaacaaaatttaaaattaaataaatctaaattaacaactttacctaattggtaaatagttgaaatcttttaactacgttgatagagatgtaattctaggctatatatatcataaacactttgctggcagagacatttctatgttttaaaatgattaaataatctttgaccattagtttgaagatattagatattgttaaaaaaaattaaataaattctagcatgtataattgttaggttgcttggtcgagggtttaaatcctaaatttagatataaaataaattaggttgaaaaaaatatttatattatatatatatgattgtcacactgatgagtcattatttcattttaatttcataatcaacaaaaaataataatttattatcatccttatattacgtctagaaataattcaatcgttatactacgtgctcgtacacacatgtaacaacatttgaattactctagcaagattcattcaatattttttttattagaaaatgttagttattattccttatatcttaaaatgactaatgtttaatgtttttcacaccgaccaaaagagtaagtgtttcaagacaattaacatttataaggaaacaattttattaaaatatccttgttatatctcttaatttcaataaatgtattattaagtcattcaagataatattatttattatagaacaaaattaaaataaatattttaatatctcattaaaaagtgagaatattaattcacctatctctccctcccttcattctttaccactaaatcaaccttacatcttcaaattttgttaatcttatacatattgaactaaacttaattacattttccgcataagatttgttagttggtatctatgcatagttggaaaatgtaatt

SEQ ID NO: 1953 - DNA, 1099 bp, Glycine max
  Soy_ogl_4500 Gm13:36968901..36969999 Cluster 8
attcaactaaatgatgagattgagtttcgtacttcgctcctgaagcaaggcccgcaattatattgatgataacacacatagagttaatggtatttcataactaatcgattgagcagctgctcgtagaccacccaaaaaggaatatttattatttgacccatatcctgacataagaagtccaatgggagcaatactcgacatagcaatccataaaaaaacaccaatattcagatcagataaaacaaagttatagccaaaaggaattaaagattattatttatttattttgaagaaatttgatttgaatattatatcctttactaaatttttgctattatattagagtgacgctatttgttacgaaaaaaacaatcatataaactgtaccaaacataaaatggacggctgtgattttataaactagttattgattaaaagattacaaaacatgtaaaaggatatttacgaaaattaaacgtcgtgcggctattataaaatccactttctctacaaacagtattttccattatataattagtttttatttcttaatttttctttttaaattataaaacaatagtaatcttataattcatcaaattttaaatattatactatcagtctttatctcttgacttttttaaattataaaattgatagtaatttattttttatagaaatcttatctaaatatcttatcaaattttaattattctacaatcattttttgggactttgttaaatttttatttttatttttcaaagaattcttatttttttcaaatatcatataaataagtgttattggactcactagagatatttataattcacaaattcaaaaacacacaacaacacttgctataatcaagagagagccatgacattaacaggagacaaaaactataagacacaacaccgcataaaaaaaggtatgtccaattttctatattttagtatttttacatttatatattataaatataattgactaaatatataattttttattcatatgtgtgtaatagtatttgtaatactattcgtaatagattaataatatagggacaaattataaatattttgtttgaaaatttat

SEQ ID NO: 1954 - DNA, 1205 bp, Glycine max
  Soy_ogl_2991 Gm09:4520301..4521505 Cluster 8
tgtaatttttgaaatttttaacctccacaattgtgttctcaaatttaaattaaaaaaatcaaattcggatagtgaaaaactatcacaaattacaaatttaatatttcttatttgttatatagttttttttgggaagaaggactaaaaaaatatttctcatgagaaataaaaaacaactttaatttagaagactaaaaaaatactattatattctaatttaaaggagtaaaatgatatttaagtcatccatcaaatttaaaaaatatgagagaaggaattgatactctcataggaaacttgggtgttttgccaccacccttaatcgcaaaattaggattttctaaagttctctaacaaaaaagtccataacttaagctgcggctgcgacactataaatttagtattcattgctttattaaaaagacttattacagcctaatgcatgtaaataaataaacataaattctcgtttaatagttgatggaaagctaagccttaataatttgtttaattggctaattttaaaaacttaagtgaatttatattaaaatatttggaaataattattatttacatgagtcaatatttttttaaataaactttaaaaaatcaataattatattaatttattattattattttggacttacaataggttgagcctagtaaggattgatgaatgcagggacggatccatgaaaccatcaaaggaggttttttttttttttactttcgctatttaaatatataacttctaataaataaatatttaataaataatgacttttataaaattatcctcagttttacatgtaaaattaaaataatttttattttaaaatataaaaaatacatgtatttataactcgtacaatttttttaaaaaatttaaaagactcttcgatctcacaagtaccataacaatcaagcaacacttataataataataataatctgaccataaaaaagaaacaaacacatcaaatataataataacttaaaatcatcaaatttcataacaatcatatatgacatatataaatgttatataatgttaataataattaatgttgatattagatatatagatagataaatgagacttataataatatataaaacatagttaatttagatcataataattgatggaaagtatatatatctctttgagttaaattataattagtgataatatattatta

SEQ ID NO: 1955 - DNA, 1100 bp, Glycine max
  Soy_ogl_3498 Gm10:42630501..42631600 Cluster 8
gcaatttgtttcttgagctggaccgtagtttcacccactgaggcccaattagctggttttttctctatcttctctctcagctttatcttttccttattgcgctggacgcccttgttaacagcccaagtgttttagtaggttatatagcatctaacggttggaaatgcctcttgcctggtaaccatcagatttgtactatttaattctttgttcaattttattattaaaaaaaattattattgaagtgctataaattattttgaaatggtgatgtatggaaatgcagttgaaagtttttttagacaaatgctgtatatccacttgactttatttggttatgatttaaatgtttttttttctttcttttcaaaccttattctttctctgatattattgttttttcgtcttccttgcttgctctctttgtataacattattgatttttcatcatcaaactctcaaacatggcatgcttgcagtttttgttgttgcgatttatgcataattaaaataaataaagtgaaataaaactaaaaattaaattcaatacagtggttctttgaaatgagattatttttaaatttcaaaaaatagtttctaaaatattattttattcaggaacatactttgcgaaatataaaatctaaaattatagtttggaaactatttttgaaactttattattatattccaaaaagtattttttgaaactcttttagagtttgcattacagaggactaccaatataaaacaacagtgttccggagactgatttctagaagaatgatataaaaatattttggatataaagagtatttgtgatagtaaaaaaattaaataaaaaagaggagaatgtacttaaaaaaataatagatataggatttaccttttttttttttgtttttacttcccctgggtccaattttaagtagaaacaatgctggtttggttaatgtattggacccatcaaataatcttttagcaaggttcacttgtgtaggaaaatcggaatttgattaggataggtatttcatggggggattttttttactagtgttgtagcatacagtgtcacacattgggaaacagcacactgatag

SEQ ID NO: 1956 - DNA, 1399 bp, Glycine max
  Soy_ogl_5630 Gm17:10361001..10362399 Cluster 8
acgtaaagcatatcagagaagtcaagtgaacctactcagatcacagacattacttctgttgctgcgagttaaaaacttcgacgttaacttgtccttttatgccttttaatttgatattgcatgagttttttgcttccttccacgcagccaccgcgtgttacacgttaacaaaaatattcaaataaattaaaccacacatttttttcatcaagttttttttgctaaaacttgatgatttcttattatcttagttgtttcatcaagtaatcatgtctgtctcatttttgtgatttcttatgatcttatttgttgttgttttttaaatatacatatatttatttttctattataaagttatcttcaatttactcatataaaatcgagctttgtaaaataaaataatattttttaatttaatttttataaatgttaaatagtattggatgatacgttgaatttcattgaggggaaaaatcttctatatcatttctgttctataattccaattgatgtgatcctgaataaaataagagaacgtgcttaaacaattaaaaacagtaatgtgaacatgtttataatgcttacaatacatatctaaataaatataattctcatgtttattcacatgtattatgaattattaatatgacatttataatgcagtgaaaaaacaatttgtatgccctcgtttcttgcaggatactaaaactaagtctataatctataatacatgtggctgtcagcatatttgacatagtaaaggcatacagcaatgtctgtgagttatgaaaaggcgaaagaaaagtatttcagaagatcagtgatggatggtgatgggcccaggcccagattttcttttgcactcgcagagggatccagtacatttgcttgctattggtagtctttttttccaagacaatagctacccacgacatttgtttcctgcatttttattattgtatctacacttctccttgtatttttggaatgtccattctaaaatgtaaaattatatttcgaaataaaattttctaaatataatgaaaagtgtaagatgtaatagtggaaatgcaagaaacaatagccgctgcccacagttgacaattgggcttgggtcatatttcgaaaaataccaattttattacttgagtataaaaaaaattaacggtgtatatattattatagttttctttatttactcatataaaaatttaaaaatatatttcaacatgtcccactttggtttttcaaaaatgagtttaagagaaaagtgggatgggacaacctatcaacccgttttttattaaaatattaatatttattttgatattttatgcatatacaaatttctttaacaagtatttattatttataaaagataaatttaactaaaatacat

SEQ ID NO: 1957 - DNA, 1000 bp, Glycine max
  Soy_ogl_5794 Gm17:39669201..39670200 Cluster 8
atctatttataaaattaaatatttttattacgaaaaatatttgtagttaatcaagttcccaaaatactaaaagtattgaagaagaagaaatatatttagagtctcacgcatatttttattttatttaaaatatatatgacttaattgcacattttttttttattgaactttggttattttgaaaattttatcaccgaatttttatttttacaaattttatcatataactaattaatttttgcaaactttaccattccactaatcttctgttcaatgtctaatgaaataatgaagtgctgtgaatgagttcacacccaaatatttatcaaattattcccattttgacacatgtttaaaatacatctatttataaaattaaatatttttattaggataaatatttgtagttaatcaagttccaaaatactagaaagattgagaaagtattgaagaagaaaaaaaatatttagagtctcacacatttttaattttatttaaaatatatatgacttaattgcagactttttcattgaactttggttattttgagaattttactgttgaatttttatttttacaaattttaccatctaactatttaatttttgcaaattttaccctttcactaatgttatgtttataatgtctaacaaaataatgatgtcctgtgaatgagttggtgcccaagtatttgtcaatgaactattccaacttttatgttgtccagttttttactgcaaatgtttctgttccaaattcagacacacatttctaggtttaaaaaacaaaataattaaaatttataatttttagtttttagttttttaaattatatttttcattgtttgtttattcttttataaaaaaataattgtaatttataatttttagtattccaacgtgacagccaggctccaactcatgcatggtccatcattttcctatacacattaaacataagattagtggaatcgtaaaattcgtaaaaattaaatagttg

SEQ ID NO: 1958 - DNA, 1100 bp, Glycine max
  Soy_ogl_56 Gm01:2558401..2559500 Cluster 8
tagattagttgattaaaattgaattattttagtagtatttgaatttcaactttgataaaaaataatttttgatcaaattttatttatttttagattaaattttagattaatcaaatttttctctctgataaatcaaaaggataagaaggaaaaaagactgattacatgataagttaagtgtttctaacatatatagttgtcatgtcagcaatgtgactataacttcataacttaacgttgaaacttaaaatttaaggaataaaaatattgatgcaaagaaataataaagataaaaatgttaaaatttttatttaggaaccaaaaatattttctaaaaaaaacaggaacacaagcatatttagcgctataaattactgtgaaatagagtaataatatcattttaatatttacttatgtaatcaacattatattttgttctagaaaagatttgtttatgtgaatgtgatctaatctaaaatattgaaatgaattgtaatgtctaacctatttttttaggtcaaagcaaaggtctttttatgttatcctactgcccatttttttcctcttcaatattcgagaatcataattattagttaaaagtatcaagacagtatataatgtccttgaaaatcttggtacatggttacccccacatcagtatttgggcatacacaacatcttgaaggtaatcggatcgaatttgaatctactaaaatcactacataatcctcaagcctgaagcatacattgggcagaggttaagttatggacatcggttgacgatatcacacggagactacatatttcaacactaatttatatttataaatataaaaattattctataaacaatataatatgtatatttctcccttttcaatttatccaaatttctaattctgttgataagaaaaaaagtaaagaaaagaaactgttttggatatgggaggtgatgggcaatctaatcacatcaaaatctggaacggcccccaataattgatgcagaacgaaagggccttcatgactccttactctgttaacacgagtcttcaacagcaacttatatgttatcatttatcaaccctgctcttggatcaaat

SEQ ID NO: 1959 - DNA, 1000 bp, Glycine max
  Soy_ogl_3778 Gm11:6818701..6819700 Cluster 8
tggaagttctgccacttgttttggttaaatatggtacagtttcaattttatatatatcagccttgtcctttgtaattttaattaaaaggtgatataagatatcagcattatcatcatttcctaaacccaatgaagatcatacgtcgatttttttgtgtgtgtgatatcatacgtcgattttcaaaaaagttttttgtatatgtcctatgggttgaaaggggtcaacactataagcagcaattattgtaattaaagatatggaaagctcttagacttaaccacaaagaaaatgacaaccatcttatttgtaatgctaaaagaaaaagacatgactttggaagtgatccatttattttatttttttatcaatgtcatttggtttgtaaaatattttatattattattagaaaaaattacattgagtaataaagattttttttaggttactattaaagaagttcttgtttataatatatttgtttgtgcttaaaaataatactacataatttgtcaatcaagtaaattgcatttttcttcctctaaaaagtgttatattacactaacttttcctttaattgtttaaattatattatccgagatattaatatgtgctaattttatttattttaatacaaacaattttgttttcatctagatcacatatattttttattaaaaacaatcttgttcgaatggattaaaattatcgtaaacacaataaatttattcaaaatatttgacataattatatactcaagatttaaatttaaaatcattaattaaattaaaataatctcacatcaattaatacacaaccatcaacaatcaatgtaatttttttaatttatcatctaattgtaagtaattatatattatttaactttgataataaccgctcttaaaatcacaccaaacctttccgtaaaaaaatcacgccaaacctaatgtataattggctaataatgtgaaaatcttcacacgcatatcaagatgtactttt

SEQ ID NO: 1960 - DNA, 1137 bp, Glycine max
  Soy_ogl_4791 Gm14:46724901..46726037 Cluster 8
ggttaacttgtaatattatacttaatctaataaaaaaattagaagtggattggacatctatttatacacaactaaattgaatttaaaaatatataatttaataaataacaaaccgaacctcagtctctcgaatgattagctttcaggctttcacaatatattaaaattaaacattttgaccgagacactatcggtttaatgctttcctgacgtggctttgattagtgacctcaatgtcaacacaattgcacataatgaaataatcagcttttatatacttcaaagggagtatttttgttaaactagaaaaagaagggagaggagcattgactgaaagaaatgaagaacatataattatatatgaattattaagaaatatgttacttttttctttaaaatataggtattctttaaaaaaaatatgtttaaattggatatgatcacatagatgataatattctctttattagttatgctattttttaagtagtcatataatcattaaacaattttaggagacgacacgtccaagttaaaagaatatgttattgtgagaaataacaacattaaataattgatgttagatcaaattaaatagaaagcttaaattaaaatagtcaagaatttataaaaaaaattgaggtgatcatcaaatctttattaactttctactggaaaaaaaaagagttcaataaaagactgctaaaaaaagttctgggaaaatggactatatacacactcatagtgtaaaaagaattatacacattaattacaaattatattatgtataatataaatttattaactttataaaaaaactattttaaaagtctcatcagtagtatttttttattaattaatgaaaatgtaaaagtgttttatatatattgtcattaaattcctttttttttttatttacaaaagtcattaaactctactagaaaccatgtaaaattactaatcattgacgtaaagaaatggaataatgaagagtgcatgagcgctgtctctttccaagacaagaaagggttctaacaaattttcaccatttttcattgtgatctttcaattacaattacaaagtatcccttaacaattcttccttcctcacgaaataattttcatctttggttgttt

SEQ ID NO: 1961 - DNA, 1125 bp, Glycine max
  Soy_ogl_5633 Gm17:10419501..10420625 Cluster 8
attctaagtacaagtgaagtcttatctttgtatacaccggtgtatgtcacgctttctagtaaaattttgtagagatactggctagtttcctttatataagctataattctgtgttcttttttatttcatatatatactttgtaagttgattatacatttcctctcttataatattcattgaaagttaaaaaaaatctattaatcttttatttccttttcgaaattgcaaagataaaaaaacctgtcatatttattaaaactgtcacaatttttaacagttaaaaactgccataacccttaaaagtaaaaaacgataaaaacccaaaacagaaaagttaaaaaaaaaaaactaaactgaaatcttaaataaaaataacgaacaaatttgacctattattgacaaacgtctggtttgttttcaaaaacgtattcaactttttcataaatggcaaccgtgtttagctcgtagcctgatacaacgaaattggcataattgattaattaatactagtaatattaacatcaattaggtaggagtcatcatcaatatcgtgcctgctttaatttattcatgaccaacttactcaattcacatttccaaatttggaattgtatttgaatatgctggtaattagctttactcattaaataacagttggaattgcatataattaaacatatatttagttggattgaatggtttttttttaaaacaagagagaaagagagagaatgcgagggttaaactgataagaacagatagaatgtaagtgtaaattataaggggcatttggcttttattacattttataaaagaaaaattacacacaaactgtaataaaatatttattttttaaccattcatcaaatatatcataatatttacgcaatattcagcatataattgtttcaaaaggtttcgtatgagattagttcatcaactccccaaaaacttaatattatgggaaaattttgaacaagagggataaattaaagtgaatatatttgacatatataattatattaataaattaaatatgtattgcacgagattgttgtatgctagatatagttacccggtaaattagttacaattaatgttagctttgcttttatttttataag

SEQ ID NO: 1962 - DNA, 1322 bp, Glycine max
  Soy_ogl_5987 Gm18:7830601..7831922 Cluster 8
gtcaaattcggtgcttgcagcgattcctacttattctatgcaaaacatctgactacagaaaggaaaggaatttgtgtcaagattgatggccttgttaggagctttatttgggtggtgctcactctcactgagtcacatgggatgatatcactagaccgaaattcagaggtggtctaggcatcatcaggaaaacaagggcagtcaatgtggctttgcttggaaaaaaggtttggtctattatcaaggacccatataaattatgggtcagattattcagtgataaatatttgtgtcactccccttatggacatcactgaatctaaggacgactcttattcctggacttctattgtcatttgtcaatgctctgcagattttgaagcccgattatagagtaagaattgacaaaggggaggtttcgttattttatgattcattcctggatgagggacctctgtacagcaaggtggactttgctcactatgctgacatgaacttgatcactaaagacattttggggaatgatcagtggcattggaatttaattgcgacacctctatccgcggatataaagaatcagcttcttcatattattctgaatgagtctgttgatgatgttttccccgcgtttgcagtttgaaattgaggctcaacattaatccaccgaaaagcagactttccagaataaataccttcagttgcataccggttggtcatccgccgaaagtttcgagtttaatactgatatttttagcaacaaatcccataaaatgatgatttgcaaaataattatttttttatttatatttttttgttccttttaaatactacttcttaatttaattttaatttgagttaaattttaaatattgattcatgtcttatctttcttttctagatgaactgaattttgaaaatattataatatcaatcaaatataatttgaagttgtttttaatttcaaattttgaaacttagaacaattcttcttatagaaatacatggtgtaatatattttttggataacagaaaatgtcgatgtaattatataggaatgttagagtaatatatttcaaataattaaagaagatcagtgtaaagataaaagtaaagaaacaacacgtcaatataatttattctataatataatctatatttacttaagaaaattagcgtgttagatataattgattgaattgaaatctagttcttctaactacataaactttaaagaaaaatagcattgacctaccttctttaatttatgagcatgatctaacctagacttaggtgaactaaactataaactcccatcaaatgaa

SEQ ID NO: 1963 - DNA, 1102 bp, Glycine max
  Soy_ogl_1737 Gm05:38679501..38680602 Cluster 8
taatctattacttggaaaatgatcgaattgttgagattataattaattttaaattttgttacatatataattttatcataattctaacttttagaattttttttatcataattcttaactcttaactttctaactaattaataactataattcatttaaaaaaaactatgattatattttattttctaaaatacatcacatcattttacacgagttaaatctattttggagacttactcttattctgacattagtttggctttgattataaagtgttttaaataaatcaagcttttcggtcttaaaacaaaaactttttttatggaaaaaataaaaattcttattaagctctatttgcacaactggattaactttacatgtgaaaaattaacatttattagaattttttctttctcatagtatttttttgtacttgacagcaaatagaataattcttcaactataattgggcgtcacaactctcagcggagcttctcctaatcagggaaggatgcaagaggggaaaatagatgggccatcgcctctctctcaaataatatctactaaaatttatatgcaagaacatcactttattataaccatgaatatattcaaattaaaataacaagaatactattatatctttttagacgagttgtaataataatggtatatttaatatcttaaaaatataggagttgattaatatttttatttaataattaaaatgttgcaagataatattaaattactctatatttttttttccttactcacggccatgacatgcgtaacagaaaatccaattaatttccatgcgatgcaataaatgctgcctgctgtttgaacaaggaaatgtgacagagaaagtacgcagaagaaaatcaagatattaaagcgtatatttataataaataagcaggatccgtttcatgtcaaatatttgctattgacgcacttttcttagtcaaaaactacttctgctgtacttatcctgacttgttttaacaaccatttcttgattttaattcatttttttaagttttattatgtaatattacatttagcagtgtcctacttggctttgggttctgattcgtat

SEQ ID NO: 1964 - DNA, 1100 bp, Glycine max
  Soy_ogl_3180 Gm09:38892001..38893100 Cluster 8
tttttttaggaatcgaagacaaaaattaaaagactaacaataattcatatattttagttaatcaattgagttaaatcttttcggttaatgtatagttttttgtattaatgtaagcattttgataatatattatgttacatatattaaaatgttctactatatccttctaacatgtttaaaatataacaatttagaggtttaaactttaaataaaagttcaatcaatgtcattcttattagaataatatgtaagaaacttttttttgtatttttttaatattttaaatattatgttgctcttactaaacaacttaaatttgttctttgttaaaaggagccaacataaaataacacctaataaaaaagtcctttttaatttttttagggatatgttaatctgtagtttttttttttcattaacgtacacattttgatcatgtactatgctacttaaattattttataatttcaaacttttactcattattacgtgttatactcgtacgaaacattcctctaaagacgtaacgtgagtatcttgaacttctgatagatttttgtgtttttattttttgagcccaaagatacaacacatgtctatagtaagagaaatccaaatgaaaaaattacacagttgaagacatgtcattgcgggttccacttacggaatgggtttcaactgcagcatccattttttattgatcatgtgggatcaatttgattgttgtatgaatataatattagtttatttttcttattcattaaacttgtgttggagttggttctgttttttgtttttttactggcgggtaacattgattttttttaccattgagatggatgtgtaatccaaattaacatttgctataagaaaaacatttcaatactgaatcaatccttatacagtgttttttttacggttatacagtataattttgtttttttataaataatgtattttgattacattttttatacaacaattctctcaatttctcttatctcatttcatctgtttattctcttaaattttattattcatacttttttctttacacaaaaatggatcccaataatcccaattttacttcaattggatg

SEQ ID NO: 1965 - DNA, 1300 bp, Glycine max
  Soy_ogl_5821 Gm17:40467201..40468500 Cluster 8
aatggtagaagattggtatactttcttgtaaaatgtatattcgatcgactttagagtaaataatattttaatcaataatgctggtcataaagtgacatatatcttcaataatattttaacttagcaatttttgtaatcatggttcacatttttactaggcacttagtgaataaatcaacttttatgttctttttattcgtcttcttctgaatctggttcgcttctttgactcgagattatgtatcattctaattttatattgagctatatgttaaatacattattttttgtacttttaagcctcattcacctctttgaccgaagcgggaaggcttgtgtaccctccttattttagactcgagatatatgtgtattaaatccacagttctaaaccgactttatcaaatattgggtcattttttaacagctcttagaacttggtctatgagcaagcacgctaatcattattgagacatttaaagcataagaagataagatccacaataaaaagagatctcccacaatttaaattcaaataattgcacagaaagtcgagtttaaatctctgtcagacctaaaaaatgaagagacaaaattcacttttcaaatgctccagttgcaggacatatccagagcgtcacatggagtttcccatgactagaacaaaatgcgcataaccttctttttcagccttaaaaatattttttaatcccttccaccccacgaaaccaaataaaattcaattaccttcaaatgatcgcgcatattagaaacagactaattagcgtctaacgtatatatacccacgtaacccacgcaccattaattaatcatctaacaactctttagagaatgtttacacggatcctctgtttgaactttgaattatatctcgtgaaatcatatggcatgcaaatttaaggggttaattaagaaatacagacatcttaccaaatttcttatagactcggattcgttgaatattacaaaagataatactactagttttatttatttattaaaatttacctcatgttattttaaattatatttcaaacaacaaatcttttgcttcacgtaagacacacttgtttatctaataaaaatactacgaatacatttttaatgtattcttcttcttttttaattgagatttaatgtattcttttaaacatattctttattattgattaaaatttaatataaatcacaaacatttgtaagtttcacttgttatttaatgattttttttcataatttggtaatttttaattaatacatttcaataaataataatgtg

SEQ ID NO: 1966 - DNA, 1045 bp, Glycine max
  Soy_ogl_4677 Gm14:5405956..5407000 Cluster 8
agatagcaactaatgcatggtccttatgaatggatatttctttttcctgcaggatatacccacccaccattcattttagatgtgtctgacctaaaatcaatattggagatgcttctcgactaggaaagattcttgttttaggacgatgtaggatttttttgcaaatgaccacattagtaattttcatttctacaattggagcattttatctccaccaaaaattgacacaatttcttagtatatacgtacgtggtaaaaaaagttattattcattcggataaataacagactagaaaagtaagtttatgttacgaagttatattttattgtcatttctttgagctaaatgtcaataaaacttcttttacagaaatgcatatatctatatatgtttttttttttttttagactgcttcatagtctaggtagtttattgcatcctcacctcaccttacaaagttttgtgtttaacttttttgtttttttcatttgaaaaagtgttgtgttcacttgtttcactggttgaatataaaataattgacaataattactatttttctatttctcatttgtattttttttgtcattttcgtttattaaaaattaagggggataacaaaagttgtttcgcatttgtgttaaaagcccatttttctgtgttcatttgaagagcacaagaaactattgtaggaaaactatttgataggaattaaattgaagataaaattactagagatgaactttttattctgataattctggagatgaacattttagtgcatgattggattaatggttgcggattaatgattgtaagtttaagtgtgagtgaaatttaagtttgtaagctgagttaatgaaaacaactaaaaattttcttttgtaaaattgagttttaagagacattttttatttgcaaaaatatttttaggaataaccaaaaatgttactaaaataagtttattttccgaaggtaccatcatcaatacccattcttggccaatgagaaaactgggccaatgactttttcaaacccattcttggc

SEQ ID NO: 1967 - DNA, 1100 bp, Glycine max
  Soy_ogl_6783 Gm20:36230401..36231500 Cluster 8
acaaagggctagtaggccaaaatagaaacaaaactattcatggaagactatgccagaagcatccgccatcaagagaatcaagatgaaagctaaagcaaaatcaaaattcctaacaggtgaactaagctgcaaatttgatacattgtaaagataaaatacagtaaacattgaatatccttgtgatgatgacaatgtctttgccgcggaagtatgtgcggcgatatcataggcagtcgcaacctaatattttcattaaaaggggagtgtattcgataaaaggagagtgagtggacatagcaattccctgaccacttactaatttatgaattcttttaattttgggcctccaagttgtttccattttagtctaggctatgcccaaaacaaaatattttaatggtgtctttttttttttcaaaattatctcattttaagtaagtttaattttgatatatagccaatacaaatagtttacagcatcaatcagttacaaattactgtaaataggaatttttaattaattactataaaggtttatacttttcaattatattagtaagattacagtgtaaaaaaaaacttcaacattgtcaataaaatatacgtgtatatgtttcttaaaaaatattttaaaattacatttcttacagagtgttcaatctactttggaattaaattttttaaagatatttttaatgttataaaatgaaattattttaagagtatttaacatgtttcaaaattaaatttgtaaaatagaaatttaaattttttatatatccaatttttttttaaaaaaattaatacattgaaaaaaaattgttttataaaatactttttcaatgtattgttgcataattaaatttctggaagtattttgaatatattaggcaaacgtagtttcagaatgttttgtttagtacttttaaattattgaaattctattatttatatttaaacattttattatacataataatacttttaaaataaaagaaaaaaattaaaatgcagtataactagcagaaattgattatacaaaaacacaattccacattcttaacgagcctatgtcttaagcccaacaagatcaacgcttt

SEQ ID NO: 1968 - DNA, 1100 bp, Glycine max
  Soy_ogl_4575 Gm13:39535201..39536300 Cluster 8
atatcaaagccacattcgtgacccaagatttgaatatttaaaaaggaaaaataaaaattgtagttgtaaaaaactattgttataagttgatattttttattattatcttgtcttttaatctgtaaatacttgcttgacttacgttagtggagaatacatgtaatttttatataaaaaaactaagattagatttcagaattttaattattaagtttaaatgtatttttaaaatgagaataacaatgatgcaattcaattttatgaaactataacataagtaattatttttaatttcttattctttcattgatattatcattgacatcataattatcgtattatttattctgctattatccatactatatgattttaaaataatattaataaaattttaattattaagtttaaaagtctttttaaaatgagaatatcaatgatacaattcaattttatgaaactataacgtaattaattattttttattttttattctttcattgatattatcattgacatcataattatcgtattactgttaatatccatactatatgattttaaaataatattaataaaattaagagagaaagtaatatatactctgataattaataaattagaaaatatcatgtgataattttattaaattttataataattattttaaaattcattcttaatatgatttctgattggttatagtatataaaattaaactcaaattaaaattaaaattaaaagctacaattttaatcctatacacaaactagattctatcgttttatttaaaagcatgaaatccctgtcacttcaaacttgaaagtaaacttaatctcatcaccctaaaaggaagtattgacatctgcccttatttcatatctcacccgaaacagtgattaattaaacccatccataggctatgggctaaatcatgggcaaaaataaaggagattggagggaattgctaagcccacccccaactttaaaaatatcataaaattaccctactacccctaacacttcccctctccccagctcctcctattctgatcttattaaggctatgattggtttgtcggcaggggagctccaaactc

SEQ ID NO: 1969 - DNA, 1100 bp, Glycine max
  Soy_ogl_6202 Gm18:56483101..56484200 Cluster 8
gttctattacagactccactttatgataaatcttgtctgcgataatatacaaataatttaaagcagttaaaattacatattataccttagtacgtaaccaaaaaatacatattataaaaacctaatataggtgttcatgggtagtataataaatgtttgtatatttcaggtttaatgtttaagggattatggaccttcatgtaaatcaatcgagaataatagaccaattataatagaacaattgatcctataatattatactcaaacctttgatttggttgtattttataaataagagtgatctccttttatgtcaactcggattcacacatattctggggttgttatatcttaagttaacttaattaatgattttaactttgaatacgtcattatatcaagtatttaaaatggcaattgtatcattcatattagtcttacggtatcggatagataatacatgtgatatctaaaaaaaatcagtaacctaaaagcctatcatttcacatttgtagaaaataatgataaaattagattgttggtgctaaaaaaatcctatataactaaacaataaaaataattaaatatagaatgatataaactatgaagttaaatgacattatctttgagtaataaaggcaccgaaattgcgctgtcctttttctttttttaaaaaacaatacaatctttttcagaaagattaattaatatgtactattgtactatgtaattagtcaactttggtatgaatgagtctcttgaggacatattctctccaaaacggttgacggtattgataattaatttaatttttaaatactcatattatcaactttagaactttaaaagatgaatgaaaaaaattcgtgaagtcccaaaacctataattaaggtgtttcagaaacatctggtttgaagtaaaatgtttaataatataatgttcaaaattaattgtaggtaataacacaaacagttatagaatggagaaaaatattttcaaaagatacattcacaaaatcacagttgttcatcactaagagcaattgcacttgcttactttagttcttgaagttaactgacttgaaaaaataatggagtaa

SEQ ID NO: 1970 - DNA, 1690 bp, Glycine max
  Soy_ogl_3832 Gm11:10639001..10640690 Cluster 8
tagtaatcattcaacgacataaataatgtgagttaagcctttattttgagaattattcaatgattaagtatatttttctcagtttatttttttcctttttaaaaaatacaaaagagttgggttgagtagtataacattacaaaaaaatttaaaaattaaagttgatcttcttttttagacgaacaaatgatcaaaaccaattgtttatagaaggattttcttgggtacgtcatttattaataacattttggtacgtcattttttggtatagaagttgattaaaaagtttgtattaaaagattttttaaaaaaagttacttcaaatattatttaacaaaacaatcattgttggctttaatgacataatttttttttgtaaagcacaagtatgcttaacttttttctgtccacttcaattttaaaataaacttaaatgttttataagtttatcgctaacaaaaagttaaatatacacatagcattaggcactccatgatttttttttttatgtgtggtgtaagtgaatgattttgtttttctttggaaaaaaatcaactaaaaatgaatagttttgtttgaaccatgtgttgcatattttataatagacccttttatacgttaatctaacatattatactctatccactaatattatgagagtgtctttatgctttactatttatatacaccaaaaaataacacacatagaaaaagcataaaaaatgtgataaaagtcaggttgataaaaaaaatattatattatttatcataaataatttgtcttggtagtgatatagaatagtttattttattatgacccgaaataaaatcaataacaaatatgtgcatgttcaataatcttatatttaatcagtcataggtttgatattttattattttcttgaaatgagattataagtcttttatagattttttttttgaatttatagtttcctctactttacaaattaggacagttgagataataagtcttttgaaattttctatacattagtattaattatatgcattatatttatatcaattggtaaaataaaatgtgtataaataatctaaaaatagatgataaaattactttacattaacgtgtgtcttggttaattaatggaaataattaactccaatttcagatcctatagtttttaaataacatttttttttataataaaacaaagtacctttacaagggtaagggattggttgtatttggtgtagagcatgcagaaagtatttgtgtattgttcttttcttgaaaagaaaaaaagtgttacttacaagttactagttacaccgggatggaaacgttggaaggtggtgctgcaaaataaaataaaaactccgaagctgaccttattagccaccctgctgggacccacagtggaagatcatgatcctatatatacgaatggatggccctgattcattttgcatcttccaaaccgcatcattatcgcttacacacgtcgaccatgtgccgcaataatgtttcgcttccttgcattgcatgcaattggaaaaattattaatttttaggctaaaatgtattttttttcttttattttttttgaatctgcaaatttaattttctatttttaattaaaaaatttcattttttacttttaatttttttttataattttagttcttaaattgagacatttcatatctc

SEQ ID NO: 1971 - DNA, 1000 bp, Glycine max
  Soy_ogl_3551 Gm10:45394401..45395400 Cluster 8
aacatggaaagattttaattataaaaatgcacacaggcatggttattgaggaataattaatagttaaatatatactttcattctttccaaaataattgttgccatagatttatatatggaggaaaattattacatattattcatttcaaggacatttaattatgtttaacttaataatatttcactgaattgctgttctttcttatttagagtttggacgaacatagtattaagagagaatgatgaaataaaaaaatcttgactttttaaaatgacgaagaaattaatataaaatatattatggtaataattacttaaaatagaaaaaatatattaaaagacagttttataaatatgttagataagaattgtaatattttttttttggaatataggagcttaatccccaaacaacacaatcatcaaacacgcttcagttttataaatgaatttaatgcatactcatattttaaattattatataatcataaatcaatatttaaattattttaaaagtcaattaaaagtaaatcattccatcaaccgggtaaggatgataagttgcaacccaaatattaataatttccacataaaaacccaaatataataatgtgtttttgtttactcagtccatttctaattataagattctttgaattaattcatattttttaagaaaaataattattatattaagtttgataattatttgtattataattctaaaattattcatttttctctatctattcacatacttatttcttattaatatttaaagaaacaataattaaataaacatatgtagacaaaagaataattaatgtatctaaaaattaaaaaatggtcttataaaaagctacaaataattttttgaaaaatattttataattatttaaatcataaacaacttgataaaaaatataaattattatcactgtgtcaatcatgattttaaatcattgttgatgtaaactatttctattcttatatactttta

SEQ ID NO: 1972 - DNA, 1466 bp, Glycine max
  Soy_ogl_1385 Gm04:44216766..44218231 Cluster 8
aaagttgttctatattttaatccttaaaaaatcacaaacattatttattaaatgaaagttgttgaattgaccttcaccgtcgcaattagttttggaactgaaactctttacattgattcattgaattgtgtgacaaaacgtaactagccatatactaacatagtaacaaaacaatgacgcaatttatatataactcaaatgaggcaaaaaccaagaatttgcaagcacaaacgaagtgctttggggggagaagagaaacaaccatgaataaaattaaggggttggctgctgaagcgtcactaaactatatttgttcatataattgcaccgtctcatatatgctttcatttggtattaaaattttgcatgggtgtcatcttaatctctttctatcgtaatcaactttgacaagaacaatcattgcccccgaaagatctttgttgagtcttcaagtttgtagcttcaaagaggttgagtagatgaaccaaacatatatatagtatctgtttcccacaattcttgggtcatggtggataatgttgaaggctagggaaaagaggtccttttcagattggcccacgtcggaaccctcatagtagagaaaccaaattatatacttataaatgctgaaaatgggatggcaagtttcacataactctaacacccagtaaccatgaacgcgtacgtcaattctttgtttcccattttctgtgggaaaagtgagagaaagtctatggccaccctcacactcaaagggaagcttttgaactatattggacattgcttagttcaaatacatttgcctctttctttcatttatgcctatgttatgaggtccataccgatactatccattgtaggtaattgccgcttctttacttatccactttccctttctaacaagagagtgtattttttggaaaacaaattaaaaagaaaagtaaatgtgcaaagagggggagtagatatagcatctgctaaagattgattttatgatttaagaagaaaaaaaagaaattacaagttggaatcatttttattaataaaaattaaaattattttttaccaataaaaaactatctactgtatataataatggcccgtcattatttggctttgaaatgaattttaatcatggtaatatctgagaggaaaagatgttgcaacaaataagtgatgcctaatgtttctattatcggtcaaacaatatatagttgtatggttgttatagtctatagaccaaccaatcactcgttttacgaaaataattttgtttttttaatatttttcttaccatatcattgtttgataaaaaagaaatagtaagaatgagtattaacgatttaattaataagtgtgtttaacttatttaattaatagttcagaaatagtgtaataaaagtaactagccgtatcaaatatatgcagagagagagagacaggggcatgtagtagtgtgctacccc

SEQ ID NO: 1973 - DNA, 1032 bp, Glycine max
  Soy_ogl_2289 Gm07:8329469..8330500 Cluster 8
tcttaaatagtcgttattctaacttttttttttatatctaagggcttatgattatacttattttttatgttcattgacaacctgcctgaaggcttgtgaattcacacttcctaagatttgataaaattatgcttgacgtttctctcttttgtgaaattactttaacatttttcgatcatataaaagtataaaaaatcaagaaaagtctatgtagtgaaaagagtacacagttttatattgtgtaaatttttttaaaaataatgtaggattttaaaaaagttattaagtaaaattttgttgaaacttaaaagatattacctcagtccttatatatgacacttttaattaattcatacacatctttttaacgatcattaaatgttaattattaatttattagttttttttaataaaaatattcaaacccacaacgcatccttctattctttcaccctttactctcaacccaaccttatataacaaggatattaagtattaagtaactttgctagttttagtttggcagcattgaaatggatgatgacatcctccaatgatgtaatgaattaccctatcatgtgatcaaatacatttttataaacaattctaaaattgggaaataaagcctgaaccaaagcacaagcagtgcctaccacaattaatactatcatttatatatttttaatagattaacccaaaacatataaagaacctactcgttcgtagtcatggaaataatatctacacaaacataaaatggcacaggttgggttgaacaacgatctggaatagagaaataattttggtgggctggtatcgtctaacgaggtaatatttatttgaagtaaatcgtgtttttttttataaaaaaaaatgggctattatatttaaatttgaaaaagtaattatttttaaaaactacattcctactaataattttctagaataagacatcctctgcagcaatgaggactaacatagagggaagattttgaacaaaagataaagaataatgatggtctaaatttgcaa

SEQ ID NO: 1974 - DNA, 1258 bp, Glycine max
  Soy_ogl_972 Gm03:39575743..39577000 Cluster 8
cgctaattgtgccaacgggaaataactagtagtaattgacaattcgacattctcgcatgcaacacgggcgttacgtttattctgcttaattgttcattttatgttggagaaatagcagccaaacagtgttaataagagtctttgacatcagctttctttttggggtattcacgtcaccggcttttgaccttttctagctagctagatgtttcttaatttccctttcatagtaatagtttggttaatcaaatattttttttttaaaaaaaatcagttattaagctagtgacgagaaaattcacaacttaatgcatggtatattgttaaatcagggtatatatgttaaatttatttaaaaattaaatatattataaattaaaatatataataatgtaaattataattaagggataatcataaaattggtaaaacttaattagtcattaatattgctcacttttgtctgttgaaaaactaagtagagtaatttattaacgacgattttttatttggctgattctatttattacaattgatcagattggctaatctagtttactctttgtaacaacgttaataatctatctaacaatggtttttgttgtattagactattagttataaaattgaaatcataaatttagtctgtgaattcttaactttaagtaactcatgccttcaatttaatttacatgaatgtttgtttcacatttcacgttgggaacataatattctctttacctgaaccaaaattttttttaaaaaaaaatccacagataactgagaaaaaataggtctttctaatttaagacttagtcaatagtagcaattccttaaacaaaaccgagtcatttgtatcaatatcgttaaacaaaactgagtcgcatgtatatattcaaaaggtaaaagttcaatatatggattaagcacgttctaggcaacaggttttgcgtccgacaactgggtgttttggcgtctgacttacttttattttattcgttaatgttgtcttagcaatatagttggcaataccctaccaagtcaagctaaacaattcatcaacctcaagaaatgaagcaccggtcaattcaaaacaaatagcactctctccctatatatatgtctggggctaccacctacctttcaccatccataccatacaaactctcattcaattttattccaattaattcatcatccaaactcagctcagcggaaaggaacacgagagagttcaaattgaaagctcaaaagaaga

SEQ ID NO: 1975 - DNA, 1251 bp, Glycine max
  Soy_ogl_4154 Gm12:38617301..38618551 Cluster 8
tcagtacctatctgaaaagctttttttaatgtcaagcgcaaattaattgttgctttgaaaagccaattcttcggtaaggaaaggatggaaatggtttaaatttacctaaaatttaatcaatctgcatgaaaacgctgtgtcggtagcactagctacctagctatggcaactatacatattcatgtaattatggccatgataataattgcattgctaattatggttggaataatcctttagaacgtgtactattttttaaggagacattaatgagccaattgccgcataaatagaccatttgtaatgttatattctcttcatgaattgtccatgttaaatggagtagttcagatttctttagttagcttttcaaaaattgtttaaatcaaaattttataaactgattttgtaaaaaaataaaacaaatcaaataaagaagaattctgaactaaggaaattatatataaagaccaactgaggttggcgacttgtactaagggttcttgtccccttaaataagagattgggacttaattgattttctgttacatagaacctaattcgaaagaatattacatattacacttgcgaaagaaaaaatatatatatactttctccgtctcataataattatagtataaaaagaaaaaatattttaaaataataattattttaactttttaatgtaacattaattacttatttttcacttagatcatttataatattactgtaaaacaaatttttttataaataaattaataatgataaggataattttataaattttttttcatctatctattagttctcaattcttttatctatataaaaacctaggatgataaatattatgggacaaaagaaagaatgtaagtgtaaatatacaaaataaaacaatatacataaaaaaaaaagaccagctcaatagtaaaacaactaatgttcaaattttaggtttaaaaaaaaatatttgtactaattttataaagcaaagagacttcatgttggcaataaattcatgtatgttgacaaaaaagacctactatatcattattatataatgtttatcttaaattttattttaactctcacttatcattagaccaaactatataacaatatgcataacattatttaaacttttattataacttgcgtatactttatatcttcgaaatagagtattaagataggtttattagaacaagttaaaataaatgaatctataaaaaaattcaacctcacaaa

SEQ ID NO: 1976 - DNA, 1200 bp, Glycine max
  Soy_ogl_2517 Gm08:5130101..5131300 Cluster 8
tgcacatatcacttgcaatatatatatgtcacatacatgtaatcaatcatatcaaattattaattatagagtagagcttgtgtttactttataaatataacaaataaatttctagaaacttcaatgggttaattttaaaattaagaaaaatctagataagtgagaaattgaatgcattattcgatgtaccttatctagacagcttgcccttttcagaatgataattagatgctttgtaaaatagtatttatcgcccgacgtaacgtgtctgtcattagcatacagtcatctctttttttttttaaaaaaaagcatacagtcattttattataattcacaatcttttttttattagctaatggccaataatcttagctcaagtggttctgaaatgttgtttaagattattttattctgacaataaatcctatctaaattgctttgcctcaagtagaacttatattcttttagacgacgtaactcagttaataaatgtgtgcgtaaattattataaatttttagatatttgtgtttgatttttataaataaataatataagaaaaagactccgcgtaatcttacattttgttataattaagtgcttacattatcctttcaaattaaaaaatgtacatacattagttatcatgagattgctctaacttaatttgtttttctgaataactgttttaccttaatcaatatatagttttgagtataaatcttaaatacatacggatgtattaaatattttgaagtaaaatttaatcacttgtaataatgttgataaaaatgaccttttgtagaagatatgtgatctcaaaccataaaacaaatttcttgtaatcaaaaccttttttctcgattgttaattttttattctttaattgtgagaaatttcatcatagttcaagttcattacttcaacttattctaacacgtaagggagttataaagtttaaactttaaactatacacgtaggtgttatttataatttttttattacattctcttataatttttataataaataaatatattttaattctttaaccaataagaactatttttaaggtaatggtcagcgttagcaagaccgtattttagaaaccgtgaattatgattatagtcaaatcatttaattcttgtaatattggatgatctttttcaggagatattgattgtacgcatattatgag

SEQ ID NO: 1977 - DNA, 1300 bp, Glycine max
  Soy_ogl_3326 Gm10:2671001..2672300 Cluster 8
aaattgttttaagttctttaaaaatgatataaataatttaaaataaattatatcttagcatcaaattaatctatagttaagcagggattgaatttatgtatgatacaatacatgtatgatttgaggattgggtggattactatttaagtgtaggaaagaaattgtcctataatacccctcacggtcaaaggcagggttgttctaggttggttgcaaaagagggtgagaaagtggctcagtcttgatgaagtaacatgggtaatggaattggataggaaagggggaaaaaacaaaaggtgcagtgggtgttgtacccgaatacaaggaacaaatatatatggcgaagcatataaagatacataaaagaaacagagaatccatgtgggtgggaagggaatagcagtcttagaaaagatagaggaatcagaatcccatctcaccttcatcattgattcggcattcctatatccacttcttcttttttctttctgccaatcaccttatttctacaatgatatatcatcaccacaaagaaaagaccttgtctacaccatataaatttccatgcttcaaccacatatatcccttcccttcaaatacactatcatattacttatttattaacacatgtagtagtagtattaataaaataaacaaacacactcgctacctcttaaatgcatgttccttaaacaaaattgaaactactactgtattaacacatttttaacgtctttttttttattaaaatgaattatactgacactataaaattttgttagattgcacaattttttttattttcatataaattctctttaattatttaaaaatattacactaatattacttgtacattattaaaccctttaattatttaaaaaatattacaccttgtctccctattagggaggtagctataaatgttaaaaagaaaagacgaatttgtgtaatttaacaaaatgttagggtgccattgtaatctatttattttattagctaaaatttagtgaatatatataaaattataagtgaagttaaaggttttatttttctattttttaattcgtgaaatgatgataaaagatatattaaaaatatctaatatgttgttagtttaagtaaaattagactttaatcctttaagtaaaatcttatgtttaagctttactaaagattgcatgttagatttctttttgatagaaattaattataaataaatctaatgaatactaattcacaaatatatcataacaaaaaaaaaatattaaaaaaggtgtcagtagcatttctcaagatt

SEQ ID NO: 1978 - DNA, 1238 bp, Glycine max
  Soy_ogl_3643 Gm10:49105715..49106952 Cluster 8
tataactaagtacgtacattattgttggcaagcatcttttttttcttgaattattggtggcagtacacattgtgaggacaaaattatattaatagactactctctaatttgttcacatgattaaacaatttaatcaatgcggccatctcgtcgaacgaggaaaatgatcgcatggaaaaaaaaataaaacattaacatgatttgacagctgaatttcactagcgtgaggaagaggaaaacggtgtagacaacaaaggttaatatagtaatcttaagtgaagcttacttttttagtagaaagaggattttcaaacgtggtgttcttgaagcaataatatagtgtattgcatcgggaggtatatcttaataagagtacgaaaagtaaatttaggtcattcactcacatatagatgcatgatttaaatgttttgatattgatgatttacgataaaaatctaacagtgaatcttgctctatagatgcgaggtctatactgcatatcaagtaagacctcttgctatcatgataaatcagaattataaatataaatattaaatcacacagattaaaaaataatatatataactactagtttttaatattaattatctatgattgtatggataaaaatgtattaaaaaatatatattattagtattttttatatatcttaagactcaaatcttaatcttctttaattaaactagaattatcaatctcatataagttatttcacgtgttttgcagaagcattttttatatattttgtgagtggagagagagtgatatttaatcacttcataaaaataataaatttggttaatttaattaatagtgttaaattcattaatgatttgtaattagttaatgtatctatattgaagaccagtatttttttataggagaatgtttattggacactccaatgttaatatacacataaaaaagttataaatgtaatatttgatttaataaaaaaaaaaaggatagaaacaattaaaaggtatcaatgaagtgatgttaaaacttcactattattttatataagaaagtaacaaaagcacggacacttttaaaaagaatttatataaaagattaagacaaatttatcaaaccttcccataaaaaaaggcagaagtagtactttttagacttttaaaaaaaaagtagtactatatagattatagagtttaacaaggatgccacgtaataagttggactatagtctttggatactg

SEQ ID NO: 1979 - DNA, 1414 bp, Glycine max
  Soy_ogl_215 Gm01:48934324..48935737 Cluster 8
cttcgaaccttttatgcaatttttttcataaatatcaaaactaaaataactaattaaatttggttagaattaaacacatcagaatatcgctggctttgatcagaattcaaatcccaaaaggcaaggatagaaagttagtagtagttttaaatttggctaaaaatcaaaacttattgatgaccactaccgagatagaaaattcttcttttctttttgaaacattactgatttgaataatattcttttaaaccacaggacttctgtgtctttgtctttttcttgtaataaaacttgcaaacttcccaaaattgtcgccattgttcataaaatcatccttaagggcaacacaaatttgggagtcaggacaacaggtttatcaaattttcctttttctacctctttcaatataatcaaagctacttgaaaattgcttatggaggctaatgacattcaattcactttcctgtattttacaagagaaagaagagacgttgatgaatcctaaacgcactgctgagaaactatgatgccaattttgttgaattatcaaaataacaatatttatttatttatttataattagtatatttcatactttactttatggtacaccaaaaaattattacatactttatatagacttttattccctggtgttctgattctgaataattgcatttttaatacaaacaagaagaaataactaaactaactaaacgttggatttcgataattgagtggctgttactatgatcaatcaaatctatgtgcggatatctaacatttaaaaatacacaagaactcaaccgagtatttcatcgtttagattcacaaatatctaaaattaaagatcttatttgccgaacttaaatttaagattttcttatttaatgaaaattgagtttcttgttacccaaattgtttgtcatcattagcttgtattttgcaaccacaaattcaaaaatcacgatttaaactcgagactaacgattaaattagaatgaataattctacgtacaccggttgattcaatcgctccaagaaaataaatgaaaactcgaacttgcaacctgttaagactttattgcactccactcaaagaatccttcaagattatgtgtttggtggtaagatatcatatttatttagctttgttaaatatgcatatcaacaatctagtaaaatacaaaaagaaatacataatttaataaaaacatattatgtatgtcaaggaacaaatgtattattattattattattgtgcatattagtcatataaaaaattaaagtaatttcacacaaaaaaatgacattaattttttattcatacagagaaaacgtaatctaattatggcttaacccgcctttgcaatcgaaaattccaaatacaatttttatctttagagcagacaat

SEQ ID NO: 1980 - DNA, 1500 bp, Glycine max
  Soy_ogl_3950 Gm11:372001..37507500 Cluster 8
ttgtcctttatgagaacttaaatatgatttatttttagcgtggattacaattttaaatatttttaaagctgtattgtttttctaagtattctctctccctctatcttatgatgtaacacagtgtagtgtgaataagtctattagtaataataagtaaatagttttatgaatattttcttacttctgtaaaaaaaatcttccgtttaaatttctgtggttattaatagataatttttgtagattaatattttaataaataaaattgtacgttaaaatatttatgttttcttcggaacttcattaaaacacttggttttttgcaaattatagaaactcacccctggttagtggcttggcttcacatatattactttaaatttcttataaaatggaataattttataattttgaggaacgcataaggcaaaattagcttaaataaccttttatttcttataaattaagtttttttagtataaatttttttgttataataatgatattaataattcattgacttgttatattaacaagagtttgatgaataatcatatctgctttttaatttcttacatgttcaacataatggacgacacatcaaattagttgattaaacatttaacttaccaaaacaaactatgtgataattatttttatcagaattttcaatgacaataagtgaatgtgttgtaaactttattgttatttcattaattaatatcgttacttcaacaactaaaaaaaaaaaaaaaagtataacttacgtcttgcaggtgtaactcttggtctttatttttgtggaacaaagttgtactgaattcgagttttggctgagagaatgtcaactaaataacaagatgcatagactatgacatgtaacagaggattatatatatatatgatgaagaattctcaaagccagtagctaatctgaccatctgagatataatgacttacaaagaactttattttaataatgagtttgtcacagtactgggtgcacgcaatttaaataggtcttgtattcagtttcgaggacaatcaatcaactcatcaatcaaacatatctattttttctacatgtccttaatcacttttacaatgttcattcaaccttcaacactaagggctctttagttagagtagcttaggaagccacagtcaagaagcaaagtctcattcttgatgcaaatcgtctaattttcttcggaactattatgagtagttagctgaacattcaattaaatttccatgcgacaacaattaccaatgactatgtgactcatcatatgttattatcctcctgactttgggtcacatatcaaagttccatactcaacgtaaagatcgtgagaatcaatctaatatatctaacctttaaattggtaaagtcagtattattgtctagagcccctttgtctttggcttgagcctagagaggtagtggaacctcccaaagtttaggctaattaagttctaagctcgccttccaaaaaaaaa

SEQ ID NO: 1981 - DNA, 1156 bp, Glycine max
  Soy_ogl_5217 Gm16:887845..889000 Cluster 8
aacacttataatcttaagtattaatgttaatattcaattttcgttacaattttttttattacaaaataaaaatattaaatatttttttattttttaactattaaacatgtctaatttaaattttgtatttttataaatattaaagataacattattttatctatcattttccttaattttaaatcagatgagagggatggagaacacggaccacccgtgttttttatgacaatatgtgatggcccgatggttccattcatttaagaataatgctttctatatagtatttttcacaatgttttttatacactgtttttccttgtgtttattacgttgtctatctcattatattttttttctgtccttgtcttattttcctattttatacattgcataattcattattttattgtaaaaatttaatatataaataagtaaataatacatgaacaaatgcattaagttaccaaattatatataatacatttattaattttataataattatctcataaatcatattaacaataatattttttattagttaataatataaagtttgtgacactatcaatacatctctattaagctatataaacaatactactgctcatccaacaggagccttgaggcgggaaaaataaaacccacagatacgataaatttcagagagaaatgagaaagcgatgcatcactactcatcaatcatcagtaacatgttgggaaaaaaatatttgtgaaagttaaatattttttattttttcttaaaagttaccttatctggtcttttttttttcaaaatatatatggttttgttaatgtatatctatttaagtttttagatgaaatattttactaatatatagctttagtttttttttaaaaaaatagattaaaaatataatttctggaaacatctcctataaaagataatcacgtatacgttaattaagtagaaacatatatatataattggagaaaatgaaatgtaatatatagcgtagtagaattttcaatacatcttcaagttgccgtaaaaggaaaggaatatttgtagcattgcttatcacgtgcttgtttcctaaggattcacgacacgagtctcaaggaaacgtgattcacccgcttatgtggatcccacacacgcgtttattat

SEQ ID NO: 1982 - DNA, 1027 bp, Glycine max
  Soy_ogl_5299 Gm16:4706946..4707972 Cluster 8
gtatttaattgtaaaatgattatcgtatgtgcattttagtaaaatgacattacacatcaccatgtttagaagaagaaagcttcttggatccttttggagattagaagcacaaaagaaggggcagaagtcacaagcccatgcaaggttgaagccaagtccagacaaaaatgtgggaccatagtaattgaatggcaaaggaatgtataaaagtcattgtcttcacagctcacactctccatttatattttctttctttttagttgttactttttacagttgtatttgtattgctgcaagaatcacatattgaatacgtacccatagagaatttcgaaatttaccgagctatccatacaaaaagtttttttattgagcagtacaaaaaccattttctattaatatttattcatccatataataaaatgattaatatgtttccaagtaacatttttagtattgtgcaatgtagatatttattcaagtgatacaaaatattaatacttataaggaaaattctcatactctgagttcgatgccaacttgccaagtctcaaaccctgcctctctagtctctaatctctatggtgatacaaggtaaaacatataaggaaactttcatataggcatacctgtaaaatatttacaacacttaaacatgaatgttaatattatttgacgtaaggatttcatgtctatgtatgtccacatattttaagattgaccttacaactcaagataaatatattatctatataaatacataaaatctgtcttcaattggatacatgtgaccttataaatgaactttttcccgccattagtttttaccttttatttattttacacctttcatttcaattgatattttcattttatctttctctactaaccgagtaaagtacacgtttttctgtttatattctattacatattttataaaatattaaattatttgaaaataaaaataaagagggaaaaataatcttttcaaacatatacaagtaagatgattagataaactagcgcg

SEQ ID NO: 1983 - DNA, 1500 bp, Glycine max
  Soy_ogl_964 Gm03:39303101..39304600 Cluster 8
aaacaaacaagagaagagattcaatgcataatgtagtatttatcaagaatttcagtgactgaaagttgaagattagcgcagcacacacattaagattcgttaggcttattgggaggcaaatttctttgtcgacctttaacaaagctgacaataacaaaaccagtcattgactttgagatttacactattacacacacagaacgccctgcattaaccgtattggtaatattattgtattattatgttacttatgcgatgggagggttagggtaggtagtcgttgatgttcttcataaaaagattgctataaatatgttgtactttaatttgattttttctatatatataagtgtaatatttttagaagtattaattattatttttaaatacttttaatatatggtgagattataacaataacaaattaaaaaaaaacattaagaaagtaagttatactagttaaaatattttttttaaaaaagaaaataatataatcaccttgacgatagagactattaaaaagagagaatatttatctaaaatgggaaataaatgttattaacttcacgttgaaaagtataaatagaaaataacaaatgacacttaaatattactattatatacacaattacatctcccaaataaaataaatatcataatattagtattataaattttaattttttaaaaaaaagttagggtccccaacttctcctacgtcattccatctctctgcttccagtgatacctgtggtttatatcagaaaaatctctagtgtagttaattaaaattagttattaaaaatgctttttttataataattcattaaaatataacgtataaattcttacaattatgtcattctttttacaggtacaataatatatatgcatgaacttaattttgttggaaaagattagtgagtactagatgttgtaacccgcgtaactatttacacttctggcatcgtgtcacgggcaagtcctatgcattgcatttacagaagggacattacatcttttgaagttcgcacttagagtttgaatggtatataaagtatcgtgcgcgtgtatgtgaaagagggaaacgatcaagtagacaagtagaagaggatgggagaggttatcacatgatgccggtacttgtcaggagagtcatttgccacacggatcctgattcctttcttcctttgatttttttcactcattcatgaataattctgttgaatcagagctcaaacctgatatgtttaaatcatggaattgataaagtagtgggatagtaaggtcctactttacatttgagagatccatctaatataaatttatatttaactttttttatatgtaaaatttttattgagttaactataattatatatcacgagaaaaattaatctttaacgtaataaattaaaagatacttataatctttaatctagacaaaaaattatatgttcgatcttcttccaaagattacaaatatcataactccgctaa

SEQ ID NO: 1984 - DNA, 1360 bp, Glycine max
  Soy_ogl_1132 Gm04:259341..260700 Cluster 8
tgtattttaaaaattttataatatttattattcttattttatattattacatatctttagaaaaaaaattggattttataaaatcatttccatgttaatatgaatatataagcagcgatgtcggaaaatatgtggtaaatttcattcaacaaaaaaatcacgtatttcctaagaaaatttatcagcatcaaaatggttctgttctttgagtaattatcagtcattgagtttgttacgccaaaaaaaaaaaacaataatcattaagtttggctcatcaaccaataaaaaaaataagtacttaatttttattttttacttttttttagtaaacttaccctctcatacactttatagaacaccgtaaccccacgttaatcatttaagtgttcaaaattatatgaatgcctcatataattaaaatctcatgaaaacaactcaaactattataatatagtagtaataatatactgtatattttttttttggtgggatatgctctttttttttacaagcatgctcttttcttctgtttgttaattttttactttaatttgaattatggaatttaatttcatacatgaagattgtatgatagtatcgacatatctgatcatattattattaaagaaaacatacactgaatttatcatgcaggtgaccggataggtgttgagttaaaatttctgacgtcattaacaaagccagtggtaatacttcatattaatttattacaatataataaaaaaattatttatttaaaaaataagtattaaatatttttttgaaagtcaaaaaaagagatttattaaatgacaccaggcaggcacaaggactcaaggagtatcagtattaaataattaataaaatatttaatatatgttatgttaaataattatcataaataatattatattttcatataatatttttctatatgtgattatatttattaaaaaacgaaaaatttaatttttttgaaacactaaatacattttttttaatattttatttatatagtaataagaggataaataaaataattttattggataatattacaatactgcactaaaaaaatagttattaagataattaattttattaaaggaaatatatcattataaaaataaataatatttttttacaaaataaattataatatgaaaaatatgtataatgtgtggaaattaaactttaggaaataatgtaactattagttaaggatatatatgcgcaccatattattcttaagtttttacttgaaaaatatattttcaacttgagaagttaaaatagtttacgtgtgtctatgtttcatgaaagattttcttttccacctttagtggtctatttcagatta

SEQ ID NO: 1985 - DNA, 1249 bp, Glycine max
  Soy_ogl_3317 Gm10:2290880..2292128 Cluster 8
cttgagacaaatttaaaggacacgtatgaaacctagggagaaatatgcaatccgcacagatgaaaataacagtaccaaattgcaagcagcaacgttgtcctatcatgtgacctacttgccggatgcaaattctcaaacggtaaccaaataatcaattgtggtatatatatgtatggaacgcaataattcgcagagcataactttgtccacacagaataaatctgtcacatataatatacctgctaaatgctaacttcttacctttatagaccctggagatttagtttatcatgccaagttagggaattatacaaacaaggggatccaatacgtcattaccacccttgcaatgcttttaggactttctttacgttatatatatgggaatatttgctagatatggagtttcaaatctcagtactttgaatatttaaatatgagtctaagaacaagatcttagatttcagagaatccttacatttccatatagaagtataatgcagacaaacatttttttttatattaaactcatatatttaattaacactaacaatattattcaaaatgcatacaccaaaaaaataacattcaaaatattgctgcgagagacgcggttgatccaagactatcaaaactcaatctttaaatctatcaataaaaaattatttattgttaatttttataaataaaaaaggctcaccatgtagttcttttaattaaaagtaaaaaaaaaaaaaacctctcaaaattcgctttatatctcattcattgttgggaagtccgtgagagatttctatttccgcaattaatactatttcaagagattacagtagtatcttctttttatataagtgaatgctctaaaaaagcataataatactttttttgtggatttaatgtacaaaatcaatgctgctaagaatcaaattgcatgtgtttggcacaaaaataattaaaaatttaatagaaagctaaaaaaattaattgataactaaaatttggtagttgataattaaaaattgttaaattaatttattaaattatgagtatttatggtcttaaaaaattataaatatttactaaaagtatatatagaaatagtgattaatataaaacgacagaaatagatatacttatgacactttcataaaaattttaattttattctatgttaatttgtgtactagtcatatcttgaaatataatttaaaagtagtagaataaataatatagaagtgaaatggttaaa

SEQ ID NO: 1986 - DNA, 1111 bp, Glycine max
  Soy_ogl_3533 Gm10:44942090..44943200 Cluster 8
atctactactaaaagaaaattaaatatatatcaacttaaaatatatttttcttatatattttctttattaatattttttaattttaaattttttttcaactacagtataagcttatagttcttttttttttcaaaatttttcttcattagtttatttgaaattctcttttattctttttattttaaaaatgtttttttagaccatcctactcggggaggattaatcaaatcttcatcattttatatacatacctagttatagtaattaaaaaattaaatatgttatgttattatctagcatttatcaactagtttattaataatttaatatattttatgttatttaacatttattaactagatttccttccctgtatataaaaaaaaaatccaccaacaaaataaatatttcctttcctacgaacatcagttgcgctttagtgcatggtaaactttttttttaagaggcgcatgataaacttttaagggttatgcacttatactatttatacaattttttttttagtattttagtatatactcttttctcttattattcatcttttttgtattttttttgtaaaaaatgtataaatacattttctccacttttaattttaatttacgtttctcaacttcctaccattttttgtaattttgtaggaaactctttttactttttttgggtacggtaagtactttaactgtatgtattttggtttttaagactaggagaaaattttaggcggatagtatatttatatacgtcaatggtttagatatggtttgagtatatagtagactttataaaaacatttatttagtccatcatctacacaaagtatctagcccgatcgagttaaatatatcttttaaagttgatagagtacatgcaccaatgaacttcactaaaactaggtgattgggaatagcaattaattaatagaactaacccaagcaagcaacaggacctaatgaatttgtgtaatattgttattcagatcaattttaagcaatcgccagacatattttaatgctaaattgatccgagaaacataagctacttaacaagcaaaacaagtacccgaagtaatatgtcatatgtattact

SEQ ID NO: 1987 - DNA, 1185 bp, Glycine max
  Soy_ogl_6743 Gm20:34376701..34377885 Cluster 8
tgattattttaatttttttaatataatattaattattttttcacatatatcttttataattaatgatttttttatttgtgtaaatttgataagtttaattattatatggttttcttttttctttttttgaatgaattatctgattttcttgaaagcatataaagttattttataagttgtacacgtgtcagcagtttgattatcattcttgactaggaaattaggatattattggtcaatggcactaaccggcatacaaatctactttattttctctttctggaaattgtttcaaagaaaaaaaaagttagattttagaaattataattttcaaaaatctggacttctaaagtttgatcgtccaatccacatatacacttacgcttcccgtgttgccttttgggttgcctaagctataaaaattaattatttatttgatttatatagttatacaaactttatttttaagttccaatattaaaaatattttcctttagtccatatatatatatatgtatatattattttttaattattttaagtttctatgagattaaaaatactatataaaggaactaaagattaaaatagcatgtataaaaatttgtgcaacaagaattaaataaacaattaaattcaaatcaaaatccccgaaaaagttatagcacatttgaacatgatatgagtgtgatgtcaatgagaaaatccaaatgtgggaaattttgaatggtgggtccacctaagttgaaacttgaatgttatatgcaatataatttgtaaactaattgttcgataatatttatgacacggcgaagaatatcctttccgatccatgtttgaaaagtatctaaacgaatcagcacgtaaaatagaaaggtagcgtagcttataaaaagtatttagatttttaaaactattataatttgaagttctattaacgtactttcgcaattgagagggatcacagacagtccaagaacttcgcgtgtacttatttaacttttgctatttttattttgtaaaatttaaaatttttataacaacaatttatttttacctaaataaatccataatgactaaatgttttttaaagagatcaaatcatgttaattttgattaatggaataaatgtttcgatattaatataattttaattttagaaaaataaaatattgcattgacatg

SEQ ID NO: 1988 - DNA, 1200 bp, Glycine max
  Soy_ogl_6824 Gm20:37965501..37966700 Cluster 8
atatccgccggtattccgccgtcagaacagtacggtcggccggcgtgacttcatcatgtaggtcccactgacactcaagacaaacttacatattttctcttttctcaggacacagaaacaacaagctaattactacttgaaaatgttgatagatggttacttaccctttcccctccctctcactctaccaacaatccaacatactaccattaattatatacatatatttaataataatttaaaacacttttaagaaaaaaatgaaaaacccaactctgaagtctgcacattgtagttaatgatgcagagagatcatttaaaccctctacttttctcagcatgttgctgcaacatggtttaataagggttcaagttcgttagtcatactataattcttcaacaacaaaaggaaatgggaaagaaagtgtttttcttttttaaaaatcaaatattcaagctaattaattttttttatctaacctaattaagcttataaattagtagtagtataaaatactttaaagtaatgttaccatattttaaatgtaataagaatttgaagatattttgatttccatgtatataaactttttagttagttttgtgtttcactattcataacttttaacactcttttaattaataaacttgccgagagataacaatttgtttttaaataatttataacacataaaaaaattagaatgaaaactattttacaataaaaaaaaaacatagtgcaaaaatgttaatgcatgtatttgttatgttattatggttatagatgacttttgtttaaaacttggtaaagttaattttaattaaatcaattactactttaaattttgtgtctttttgttttgataaataatttgttagaatttattgtaaattataattgttaattgtttgcctaatgcaatgtacattgtatttaattaatgtgattttgactttttcattattttttgtcatgcaattatacttacttattagtatattttgcgttagtattattaattccaagttgtgagtattagcagtaccttctaccttgcaggaggcattaaagataattatgaagttgtgattatattctatcagaattggttgatgactttttcatgtaaacaatattgtaagctcggttgagagcatcatcactcttcctgttagtttcaatttgctaattcttccgtt

SEQ ID NO: 1989 - DNA, 1301 bp, Glycine max
  Soy_ogl_6874 Gm20:39614200..39615500 Cluster 8
atgtctaaataaataaatactagttggataatccgcagtctccatcatattgatgttactgaatttgagaaatgctcaaatatgaagatttcgtgaaatgtgattatatataaatttccagtataatgattttaagaaaaataaaaatataatctgcatattttttaaactattttttctttggtttataactttatacatgaaaaaaaatagatcttatataatatatattcacaaattaatatttaccatttactgaagtaaaaaccaccttaaagtattccttttgaaggcgatttctgtcttttaatttataagctgcaaatttttgttgcagacgaattagatagtattgctttttctgttcatgagagctgaggtattaggttgaagaggcgatttctgtcttttactgaagtaataaccaccttaaatgtttgctaagttggtgtcctacttgacaatatgaattaatcaattcaacaaatatctaacactattataatttattaaatgacaggtattaatttgtataaaaaaatcaagtaacaatcctaattaaaccaagtcgcagtctttttaattgtgaaacaattacaataaacaccaatagcctaaaccggtactccttcatttttttttttcaaacatattttatagttggaaataattgagttgagttaaatctgttttaccttaccgtaacaaaaattgattcaattttttcaactaagtttaattcaagttaagtttacgaattgctcatttagctctagaaactaccatggttttcgatcccacttcgagtcctagcatacttaggtttttaataatgcgaacttatcaactaaaaataccatggttcccaaggatcaaaatgcaagttctaaattatgtatcaaatcaaagtggaaatgcgaaaaatcaccattgataacttcattttagaagaaagttcaaccatccgaaacaattatcaatatgcctcgatacaagtttgaagtaacactactataattttttgttgaaacaatttataatatactactagtccattactaaaaaattcatatcgcgtgaagagtgaaacttgaaagttccaacgtgaatttcctttttctgcatctccgtaatgattgtgagagcataactactgaagcccaccaccttgttgcatacatgattgagtggtcaaaagctcacacggtgccgttcatttgctttcaactaaatattggatatggggtcaagttaatgttgttcaagagatagtaggaatcaatttgaggcaattatgcccc

SEQ ID NO: 1990 - DNA, 1482 bp, Glycine max
  Soy_ogl_1924 Gm06:13618919..13620400 Cluster 8
ttacaataatacacaaaacataattaacctaagtaataaaaattgataaaaaattcatagagatgtaattttttaatcatatctattattctatatatctttttggattataatataattggttacaaaatatattattaaaaattagtatatgttaggggtaagtgataacatatattttcaaatttattaattaatatttttttactggaactaatacatattaattattaattagtttattgttttatttaaaatatcttttaataaaaaaatattaatcattatatttaacattaaaaggggtttgagggtgggggctaaagtcccgaggtgcccccataatagattaataggaaaatttaaaccataattttttttatggaattcagagatgtgctaaggccaatcaaagaaagtaattctaattatgtcgacactacaaccataaacagtgaaaataacactctccactgtattaaatccaaaatagaaaataaagatcatgaagaacaaagatcaaaacccacaaacaatcatttgaacttataacaaggaagatcatacttattcctagacaactcctctaataaaagaatggagggagtcccaccaaactaaaccaggcgtaaaactatcatgagaagcaagtctatctgcacaaattgtcctcatggtaaatatgagaaagagaaaaggacatagagtgagtcatatttatacaatttagttatctatttataagtctccaaggaatcacattacgaatcttgaaagctttaataacaagaatggagacacactcaatccaaagggataacatctttgatagaaaactagcttattttaaatcacattaataataatatggctaatgagttactcgagttatttactttactgaaatctagctattctcattattagattagatttatgtccaaccaatattgaagacataaattttgtacctattatttgatttctgctctttgcttttatatttttgttacttgcagtagcccaaaggtcctgagtccagtgggttggttttactgggccttattcttattgtcattaagttttacgacgttattattttctacatttccattccataattactttatgcactttccgttgcattccaaaaagtccaatctaaaatgtaatagaaagcagctagaagcaatagcaagagtgcaggaagttttagccagtacgatgataggttgagtttttaatccattctaatttttaactacagagcctgagtttgcaacattcatccttttcaaatttttgcgagtagcatgatcaaagttatacagaggtttaggatgttggtttcccattttggtcatgtaacggcattgtagtattatgaacctatgaggatcaattccaaaagattatagaagaacacgggatcgtgaagttttccgtggtcgtggttatgcaactgattatgacagcatttgt

SEQ ID NO: 1991 - DNA, 1000 bp, Glycine max
  Soy_ogl_42 Gm01:1961601..1962600 Cluster 8
agattttgacaaatggactttactgatttccaagattaagaaaggtgtaagtttaattttcttttaatttaactaaataaattgactaattaaactattacttttttttttattgtctatgtacaattccacgggaatggtcttgatgctgctggtaagaccactatcctctacaaggtcaagcttagagagatcgttactacaattcctaccattaatgagtttctaaattttctctttttctccaaccttaatagatgtgttattctaattattttttacatgtagaaggaatatgtcttatcgattaagattgtatagaattatcttaattaatcactaatgtcttaattatttagttaggattcatgataataactgacttcaagaccactaggcctgaataccgagatcccaaattatgttggttatcatgttttgcttgatgtgagaccctgaattgaagttgatctaattgctatgtaaataaaataatcttcgacaactgtaatattactttttacaaacgttgcggggttattatgggtttactatttggcgtgtgagagtgctggaatgttttgaatattagcttcattgtttgggatgttggtggccacgacaaggtggaaattttgattctcatgcatcccttaaaatacaagatatttaatgcatatatcactgattttaatattttgctccatgtgtacttttaaaatgaaaaaaattagtagttttaatttttaaataaataattttacaataattgttttatgtgttttttgtttacttctccacctttggtggtaagtatctattctcattcatctttttcatgtttaaaaatctcgaagtattggatgataaaaaaagattaaaaaaatattgataatatactttttgtttaatttaagaaaaataaaaattattaatgtattctaaacttcttacatgatttacactctatgaactaattaaaaacacattctttggagta

SEQ ID NO: 1992 - DNA, 1000 bp, Glycine max
  Soy_ogl_1254 Gm04:6352401..6353400 Cluster 8
attatacacaaatactataaccctaaaatcatacattaaggagtagaaatctttaaaggacatttttgggatctgaagtaattaagttaagctaatttgcaattgcaaggtatttaattagtatcaacttgaatatcttaataattagttcctgaacaaatgattcagtggagtggaattttgtatttgttatattaaagtgctgacttctcaaataaaatgcgcaatttttttaaaaaaataatatacagtatataactagtaaaaattgctgagcaatagttaatcaatcgtaatttatttttaaccctaagcaattaaataaaagatccaatatctatcttggatatgagtcttattctacgaacctatattagctagtgactcgtaagaagcataactccccttaaactttagctagattcgagttttataatttaaaaaagaaaaaaagacttcattaatgagttcagtgattcaattcaaactagtaaggatttaaggtgacgtatatataaatatcaaatgtctcatgccaaaagatataattcttatcttacgtaagaggaaaatctgtagaataatctttttttatgtagaattcttctcattcacaaaaggaaaagataaaagaatttttttatgtaggattttttttttaatgtagcttcaccaatgttaatatgggatttttcttatctattagtactactttgcttcgataggaactaaaactttatcaaaagtaacagtgttgatggaaacactagcataaaaaaggtttttaatattagtatttttacagcagttctagtaaaatccatatataatctgtgaagcgattacaattttgttatattgaataactatttcaattaattgctaaattattaatctagaaaatattttattggtttagatagtattttttataacttttaagactcttaacaagttaagatgttctagattggttgcactacaattacaatcaatgtag

SEQ ID NO: 1993 - DNA, 1200 bp, Glycine max
  Soy_ogl_1421 Gm04:45793401..45794600 Cluster 8
tgtaattgaaaaaaaaaactgataaaaaaactcagaaactaaaattgcaaattggtgatactttagagacttgaagatataattaagactaacttttacaaatagtaaagataaaaatgtgaaataaaatcagtaatgttatattataaagaaataaaaaatactactaatatataagtgttatattacagttattgtaaaataaatataatacagtgtctgatcttattagtgaaaaataaagaaatcccttactggtactattcaacttagacgagtgccacatggcaagaagaaatcaagtgttggcagaataaaaaggtaagacagaaatgtgaatagttagatgggtgaggatagtaaaacccggcgagtatgctggattgctgttacggaagcgacgagagagtggagaaagttttgaaactgaagtgaaggcgataaattttgttgtcctttagcagagattcactttttcatttgacgagagatgatgatgtccaactccatctaactctaaaaactaaaaactcattactttgctttctttttttcttcaggaattgctctatcccatcccacgttttcgttaacccttcgtttttgttgattaactcatctccaattcatttattagtgaaacataattaaatttggattgaataagtgaacgtgttacttattattattgctataggaaaattcaaatttcaaaatattacccgcggcaaacacacattgttttgcagtaggtttatttctaaagcacgcttttcagtatcattaacttttatctattaattgaaataaaatgtaattagtaatttaatatataatttattttcaaatataaaatgtgagatgattattttgcagatttttccaaactcaataaaatctagcagggatgagatatttttttaaaaaaattgtctctcttccactcgacctcaagctttgcattgcttttttgtggagataggggaatgttgatcttttaaaaatggaataagataaaaataaatttaacttatataatgctcattcataatccatgacttatagcttttatattgtggatgaaatgtatcattttcgttccttattacatttatgagacgtataaagtagcttgtatagagtatatttagacttgtgaaagtattttatatcttttttataactctttaacttgtctta

SEQ ID NO: 1994 - DNA, 1200 bp, Glycine max
  Soy_ogl_3215 Gm09:40055301..40056500 Cluster 8
ttttcgtggaatcctttgtcccttactatgtatcttgatttaattggaaccatttcacttcaatggcattatccatagaataaaagcagtatatgatgcttccacttagcctaacttttaactgaaacaaattcaagcacttatgaacaggcacctacaatatgctattaattaatgttcattgtgctttatataaatcgtgccttttttatgcttcattaattgccttaatttatacctttaagtatatttatactttttttattcgtagaaattaaatatgatttcaacaaaattgagttaaactctcgattacatttatacctttgatcaaattacatgattcatgtgccatatacactacgtacaacagacttttttttttcctttttctgagtgctgtccgcagattggatcaagacttaaatttatagatgagttgtgctgtttagtatgagcgtcatccttctaattaaaagcacgaatagccaacgtggaacatgtcattattttaaattaatagtaattacagaattagaaaaatataaaacgagatttgaccaaaatcacttgtttgtgcctattgtacaaaaccaattcgtgaaaagtagctttttttttttatatagattaggaaattgacgtatctaagcttttcacccaattaatattatgatcaaatgactagtctgtagtgcaaattttttaacttatctttcaatgcatatatcagtactgcaaattaaattttggggcattttataataaaataagttttatattttattaaaaccggaatctattcttgcttgagagtcatgatctatttaaaaagttgattatttttaacagatgttattttatacacatgaaatcaattcaaattatatttctttcctttcagataattaatataaatctagaaaacattcatttctcattttgtatgtaaaattattgataatttatctggataatatgtcaaaaagatacttgtataggaatttataaattatgagactgtaaaataaaataaattagcacctgtataaagaaaaagaaaaatgatggatgataagttatccttaaataataaaattttccagtcctcattttttacagtgaaataatattgttacgggctgagcttaagttcaatctaaataatagcacttacaagtttaaatattggatccacac

SEQ ID NO: 1995 - DNA, 1119 bp, Glycine max
  Soy_ogl_3359 Gm10:4085582..4086700 Cluster 8
ttctcgagcaaattagaagcattatgagttacaaaactttagatttcatcaagcatttaaattcaatatcgccgatcaagctagaataactccttattaattaattcatgcacctaacatcttcttcctttgtctatcatccatatatagatttttataattaaatgaaaatatattcttaattttgagctttttaattttaaaatgaaaaaaaaaacaataaaacattttattcagcttttttgggtatcttgttctacaccctagatattcaaaacttttcatttccattcttatgacaattaggctaaactaaagtatttgttacttatttaccttttttagtctcttaaatttaaaagttttatttttaatctcttgaaagttttatttttaatctcttgaaatatctttattgatccaaattaattattccgttagtttatcacattaacttggttaacttgatcacatatgataaactgtaaaaaatattatgtcagatggatgtttgtcagttaggcaaaattaatatagttagtgcaaaaatcaatggaaagaccaaattgatataacaaattaagacactttaaaataccactagataagaaaaaaggcattgatttaacagatatttcattttcaaatttatcatgaaaaagtcatgtataaattttgtagtcttaaataacaatttcattcctataaaatattctattttttttgtaagttatgaaactaataatttgcacattttttcgttcaacttttgaaattgtttgcattttgtcgcccaacttcttttattgcatattttgccatcacactttaataatttctgcattttatcactcaatttttaaaatcaaaatgattaattataatataggggacaaaatgtgggaacttattaatttttgttacccaaaaaaattagaaatttatttgcttattatttaaatgttgagactatgataacaatgttatataaatttagaaattaaaatgaatgtttactcccttaaatgtcaaagtagaggataaatgtgtttatttttcgtaaataatatcaataataattaacacaaataataataattgtgttttttaattaaatgg

SEQ ID NO: 1996 - DNA, 1000 bp, Glycine max
  Soy_ogl_207 Gm01:48649401..48650400 Cluster 8
agatggtaagcacttctttcacttggggagaataacgcacgttactaattgatcccctttgactaacgaaaaaatgattaatgcgattcttgtttatgaccaatgggcataaatgctatgagtactttcattactacgtactaggtaatggtaagtaccaacaaaaagggaaaacacaaacaaggggatcatcgaagagatgaagttggaaaaccactgcggtgcgctgcttgtttgttaggataagtgaaattctggttaaggttggttggctgacaaaacatatatgctttccttttcataacttgctttgtcaagttggtgactaagcattgtaattactcttaaagacgtgattgctttaaatgccattgacatgacttatcaacagccaaaatatcatttttcattttttttatcgtattattttgttactataaagtttaaatcaagaaaaaaaaacatatattttttcaaaacaaaaatatctcagcaataatttataataaaaattttatattgtttattcataaaaaaaattgagaatcaaacctaaattaaaactaatatgacaacaagattcgactagacgtacaaaagttcattattttggtgattatattatatttcattttaataaatagtcatgtcgaaagtttgataataaaaaaaatggtgatacatatatgtacatattttatcatttaatcataaataatttgtttcatattttgtattttctactttaattttattgccaagtgtgaaaatattaatcttaaaaattatacaagaaacgtattttttctataacttttaataaaaatattaattgtacacattagaaaaaactacataaatattttagtttatagatttatgaaattttatttctatttgttaaccaactcaaagttgtagaattatgattgtgctaatatgtatcagcaccctttttaataattattttttatttctaacataattttttcttttattt

SEQ ID NO: 1997 - DNA, 1000 bp, Glycine max
  Soy_ogl_2261 Gm07:7867901..7868900 Cluster 8
tgtaatattaatagaataattatgcttgtcaaactttaaattattcaacaccagtccaatataagaaatatttgaggtgaaatttaaaatcttgtatggtcttccaagagtcaaactccaattagatcttggatttgttatatgcttaattattcattaagtttggattatgaatattattggactaacagtgttaggccatatgggcccaagtgagtctaaaagtgtcccaaaacataaataagtcaaaatatcaaaggtatatgatgttataattaacatttaattctattttaaatgaatttatttgatgaattatcaacttgtgattatattttttttttgtgctgggacaaatatcagggatgttctttaattcaatgggttagaaattaatctcccttgttatatgtgactctcactagtcttcactagtctaaagaatttttgaatttttgcataaaaaaaaattaaatacaatttttcctcttgttaaataaattatataataggaccttacattattctattaattctatgagtttaatttataattatataacatattttaagcatcatctaataagaacggcaattattcataataaaaatagaatgattttttttacaataacgataataaagatcaaatttaagtcttcatgcatcaatttcaatcctatcacgaggctgatcctaaaggtttaattataacattttttaactttaatagagtaaagttaactatacttactattgctatttttttaaagagatacttactattgttatttttttatgtctacttactattgttattaatagttttaattttgatatttttacataaaactacggccgataaaaaaaaaacataaattcaaccatacactatatttcaaatccaaaacataaggggagaggctttctcatgattgaaatttttattaaaaataaaaaaatgctataactattattactatatactgattcaaattga

SEQ ID NO: 1998 - DNA, 1100 bp, Glycine max
  Soy_ogl_5840 Gm17:41396901..41398000 Cluster 8
attaaacaacttactgtgtgtgagattgaaagctgaaaacaagagagaatatagagtgtaaattgagtgtagttttaaattgattaacaaaaaattaagtacatgttacaaaatttcgggttattgtgaaggagaggatgactgatgatgaattgagtagagaagagaatgggacaaatcgagaagatagagaaaaaaaaaaaattaattggggaattatggaaggcgttagtgtataaggattaagtccacttaagaaactaaattaatcgatttgaaattagaaatattaaaattaagtttgataaaaaaaatataagaataaaaagtatattttatttgattttttattatgaaaatagactatatattaatagtgtaaaataaattgatagtacaaaactattttataatgtgagtacatgatcattgttaagagaactatcatatatgaaaaagatttatttagaagaaattaatctttttcttttagtttagagatgtctttatataagcaaaaaagaattaagagttgcctaataattaaattcaaatcataaagtaagatcaatactttatttttataatcaacctcatttttattaattttaaaatactaatcattcattatttataaagggttttatttcactgtcatcttgatttaaatattaataatatcatttcttcttcttcataaaaataccttatcaaaaccaaaagaaagacgctcttattcacgataagtttcaatttacaagctataatatcttgatatatacctaatgacgtatatgatgtaatgcataaagtggactcaataatttgtcatcgttataatcaacctcatttttattaattataaaatattcatcacccatgaaaggattttatttaaatatcatctttaatttaaagatcaatatcacaattattcccattaaagcatctgataataaaaaaaaacattcatgataaattccactttccaaactcataatgccacgtgagaaataatgggtggaaccaaaatactgatggaatccctgttccacgcacaatgcaaaaaggtggatcttcgggttctcagttctttaatt

SEQ ID NO: 1999 - DNA, 1100 bp, Glycine max
  Soy_ogl_715 Gm02:47413401..47414500 Cluster 8
agtgtaataacaatcgctgctggcttgtggtgccacccatgcaagtaaaaaataaacattggggacctcacacattgttttctgagtcactaaacaagtgaaacaagttcataaattttagaaatgtacatgtcctactagacagtttcttgttttctccttttcacaatcatttctgttgagagtggaaaaaaatgaattgcagaactgtctgcaagttctcgtagaaatcctaaatagtaaatgcaatttctacgtagtactctataatttcaaataggcaaatactaataagtatttttaagatattagttaagaatacaaggataaatatttttatttggaggcaccaaattatatcgtttataattttttttacggttttttattatttttataataaatatttttttaatttcttaattaaccaatatcctaaaaatactgattagggaaaaaatctccttttcacaaacatcattttctcctcttttttctacaaactattgtgaattatctttttctactcagcaaaattgattagcttctttatttaaaaagaattttaatggtgttatattaaatttgcaaaaaaaaaaaaaaaaaacttatgaactactataatctttatcacacagaatatataccaataaaaaacattggcttttgatgaaaaaaaaaagataacatagtaaaatcatttttgagttctatgttaatttggatcaaagcaaacaacggttgaatatttttttttccttaacacactttttcatattttatttgaataaatttatttgttcacatcttttactatttcgaatatagtttttaaccaccatttttatgtgaatacacatcacgagtgtttttttaacacaaaaacactcgtgaatagtttttaattaatttttttattttacgaaacttaattcaatttgtagtaaaaaatgcaaaaaaaaatcttttattttattggttaattttgaaaatatgttttatttacactttgtaggttgtctcctcataaaaaataagccaactctgcacatgcatttagtcttatatttataaactcactttccctcttatttttattt

SEQ ID NO: 2000 - DNA, 1000 bp, Glycine max
  Soy_ogl_926 Gm03:37371601..37372600 Cluster 8
aattcaataaaataagacaaagaagtaagtagtacgactcaatgatagtactatatttaattaagcatttcgcttataaatacaatatttcaatctaaattgaaaccatattttaagctttatatggcagtgcatgattgtatagcagatgcaataaattaccacctgctccaaaaatcaaatgctgattgtttcatgaagaggcatgtggggaataaggtgtattattatatactactaacagggtattacattgccctgacacttgctatttcttttttggcaatacataaatacaatttttttatataccaaaattattttaagagttcaattatgatgtattattagtataaataattttataatgttaactaatcataattattatatttgggataatttttatcctacataaaaattcagcagaaaaagaaatcctacataactataactaaatgcgttttcttttttttattttaaaaaactataactaaatgtaacactataatgtgaatcttaattaaattattgttttatatttttcatgcaaaatatgttttttgaccaaaaaaagtttttatgtctttaaaaaaaatgttaataaagtatacttactataacaaaaatgcaaaaaaaaaaaaaatcaatgcttaaatttctaagtaatttaaagcatttaataaaaaaatacatcataaattgtaaagttacattattattttttagagagattaatgtatgctataatttaatctacgttaaattaatttgcaaattcctgaactatttcacaatttttaactacgtctttgaatatattttttttctcctattgggtctctgaacttgtatgagtttttttaattaggttgttgtcaaacttaattaaaaaagtaaatataagtttaggaatcctagtaacttaattaaaaatgacaaaaaaaaattgcctatctctaaactcaatataggcttgggtgtgcagtgtgctgcagag

SEQ ID NO: 2001 - DNA, 1413 bp, Glycine max
  Soy_ogl_1427 Gm04:46013701..46015113 Cluster 8
acttccatttgttttatatgcttcaagtattgtttttttttttctttttgcatcaagatttggtgtatctcttccgatccaaacttagttgctcattcaattttttaaaaataagttatatatatcatctaaattaattataaatctctcgcgactctatctgtctgatgttttaaatacttttaaatttaaaagtacctttaaatatatgaaaaatttactaattttatgtactcaactttgtagtttctactttgtacatacttgtcagtatatacctaattgagggctcaagttcaaagtagcatctcaccgaattgattggattcacattgccattgtcaaaacttagaaaccgtcaaagttcacaatgatcacgttgcatgttaaagcagaattgaaagatgccttgctcattgaattggttgcttctctactcgctaatcattttataaaaactttataaaggtctttgttgctttagcaagttttcttttttgcgttttatattgaactgttacttagaactaatctaaggtaccttgttgcgttagcaagtcttctttttttaactgaagagggattatcattgactcaatattacatagtttcccaactataaaacatgatctaattaactaattttacacattatattacttatctaatacaaacaatgaaattaaccgggaatggcatgctatataatgaaagactagagagtgcagtctaggaatataaaaagaaaattacaatcagaaatatcaaaaaaaaaatatcagctgaaaaatatagatatatatgtgtcatgacattcacaaaaaaaaagtaaaaaaaaaagacttcaagtaaattacaataaaaaatatatagtttaattacatattttatgaattttacaaccataattttttctacaaattttatcatttaattttttaatttttacactttttaccatccaataagtttgtttttcaagaaaatactatttttaaatttttttgcaatttactatcatgttgataaaatgtaacttagattatacgttataaactagttggagtaacttataaaaataagctaaaaactaataaaacaagttcaaatatcgaataaactttctttttccaaagtaacttataaagtgatcatattagcttataagttcctagagtggcttgcaaaacctctaaaaggcacatgctaaaatgttatttgaaattgcatcatagctctaataataaaattaataaaaaacttagtacatacttggattgaagtaagaaatgttgtgcatgtttttcaatgtaaatccaacgaataaataaaataaaagcaaaaagttatgattatgatcttttgacaaaattacttttgcacttgaaaatcaaacattcacttaattataat

SEQ ID NO: 2002 - DNA, 1207 bp, Glycine max
  Soy_ogl_1954 Gm06:15004201..15005407 Cluster 8
acgtggccttagggtgattgcagctctttaaatggatgaagaagaccatttctactggagggtgctgttgaatcagtaatttatgtcccagaaaagggatactcaacaacaaaattaaactagaactcagcacagtagtctaggttaagtcaataagttgtcatcactcatcagtaaccgcataactgtgcaagttcaactacgtactagtgatctactaccaccctcaccagtagatttgtgcagtattcacattagtgaattgagatggctcacctttgaacaataattttcttgtcagcattgagaaaccatttccaaaacatataataaacaatagtttgatggtgtggatttttttcattgtaaactattgtaaaatcgttcttaaaatgagcatgtgcaacaattttttaacagttggcaattttcttatcaccggttataaagtatgaacattatttgttctggtctatatatcattctaaaattgtttctaaaacagaggataaataacaaatttttaaaaaaaaaatagacaatcattactgaaaatgttggatgaataatagaaattttgtgtttttaatatataatgataatgattaaaaactattgtcgaaatctaataggcaaccctcttacccatatttttgttatttttataacaacggtaaaatcttattgtctatatatttaatataaacaacagaagcgttcaccagaaatttaagaataatttcagaaatatttcataaaattcatcataaacaataagaaaatttgttctcagaaaaaaaaaatgttaagtgctaaaaaatttgcccatactttttatcacaattttgaaaatttaattactctaaatgaatttgtgtttgattgcatataatgaagctgaactaataactattcacattaactaatttagcaaagcagccaataaaagttgttcttacaagttttaaaaacgtatatttttttgatacaacagataaaatccattgtaaaaattaactaacattacatttcatccattattttttacttaaaagttaaagttcaaaataaaaaataaaataaaatctgcttaacagtttttatttatttttatttaaagttttgtcaaagttaaaaaaattgataaaatttaaaatggtttgattccatttaaaataagtcatcttgtccaatgaaagaatgtatc

SEQ ID NO: 2003 - DNA, 1145 bp, Glycine max
  Soy_ogl_3358 Gm10:4082762..4083906 Cluster 8
tggtaaattgtcgggagtaaactgcaacatgcagcatcaacttgtacaagtggtgttcacaacatcattaatttagatttattgataaaacgatataaattaaattctcgttttaatttctataacttaataaatgatctgattttcaacttcaaaacctttgccgaataacaagttgtccgtgtagctggggaagcatctacttttacaagttgagtacgcactaccattaatttaaatttataggtataacgaaggttgagatattaaagttgttttttaatatgtggaaattgaacataatattagaatatttaaacacacactttacttaattaattgaactaaacctttttaatattcaagttcttatttagcattatagtaggaattattataaaataagttgatgaaatactatattttaattttattaattttttatttttatttcatattataaaataaaataaaaggtgtttaaaaaatactattacattaaaataataataaaatgtttaatatttaaataattaaaggctaatgcaattgtttcttgaatataattaattattattaagagaaggtagataagtgtatacttcatactaatattatgattaaaaaaaatcatggcaagaagatatttgtgagaaacatttttccccttaaattaccaaaaaaagaataaagatataataaaaacatgaggcagatgcattaattcctcgtaatggtaattaacttctctataccacttggatcatcttcatttttactatctgatatggaataattgatttttttttaaaaggcaattgaacgattatattcaaaacaaaaaaagaatttgacttctgcattttccccaaattttattgacttttgcatttaattttatatgaaatctgtaaaaacacacgtacggaaaattcaaattcagtaaagaaaaatgcatgaatggaatttcatagtcatagacatggtaatcagggtatcgttaatgtgatctctcatattacttatatacctaattttcatatttgaatctcgtgttaccatgttattaatatattttatccaaatagcattgtctactatttttttgatacggcatctgtaaaattttggatacggatgggatt

SEQ ID NO: 2004 - DNA, 1000 bp, Glycine max
  Soy_ogl_1565 Gm05:3016101..3017100 Cluster 8
gtgttctctatacaaagtagcgtataccgaattttaaatagttgttttgttttgcccacgaaattgtcaaggcttctcaatttgtttggttagtttagttttaaaaagtgtgtttttgcaagttgctcatttataagggggctaacaaaagctaggttcaattttttatttattttttttattgaagttacaatggtcttaagctcgtgaacatgtgaataaaagaaattcggacccaagtggaaggaaattttctctttttcttcattattttttcatgtttctataaataaaaaattaatgttactttatattaaaaatagactagacctaacttactcttaaaaaattaattctagaagaaaaaaatattaaaaaaaggataaagagcatctgtattggtgaaagtcgttaattaataatgttgtataattcaaattttcatatgaaaaagatagctgcacattatgcccatgtgtcaggtcagtaaccatgagtccatgactcactcataacttcataagatacgatttcccattggtaactcacactttattgctctctaatgtttcaaccatttatactttggtttcataatttaaaaagcagtttaaacaattgagtcaaagttgcttgatataagaggaaagaaattaaataaataggagagaaaacatacaaaatatatttttttatttgattaaataaaaataaaaattagacttttaaaaacaatttttttttccattttttctttgatttaattttctctgtctgttttttccctcttaaactctcaaacaaacagggggaggtaagtgtcactttttaatctgcaaaggaatatactttatatactaaaatggagctggtgaatttggtgctgataataactttggagggtcataatcggaacgtgggcccgggtcagcatattttaaatcttgttaatgctaacccattaatttgtatcgccacaaaaaaacaattatttgactat

SEQ ID NO: 2005 - DNA, 1000 bp, Glycine max
  Soy_ogl_5182 Gm15:49870801..49871800 Cluster 8
gaattgaattgattctgaattgcacaaagttggggaagcttggggaaattggccactgattgcttgtgaatttaacttctaaagtgctgaataatcaacatagttggtctcttatatttgttgtcactattgacaatttatggaagaatagaaatggaagaattttggagaataagttgagaagtatgttggaaacctcttgcacaaattagaatcaagtcaatgtcatttccttgagtttcacgtaagactacatgcagttgacaaaattaaattcaatatatcaatatgcagaaattattaaatagatcatgatcattaagagtgttcattgttacaaccaatgtttgtttagcacatttaaattttatgatttgcataaaagaattaataacacacgattacatgtcatgtgaaaattaatgagagatcatgtagtttaaaattatctaataatttatataaaatttccattgagccaatttaattagcaatggaggaacacatgattgtttataaacacaactctaattttttttaactatttggatttaaatatttttttttgaaagacttggaatcaaatttaagaaatataaaaaaataaattgatgtgaacttttcatcccgatattgataacttgtttttaaaccaaattaaaagccaacgagttattggtctaaggaaaactaaactcaaacattttaagtaaaatcacatatttaagtcttgtttagagattaattaataccaaagtgaatatatctgcttaacatgtataaatattcttacaagaaaacatactaagaaaaatattaatggagatacgttataaaaaaaatcgtcatacatttaattaataagacaataagtaataacaatactgaataagcatcattaattttaaaagttgataaatgtaaaggtttgtcgatgatgatacattgatacttttatctaagtcggaaagaaagaaaaaagttcacatatataaggtgt

SEQ ID NO: 2006 - DNA, 1458 bp, Glycine max
  Soy_ogl_415 Gm02:6457216..6458673 Cluster 8
atgtttgcatatatagtctagtggttgttataatttttctagaggaattaaggagaaggtgtccaaatctcatctcccatatatactttagtaatctgttttctattttcacatatatcccatctcccatctcccatctcaaggttacaaccctttctctcctaccagcaatttcaaataagtttttttttagggaattttcaaataagttgaatcttctactaattaaatactagttcaacaattgttattttctatatataagagtcttataataacagagatcttcttattccatccagtagtttttctttcttttttttgccggacagtagtttttcttttaaatctattagcaatttgtctgtaatatataaatgatcatatattatatggctctttaatttcataattaataaggagattagagttcaactcaactacacccctataaggctataacctgtatctgttaaaaaaaacgtgaataaaagtttatagaaaaatcaggatttttatgtaaaattcgcacgtaatttaaaaagttctagtaatagaacataagtattacgcataatatttagaagataattttgatgcaatataaaaagtataaaagttttatacttttaacaaacgatgcattattataatattatcaagtcattcaatgaatttgatagttttgtaaaagtattaagtcttgatttagattatagtgaaaataataattataaatggcaagttacttgaaatgaaactctgatgatcacgttcccgactcaacttgaaaacagcttgaaatcgctatcaagacatatcctcctcaccggtcaaacttaattgaactggcaggatatatacttgtcataattccaagtctcttggttccttctaccattattcttagcttattgaaactgcttatgatcacttttgatagaatttattcgcataatctaaaaaatgaaaacttacacttttgaagaacaacttgattcacataatcttaagaatttgtcacttatgaaaatgaccagccccataacgcaaacctcacagtctaccaccatcacagccattacattactacaattgagtttaattatctcactttctatttaataaaataattccccacccattcctaactatatacacttcgaaaagagaaaaaaataacatataataatagttactaataataatgagaaaaaagttttaattaaatattcaatttagagtctataaaaaattaaacccaaagtataaattaatgttaagcagggtggactattttttttataaaaaaaatacaacatttatatgtgataaatatttttctttttaatatatattttttacttttatatttttaaaactctgtttgttgttattatatatttagacaaccccttatccaaaacttgcagcaagaattattaatctttgtaaact

SEQ ID NO: 2007 - DNA, 1081 bp, Glycine max
  Soy_ogl_1675 Gm05:34702101..34703181 Cluster 8
tagtgtacattattcttagtcttaaaatgttaactatatttactttttttatttaatccttttataaattattaaaataattaataatgattttataaaaagcataatagtatcgttcattataaaaataattaaattatttttactggattttttaaatcttattttgaaaaataattgaacacaatatcctaaaatatatttaagagattgatatctttcaatagatatttttttatattaagaatttgggatataactcataatcataattatatgcttaaggaataaaaatattatgtcacactatgtttttataaacaaaatttaattttaattagatttttatttaagtgattattttgaagagttaaaacaagaagtattaaagaactttaaaaagcaaatatttttaagaaatagtaatttcttaaacaaaaactgtaacataaatggcctaaatatactctttgaccattaggcttgaaatggtagcagttactaagatgcgttttgttttattagtaaggttggtgttggaattgaagaaataaagatattttttagatgcaagaaggaggaaactgaaaacgaagcaagtagtactaatgtggtgtggtgtggtgttattttgtttcattgtctgctaataattgtaagcatcagtaatggccagtggctgccaccacatgcccgccctgctccaccaatcaccaatccaacttcgctttcttaaatcacatccacataaggacaatttcctcatttttttttttatttttaaacttttttttctcatacggaatgtctaactattttcatatttgaaagtcattcaagtcttcaagatttaaagatcttaattaaaattaatagtttgaagtctagacggaatgccgtttattgataatctattttgattctctattaatcaatattttgaactattaccataattaaaatgaatagtttcaattctagacggaatgtaatagtctttcaaccactatttcataaaattattagatttttttttatgcagaacactcgagttaataaaatgatttggtgaggatgagag

SEQ ID NO: 2008 - DNA, 1041 bp, Glycine max
  Soy_ogl_3175 Gm09:38741101..38742141 Cluster 8
taaagagaaagaaagatagaacaagtactaaacgtgataaataccttaaagatagaacaacttcttttagcaaactccacaaacattgcattttgttaatgtacttatgtactcatactaaatttatcgagttttataataaatcccttaaaaatcataatcacattatttctgattaataaaaaagtgttagaacttttatagtctcgagtcaaaatatatgtatatatagtccggtagttgtaaataggacaacaaaagtttagaattctattaatgtttaaaattagtagttagcaggttgcattggataccaatttctaatagtaagttacaacatttttgtttgccaaagtgtcttcatatttatatatataatataacgtccgactcactcacatccaataatgtatcacaataaacaaaattcaattataattttttatttatttaaatactcgtgctctcaaataataattaatgaaatatgttagaatacatttctccataaatatttataagagaaaaatagatttatttttccgaaactaaaattaatttgtataatttaaaataaaagtcattagataaattaaagaaaaaatattattaaaattaatcaaaggccaaggttctgtacatcagccttcagaactgaattgatctgaaatagaaattcctgtaaccaaacattatccttcaacaaaaagatttagcaaatagctgcccaagtggatcacgtcaagtataatcatttcaaaattagtgtccacaacttttaaaagttaccatttgctttctaaaacactctcaaaactccttatgcatatcacttttgaaagaatgctatccatcaacatccatttgatgcttatctttattaagcgcttaatgaaactgctagataagtttatcaatactccacgttttttcaacaaaaactttacgttttcaataaagcttaattatattttaactcatgaatatgattttgatccctaaagtttaaaaagaacattttagtccctcaattcttttttg

SEQ ID NO: 2009 - DNA, 1300 bp, Glycine max
  Soy_ogl_5586 Gm17:8377401..8378700 Cluster 8
gcattcatctatagttttctacgacatttcagatttcactcttcaaagttcaaagtagattgttcccgaaagagggggaaaaatcttgaactcaatatttgtctattaacgtatttaatgaatgcccggagctaatatatttttcaaacttttatagaagtacccatttcgtctatatgctttgtttttagaaggaaataaaaagatataccatactgcagtaaaaaaaaaaaaagaagaggggacatgacatggttagacgtgtacgcatgctatttttcatttgcaaggccaacaatttaatgcaataaatactacattgcacgtgtgggaatgtatggtattatctatttttttatagatcacaaatgtctttcttagaaggcatttgtgtctgaatcatataaaattactataacagattaaattctctttataattgtttatttagaactcaaattctattacttcactagttaagttgtaataatacattgattgttaagatttttagtttgttagaaataaactctataaataagtgcttacacataatcattgtatttttttaaaatcaatcaattacactctgagctactacttttatggtactcctcttttgttttagatctatgatctcgagccacatcaattaggtgttacatgtgtctcttctcccttttatatatgtgttagtatcattgtttttttaccgttaaaaaatgattttcgataaagtattaaaattaatctttcaataaattattttaactaagtgtcaaaatatagtctcttgattaattatatggtgatagaaaaaaagaaaaatggtctctttcttctaatataatatgagattatgtttattaaaaaaaaaaggtgtagatttcactgctaacaaaatgacatactagctaagaattccagaaaataaataataatgttaaattttattataatcattacttattgaccaacattatatattacattcaaaatcccttttatctatatttttaaccgtcaatatgattaaattgaaggtagatctattgatcatgctgttgatattaccggatatcatgtacaatgattttcttttgttttaatggtcagtgattatttatcaataaccactcacgataaaataaaataaaaaaatgaaaacactggtgatcggtggattgcaagtcattgaaatataattggatatgacttgagtttgaatgatttaatacaaatagttattttaaattcaagacttacaaagaattatggaaaagcatgtttcaaaattaaa

SEQ ID NO: 2010 - DNA, 1100 bp, Glycine max
  Soy_ogl_1732 Gm05:38492101..38493200 Cluster 8
tcttttaatcattcctagctgcagtacttgtctatcttttaatttgtaaatttatttattgctttctgcctttactgtggtggaatgctattgcaatcccctgactttttcattctcgactatagttacgttttagcctaacatctttttgggaaatcataagcatggtgactttttaaaaagattgcaataacaaatttgtttgtgagactaattataaaccccggtaatcattcatcaatgaaatgaaaatatgatctataagcattttcttttatttcctcacagaatagaaacagtaattttttttggtactccttaatgacaagttctttcagatgatacaagcttttggggattcacttatttaggtttgggggactcacctgaatcagaacagacttcaagactcaaaatacacttatagaaataattagattatttaccaacaaaatttttatatcaacagtaaaaatcaaactcatattcttttaagatatatcatatatttctaatcgactgaattaacctttattgttaagaacaaattatttataagttttgaattttcacattcagatataaaagagataaaagaaaatactgttatgatattttactttttgttggccagttattcctaaagaaatctaattcaaagttcctaaaaacatccacaagcttcaaaccaaaatgtcacattattaattttctgttgaaaaattgcagtttagattgtcaaagccaatgataggtataaatacctatacgatgcaaaggaagaattgaattaggatcttgttaactatagtactctaaaattattagttaaaaatcaataaatggaaatatttttctttaaaaaaacaaaaattgagttggaattataaagagtgtatctcattagaaaagaaacttctcaacttttattttctaagttaaggtgttgctaacaagtaatttcttaacatggaaacagaagaaaaaaaaagtactaaaagataagagcactattgctgccaaccagagataattccctaggccctaaactaaacgctcaaaaaatgaacaccggacctttgttacgatttaatttatac

SEQ ID NO: 2011 - DNA, 1107 bp, Glycine max
  Soy_ogl_1582 Gm05:3583794..3584900 Cluster 8
gtaagcgttccttttttattattctgtcttgcaccttaaaatgtcaaaatcgaccccgtgcatacttgtaaccattttgccacttagtgtattttttttttttcttttcgtatctcttgcaccgtggcacataagaaataaataaataataaacaaagttattccacaatacacatctattactttgttgtgtaaaccgtattgcacattggtttaactatttaattttattgtgaagagaagtagtacatgatgtacattggatattaaggtttatggcaacactgcaacaggctttccgattttcgaagttcaataatttccatacaaatatatttaattataaatacactattgggaatctataatggtacattattaaacataaacctataatcgtgcgcgtgcattcaaaatgactttgagcgtaattttcatttatttagttttaaagctcctttaaaattaaaattattcgataatttttttataaaaaaattattataaactaactgtcacattcaatagacgaatatgtttttaaaaataaaaaatattactttgtaaaattaatttaatcaacataactttatttaatgacaataaaaatacataaaatgagcattaccgttcgactaatcaaattcatttcaaacaaatattctttattgtcattcttttctataacaaatattttctaggtaacttctgacaaaataatctctccctcatattgataaactcaagtattatttgatcataaaattattattcattttctcaaacaaaaaaggtttgatggattacaagtagtctattcacagagtgagtctatgaaattacaatacaaaaacaagtaactttaattagcacaacaaaggaacaaaggagtgttcttttctttttgtttcaaagcataagtccaatgagtataagggtgtccctgttctattgcttgaatgcttgttaatttctttaacttgtctcacaattcttcaacgcttcaatcttgaaatatataaaattcatctgaggggaccattgtgagtgagaacccattgatattttcctattatgaaacatgacacatgctacttttgatgcgtc

SEQ ID NO: 2012 - DNA, 1139 bp, Glycine max
  Soy_ogl_4657 Gm14:4829924..4831062 Cluster 8
cagggggagtttaagactctaattagagaaccaaatcaaaaacattaataatagattttatatgtacaaacaagccattatgtgtgaccatgatccattatatcatacgtgtaatcaattatatgatcaatgaaatgcataacatgcaattgctcatatcatatcaaaaaccatgaagcaaattgaaattgaaaaaaaaaatgaagcaggtgacaatctcactagatctaagcatgtcacagcaacacaaacacaacaacaaattcacttccagaacgaacagatgcgacgcaagagatgactttggtaaaggtgaataaaataatatttttatgcgtttcttcgcctatgagagtagaaattctgttgcgggggactcactagcttttttgatatctttaatatttattttcttattaccaaatggcgaaaattttcttctttgcacttttgtcctctgtttctcatttctttgcaatttaaacgctaccaaatagaacaataaaacaaggctttacaagttatataaggggaatttttttagccagcgttttattttttgagtaaattatacgaacctcgagattttgtaaaattatacaaattttccaactttttaaacatttacactaacctcctttcgagttctatgtaatattttttaaacaattaagagtgtgttggggtatattttttaataactaaagagattaatgtgatgtacgcgaaagtgtcaatgtatattttaaaataattaaggaatgttactgtaattcactctatttgttaactatttttggagcaggtgttaaaacatgcacaaacaacttttgtttgtaatagctacatatttaaaaaaattaataatccttttgcctttcctcatgcaattacgtgcttggttatgtatattttccgtttttgaattttaaaatatcagctttcatttcacattatgatttaatttcttagtattggaaaatcataatattttaaatagaaattattttttcacatctactttttttttgtcttcattatcttcttttttttttgttgcatttatattcttagtagatttccgaagataaaattacactttccaacatcatttgggatatatcatgttagactacgta

SEQ ID NO: 2013 - DNA, 1000 bp, Glycine max
  Soy_ogl_5188 Gm15:50226301..50227300 Cluster 8
gggattcgaatccaattttatttaaacctaacaacatattgataattgattgattaatatataatctatcaaacactacttgaaagtggttattttgctaaaatatgaaatagtccaaatatttctaaaaattcttacttttattgaaccatttgtatctatatacattaggatcttgatccatggatctctccgttcgagaaataaaaataagaaaatcaaataatttcttctaagtttttttcaaattagataaatattgattgatggtttaattagtcgatttattattgagaacaaggaaaaatgttatcaagatgaataaataagttgcatcacgtagtggtagatgagatacaatttttttaaaatagataacatatatttttgtttaggtaaaaagtaaattcacaaaataacttgatactatgataatatgtaatctttgtttgtacttaattcgtatagaggatatttctcagcttggagttgaaaattaattaattacttattaaatctgaagaattttaattaaacttgaattctcttaaagtgaatactatatgcacatgataaacaatcaaccctagtcaatattatactaaggtttggcactatatagagtttactgtcaagtaatgtttcataccaatcatttttgggcacctgaaaagcattttgatgattgctgaagatatttatatatttgattcataagtcaggaaacatggcctgcaatgaacacatctctacgctgcataatttgtctatatccgttattgaatttgctatgccatcttaatcaatgggttcgtgtcccttttctttggctccaggtgaagactgctatttgtagttgtaggttgtaccaaactagaagaaagtgacacaaaaaacaaagggcacggctgaaaattgtgtgttaatgcaaagtacaattaagttactaattcattattagtatgaaaacaaagatgatactcagtttttctaacgtgtg

SEQ ID NO: 2014 - DNA, 1035 bp, Glycine max
  Soy_ogl_925 Gm03:37352766..37353800 Cluster 8
gtaagataacacatgttactgtaaagcaaatattgttgttacaaagagttgtaaaatgtatgtaaattgttaaaacaaatatctaattcttcacatattccaatcatatgataattcagcattgtattagaagtatacatgtaactaaaaatgtttattagtatgcaattatctaaccatgatccctactgaacaaatgagactaatacttttgaaatagagtgagattgtaaaataaagataaacaattctattgtatataagaattagaaatattattgtatgagattatttgaaaaaacataaggaaaacatagatgaaatcaataaaaaaaaacacaaattgatgaatataaaacacaaaccaaacttaactgttgcaagtgaatgaaaaaagaaacttacctaaattgtaagtaatttaacattcttataaacacaattaaaagaaggaaggaataaaatttgaaaagataacacaaatcaagaaatattataaaatcaaatttatcataaatttatttacttaggtacctaagattttactaaggtttaaattgtgtgctaatgcaagagaaaaatggaggaatcatgagagataatgcaaaaatctagcataaaaggtttttattaaaaagaaaatagtgcaaaatccaaaaactaacttaatttctatttatatttatattagattacaatggagagacattaattataattgaagaactacgccttcatgttaattttcaaaaaattaaaaaaacaatggagaatagaacactgaaatagtgtaggaaaaaaaggcatttacctttttaattatattagttgttacaataaatttatttatgcatagtgattactataattacccttttaaatttctagaaaggcactaaagtattgaaagatttttttatttatttgaaaacttcattttttttctatttttcgtttgatattttaaaaaaattaaaatgtgcatgagtagtaacataatatttaatgttattatttagtaccaaaattaacatt

SEQ ID NO: 2015 - DNA, 1000 bp, Glycine max
  Soy_ogl_5611 Gm17:9615401..9616400 Cluster 8
taattgtatgagatctattaactattaaatatagagagaggggggaggggagagtttttgggtaaggtcatcatttccaatgctattgcataccagagttgcttcaaactaagtaatattactaaattttattgaaatggatgatatgatgttggttataaagtaatattatttaattaatttaaaataataataaaaatattttttaaacccatttaaataattcatttaatatttattaatagataaataaataaataaaagctcttaagtctacagtggagtatatgactcaccaaaaaagttttttatgcaactcaataagcaattatgcattatgtatactccaagcataggttttcatttttaattcataaaaatatataattacaattattatttacaaattcaattgatctatctttataataatttcaaaatgattataatatcaataatcaatattcacaatttaaaaattcatttcagtcaatatcagttcaaaaaatattgttaatttatgatcatctgtaatttatttaatcaagacgtaagtaattcaattaatgatatgattagtgttaattataaccttattcttaacatcaaacaatatttcctaccaagaaatgtctaataatttgttttaagggttatgatcgtcgttgcttaaaatgcataacaccttaccactcaaagaattagttctttgtcgcactctatttttttatgaaattgaattttttttcatgcacacaactaaagggaaacccaaatatttgtcaccacctccttcttctctcactcctaaaatatgattaatattaacattcagtaggaactcaaaataaatataaacagtatatgtatatcatgattattattaaaataaataaagtttaatgaatattaacaaatatttttttattacatattaataaataatccaaagacactaattaaaattaaaagtatttattgaaagataaaaagtgattta

SEQ ID NO: 2016 - DNA, 1113 bp, Glycine max
  Soy_ogl_1955 Gm06:15093688..15094800 Cluster 8
tttaactagcttaaattattgtaatgataataaaaaataaaaaaatattaaaatcatatatttaaatttttcaatttttaaaagtttcaaaatttgttttaataataatttattttagtggaaatttgcagattatatatatactattaataaaataaataaatatttgagtaaaaataattagttttttaacattgtttgatatttttgaagaaataaaaaaataagaattttattacagtcaagcattgataaaaaagcaaagtaaaaaaaaacaaaaaaaaaaacttaaggaccacattcaagaaggtacaaaagtccatgtaataaaaactttaaaaaaatataggcatgtatcaaaataataaaaaaatagcataaataaaatataagtagattgaaattaaagtgaggtctaacataataataaaaagtccgtgaaatctatatatctaagaaatctttttgttttctttttcaaaagcttcttattctcataattatttttaaaaataaattatttattttaaaaaaattatataagagtatttgatccaacttttttttttcaaaaaataaaaataagtggaatccaacatattatctgataaccttctaggatcgaacagatatctatgctatataatttttttttttatcttataactattataaaaccgcctattaggcatgcatgcacaaacctctggcatgagaactgtagtgatagacagtcaccaaataaaatagcaaaaattttatatatttcaatttgtacacttattttagtatatttttacagtctcttttattacatttttatttttctcttctcctatatattttcttatcttactcttcccacttactccaaagggtgtcgagtcattcttcatcaacccaaaaaagaaaaaaaaaaacgaagtttgtatatcaaaactaagttgtgtaaattacattaaagtaatataattcgttacatagaaaaattttcatttagtaacaaaataataaattttaatatgaaactgttattgtgcaaaaactgaagggatttttgtgtcaactgccatgcattcacatgtgtatgtaaaaaaaataaaaaaaatcaat

SEQ ID NO: 2017 - DNA, 1384 bp, Glycine max
  Soy_ogl_469 Gm02:10162001..10163384 Cluster 8
tagaaaaatatacattaatttcttaaaataattgttatggatgggatcgttgaaaatctaatcataagacgtgtttatccttctatcatcttgaatctctaaccggtacacacatttcacatgcacgggtgtacacgcttaacacgttataaattgtgtactttggaaatgaatctttcactctagatatttgtcggaaaaaactctgaaatttaatgtcttaatgcttactccattttatgttgatttccccctaattaattttatttgttttagaatttgagaggttaaaaaactaactaacgtaaagactaaagagtcgtgcaaaagagaagaattggttttaaattttaagaaactatgtacattgagatgaattaaggtttaacatatagtagtaataatctcttggttaaaaaaaactatttaaaaaaaaagaaaaaaaaaacattgcaagtatatgtataaggacagaaaagtgacttttcaccctcatttaaaacaatttttaaaaaaaaaacataatattttttctcacttaagtattatataagttccttcttccttctaccaactattttaatttattctaaatcttttcaaaactcatcagaacatcattaacaattattttttttagtaaaatcttacttttgatataattttaacaaatttcattactatttttcagtgttagcaattggaattaatgaattttaagagttttgataaagcttggggataaaactgagggataaaaaatatttttatcctttttattttattttatgagatagtatgtcttaagtgtgggactaactaattcttatttgaaatattaaaacttgggaataaaaatttgttaataaataaaaaatcatcattaggcattagaatcaattaaggtaaagtcatttaaccttggccagtagtataacattcgcatttcaagagcatgtaattatgttaaatattcaaagaaagaatttattattaataatcatctaacttaacttgaacaaaattacttcatgtagaagatacatgaagtctatacaaaaatcatttgttttacttgtttatttcatgatagttcactttaaataatatcatatatatttttatgcatttgaatgatattatcacccaacaaagttttcataatcggtaaataagtttcttgaacatgttaatgaagatccaattcctaatcctgtctgtgtataaaaaaaatttgttgaaaatccacattagtaatctttataccttaatgtaattaatctttaaattgtcaattggaatctttgatttcagacttaaaaaaaataatgatattatttacataaaatatttttcctttattaattgtcatggttacatatat

SEQ ID NO: 2018 - DNA, 1100 bp, Glycine max
  Soy_ogl_1953 Gm06:15001501..15002600 Cluster 8
aaccaggtgtatatgtttaggggcaaccgccaccactacgattttaagactcttaatgtttaccgttaagaaaaagaaattgtgcctacagtcccttataatatttatcagcttaattgagacttgtcttttatgttattatagtatatctaatagtccagttaacattttataccacagttttatttattatatatgaccaaatggattaattccaatccattaactcaaattcttttttttactcttagacactatttcttatcttaaatttaatctactttataataaaatatttaatgttttagctatcatttaagtcaccgtttcaacaatctaatctaattcatttaaaagtcatttgcttaaagttgaatttacatataattagatgctttaattttaataaacttctatatgaaaaaatggttcacacaatattttcttaggacttaaatattatattcaacttcctattttaaaataattaaatattatttcagtctcaaatattgatgtatttagattaaaaagttaatgttattttatcttgacttactaaattattatttctatttccttaggacttaaatattatatttaacttgttattcaaaaataattaaatattatttcagtctcaaatattgatctatttagactaaaaagttaatgttattttatctttgacttactaaattattgtttcgatgttatttacatttaagtcagtaattatatttatctgtctactccttcttaacttaactttaagtcctaagaatatttttctgtttgtgtgtattgttttttttttaccataaaatacactgtagttatatttattgactctcatgcgatgttttattcttcattagactaaactgtaaaatattattaatagtaaaaattaattattattgattttacttatcttgtgaaaaaattcctcccccaaacattctttcttagttttgtcccttatattaacaataatttataattaaaaatttattttatattatcaatatatattcattaaactcatataatttgagatatttaaataagttgaaacaatttatcagcaattctcgtga

SEQ ID NO: 2019 - DNA, 1000 bp, Glycine max
  Soy_ogl_3789 Gm11:7360401..7361400 Cluster 8
attgtttaaataatgaatgaagaagtgtggtcattagataagaatgagtaagtttaataacgtatttgaattatgtaaaattttagcctttaattttttcagttaactgaatctctgtatttttttagaaagaagtaaatataatataatcgttctataacaatttttcttttccttaaaacccttaaattcttattttcaactcaaagcattcacaaattaaattaatttagaattttaataactttataaatgtaaaaaatattaatctgttactgagtactcgatcattaattagtcaaaattaccagtgtgcaccttccgaaaagagaaagggtacggacattagtaagttggtttagcatgaaaaaggttgcataaaccgagtataatagtaattggcactcgtcaattcccatataaaattcaatcatctaattcattaaaattaaaaaaaatattaatttaatttataataataaatttatcttaaatttatttattttttaaaaattatccttgtcattaatatttatttcctctaattatttgtcaatatatttttttttcttttaacgagaaatatttaaagtctaaaaataattaatacaaacaatataaaaaaaaaataaacaacattttaaagaatctttatgcgtctgaatgaatgtgagactcaatccaatctaacccaatttgaatattctttgctgtttgagttaaatataatccaacccaattatgtacaaacggtataattgattttgtttttttttcaaccaaaatcatataattaaatttattattacatataaattaattattaattataaaacatattattttttaacacacaatttattaaattaaaccatctatgaatgcatttagttatcatatatttacaaaaatttagacaataataaattattattcttaaataaataatttttacaaaatacaagataatttaaaaatattcaaacttaactaatccaac

SEQ ID NO: 2020 - DNA, 1044 bp, Glycine max
  Soy_ogl_5950 Gm18:5671801..5672844 Cluster 8
tcaatgggtttttttccttaatgatatattttatagatctagattgatatattgctgttaatgtgggccttgaggccatttcacgatcttttctgctccttgtcaatgtaggcaaaaagaagtgatataaatacatcgtctaataaataaaaagttgtagatataataattatagagtggaattgttttaaaataaggaagatggaattccattttttccatctttaagtaaattatatatgtatacatgcatgtgtgtctatgtgtaaaaatagtgagagaatgaattaaaaaaagttgaattgttacctatggtttattataaaaacttttatacttcctactaatcataaattgttgatattgttattctaaaatatacatgataattcatgattgaccaataatattaaattctttaacaatgttagtaatataacctgttttctttaaaaaaattatgaaaagggtaaaatattgtcaaatttcaaaaaatgtatgtaattaagatacatatttgtttttatggaatatgatgaattggctctttttttaattacatatttaataacgtttcataaaaacatttatcaatttaacaaatagattaacaactcttataaaatatatcatgtttacaaaaaatcatataatttaaagataaattaataaatactttattaaactaaagcacgatgtgttatttagaatataattaatatcaacttataaaagaaatataattaatatctacacgactttatgattgaataataaagtttattttcttctaaaatattattaaacgtgtaatattacataaattggcgttcatgccaacctatatttttatataaaagatgaaaatgtttatataacttaataatacaaatttaaagggaaccaagatccatgctttcccccctaggatctgtttaccccttctcccctctctctctaaaatacacactttcaataatttttatgctgataattttattactacaataataaaattatgtaatattattctgatgaacatgc

SEQ ID NO: 2021 - DNA, 1100 bp, Glycine max
  Soy_ogl_3437 Gm10:37765501..37766600 Cluster 8
gttgtgaaattagaatttcgatccaatgataataatattaagtagtaacattttatttgctatataatttttaaaaattaatattttagcattgaaattaaataaaaaacattatatgtgtctatatatatttttataatccatttttaaaattgattataaaatcaaagggagtaaaaaaaatctatctgttctaaaatgttaatactttttcttataaaaaaaattcgttgaataaaatatttttacaaaaaaaaattacaatagctaaatcaatggttgttataaaattagaattttgatctaacggttgaaaaagcttcaaggtttctttagtaccaaatcaataattgttgtcaaattagaattttgatccaacaattgacaaaattttaaactttctttatatatatatatatatagacattaaggtttgtgaaattattttcattttatttagtgtaaaaaaaatatattaaatattacatatttttaaaaaaatcatcttatttattttgtggcaaaaaatattcaaagtaatggcaaaagaggtaaaacctagattattaataaataaaaaaatgtatgtgtgtataaattattaatatacattttaaatttagtatattacatagtttttaaaagtaaataatcattttaaaactgaaatttaaattaatattatgttattagttttccctagatttttaaaaattaataacctttcattaattttatatcacattaaatcatatcaactgttattatgagattaaagttttaatctaacggttcaaaaaatattaaagtggatattacatatttaaataagatcaacgattattataagttaaaatttcgatttgattgttctaaaacttcgagtgaagtttatatatagatatgttttcacataaaattttggctgattggaatgtgaattttaaactttataacaataatatgacaacacatttaaataaaaaatatataattaattaatctgatttcataataaatgacattttagcattttttttgtcgccatttttaaattggaaaattgatcaagactaagcacgattaaattcctccgtttt

SEQ ID NO: 2022 - DNA, 1300 bp, Glycine max
  Soy_ogl_4279 Gm13:26401301..26402600 Cluster 8
actcgttactaatgttatttcatattttaattatacgatataacaaacaaaatataagtttgtctcaagttcaagataaaaccacacttatatatcttctctctatattttttttaaataacaagttataattttatttttaaaattcgcttcaagcataacttgattcattaaagtcattcaatatttctatattttttacgttaacatgataaatggtgaaaatcttatatcattgaatattgtgtataaaatgtgaccttttttttactaaaatgtgactttaatttttttgactggaatatgcttagtgtacaaaaatgtgactttaattgataatttatgtaatatgccttttattttagcttagtgaataatgacaacaacgatgtttaaacctataacttatataattattcaaatcactgaccattatgccaattttaatgatttattttatctttagtttttatgtataaacaagaaagactggtttattgatgaagcaaattattaatgagtttgattttttattaataatgattgtcacaaatgataaagattttatttcttaattaaataatttaggaattaatttcttgattgattattgaatatgaaataaatcatgtttggttaggacgaaaattattaaaacaactaatttcagggttctcttttcataacagataatactcgtcttttcttttggcaacttttttgttatcctttccgtggtttctggcatgctttctcgaaagataataagaaagatatttttgtttttccgaataaaagaatgattagttgattaattaataaatagcactacacacacacacctctcaactaaaaaggaattcaaacaaatgctgagttaagatcagtctggattaatacttaagcaacctaactcctaagtaacattgcttaagcgttaatatattcctttttttatattttggatgtactttagggtaatcatgtatttatgttcaacatagaatgtttttctgtattaattgtattggctctgcatgccaactcctgccttaacaaaaaatatatttgttcattggaattttcttttactccaaaagaatgtctcttgttatttaatgtgtttgttttacagttatttcaatataagcagaggatgagggaaaagaatagctccatcttaatcaaaattaaaatgtgtctaaactataaaattatggatgataaaattgactgactcgtcagaccaattcgttttgctcattaattttggcagttggattggaatttttttaccctt

SEQ ID NO: 2023 - DNA, 1000 bp, Glycine max
  Soy_ogl_562 Gm02:15199401..15200400 Cluster 8
aaaaaaaataagattgaatatttgtttgagttttttctctaatgaaatgttgcaagtttaatgcatgaaattgcaagagatttgataagttaaacattactttaaaataaaaagagagaaaaataattgaatagataaaagtaacatgttaactatttatctttagtgaattattgaatttgtagttggttttaatgtctgaaattgaagattttaaatgtctaataaaaaaatatatgaaaagttttagattttacacttttattgttgtttctctttgtagttttatccataataatctatctattacatataatccatctataatagatataaaagttgttacttctgccatctacatctttaagttaagattttcgtttctgtcattattaatataccacgtcaacaaaattatttttttcttcatgaaattgaattctttaattaagttagtcataattagtcattatttactaacatttttagccataatttaattaaacatttttgccaacagttttcatgaaattaaattattttacttaaattagccatgattaattgttatttctctttgtagttttatccataataatctattataaataatttatctataatatgtataaaagttgttacttctacaatttacatctttatgctaaaattctcgtcattcccatcattattaatatgccacatcagtaaaattatttttttcatgaaatttaattctttaattaaactagtcattatttactaacgtttttagccataatttaattaaaaatttcaaaaacttaattaaacattttttccaacagttttcataaaattaaattagttaacttaaattagccataattagtcatgatttattaacgtttttagccatattaattaaatgtttcaaaaatttaattaaacatttttttactatttttcttcctctttcaaccttaattaaatgcttttattggtcatttattgacaacct

SEQ ID NO: 2024 - DNA, 1205 bp, Glycine max
  Soy_ogl_1279 Gm04:7549896..7551100 Cluster 8
tttaaaaaattaataatttcctcacacaataagtagaaacgtcaataaatttttgttgtaaaaaaaatttaaattatttataatttacacaatcacatacattaattttaaagtcttaccatcataattattatcgtccatttacactcgtaagtattcaaatgtatggtgattaagtgatttactaataaggtccgctagaaaaacattgttgatgaatgattgacttttttgttgtaaatagttcaattaatattcacgtatatgaaaaacaaaattattaagagaattcaatggtgttaaattataaaaaaaatatttaataaataatttactattgagacttaaactgcaagtgactaatcagataacgatttctgtttttcatcattataattgttatttgtttcaaactctatcctatgtacgaaaaatacacaaaaaatgtataacaaaactctccatataagcacgcatcaactactcttttaggattatatgaacacatttcttcatcaacaatattttcttctttgcacatagtcacattttccatgataatatatgttaaaaaatctcattttgaaaaccattgttgttgcaaatttgatattttgtcgtttaattaatgaatattgtatcatatcctttgtcacattttattcaaaaccctagctagttgtacgtacttccaatgacacttttaagtgtagaatgtgcattattaaatacttaatgtaaaccttgtatggttaagtaattcttataaatcatttgcctgactaccatatttgaaattaggaaggtaatatctttcactattgcacgattttagattctttctcatattaagatatacgcacaaggtacaacatatgtaacttatagatgtaaacatcattttattaaccaataattttctatttttaatatagcatgagatttagtccttaacaagttgtaactttcacttggactattaagagttattcaaacctacttacattgagaatgaaaaaaactttcaccttaatcagatacttcattaaatactcacaagctgctgcgattagaccataacattttttttatagaactttttacattccattttaattttaagttttcttggatgtttattgatttgattagaagttatcaataacatttttttattttaatcctccaattcattaaaaaaaaat

SEQ ID NO: 2025 - DNA, 1184 bp, Glycine max
  Soy_ogl_4294 Gm13:27088752..27089935 Cluster 8
ctttcttgaaaaaaaataatttttatatttatattttattttttctatgtaattactatctttagggaaaagttcctcttcataaattaaataaagatttcttactttttaaaaataattttcatattttgtattttatatataatttttatctttagtgaaaaagttcattctcatatattaagtattgatattcttacttgctttaaaaaaatatttttcatattttatatataatttctatttttattaaaaaaaaattctccccataaattaagtataaattttcttacttgttttttttttaaatatctttaaggaagtacccaagttcaattcttaacaaaaataattttcaaccaagtattttatatttaatttctatctttagtaaaaaaaattactccccgtaaatttggtatataattttttttacttgctttaaaaagtcatctacatattttatatataatttttatctctagtaaagaagttcctcctaataaatttagtatacatcttcttacttacttttgaaaaaatcatcatcacatgatatattttacatttaatttatatttttaataaaaagttcctctccatatattaattaaaaattttcttacttgctttaaaaaaatcatcttcatattttatatttgaatatataatttttatctttggttagaatatatcttcccattaattaagtatagattttcttacctgccttaagaaaatcatcttcatcttttatattttaatatataatttttatatttagtaaaatagttcctccccttaaattaagtataaagtttcttacttgctttaaaacaaatttatgttttatattttctgttatttatgtccttaggaaaaaagtttctctccataaattaagtatagattttattactttccttaaaacaatcatttgcatattttatacttaatttacatggagaaaaagaggaaagaaaaaccccacttcctaattttacttataaattttatatattaattttacttatactttgtatcttagataaaataaaatattcaatgaattagttaagtgaggatataataagcaagaaataaaaaaaatatttacattattctcattttttatattttattcatattcttctgtcaaaaaatattttatccatattctctat

SEQ ID NO: 2026 - DNA, 1270 bp, Glycine max
  Soy_ogl_4659 Gm14:4925831..4927100 Cluster 8
ctaacacgttcctagaaacctaataattatttcttttcatacagttaagaagaatattcctttttttgttcaattattataataatatatcatgttagtaattatttaattaaatatctttaaaatttgaatgtgtctaaatatttaattttattatcatattacaattttaatttaataaattatttaattcattttttattggtgactataaaaaaagtcaacatatttactcataataaatattttgtaaaaaggggtaagactccaataattttttttggatatgatggcaactcatgtcatctttggatgttaacaatgtctcacgtactgatggtatgccgtgataggaaaaaaaaaaaaggtggaaaacttttattttggaaaattaatcttaaaaatgtgttggaatttaagagtctggttatgcttagaaaatatgtcttttgtgagaagaatgaataggtgtcttatgcttgagaaagaagaaaaaaaaacaagacatctagaaataaatttggtctttttgtatcatgagaatatgttgtgtctctcttcctttttttttattcttttttctcactttgatttttttgtctccctgccttatagctataggtcttattggtgttgttctcccatccgaattagagcttcaactcgataatttgggttccatgaaacttcatttttaattgagaacaacagcagcaaaacttatatatggtattgtgtctaagtttaaaccttttaataaaacaaaagtatatcaatcaataaaagaccaaataaaaaaaaaatctaacaaaagaatagcatagaaattaagggtgacaatagagtagggtatagcatgggttgggataatgacgagagtgacaaaataatagtgagagggcggtagttacaacattgaaaatagaggctttgtagaggtcgtagagaatggacaatttttttattatcaatgtttctaacctagtttcttgataattttgaccactatatatataaactggtcctaaattaagaaatttaaaagtgagaacaaaggttttcatgtaactattgaggattagcatgcggattcttgttttaaggtttgttttcatttttattccttccattttgtttcatagcttcacctattttacttggaagaacaacgtacagcaaacagcaagttagttttagaaagaaaaacatatagaattctctctgctagttgttgtgataaatgacagaatatattattcataggaacaag

SEQ ID NO: 2027 - DNA, 1000 bp, Glycine max
  Soy_ogl_6406 Gm19:36756001..36757000 Cluster 8
tttttttagtaaaatttaatcgaaaatttataaaattaaaagaaaagaaagactgattaaaataaaaaatgaaatccactaaaattataattttctgttaatttcaattaattgtagagattataatagaaaatgttgttaaaattttatctgtttttatttactaattttaacataattttaattattaagagaaatgctaaccatatttttccagacccaccttgttgaacatacgcttttatattagttaaaaatgattaaaaattatagaaattatgagtcttatatcttattaaataactctatcagaattttgtaatttttaataattttaactcataataaagtgttaaaaaaagagtgtgttgctagtcgtgtaacactcctctactactaaataagttatgcgtgaagtatacatattaatttattttttatcaaagaaaatttatatgtaatttttaataaaaatatattaaacatggtgtataaatatatattagttacttttttttttcagttttgaaatatgggggagaaaaatattatggcggaaactgtgattaataaatttacttatgtgaaagtacgagtatttgggaaatcagcaggggatggggcagaggggggttggtaatggtaatggaagttggtggggagttggtggtgagccccacggttcgaactagtttgcacgatgttttttaagattgtttttttttttattatttatttatttaaatgttgctaattattatttaattggccaactataatggaatacccatattgccctacgcatagtgttgaaatgacggctttggccttcggtaggtgtgtaacgtgtctttgtttcgtcgtgtacatgcaggggttggtggaattacaaagcttcgtaatctcagtattgtatttgtgtatttacccgagtaaaaaagctgagagggagtcataaatatttagggtaaaatagaattttgatgtctcatttatattt

SEQ ID NO: 2028 - DNA, 1011 bp, Glycine max
  Soy_ogl_203 Gm01:48492490..48493500 Cluster 8
atgacaaccataaatctttgaattaaataatcaaacaaatacaaattactttcatacgtaaaacgttttactttcgcgtaattaatatggaaagctggggagaagaatcaaatatttgcatgattcatgtatggtttgtcacgttcaatcttggcttcacgacgtgattagattggagtgacccttttgcatttgcaaaacgtactaaagcggaattgacgccaatcatgtccataaacccaacaaacaacaaaatcttcatttaatagagatacttcaaagtagagactaaaacttaaatagaaaaataatttaaaaactaagatcaatcaaaattttaattgaggaattaaaaataaaaatttaaaataattgaaaaactaaaaatatatttttttacaataaattggcccgattaacgaaggattactgtcataatgacactggttaaaaaaaggtttaaatataagtgagcctttcaccgttaggttaaatcaagttcaataaacccattgatcatactaaatcacatgataagagcttagtaagatttcttctttaaaaaacattattttttatcagtgcttactaaaatttatcaaggattccttagcattctcgtctacgtaaataaaaaataatagtagttttttattagtttttttttccctaaaattcgttaacattaataatttataatgtatcgcaatgatgatattcgtgatgacaaagggtgcacaatgattgtccacctgaatcatgtcttggcttttttgtcacaatattttatatatgcttccctcaatcatttaattttgcattagtcttctaatatacccatattaaaaacttgtcaccacaataacctatagaaatctaaaattaaattgtgtgaaaattacataattaaacggataaataaaaataataatgcaaaattaatgggtaaagaaagaataaaaacataggcaaggaaaaaacttattattccatcaacgttttggtcatttt

SEQ ID NO: 2029 - DNA, 1300 bp, Glycine max
  Soy_ogl_3356 Gm10:3850201..3851500 Cluster 8
catgcctgcaaagtaagcaaaatatatgaatgtcgagagagtgatgttgatatgaatgggaggtgcgatggtagacaaaggtgaggaagaaagtttgagaaaggaaatcagttttaagaataattaatgttgtgtatgtgataggatatgacaattgtagaatgtgtgagacttggaattggaacaaaaataaataaaaatgcctatttttaaataataatgagttacatgggcagttgtaaggataataggtggtagttttttttattaatttaaggagtaaagatgtctatatataaaagtggagataaaaacaattttcaaatgaaatatcctttttatctacggtatagattactagtattgtattgcttaaaaaacaactattattatattagattttaatttccatgcattacttatcatttatactattaattaataaataaatcattctaattataatttttaaaaagagatattacaatatataattaataaatttacaatgctatattaacctaaattttgattgaacgaaagtataaaaatgtacttcaattaaattcttcctctctctttttttataaattaaaatctttctcatattatggagtaatggagataagtaagtccttatattccgagtcttattacacacaagaagataaaaatttgggtgatttcatattttatataattcgttgaacttagattcatacaaaccaaatcatgagttgaaatatatttgttgatttttttatcagtattttttctattttctaaatttaattttatgcatattttatattttcttttattaattgtaacatatattaatagtaatatttggatgcataaatattaaataataacattagaattaatttaccactcattgtctataagtacatgatactaccacatttgtcactagtattactcctattattactgccactttattcccgtcactacctccttatcaatcctggccattacctgaagggttttcccccctcaaatttgacgtattatttattatgaccatctctaaaagatatatgtttttttaaaagtaaacttagaatttattttagatctataattttattctttattcttttacacaacttaaatatcaaaagtatacattttaattttaacaagttaaaaattctaaactataattttaatttcatacgcaattggacctttaaatgggtatcatagcgtgatagcaccgaaacaaatggaagtatttattttaaggcttggtcctcatcgatatttgggccca

SEQ ID NO: 2030 - DNA, 1000 bp, Glycine max
  Soy_ogl_6235 Gm18:58059401..58060400 Cluster 8
ttaatgcacacttgaagcatagagaaacgagggcttttgtttttgttttatattgtatacctttttgaatgtaagattatttcttccttgatattgatatatgaatttataaacatctaattgacatttttttatttaccttattttgttacattacatcatatattatattaattacttaaaaatagaaacatttaattctgttaattgttataaactttttaatatcatttttttattcctgagcattaaaagtatatatgaagcacttaaaacatctataatactgcactctttatttgaattcttaactcacttgtattaagttttaatttgctcttctaaaaaaagttttactttgctttattaaattgaagaactttaataactttctaatttaataataaaactgtttcagaactttaaataaatttgacactttaactattcgttccctctctctagatgtctggactcaagggtgtttattatatctttttgtttgatattgatatagaggttctcattcttttattcaaaacgctataatggtgaaaagaaaaacggcatgaaagcattatgaatcatcttggcagttttctattggtgagaagacatataaagatatgaagcgaaagttaaccgcaaacatagatcatcacgccatgctattcatcaatttccttatacagtatatttgagctgctggtgctttatttaagaggctatttagtagcttttgaccaattatgaactagttcttctgtttcaaattatattgttaagtatgaaaaaataatatatctatattgtttaagcttttatgtatataacaaaataatattctatgcctaaagtatttgtattgaaaagaatgaagtgtaataaggaaatatcaattaagtatttacatgtgacattaatcatcatattgttgtagaataatgttttgtagagttttcttaggagaatattttgtagagttaagaaaataagaaaa

SEQ ID NO: 2031 - DNA, 1422 bp, Glycine max
  Soy_ogl_1947 Gm06:14621501..120922 Cluster 8
atttctgaattctgtaacaacataatatttcttgaaacaataattttaactagttaaaattaaagatggcagactacaaatctgttatcaatttgggtatatatgctgactaaaaagatactttttagtcgaaaaagaaaacttacccatatagattcaaaatatgatccaggttgaagaaggtactgctcgacatttcttgaacttgaagtctcaatattcacggcagcagcattgcgatttcgaaccggccaactccaaggactaagaaatgaggtatctttacgaagaaaagatgttagtctagtataagatattgtattttccctctcactcatcatatgctacccaatttcctccacagaatcttgttcattcttgcatggaagtttcgggggttgcgctcatttgtttcttaactggacgccaatatatatatatatatacttcaatggttagttatatgctggtagtcttcaacggatactcataaatatcactggcagtgaatagtagtgcatttttttcccattaattattgagaataaataactcgtactgttctttcggtctcatcatcattaaaattgtctgaaagtgatcgtcattttagttttataattaaatattaattattttttttacttaaaacatctctaatggatgcaatttaaataattcattttgagttgtttattttatattaattgatctcgacgatatcaaatcataattaagcaattcatatatattttagtccaatgttataatttttaaataacaggaaaatattctttttattcgtaggatagacgacatataaatcatctccaaaggtaaaaaaagaattaagtaatggtatctaaaaataagtaacttaagcaaccaacattcataatgctcttatattctttataatattaagggtggacaataaaatttatgaataaccaaattaatgatgatataaaaataattttataaaattattacttttatctttttaatatataacgcaggacgattattattttcggatgaaatagattgctcgggtcgaattaaatattgctgtatgtatcgatgtttctctcctaaaactgacatgaggggtgaagagttttagatttctctggctctcttcttgctaacatgcaagtagagattggtttaatagtatttgtttttaatattagtttgttatttggggtgcaaggttcatgatttgtggtttatgctttttagataaggaaagctataattccagaatgatgatatattatacacaagagcggatccagacttaacaacatgactgtaaaaatgacatttaacaacggttaataaagatattcaacaacagtagacctttaacgataattataaaataatcgtcataaaaaatataaataatatgtttca

SEQ ID NO: 2032 - DNA, 1200 bp, Glycine max
  Soy_ogl_1991 Gm06:16697401..16698600 Cluster 8
cacctaataattaaatgtaagcgaatgcagactaggtcattgaaggaaatatctttgatgagggaagattttttttttaaagaagtctaaccttcaatatataataatgaaacccaagaatctaaccaagaatatttttaatgaactatgttatgaaacttcaattggcaaagtcatcctttattcaagtccaacaatttattgccttacggattaattatacttttttatcagtcgttttacaaaatcttttgtaacagtattttaagaaaccttgcgtaacaaattgggaaacaaagtctacacccaaaatccaaagatacatatatagcattgccttttataatatggtatttagtaaccatttttttttccttttgtacaaccttcttttattcacaaaagtttttcaaaatgaaagcagactatcccacttttggatcaatacgtgtcgcaaacatccgtgtttatagaagaaattcattctaatccatttaattgaaaacaataaagattataaataataatgatttttttaaggaataacaataaaatttagtaaatatgaatatatatttaatcacaatttttaccattaactttatacctgttactattttttatgaatttatttgttatacaataacgatagataatgagatttaaacttagtctttataaaattatatgaactctttgacactaagctgattctagtgagtttacgcaacaacaaaaattaacaggagttgtgttttggcttacctacgatttatacccctattaaatgtattacatgcggttgttctttaaaaaattaaaatctataataaagtgtaaaataaccaaccaaatactaaacagtttgttgattcagcgtgtgacttatcataaatcttctaatattagagtttaattccattatgtgaaccaaaagtttaagtgatgtctaaattcaaacctctgcgctatatataagtgcaatgtattaaattagttagtccttatagttactaaacaaccactattttagctaataatatataaaatgatggtcatcttaattcttaaaattataaaaaaaaacggaaaacatttcattttttcaaataccaaaatagcacttttatatttttaaggaataattttgtatttaatttttggaaatatgataacttaaaatgttactcttgatcagta

SEQ ID NO: 2033 - DNA, 1099 bp, Glycine max
  Soy_ogl_5337 Gm16:7391601..7392699 Cluster 8
aatgattaaaacaagtataggagatttgtatctcttaatcaatatttcgtattgatattgataaaaaaaaattgctgtgtggcacctttctcatttatttggttcaattctgcattccattctgcattggtggtatcgaatccactcaaataactccagattctatttaaatgctggccatatagacatcgcactcgtcatcaccaaaaccacatttttcttttccttccaccgcacgtcctgttacatcccttctcttctttcgggtcagatatttcgtcactagcaaatctaactgtatatggatgattccatggagttgcaacttagtgtctacggaaaatgcttcttgacagaagattaacaaaagcactatctgggaaggtaatcaactttataaattactagttgaaaagagatacttcatgcttttatctgtatttttaaaataaaaagaaatagcagttgaaaaatgtaatgacaacaacaattatattttgcaggtttaagaaggaaacgaaaacatttatatatattgaagggtaatttagaaataaaagatatgtacattaaaggaaataattgtttttattaatagttatggataacaactgatttacaaaattaaacaaatataaggattataacatcacgaaaatatattcaatggtgattgtttcagctgtcgcgtggaatgtaattttttacttgtaaacattttatatatttatctatacaaaaaaagttgataccaaaacataattatatataatgagaaattatcggcctgttagggatatatttttctttttttttttcttgaatgggatgatatgcttttcttgaaaaatatttataatgtttgcttgagtttttcttataacgtttttacgttatcaaccagaaatcattaataatataaaattttaattaactattataaaaatcaatatataattattttttattaaacaatttgtgtaaagaacaaagtgagtatatatactgtatatactgtgtgtgcgcgcaataagtatattttgaagaataaatagtttatgcactttatatatatacaaaatagtttatgtagtaattg

SEQ ID NO: 2034 - DNA, 1200 bp, Glycine max
  Soy_ogl_6890 Gm20:40612601..40613800 Cluster 8
ttgtctttaaaaactaaaaataagatattgttaacaaatacctttttttaaacaattttctataacaataatcaaccaggtcctaattcctttaaattattccttttaattgtatgagtacatttgtatttatacatctaaaaagagatagacaaataatatttagttgtgcaataaatttttggcgtaatttcaataaattttattcgtgatgcgagggatttgaatctcctagtttgttattttgtaagaacttaacttaactgctgtttaattcaagagttaatctcatttatttttgagaaagaaaagaaaatgcaaacaaagatgtgatcagattagcattatttattttaattcttactaggcgatttgttctttacactaggttagcgtgatgcataaaattaaattaaagcatggtttgctcaaacttttccccgatctttagccgaaattcattacacttcttcaactattttacttggcttttttactttataatgaaaccaagctaatcttttctttcttttcctctaatatttttttttgtccattatttccaccatttaaaccagtagttacttacagctagtttttaggatttcaaagtgggtttaggccagatctaaatggcccaaagcacagaggcattaagggaattgttattcccatctcaaaaatttctattttcaccccagatttttcaaaacaatgtaacgagacaaaattattcttcttactttccctacagccccctccctttctcctcctccatcacatttagctttccattgcaacagaatcatgacttcattatgttgggaacacataatcacaatttcattttgtatttggcatagtaaaaaatggaatcacattttcattgtagtataagggtggcaaacaaaaacggatatacatttctatgtacaaaatatataaggaaaatatatttttgggtgcaaaatatatagtagaaatgtatttttattgtagtaaaagggggtgtacaaaaagcaaaacaaaaatacgtttttgttgtatattttgtatgtgaaaatgcatttctagcaattcccaggtacacaattttttaaaaaagtatttcctttaaagaagcagacctcatatctaactgtctcatgggttcttctatgttatcatgttgagtttgtcatcacctttcatggattaaac

SEQ ID NO: 2035 - DNA, 1100 bp, Glycine max
  Soy_ogl_560 Gm02:15022801..15023900 Cluster 8
aatcaattgattttaaaacattgaattttactttttaattttaaaaatggctatatttttttaaaaaaatattcttaagtttttatttaaattcatttatatatatatatttgaaattttagacacatgttttaaaaatgttatattaactaattccatgccttctttataattttaatacattaaaatatttttctttcaattcatatatgaaaaatatgtttgaaaacataattgattatgtatgtaagcacaatttattatgcttacaagcataaacaattttgcacacacacacatctagatgttggataatattttgaatgttcataaaacattttcgtaccaaaagtaacttatcatgagttgcctaagcaagacgagggcaagatggaaaaagttgttgtagaatacttatttcttcttatttccaaacactttagaggcgttaaaagttaaaacatgtgaaccttactcttattttaaaatttctacaccatttcttttttgcccaacaaaagaatgtctcttttatatttttccattctctttctttcctttccatattattcttacataccaaacacaatttaaaatgaaagatgcctacttttccgttcaaatcaaccttactcatcaataagtttactcaacaaattaaaccacaaccctcagtgacaatttgcgcaaaattggaaactttttgctagaaaataaatacaaaaaatggtattttctcatgtggcttctgagtcctttagagacatggatcacacatgttgctctcgatacatcttcatctccatccaaaatttgtgtctattaatagataatggatatcttagccttataaggtggagttttctttgttgtctgtgtgaataactagtattagagctcgtgcaatgcatggacaaactgattaagctttcgaatatttagttgtgttctctattttttgtaaaccattatattttgtatcctttatttttaatttgtagaattagaagtagataatgcaattagaagtaaatttaaccgttttggtatgtgcatttagatgattgctcatggagagcaagtataatgtctgaatcaaa

SEQ ID NO: 2036 - DNA, 1040 bp, Glycine max
  Soy_ogl_5004 Gm15:11787561..11788600 Cluster 8
gacaataaactcataaatcatggagaaaaaatgtatgtaaaacaaattataatctataaaaatcacaattatcattactaaaacatgataaagatgaaaatatattggaataaacaacaaaataacacaataaaagtatgatcttaaaattgtttgttaacaactttttttaaatcaactttatttcattttaaactactaatacaattaaaaaaataatacaaagtcttctcaaactataaactatttttaatttaaacataaatatagataattaaaaaggaaaaaaattaaaaataattttttaaaaaaatcaaaagaaataaaaaataaaaactacgttatgaaatcgattcctaaggaccattttcataatgcatgttctaaaataaaaatcttagttttaaaattagtttctaaaaaataaaaatattcacattaagaaattagttcttggaaaacttatttttcaacataaataataatttatatcatacacgtaaataatttttcagttgcattatttatataaataattatttttattattatttatgtgaaaaactctcatccaggtcgcatttatggtttttcttaattctgtcgtaccattttggttcggcgagagatgggggcgggtgctaactattaacacaacatgcacgatgagagtactcgaactaaaaactatgcccccacaaaaaatcaactataaaatgattttaccataattgcattttctatgcttcaaatcgaagctttccctcataaacttacggtgacccttttatttgtttaattttttcttttttgacaaatattaatttattattttttattaaaaatgtaactgatagattcagatcgtcacctctcttttctcccttctatctttattattaagtattttcttttcaattattaaatcaattttatatttttcatttgttcaaattttatcatcatttacccactgaatatacaataagttctctatgcttaagtgggactagtgtagcaattttagaaaattccttttg

SEQ ID NO: 2037 - DNA, 1450 bp, Glycine max
  Soy_ogl_3167 Gm09:38171051..38172500 Cluster 8
ctattctttttactattgttgtaaattcaaattaagtataatttaaagtagtttgaacaggggtaaacctgtctagattaaataaggttttgtaaggttaaaaatttgactctctttttcttttattaaaggttcgagtttgatctatttaatggatatgttttattccttaattaattattttaaagtctaaatagactaaaaaaatcttacttaaacttttctttgtaagcttagaatttttttgcatacgtttttttttgtttatgaaaacttatagaagtcggaaattgaaaagaaaaaaaaaatctttaagtgaaaattagcttatacataagttaaaatattttgttttttaagaaacttaaatcatttagcttcttgaaaagcttattctaacttatggataaatttattttattttattttcttattttttataagtgcttatgaatatgtttattcgagtatgactttactttaccttgttgtaagtctatttaactcataggaccatctttaaaagcctgaaattaatataattctccttgtatataaattgaaataattatcctaaataatattgaactgtttttaggagtcattttttaacaagaacgttttagggagtcatttttcaacgagagtgttttaaaaaataatgagatcatttttatagatttttcttaactcattatctctttccatctttctataggtctaagagtgcgtaattccaacggaaattctctttcttaaaggtacactaatagaaataatggtttctcttctcattatggagagtaacttgataggttccatttcaaaacagacttgtcaactgcaacacccattttagttagttttttggctggagtaaaaatttaattgaattatttaaagtaaaaaaatgtgatgcgacaatatatgaaaatatgattttttttttacgaattatataaaagtatgaaatattattaaaaagtaaaagagaaatattgatggatttgttggttagatgctccaatacatctataaattgatctgacatgttattgattgtgaaataccaaagtaaaaaaaagttcaacttatttctataatgtacattagactcggaaagacagatttttttcttttatcttttttgttttctgtacgttctttattcatgtgaagtttattgtaaatcgcatacaatgatttgtcatttgaccccgttaagttgcaaggggatgccttagcactggtgcttgagtttttttctttccaccctttgtaacccttttcacactgtcaacgatttgtcaaaaccaaattggaaatctatgttgcacagtactgaagcacttttgtttcaatcgtgcctatactactaatattttagtcctaatcaacctgatgaaaaattatttggtgaagaaaaaggatatatggattcacttttggt

SEQ ID NO: 2038 - DNA, 1000 bp, Glycine max
  Soy_ogl_3786 Gm11:71001..7249100 Cluster 8
catgtgttgttttgctacctaggatagtggagcaatcgatataaaaaaagtaaaaaaaaaaaagattaatactaaatcatcctattatattctcatattatcttttatattcaatattaaatgaaagtaaaaacatttatttataaaatatatttaaaacttatcacaaaagatagtaaaaaaaattctaggaaaatataataggaaaaataagaattattcaaaacaatagaatgttccactggagataacacctcctcttaagtgagtataaaattcaatttaaaataatattattttttattctaggtaataaaaaataacccagatgtaaataattttaaaactactctggtagatagtttttttatttcttgtttagtaaaaaagtcctcacaccacacctatcttcttttttcttttttcagattagtttacaataaataaaagtaacattattattggcacttctgttacatacttttttctgtttttcaatccatgatcattaattaaaataggttttgcagagatgcaggactcataaaaaataattaataggtttagatatatttttcctttctaaaatattatgacttttattcaattttttcataaaagtgttgtttctaaatatatttaataaaataacgtgattttgatttctcattatacacgtttttaacctttaataagagattaaaaatattaggatattttatttgtagtcttttatatttaataaaattatgcaaattctttattttttattttccttgtctggatgtacgaatttattaaaaacaaatacaaaaatgctagttgtatactcccaagtctcaaacaatttttttgaacacatttccaatgttttctacgacatggtataaatattgcaagagacgtactaatgatatgatggaaacaaaataacctttactagctcttaagataatttatgagattgagtcaaatttaaactaaagttttaagataatat

SEQ ID NO: 2039 - DNA, 1279 bp, Glycine max
  Soy_ogl_6850 Gm20:38664322..38665600 Cluster 8
aaatcgtatatagtttttttattttaactatttaatgaattaatgtatgttttcttttttagttttatttaatatattttttatattttttttctaatgttgaagattattatttgttttgtaaattaaaaaaataatgtaaaagacttaaatttaaataagaatattaaacaaaaggaggaagaggtaatataaaatgtaatacattctaatatttttatttaaatttaagtcttttatattattacttttaatttataaaacaaataataattcttaacacttttcgcaccagcgaagtattcattggagatactgtgtggaagaggtaccaacaccttataataatgaaaaaaattcaattcaattaagatttggttcattctagacttatacatcatggacatcctccttttctatgtggtagacttgtatgttactattgaaagtgataatattatacatattattactattccaccaaaaagttttctattagttcaaaacaatcaatgtgtaaaataacaagtaattgctaagattcacccaagaccatacatcttgaatttaaaagaaaaagttcaaaaacatgtctattagtaaaaaatatattaaataaaaaataaaaaaatattaaaaaaaagaaaacatagattaattcattaaataattaaaataaaaattatttatgattttttaaaaaataccacaactttaaagtcgtaaaaaaaaattaaagttgtgaaatatttataacttcaataaaaaaagaaaaaaaaatctattttgattttaaaattgtgttaaaaaattaaaatcatatttttacgaatttaatgaaaaaaaaatcgtaacataatttaaaactttcatttcagaaatcatatattatcttaagatttattcctatcagagtactaatttaaatttcatcccatttaataattaaaaaaaattactccctcagtccctcaccctttcggtctcttaccggcaaaaataagcattaagcaccgtcgaaagttaaattttcctagagttggatttgacctggcacgatataagaaaacaaattagagaaatgacatctgaaattgcacaaattaaaggacagggataaagatgaggtggattttcacgttactgcttcgctttgctttctgactttctgtgtgcgctgtggctatgcaagatctgtgcagactatgcatgcaattgcaaattttaaccacctctccatgattgagataatcaggtgtattgaggagacgaagatata

SEQ ID NO: 2040 - DNA, 1000 bp, Glycine max
  Soy_ogl_795 Gm03:1655801..1656800 Cluster 8
tgcacttgaaaagattattattacatttaataggtgaactcatataatttatttatacatatcaacgcttttatattcattaattatagacctgctaagagttgtccttatcaatagatttacgacctacgttcttatatatgcatccatactactaaaaattatataatttggtttaacatgattatctttgcctattttagaatatagtaaaaaaattgtggacttataattcataaacaaacaacaaacataatattaattaataaaatgaacaaacagaatattgattaataaaatgaattgcctaaacatcggttatgagggtaatattttattatgtggtattataagtaaacaacaaacataatcttgttcatttataagtttatgaatatatgtgttataatataacgcttgaataaatgtgtatttttaaacataattgattcaataacggccataaacttgaaatgcatataacacataataaattacgaaaaacacatacattgcaacaaatcagtgcttgtattattaacttccgttattatttggttaaccaatcgattgatgtgttgttacaattcgtgcagcacctcaaagataatgattatattatatttaacatcagcctaatgatttaatgttaagaaataagttagtctgtaaaaaataattgacaacaaagtgggaaattggagataatgggttcgaaaataagaaaaaggggagaaaaatataaaaactctagttatttacttataattttctcaaagtgagggagtgcatctgcacactctcacttcaacataaatctgccaccattgatattttttgcccactttaatacttttgttgttttgtcaacttccaaatctcaaacttcgaaagaatgtatatcatgatttgacacttcgaactctcatgagattgtatgacttgtttgagaggataattattagtcaagttgtgtgtatcattgactaaaatctcaaac

SEQ ID NO: 2041 - DNA, 1283 bp, Glycine max
  Soy_ogl_4718 Gm14:6447218..6448500 Cluster 8
cttaatttttataaaaaaattcttttatttaacttttcattcaaatgcatactttcatctcttgaggtaggtacctaatattactcagaagatggaaataaactctctacatcaacattctttttcttatattttttccaaaaaaaaagaagaatttatataaaattgacaaggagaaatataaattagattcattcaaaaacctctcataaacattctttttaattataaacatggaatcgtccatctcgatctataaaaaatattcaatttaaaaatatcgtaaaaaataaaatttcagatttttttttacatatcaaagtgatggaaaagaaaaaatatcttttaggttcagtctgttaagaacctcttatatcatgtatatattctttgaaagaaaagctaactgcacaaatttgtcggctaccatgataatttataaattgattttagtttattagataagtttaattcattatactgcatttttattaactttcttactataaatgtcgatagagaagtttatttaaataagattctatttcaattacatgaaaatattttttaattataaacacattttttattagcaaaaccattataaatttgcttgattttccttctccattgttttctaaattttcccttttctctcccttctcttttgtttcatgtatgcattagattaaacaatcagaattctttttgcttacattctgatttctattccatacagatgattatggattctaaaattactgataacacacggatagcgatgaatgtttgcatctaaataaaatcaagtgctacatatatatatgtgataaaaataaataaatataggcttcaagaaaagataatgaagaaaaataatataattgcatgtttggattgactagtttttaggatataataatttataaaaaaaaagttcatataacaagatttgggttgtaaattattttaaataaataatagctacgctaatacaaacacacacacaatgtgttaaaagaaagtgtatcaataggttactcaaaagtagtcaaaatatttgtgagaaggttacaatcttttgatgtttagatatacattcagggttattttttaaaaaagtacataacttcaaataaaaaatagaaaattgtaacttttatgtatagaagtttttatacacttattttgaaattcttttaacgatatttgtaatttgtgtaattaactattattaatagatgagacttgagagttggttcagtgtgtttggatatattccc

SEQ ID NO: 2042 - DNA, 1600 bp, Glycine max
  Soy_ogl_6487 Gm19:41261201..41262800 Cluster 8
tgtagaatggataagcattgtacagaaattattacgttattattagaaacctgttcaatttttttcgtcgtttttaatttttttcctcattatatgttaagattttatattttgatttgatcataattttacccttttagaaattaatatttaattaaaatttatctaggattattattttgttataggggtactctagatttgttatttcatatttagcacaaaaaaaaagatttttttatttcacaataaatttgcacaagagtaaggattgagttgttgcatttaattttttgaattggatttttttgttcgtcgtgaacttcaaatttcagtactgctttccgtcattgacgatgacgagatataatattgtggcttaattttatttttgtttctcttctttctcaacattatgaattttgtccattaatattttttttttgcaattttagttctccgactattattatttcttgaatttagtttccttattttttttaattgtgtaaatatgagtcaactgctcattagataagtaatagaaatgatagtataatatgtcttatttatcttatatgatgcatcatattaaaaataggttttgatactatatcttttatgaaaaatgacattgaactcataaactactcttttataattatcatttgaagaataatctcatactatctcatgaagtatcctctattacttccaacaaacaaagtattctccatatatagggttagaaaatcaaacttctattaacatttgtttgttttaaaataatggttgatctatcaaataagagaaaattatgtaatatttcctaaatagtaccatacttatatttaagtctaggctttgcgtacttgccttacctatggcaatgagaaaattaattaaaagggtatttttagcttatgcgtaagtggttatgttaaggaatgaaatgagctggaaaagagtgatttgatattgaaacgtaatttacattataaaatacggtgaaaagaaaattaagagaaagagtcgagaaccgactcgaagagttgattatcataataaattactaataacatcgacatgctataatgtaaaagtgataatagttaattggaatgataaggattaaggaatgacaaaataagaaattaagaagctggcaacgctataattgaatctttagcttttatacatttatatagataaatatttttttttggaagaaaagataaatataaattcttaaaaattattttccattttgtacaaaggtaatgtattaattcatctttcaccataatacactttttcagtcatgataaacggttgagattgcctacaatacgagttgtaagattccttcgaccgcatatagcaataataatttttcttgttgggagaattttgtttgaatgcaaaacaatcaaactttaattgtcgagcaataaagcttttgtttgaacaacaatgttttgtatgtatctctttttctatttataaatatttaaataattttcacctgtttaaagttattatgttcattaggagagagataaaaataaaattagatccacatagaaaatgtggattctac

SEQ ID NO: 2043 - DNA, 1120 bp, Glycine max
  Soy_ogl_5400 Gm16:31892875..31893994 Cluster 8
aggtctaagatgtaaacaatgtcttaattaaaataataatcaagaggcaggtggggtccaactatgcacatggcccataattggcttggcatgcatgatagtatgaacagaaatagtgtactatataattgtccaaaagctcaccaaaaatgaaaataatggttgaacaaactaaatacaaaaataattattttgcacgttttacagtgctaaaatattcgtataacatttgaattaattaaaatggagataaggtatcccttctttgaactaagaataagctgtacaacgtgactgcaatgaaacattgcaggtttcgattgccgcaatgatttcctttttatttgtttagttttcaatcactatcggtttttttttttcttatgtgaatttttcttttgccaaagatttgaaggcaaaaataagtgcttttattgttttagaaaactcatcaatctgaattagtaattgaaataatgctaatatgattaatgagtacatgaattagttgacataaaattatgttagtttaatttataatttttaatttaatctatttggttccaataaaattattttcagcaaaagataccaatgatgtagattaaaaaaataaatttaatatataattgcattaaataattaaaataacaattataattattacttgactcaaatataattaattttagaataccttgataaaaaaaattaatgtaaatatgtatttatgttggtgatataatatagtgtgttcttttaattaaataaaacatatagtgtgttcttttaattaaataaaacatatagtgtgttcttatctaagagttgtagcatttagaattgtttggtccaaaaattgatctttttctatttcattttcctaatagaaaaaagatatatacatactaagaagttgctataatcaacaaagcaattcaggaggaaattagtgtagtggtctaatagcaacaactgtgtagtttttatttgaatctagaagatctgatcacatatctctgttcaagtcgttgtaaacaattaggtctttaatttttagcattgcaaacttttagaacatgcttgggagtgatgttttaaagaagaagaaaaaggagag

SEQ ID NO: 2044 - DNA, 1000 bp, Glycine max
  Soy_ogl_4191 Gm13:21787201..21788200 Cluster 8
aaataaattcttacagtgtggagctaggtaatgagtcattattttgcattgacggttttgttttgttaagaaattgataggataagctatatatctagctagatttgcattaatcatgcacgtgtaaattccaaaatgatataatatgtttttaattcttataaagattttattgattttttaaaatttcttttatttctttttacaaatcttaaaattttaaaaaacaattcctatcattatttgatgatgatcggtcatgtatttagcaattattttaagataacacgtaatacgacaccactacacgtatgttatttatttttttacagcatgtatgttatatatattcttataaagtgacaaaaatatttttagagaactaaaactaaataaaactatagttacaggataaaaaatatatttattccttaaaaattacaactaaaagaaaaattgtcagttttcaatgttgtttcaatccagtatagtgaagatctcatttattttttaataatttgatttccattatttaattgtatactttttatttatctattaagttgatatttaatatttaacaaaaaatgctaatacgacgctgcgatgcacatccactagcacatctatgttaacactctactagagtactatctaatcaacatttctgttaaactgtatctaaatttaatatatgaactaaaattgtataattaaaatatatagatagacattaatttttttttaaaaatgaaaaaactaaatttgacgataataagaagactaaaagtataattaaccattattcttttaccaaaaaatggacagtctaacatttacactacttttgcatgtttcttgagccaaagctataaataaaattgaaaaaaaattaaattactttgaacattagccatcatatttaaatgggccaaataattttttgggtttgtgtcaaggggttttcttcttacaccagtcaaatcttacatacatcatt

SEQ ID NO: 2045 - DNA, 1200 bp, Glycine max
  Soy_ogl_394 Gm02:5235701..5236900 Cluster 8
taatagaaagagtgagagtattcaagcgagaaaaatatatttgattataattttacacatatttttttattttatttaaaatatttataaaattgtatgaaaacatgtgtaaaaattaaattgtaaatacccaaaagttactaattttataagtattataatttataataatatcttgaataatttaaaatgtaaaaattaataaaattagatgaatctctaatagataatttatatttcattagccacttatgtgagttgtaacttatgtattgttatggcattatacgtgtttggtaaatattaatggttaatatggaagaattcaaactcatgattattttttttagctatcaagtcaatcttataatttttcatttattaacataatcataaaatattaaataattatcaaacagaatattagttgtaataaatgcataaaagactaatatttttgcccaaatattttgatcaaattttcattaaagatttataatgatattatatgtcataactataattaaaaacaaaataaaataaagttaatttcaaaataaaatattttagtttacagtaaaattatatactttaaagaacacattagactgaaacatcttggggttatctctcaacactgtagcagcttcatgattcagcggatcctcataatttggttcttgcgcaatgattcagagattataatctggaaattccaaagataatatccaaaaatgtctaaaaccagagtcatacaatgaagagatgatacaagccgtagatgatagagtttatattgaggacaggtttccaatcttctcgtaggatgttaaggcaaacatttccttccaagtctatatttggatggtagacctacatatatgacatgacaaattaattaatgactttgaaacagacaaggaaaaaccacaaatatgacacaagcaagattaaacacgtatgatgtacataaaaaagaatgagttaataataccaaagataaccaagatctcctagttcctacctttgtcttgcactttaaccttcggcgcctcatgtggatagatgggggacacttggaaggtaaacaaaaatgtgccacctctgtaacaacaaaaagtagtaaagataaggaagttttctgtttattttccctttacttttttgggggtggaggatgtagtgtgtttgtgtctgggt

SEQ ID NO: 2046 - DNA, 1244 bp, Glycine max
  Soy_ogl_2612 Gm08:11553801..11555044 Cluster 8
aaattaatcgcagaggtcaatcattggaagcattaaattatgtgtttttctttataattaaaaaaataataattagcgtattagtttctatggcaatgcatattgattgattatttttttaataaattttgcaatttggattctatttttaagttaaacatcaaatccaatcaaagatatgaaaatgcatattaaatattaagcacaaccctatattatataccctttaaaattaattaaaattatactgcgaatataaactaaataatttttatgcacaaattttaaaatattttaaaatgtttttacacatacatcattacgtcaaagttttataaaacagtctaaactctaaagacaattatttcagcatcaaagtttttgaaatcactgttactacaattataacaccatcagccatatttatcttaattttttacaatattaatcgcaacttgtacccaaaaaatatataataaaaatcacaataatctggaactccaattaagattgtttattgtaggataaagaaggcataacaaaagttgcttttcaatccaaagattaaagttacgtttggattaaattttgaaaatatttgtacaacgtacaatgcataataattaattatattgcatcaaatgaagaaagaagaatgttattgcataatattttaaaaatcacatttttaagaaataatatttttagcaatttttttgttacacctgacaatactatattattcttataaatggaagtatgtaattgatcatctttattcatatttaatgtaaataaatattgcatgagttacgcagtttttgaaattttcaaattctataggttttgaaatgaaaatgtaaaaaatgacaacatattttgcaattaacagtaataatgatgagaatgagaaacacacatggttcatcatttgatttttacattaccctttattatagcctagatttctccctttttttttttttgttgttgtcgggtataagtgtagtaagtgttggaagtgaaactacacaagggtcagttgacaaaaaaatgttaataaaccataagtaacgttagtctcttcaattgcttttatttgtctacaaatttaaatttaaatttatgaaaatgttaatatgatttgattttactaagtaaataacaataattaaaaacactttcattttaccatttaatttccaacaaaaaactttggctataaaaggatattgcaggtgata

SEQ ID NO: 2047 - DNA, 1200 bp, Glycine max
  Soy_ogl_2845 Gm08:41159901..41161100 Cluster 8
aatgaaagaaaaataagaaaggaagaaaaaatggttttggtaagacataatcaatacaaatcctttcaataataatattaatattttttctgaataaaaaacattaatattttaggtgatttgatgaattttaaaattcatgtaaaaaaagtgaaatcatttttttacagaactccttcgctttaataagagatttgattgttttctattcttttgcattcagttttttttttccattaacatgaaaagcctcttattacacaatattgattaacgaaacgactctttcttaatttaattcggagatcaaccagtatgttttatagatgaataattaatttgattatataagggaactaagtttatgcataaaaaataacgatattagttaatgatgcatttaagggttgattggtatgcacttttaatatcaattagacaataatcaattcatatcactttaataataatatcaatattttacatgaatttttgagagggatttacatacaaaaagggtggaaattttctctgcataactttttcactttaataataagagataaaaatatattcggtaaatgtaatatttttttaaaaataaatggaactatttttggtggacatacaatttttttatttctatattaagttatataccaaaacaaatgtcctaagaacatatttttgaaatcaaattttggtccattaaattgtaattaaattattttttacaataaaattcagtggaaattttatcatgcttatccatactattaaaaaaaattatttcattaatttcagcatgtttttaataatttttttaaaataatttatttagttcaataaaacaaattttatacaggaaaataactcaattgttatttcatggaccaaaaatttgcattagtcaaaaataataacggatgaatataaatatgtaataatttatataattagaatatctatttaaatataaaccatatctatattatttgtttattatcacacaatttatgcatttaatagaattttgatagacgtccaaaaaaatttaataatttaaaattgaaaattaatttgaccttaaaatgcattgttcatttgttaaattcttaatggattttttttttacttttcttacaaataatattttaaatagagataaattgttttttctttcaaatccacccgtgatta

SEQ ID NO: 2048 - DNA, 1400 bp, Glycine max
  Soy_ogl_5935 Gm18:5155301..5156700 Cluster 8
atatttcatggccatgttagctttcaagatagatacctcttgtaccctcactttcgtcctttttttattttttttttatgaatattttctatttattatactattacttcatacatgatcaataatttcagagacaaataagcacttcaaattgggagagtccttagttgggttaggttatgttttcttggactatttatgaatcaaattcgttctttatagcacgggttttctttctttctttcaacctgacccaaattcaaccccaatgaatcgagaaggaatcatagccaagtatagataaagcattacttttttttttgttttcaggtaaaggagaatagtgtgcatttcattcctgatatgatagaggaatacgataaaaaaaaatttagttgatagcatgtaacttaattatcatacttagagtgcgagtaacttgattgatttgccttcttacataactcactctagaatttatgataattgaaagtgaattttaaagtttgaacaaaatgaaatgaaactcagaataatcattataggagtcatttcctgagccaacattactaaaatatttgtattcttacgtactcatgtcgttagtaattttaacgttcttgcttggtatgtaatgcacatttgtgcatgtatatatgatatatctgaatttattattcacactttaattaaatgttattttcttaatgtgtttttttatgaattaataaaagaaaattattactttaatgttaaaaacttaaaattgataaatagatatatagtcattaaaagtaccacaagcttaattacttataaaattaaaatctttcgattctaattaattataatatatggtacaagtataggataggattagatattatactacctatatttgtatcaataccttcacaatcttaattatgagcaattttttatgtctagattaagtagtgttaaatattaataaaaaaattgatatagattaaaaaatagtaaatgctatttagtgcatcggttgaagaaattaaatagaacattattctgtaaaaaaaaacgaatttattgtaccagaaatataaaaaggagaattttaacaagtgtttaagtagtcaataactattaaagttagtctattgatgaggattttaagtatagtttgctaatgattttaagttttaatctcattaacatcgttgtaaggaaaaaacaaaacgctggtcattgaatcaaaagaaaaatgaaaaaatgttatcaatatactgacttttaatgcatcctaactatacttttcaataaatattttctattactttttttacttttattttataaaatactggatagtaatactttatataaatatagataaaattaagtatagtatcttcaacaca

SEQ ID NO: 2049 - DNA, 1195 bp, Glycine max
  Soy_ogl_1353 Gm04:42834901..42836095 Cluster 8
cttttcaatagtatattatatgagaattgaacctagtttttttcttctattctataatattttaattatgaatgaaatttcaacatttgatcatacaatatatattcataatcaagacaccgaattaactaataggacgaacaacaaaaataatatctctcgaagacacaacgtattcccttctttttatattgtttgaacttcaagtaacaatgaaacctttctctcttctttttagaaggttttgaactttaagtaacaacagaacctttttctcttcctttttttttaaaaaaaaaaattagataggataatagagaattgtaaaagaattattagccatatatttcaagacattcattacaaagtatagagaaaaaacctatttatcattggttgtcctcgtgaagggttgcatgattgaaaccatcttgaacttattcaactaattacattatttgagtatgtttatcatcattgattttcattatcgatcacaaaataaatattctaaaataagttaagacactatttatctgatgttattagatcaacacttaaaaaaaaaattctaacaaaaacttcaaccgtggtgaatattattagatgggatgtgaaattgtacataataaagttatcatatctttaattttcaaatgaatttaaggaggtgggaagagatttttttatagtaaactagagcttaatgtctcgtattcaataaaataaatagaaaagcttaatgtctcatatattaagtgcttgtttgtttaataatttcataaaacaggctttaaaccattaatctatatattgtaggtcactaacaaagttaaaccattctactgcgtataacactgaaacttgtcaccctagagattgatgatgttagctttgaggtcttttggatcattaatagagattgaaaattttctcattttcttatttatttttatatttttatttttattagttaagtaaactatacaactaaagccaacccaattaaggtcagtcagattcggttacttaacaaaaaaaatcgaactatgtctgattggattgcatcttaaattatttcaaattcaattaattcgaatcatttatactcctaattaaatacttttataattttaatttttaaaattattaggactatttttcttttactttttcacttaactacttctcccct

SEQ ID NO: 2050 - DNA, 1500 bp, Glycine max
  Soy_ogl_1910 Gm06:11831201..11832700 Cluster 8
aattacatattactatatgagctataaaagcatatacaatatacaaaataaaaacatgtctcggatatccatcgatcacaggtgtacctaactataacaaaagaagttttattcaagctcatggccttggactaatggtaattatgtaaaagtgataatatgtcttgtgagaaaaagtaagaattgatttttgtttccttgcatatcattttcttaccaaacaatccatccttccgattttgtcaagtaaattaagatgtcaccgtatctcgggatggagggaaggataagctagagtagtctctaatccaataaattagaagcgatctctaatctctgacccaaaacttaaaaaaattgtccctactaaaaacatactttcggtcaaagtcaaatcaaagcttggtaagaggcagccttaagcacctcatacaaacagtaatacattttaattatataaaaaattaaaattagtgaaatagaataaacccattccattctgtttacttttgagctacgtggtcataatcaggttttaaaatttgaaacagaggaatcctgagttaattaataataatttttcttgtggttgactgagtaaatgattctgcgtcagcttgtgtggattcgatagtctataagactagtcatagttagaattgggtcactttagcccaaaaaactcgggctttgatattaacttgtagactttctggacaagaaggagaaggctagtagttgtagcctagtacaaagcgggcaacaagaaagtgaaaaaaattaagagaaaatgaaaggaaagtgtaattaacaagactttactttctgtatgctctctaaaaaaattctgtatgtttgcattgttgttaggatggattctagggtgagggacctcaaattctcaactatggtatcatagatatagatcttttaaagttagtcatcttctcaaattctcataagagagaataaatttatcttaacgtataacatttattataaagtaattaaagatatttagataaaataattaatacaagaggtaacttcaaaagaattttataaaatttttttagaaaaagaatcttatatttaaggagaaagatagtattaatttttattttttacttaaaatttctttgtactttttttttgttttttagaaacttttttttttgtctatcctaccactcttggctagtgatgcctagttctttcttttacgtcctccgctctcacacccaaaaaatgacaacatgcatgcaaagttaagttttattcataaataatatatttaacgaaattttaattaatttacgttcagacatatatagctttaagtctcaaaccataatttgtacagaagtgaagaaagatatatacttttttgttgagtcaaacaataacttgtaaatttatattacacaaacattcaacttatagcttaactttgtaaaacaaaattgtaccttaatttacactgatttatatgtctttaag

SEQ ID NO: 2051 - DNA, 1000 bp, Glycine max
  Soy_ogl_826 Gm03:3537401..3538400 Cluster 8
gtggattatacgtgttttgccactctgctattttgtttacccaaacaaagaaaaacctgttattatgggaataaatccttatgagtagtgctcttgtatgtttcatggcatttttgtccttattttcctacagagagttggaacacttccataagaaaatcagttatggaaaaactgagggcaagaattagaaagtatactatatttggtatagtttgagaaggataaggtaagagggttggcaattatgtcagctctagcaaaatgggtgttgtaatcttcttaacatatatagagagagatcgagagacgatgatgtatcaagttccttgatctgactaatttgtttgcaaaattttatatgaattaaatatttgttgttatatagttttatagtagttaatatttacttatacttttaaaaaatattatacattatttaatttatttaataaagtaccaggtttatattttaaaactttactaaaattgttgactttatctacttattacttttaatttaatgattaaattaataaatttatctttgtgtgtgagagagaattatacttatacttaatcatacacctttaataactttgtataaaatatattttttatcatcaaggagatttaattcatttaattgagtagagtatgtgaactattataaatttttaaatattttcttataattcttataaactaaaaaaatattttttttattgatttaatcattaaattaaaacttaggaacttatttgtggagggactaataattaatattttttattaaaagatattttaaataaaaacaatatactaattaatcattaatatatacattagttccagtaaaaaaatatactaattaataaatttgataatatatgttatcacttaccactaattatatactaacttttttaataatatatcttgtaagttgtaattaatagatatgataaaaatgatatttctatgaattttgataaatttt

SEQ ID NO: 2052 - DNA, 1200 bp, Glycine max
  Soy_ogl_901 Gm03:36361601..36362800 Cluster 8
ataggttcaggattcaactttttagccgcttcttttttaatgattggtatcttgtactcgagaatatttcaacatgctcattaatcaacatgattgtttattatacctgtaaggggaattgattataaactttgggaatttctatatttacaaaaaaaaaattgttaataagaaaaattgcttgagattcatatgcatcaaaattaacataatacatacttttaaaatatataaaaatattaatcatatttttatgagcaaataattttattgatgaagaggtatggtatgttaacaaaacacaaggtgtaccagataaaagtatgaattatttgattaagtatagttataaatttacagttagattttttataggtaataaatttacaattagattgataaattaaacacacattctatataacaaaggtattaataatgtatcaatagttggtatactttgtaataattttgttttttaagtaaagtcaccagtttaaatattgtgaatgaaaaaaatataactaaaaaaaataattttactaaaaataattaatcaaatttaagttcctaataaaaattaattattaataaagtcagtagttatttcatatcaataatataataaaaaaattattaataaagtgaaacttgatttaagttgtaccgatcaacgtatatgtcaccaagatttgtcatatatgcgtcaatgggcaataagattgaccaatgaaaaaattgatggcctagaagcaaagacaagcaacattgtccagtcttgaccttcgccaactttaacatttagatccatcatatattaccaattaagtcacaaacttgccgaccctccattgaaaattttaacaacagattgtcctccaaatagaccaatatggagtataaccaaggtgttattgtgggaaaaggaatgcttttaaataggagagaaaagaaaaaggatagaaggtgagtttgattgtgtagaagagaatgaaagaaatgagaaaggaagagaaatatttgaattaaagtaaaaaaaaaaaagtgtaacacctacattaattttttttaaaattctttatttcttttttttttctctaacctaacaaagggtgaatttgcaaacaatggatgggaaatgcttgattgatatgaattgacctcaatagtattccaccaccacatagcttataaattgca

SEQ ID NO: 2053 - DNA, 1007 bp, Glycine max
  Soy_ogl_2971 Gm09:3526401..3527407 Cluster 8
taattgcattttaattaattttattgattgcatgactagattataataccatcttacttttacctttaaagtgatgaaataattcttatattgtaaatttaactaattagttaacgatacatttttaagaattgattgttattagtagggccaactataaaaactaaaattcctccatcaaatatacaagatcaaatttgatacaaaagtttcataattacgttttttttttcaaaaaaaattcaagaacatataatagaaaatatatctacttgaaaggcaaactaaatgtttttttttcccttttaaaagtccaaatttacaaatgtcaatcataagtttcacatgtcatcaagaatcaatttacaaaaaaatgataaatataaagggtaaaaagaaaaagaaaaactagagaagaaaaatatggaaagaatagtaattgaaaaagagaatatttattgtagcctatcaaaaatcaagatgcgaatctcttaaatagtatttctaagtttgtttcattagcaaagattaataaataatattgaattattaaatcaattataacgaaattaatataaaaggaagggtagtaaaattaatcgattgcaaatgtcatcatttatatctattaagatagaaatgatattaaagaaaaaaaaaactatccataaattacactcgaatattttttgtttaaaaagaaaacaaattgcaattatttttacaataaaaattataaaaaggaacaaatgtattttatcaaaacatcatcaaaaaaggtattttatcaaaaagcttgagaaaatataaaacttaaatcatcttagtgtatagagagaaaataaaggttgaaacactagtggaagatctcgttcatacatatgagagatctatttaatgggagaatggtgttttattctcatcacatgtaaaattttgtttgatcaataacacaccgcaaatggatttctgtctggttcgtttacagaagtggtaacaaaatgagc

SEQ ID NO: 2054 - DNA, 1400 bp, Glycine max
  Soy_ogl_3190 Gm09:39278401..39279800 Cluster 8
ttttcaatgctttttttaaatatttattttttaaaataatcattctcaaacttgactactagaaatgttggctactagaaatgttttatttgaacccagtagtaagaatatctgcatatctctattttgaatttgacaattaaaaggaagaaattgctgcagatagtaaaatggtttcttttataattttttgaaatctgacattgctaagtatggatgctttctatgcaaaatgcaaaattattgattttggaccaagtgatagggacaatcacgccatcgatctaactgtctcataaacatttttttcttcctgaaaattatataaaagaaagaaaagaaaaatacccatacccataactttttcgtaacattacacatgagatcaatgtttgtggggttatgcgtgtggtacaaaaaaataattattgaagagttacgagtcctgggcatatcataactaacaattaaaacagataaataatataacagtaaaaaaaacattttgattaacaagtgtactaatacgagactagttttgttttactagtgatctagatattagtatgagtatgcatttgcattattttgaaaaaaacattttgttattcataatagtcctactcaatttgaatatgattgtttattttttattattatattattaatattgagtatatattgactttagtgatgaataatatttgttgttgtaaaacctgatttaacatctttaatgagatatttttatctcaattatgtttatctctctccaataaaaaaacatatataatcttactagaaaaaactctttaaacttatgaagaattcttctaaaaatataaggaaaagatatttggtatcaataatgtgttaaagaaaaaaatattaacgcatagtaatttactcttgattgtgtttttccttcaacaaaataaaccttttattaacagaattaaatatttgtaagaaacacctgaagacgatatttctcttgaaactaatacaaatgtcgacaagattttttatttttaaaatttatagtaatagaaactttcaatcctaattcaaacttgtagaatttaaatttatagtttcttgtataatttcttttgcatttaaagtaatgttcatcttttttcaccaatcactcatcaatatgcatttaacagctcccgcaactacatcactatttactagtatttttaacaaacaataaatgaaaacattaataacttttccacatctcaacagctattagagaacatttcaatttaaatgctaaaataatactcctagcaatgattttttttcttataaattttaatccctgttcagagaaaagaggcagtctctactcagtaattgcttatgatgtcttatattctactactaattat

SEQ ID NO: 2055 - DNA, 1267 bp, Glycine max
  Soy_ogl_5425 Gm16:36988934..36990200 Cluster 8
tttacaattaaaacctttttttttagttcattatagctttggggtgcaagatattccagtcattcagtttcccttctctttattaagcttttctgtgatattgtactttgacgaataagttggtaaatggtcaaatcaataaatcaatcacaaacatttctatgtcctttaatattaatttcaaaatttactgtgagtattaatacttctaaaaaaacgactcaaataatattctattattatttaatttcatttgataatttattctgatataccttttctatcccacaagtatcttcttttaaaattattttttttgaaatataattggatattatatataaatataactttgaacaaaaatttgaacataaaattatcatatcatgagaggctaatctcttatattaattttgttttttttaatatgttacagagtaatatcagttttatcaataattaatttgtgttgaaaaatatgattaattattttttagtaggaatttttcatttttattattttttttcatctacaaatctgaaatccaaaatttcattcaagaaaatggaatctaagtatcacttaaaggaataacttattgttataactatattactccaaatatgcattactattattaaaatcctacaagcggctctcatttattgataatttcggagtaagttacatagcaataaattatcgtcaatagtattattaaaattgttcaaccatcgccacctatcaattgaacagttttttaaaattttcatttattttattcaattactgaatttgttattcattctttactttttttttttcaaaacccgtgctttaaaactagtttcttttatttttggaaagatgaatattgaagaggaaggtgattttaacaaagaaggaataatatgagttaattttataagagggaaggattagtcaagttattaagcgcgtgttttttgtgtttattaaaaagaatcaatctacaaatgaagtatataagactttgatgcttacaaagaaaaagaagggtttgctttcaaatatagtaactcgtccgaataataaaagccacaaaaaattgtgagccacaaatgcactagggtttaggacaagttgtttgtttgttagttggagaaatagaaaatctcgatggcctatatgaaacgtaccattgataacacttccaagtcaataacaacacaagcacaaatctgaggcagatctgtcttatgtcctttcagagctggcccacggatt

SEQ ID NO: 2056 - DNA, 1200 bp, Glycine max
  Soy_ogl_2624 Gm08:11995201..11996400 Cluster 8
aattatcaatcagaattagaaaattagaaattgaattaggaagattaaggataaagtgtttttaataaaatattaaattaaaaactaaaataaaaagtataaaatttgttatgagatcttagtaatttaattgattggtgtaattatgtaattcccattatattttataattggacaatacataatatatagcagtgttgtgatttattttaaagttagatcaaagtaacggttcaatattttattcttttgttggggttgatattattttcgttttagctccttgcatcatattatatttctatcatcatattgaatcaacgaaaaggacattcattttatcctaattcaaaatttccttacagatataaaattcaaaataactaaatttagaagaaatgatttcgcattcactaaatgttagcctcctcacactcaagtagacttcttcttaaaaaacacatatgatgatcagggttaataataaagagcttaattttcctaaagcaaaaaaaaaatcatgtttataacaaaacatttcaattaatttttaatttttttaataattgaaaaacttatttaactgttccagaaataaattattttaatacacttcttcttaagcaacggttcaatattttattctatcttttgttggggttgatattattttcgttttagctccttgcatcatattatatttctatcatcatattgaatcaacgaaaaggacattcattttatcctaattcaaattttccttacagatataaaattcaaattaactaaatttagaagaaatgattccacattcactaaatgttagcctcctcacactcaagtagacttcttcttaagaaacacatatgatgattagggttaacaataaagagcttaattttcctaaagaaaaaaaattatgtttataacaaaacatttcaattaattttaattttttttaataattaaaaaaattatttaactgttccagaaataaattattttaatagatttttagtagctagcttttagcaaaaatcacttataatttaattagttttttaactttcacctttcaactagctttatagttttcagtatttcttgctttcatctagtttttttagttagttttgcctaatatagtttaaaataatttacttatactatttttatttatcaaaaattaaaaatagacaa

SEQ ID NO: 2057 - DNA, 1100 bp, Glycine max
  Soy_ogl_6445 Gm19:39089401..39090500 Cluster 8
ctgtcccaaatcagcaacgtggaaaacataaatctttattcactatatcgatcaagattaactttatcttttattttcttgtcagatctataggtatgtcttcccttagagtttatcttattcggatttcaaccatttagcttgtgatgaaattaatttttttagtaattctttttttcatatatagaactcaaagctaagacattttttactaaaaaaataaattggatacatactacctaaatcaatcgcttttattcataaattcttttattataagttaactaaatataatccaataaggtattatagatttgcttaattatatgagaatttcataattgcatgtactttgtcctcactatgttatactacaaataacttttttgtgaaaacagcaaacctttgctaaaagtattgttggattaaaattttgacttcaaaaacattaattgaagtgattttttcaacaacaaaaagggacttgttattattaatagacatttaacttttttgtttcaaatgtaataaattatgttaattatttatttgttatattgcaattttgctttatcgaataaataggaaataaatagatagaaaataaaagatggatgaaaaagtatttaaaccaaaatccataataaaagcacgttttattttttacattctcaattttctcaccaggatagtatatacagagaaacaaattttgtctaagttttttactaatagtataaaagttcttttacgattatccaatcacaaattgacatataagataagtatagtaaattttactataattactttaaaattataaatgtaaataaatatggatgaccataatttaattcaaataaatagatcagtttcattttcttttattcgacctaacatgatttggttgtctttgagttcttaagttttaaacttgacaaaaccaactcaatttgaaaatactctttgattgtaaattgtcatttatttccttcctagaaaaactcaatttgtagttacaatgaataccttacaagatatttagcacaacttattccattatcttttgaaatggggtaatgaagaagcacttggtgatc

SEQ ID NO: 2058 - DNA, 1100 bp, Glycine max
  Soy_ogl_6524 Gm19:42961001..42962100 Cluster 8
gtccccggccacgactttccacaatgaaacattatacatatatccctatctatataagtacacacatcttgttgcggttccacaaaatttgtggcttagcgttgtaacaattggagaaagtgaatatgtttccattttttcagtatcaccatttgacatgggaatggtacaagaatactcactcttggggtatcaatatattgttgctgatcatcaagtttcatgagagctgataaatatgtttatcaaatatatatagggataaataatttttttaataatcatgatcaattatattctagttaatactgagaaaaaagattgtggaggctccataacattttatcacaaataaatatttattttaaaatattttcatatcattagtttcttcgagctcccgagtgtcgtttttttttttaaagttgtatatatgattattgactcattgaggttagttaggggccggtaacaaataattataggaaattaaattgtttcaactaaggttaacaacaaaaaaaactgacacacacacaataggtatttttttaaatttctttatgtaagatttttttaaagtatgtataaagtacatttcaatgaaatagtaatgctttttttttaaggcctgcaatagtatcatgttttttctataaaagaattgcataatatgtgttttgataatattgaattaatcattcccatattaacgaatatttttccaactaaatcacatatatatgattgaaaaacacgtggatctcacattagagggttaaaaacaggttaaaatgcatacaagtaagaggattacaagtataaaatatttccaaaaaaaatgtaattcccatattaacgaatatttcaataaaaatcaccttgtatgtaaatcaccttatatatctcaaaaaaaaaaaattcactcaagtgcattaattaacacatacgcttcccgtcttcttcactggtcactattaagcaaggcccacagacaaattctggtgtatatataaaaaaaaaaaatgggagccaggtaaaaaaagagtaaataattagcatggacctgaaacttttaaaatttgtgcctttaaaagtca

SEQ ID NO: 2059 - DNA, 1000 bp, Glycine max
  Soy_ogl_3523 Gm10:43756801..43757800 Cluster 8
ttcttaattttaatgatgagaatatcgctggcatggcaatcatttcgctccaaatccaatgattaaacagtgttaatcaaacgccttgtcccaaacccagcctcttctccttccacataatgggttgtcatttctcatttctcaaactctaatcaactcttttactatcttttttcttttcgcaaaactagaatctatttttgaaaaaaaaaaaaaagggggtactctgctaataacagaaagaaaaacagttggctaaagggggaaagatcgagaaggaaaagtttctttagatacaaaaggtaggtagaactcaattattcttcttataatatgagaatcaattaactgagtttatgggaattaagaaaatagttcaattagtttagtaattctaattttttttataaatttatataattatttctttaaaacttatatttgaaattattaagattattgtctgactgtgtcgcctgattaattaatatgtgaagaaataatagtgattataaaacttattttattaatttgtagatagttatttctcaatctaaccagagaaaaaattatcttactaatttacaatacttattttttttactgaaagaaaagtgctaacattctaacacactcgttaatttacaacacattctaaaatgcacactcttttttcttaaaaataaatattggaaactagaaaaacaaaaaaaaattgttacataaaaattcaaatttataaaatttgtgattactaataaaaaaaatatgtttgaaagtatattaatgtttctcctgactaaaaaaattataaaataactaaaagtatttaatataaacacagtttaaaataatttttttaagaaaataaacaaaagtttgttcccataataaaacatttttatcgatctttttattgaattaaagttatatattaatattatattaattttttgtatcaaattttgttgctagactatataaagttgggcaggttgaa

SEQ ID NO: 2060 - DNA, 1200 bp, Glycine max
  Soy_ogl_6887 Gm20:40381001..40382200 Cluster 8
tatttttttcttgcatgttatttccacgagcttctttttttgatgaatttatttccacgagctaatgctcaaaggttcttcccagaaaattgagtgtctgtgcccccacacctcaaatgaccctaccttttacactccattatttaataagccactagggtcttaggcgtaagtcattttcaatgcattgccacataggccagtagttaagcgtggtggttgctaaagaatattaatgtctcttgtgtggtagcatgtgtaactgtaggcatattacgtggtaaataggcatcctatgtgttaggtatttttttcaaggtaattcagctagatggcattatctaataagagtaatgactttagatataatactataagcagctagtactagtagaagtttgaacgaataatgctatggagaacattagagtttaagtggatttagtgtggctccacttctatcatgcgtatgcaaataaaaaaaatagttcaaataaaatataatactaataaaatacatattattaaagtaatttgtactttggttaattttaagcattttttatggataaattatatatagatttaattgcatattttattacccaacttttattatttcataaattttatcatctaaatttttaatttttcacattttatcatatgagttattaaaaaaactttgaaaataaaatacgtgaaatgatgataattgaatgataaattatacaattaaatcttaggttgtatagcgagtataatatcatttattttgtatgaatcaaaatatttttcggttgaaagccaataactaatctcatgagatactcaaattgatttaagggattaacttctcttaatagatatttttcaatacacatgaattagagatcaaactcataattacatgcttaagggataaatttatgtatcatccatattacatgagattgatgcatgcgagtataatttcattgtcacatgcatttattgatttcgagaaaagtgaataatagaatggaagggagcttttttttaaaacaataaaaatatcttgattagtttagaaatttagaggggggagaggaaaaaatgggggaactaaaatctttttacttccatttttgttttccgttcaatattgaagagttagagaaggagaaaagtaatttataatttttggagtgtatatcaata

SEQ ID NO: 2061 - DNA, 1223 bp, Glycine max
  Soy_ogl_3906 Gm11:35553278..35554500 Cluster 8
taatttattaacaattttgataaacctcgattgtgatttatttaaaaccattaacaataactgtaagaaaattaaacaaaaagaatctaaaggttgaataactctaaaagtgaagaaagacgtacaagaaaaaaaaaagtaacaaaaataacttgtaattcgaatgaattaattcagaaaacgtaaaaattcaagaatgtattccagagtaattttattagaaatcattagatagctattattatatcaatatagaccgtcagaacatttataataggttgttgttaaaataagttgtttattttaatttttttgccttacaaattgtacataaatttaaatatgttataaaaaatttgttttaatattaagattattaaagtaaatatttaaattaattctgtatgtccttgcaatacttaaaaaacatattatttataatataatgttgttaaacaacagttatttatatatgtaacaatatttatacaagtaacttctattatctgttttaatgaaaaaaatgttaaataacattatttaaaacaactatataagatgaatggtttgtttctgaatcctggctattcatcacaaaagaaattaattgtagtactagatcctaacatttaggttgtaagactttttttcttaaattataagtctaggataattaatgacagaattgaagactttgagcgttgactatgtcggcaattcctctagtgtgactagtttttgtgatgatcgaaagctaaaggtccacttcccatgccgcaacacaaacacaaacaggataaggcatttgcatttacgggtttcttgtggggctgtcgagcttcatttgtacaatgtctactacaccaacaccaaaatgcgtgtccataacaccagaaaaacaaaaatatatataaaaaccttaggctctctgccaaaacaacgccagaaactttgaatgctctgcattaaagaaactaaaacgcaatgtttgtcacttttttttttagtggggtacaagctttcagtattatcatgcgtagtggtttaaccaaactagaggattttcctcaattgtattgtttggtttggtctttatcccattgttgttttggtggtgggtgggggctcttaatttgtaactgtaagttagggatcaatgtctgtaattttttttttcagcgaaatttccatatttatgaatttattaaaggattaattaatta

SEQ ID NO: 2062 - DNA, 1700 bp, Glycine max
  Soy_ogl_6236 Gm18:58062001..58063700 Cluster 8
tcaaagcttgttgttctgtggtcaccttgtttccttcacaaacatatatatcttgcggattaaggaaagaaaagaaaagaaaactagaggagcataagcagaacaagtactgcttctctaaattgtaataatatcaagcatactgtaacttttaaatcaaagaaaaatttgttctaattaattctccaaaataagaataatatataggttgaattttgaagagctaaaattttatataaaccttaaaaatccagtcctcattatacaaatcatttgctttaatattattgttattaaaggataaagttacaaaatcttactctcaaaaaatctaatttccttgaatgatcacactttatacaaggatcacaacctataatcttattttctattaccttttcacactggaatatttagtttcttttgtttatttagtcttaataattggttgtacaatagtgtcaaagatttttcgttttcggttttaaaatgaaccaaaaattgagtggagtggattctaatatgatatgtttcatcatttgtaggtagaaaacctacaacttcaattttttttttctgagaagcaattgacaactttaatgatctgattgaacgggatccttctttctctacttgtatgaatgttgattgaagtgcccctagttaataactttcatattttgctgaccaaaccttaagcatgaaattccttttatagatagcctcccagcttacctttccatgataaaaaaaaaataggtaaaaataaataaattagttaagacattaatgaatggtcatgcaacctttatacgattccctcttcctgtaatatcttttctagttgcattaaaaattgtaaccctaactcaagaactaggttaaaatattagttacaacctttttaagggtgttactaataagtatacttataacatcggttaataaactaagaaaaaatatttattatataaattatgagagaatatgaaaaagattatggctaacgtaattttttatctcccaataaaaatattgttatttgaagcttcttcaccaatatctttcggatacctagcatttgtcctcttttagttagcagcactggcggcctctaatttgttttttctttctattttgaccttcgaacaactgaacgaaaggaacataaatatagtattaccgtgaacatatatacacaagcaaattaaaaggaaataatagatttaacccaagggcatattacccaaattaagcgtaaaaacctccctctgtaagatgaaggactacgccactctggcgtgtcacctttcaaacgacaaacaatttggtgattttaattaattacctgactaagataagagatatatgttataagtataaagaggacccatttcaacgtacgtccgataagcccatcacacgttggttcatggtactgtctataactaccgcgcgattggattttcttagcatacgtgtttagttttgcgtccaagaaaccaggacgtgagtaattaacgtgcaatttagaaactatatgtagaagcttttttgtgttagtgtgagaatacgtgattttggaagaagcctcaggattcaatgcacgaaatgatcgtttgataaaatgtttcagttgagatacatattttgatatttctttaaatatgcattaagtttcttttcgggcaaagtttgat

SEQ ID NO: 2063 - DNA, 1000 bp, Glycine max
  Soy_ogl_468 Gm02:10055301..10056300 Cluster 8
ggcgtaaagattattttgtaagttgtggtgataagattcctctattttttattgcttgttacggttttcttttgtatttaggttaaactcatcaaatttagatagggccttgttgatttgggcccagattgttatgggcaaatattgtgtcactttgtgctgcattagtttcttcttctttctatatacatataataataaaatgaataaaaatcagtttgaaatcatttagttgacttttatggaattaagtaattagtattgggtttaatttctatttgcctctaattttgttttgggctaactttatctttgagaaagtgaaaaataattttaaaaaagactaaaattaataacctctttatttttatttattttatttttagttttgttactgagtatttactaacctgctttctagtcactgcattgcctaatcattgttttgtattatttaaaggcttaaaatatatattgatactggaaaaaaatcattttggtgttacttcttaaaaaatttcattttaacccctataaaatttaatatttgttggttttaatccatgttgctaattaaaaattttaaatgatgatataatcatgacattcgctgcctagtaactttcgcatgtagttttttttttatagtaaattgcatttctaaatccctcctcaattattttgatgttatcaattattttgaatatgtaaaaatttaaaaatataatttacttaaaaaaattatatataactgttttgtcagacttctttttttagatgattcaatttttcaaggaacaaaattatatttaagacttatttaaattctgaagactaaaagatcattttgtttcaataaaaagagactaatttagctataacaactcgttaatcttacactttattttagaatacttgaaccgataattttaaaattctctttttattagctgctaaaaggtaagtccttggaaaacaattcattttaataaaaaattaa

SEQ ID NO: 2064 - DNA, 1421 bp, Glycine max
  Soy_ogl_706 Gm02:47079601..47081021 Cluster 8
attgcatactctttccttcaaggaactcgattatagagagaaatatcttctttataacaatcgcaaataaatgtgtatgcttctcacaaattaacaaaacttcattcctgaaaagatgtcctcaaagctatatgtaacttattactacaaatttgtgtataaatccaattaattattgccagatgttttctaatcaaatgggaagtctaagtgtctaaggacactcaattttttttttctcttaaatcatgctatgtagtatataatcttatgtctaacttagtgtgcgtaaaatagaactgcctgtaaaagttaattactttttcatccaaacgtgttaattttggatcaagcatgggcacaaaaacttagggtgaagactaaagaaatgcctttgtttgtaaaggaggacgaagcgatccgtgacttctttcgatcactttaagtttaaatagataatttctgttattatttaatatattttagattttagatttgaagtggaagagcggaaaaatataagtagatggtagacatatataaccaagtattcctaccctaaacaacagaaggtacctcggccgagtatatctcagcttcgattaggaaggacctttagtattatcctaatctaatcatcttatgttaatatgttattatcagataatatcaaattataattttctttaatcaaaacccagtgacaaatccataaattttatgttattgggacaatattcatatacataaatttgttgtggacaatactcattataaatttgtttgtttgcattatatttcaaactatagaaataatttataattatattaaaaatttgtggagacaattacctccaatgtgcaacaaacagatctgtccctgtcaaaatataaggtctataaatcctatgattcataaatatttgtatatataaaaaaatagattctcagtgcatgaatgttaggttcattttaattatcatacagagtatactcctaattttagtgtcggagtgttcttgccgagtaaattacaaaaattggagtaggagaaacaaaacaggaattgacaaagaggtactaagcagggctactaaagaaaaaaaattgcttcaatacaccttggtcctgaacaagtacaatatgtttcgtacattaaaatttataaaaatacttgtttaaatgttattccagcaaacccttatattttggaagacagagaattttaattagagaaccaagcaagcacgtttcgcccataaaccgaaaaaacagtgtggagcaaaaacataaacatgacctattattccagacaccattattctagtggattcagataacaccaaacatcaattatacttcccaaaatcatgataatatcataaaataataacagtaattaattattattttagttttca

SEQ ID NO: 2065 - DNA, 1400 bp, Glycine max
  Soy_ogl_1249 Gm04:6149301..6150700 Cluster 8
acaccaataaaaaaaacttgacatcacactttaattcaaatctttcaaatttaaaggtctttttttacttatatcaccatcaattttttcacttctactttaagtaacactttacctcacactactccaacaaacatcaccttataaataatcacggggcacatcaatgatcttaatagatcattttctttcccattcattcttaaacttgagctcgagatgtcggaacccaattttcttccctaacactgtcaccataagggaaccttaatttccacggcttgcaccattccttgaactcctcatccgtaatgggaacgtccttgaaacgctccttatcctcctttgatataagaggaggaggcagttctttgtccgggctcccgtcaaatgcagaaaaaggaatagcagactccagcaatttagtccagtatgacttgtttgtaacatcggcttctacttcattatccacttccatacccaactcattttcctcaacatcactttttcttttaacctttctattagatcgtaatagaagatcatcttcctccttggaagaaaccctagcagagctttcaatctcttccattttcctgtcgttcctaaagtttccttcggaacagtagaccactgagagcaccaattaatgaattaaaaactcaaagcatttaatgttactgatatattttcggtgtaatttttaataaaaaaatatttatcaaatttttaaacaaattccttgcctggcaagatcattttaaagtatggtagtaaacgctaacaatgcctaaagagaacttggcaagaaaataaacgcaaaaaaatattaaaaaataaaatatttgttgaattgagaacataaaaacgttggaaagggatacatatatattaaaaataactagctagattttctagaaaatattaattatcaataaaattagttaatatttgctccaaagttaaaaaaatatttcatgcatagattttgttcaatatatacacaagtataatttcttatgtaaagttctgactataaaaaagctatcaacaaaaagtcccttttaattagataataatcattttctaaatttactagtctatcttcattcagatggtataattaaatagaggaaaaataaatatatttatcgatgtattttattcggttgttttattctagataaaaaaaatataattatatactcttactcatagtatattcttgataagatttatactttaatactaatagtctatctttaatcatacgacataattcaatagacgtaaaaaaatatattaattgatatttttttggggattgtcttatttatttatttcttattatcttgttttattttaatgatttggttaaattaatatataggtgcctatag

SEQ ID NO: 2066 - DNA, 1200 bp, Glycine max
  Soy_ogl_4206 Gm13:22518101..22519300 Cluster 8
atcataagaaagataaataaaataaaaacataaaaacaaagatatatgaatagttattagcatgtctcaaaattaaatttatctattcttttatgtagtataagtttatctcataatcaaatattaattataaataacatttaatttttcaaatcaagttataaccaaataaatacaaaagaaagataataaagtcatttggtcacaaatataaatatttatgacctttaaaataactataatacattataaaaggaaaagatatttataaaagaagaaataacatcaatattttgtttaaagaaagggaaaaaatgtaattagttggatgatgaagcctataaaagaaaaatagcatattttgaaatcattatgttgtgttcttggagtcacactataatctcatgatggaacatatcttacacttcatcttttttttttgcaccatttcactcttcacattaacactattcaccccaaccaatcttaatagagtaaaatgattgagttgcgtgactcattcacattgcatgttatgtattgcatatacatcttatttttcattcatttgcatttcttactgtgttgcaatttgtattttaaaattttcctttcaaattattattgtcctagcataagattttttttcaaaaaaacatgtattcattttgatcatactcttttcaagttgtcttttgcatgaattattttttaccaacaaattattttataataaatgttatgaattaaaaagataaatacactctttcttataagtatgggagaagaataccaacacacattaattaaagtaaataagtaaaagagagagataacaagttttaataattttaaggataattagaaaaaaaatacaaattactaacaaacttaatactactaactaaattaatcaatttacttaaagagtataaattattttaaaaagtcttatatttcagcataagggtaatatttttttaaaaaaaaaggaataaatgacatgcacaccttttttacttgcgtttaactcatcaaacaatgtaatatatgttaaaaaaattaaaattattccttacaaaaataaattacccaatttaagtataggagtataattatcttattttacaaagatgaaaccaaacttgtaacttatttacttttgattggaaactcactagaaaaaaggaatcacatttg

SEQ ID NO: 2067 - DNA, 1100 bp, Glycine max
  Soy_ogl_6651 Gm20:194901..196000 Cluster 8
aattaactttctcaccaaaactatcttaagtagaatttgtgctaattaaacatgaaaatataaccaaagattaatttgtgcgcaaggcagtgattcaaaattaaaaaaaatgtaacaccaaacatttaaaaaaaatgtttattttgaagtcataagaacaccaggcatctctttaattagtttggttatactcgacaagttattacaaataatttttagtttctttttattacctgaataagtttatttaacagttcaataaacaagttttctttttaaataacttctagtttaatattttttttgttacctacagttcaatactcttattttccttggttaggcaaatgaacgtcatctacatggattcatgcatatctaggtccagcagggagacatatgataaaacttttctaattaaattgtgtgaaaaaaacaacgtgtgtgttacactaattatgcatcattagttatatgctaagataaaaaatttttctttcatagatcaagaatcttttgtaactaaaatatgttccaagattactggcacatcccaacattttttttacaaaagttagtattaatgttttgtataaattcaaataattgtctttaaaaaaattcaaaaaatttaataagcaataattattttttaagaaaatatttaatgtagcattaacattaattagacaacgcagagaaaaaaattaattagactgatgataacgtgttgttcaaaactagcttactgtattatcaactttaggttctattagccatcgtgtatatttttttttcccgatgcttagaatatttttttttttataaatgatttgcaatatggttgagtttatattaccctgaacttattataagttttttccccttcattttctggttataatgagttcaaagagccattttaactgcgcaaactaggttctatcagaatgttatgttctgtgcgttcactgattttaaattaattattgtcctttttaattcagccagaattaaaaaagattgtccttcctagaaaggattgttatcaatataaatttaacatgtttcttaaaagacgtgatgatagaatatgctag

SEQ ID NO: 2068 - DNA, 1000 bp, Glycine max
  Soy_ogl_4273 Gm13:26129401..26130400 Cluster 8
cattataaaaatcaataaagtatgatgaattgtttattaatagtgtaaaatattacataaactattttctcaaaataaagttatccatttcttgtagttaaagttactcacatccgattcaaagttacattcccgcttaagttattgctcaagtgatgacagtatcttactttttttctttgacaaattattaaatgatgatattttctgcgcaacaaaaaggaaaaggagtatattggattgaaattttaaaagatttttttttcacaagaaaaactcttatggattacgaatgtagcagaagaagaaaaaaaatgttcactaggggataaattttttgttctcgagaatcataggttgaaatatttagtttgcaactttggtatcaatttttaaaaaataacattcttagataagaatatttttcaaaaatactttttaatcagtttcacataaaaaatttctcacgagaaaaatgagaaccttatttttgcaagtattttttcttgtaccataataacaatataaacttattctttataaaattattgaatgtgataaaaaaaatgtataactatttgattaataggaaatttattttaaacttttaatagtctatcaagcatattttatttattcttaaaaaatataattcttaaaattcataatatgcagaaatcatgattcccaaacattaaaaaaaaaacttatttcctatgcaacgtttccttaagattttgtgattactaattttaattattaaggcaatctcttcactcataaaaataaagttagctacataatttgattcagacaaataatcacaataattagagtatcaaagaagtacttctatcataaaatgaatgtggttatctacgtgtgattgttgggagttgggacgtctcatcctcgaaataataagaataataatatacaatacaaatagcgctcatttatatttttacgcaacaaactttttatttttcaatatcataaa

SEQ ID NO: 2069 - DNA, 1100 bp, Glycine max
  Soy_ogl_615 Gm02:42836201..42837300 Cluster 8
caataaaaagatcttacaatttttttcaataaatttcttaatcacatcttattattaaagaaattaatataacaccaaaatatccccttcaacctcgtaaagaacaagcaacacaaaaatacacctacaacaaaactttaaccacactcaagtaaacaaaaaacaaaatggtaaactaccttaatatcaataattaattttcataaacaattgcaacatactcgttttctctcttcaaattcgcactctgtgttatcaaaattgattggcaaaatctaaaatactaacttatatataggtattgatattggtggtatactaaaattgttacctaattaatatgattctcaagtctcaacccataagaatccatattcacatccacttttcatgagaatcactcaatataaaattaatataagtatgaacattttacttttctatgaataaaaaatacttaggattattttttgattatcttaaagcaaatgtggaaatatacattcctatttccacattctgagaaatcctaaaagattatgtgaaacaatcgtctcttattaattgtattctaaaaatatattaaatttgaataaattatgttgataatagtagccaacaatcattgaagaataattaatttactttcaaacagttttttattttactgaatttactttcaaatagttgaaaaataaaagaataaaaatatttgttgtgagaaaggctataactccgaaagcaaaatgtggtaaattagaagtccaacttaatctaatatgctttcttaaaaatcatattgcaagaccaatattttcctcttattcattctatatcaaagatcaaccatgatttaaattttagaccacttaattagagataaaaaccgacaatttactttattaatacttctatggactacaattcaataattaattgtgtgcaataagtatgccttttgtctttctaacattctccttatataaaattcctcctcgagcagcgccacatgacaatgctacatgcactccttcatttaggttcctttaatcccattttaagatgtattcatgagcaagtgtgtgctgtgaacctacgcg

SEQ ID NO: 2070 - DNA, 1081 bp, Glycine max
  Soy_ogl_4111 Gm12:36112620..36113700 Cluster 8
ataatgtaccaaatatgattatttgtgattgaataatagtataaaattgtttttttctctattatggattgttaattagtataattgttgattttttttaaaattttatttttaataagtatccatgaatatccattaatattcacaggtgtctacttaacaatacttgcgtgcatatgaggcagacatgagacaattttttagtcaatagaacaagtaatgaaggcatattatttgggcttgctttgtctctctaatatccttaggtgagtcaggtggaatataagaaaactgacaaagtttatttcctttataaaattataagaaaagagtaaagaaaaatagatatttgaatagaaaattaaaaaaagagaataactagcagttaaaacaataaccaagacaaataaataattaaaaatcaattatgagaaaactctaactcaatgtataaatcttagtttcacttcttaagattgcaatttttctgacaaattgattctagttgttaacaagttctaataatcaatcctttcttacttttttaataaccaagaggactttgttgattaatttcccaataatagacaaccctaaacaagctgctaggatttaacttacaatgcatcaaagggatccaattcaaaccaacaaacgcacaaggatggtcattcatttagactagattatatttctaaacaacaatgcaagtgtaattttaccactaactatatttgtgcactctacaacaagatgtagttatatttgacttattatttcctttctttttttgatttcagttaactttcatcttttttaaggattaatttcccccctttcacataaaaaattaataaaccaaacaacagtaatagaactgagaagataaaactatacaaattaataaagaaatgttatcaatagtgtttgttttttacttccaattttttagtataaagttgataaaagttgttgtctccttgtttgatgtttaggagacatacctattttaatttgtagtcagttgcattaaacaaaaataagaaacagtagatatagttagagttgcattctctaaaca

SEQ ID NO: 2071 - DNA, 1735 bp, Glycine max
  Soy_ogl_1016 Gm03:412001..41507735 Cluster 9
cacgaaaaaaggttaattaagctcaactatgtcgacctttcttttttagacaacataaatttttttctggtagaaatctgaagtattttcataattttttattcttagtgttagttaattttcgattcaagatttaattatatttttaaaatatttaattatatattctataagaatcaaacttaatttttttttcataaattcattgtaaagtgtgttgtcagaactatatcaatatctatggtctctttgttattaataaaagttgaaggttaaaaaattgatggggtgtgcgcttgtggttagtgaaacacagctgcaatgagttattttgtggtgagtccacgtgtagaaacttccatctcaagctgaaaaaagacacaagaaattgttgatttttttgggtcgaaattatccctcttattttattcctgcgtctctcacggtttttaaaaaagcacgaccgattatattgttgtatgagtttttgtttttttttttttttcatttttagttggaagggctttttatttttacaaagatagttgattgtgttgttagcataattgattacatgtttaattaaaaaaaaaactttcttttttgtcttgactcttgagacactggaaatgaatttttttttgcctaaaatggaaaatcagttaattattaaaaaaatcttatttaattactataatttaaatattttatatgttttttatctcaatcaatcatatttacttgttactctctttaagactagttcatttgaagagaaagaagattaaaaaaaaatataaaatttatacctttatactatattttaatttaaaactttctactcagttgattttatttccattctattgaacggatgctaaattcttcttcattccttcattaaatataggtttaaacatgattatgtgataagaaaaatagaagtagaatggtacaaaaagataatgtctgagccaatgacaaggctaagatgacaactggacctggattgattgactttgtaatgattgaatcatgcattctagtcttcgaggtgatcgtctctctgccggtgtcagagagggccgaaatttatcacaattttatttattttcttcttagcatatttacaattatggaaaattcttagaactttcatagtttcatgacaatttgttactgtagcttaaattaaatatacgatagtggacccaaaaaaataaagagtacgtacggggctacgggcaacaggtgagatatgagatagtatatagtttgttcacgcgtaagaggaaaccgttgcatgtgcgattcaatggaaagtcattctcaattatacattatatgcgattcaatggtcactctcaatattctaccatctttttcggccctatttatcacgcacaaatattaatttttactacatattttacaaaatctattgctatatatgaatgggacttacgcataatttaaatttctattaatataatgatatatatatatatataatataaaaagattatgtgtaaaaaaaacatttatcaggccgcggtatctcaactaagggctcactgaaaacaatattataatttaaaatttataactaaaatgtatttaaaaataccaatttgggtacattgttggtgttctgagtatattatgttgctcacttactctagatcgcattatagtagtatatcacttgagctaacaccatattttattttcttac

SEQ ID NO: 2072 - DNA, 1800 bp, Glycine max
  Soy_ogl_5564 Gm17:7355001..7356800 Cluster 9
aaaccaaaagatccactatcttattttttttaattattttattttagagatattgtagcaattttaagatttaataacaaagaaaaaagtaatgtgtctctactctccttatctatcacccattgtcctactaaaaaattcatggcttcctccaattttattttattgttattttctctcaaacactgatattgagttcccactaactacaatatatataatgacggagagattaggacttagccaggagatcacgaattactccgccaaaagaaataactgagttgcgactagactgacccaattacagttgagatttaaaataaattttaagattttttattttaagtaaaaaaatttatatgtcaaaccattatatatatatatatgtgtgtgtgtgtgagattttttctttaagaattaataacattttttttattaataattaaaaaagttaatctttagttattttacttatgagttgatccagattgtgactaatgactaacataagttgatttgtgcgataatgagaatatcactaaaatcgccacctatgtataattctaaaaaaaactttaaaataagaatgcaccatttcttcatttttttttgtccatctcagcctataccgttacttgaatacatgttctcgtaaatagaaaaagagttaacagattgaaaaatatgaatgctgggaaagaagattgagaactggtagagggagcgagggggaatggggaagagagaataatcggaaaaggttttatttttcaaaattaaattactataatattaaaataaaaaaattattgatatttttcttaaatttttactgtaaattactaacatatttcatttaaaaaaagtgattgtattagctatcctcaaagcattctttggatttgtctgccaagcactgtctaaaacattttaacaaatgatacttcaatatttatttaagaaaaatggtaaaaattttaaacaattattaaaaaattattgaatactatcaattttaagataatataattaaatttgaatgaataattatcttactttctcttaaaaaaagattatctgaataatataattgacgtagatagtcatggttgttgctgagggtgaaagcaagggacagagaggtcgtaggagtttggtcggtgtccacctgccagatatttatttggataaaaacaaacataaattctctctctctctctctcaaattctcaatgttgaagccttcaaggcagtgtattgcgtatccttcgggtttgggttactatctttttgttggtaaactagtacgtgaactcgtataattccacgcgtcgtatcgctaattacatttatttatactaaaatgattgttaaatgtaattacgtttatttatttggtttgagtaacaatattttatcttataaaaaatacttatgattcatactaacaaaaggaaaacaattacgtccataactagttaaatgcttccaaaattgtttataattgttttaagattgcctacgtgccttaattttatgaagggtcaatgtggcccatgatgaaatcgggcatgtaccaattcaaacgtgaattgatgtttcctattcaaatttaaaatcattccaaattaaatcattctaaattttggatttactttcaaacttgtttagggttaattatgtaattttctacaagaagacaagttaaatgttgtttaaaacataactaagaaatcaattccagttggaatacatttttttagggatccagtaggaatatataagctcataaagaga

SEQ ID NO: 2073 - DNA, 1800 bp, Glycine max
  Soy_ogl_5561 Gm17:7323401..7325200 Cluster 9
gtaccttacattgcgacttttttttacacacgtagctttcgtcaaaactcaataatgcgtttgagaacaagattccaaaccgaaaatacgactaggacatcgataaaacttgaatccaacatgaccaagttcatggatcgatcataatcacatagtaggtgatctgagaaacatggacatctaaaaacggcacgaggtcaactactcttttttttctagtcaagtcaaagtatccgtttttagattttttttccttcgtagatgcattaatgttgtatttggttgaaataatgaattttgtaaattactaaaatatttaaactcacttgaaagaatccaaattcaaataaaagagaaataatttgaaaaaaaaataaagatatttgttttggtacacaaatgaagatataagttttgttatttggtttaagaaaaatataatagaaataatactttttgagttgaagaaaattgatttttcgtctaaaaatttgattttttttgtctaaaactcaaattaaaaatgtttttagtttaaaaaattgaatttttgagaaaaattaatgaattttactgtaaccaatttttttttataactttattctcttgagaatcacacaaaccaaatacacccaccacatttaatttctgtctaacttacaaatacagcctaaattatttcaagttttcaacatcattgaatatttgaatggctttattttggtgtgaagtaagaagtcacgtggctttttacatgtacgaagcttccgcgtaactcaaccacacagcgtgctgttgcctatggtagcattgtctgttcacagttcaatggtcagtcataaaggacaaattacgaatggatcggacagataatgtattttgatttttttagttttgaagactgacagatagatacttagaatttcagtttatattactaattaaactgagtttttttttatattaaattcattcacgtgtactcgataatgaaatactagtaataattttatatcagttgaaagaatgaaatttgtaaaatactaaaatatgcaaactttaacttttgagatgatgtctctatttttttttatttttgtaaaatacctgtgcttaatatgcttaaaagccatccatattataaattggaaaacttactctacttttacagttttaaccttttttgctgcaattttcacctatttttgaatttgaagaattttttttatctcttcctgcaattttcaacctattttttttcctaattggtttagctttttatttcagttcaatggatgtgttagttcttactagtagtactcttccttcatcacttgggccgagtaggggtttgactggatccgtcacagttcctcctacactttcataggctgttatatatatattctgcacctctaagttgcttctagtacccattttctggtttccggaattatcaatccataatgtaaaattacagattttgtcttccaaaatgattaatccaaaaagataaaaaaaaacattccagaaatggtacagaaaataacttagagacacataaagaaacactcactttcattacactatcatttttaatgaactatgcatggaataaagtggattataactttttttagaggaaagtggatcataactaaaatcctaattaagaagtttctctctggaggatataaaggttgatctagtggcgaaaaaataagagaagagaaaaaaaagctgacatgctcaattctcttactaataaaaattaacaattaacatttgtccaaaaaaaaa

SEQ ID NO: 2074 - DNA, 1683 bp, Glycine max
  Soy_ogl_438 Gm02:7432226..7433908 Cluster 9
aaacctttttcgatgaagataaggatcacagtgttttgcttcggtgtgatggcgatgcaccacagatcatgccctcatcatcaaccgaaactccctggccgtcggattacagataaatcacaatactgttataagattatcaatcatttcgaattcagtctcagaagaaaaaaatatgtttgaaaggaaaaaattgaactaaacctgatgaatcagatattctgatcaaaattattatcaaaaagtaggtgaaaattttgtatcaatatcatgttaaaaagagttaacatgtttatttttcaaattttgtaattttagttgctttattttttattaagacatttcatcttttatttttaaaaaatttatcatttaatttttttcattttttaattgagatatttttttccattttaaaaaaaaataatttatctctttagtcaattttaaacttactaacggtttatttttaattcttttttttactaaattaaacttattaacaattaaataatttttttaaaaaaatattagattaatatttaaaattgattacaagaactgaaattattgatttttaaagagtgagagataaaatatcttaattaaaaaataaagagttaaaattataaactttttaaaaataaaagattaaatatctcaattaaaaaataaaaaactaaaagcatatatttaagaaaatagagagacagaaattgcattttagcaacaaaaaaaaaattcattataattttggtcctgtgaaatcaatctttacaatcttaatttaaaacagtacaaattcttttagcagtaaaacacctttaaaatttgatgttttagtttagaaatttctaaaaatcaaaaccagtttttgttttcgttttgagttttaaatttcaatttaatttttatttttaaatttaaaaagtttattatagactaaagatggtaaaatgaatcaatcattttattttatatcatgttcatggtaatgataataatagtgaaaaaatggtggtaataatggtggactggaggtgaagataatagtgtgtttttaaaaattaaatgtaaatgtattttattctaaaaattatatttaaaacccccaaaataaaatactcacaaccacccttatacacgtatcataatcgattttgatttcgggcagctgtgaagagttcaagctacccacaattttattttccctcctccaaaattatgagattttctttattttttatcatattttttttaagattaacttcgaattttccaaattaatgggcttgtttttttaaggaaaaaaaatggctaataggtttttttaaaataatgctacggtcgggctagggccaccattgccctaaacaattctcagctttttagtcaacctgcttggacacaaagatcgagttaagttaagcaagatcaccaaaattgacaactctattaattgggcttagaatatgaagctagtttggactagaaattttgtttgaagaaaaatagagtaaaataatttaattaaaatgtacttatagttttacaaaatataatagagagattttacattgaaaatttattaattatacagttaaataaatattttaattaaaatttagtcatacatatagtattagatatattatttaaagttaatttagtcattctttcata

SEQ ID NO: 2075 - DNA, 1413 bp, Glycine max
  Soy_ogl_3783 Gm11:7069488..7070900 Cluster 9
aataatatttttttatgattcaaaatatgatttttttattgtttaaagtattatttaaaatacttttaaaaacaaaaagtaaaataaatatattttataaagataaaaaaatactagattataaaaaaatgtatttaaaccaatttattattgtcattgacctaaaaatatataatcacttcttttatcaggcgttattgcgttaatgaatcactttaaccattaacttcacgaccgcccaatcgcaggattcgcttttcacgttcgtcctccttccaagtttcatttgctttgaactcgtgacgacgtcgtttggagcgtctgcttaaagctactcgttctgttgttctcttggtacctttagttctaattgaaggtgtaatgttaagttattgattttgccccttggtctattttaattcattcagtgggtaaaccctaaaaaaggtaatttctataattttaaaaaataaattcttttttttttcattttctattcaactaaatagaaagaaaaaaacatcattatctatattttttattttctagtttgttatttcttatttaaagaaaccattgaaatgtcattttcttggtaaaaatatttgaaaatgattgaacaatttcttgggggttttaattggggtgccaatctgaatttcccccattagtgcaactcaaaggcacgcacgccatgaaaagtttctcccaacaccaccactagttccttaatgcttcagtgggcaccaccatgtacctgtataatcatgatacgactctaaataattttttatggaataggtcatattcgtgttttcttcttgagaaaaaaaaaacaattaggattacttgaatttagtatgtcattttgatccttggattttttttaatttattctcttaaatttttaattattacaattaattttcgccactttttattcacataaaaattttcattttctcttaattaagctattaaaatattatcgttaattaatttaagaagaaataatataataatttaaaaatagaatattatgattaaattcaacgaatttgtaagacatgggaacatggttttgaaaggaaaaaaatgattttttaagttttaaataaaacatgaatttttaattgataatttttttagcaaaatggcattaagtaaatttaactagtgtaagactgcatttttataaagttttcaattatatatgttgacattttgcgaaaataacagtgattgtcataaaattattattgtaaccagctagtatggatggtgtaataccccatatctatatataaaatagataataatatcttacactgcacatgcaaattaaagttgacgtactaatttagaataaattttactgatttttcaaataatacttttttgttattaattttt

SEQ ID NO: 2076 - DNA, 1668 bp, Glycine max
  Soy_ogl_3970 Gm12:1504633..12300 Cluster 9
ctactaatttgagtaattataagtcaagtaccgagtaataagtcgagtaccgtcccataaccaaaagattgatcaatatcccttaacattaacaacattccaatattgacatttaacacatggattggaagtccaatactgatcaggagtgtatataaagatcatatagcttatcaatatttcattcactgagcaaagactatcacaacttaaaagttttagcatcacaaagaatcaatgcaacaaataattattcaatttatcaacaatagctaggtatttatgtctatttgtcttgtatcttccattatcgtgcaagagactcaatttttctatgatgtaacacgattcatcttcaaccaaactttcaaatcgattgttaaattatcttctaatggtagcttaaatcgtggaactctgaaataaataaatatgttttttttgacaaggaaataaagatgttaggaagaaaattttgtgctcaataacaactttaaaaagcattatgcatatacattttcatccaccaaaagcaactcaacactatttgttactccctttgttcatttataacagtcgtttaagattctttcactccaaccaacaaagtcaattactattggctgccatttctttctctctcagtaagtaattataatttgttttcctattggttgccttttcattaatttctctctatccgttagtttaatttctctctgtctatgtaaccaacttttccttctaaatttagattcacagcatatattatcattaattcttttttgttggcaataaacaattattgggaaaacaagctagaaatgtgtacatacaccactacatatttgatcaataactaatttatttttcgttgaagtttacttttataaaaaaaatgtaaaataattaatcggaataagggcataattgacaacaaaaaactaatgttatcttgaactttgaaaatgaaagataaataagaataattttttattaaaaattcaactcttgaaaagtaacgaaggaaggataagaggattgttgaatttaggagctttccaaagtataataacacgatcatgtatcttctagtcaatctttccaggtgcaaactcataataataaatgtaattttcggagccattttgaatctgtacaaaaacaaatagtgcatgattattgactttaatttttatagaaaaatgtaataaatcaatatatataaatatatacacgtcacctttcatgaattaatgtaatttaaatataacaacataaattatagtaatgaacgacatacctctacactccagcagaaatgggtcacacttgaagaagataaaatcctgcaacaatttagttcaggatattcattttaaaaaatggactaaaaaattgcaagaaataagaattaaattaaaaatccaaaggtcactggatttgaaaacactgctgaaaagacttttaaatttagagcacaaaacgcatttaaaaacaagaaactgaagagggttttcataataatattatctttttttacagtatttttgtttcaaatttgaaagaacaaaaaatgtaactcttgaaaaaacaagaaaaggcagatgatagtaactgcatttgaaagcatgtaattggaaaagacaaaaaaggaagaagcaaaac

SEQ ID NO: 2077 - DNA, 1204 bp, Glycine max
  Soy_ogl_5505 Gm17:4384862..4386065 Cluster 9
tattcaaagtcaggatgaatttaagtctttcccattaaaaggtgtcttgattataagaagactgttaggaaatctaagttaacaacaaaaaataaaatactggcaacaaatatcacaagcaagtctctttctcattacgactatacaagtgttttttggaatttttgaatactatacaagcaagtcttgctatttatgtgttagcaaagagcaaaacaaagggaaaaaaagaggggaaatatcatatacgtgccagcaaaacttttggaatttttactcgtgtttgtcagtttgtattagatatattatatattataattagtttgtatacgatacatactttacatcatttaatttttaaaatgagacaaattgtataagtgttttttaacatccatattcaaacacaaataattaacttattgaattttatgtcttactaagatcttatatgtaatacagtacgtaagtgcttattgactaggatcttaactgacttgtttatccaaacgagcactgaataaaacaatttgatatatttaccaattaattacatacaactggatgaaagtctaaaaaaaatgaattattgaatactaaaatgaaaaggaacacctttaattacactgtaccttcttaacttaaccatgttacatttaaaactctccgattttatcattacgacaacttttcctcatatcatataattaccatcataagaatcaaaagaaatctttgttaataaagaaaatacacagcgtaatattatcacataaaataaaaaaataaaagaaatttatgtaaagtaaaaacaaaagacaagaatttgtggtataatattactaaatttgaatgtaatttattctaaaagtaaattcatttgaaaaagtttcaattcattatgactcccgttaatgggtagttttaatcgatcatccatccattctacgaatgaataaaaataattgaatctaattgagttcatattaaaatttgttcatttgtcttcgtatctaataaattgtggccacaacctcccttctccacggatggtggtgacatggtgtagatctttgaaaggagaatattaaaaataaagaaaattaagggaaatcaaaatttcaacagtctatttctcttttattgctttgaacttcttgacaatgaagcatgaaaaaaagaaaggtatgcgtgagtgttatac

SEQ ID NO: 2078 - DNA, 1517 bp, Glycine max
  Soy_ogl_427 Gm02:6910284..6911800 Cluster 9
ctgttatttaaaatcacttaactacttatttatttatacccaattttaaaagcgttaaagccgagagaattaattctaatctcattgcttcaccttaagttctcagtgatttgaggttgaagtctatgtagataaattatgactaactataattatttagttgtaaataaaatgaacaaataggacgacactaattccttattataaaaagaatatgatcatatttcaattttgaatatgtaagaacgtgattaccaatttgccattatggtggtggtgaaagagacacgtgtgaaattgttgacatacgaggagcagttcctgttggatgtcgttttcgggacagcaaaagcgcgacattcgttttatttagcgttgtgttttgcattatctcgtcttgtgtagtttgcattgtcggtggggatcgtgtttgaaacgcgttgtagtttcgtacttctcgcgtgccgcgccagtttctcgtacgtcatcaataaagcgcgcgaagatacggcgccaagttaaaattactgaacagcgctcaaattttttaactcccgggcttggtgccgcaagccgaattacaagccatgaaggtacagtgaattttctgttttctttttttaattttatcatatgtccttttattttgctataaaatttatcatttacttatgaattgggaaagagaagagaattatctgtaatgtgttaggctatatttaatttctttctcactttttaattttaaaaatgattttttaataatttcatgtatttaataaacattgcatctaaaatgtaatgattttttttttacttacaaaaaatattactttgcttgtttttattatttttttaaaaagtttctatataaagagtaaataaagaaataaataatgaggttaatggcaaaattgaaagtctgaaatactgtaattgaactaattaattattttatgtaaaaaaataattaattgttttggaagaatgccaaaagatgatatagaaaaaatgccaaaagattttccaaacaaaaaaggaccaaagcccaaaaagctattaaaactgaaaaaaaaattgtggctgctgggattcgagcccaggtcatcacggcctctttgttgtcggcttgttagcaaatgtgtttaatgacatttacaaactaacgaagcaatcttttttattaactgaaagggaggaaaaaaaaaaagattgccatttttcataaatccgcatgactgaaaacagaatatttcatacgataacaaaaaaaaaaagaacaaaattagtttgtgtgtatttttttatgaatgactttattataccaccctagaatcccctaggaagcaaatacaagctgaatcggcacaatgaaggacttttatttctctttttatgattagaactgttggataaggagtctcttgtaaatctttcttttgaacttggtttttgtatttgggccgggttaagattatccttatatccaggccttttttctaataaataaaacactt

SEQ ID NO: 2079 - DNA, 1069 bp, Glycine max
  Soy_ogl_6892 Gm20:40628701..40629769 Cluster 9
tgaccactgtggtctttccctctggaggagtctttatcattctcagcgccgtacacacgtgtcactttatcactgggcaatacagatagcttaatcctttttcaaaacgcgaaccccaaggcctaagggactgtgtgtccatactcccatatcgtacagtatgttgacacgtggtggacccacaaccacaacacgtgtttttttatttatatattctcttgcaactaaacacacgcatcacatagcttatggtccgaaacgacttggcggttccgccttttgaacgttggctgtggggcccactcatgcacgctgtaacggatactaggcattggttggactcatctcatatccatgtcatcaacatcatcttcgaaatttccagaatgctctttttttttttctttttctttttcatgataatgatgtattcttctagctgtaagctatgttttggtaacgtatacggacttagttagttaattattcattaattaattatagacaaaattagtatatgttattatgggacaaaagatttcggccccaacgttggatatagatacagccctaagaataggctcaactttttctttttttttttggtgtggaataggtttaacctgctcgactttatatggtctaacaacaaattttgatataaataattaatactgtataatactactatataactacaattcaataaaaatatcagtaaaaaatactttattatgggaacaaaaattgataatttttttataatatttctttttttaacggagacaatatttcttttaaacagtgtcttatagtaactattttttttattaaaatacttttaattatttgataattttttagttaagagaaacgtgagtatattttctaacacgttattttttattaataaaaatttattagaaattacatttttttataaattttactttttatttaatgagtcttttttctgtagtttttaatatgactatccgcaaattaataaaacacattgcataattgctattctttcttctcatattaattaattaggtgacacagtcag

SEQ ID NO: 2080 - DNA, 1097 bp, Glycine max
  Soy_ogl_2680 Gm08:14324304..14325400 Cluster 9
gtaaatatatttttcctctttttactgttcagatacccagtagggtttaaaagcaaagctagctagaccagtctatgtccgaccatttatgacccttgtctagatttgattcagtccactttttacgattgacgatacacgacacgagtctcgcattgcagtactgtgtgtgtggataatgttcaaccaaaagacgtttcagattttttggagtaataattttcataacattgaataaaaaaagagaagagagaaaaatattaaataaaataaacgacgtgacagagaattaaaataattgtgaaaaactgttataaaaaagttatatggaaaattaatactgttcgatttattttttcatcgttatatatcataaagcaaatatgattgattattttggattaagcactttggtgtgtgtgcgtgtacgaaaaattaataatattctattttttcatcgttatatatcataaagaaaataggattgattattttggattaagcacttttgtgtcggggcatgaatacatatataattagttttttctttctttcttaaaccataattttatgtagaaaaagtgacaataaaaaaaaatttgaaggtatgaaaaaggaaaaacacttgtaagaagtaagaaccctatcaacaaaaagaaagaagaaagaaagaagtaatagcaacaaaagttacttctattcctctaaggttgtgagttggaatcttactattaatatgattaaaattttattagtgagcgatttgtaacttgtaaagtttgaagtatcttagtgaggcctttgtatcaaattcatacaaactttttaataaaaaaaataaatagagtaagaagagaagaaaatataggtgatgttttaggttatttgaattataaaagaaaaaaaaagttaagtttatcttcacgtacttggttaaataaaacacttgaattaaaaatataatcgttttaaataatatttaaatataataaaatgatattaaatgaaataaggtaaatgcgtgattgtatatttgttttctacacgctcaactaatttttttaagagatatgtatacagtttttttgtcttctcat

SEQ ID NO: 2081 - DNA, 1100 bp, Glycine max
  Soy_ogl_3195 Gm09:39572601..39573700 Cluster 9
aaatttttctagtaaacgtctgatgggaccaaaggccactttgagagtccccattcctatatcattatctgattttttaattgaattatacatggacacatgactcatttttactcttatcaatataagcacttaaaaaatacttattctctcggacccaataccttaattttgggttcttagttggctctcaccattaatatttctattttcttaacaaaaaatgaacatggacccaccattttcaaattgagaaccggtgctaatttgagaaactccaaagaaaaccaatacggatggcttaatcccttatactactttggaataatacatttctcctcaaataccgtgcacaaattggcgatgcagatggtcttatatataaccaaagcaaattgagtttgacagaagaaattaatttccaatataatttttactcttatacccatgaatattggttgtttggtaaagagaaaaagtgagagaatattgattgtttagtaagatggaagtatgatgatatatttttaaaaaaaaagtggaccataggaaaaaaaattcacagaaagaggtaatgatatataaacggtttgaaaatgtacaacataattgatttttatgttgcaaagcataacaaataaattatttatgttgaaaaacataataaattatattacaatatagttaattatattttttttctctttacttctcatcttttatttcttctttatttctcttaaaaaataaagttaattttcactcttttttttctcacctaccttttctttcttcttcttcgtctatttctgttctttccatcgaacatagtcacacacctttaagttaaggacaaccttaagtctaattcatacatactaatctaagtattgaattagtctaagtcacaagatgtgtattaaccgaaatcaataccaaaaacataagttttaatatatgttagttgactttaaaaaaagtttatgaataaacattagacttgatcgaatggcatgtgctttctatattttttcttatcagtaaatattaatttattaattttattaaaaatatcagtaaaaaaaattaattatgacctc

SEQ ID NO: 2082 - DNA, 1100 bp, Glycine max
  Soy_ogl_3709 Gm11:3843201..3844300 Cluster 9
tacaaaagtgacagagtcgaataataaagccctacataattctttctatgcttctagatcgagagaaatacagagccctgtttgcataagtgtaaagaagagacaagtgcttaaaggaaaagaggtaagaggtgacgctgtctgaggcaaagcaaaagaacacacagaggtggataaaagttccagtaaagcacaataatgcacgtggtccatttttgtctttgtacaaagcctgagctggaatttaatgaatctaatcatctcgctttagcccaacccagtttaaatctctattattcaagccctgcctgagctttctgggctcctatttactccaccctgctgccgctaaaaaagaaattcaccaccattatacatagaaaacaatgttgttgtagttaagtaaacaaaacaaatcactgagtggtttattgttttctttatgaatagggttatatctttaatttttattaagatattttttttatttaaccttttttatataagttttacgctaacatcaatatgttatattaaaattaatgtttgaatttagatgattaaatgatggaataatcaaaattatttattttttaaaatagagatactaaatgtcttgatttagaaataagagaatcaaaattatgataaaattaaaatttagcctaaattttaaccattaataagaaatttaagagagtgaattttgtttaatccattatttattatctgtgtacacatatttaatatattgttagttttctaattaattaatagcttcttctttttgctttatattctaaagtgaaatgtttactttttttttttgtgtttgtatatgatagccatgacgtttgaatgtataaaatctcaagtaaactactcaaatcctacctctagattgactctagtttttttttttttcaggggaagattgactctagttagttagtgaaaaagttatttcagaaaactcaaatgatcactattatatatttttcatatttaacttcttaattaatgtcctaaatgtatttattataagtagcttcttgctaataaataaaaattaaactcttttacataactattagcttcaa

SEQ ID NO: 2083 - DNA, 1100 bp, Glycine max
  Soy_ogl_5323 Gm16:5547801..5548900 Cluster 9
ataaatgtggtggagtttttaccaacacgtacggtgtcttctttggtggtatcatgtgtgtattttcaagaaaataaatgataatgctaccttttaagaagaaaaaaaagttgaacctcctgggtcatctacagccagcatatacccggacgcatggttaattatctcataagtaattaatattaatagtaaatgaatatgacatacgtagtgaagccaataataggctcctagctaaatagtaagcaatatttcaatgcttcatcctatatcaataataataacaagtacaaccatgaaaccctttttttggggtggggggagtggaacgtgaaatatggaccatataggagttttaaaaaccacgagcatgaactcagtccatgaaagctttgtaccttcttgagacaatcaatgcatgaaataacaatgcttttataaaaaaatcaaaatacaaaggaaattttgaagatatggttctcttttctgtcaatatttgttcgtggacaagaacccaaaagattttttttttaaaaaagattcaatcatttttgtatgagagaaaataaattatacattaatattataaaataattttatatcattatttaactataagtcatataaataataataatttgtgattgaatgataatataaaattagtttactttttgtttcttttttcttattacttttattttctttgtttactaataatatttatcacaaactaatgctttttaagtcgaaaagatcagtaaagtagatataacttatcgcaacaaaatttgttcacatatatgactatattatattatatatttatattgaacctagttgcatctcaaaagaagaaaataaaagaaccagtcagcgtacttaaagaatatccagctagattttttttaaaaaaataaacatatacaatgactttcggtttgatgctaattggcttaaatttcttaaagatgaagtatgtattcattattattgctaatttcagctcaccacttttacttttacccgaatttcttcccttttagtccacttatattttgtgtcgaattgaataagcaatattctagctccaaatgggc

SEQ ID NO: 2084 - DNA, 1168 bp, Glycine max
  Soy_ogl_6806 Gm20:37262933..37264100 Cluster 9
ggaaaaaatatataaaatatgctataactgtttttatttttcaatgattagtgttacttattaaaagttcagctcaaatatataataaattattatatgataatttatctatgtgtcgaaataaaacacgctctcttaaaagttactcattctcttagtttaatttttcttgaaaaagtaaaatgagtcgttttttttttctcttttctcagtattaaattcaataattacaggtgtttaaaaaaaagaattcgtaaagataagcacagatgtttctaattttaaaatattttacgtacccaaaaacttcaacaaaaattattttaatattttctcaaaattctagaaatagtaaaataattaatgctcggggtttgggctggcttttcgagaccatgaaggtaacaacatccttgcctcggctacctcttggacaccacagctgctgttatttacagatgttactttcgagatagatggtaaatgaattcagtaataatgtataaatattttgttattttaaattttaaatattttattaacgtttttactttttatatcgtattataaattttattatatttttttatttttctctctaaatataaaataacataataggtgttggtgtaacatttttcaaaaaatttatgatgtgtggaaagctgttgatagagagatgctcgttcttacctgcatggtgtgattgaagactgcaggaaggatactcgcaaccaagttcttattatgaagcttgtgttcactaagtgtgtgggaaatatgctagctgattctttggcaaaacttgtcttttattatcataataggtgttggatagaggatttgcctgtacatagtacaaggactagcttttttgcattctgatgtacatgtctgattttcttcttgaacaaaatattctcactttccactctaaaaaaaaaagaaaaagaaatagtactagcatctaaaaaatacttcatcttacctttctgatgaaactaagaaaataatcctagtaaaacaattaatgagatggaatatcctagtaaaacaattaatgagatggagtacgtgtccacgtgggtgtttatcaggagaggtcatgattgactgatcacggtagtcttccttcattatttttaataaaaaagctggctacctttat

SEQ ID NO: 2085 - DNA, 1300 bp, Glycine max
  Soy_ogl_913 Gm03:36731701..36733000 Cluster 9
attaactatagagtaacttaggatcatttgtttaaatttaatgatcatgcctaaaggagagaagtacttacaagaaatagataattgagtcttcaaatgcattaactagagttttattctagccatatacatagggaaagatttcactttgatgaaatcaatgactcaaatatgaattaatctttcactttcacttaagagattttttttcggagacttaagagatgttcttaatatatactaccacaaaaaggtggcacttcttttctttttcttccctaaataaacaccaagtaattggaaaaataaatctacacaattaactacgtgatagtattatattagtggtaattattttaaaattcatctaatgaccagttagaaagaaaaaaactatagaaattaagtttaaaaatgaatgaaaactaattttaattcaacattttatttcccaataacttccgtccataagccactactatttactattctcttgctttaggcaaacatggatattctttctgttattatagttaggcataattaggccaaattatttcttaagctgtaatttttttttgttttggtcttttaacttttttttaaattttgtttttctatcttttatttagtttcaactttatctaatttataaattatgacaatttttgtttgtaagaaatatcaatcgtgacagttttttttaccaccataattaataaattagactaatttagaaccactaaaaagacaaataacaaaaaaaaaaaaattaaaccactaggtcggtccaaatgtagagtttgggataatatgcatgacatcataagttcatacttcaataggaatatgataaagcataaataaaggaacaaactaaaaatagaagataatagagtatcaaacaagataattatacctattaactacaagaatcttagtgtcctaattttttatagaaaattttcctcttattacaagctcaaaagttttttttatccttcgccgacatgttattactaaacaacgaaatttgtttttaggtggctttgttggacacctaccattctaaatacatgtgaagaaagctggacttgggtttagaactttgtcttccttttatatttgctgggactgcattctagatcatttggaaaacctataaccactgttggaaggcgaggatgtatgcagatttacaagatgaacccgatcacaagccaaagtcagttcattcaaattcatttcaggggatgatcttcctctgcaagagcctcatgtaatgttgtaccgtttgtac

SEQ ID NO: 2086 - DNA, 1200 bp, Glycine max
  Soy_ogl_993 Gm03:39943101..39944300 Cluster 9
aattgacgagcaatgctcccccaacaaatagaaaaccccagcagagaggaattcataacgggagcagaacgagcatgatcacaacaagcctccctagattatatacttattggagtctcttaatttgtctagtttttcattaatttccatcaatttacatctgaactcaatcctgcagcttcctgtaactgaataacctcggaattaaatgaacttttttcgctccattagaatatgaattactcctaccaacatcgtgggcttgatttatatttatataaatataaataaatgatttttttttttcgttcggagtatctaattttgatgcgacgtcacacctaccaactttatgggcctgattttgcagtgattttcacctctcaattattgttgaatttctgcaagattttgagttactgaactaaacctaatatttattcggtctagattttagtatattatattttttttctaccaacatgctttcgaagtcaaagtactagtgtactactgaagctgaggatttgagacggactctccttaatttgtttcttcttctattatacgtaagaaccaatcaatatatcgataggaaaaaaaagaaggtattacagtaaaggaagtagagatctgaatatgacacgagggatggggagggggaatgctaatttgatgcagtcatactgcacaacagcaaaaggcctcctaaacatttaaaatatttcaattttaatagtacgtaacataatataattccttgttaaaactcatgatataatgggtttgactgttttgagtctccaattaaaactggttaagttgcagtaatgtaattaaaattagaaattgtaaggatataataagttttttttattttttattaacaaatattaattgttaatttttattaataagaaaattggatcatttttcttctcccttcatcttatttaactctttaagataatatcatttcatttgtcactattaaacttttttatttgatatttattatttagatcaaaagttgttattatttaacaaatttttatactcattttacatataaattaaaattcaactaaaaatacttaaattttcagtttatcccgtacatcgtacaagttaaaatctgtaccaaaacttgcaaacagtgtaacacaatggatgtttcatttctttcttattttttagatt

SEQ ID NO: 2087 - DNA, 1809 bp, Glycine max
  Soy_ogl_6249 Gm18:58395367..58397175 Cluster 9
atagttataatttattatttaaaataaaatattacagtagtttctcaaatatttagaaatcttatagttttattttcttaataattttttaaaactaaatcaaacacaaatagccaagtgaagattttgtgaatcacgaaaactatttcaaaaaataagaatagctattcaagaatagcttttcagattgactgtatactttcaaaatagttattccagacgagtgttgggtggtggtttggtgcatcgatctatgacgacgtgttggtgcgtcaatggtgcggtgagtagtggcggtgcaatgtcaggattgtagtgagtgcagtgttgtttgattgcacacaatagttttttttgtagatatgtgctttggtgagggtttgcagaattgcaggtgtggaggatatggtttgttgcgcgagttgattttggtgcttttgtcgtggtcgtcgaagttatggttgtggctgaagaagtaacaagatgaaatggagagaagggtaagttgggggtttcaaaatttaggaggcgaaggaagcaaaaacaaggtgcatgaagtaataacccacgttgagacccaataatttggcccattacacatcagtccagcatctagatagactccaatgtctcaccagaaaagctccaataaggactataaactatcaagaacaacatttacattcttggagctcccactttcttttgtttttttgttatatttctaatatatcgtttttctctttcacctttgcattcatttccttttcttttttggattttagagaaaataatttatataatccatttcggaaactagtttttactattatacaaaattattttaaaaaatattttttataatatgtgacgacataaatatatgaagaaaaaaaaaactagttttcataaagagtaattttgtaaaagaaaaatacaaaaaaaaaaaaagacaagaggcgccaggaacaaaagagattagtataaataacatcttctagcattttaaattttttgtaccataataacaacaaaaataaaaaaataacaacaacaaattaagttaaaatctgaagagataaaggacttgtaagcataactctaatccttatcacataccaccgtttgcctacaagtgaagttttaacgtggaatctaccattgatgtatatgatatgatagtcttgagttagccgtcaaagtcctttttggattataagttgacaactttgaattgtatcgactaaaatttgaacgagaacaaaagtctttcctcattttttaaggtcaaactaatcatgtggcaaaaaataaaacagtatttgggaacatattgtaatatacaaccataaaaaataatcaatataaaattgttggaaaaaataactagtgtgatatatacaaattaaaaaaaaaaatgtgttaggtttcttttaaaattatagttaacataaatggagcactagcaactcccactaacgattatgacactagctcatataaaaaataagtatttttattataaagttagacccatagtgatgtttactcatagtaacatttttgttgtgtagctgtataatatatacatctttatcatttcaaatagcaacatacatatattgcataattttttttttatgctgatactgtataattatgtgccgtacgtttaattacatgtttaatcgctttacaataactaatgtgttgttttagtcccctgatcatttttgaaaaatattctttgattcttttagttgttaattgttataattaagatttagcatcgtttttcttctacttatt

SEQ ID NO: 2088 - DNA, 1400 bp, Glycine max
  Soy_ogl_2870 Gm08:43363001..43364400 Cluster 9
tcaataaaggagttcaatccaacatgccccacaaatatccacagacaaggaaatactggattgtagttacaggtagggcaacaaatcagccaataatatctaaggatcatgcactgggaacatgactatttttgtacctatcaccaaggcctatgtaggcagtagcggagtttgaccataatttttgggaggccaaaatagtaaaaagtattcatatattaaaaaattaaaataacataattatataaaaaaaatgggtgaaaacataattctataactcaaaacaccaaataataaaaagtgatttaggaattataaggttgattgagtgataaaaaaaagaaaggagagaaaaaaattgtgaatttgatctcttctctaataattaacaacaattaacaagtaacatttatcgataaaaaaataaaaaagtgataaaaaatatcagcacatacatattaaactaattcaacagataaaagttattttaactaattgaaataagagacaatttaaaaaatgatataaaataaaaaaagatataaaataatgtgtaagaattaaaactttaaactttaatggtttagagtataatattagtttcaaataaagattaagaaaagtagaaaacgttgctagcaatggtggaaagaaaacaaccaccgaaaaaatggatattcacttgcctaagtgttgataatttggtgcttaagaatgaatgagccttaatgtaatgtaatgggaattgtaaaaaaaaaaattattagtattagctaattatataagatagctaattatataagatagccactgccactgattcaaaaacgtaagtattaaaaaaattatatttatagggttatttttttaatttctctcacattgatattattacttgttatatctaatttgatattaatttttttaattatatttaccgtgtttgaatttagcttttggaattagcaaactacaaagtgtgagtgagtattgaacttcgacttctacttccaagtgcaattgttatttttttttttttttgcattaattgactatttcatttatcttttataagatgctacctaaaaataatctgtctggaagtgaaaaaagaaaaaaaaaaaaaaacaagctgaatagttaataaaatcacaacaaggaattactgataaattcatttttaaaggggtaggttctcatgaaaatttaaatcaattaaataaaattctgcataatgaaaatcatgtagatgagaatgatgaaattaatgattcaagtgagcctaatgatgagtcaaataaatctaatattgaaaatcttggtaatattcatgaggccaggaataatcaattcctcctttagatgtttatgatcttagaaattgagataatcttgataac

SEQ ID NO: 2089 - DNA, 2200 bp, Glycine max
  Soy_ogl_1113 Gm03:46414801..46417000 Cluster 9
aagttatttttctggtcatcctctttatgcttatactagggaagaaaacaatttcagtgtctgaaatcagttattaatgtagttaagagtataaatgttcaaagaaatgtcatgaaaaaaagaaaaatataaatcaaaaagagactatcgctatcatatattacattataaatcatatattataatttataaattatagatatcatgtatgcctattaattttttttatcatcattaatatttctatattgtagttttttttccccttagatttaatagatatactgtcaaccttaacatatatcgtgcattgtgtgaattactacactagttagtaagttagtatataaggtatcgtataagtttttttttcttattttgtttgattaaattttcttttatttatcatactcaaaagggacaaagtgaaagttctcgacataagcctggatgatttaaaagttttttctacgtatgaaacacattagccattatataagaaatatacacaacttttaaattgacaacttgagataatttcatcttattttttaataaagtttaacatcacctatacttcttaaatctttcattaatagttatagaacaatataacaagaatataagacaatgaacaagaatctttcattaatagttatagaacaatataagactaccttgtattccattgcatatataatccttaaatctagtactttaaatacataaatttggtgtggtgcttttggtttaacttgttatgtaccttttaactagaccacaaattcattgtaacgaagagcaatattatttacactagctgacatcaatatatgtaaatacagtgagcaacattacttagtgggaaaccattacttattctaattccataatctcttacctaaaagaaattcgtaatcattggttgcttgttggaaaaaatctaaaaagggattgcaagattattatatctaaatcaacgaagaatatattcaaatttaatgaaaaaaatagtaagtagataaaaaaacatcataaaaggtaaaatattaccatattagctctataaagcgaagttagttaggtaatacgatagaaaataatgtgataacaattagcaatagagaaccaaccctaaagctttataagatatcttctaaaaaaattaccagtaaagaaaatgtgaatgtagataaactctgtgtcaattcccatagtaacagaagaaaaccactttaatttttagtgggatgccaaagttaaaaaaaaaataaaaattgtgactagtaagtttaatatttttcgccattctaaatgttaatcaattaacccatttaagagtccatacactgatacaagtcaaaaagtaattttgttatatactggttgatttggtaacacaatagatttaaaatagatcatatgataagaataaaaaacatttcaaataactgtaacaaaaaaaacatttcagataaaagatttccacatttaaaactgtacgtggatctattcaatacaactaaaataaaagtacaacttaaataaaaaataataccaaatcacatgatatttgtcaatttaaataaaagtactaacttcattgacatattgtattatactcaaataaaagtacaacttaaatcaaagtactaacttcatcgaataacatatatgtcaatttcttaaaccgtgaaaaccatcgacaaaagaattaggattcgattggacttcccttcataaatcgtgaaaaccatcaacaaaagaagtaggattcaatgacatattgtattatatagttagtattttttatatatatctttaaataaagaattaggattaaataaaaaaataaaagttagtccgtctatccccttttgtgaacttcccaaacaaatggatttgattggaaaagtatactagcagaacatttatatcctgcattctcattattgtatcgaacacttcttattacatctgaaaagttgattccagattacaaatttatattttaaagcagcttacagaaatgtaatgaaagttaaagaatgtaataatgagtgcagggtacaataccctagcagttactttttgggctccatcatccaacgttagcccacgattagtcaaatataaggaaatatgttgggcctgcaactgccccattgcctttgcttcttcaaagtgattttgggatgca

SEQ ID NO: 2090 - DNA, 1500 bp, Glycine max
  Soy_ogl_2484 Gm08:3228001..3229500 Cluster 9
ttactctaatatatggacgactaaattatattgatttagcaaaaatatatgttttctaagtctaggcccaaacagaatctcacacaggcccaaacaaagcagggccacccgacccgaccgaatgtgttctataaatatatgcatgttttaattgatgccacaaactaaatgttatgatttcaatttcgtaagttgtgtgtccgtgtacatgcaaatataggttgtgaataaaagaatcgcaggtttaaaatgaaaaagttaaaagtgttaattagagttggaatgtgaaaccaaaaagcttacaagttaagagcacgttccttgtattgtaattaatttaaattagtcttagcagttagctgtgatggaagaagatggaggagttcatcgccatgcatgcaaaatttttattttttaatcactcaaattctagctgataagttaaaaaaatatttttttattaggactaaaagaataggctcataatttaaggattaaaaacacaattaaatttattttaaattattttaatttttttcttaacaactttttatcctgaaagtataatacttaagttttccaaattaagaaaattttaaataaatttataaaattttcagttatttaatctaaattctgaaatttaatcatattgtcattttggttatcaaatatgttaacattattttttaagttatccatctttttaaattttgaaccaatgtgtttgacgaattgtactttcatggtcttatcggaaattttcgtagaactaacgtgacatcactatttgaaggactaaagttgtggtttattttatattttttatttaagtttttttaaagattataaacttgttttttagtttttatttgaaattgagtttttttaaacatcacatgtatacacgatcagaggtagtaatttactaatttcattctagaagaaaaagaaatgaaaagagtttatactcgaaggagcaggaggaggagagaataatttagggaaaataaaataaaaaagagaacggttgggatatataagtaaaataggagttattattttaaactaaaatatattttttatcttaaaaaatattgaaatattcaaaatttatcaatatatttgtttatctatttccgttgaaaagtgaaatgtgtcaaattttgactttccaatttaagtgtaggggttgaatttttcaacttttcatatcggttaaaagatcgatgtaagaatttctctcaaacaaatctcactttccgctcaataacatgaaaaaaaagggtcgttcattaataattgttgcatgatgcttgtgaatcttgtacttgttgaagctatacatggttcaacacttgatattggctaaagaatttgataaatccaaccgagattccaaagatgaacccatgctccaacttgggacatgttgatcctgatacaaaatattgatagtaggaactagtaacttttgaaatccaacaaattgctccaatg

SEQ ID NO: 2091 - DNA, 1800 bp, Glycine max
  Soy_ogl_2521 Gm08:5248401..5250200 Cluster 9
atttttcctctattattttaattatgcattagtttatttggtaacttaacaaataatatttaataaaaatactatgtgcatgacagtataataatagaatgttatgtcaatatgataatattaatgtcagaatgtcttagaatgacatgttaatatttctattaaatattatatgttaagtaaacagataaattaaaatgccacaactaaaataatggactcaaattcaaaaaaaaagaaaaaaaattgaaggatgacagcaaaggccttacttgggttagtgctaatgatgacagcagttccacccaaattgcagctatttggaacaaaattcttttgataatacttcaaaaaacttctatgaatttacactgaaatactaacctcatactccaaaaaactttcttttaagtgatcagcatcaacaaaagtgtctgtgaaatctactgtctccaatagatcaggcatattagtaataacaaataatgttcgaaagccacttgtaaaaaaaagaatttacactgaatcttagcctgtagtgttgcgccacattagcaggcaaatttacacagtgatcacctcacatcatggctgccttggaattttggtcatggtccccagctcttacttcttgtttgaggttattgcctcccatcttattcttatttataaaacgaaagtcttgttaacaactaccacattgattaaggtattaaaaaaaagaaattttttatatgtaaattattttttgaaagaattaatacgtaaatcataatacgagaaataaaaattttatatgaaatgtaattttgcatcttttaataaaaaaaattacttttaatttttaataatttaattagtgtcattaggacatttattaatatttttctataaagaataattaaagtgttaattttagttaacaatatgataaatttaaatttatttcaaatatacttacagaactaaataacttaagtatttttttagagaattttatatttaataacattctttgcaacttacgagatattctttcaactaataagtgcgctttatattgataacaatccaatgaatatatctactttaatgatccactgtacctcaaccaaacagtgaccaccttcaatcccaaatctgaagaataattaataataacaattaaaattataatcgttgaagttgtgaatttacacttacctcacacaggcatattagtcatgattatctgctattagaataaggaacctaacttgactaagcacttcaatggtaaaatagaatggaaaatgaaaagttgcaactgcaaggaagaatgcttaacagcttaagtatcaaaaattttttaaagaggttttgactaaggtataacgattggagatgcatcaccacttaagcaaagcaaatttaattaaaagcaacttctaatatattgttggatataaaaaagaaaagacttcacctttggatagtacatgagtacggttcgaggtaggttgtcccatccccatatgcagtaatcaatgaaagattttgacagtgtcatccaagccgaacctaacaagagaaaatttttagataatcattgatgataatattcacttttcataggcacacataacccaaacttcaagatattttcattctatgaactgtattatttactaattacaatttatttttaataaataaaaatcagttaagcgatcacaatccacattttgaaaacaagtgcatttatttccaaataagaagaccaattaaacacatctcgataacaaaagtcaagcagcacac

SEQ ID NO: 2092 - DNA, 1968 bp, Glycine max
  Soy_ogl_5449 Gm17:1663573..1665540 Cluster 9
tgcggcatacaacggggaggcgttgattgagaattgagattgcaagtgggtcaacgttttgttggaagaaaaagtagtttttaacttttttagtcatcacatgttaacgacaagccttgttggcttgatgaagccttgaaataaaatacttgtatactactctttcaaattaaactctacctcctttaaaaaaaaaaaaaaaaactctactctttttttgactgaaaattaaactctacctagaaagtagaaatacaacatacattgtatttgtttctcaagacattcattaattaaactaacgaaaaatactaaacctacgtcctattttagggtgaagtgagtaggaaaaaaataaacaaaagataaagaaaaaagtgataaataaattagggatgtaatgaaaaaagtgttaaaagattaactaaaataaaatagatgtatatatatttataataaaatgtttaattaatagaaacaatttgtatgtgctgtatttgttcttgtttgaaatacattcggacaacaaattttagttgttaatgcgaagtttctctttcaaatttaacactacttagaaatacaaccctcattgtatttgtttttcaagacgtacatatccatttgaaatagttgtttttcaacacacatatgttggtgcattcaattgtcagatttttagtttatagagacactacttagaaatacaaccctcattgtaatttattttttttatattaccattcacttacaaattgttatatataaaaaattatttacttttatattaactgctttaaaataaatatttgagataaattgtaattgatattggttaacattgtcaaattatttacactaatttttggttttatacaagttttcttttttggaagtaattatgttcaagacatcgcatgaaattaaacgtgggctcacttcacaacaaagattcaaacctttttagtagcggcatgaaaatttattttattttattcttacactaaacttataggataaatgattttcctgatatgattttttttcctggaaaaatatgataaaatggcataacatgtttgatgttacatatcgacataacttagtttaacgttaagatgctctcagttgatggaagagaaacaagttgggaccctaactataaagcaaagggatgatgagatgacagacatcattgacaattttgagttttcaaaaacatacttatgattatgcagcataattatcaatgtgcggttaatagaattgggtataaacgcttcttcttcgctgaaagctattgtttttggtgaggtgagggttaaggatgatctccatcaacttctatttaaaagtctgaattgtggtaggtaccctaatagtaagagggaccaataattcaacttccgccaacccatttggataaggaccctgtgatagtttccttgttctttttcactattacgaggacaaatataattttaaacaatattttttcaactatatatttttgctattacataaaatatcatcttaccttattattaaaaattgtgactaattatttaatgaaacttagataaattttagcgaataaaaaaaatataaaaatatattactaacattctttatcttgctccccataactttatacatcaactaaaaattattaagctactaaggccattgatttgacattttgattatatatacccgagtgatcaaacatttggagacagactctaatgctcggcgaagggaaagaatcaaccaaaaactaggttatataacaaatgtctgctgatttaagtataaggatttttatttttattttaacaaattaaaagtgttagtatgagttttgtaagggatcagtgaactaaaatttgaatatatgttgagacaaaagtttatatttagtatttaatcgtatctgagtgtcagacaatattgcatccaaagaaaaat

SEQ ID NO: 2093 - DNA, 1503 bp, Glycine max
  Soy_ogl_5919 Gm18:3155401..3156903 Cluster 9
atttattattttgctttcatcataaaaaatagttaattatttctcactctgaatttaattcaaacatatatgagtacgtgtttggattgaaattaaaatcatggcacagcataataatttaattaggtccaacctgtgtgtgatatatagatgataattgaaagtcgttgcgttagtgtatgtttttattttactgctagtgtatttttatttgtttacgattatctctagaaagtgaagcttttcattagattttttataaataaaaaaaacttggtattttcataatacttcttcaataattcataatctgatatatagtttattttagtttatcctgtacgcgtaattatattaaaacaatgaaaaataataatatgattgctcatttatctttccatatatttaaacaataagtgttgaataaaaacttatcttgatttggtgaactaagaaaataatattttattaatttaaaaaatattttaaagtttgttataacattaggacaattaccttagtaaaataaatatatatatagagagagagagataattgaaaaacccaaattattaggtaaagatatatagataatattttgacaattaaactcagagtaactcaatttagaatgatttttctcgatcaataaataccttttaaataactcagttttgccgatcgagctttaaagagatttatctaaccagatgcatgcagactcgtgactaaaaaaatagttgaaacttgaaaagggtggttgaataaactagaattgaatgagtgtagcctttgttgtagagttggtactgtgaaacatgaaaatcaccaatatcacattaagaatatgctaaaggtacggaaagccacacctaattggaggatggaagctgtgtatttttattggcacattactatgcacttttttccacatgccatgggagagagtgttcttagagtacaagttttgtgtggtatttattaaagcaagagcattacaatattaatggcatttatttatacgaaaaggaaaagcaaaaaagtttacaaaactcacggataagttccttccttgagcttcaagtgatttctccacaagattcatcttttttttatttatttattttccttttctttgggtcctaattagtctccctcgtgttacgtcttttaatacttttgagtgcaggagttgacggtgtattttagtttctccccttcagcaattcaattttatagcatgcatgaggaccacgtaagatttcaaatgtaattaactgaaaggcaaacaaaaaataatattactcgtaaggattaaggaagaagtgcttttataataagttatttaaaatacaacacgctgaatatactttaaagttttaattaatctattcgtacatgtgtaattcatggctgtcgtctcacacccaacccacttgggattgggtcggatcgattcgtcaagattattattaaaataataaaataaaaatagaaaaatta

SEQ ID NO: 2094 - DNA, 1577 bp, Glycine max
  Soy_ogl_5202 Gm16:444024..445600 Cluster 9
ttaggtttatctttcgttgcctgtgatgttgggtgcaagcagagtttgatcactcacggcttttacaactagagtacgtacaacactttatcactttgttatatttttgaagcataaaatttgaataaacttttaattagtctgtagttaatttttgggacaacttatgtttatatatataatcaagggcattgaaataatttaagttccatgtacatgctagcacaagtaccttcttatctattctcgtatgtccgttaataagtgtactaagaattcatagatcaaaatgttgacaaattccagaactcaagtcaccttttctcatattatcagagaagcgatacgcagatgcttttattagccttctctctcgttttagccagagtagttataactctgttagccttctctgtcatctaacttttattttcttagcttgtcagttagtttgttataaactaacttttgtatataatttattcatgattgaattgagtaatgagaaccattttttttgtctttattttttagcttctttttttttatgttttaaaatatgtttatatcagagttttacatagtattagaactcttaatatgtatttatgattgatttgagtaatcagaagtattcctttcgtctttttctttgagtttcttttttctttattttagaatataagcatgggttaattattagtagtgattgtcatatttttgaatttttgtttgatttttttatttgccaattttggcaaactcggctgatatttctttttatagaagtttctagtttggacggttagcccagactttcaccaaaaaaatcgatgtacatgatgtaataattctcatttcttttattataaacctagagatcgatgtatgagatagttagacttcacaagcactatgattaagaatttatctacatggtgtaaaagtatttcaagatttaacatactccctcctaactgttaatgatctaagaacttataatttgagagaagaaaatagagagatcgcgattagaaaaacaagttaacgtatagctgaaagggtttaacaaatacaatttccttttaaaaaagacaaatacaatttaaataaatccaaaaactaaaaatcattaataaaagcattaatggataataaaacctctaacacatgatagcataaatttaaaattaattaacaaaactaactaattaatgagatttaaacttttaaaatatctaacaaattaatactacaaattaattacatatacaggtattcagggattaacggacgaacacaaacagatatttgaacacatgaaacggataacagttaggcactatgggtggctgttgcagttcctattcatatttgatagcctagcatctttcaattctccatgttgcctcagatttaggatacaaagctcttttgtattcttatggggcatagatttgcctggtctctcaaattttgcaatgttattgtagagtttgatttgcaacattgttttacgattattcactttttcaacaagtacaacatttatagtatcttgccctcaccgttgcaaa

SEQ ID NO: 2095 - DNA, 1500 bp, Glycine max
  Soy_ogl_5913 Gm18:3022701..3024200 Cluster 9
gtttttactctaatatgaaagtcattgtgcttttaaatatacaaaatcatagatcagtcatatggaaggtgttcggaaggatttagcacttccaaatgtggtggacgattcaagcggcaaggatgactccagcaagcggcaatggcttcttgtgagcatcaagacatgctgacactctgatatataattaagttaatgagtataagacatgaaaagtgaagtttacatctataattgtgacatgaaatgtatgtatcatacaatcagtagatgaccctttgaaaattaagttatgagtgtaataggtgaataatgaggtttatatttatacttgtggaatgaaatatcttatacagtcgtagatgacggaaaaaatagttattattgtgaaccttgagtcatgtgataagctcaaaatggatccaaaatagaaatatattattatatatgaactcggattaagtgtaatctaaatgataatttttagacgaattttggaaaggtccaacaatataaatgttgacctcggtcaatatcaaaagcatgaaaactaacatgtattcatgtacaatgaaccttatcataatgaagactaaaattttctcattgttacaccaaaatattatatagggattgtttgagtaagttaatatagaaataattctaagaaaaaaaagtttgtgtataagttaaaattagttattcattaattaaccacaaatttaaaggataaggttatttatccaattatgtcagtggaaatcttaactagatttgaaacaataaaaaatgaaactccattttttctttcattgtgaaattattcaacgcaatttcagcattaaaatatttattttactaaaatctataaaaaaaaaaacctcaaatacatttatgcagaggaaaaatagttttaaaaaatacaaatcaaacaagcgctcaattcctcaaagcttggatctgtcactcatgataaaatctaaagaagtactcaatattatatacgatgagattttgactaactaataacggtgagatttaatattcttaatgaagaaaaaaaaactttgacacgaaattaaaagtaaaccttttattttcattgttctcccccattacccaaaacgaaattataaaaaaacgaaataacatttaaaaataagctagaaattaataaaataaaacttgtataaatataaatttattttaaatcaacttataaactatttaatataacttatcaaacacaccataggagtgacaaggacagatatgaatttatgttaattaaggattatatggacatctccaaatcctccatatgatttgcgagtacttttattatccgtctattgccttaattaaggaataccacgtcacgactcaccagcgtatacaccaaacgagacaggacaaaagtattcgacggtaataaatttgtcacgtgcaatatttttaaacttaacatgagcaagagataaatgggtttcttagaccaat

SEQ ID NO: 2096 - DNA, 1600 bp, Glycine max
  Soy_ogl_6999 Gm20:44920101..44921700 Cluster 9
tttttgttttcacagaaaaaaagtatcaatcttttttgtaattttttaatttagaatatattaactgaaaaaatgtatcaataagttattctataatgtatttaaaacgagatattagctttgcatatgtacggcacttttggatgtgcaaaaacataggaaagaaaggtgggaagaaaaaagtgagaaaaaaattaagttattctattaaaaaatttaaataattatttttacgtttatttaattggatagaaaggtgaaaagaaatatatttttattatgtataataacacatgtatatttaatgttttaagaaaaaaatattatataagataggcattttattaagagaaaaaaaaaggtaaattattacttcgccccctctcttataatgtaaagaaatgaacaaggttcgcatatttctttggagggcgcgtcaggaaagaaaaaaggagtgatgatgagctacgtacgatacaaagcagcagggcgttgaaaagacaggattggaatttatgcacacataaaatcaattgagaaaccctaaccacccatcatgtttcaggacctgggagcactacatttcctgtttttttttatttgactccattcgtaaccaacacattagtagtatacttttgtacttctgtttttttttttagagtaataataataataattaaatattcctcttaattgatattttctagtatttattctcttgttacatttgaatttggtatatccacgaaaaaaatatataactatatttggtgtactttattttattttggcacaactaggttttttatttattaggcgataaaaaaaggtttttttttatatatatatttattaccttcttgagactcatgtaatacaattatacagtatatacgattttaccaagtcctttgtttttcttatgatccattatgatatgattttgggaatcttaagaagtggaccctggcctctagttaaagggaaaggcaggccaaaagatactgtgggagtgggaaggtataggcaggttgttgttgttttgttgtaaaagaatcaatggcgtcccttttaacttaatttatttatttatgcgagccacgatacgatacaatacataatacatgacatagcttaggagtgtgtgcgtgggtataaggataagtcggagatcagtttgacctttgtaatgaggggcctgtttcaatgacagttcgaaatggactggacagcactcaaaataggccatgtgaacctttgggtcccaaccccttctcttcttttatcttcaggaatcatactacaatattactgtactccccatcttttacataaagaaaccaataagaggcaaataattcattctcaatagtaataaaaaaattgtttaattaattttaaatttattccaattttttttttatcaacaaagttagtttgttagtttttgtattcaacaaaaaaaaattattagtgagaggaattctcaaattcatgacctctttcatttatttttttaccactaaattaacattataattcctaattttattttaaaataatctataaaatctattcttggtgtttgatcatgcat

SEQ ID NO: 2097 - DNA, 1302 bp, Glycine max
  Soy_ogl_7000 Gm20:44923588..44924889 Cluster 9
ttaaaaaatttcattgaagatatatataaatacaaatatggaacacatagtgacaccttggtcccaaccatgatccaattaaaaaaatcagagatcgagtgggatattttccattaacaaatttggtgaatatccatgaattagcggtgatttcaaaataaggaggagcgcgtgatgcaaattgcaatagagggagggtagggtacaacgcaagagtgggaatctcttacacaagtccaacttcatcatcaaacattaataagtgagacctataaccctctgcacactgtgtcatgtttatcgtaagtaaagaggtacagttacatttatgaattagaattttttaatgagatgcaaaattgttgtcatttattttttaacaagtctatactattttttaattacgaatatttttcagaagaaaaaatcttattcaactaaaataaaattattatgaaaaataaaatttattgaaaataaaactttatatctaaaatttggaattgaaatcattttataagttagaataattttatattatttaagttacatgcttgataatatatgtgtattgtgtataactttaaataactaaaataaaaatgagataaaagaaaaaaattacttacggtcttaagatatagttttattaaagaaattttttttgacaaagattttttaatgattaattttaaaaagaataacctattaaaaaattagagtcgttcaattttatattttatatatcttattcttctcaacgttcatagactccaacacttcaacaagacgttaaagttccttccaccttttcaacatcattttattcaatcattcatagctttacttccttcatataacggttcctaatagcgacaaacatgttcggaattaaagatggagtgttgctcaaacggagggctgatttcagaaacactgacgaaatttctaacatggtaaattgaagataagttgttactcaacactgttttaaaaaaattatcaatcagttttttctttgaaatactagtaatttttcaattatatcttccatgttttactgttatatctaacttcatataagaataatgtgttaataaaacagtttacttaaatatagttatatcttttaaaaaactattgatatttagtaattttttaaatatctatacaaaaaataaacgaatgatattttttttaaaaaaataagtattgttttaaataatgaaagaaaataaacgagaaagagtattattttttcattcagtcgatacaattaaattgaagaaaaaaattcccagc

SEQ ID NO: 2098 - DNA, 1339 bp, Glycine max
  Soy_ogl_3491 Gm10:40933962..40935300 Cluster 9
aaacttagggatttagattttgtttaccaacaaaatctaacattggtagatatataacgttaaatctgttaaacatattacatgtttaattgagttctttttttcactaaaaatatatattcaaaaaatatttaaaatatcaaataacaagtactaatttcttaagatattaatctattgaaggaactcatcttttttaatagatgttttatttttctttcatacgcatgaatcttaaatcaaatcctaaccagatacttaagttaaggaacaattgttaatcaagtcgcaccatgttataatttctcatatttttttaaatcattaagaaattacagaaacaagcaagaaagctaaagcctcatggaagaaatcccgagagagactttctcatattatttattatcattgaacttattctcaattattaaatttccaaaaccaatatataattatcgctgctaacttttcagaaataaaaacaataatacttaagtatagcataaataaataattataaattataatatatcatgtaacaataaaaccacagatgacatttgatccaaaatagctttaatgttagaaaaaaaatatttttcgaaacaatttatctattctaatttaaacacacttaaatgattacagagttaaccacaatgtagatattatacaattgaaaaatgaaaattgaggatataactcatggaaaagttcgctgttttcatatgctttagccagcgtcatttttattttttatttcctaaactgctccactttgatataatttatgaatgtataacagcctctcctctttcatactttctgtcccccgctcccctacaaaccacacagaaaaaaaatgatacgtgggattttactattattaatttttggtgcgtattaaatatctaaaatttaagatatttatgttttatatgtatacacttgaattttaaaagaaccaaaatgtgggaattttatatttttaacatttttaaaaataattaataatactttgtttgatatattaaagaatttgtaagatatgagtgcaatattaatgcattaatataaaagaataagagataataagatatgtgtctgttacctgaacgctgcctttgttttccgttgatgcaaattatattttgcacgaattcttaatacatttgcatgaaagcccaaaagtttttttttttggctttctgcatttagaaaaatataaaacaaacggagtttttgatattcagttattcttgtgtgtagataccgctgtaaggaaaactgaaaatgctttctataataattttgtaatcggcaatggtttgattatagt

SEQ ID NO: 2099 - DNA, 1707 bp, Glycine max
  Soy_ogl_2556 Gm08:8143801..8145507 Cluster 9
ggactagtaaaaattgaactaaaaataaatcgaacaaactttcgttctgcttctttttccttcgagattgaaattattattttcagttttaactttaaaatgatttgttttttaaaaaaaaaagttaagactagctcgatggtatttcagagtacacgcctgtgctaaagcaagatgacaatgtatgaatcaaaaggggacacggttcataacataccgcataataaattttattatagcttctcctaaaatttaatggaagtgtcgccgataggaccatacaagattaaattcagtgcaagataaaaaaaaaattgcctttttaaattcttagtcttaactgaactttagttctcatattttgttttaagtgcgattgtgatcactcgaattttaattttttataataatttttttcaatttcttgtttaaattaagtttgtcgtcctaaaattttatctattaatttatcaaaatgtaatggaggtgttatatgttattgatttgtataattttcaaagaaaaaaatataaaaaatacttaaacacactcacacacacacattgtatatattatttcgagaccaaaaaagtattttatgcagaggaataaagagaaacccaccatgaagaggtaataatccttgagatgatctctcatgcccaagtgtgtgttcaactaaatgttaagaaaatttattactgtcactttagtgcatgttaggtttattggtgaaccataaagacccgtgtcaaatcagaagctattgagagcggtttctatgttatttactcgataaatttttggttttacatgtgttattaacatgtgtacaaacacacttaattttgtaaaattattgattgattccaggtaaaaaaaaattattataattatctattattcctaaatgtttaatttcttaattataatttcttatttatttcagtactcgttagtttttctcgttatagacggtgatttaggttttctcattaacgtaattataggatcaattatggatttttttttacctgtgtatttcctgtctacaaatgcatgaatagacatatgaatattacagtggttttaattgtttattccattcgtaatggtatataaattcaccaccaatatgagtctgatgagcatcttattatatgttgagtgtaaggagtatctctaatccaagcaacctagtaaattttagtaatctttgcatatactggtaattctatgatttgtctctctcacttatcataatccaaaatctcatcatattacccttgttgatggttctaaagctaaggtcacgaacacgggtcaagccatgcataaatcttcctttataatatttacattttgttctcttagtacctagtcctcctttcaatttactctcaatcaatcaactcattcacactcttgattattttataatctttactcctaagtccagagcaagttggaaggatatataacaaatacattgcaggatttattatgtcagatttattcataggtcataggtgttttggttatagtctatttatgaaacttgtatcataaatatatgttaaccgggactgttattaggcaggggccttgttaaatgttgtaattgctcttggtacacctagtacccattcacatatatataataattgtttgctggtaaaaaaacaaaaaaaaaaaactcctaagtct

SEQ ID NO: 2100 - DNA, 1400 bp, Glycine max
  Soy_ogl_659 Gm02:44910301..44911700 Cluster 9
ctgtgtgagcgatacaagaaataccataacattaataatgctttaaatgacccgggcattgttacatcatctcatcgaggggattgtgaataagatattttcaaacacacttttttaaaataatttttttattgatcaaaatttactgaaaatgatgaaaatttgtgaatttcagttctcatatgaaaaaatcgtatacatttagaaagtgatagataaagacaaaattttacatgatgtattcatgtcaaaattcagcatgtgagtatcactcccgtgaacatacattaggacaaaaattatttttctggtcgtatgtgtaattaaatacatttaatttcagcatgagagtatcattagttttgtaaaatgataattaatttataatttttttttattaaaacatcatatgaagtggaatggaaacagtatattaacaacgagtcgatgatagggtttgtgaaaaacaaaaaatgcatcttagaagcgaatgaatttattttatcaaatatttactgggtgatagttttagataagcaaaggtttcgtctaatgttttgaatgctccaaactggttttgcagtatcaggcgacaatggtgtcaattaattctttttccaacattgactcattgttcatcccaattctcctttttcccttctaatgaattaatgaagtttagaatatcaatccattttatcaataattaatcttattaaaaaaatgaatatattaatgggatcttttcttttaataaattagattttagttttactaaaaacaacataatattagtaagacatgagaacaaataatcttttgcacacccctttcttttaactactgtaattattattatttttctgatagactttaaggcgtttttttactgaaaggcatttttataagtttgaactttggatcctttaaatcatttttgaaattaatcttcaattggagtctttatcaccttaattacagttaaagtacattactatatctcatcgattgattgctgaccgttctctatatcaaaccttccaatcatatgtcaatcaagtccttatgcatcctgggtaaccgaccgataaatcttaggttgtctttaaaccgaggtccacacttatttaacctgttctggccacaatgcttgaggttgtgaaattgtgtactccttcgagtgatatgctaaaatgtacaagagccaaccctttttcatgctttaacctctttatgctactgaagctaagggattatgcatctttcagtatcctccggtcatctttgaaccgacatctgcacatatataacctttttgtgccacaatgtttgagtcaaaaaggattgtgtatcattcagttcttattgaattaatctacagacttgttgacttggatgtc

SEQ ID NO: 2101 - DNA, 2235 bp, Glycine max
  Soy_ogl_682 Gm02:45816543..45818777 Cluster 9
tcttataaaaattggtgaaatgaaaaataagctcgcatttattgtgtttaaagtgaaaataaaaaataaattaaagctatttttttatttaaaaccaaatgaatcttaaatttgtgctagttaattatttgttatcgaagtcgactgtgtcctatatgagtgagtgaaagtactgatttctcctctactatggtctacagccaattcaaatgaatcttaattaatggcactgattatgctgtgcatgatgatcggtcacactcacatgcaacactcttgagtataaagttttcttaaccactttttttgtttataaattggaataaaatgttaatattttattcatatattattttattcacaaaataaaaataaataaattttgattccaagaagaatagattaatttaatttatcattcaacccaaacattcgaaagcctcgtattaaaatctaaaaatcatcatacaattgtaaaaaaaaaaacatttctttctcttgacggcaacaaaaagaaataaacaaagtgaaataaattactacaataataatcgcaagcatatattgaatctacgacctacgaccatgagaaaagaaaaaatgatctaactcaagatcccatttgcaattctcgcacccactcatatcatatatttcttctttcatatcccaacaaatatacgatacatgacacgagccacatggcgcatatcttacgcacgtagtagtagaattcaaacacatgcgaatgatgtttcgcacaagccatccagtgggattctaaaaatttccgagaaaattaaacacactacgcttagtctccaaaaaacacttgttcgttactaaatcacgcaaatgctgcattccttcttgtctcgtttcattatcatctgagcacaacaatataatctcgtataggtattttgcttgcttgagatcacattcagcagcatacttcagcttctcatggccactaacattcgcaactaaataattgcaaaattctttcactccatctctatatagaatgtcaatgttgcccttttccctgcaatgttgcaaaaaatcaatagccgtttgatgagggtaccaacctgatggaaagtcctccaatgacacgtttttccaaacgttgtttgcttcggatgcatgcagaaaatctttgcaagaaagtttgatgttaactaggtcaatagaggatttagatgcagcttttgcaataatttcttccaacaaatcagagggaagtgagagtataggaggcttgtcatcaattacgccatcacatatacgtggtcgagtgctacctgtgtcatccatgatggtgacgctatggagagaatattctatcaaagtcctacttataagaaaaattaacaaaactcgtcattgttcacttgacataagaaaaataaaataagatgagttatgagtttctctaagttaagatgagccttccattagcatctattcaaaaagtcgttgggaccggtagaaaaatctttctttgtcttctgttggtagctttctttatttgcttatataacttaccctgtttgaagctttctttattcgcttatataacttaccttgtttttagctttctttatttgcttatttgactaattaaccttgggttttaaacaatttgttaaaggttagaagttttttttttactggaagagctttttaaaacctattaatttgagcttcgtctaacagattagacaagtcctgttctcgttaaaagatttgtgaggaagtttgaaacataatataacctcactttttgtgttatcctttacggttacaagcatgctaccttctaatggttatgggataaaacatcatgatattggacggtgaaaagttttaacttagtctttgaccaagtagggttaaaagagaaattaaagttgaggagcttcaattagagggtctacgagaactccaatatttaaaaggagaaagtgaagcactttcttctacaaggcctccaatactcctaactttcatccccaaggtttcgtaatgcattcaaataactacttgagcacctcaaatcatgaaaaaaaaaatctctcttgtaagacaaaaacactaaacatgtatcaggttcgataaaagatgaaaatcagtataaacatgcaaaatctaagtcctaaacgtcaaataatgcagataacccaaactaaaataacacttaataatgacttaaaatacaacgcatcatgc

SEQ ID NO: 2102 - DNA, 1767 bp, Glycine max
  Soy_ogl_3177 Gm09:38839834..38841600 Cluster 9
ttttttttaaaaaaaaaaaaatttaaacacacgtttaacaatcctttatttattttgtaaaattatagaaatcctctttatttgttgaaaataaaagctttgtttaaggtgacctaaacaggagtgaaaaagaaaagagagaaaatgatggtgatcgggtcgggcatggcgatggatgcacgcgagaaattgatcatgtaggagccaagccatgtcgagccagctgggttcaagcgacacgcgtcacgagaacaaagcatcttgtggagaaagcgggacccaccatcttttccaataatggaaagtgacgggagaaaaaagtggcaagtgggtcccacgtctcatgaatgggacaaactccacggtcttttcgcctttcaggtggggaccactaccttggctcgtgcaactcacgtgggggccactacatgactcgtgtcaccatcccattccctgcttcacataaaaaaatgtttataaaaaacattaaaatcatagtaatattttccacgttaatatacacatcaatttacatagtgaaaaataagaaaaataaaaaatttacatatctaataaaaaataggaaaaacaaaaaataaagcacgttatgtgatgaaaaaaaaaaagacaaacatttatatattgaatgaaaaacaaaaatcttgaatcttttaggacttttgataaatactaccatatcagaaaaacgaatttaaatatattaaagatggaaccctatccaagatatttttttttctctggtttatggtggctttgatgagcggcgatatggtgctgcactgtcacacagcgttgtggtggacgttgaacccatgactttccgttactactttggctccaccacgtgtaagatcaacctattacgttacagccatgtggatatccctgttatgctatactatcctatatataaaacttaaaacttatatgtaatccagtttttagactacgcatattttagtaaaatagatttatctcaattcactgatgtataaattatatgatattattttttattcttacaaataaaaaaaattatatatagttatgtcttacacacaacttaatttaatttcatgggatgaaagtattactttggaaatgataaataaaaaatccctgtgtgagcctcatttccattctttttacggccactctttattaagtacatataaaataggattatcctctcaaacaaaaataaaatagaataaactactaattgatttcttttagtttccgtttaatatcactaaactaattcagtaataccatgctaaataccctcaagccttagttttatactagtagtctagtattttgttaaaattaaagttcctttcatcactaacatacacgttaatatataataaagaaaccattttaaataaaaaaaattaaaaaatacagacaaacatgataacaaatatatatcaaataaaaaatttcatttcacacatattttaaaataaatctggtataattattttcttttacttcttaaatattgatgttatattcatacaaataaaaaaattgtctcaaattgacccttcggcagcaaggtccaatcccacggacacaatccaagaaggtttaaagcccaataataattcaattttcgcctaagccaatactttattgttgcctttacacaaatttatatctgtagtttgtacagtacaaaaaaaaaagtgtacgtcaaagcacaactaaaataaataatgatatgaacctctaatcata

SEQ ID NO: 2103 - DNA, 1956 bp, Glycine max
  Soy_ogl_3614 Gm10:47950493..47952448 Cluster 9
tacaaattagttttaaaaattgatacaaagtcgtagtaacataaaatgcgaaacaaaataattaggaaaaaatagttaaaatattactttatatctttgagtctgttggttgtaactaactagatatacttatccacttgttgaataaaaaagagcacatacttatacacttgttgaataacaaaagggaatgtttggattttttttttcaaagggaggcgatatatctatatacagagagaataagtgttttatctattattaagttcataaaatatttaaattaaaatcaatgattaataataagctgtatttgtttcactctccagcaagatttaaatcatacatttttgttattcaacaaaaatggcagttagaaatggtctcacttgtttgtatcgttctgaagattcctttttgttattcaacaagtgtagaagtatatgctctttttgtttttctgaaacattgttggtttcgaatttttcaacgtgggctagtgtttttcgagagaaaaaaaatggcagttagaaatggtccgaatgcgaaggaagttttccaagatgggggagaagagaacgttaatccacagggtaaaggctttccttgatttgttcgattgctgcgaaatcaataattcttgcgatcttgatcaagactgaagagtgaagagtgaagatgataaagtggatcaacatatgaaccccggctgtggaagaatgaatgggctgagatgaaaaacattgagttttgaacttcatggatgcgcctcttttatctgagatgagatcatattcatgtgcctctttgatatcatttttttatttataaattctcttactaaataaattattttgcacgtgtgaaccttagagaattctctttgatcgattgctacaactttcatacaagacatcaattttttatatatattatttgtataaaaaattacactatttgctttactaggacttttaagaaagttatttactgtacaaggaggaacaaatccagtataaaaggggctgaattttttttacataattatttaaatagttaaatttaataaataataagttttaaaaatatttattatttattttatggataaaattaaagatataatttattattagaaaaaaattaagtaaatatcaacttaaaaacatattttcttttattttaatttccccccctcatatatatatgatcttaaggaagagagatcaagaccgcgcttgtctctcttggattcgtccttgtatgcaagttaacaagttgatcatatattaatgtcattcacgaaatatttgttatgttacaatgcagtctattattaaattccacaaaaaaagcctattactaaatttattagctattcttgcattttaaatttactacattaatattgaacattgtcagcatacaacacattatttattcataaatcaatggttaaaatatagaaagatttgccctccaataaaaagaaaattgtaggattttaatattttctgaaaatatttaccaagttagaaattgatcatttctttcttgtaatttttcttttctttagaagaagttaaatcaactacatatacaaaaaaaatttaaaaattaagaaacttaattcttataaaaattaaagaagaaaaaaagtagtatatagaaaagtcaactgaacctccaccatgacgatgacaccttcatcaaaacaagaacaagttcgttcatcaaaccaaatgaagctgaagtatttgcgatgccaaaaaagtttagaatggatccagtcactacacctccacaatgtggtatttgcaactgactgtaaattggtaacgaaacatatagattcaggaaagaaaggtctctcaaatttctctctcattttagcaaattgtaaactatatattttggtctaatactcataattttacggtgagtttttctaaaaga

SEQ ID NO: 2104 - DNA, 1900 bp, Glycine max
  Soy_ogl_6986 Gm20:44472301..44474200 Cluster 9
aaaaaaacccaaatttcctaatttgttagagaaaaggtctagaagaagctaaaggggtggaaagagagttttttgtcttcaacggggagagaagttcataaggcaatagttcaaactattctttcctatgtgatagggtgttagaagctcccaaatgctatcaacaaccaagttgaaagcctcatagccaaattcttatggagtggtaatgtgcaagaaaggaagattcattggcttaactaggaaaagttatcgagatctaaaaaacaaagagggtttggttttagaaagactgcgactttcaatagagctttgctttccaaacagtggtggagattgtcaacaatcagtagctcactcatgtctagagttttaaaatcaaagtattttcctcactcgaaagcaatagatgcacacactgtggaccttggcccaactacatttggatgaacattgtctctacaaggatatcttatatgctggaacttattggaaggtgaggagtggtttgaacattaaagtgtggcatgatagatggattatatagacacttgggataataaaactcgctttcgacaagatgaaggaacgaatgatgacctgagggtgtatgagcttattctacaagagaacagatattgggatgaatagagaggattagggaattattcccacaacaaattgtagacaacattctagctgttccacttagagtcaatccctttgagcattaactcatatgaaagttcattgaagatacattaggcttttgatagaatgataagtatgaggcctcatctagtgcaaattccaaatcaatgtggaaaaatatttaacaagttgtcccgaaatgccaaaacttggtatgaattagggcatataggaacattgtgccagtccaaataaaatctccagaggaaaatgagggatctagcttgtccttgccatggagaggaagaagaaattgttgaatgtgctttctttttctgtagagaagtttcaattgatctatatatggtttgctagtcatgtgagtggaagaataattagtgttcaacaaaagactttcaataagtggatgatatcttgctttaataccaattatatgaacttatgcaacaaatctataggaatcctttgatcaatttggaaaaaagaggaataagtggataatttggaagaagtagccttagttagagttggcgatagtgattatagtaattataatattttgtaatagtgacagtcaccatgataattgtgttatatttttaagatttgatttttttataattgtgttatttttttaagatttaatttttgtttagtgtaacttttaaaaatttgacgatcatatgaagttttaataattttttgaataagtatttttttaataattttttgaataagtattttaattcaataagtctattttgatatgaggataattattgagtatttttgtctctaataagaaaataattctctcacttaatggtaatatttctcaaccacacgtcactttttaacaggaaaataagaattgagataaattatatatcaacaaagtgataatttgatgtgtatgtgtgtgaaagttttagttgtacgtacaatcaataagtataataaagtgatgctataataaatttgaatttggaataaagtctacatatggtaatatatatttttgtatgattgtacgtgtagttactttggaatataacttttgaatgattgttatgttatcatgtgtaagatttatataaagtttaaagttatatttacataactcacatcaattttagtaactaatttgatcagtagtgcttctttgtggaaaaaaataccaaaattactatccgatattcaaactattatttatactgttatatttcta

SEQ ID NO: 2105 - DNA, 1600 bp, Glycine max
  Soy_ogl_4904 Gm15:42291..4266800 Cluster 9
ttttcttaattaagcttgacccctttcaattgcagcttcttgttgttgatgtatcattaatattttcttgcaatcatccagcttaactaagacgtgtttcatgtctgacactgactgaagtatccatcttaaggaatagaataagatgcaccctcactccacccatcctatattattgacattgagcaattcaaactcaattagtcttttttcctcaaaactactgggactatttcaaattatcaaatcacaaaatacccaacaaaaatttggttgtgtttattatttttgtcccgaaacttttcctcttaagtttcattcttgatttaattttgtcgacgaattaaaatgtgcaataattaaaaaacttgagtgacaacattcttaaaaataaattttgagggataagattcacaaaataatgaaaattgaatgataaaatatacaattaagcctttaacttttgaggtgagcatattttatttttcttctttttttcttattttaacaagtgtttataaataaacttattcaaataaaaccttacgaattatttttgattctatgacagtgtagatatcaatacattttgattaaataatttaatttatttttcatacattattaatataaatattctgtactggtgttgacatatttggaatgatcacatcttgtggtgtatccaaatctgtttttctttaatacaaatttctttggcttcttaaaaaattaatataaatatgtttataaaatcaattatttaaaaattattttagatataacttttaaaataattattaaaaaataatacttttaccgtatatattaaactataattaaaatgaaagaatgaaaattaagaagtgaggtatttacaattggatttacatctaaggttataaaaagcaataatacatttatccatatcttacaatggtcaatgtagttatgacattatttaatgttactccatagaggataaaaagaggggcttgcaagagaaaatgtaggtccatttgaaatcttaaaatttacagctttaagtgtgaaaattttcacgctattaatgaacattctttcaaaaagaaaaaaaaatgaacaaatgatttaccgttatgaatatatcaattttttcctactcaaccaaattcatacgttataaaactagtcatagatttaggccagaaatggcattaattggaatgctctatttcatagtttggagttgcgtggacgaattcttctttttcaagaagctagcaagtatattgtcggtcgtcaatgtatgttgaattgtatattttttaaacataaaactcaattcatttcgtcattataaacatcgtggtatgtaataaaaaatctagtgagcagcatcaaatttcgttaccctaactaaataatgaactctaaaatttttttgtctcctaacaaaacatatcttaaaatttagaataaactttagcctataatgattcctaaatcatatacaactatacatttactcctatctccatcaacaacagctctttgcatcaggggtgtttataggtcgtttggtttggatttgaaaaaaaataaaatttaaatcaaatga

SEQ ID NO: 2106 - DNA, 1838 bp, Glycine max
  Soy_ogl_3194 Gm09:39555801..39557638 Cluster 9
agagtgtggcaattattgccgtgcttgacattgccaattattgcttttactacttacttcatagtagtaagtagtaacatcgactcaatgataggtaaagaatctttgcatttaatttgatcaagtaacttgaagacaactttgttgttaacttattgatagggaattttggttaaaggttcaaaaattaatttaataaacaaataaatattttaatagaactttattctttttaatcagaaaaaaaaaatataacgatgggaacaaggggttcccaaaacccatatacaatgagaaacagaaccaagtgcaaagagttccctgtatatttgactatccataccatgcctcccgtatgactagactcacagattcatcaaaccattttaattagccttctattcccaacccatcacagattactcgggtctcccttttcatgtttccaaatctgcatatcatttttttcctatagttctatttgtacaacgtacagcagcttcatcaaagcatgacagtaaccaatatcaaaattaacaaaaccttctattccattgccatttcccatgaattttaccttgctggtacaattatccttccctgagaatttactctccctggtcacaacaaataacaagacagataggggaagctctcacaacctttgattcaaaattgatctaatattagaagaccagtcatataatgaacattgaaagttctttactttagcccgactccattgctaggacctcacttttattagttccatcatgtggaacctacagacttggcttcctttaaataccacttcatttctttatatccaaattgtccacaaaactgctagtcagacattcgaccatctgcgcttgtttaccgtgaacccaacctgcaaattgccaatagaactctttatgttaatcaaaacataagtattttaagttcttaagaaatatcgaattcttacaatcattataaatatatgttcgaaaatatattctctatttcaaaagcattctcttgctcaaaagcattctcacctttatgttgcctcatttcaaacactgcacaattgagaaaatgataaatcgatttttcataaacaaattttctcaactaccccaacataactttaataagaaattgcatttgcataataaataagtatgtttttttatacaataaagaggtataagaagagatgttaaaaaagtatgagataaaaaaaagggtaacgtgatatggataaaaaaaagttgcaatgcaaaaaaaaaagtgtgtgtatgaataggactcctataactcaaatatacggaaattcattggtgcaagttgcttaacactaagtcttttaacaaagatttgggctcgacttattagacatgaagtcgctcgaggtaccacttcactcgaaatgggtggatcaagtggaagaagattaattgagtaccaagtaaaagcatcaaatatctcccggccggttacaaataaaatataactcaaaaataaaattgcatttaatgacttatgtatgtaattttaaaaaaattataccgttatagttttattaatattttaaataattttgactaaatctttatagttttaaaaatatttaaatcatgctttatttactattggtcattaatttttaactatataaaaacatttaaaattcaaatatattcgagaaacctttctacttaattttttttcacatctctccttccaagtatttcacaaagctaaatactcaagattcaaactgaagtcactggtattcagttgaaaaatcttatggatctacacaactgatgatgcctttctccttatac

SEQ ID NO: 2107 - DNA, 1175 bp, Glycine max
  Soy_ogl_4512 Gm13:37272826..37274000 Cluster 9
ttttttctcctcaatatgaacggatttatgattaggaaaaatcaagagtactacgagtaatgttacaaagccttcttagctagaagaaaaaaaaagttacaaaggcgcacataacgacgataacacatatagtaggatttttgccactacataattaaatttcacacacatgcacattaatgttgcaaaattttctcctcaatgtgaacggatatttgtttaaattaaaggtacttacgacttacgacttacgaggacaatatagaaggcacttgtatgttaggaaattctaagaaaaacattatcttattttttctttttaaatatttatataagaaattgtgaaaacaacaaatgttctatttattatttttagataaatttcatcaattctaagtttctaactaccacatgatactgaaccgaccaatgttgcagggttggtgattggatgcatgctacagttgtttcctcaaggttggatagagctagggtggattctaaaaggagggaccattctaagtttctaacatatctagaccagggaagtggaatgaagatattgtataggttaagtagttgcaaatggcgtcaaaaaaggggttattaaggagaagtccaagttattcctacacccaagacttgtgtctcttgtcaaatgttacttgagtggttttaagttcacattctggacagttattccacttttgagtgtgcggttgagtagtctagaatttgaacaaataggtttttttcatatatatttttaattccgggaatattattttaagaataaaatatgagaattttatttttacatatttaagaaaaaatgtattgattaattataaaattaattaagaatatttttatattttcgggaataattaagacataggtttggttaattttttttgaatatatattataattactaaaatatcttaattataagattaataaatgataaataaattatactcaaaatgttacacatatctcaagtttttatgataaaactcatctctctacttctttattattcattaaaatataacccaaaatataaatatacatattcacatcacatcagacataaataagaaataattggaagaaaaataaaaaattattacatataaaattcatgaaattaataataaataaaaatggac

SEQ ID NO: 2108 - DNA, 1324 bp, Glycine max
  Soy_ogl_5533 Gm17:5562777..5564100 Cluster 9
acataaaacatagataatgatatatatatatatattgtttgaattaaaaaaagtgaaaagaaaaaaaatgatttatataaacaaaactttaattctttccatttaaatttcaatttttttatttaaattccatccaatataaaacactcaccgtatgtttacataagaagaaaataaataaattagtctaaagaattcttactcaattaacaaaaaaatagtaaaaaatactacatttttttatttaaacattattttcaatttaaatttattttttattttattttttcatgcttctttcctcttatccaatcgatcaaaagcatcagtgtcgtgaggtcaattaacctggacggatataatgacacaattaaataagaatttttctaatcaatgattttagggtattggttaagaaattaaataaaaaatatttaatgtgaaaatcataaaaaaaagttcagaaaatcataaaaaatgaaattttgtgtctaataaaatctttgtaaatttagtttgttaacccattttgtaaaaatactactttccatttgccattaattaacccattttgtaaaaatactactttccatttgccattaaataacccattttataaaaatactactttccatttgccattaaataacccattttataaaaatactactttccatttgccattaaataagacgggaaaaattctaacaagaaggtaagtaactctttctttaaaaaaaatgataattttacaaagataccttacatataaatacttgtactgtaaaaatttaataaattaacatttgcatccttttcagaaaaagaaaaaaaaaatttgcatccactcgcactttgttagtattttgtatcagttgacttggggcatgccaaaaagcttatctaaaggcggtgaagtgaagagagtcattaatgaagacgacccgcataggttaaaaaaatgaggtgacgtggtgtaaaaaggatatggcacgtgtcattacagggtccttactgttgataatttcctcattgaacatgtcagtcatcgtcgaaggctttttccaaacaaatatcggtacctgcggctgcgactcatgaccaatgagaattaaaaaaaatatagaactttgaactttcaagaaaatatggatagagtggggtccatcacggattacgtggatcggcggaccccactttatctacaaagttattattattagtagtttttaaaagatagccattcacgtggccggcatcttgtgttgtatggctgggaacttggacccaccaattcctctgcgtgctttacttttcatgttca

SEQ ID NO: 2109 - DNA, 1500 bp, Glycine max
  Soy_ogl_4540 Gm13:38215501..38217000 Cluster 9
gttatttatggaattgctgacagaagttttggaattatttgtgaataatctttgtggtttcttaggtgtactcatattggttaggtgttaaaatctttattgattgcttttgttttttaatgtcttcggggttttgctgctaggagttgaatgtccaatgtctttaagtgtctcaagcctaaatgagaagggttgtaatttctcatggtttattttgatatattgaacaaattatgtcatgcttaaaaaaaaaaattcttccgtcatgatcagaagaagattgcatgtatagatttcaataactaagacagtttaaaagtatatttactttcaaaacaacgcatttaatcttttatattttatacattgaaatttactaaaaatacttttcaaacttttatctaaatataaccttatatctattaaatactacaatttatacaatttccttgaaaaatggttgatttggtttggtaacattttaggataatattcaaccaactttgcatattttattttgtaattttttctaagtggatagtagacggtttcaaaccatcttgtatgtataattgtggtcaatctttttatgtagcatgtatttaagaatttaaatttataaaaaaaaaattaataacattcaactatatgtcatatgaagattaattaaattatgatcgatgatctcatattatttaataatttcttgacaattatttatttaaagtgttagcaaactattctctaatatattatttctaatacacattctattgttgatttaaaaaaactacaaaatcaaaagaacatttaattaataagtgagacctacaaaataattttactttttcataaattttttctatagtaaaagacataataaacatggttttatatttttttatgagtaaacatatatagcttagtatgattgataaataactttcttttttaaatgtatgatcaggaattcaattattgggacctcgagagattactctaagctcatctataataataataaaagcagataacgtcattttcttgcataacgttctaagttttttattatccaaaataacatgtatttattcagttggttaatggtaattggcaacgctgtcatgtttggttttaaaacgttaattttgtcatccgcactttaaccattctataatctaaatattttgtttgccgaactagaaaaaatattccaggcggtggtgactggtgagagccacatattgagagaatagagattgagatttgagaggattagaggaactttggtggacccatattttgctttaaaggcttgcaattttttatgttaagtaaggacccgtttacattagcccactcatttagggcatgtttgtattttcattacggtaagtttgtaccaattttaaagtgtcatcttgtgagaagtaagtaacaatttgttacttttaattgaacgattgtttaatgttcctcaaaacgttaaaataaacatgc

SEQ ID NO: 2110 - DNA, 1411 bp, Glycine max
  Soy_ogl_6833 Gm20:38099448..38100858 Cluster 9
caatttatgttcctacagtcagattatgctttagtggaaggagatctacttgaagatttgaaatgtattttacctccctagataaaatgttaaggtacatataagaatacgttgcacctaacagatctgatattttctgaagaattatcatatctcgaaatctcataatgcagcaggtgtggggttaggattgtatcacgcgcatagcgagtgccagaccggtggcgtgagggactcggtcggagaccaaagatgtcgtggaaaagagtttcagttgaccgatagagtcgaaggggtagaaattctaattatcaaatatataaactattgtttctatttaaaaagttaagtaattaacaatcaaattttatcattatggttatcgctatttcttttcaattcgttttggagaagaaaagttctgcacaaattaaaattgaatagtccagtcttgagtgaatttgtgattgtaataattagtctattatctagtggaattattaataaaacttcatattatgagcttttaaacgtgtggatataaaaaacattcaataactaaaatctagtctactctttggtgaatttgtgatattagataagtctattctccagcgatattattagttcctctcactatttcggttcaataaaacttcaaatatggtggaaaaaaaatcaataactaaaatctaattttccatctaatttgaaactaaaccatacgatattgtaatagtaatcggtaatcatatctttttttctcaaaagtatattaactctattttgtcagcaaggctatttgttataaattgtcataatatttcttttgttaaccattcaattcattaaaaaaaaaaaaagatctgactaatttgaaattctatcgacagataaataaaatctgatataaaattatctctatgagtaatcaaactcaaataatatccgaaagattcaatcttaattttaacacattaattatttttcaattagttaataaatgcatataatatatatgaaataacacaaattactgagctggatcaatatatattttttaaataaattttaattaaaaaattaaaatggcatttgacggaaaaaaaagtctttgtttatctttttaccaaaattgtttcgtaaattttcttgtttttcagagaatgaaaacactcttcttattcttcacacattctcaatattttttttttttattttcactcacacagtcacactagtacctcaactctcaaactcttatatcaatgtactaacaaaaataaaatcacacatgtcgacttcattgaaaacttaatcgttaaggagacccacaggtggaccaagagacaaagagagaattggtgagactgtgagagaaaaaggtgtacacctgattggacaattttat

SEQ ID NO: 2111 - DNA, 1531 bp, Glycine max
  Soy_ogl_2849 Gm08:41243570..41245100 Cluster 9
ctgtataagctgatctcatatccgaactacattaaatataattcctgtatcttaaattcatcaaaattaatttcaaatggataacagttagaaattaaagcagaacatgaccaaactagtaactagtccaagttaatgtcgccaaaatttggcccataagttaataattgacatttgggtcataattaagtttggtcttaatttcatctaacatcagataatattttaaattttataatttttataaaattataagaatttatatttttttatactaatacaaaattaagaagtattttacaaactgtatgaatctttataaagactgataaatataaaattatgaaattcaaaaacaataattcatgacttaatgtaagcaggaaaaggtaaaataaaatgaagataaaataagctggaatgtttattgtcactctaatgtatccattactactcttatttaaataatttgatttagaaatcccttttctttctaattaaatcatttctatttaaaaaatcctttttcttcttaattaatcaaataaatggtaagaatgttatagattaaaattgcttatactagagtgacaacaaacgtataaaagtgacaaataaacattttcaagcaaccctaagaaattggtaattgtgcatatgacttaggatttaagggagagatcaatccttgagctaagacttggaggaggcaccgacaggacagcaagaacaatagaacatgatagtattttattgtaaaagacaaaatacgaatcaaagttagatctaatcgcgcgagtccataacaaatttagaacatagatttgtctggagttcacccctcgaataatctattccatattttattcttaaaccttaactatataaagctaggatgttatttgtttacactcaaaaaatcccactttatttttatataacaaaaaaatatcgtccaatcaagctcaattttgagatttgtggtaaaattatttttctaatcaatatctgtgtttatatatttatggcaataaaaaagtaatgtcctgttctagtttatatataaaagaaattatttttcaccggaatccaaattcgtgtgtcccttctccatgcacaaaattcgggtgcactgtatagtccccctactagtccaccagaggggaagaatgagaaatatttttctttccaaattttcccatgtgaactcctcttcccttgcttgttagtttgtgcattgtacaggccaaatgctacccacttagatttttttttcctcttaagtaaattacactaattaccattaagatttcataaaattaaacactcttttgttgctataaatgttttacaaatataggaaaaaaactatgtaatttactattatttttttcatttcaacaattgtcatgtagtaacaattcccaaccattaagattacttaaggtgagtcaaatcatcaatcaatctactatacatttgcaaatgcatttagaggaaatttttgcgaagtatcgctctcattttgtct

SEQ ID NO: 2112 - DNA, 1638 bp, Glycine max
  Soy_ogl_3975 Gm12:2296955..2298592 Cluster 9
tccgctcttatttctttatgcatgccacataaattcgtaaaaatctgtttcctaccaaatagcacaattcttacactatatgacactacgttataattaatctaattgcagttgataacatacccaaaaaaatgcaattgaaatgggaaaaacactttaaaaagtgagaattctcacactatataggagaaatatattgtagatagattctgaaattatctatatttttttctcaggtgaattcttttataaaattgaaagtttgagtcaactctaaaggtgtattattaattttattttatttaaataagaaaaagtattgttttgggaggagagatagtagcacaatcattgaataaaaaccaagactctcaaaattattaaaactaaaatttatttttattaacaaaaatacaaaattaggtgtacaactcattaaataagaaataagacagcaaattttactgtataatttttaatatattccattcaattaatagtaaagagtatataattccaaaacaggaagaaatatattagaaagtattttaaaatttaaacttttcatttttataagaaagacaaataaaatactttctaatatatttcttcctgagctatacaggatttgtttaactatttataaaaatgaaaagtatatctgagctatacaggatttgtttaatttaatttttttcatttttataaatagttaccaaatttaaacttcttttcattttttctttgtgattatcgaatatttgtatgaaaataataaaaacaataataataatatcatattcgcaatatttctcaataaatattaaaaaaataaggaaaacgtaaaattgaacaaggtgagatttctgtgattagatgttgttgttcatgatttggattttctatgaagtatttatttttgtctgtaatttttccactgatgtataatgtgttaatttgatgtaaatgtaaggttaaatcattcaaatagtattgaattcgatcattaatataaataattttttattagattttaggtcaaattttagattagtcaatgaagcataggattaagacaaaataagattatcaattaaattaattttctcttttttactttggtgcttgtcatcggcatattcacaaatcattgaggccgtagtaggtaggtgagaattaaggggcagtttgattgtgtgaaaaagaatgaatgaaaggtaattgagaaaaaatatttaaattaaaatagaaaaaaggaagtgtcagatccatacaaatttttgaaatttttttcatctatttgaagacaaccaaaccatccctaaaagaaggcgagaggaaggcgagaggaagagattctttgtgcgaaatttgcaagctttgcaaagttggcgttcaatctatgcaaaaggtttcgagttccaagaagaatgaatagctcgcgggttactcttgtcttatttcattgaatgaaaagtagataaagttgatcacttttctttttaagaggaaatgtagcattcacaatgatcaatgaaagaaagaaaatgtgctaaaagaaagaaactaaaacgaataaacgagcatgtctccaaagttgacagcacgcatcatcatcttcttttgtttgggaaagaa

SEQ ID NO: 2113 - DNA, 1176 bp, Glycine max
  Soy_ogl_1213 Gm04:4127179..4128354 Cluster 9
tgagaaaatctttatttgaaatcacaaaagaataacaaataattctaaatcttattacaacatttttctactaattcttcatttttttacataataagtattgaatgcgtcttatatttctaaaacattaaatatatctacttttttattactagaaagatttgtaagacgagttgtagaaaaatataatataacttaaccataattgctttgtagatacgttgataaatatttaattgatataattggaactaattttctcttagctggacgtggaggtttcaccgggagaagagacccatatggtgactgatgttgagaacgagaaaccgtggtaaaaacctgaagggtacaaaagaagtctgaaacagaatcaaaatagggaaaagtgaatcacggtgactcgcatatatagaatttttttaaagtggcatatattgaacgttggatttaattcaattaagggttaagatttggtataaatttaataatttacattcagtgtaaacggatttaataatatatatatatatatatagagagagagagagagaggcaatgaaactttataaggaagaaagaagaggtttgacaggaaccatagtctccctgtcaacattttatttagaaaatttaaaccattgaatgttttaaaagtattttaaggatataaattgagaacttaacaaatattattttaaaaaactatgattaaattataatggaaattacaatggggtgggtgggtaggtaatactttttttttcttcataaaaccattttatttctagcttctcaattaatgttttaaagatactagtatttgccttttaacttaatttaattttctaaaaaaatattattattaaacaaattctgaaaatcgtgacactacctatgacattttagatttttttttttacggagaaattatagatttttagtattaacttttctgccatgttaaacatatctattctattctactaatgttaattttattaaataagaagtatttttacttactttctcttagaaattataccttgggagaaaacaaaattaacaagaaaaaaaataaaaaagagtaaatatagcataatatgataaaaaaataatgtgatgaaaaaaattataaaaattattcttccatcccaaaataattatagttctagg

SEQ ID NO: 2114 - DNA, 1023 bp, Glycine max
  Soy_ogl_1555 Gm05:2644478..2645500 Cluster 9
ttaattttaaattcttattattacaattataaatcctctgaaaagttaacaataaataaatctacatgttttaattttatttaaaaataataatatatcatcacattttgttgaagaattatatcgtcatttgtgttttttgaaaatcaattttattcaaaattaattttatcccctaattcaaacccacacgaaaacatgtgaccatgtaataactcgaagttttactcacaaataaaaagaaaacttcaattcaaaagataaaaatattctcagatataaaaaatagtttatttaataaacaaaaatttcaaattttgattgacttctacttctatctcgtggacatccgttacaccttctagggctataagagttggtaaatgtaacaatctaataaccatcaattagacatgacaagagagcaaggtagagtccgtgggtttagctctttccatctcatctttgctttttgcagagtgggtttgagtgaaatttatgagagatggtaataaataaaaaaattcaatcacgagtttgaattcaattacaatatctacaaattctttccaagttgcacattttaaacggaagaatactgtttcttattcttattggattgaaacagttctcaacatggtcattgcccctgcgtgcaattgttccagcagcagtggatgttggattaataatgcttatgaattcagggcaccaacatttttgtttatatatattcttggttcttatttataagatatcatcaataatttattttatctcttctatatattaattaatttttactaaaatatcataaattatctctttctcactctagagactaaagaagataaatagatttctaataaaattaagaataaattttaaaaaacatataattataaataaatttgatattaataactaaattaactaatatttttaataagcttaaattaattaactatattttattattaaagatgaagagaatagtatatataccgagaaagaataaaacca

SEQ ID NO: 2115 - DNA, 1500 bp, Glycine max
  Soy_ogl_1768 Gm06:2756401..2757900 Cluster 9
ctcgtgaatcacagctgcttatttgcatctttgtcaacatctagcttgatacttttctatttattttaagtgttgtttaattttttttacccaaactaaagaaatacaataaattttttcgtttctcattaaattaaatagttataaatttttctatttgactctcttttatttatgctctacaacaaatacatattaattatttttcatcttcaatttcatgatttgacaaaagttaggtgagaagtaagagtataatagagaaaaaataattaagcaagtgatttgaaaaaaaatattaatgagttaagatgaaaaatctttttttatcatattttatttatcttctaatcaaattccgaatcagtccaacccatttctcctaataaccaggtttgaatcattatcactaataaaaaaatctaccaaatcaacaactaatattcagctttaaaaaaattgagtaagccaagcctttctaaatgtattacaaaggacgcagttgatatttttttttatagaatatagtacaaataaatgtcatcttaagttcataacaataataataagaagttgatgatttatttctacatacagtacaactataacaacgataataacaagtataatttaaataaataagcttatcaagcaatttatgataatataaataaataagcctatatcaagcaacttatgacaacaatactcttcatgtcaaggcggttaatgtcacggacattgtcctattttctcccttcacatgagtgatggagaatgagattcattggataatttaactaattttgacaagggattctcatatgctgcgcaaaataaaacaacttaatgtaccccaaaaaaatattctgaaaaactctatcgcattagatcattcctcaatcaaatctcatttttttaaggagaactagagttaatgggcaagccttcaattgaagggagtaggattaattgctataaaatacgtaattggagctcctcgtcatcctttccgttatttcgttttaccaataaacctgcacatcgccctctccaaaattttccatatctcgctaaatatgttatatttaaaatttatataattttttttaaagaaaacagatttagttttttttaactgattttggtttgtaaaaaaaaagaaaagaagctgtttttttggttaaaaactgatttttaaattagtttcaaaccataaggctagttgtaaataaataacagttttaaaatcaattttaaatcaagcaaattttggatgggggacaaagcaaccaataaggagttttaagcatattataatttgtttatttttttattcataaaaatgaaaagatagtatcaaataatttataacactcactgtatatctttgagatataatttgtttaattaaattagtacttcttctacaatcaaatgtaaaagagaaaaataataattcaccttaactaaaaaagttaattaatcgcatttaatcgg

SEQ ID NO: 2116 - DNA, 1200 bp, Glycine max
  Soy_ogl_2515 Gm08:5119501..5120700 Cluster 9
gccaacataaaaaattgtatgattgcctaatacatcatatatttaattttgttagtgtacaaaatatgcattacattattaatataaatcttaaatatttatattaacagtttaattttcctttgacgatattatattaataaagacaattctaacatttaagtatctatagaaaaagaacaaactaaattttaaagaataatattattattcttatttcgcattcataataatatttaaaataagtaatataattactaattaatgaggattggtctagcaaaagatgttagtgtctcatgtgacagaccaaagttcaaaattttgctaggaaagctatccacatttagtactttagtacttgattagttaatgtgaaaaataaggattatatatatatatataccgaataaggattgtatgtttagactatatatcaaatcgtatttgaatgatcattattttttaaaaatgaacattacctttttttcagtagtcaagtgacaatattataatattgatcatcttaaagatatgattgtatagtctaaattgatattttttatttcttacaaaaaaaagaaacagaaaagacattggactgagaatagtagttgggtccaattatcaaatacgtatatttgctaagtatacctctcccttccctttatattttttattaccaattatacccttttatttattgaaatacagttctgaaaattaattttcagaacaagatatgacaattctgaaaagtaatttttggaatcatgttttaacaaatacatagttctagaatttactttgtaaaacaacatatatcaattctagaaattaatttttggaattatgtgtatcttgttaaaatatagttgtgaaaattactttccaacacaacatatataaattctggaaagtaatttctacaactgatatatattgttttcaaaagtgatttttggtagtcataaacaaactcaaatataagatatcaaacgtatctctcataaatgcttaaaatcagttacttactctcatccctaattccttgtagacaaggagggataatcacttccaacattttagccaaacaatcagcgatcttgtatctgtttaaggcccaactcgatcaccataagcaactgagcgtggaccatgaactcactaaatactctatcttacttgggacaattgctt

SEQ ID NO: 2117 - DNA, 1300 bp, Glycine max
  Soy_ogl_2925 Gm09:1076101..1077400 Cluster 9
tcgtacatttatggcccatttaatttgataagcaacaattatggttccctttctccctaacttatgcaattctattattcttatactatatacaatgaatccttatgctttttttttaaagcaattcctgctagttagagttacacgtccaaactgttatcaccaaggcatatatataaatctattattattaaaaacatttgctttaataggggttagggttgccgtaaaaaaaaaataggggttagggttcttgatgtgattttttaggcctccacgtccaaactgttaccattaattaaggctgatataatttaaacctaatttcattcttttttttcagtcaaaataattactttatttttttttatttttctaattaaacattcactaaatcttcaaaatatttctaattaacctcaatatatcttcttcattaacataatttttctgcaaaaaattattaaatgatattatattaaatatagaatctataaaactaataaggtgtttgtttaaaagtcataccctaaaccttgattataactcatgaacaacttccaagaaaagtacaagatgatagatttttatttctgtacgtactttcatcgtcacttaaatttcagatcgatctgttttcatttcctaaacaactaaagtcaaatacttcaccaaccatatatatgagacatatgtgaattgtttagtaagactataatggctaacagttcaattccttgtattattgttataaactccaaccaaataaagttgcatgtatgcgattttcttaatgtttaataaacttaattaaaattaatgtaaaactatacatatttcatttatttaattagaaattttgatcataagattataaaaaatttaattaatcataaaattaaaagttaaccggcctcagatataatacaggaaatcaagaacatatatcaaatattaattgaaaaacatttatctaattcgattacctatataattttcacaaccaaataactatggatggtctcttcaggacaatggatgaagtacagtgtacgtaactcaggacaattgggggacttaatgaagggttaaaatgtgtggtgtattaataggaaaacacacttacagaggtacagggaagggtagttttttttttttttttggagattagagtttatttatacacaaactgtttttgatatacataaattttaacctctgcgttccttttctcttataatgctacacatttgaaataatattatttgaaaaatagatcatttttttaatttcacgagta

SEQ ID NO: 2118 - DNA, 1561 bp, Glycine max
  Soy_ogl_3245 Gm09:40657501..40659061 Cluster 9
ttatgattatttgttctcgcaactagtttgattatgcgccacactttaaattcttttaatttgttagtatagacagtctacatagttacatgctgtattagtttttttgagataacatactgtattttttttaagcaacatattagttagtacacgtaataattatccactgaaaattgtaggcaccatgcaaatcacatttttatttattaatttgaaaatctccatggtgcacacatcttgaatctccaactgtaacgcgcatttcctttttattattattaattgagaacttctactatatttaaaaaataattatcctcaaataaatagtcaccactcaaatcacatttttcttaaaattaatttgaaaatgcagtgagtatattgttttcagcaaaatgctaatattattatattggtggtatgtaccagtggtacattgtcatgaaaagggtttacattgtcgtacatcatacatttgtttctataggatatcatcagtctatcagtttatccaccaacattaaagcatgcatgatgccctgcactcatcaaaacagatcaccatgcaaggtcataaaataccctccccaaaacatgcaaagtttaatgtagggcacttaaataaatagctctttgctattagcaacgcccaggatctgaaccggatttgttctacaacgttgtcaaaatccaaagcttcattcaatgtttatagagtatatatatgtaatgaatttgttttaagatttcgagagttaatataaaaaaataaataaacttggaaatatatatggtactcttgtctaatacaagctacaaataagggtttactttaacaaacttttcaacaaatatttataagaaaaaaaattactaagatagtcaaatgaattataattgagtttgtttggtaaataagcagccacagtaaacccttctccacaggattttctttctaaatctcctatatatattggtgtgttggatatttcttttcgattttgattttctaatattattttttataaatggagccagtgtccgaaaatctggtttgcatgtgaaagctatatacctaagctaatgtaccttaaatttatcgatccgggatttttattttatttttaattgaatagtgatatataaatattttttaattttaaacattctaataagctctgctacaacacaaattttatgtttttaggtgttgaataagttaacaatgttgatgaaatgttttaaaaataatataggtgcattcatcgtccaaaaatctcaacccttcactctttcctttcaattaattaagttagaaaacctgcatatatcattctcattctccctggcttctacttccctgttcaaccaaccaaactgtatatagtcgttttgaaaaagccaaagatgcttggaatcacttggtcgtgcgttacggctcttagttaaaagccataccagatattcagcaaggtacatgtaataacctgcaattcgtacgcgcgcatgcatgcatgtatatttttccaattatatttatgcttaaatgtgaatg

SEQ ID NO: 2119 - DNA, 1500 bp, Glycine max
  Soy_ogl_4471 Gm13:36015001..36016500 Cluster 9
caaacttgaaggggaaacttttcacgacaatcacaccaacttctccacaaattaatggacgtgatattaagagtcaagagcatcgtactcttgtgcgaacataagtaccaaagttaaagtgttcaggttaaaatagtgtgtgcaacaaaccagtcaatacggcaatatcctgtaaagtcttcaattcaaaattacacgtgatgtctttctttatacacaactataagtggaatataaaagaaataaaagttagtacttcaatatacctatatctatatcacctgtgagattggaagatcatcataagttcacaactaatggcatgagatcaagaacctttttcttttattcaactgatagatagcattgtcttcgctcataactgaattaaaaagatgttgaacataagtaactcaattagatatcagtccatatataatatatacattttgtggggggaggaggaagaaggagatatgagaaaaatatattttataacagctaagatccgttaatatttgagtactgttaactttaaactgacataatgacaattttgattcatattaaaaagatatagaactagttaaaataaattttttaaaagataaatgactaaagtaaataaaaaatagaataaatgataaaaaaattcatttaatcttaattaatttaagttgaattaatctagatccaccatcattatattggtctccaatttagatttcttaagctaaaaagattttgagtttgaatgtaattttgtgaaataaaaaaaaagtaactaagaagatcatctccaaaaatgtctaaatagactctcaaataaaaatatatcatgaacaaaattgatgaatgagtgagatctttaacagctcaaccaattctgttcatctgtatatataagctctggtcagtactttacctacaacttagtggactgttgttaaaaagaacctgggcccggtatgtaaggagcatcatgcagatattatatagggtcttgattgatgcatctgcgttggcctatatttacaggcagcaaacttcttcacacagagaattgattcttttcagcttttcatatcatgtatgtggttactattttgtgttaatttagcacatttttcaagttttgtcttacgcctaaggataatatctaaagagctacgtatatattacaggtaacggatatgacagaagatatcttgggccctcccatctcctatattttatttttttaaggtaagtcccatcaatttataattaaaatctatctatatctctatatcaaacaacaatttatatactaacattattttggtctaaataaaactctaaattcaaattttttaatgagaattagttcttgatgaagtccataaatattatgcacttataatataattaaaaatacaaaaattatggcttaaataataaaaagaaaatgataaaataggctaaataaataaagaaatgataaaaaaaaaataaagtgac

SEQ ID NO: 2120 - DNA, 1738 bp, Glycine max
  Soy_ogl_6950 Gm20:43421363..43423100 Cluster 9
ccaaaattcataagttaatatttgtactatatcatatattataaggaaacaaatcttacattcaatgacggatctacgttgaggagttcgggggcagctgcccccactaacattataaagtctttcatataatatatatctaatatattaaaatgctcccaaatattatatttaaaaatgaaacttacataggcttgcacaacctatacgttgaagagttagcttttaaagttttactactagtggataacattataaagttttaaaaggtcaattttttttttattttgaaaatgaaaaaattatcaattgtttttagaatacaatagctctttgagaacaataatgtattttttttcttaatcatatgtatcttttacaagaaatcattataatgtatatttaattatacggttaaaagtgatatataatgtttttaatgctataaatttatttataagtattacccccacaattaaaaatttctgaatccgttaaattcgagttgcatggagaggatcaaatcaaagaggatcgtgaggaggaagagacaaaggtaggaactctaaagactaaccagtatgtcaagtctgtggtaaatccggttacgtagaagttcactgcttctacaggttttgttgtaattttgtgtatttcaaaaaggttattatttattgtttttttaacttgggggagtattttcctatataatttttgggagatttgtgctttacatccttgagaacaatatgtctatcatacttctcaggctatgtgatgcaaagctttataagtcagaaattaggtcaaaatttgtgtgttcataagatggtgatttgtgattttatctttgtgtataacaagtttgaataaacttacacaagacatgcacataaagaaatcagataagacagatctggaaattcaatttataatgctctcattgactcacaaaaatcatttctaaatggttatgggtattttgatagtggtgcaagcaattaggtgattcacgactccaatccgtttcaagaaattttagatcatgatggtaagagtacgtactctagcaggaggtcatggtgataaacttgagagatccttgccactagctccataacgcttagtacccatcaaagattacttgatctaaatgaaatgttatttgtccctaaaactaataaaaatctcttaattaagcatatcaaagcctgcaactaataatgatgtgatagttaattaagcatatcaaagcttgtaataaacttgtgttatttttctagtagtgattgaatttcatgcaaaaaataatttcgtgaaggacaaggtcacaaggacaaatctacttgaagggaagcttaaggaaggacgtactgcccattgcagataaattttctttcaattggattaaattatcttttcagttcatggtaattatttaattaaattataagggagtctaagatcgaatctcccttcatagttgagcgtttaacatctcgtattttattcagatcatgattttgctgctgagcgtaacacaccaaaactgtatgttttatttatttatttattattatttgttgagtttgtgaaattgtgaagattccagtgaatatgggaattgagacgtgaattcagtatacatacccgtaaacgtacttgagaaaaagaaaggaaatacacatgataatttaactcaagtggtgttttaatctcagctattaattgtttttta

SEQ ID NO: 2121 - DNA, 1287 bp, Glycine max
  Soy_ogl_7003 Gm20:424601..45123887 Cluster 9
ctgtaaaaaaatgtgaatagcagcaaaattcagtggaatgactgtgaaaatggttcccgaaaatgtgaacagaagcaactatataaaattcccaattatatacatcaacacattcaaagcagctggtcaaatgaacctaacaatgaaacttttttgcttgtttgacaattttagcttttgcttgcacttctagaacaccacaaaatataattttcttttttagaattcgtctcgtagccgcgtgctcaacaaaacagggttggtgtcatacgaataacaaataaaaacacgtaaataaatccttttagttattggttaattgtggtaaattttatcacaggttaaagatttatttttaaaattttacaaaatcattcctactagtttttttacacattatttacaaaaaacattacgaaagtttaattaatgagactttaaaacagccttttttacaattaatttactattaaagcatttcttctacagtttcttacatttgactagttttttctcttctgtgaaagtaagatattctcgattcaaaaagaaaaaaagaaaaatacttgacatgaaactactccttaagtcatagagattattcaaataaattttatctctcttaatataatattttttgaatgcataactaggaaaataaaatctagcttgagctttaaagcactttctttatttccagaacatgaaccaagtgaaaaataattatgaagatgatgaagaggaaaaaaaacaaataataaaaatattatttgatgcaatcataactaatttgaacaaaaaagacaatagtaaataaaaaaaattaagtgtattagaataaacgaaattcataaaaaaaaaacccatacaaatttattaacgaattgaaaggaaaaaagtcaaacataaatttatcaaattcgttctaaaaaaactaaacgtgtaattttataaaaaaaaatctaatcatctatcaattctattgaatcttattagtaatacctcttacttttgaatgtttgagttacttatgttttgtcttttttcattcattataacttttttttttattcgtgtagctaaatatttaccttatacaaaacacaaactaaaataaaacatttacataaaagactcaacacgtcaaacacaatcatatccaagaaaaccttaaacttaagaagcttttgatataacaaaagttttttatgttcaaattgtaatatctaagattcaaaaatcataggaatgatcctttttagaaataaataaaatatatttggtagg

SEQ ID NO: 2122 - DNA, 1706 bp, Glycine max
  Soy_ogl_1672 Gm05:34629630..34631335 Cluster 9
tcaagcatcttaacccaaataatcagtaaaaatatctttagttaattatatttttcataaattgatatgatttttataataatttttaaatatataagaaatagaaatagaaatgagtgatattataaatttatgaatagaaatatatacatatgcataagtttatttgaattaatttttaaaatcaaatccaaaatccaaatttcatctaataaaaaaatttgattttcaacttttttatccttcaatttttgatttttttttggattagttttttttattcatattggattggatcttttatagacagccctatgtagcagtgtgttctcattttttgtttcatgatgctaactttgatatattataaaattttctttatatattgttttgtcgatatgtttacgtatgtactgtattaaatttgacacattgtaacaatttatttttatcatttatttatgtgtatactttttaggcaagacattaagtttgatatattgtaataatttttcttattatacattgacacttgtattaattttagtttattaatttattttttactcaatatgtatttgccattttgcataaagtaaaattaacatatgcatcaatccatagtaagaaaatttgttacaatatattaaatttagcataataaaaatgcaagtataagcacattagtgtctatgtttttaccagtataattaaatatatgataaaataaatattctgaaagaagtttattcatttattttctttttttatttttttcttatcaattagaagcttactagttaaaattttcctagtttggcttcttctttttctcttatgttcttaaaaaaaaataaaaaatcatggactcttctgaatttatcatagtccgcaggtcccctacactttttgttattggccattacaaacctgagaaaatattttcttactctctcccttccccttcttttcaccccataaccaccacaccaacgccgcgcgccaccacctttgtccagatttgaacccaacaaccgtcatgtcattgcaatatcgtcatgcatcgctcactaccccttggccaaaccaccaccacacagctgctacaccgcgcgaacccttggccctgcacctctgtccgcgatgctacgcgttcgcactaccactgtgaccaaacacctttgatctacaccaccatccttcacccctacgtgcagaggaagaagaaaaaagaaacaggcaacgaaagcttagttacgtttttgggtataaaaaatagaatcacggttgcattatttttttttttcacctcagaaagtaatagaaacatgcttttcctatatgatataaaatgaaatcatgttttcattatttatttttttcacacttgttcaaaaaataacagatacaacagaatcatgtttatgtgaagaaaaaaaatattttccaaaaaaaaaaaaacgtcaaccctttggtaggagccgataggggttgggatcaataacaacccccataattaactagtgaaatatctcattttctctctatacctgcaatgcaatcaactataccaactatattcttctttttttcacaatatctgattttgatacatcattaatgtaaaaaaaattatatgtcaattaattagttacctctctcgatgtttcttttaagataattgttacagaaattatcaatcttat

SEQ ID NO: 2123 - DNA, 1900 bp, Glycine max
  Soy_ogl_1850 Gm06:8272801..8274700 Cluster 9
ttcaaagattacaactcttacagtcaaaagttgcatagctttactacactgatatttgctagattttactagagatagttttactcatgcatggcacgtcattgactgtttttacttcttaggcactgaattagttatattttattgttataatatgcctataaaaatacctccctgtactataatatgtgtgtggaattagtgtgaatgaattagtgaaattatagagaaaaactcttcctcctgtacggctgtacgtgtcaattcttttctctcttttatctgtgtgagtaagttgtgtgttttcccacagttaacacaaattatgatttctaatactttaataataatcataaattagcttctaaaataatcaaaataggttataaaatacttaagtgtcttattaaacacacggatgaatgtaattgagataaatcacgttaaaaaataaacgattaatatcctttatttgtttcataaaaaagggtgtcatcctaaacaaaaatatactttgtcattttctattttttataccaattatatttataattgatataaaatttattttttatacattgattataaaaaataaaaaattacatagaacaaaggacaataaatataatttagaatgacgtctcctgtataaaagaaaaaaagtaatataaattgttttaatatcataccttttgggtaagaaaaaattaccagtttcatcaaaaagttgctttaattaattacctgacagaaaattaagcatgagaatggcaccagaaatgaagaagaactttgaccaaagcgatcaacaatagcagtggataggatgagaggagcaaggttgactattccaagtattatggtggaaacccacagactgaaagaggttaggagaatagaatgcgacgatgttaatccccgtaagctgctgaaaaagtgggatatatagaaattgccgtgatcaagtctctcaaatatgcaccatagatttcgcattaatgagttcttccaactcggattcgacgtccatgtgggaccctctgactttgcgcatgaaaagcgtttctcgatctgccttgctctattttaccgcgctcaaccaggctgctaggggtgtcggttgcagggaccacggcgaggccgagagagagtcgccacccccacggctgattcgcggtggcgtagtttatgcagccggcggcaagcactccgactcctaggaaaaattggaagcccgtgttcaaagcgcctcgccatttcagaaaggtacagtggcgcagccttttccaaattaatgcaacattataccattaataaccaaaattatgaaatacagtggtactccctcccgaatataaaagaaacaaaaatttcttattttttctctcaaatattaattattcatgtcttatttaattatattatttttaaaatattatttatttaataagattaaagattttttttttatgttcgatatcaaatccaataaataaataatctaaaaaaagtttattttttagttaaaaataacataataatattaactaattttttttataacaagaaagatggaaagagtactaattaaggtgcttacagtcataggtgatggtttttaccttttttttatttattttgtgtgtgtatatgaacagggtattggtgcttaaggttgggactgactaaacactagccaagtagaactgttgcattagtatttaaaaaatatttgtgtaattttttacacaaagttatataaaaaaattaaaaagaaagaaaagtgtgaaattaataaattattataaaaaaataaagaatagaaaatattataaataagtactacttatgtaaatcatattattaactcgatctataattttagtctaaattaagaatg

SEQ ID NO: 2124 - DNA, 1410 bp, Glycine max
  Soy_ogl_5177 Gm15:49567291..492600 Cluster 9
ccactgtgcgggaaggtttccacctgaacccatcactattgtttcttaaagatacaactatacactcactaatattccaggtccaggaacgaatgagctctaattaccaatttgttagaacatgttggacacgaacactcacaaagggaattattgttaagagagtcttgcagagaaaagtaaaagcttattgaaatcacacacacacttatgaattacacaagaacaacactatttatcgtgtgtttaatagtttcaaacaatctaactatcacattaactaactaattgatatttgaattacactgaacaatatataattgcaaacgcaactgtaatctagaacacaggtgctcatttacaatgcaattgaacctatatacatagttaacttttattacttatggttttttacttcttaatgtggatttacctgtatcttttttgcttatacattaattgcacatttctaacaaacttattttattatattttttctattaattttttaaaaaatcaatatcataagtaggatttattaaataaaggcgagacagatacaattttatgatttccaataataaaaaagtatgttagggaatatgtttataaaattctcataattaaaaaggaatcaatggtgggtgggtgtgtgtttgaaattaatgttaacacactgtaatgtaatgtgtgtgaaatgttatttcacacacacagctattaatttactgtaatgtgttgtaatgttaattaatatttttttttaaattagactctttattgaattgggtaatttttgtgtaatcacattcttactattaattttaatattatattatgttgagttttgtattagttgttcctaacaagtattatttttatgttagaattgcttagtgcaaaatttggtctgctaacaagttaagaaataaaagaatgcttgttacacattttattttataagtttttaattttttagcttttaaataaattttaggagggattttattatattattattattgttattttcttggtcatctctcgtcgttaattataacatctagagaggaatcttttttcttagggtaaagaaaatcatctacattcttctatgatgtcaggtgcctttctaatcttctccgagttatctttccattccttttcattatacattgttcacgtttatgttcataacttacaaaattttgcacctcccgcattgacttcaaaaataccaaattaccttaaccccctcccagcaacctctccaaccattattcgtcgttgccaaaaacaatttttggcaatgatgtttcgatattattttatcttctttgttgccaccttcaccatttcccccctcctctcaaaagatccagtgatgacgactccactgatgagcttgac

SEQ ID NO: 2125 - DNA, 1000 bp, Glycine max
  Soy_ogl_6762 Gm20:34919001..34920000 Cluster 9
acccaaatcccctaaactccaaactaccatcaaacactataatccacattcaccaaacaaccatcacactccacacagagctgccatgcaacacccaaaagcacacctcaaacctcaaatttccattgcacagagccactaccacctgcaaaaagaaaatgccaataggagaaaaaaaccaccaccaccataactacatagaatcatcaccaccacaaacctcaaattgccattgtcaccaaaacacctataacacagaaaagaaaataattaataaatgaaaggaaagaaaataaaggagaagatggaaaaggaggctcacaaagtgggaaggagagaagaggttgatgataaaattaggaatacaagtgacgatcaggtctagagattttttttaaaatattagttaatgttgacctagccaacactaatattttttccctaaatattagtagcaacgaccattaattgctcacttttaaattaaaaaaaaagtgagactggaatagctttgtttttgcgctcaaatgaaactttcaaaaattattaattagtgtcggtttagccgaaattaatacataattgaaaaatatatattaaaaattaatgaaaagcgtttttaatagcgatttagtgtcagccaatcatttagtgtgtacatgttgatgctaactaacttatgctaatttgagtttttcttgtagtgaaaactctatctaagtattgaatgagttgcatatcgaatagatcacgaggacttgaactcacttgttaattaaaaataatcctatttagcattgataaattcattatttctatttttaagattctttcaattaatttagcagtgataaatttcattttgaatttttcagattttaaatatttttataaaatactcatttttttggaagctttttatttaatatttatgtgattaaaatgatgttgggagatttattataatattgatatgtatgttcaatttgtgtaaatatga

SEQ ID NO: 2126 - DNA, 1200 bp, Glycine max
  Soy_ogl_782 Gm03:917801..919000 Cluster 9
aggttgctcatgttttcctgcatcaatcacatatataaactcagtcactatactggtagaaatgtagaatcaatgtgagaaaaaataaacagagagagggaatgtgtgagttcaagccatacaaataaattattacactcagatcattatggttttatcgatttttaggtgacatataattaagttttattttttatttataagaattaaaaagatgtataaaaaatttataataattcatacacacaactcaactagttatattccatagactaacatataactaagttgcattaattttttctcatttacaaaaatttaattatatgctattgaaactataattacacgatgcttttgaactatgtaataatttctctcatatacaagcatgagcatgtattaattataacctgacgaaactttgcttctttgagtctgagtcccgcactcaataaccacatagtaggaaggtgttcctgtaatggtgttggttcaaagaaattaacaaaaaagaaatagttttctaaaaaataaaaattaacgttttagattcattgaaacattatattgaaatccacatgctaaagtgaaaataaaggaaagataccaacaaggtttgggtgtgcaatgcctttagcattaacaagaagtatttcgagaattcccgtcttcatttgtcaatatctttaattgtgttttttttttcaatgaatctttgtgtttgattgtgggttctaaagatgaaatttcacagaaaatatttcagataatatattaagtgggtaattaagaggaaggtgacagtttcacaagttcacttaacgtacgtattaattgaggttaccatagagttagtaagtatacatgtgatagctgtttctacacgaagtatgcatgttattaatggtatcctttttagttttagtgactaataatttattcagaaagagttacactttatgtgagattgattattcatttaataatgttgtggttttgagttattggtgccggttttcttttattgagattaagtgaaattttgatgtgtccaaaggaaatttggttgctcttttttttgtgcccctttccaggccatattttgtattttcaatgcagcgtttgaagcaacattaatatttttttcattttctcatacgttcattggcgttggaaacgaaacaaacaaggcattga

SEQ ID NO: 2127 - DNA, 1000 bp, Glycine max
  Soy_ogl_3562 Gm10:427301..46088300 Cluster 9
ctcctaataaaaatgttatagttttgttttgcacgtagaaatatatcttgtatatttaattcaactgttaaatttgaattcatcataaaatatatagtattaaagaactatttataattttttgcctttaaccaatactgtaaagatatttgtggagaagattctcctggttaaaatacaaattggaaacgcagagcagagggctttggtggttgcaatgtgacatcccaaaacaaaaaaatgcaacggtggagtcaaagcgcttgcgggcattgtgtcggtgtatctgctactccgcggaccacaaaagagacatggtcttttggtcccaccaaaagcaattgctatcgtacacgtggcacgattaaacccgatgatgcgtgggaccaagttgacaagtgttgatttctgagaacactcactcactcacgtgaataaagggttcagatttccactctcactcattgcctccttttctacgctaacactttggtgggagagacacccaacacaaaaattctttttatctgctttcattttttgtatttgaatgcacatattaaagagttttaacagtgatagagtcacataggaaaatgcttttatattatcatttaattataattaacggttaatatgattttaaactaattattataaaaattaataatttattatatatgatgaattgtaattaaatgattatgtaaaaaaaattaaattattaatatataactcctttttttctatattaaattcttttgtttatgtgaaataaaataatattgtcgtttagttagttataatttttctcattttttttggtatcgggagattttttcagcaatccaggataatatttatcgtttagttagttgtaaacagaaaaataacaaaagaaattaattttttattatgtaaatatttaatatatctttgtaagatcacgccattatttaagaaaataaataatatttttttatttataaaaataaaaaat

SEQ ID NO: 2128 - DNA, 1500 bp, Glycine max
  Soy_ogl_4589 Gm14:451401..452900 Cluster 9
ataggcgagctataggaatatagtttagaaaaagtaaacaagtcaaagagtcagctgactttccagtccttcaaatgcatttttaaagagttgatttgaaaattgaatgtgacaaataagcattgccaactatatatatataattgattcttttaacataattgcagtcaacaatcgcgtcctgaaatgatcatgcagcctacccactattttataaaatttgtcatcaattattttatttcctggtggaatatatggtaggtcgaaatttgcttacatgatcgatgatcatcatgtcctgttaataaaaaaaaaaacaaactactatttagagagataaaaaaacaaaaatatggtattttgttgaaagctaaaagccaaaaatattatatttgcaaacgtgtgaagcaaaattttcgtaatgacaaatcatgcctgtgactaaaaaaagcgacaataaacattcgggattaaaaaaaaaaaaagcaaacaaatcccccctccgtcagaaaagatagagagaaaggaagaagagtcaaagaataatgttgaaaaggcttctttagtcaataaaaaaaagaaaaaaatatgacatggatatccattttatattatttaacacttagagaaaaaatatttatacaacaaaaatttatgatatcacaagaaaaaagacaaaaataaatatttaaaatgataaagtatcgttattaaaagaataatataatgggtcggggtagagctgcgcataatccacctatcctccatttccatagtcaaagttggtctgcccaaatagttggaattgtaattggaatttgaatacaatacattacatgaagcaatgttgttgttgttgtatgttcctccatcaactgcattaacagtaatacaataatacttattacttttccatacttactatggtgtttccaaactcctctagatttgtgaggtaacaggataaggcactagtgagttttttttttaaaaaaaaaaattgtgagaatcaaagacattatcactagatttacaatatgtcacacactaagttagatttcttgacttttctcttccttaattgaaagtatttattgtatattaagtatatttttattcaaataaatattaagaattaaacgaaggaagtctaaaatctaaatcatatatttagcaaattgtgtgattttattattacacaattatcattctgttactatttaaatattttaacaataaactattataattaatcgatattttttgtaattgtgaaaattaagagtataaaaatttatataaaataatcaagaattagagatacgaacttgaattagagatacaaacttgtcaaaccattcccaactttaataggattgacaaaaaaaaaaaagtttcaaaacccaaatcaaagcaacacaattaaatatgcatcattattttgtattcaatctcaccctaaacctaaattaattcaacccgtgaatattcctacaaaaa

SEQ ID NO: 2129 - DNA, 1380 bp, Glycine max
  Soy_ogl_6294 Gm18:60159421..60160800 Cluster 9
tagtttcactctagctattaattatcaaactcattttgtatatctctcaaaaaaataaactgtatttatttaattttaaaataacacataatttttttttagttaaaaactttagtttcactttttgtttccccaaagttatctgtttggacacacctcgagaaagatcgtgaaagtttggattttaggtgtttacatatttatgcaagctggattgtcttattgatattttcagatttgtttccaacacagaaaaaggaagacaccacgtgagatttgaggttcagcttactaggttgagttgtcaatgaaaatcacaaataaaaaacaaattatagcgtttcataatagaagatgattcgattttccagcttgtgcgcaataaaataaaggcaacaagttgccaaacgtgtttataaaaaagagaacaaattagtacagatactttctggtcctcagtctaagacgcaaatcaatagtctaaatgaaggaaaaataatttactaaaatattgacaaaaataaaataacttgtataaaatgataactgaaactagttacgtttcttaaatatatatatatttaattcttctaaaacatcatcaaggaggtggagggtaccactcgtgaagtttttttctcaagaccaaaggtgctggtatctttaaagcaaatcaatcattaccacttatagcaagagtatcatatgacaatcccaaatatttttttagatgtatatattatgtaccaataacaatcttacaaaaagaaaagagttgttacaattaaatacacgcgaaaaataatataaatttctgttaaatttcagatgataaggggctttatttcttaataaaaagtgatttaaattataaatagtatttaattatgcatatttattttcatatattttctcggctattatcgtataagttattgaatgaaacactaaacacgggcattaactaattgaaaatcatgtcagtttagcatatgaacttaaattcaattcaaaatatgcaattaaaattacatcaaatgctaagaatggagaggtgtgtggatcggggaaggttttgttgttagagtgttttttctgtgagttgatatggtttgccgtcatgctaagaatggattaatggagtaacaagcataagggcattaggagtaatgtagaaaagattaaaataaaaagttggataattattttaatgatatgtcaatatatgattggtggaacatgaatttgggacacaataaagacacaagtgatttgaatccattttttattaaaataaataatcattttttatcgttaaataaatttattttaaaagataaaaattcaaatttcacattaactttttatttttattattta

SEQ ID NO: 2130 - DNA, 1200 bp, Glycine max
  Soy_ogl_3641 Gm10:49095301..49096500 Cluster 9
tataaatagtaacaatgccaaattgtaattgggaagcttctttctctattttttccccttttcttaagcaattgataatttttttttttacttttcaaaaacagtttataagtttttttagaattaaaaaaagaaacttgttgatggtaaaaacagtaagataaatcatagatgggtgcaactttctcaaagggacacgctctctaccttctcgagatcttggtcacaagttctttgtcttctctattaattgaaacttgaaaatacttgtagaaatttgttatttaatttgtgtgtacttgtaaaataaagcgtccgtatgaatacatttataaaagaaaaataacttttgaataaatttatttaattttgtgtgttctctttattctctaagtgtcagtgtttctaatactttgttaaattggattcaaaatcaaaatcaattagggaaggaagaaatgaaagaagagagagaaattgcataaaaatgtgtacttttttaatgaatggaaataaagtttgaaattcatttctaaattgcacttttatatttttctaccactgcatgataggctctaccactgaacaagaatatgtgacagaggccatcaccctggaatttgctaaaggataaatatgctttgatgagggcaagctgcatgaacaagttgcacctgacaagatttttgcttgacaatcatagagtaccaacatgggattttaaaatccgattaaaattaaaagataaaaagtatccaatatctatggaagttaaacaaagattcaagaaaactctcaatactaatatttatcctaaaatattgtatttttatacttatttgcataaatattcctcaatttagccaattaaatttacacacactcggcatccggttttttttatttacaatgacctccccgccccccttttttatctatttttcaagcttttagctgcatatatttgtagccatgcggccaacaataattgtgatcttcggaaaagttccttacaattttgtcaacattccaataacatgtgtttataattgtaaaatttggcccgttctaccagtaaatgtaactatagtatatttattaataattaacaagataaggtaaagttttgaaatcaaatctagtcttatcagagttcaaagatatcccttttcaagaccaaccgccagcagcagatgtttt

SEQ ID NO: 2131 - DNA, 1100 bp, Glycine max
  Soy_ogl_4628 Gm14:3831101..3832200 Cluster 9
aaagtttaaaggaccaaaatcaaaatgatcttatatttcatagatcaaaatcatatttaaactttctttaattagtttaatttaatgagtctttattgattatcaataacggccttatccacgatgttgctgaaaagagaaaggaagttgcaaattgtaccctgcctaccatagtgttagtggccataaagagaaggaattaaaataactatattgtatatatgcagcccaatagtaatgaaagcaaacccaatatataaacatccaaaatctaaaggactaggaggcagtccaaataggaaaaacacaaagggatttgaatccagcacatgcatgtgtatcttgcacccctatttttgtttgaaaatactaaactacccttttactattatagaatgcttatttcaaaagttattttttattattatgaaatgctcattctaaaagttatttttttactattctgaaaggaaaaaatattttttcttgttatgaacacttattctagaacctattttgtattgttatgaaacgtctattttaaaagttattttttattattatgaaacatctattctagaaggcaaaactatttttcatgttatagaacacctatttcaaaaattattttttattattatgcaatgcatattttaaaaaccattttttattgttatagaacatctatcatgaaaggaaaaaatactttttacttattaactatctatttcaaaagttattttttaatgttatgaaacatctattttaaaatggtataatttgaaaaggataatttgaaattcttaaaaatttgaaagatccatgattcaaatcccaatcggatagtctcggtccagtccaatgtatgcccaggaaaatgcaaatagaacccaaaaaattcacaacaataataaaatatgtgaagatgattgctcgaggcacgttggagatggtgggcttgggcatgattgattgtaacgaccgaaataaataacaacaaagctaaatgatgtgtaatggaaacaatgctactccttgatattcaaacttttccatcgccaatattaagatatagaatccttatcacgtttattttaaaa

SEQ ID NO: 2132 - DNA, 1805 bp, Glycine max
  Soy_ogl_1836 Gm06:7563696..7565500 Cluster 9
catcataattacttacgaagtttcttcgatctttcttcagcagtacacctgcagcaatgagggaaaaaaatacaggattcggatggggattgggatccatatggtaagatttttttatttttttaattccatatattaagatattaaatttaggccattataaaaaacaacaaaaaaaaaataccgaaagaggatctaagtctacttgaacatgtggaggactattattattaataattgaattccacttgttctaacttggacagatgtaagccacagatggaccaagaggtagggcataaaaaagtgggttgataatttcggtctttcgtatcctaaaaatttaattttaacataatgaaataattcgcctaaaaaacatattgaaataaagaatatatttgtacttaataaataataatatattatttaatggaattacaaggtgcaggaacggatccaaaaatatatcaagggacatagataatgaatttaactaaatatttattattttatgcgtaaaaattaaagatagaatccatgtagaaaaaaaattagtaaatattaactcaaaaacatgtattttatttatttttctccattaatgttttttttaaatttttttccctctcatttacacaaaggatctcaaaggagggggtcaagtcttatggtaattaggaaaaaacatagggtgtgtttgagaaaaaaaattacgttgaactgtaagttacattttcacaaacataacaatggaattacttatatacttttgttgctttggaaattgaaatgcacaaacttatgtttgatgggtttcaaacgaaaattcaaacaaactaagattttgaattagaatctttctcgttaccactaatataacattaactattaatatttttcaataaaaaattcttaaatatgacacaagactcacgacatttaccctttagatatcaccaattttacttatatttatgttggatgggagaaagtgacaagtttttattttccttatttttgttctcgatcctcaccttcaaattttataaactcaaaattcatatattggtgtgtatttataaataaatttattattaacatgtttaattattccacttcttgaatataacattttttttagttttgaaaaacgccatataaaacagagcagaagatttcgtggaccaaaaaatcgcgtgagcttagtctccaaaaagaggacaaattttacggtgcacctatgaattaggtggtgcaccggtggacaatcaaaattttgatgaacggtagcactttttcagtgaaacgtaaaaatagttttaaaaagttaagtatgatttaattataatatttaaaatgtggattatatacctaggtttaatatgtggacgataggaagatggagtattcttgaggggtttttgtttttaatctccttgctgcttcgtttgggtcactgaccgagtgcttcataagtagaagtcaataatatttaacatgccaccgtaacagtaagtcagtaactcccttccccacaacaataacaaaataaataaatgaacacaagcacagtcgaagcggagcgcttgccaagggcctttgtgtttggaactttgggctccaatgggcctcggcctatggttcataatggacccaatcagtggcagttttgagggcattgctttgcacaccagccaaactgcttgtgcacccagtgctttttttcttttccaaaatcatccctgataaatttatggatccataatctatatgggccccaatggattttttttaaaaaaatt

SEQ ID NO: 2133 - DNA, 1221 bp, Glycine max
  Soy_ogl_2201 Gm07:4965780..4967000 Cluster 9
gcaatacatttagaattaaggatatgtttgagaagtcattttaggagtttaaaagctagttcgatcaacttataagttggtttgacaaaaataatattgttttaatattttctaacttatttttataaattactttgactagtttatatatagtttataagttcctaattgcttttcttctttcaattgaatcctcattgatttacttgaaattttttttaattactattttctttttatttatttttcaagattgccatctttttaacttataatttataaactataactatcttataagctttcgatcggctaagtaataatctataatttttaatatattactctttcctcaaaccacttaggacttatttaaaaagactttatgagtagccgcgatggaaaattatgtatggatcgtataacatatgtaatggattaataaatgagctatatattatgcagaatgtgtggagcagcctaataatagggtagattttatgacctagcaatttttggtgtccagaactcctcaaatggcaaatgtgaaagttgaagttccaactagaatggatgatatgctaattattaaaaaaaaattgtaaaccaattaattgtttaaacacaaaattaaacaggatccccatcacaaaagaaaaagaaaatgccaaaatctaaaagatgaacgagttagtcgtattcacatttttttttatgtgatttacgtgacaggggcaacaacttgggttggtggtgatatagccacaggcaactacacagcccttagagggacaagacacatttgacacatgaaccagaaattttttggtgcacattgctgagacaatgcagaaaccataacttgagtggtgcccgtaggagccataacttgagtggtgcccgtaggagcactagctagttacttttggacgggggaattgaaccgaactttagtttaaacttattagaaaaaattattgggaggaccacaaggtatcaacttctatcacctttcttcattgtgtctgcatcctttgttggtgagaaaaccttttgtagccacttggaaccctaaggacaagtgctggccacactttggctcttttgctcccccgttgggcccggattcaactgatgttctctccatggagtggtgaattactttctcttttgtttgattttagtttttaacgtgtccaacgtttttaaaaaacaaaagat

SEQ ID NO: 2134 - DNA, 1380 bp, Glycine max
  Soy_ogl_6579 Gm19:44833121..44834500 Cluster 9
aaacatttaacaatagaactattttattggttttccaccctaagccatatatactaattatatgtaaatatttaatagattaacatttaaaaagagctattagtatacatattttttttggtggtaaaattagtatttcatgatttatttatacacaaacttatttctatatccacatgccgtttgcaaacatgcgtaaaatgaaaaaaaaaaaaaaccgaagaggcagggatacataactagttaactaaaaagctaggatttatgatcctaatctgagacatgcaaatcacccttttgatttagtttgttcatttttacacgatgatgtacatgtgtatgaaagtaatttttacacaaaaagaaaatataagcataatttttatgagtgtatattacttactctcatgaagacgaatgtgtaaggtggagtgagagtttgtcggaagttggttagttgagactgattgagaatggaacacgggttagttaagctgaatgtttagtaaatgaatatattttactttatttttaatttaattttcctattttgttataagattatttgattaagagattgagtaaattctaaaagaaacaacatttttcaatggttcaatgaaaagatgtgagacattttatgagtatgaggttttgagaagagtatatagtgtgagattaaaaaaaaagttttttaaggtctttttgaagacaaagcccatgccaggtcataattagattaggccataaaaatccatatttaatttgtgaacaaaattttagttaagctttttatttattttgcacagtcaaaagaatagtatattatatgaaaaaaccaattagcctttgacacaaggagtgacaaagctaaccaagagaagtgttaaacatagaaaagtcgtgtctgatcagcactacatttgccaaatataaacataaaagcctccaacctgcatatccaattgccgaaaacatttatcctcccatgcagcagattgattttgaatgtggcaactttggaataatgcagataaagatgaccaaatccatattaagtgcagcagtttgccacgtgaagaattcaccctgcataaggatctccctctgtcaaggttaccaacaatgattcaagctatctaaggggtcaatgcaccaactataaagtgatatatcaaagtcatttacagtgttgcttttagccaagtccaagcacagtacttagcagcatccaaaactgcttccttccaaatcacagttagcattattgaacacaatgtcattgcggtgtttccacagagcccaaacgactgatagccaaaccacccaccacgcaaccttgatctttgttactcctcatattgccacaatgttgtaaga

SEQ ID NO: 2135 - DNA, 1300 bp, Glycine max
  Soy_ogl_252 Gm01:264801..266100 Cluster 9
taagattgattggtgagcctgctattttcgaatggagtctataattttttgtctcatcttctaataaataagagaaagattagactctctcggcacttagaagctctaacacacgtacatttttttctcatttgcctctaataatcaccaccatatggagcaaaagcaatatttgttgccccataggccaaagtttgaggagagagaagttgtggctgcacaaaagcaagatcgtgggttttcattatctccttggccaccatcttggggaggatacaattaatcactgcagaaatttcacatagttgcaggtgcatgagaggttcatatttatgagcaagttctcgaagagcatgatattgaagtgaacctgccactgttagcaagttgatgcaggttcctatgagaggtaacttccttgggcctggggacaatgtgtgactggattttgacttgtactttttaatgagccaatgcaagagcaagaacaaaaagaaggtataataacaatgcgtaattttattattctaccagttaatttaatctttaatattaagatttataaattgtaaatcatcaattaatttaatctttaaaattgtaatgagtaataaaatcggtccctaatttttttttttaaaaaaatcttcaactataaatcatcaatcaatttaatctaacgtcattaaatgagtagaggaatagtaaagacgcgttaggatgggaaaaactaattattattctaccaatttaaggtcatttttattcatgtgacgtaagtgaaactagtttcttcaaaaaaaaaaaaaaaaaactaagtgaaactatagttggtttgttacttaactaacatttaattcatttcagtctttttgacaaaattaggtgatactaattaataacgagagaactaagttagttgataatttacaattttaggagtcattttattatatttttaaagttcagacaataattttaatggctaaattaatcatccactctttaaaaatttatattccaagatttgaacgagtccttggtattacactattatgtaatttttttaagtcaaaatgtatacgtaattaaaattttcaagataacaatatttaccatagaataaaattaaaataaatattcttatggtatgagcatttattagaggataaaattaaaataaatattcttatgatgggagcatttacaataacagaaaggttggtcattggtaaggaacacaactcccaaacatcaagtatgaactttgatatgaagtaggtcattcatattattgatg

SEQ ID NO: 2136 - DNA, 1264 bp, Glycine max
  Soy_ogl_645 Gm02:44476001..44477264 Cluster 9
gagttttcacccaacgtatccacaattcagaataaaatgaagatcagtcttgaatattcacctaaggttgaggtttcagctagtgaatctttgtaagagatacatgtgtagttactgatgatgatgtggatgtgacaaatggaagcacggttggttcttttgaactttctaatgaaattgacagaggttaagtttcttacaacttcaattcaattggaatattgataatgttgtgttcgtattttatcacattaagaaaaattacttaattacataaaattgtctaatttcattatgttttttcttactttacatggtgtcatctattcttatacttgaaccttcttgttgtgagtatgttaatcaattcaatcatgcctcagttctagatccttcttttatgcatgacatcacaaattatttgtaaaagaaagttctaggattgagataagattaagtttattagcatcttttgagcaagaagattgagtctaagaacaaatgattcatagaggactgaacttccactaaatgactcaacttagatcctaaaatattattacatataaagtaagaaaaaaagataatgaaacaaggtaatttttacgcaatttagtaatttgcttaatgtgatataagatcaacacaacattattagtatatcaattgaaaatgctagaaacttaacttgttgtattgcattgtctttgtgaattgcactattgttgccttttatcaaaacatggaaagataattcgagaaacaccttattagaaggatcagaagaattaattgtattttcatttgtcacatcaacgttaattgcacttgtatctcttatcgtatcagttttattctgaattgtactaagtttggagaaaactcatcaacttttaattttgatgaatgcaaagataaagacttcacaccatgtatatgatcaggattctttgttgccatttttctctcgtgtttatgggtctgttttggaataataaatcgatcatcaccaaaaatagatgttgggcatatggaagcaacaactatctatattttctactactttttgttgaagcatatatccttatgaagtaatgttttaatgacaataaattatttctaagtcttttagacttaagctactaatggttagtaattttttaaagataggacttgatcaagaaacatgaagaaaggtgagaagcatcaatttgaagtgtgttacccttccaaaaataggatttgctcattagaagcaggatta

SEQ ID NO: 2137 - DNA, 1200 bp, Glycine max
  Soy_ogl_2170 Gm07:3898701..3899900 Cluster 9
tggacttcattaataccgtctattgatgataaggtgtgtccaacagcttggcaaaaaaataaataaaaatagaaggttcaatcattaggtaaaaaaaatattatggataaatggtaaaattacaatattgttaaagttgaacaacacacctgaaaatcttaaaacacaataattaactataatggttctaaaaattagatctttaaaatcatatattctaatttttactatttgttaccaaaagaaaattagagcaagataagattattctacccaaactcgctatgtataagatcctaataatgtgattaattgcgcagattgaccacggctgtgctaatttgattaagttcttggtcgtacaaaatctgttgtgaggtacgttagggataaaaacaaattattatggatgaatgatgaaattataatattggtaaagttgaacatcaccactaaaaatcttaaatagtagtaattatgtatattggttgtaatagttaaatcttctttaaaatgatatatgttttacaattatcagtaacaaatcacctctttaggcacaccaaaaagtgatgaataacaccctatacaatttttatggtaaattgagaaataatatgaatatgcaaaacaaaatgcaatgcttaaagtaaaaaaataataataataaggaatcatgtctgacacagtggttcgagatgttctagccagcaattttggcttggaggaactagttgatgttgcctcttttacccacgtgtcagtggtatagatctccttcgttcagttttactctttctttcttgttattaactttcttctcaattttttttcttcaatttatcaaaatctcaaggacttggtcacatatataaaaaacagttctcactgatatattccacgctggccaagagaatgtggaaactagactttttttttttgttttttgttttgattaacatgtgctgcaatagttctagatccaaaaaacattagtaagtaatgtgtaagtttttgaaaatttcagttggagggtgaagtggtaaacggggatgataagaaacgatgatggcgattcttcccacttctatttatatattttcagcaaagttttctaatgttattttcccttgttgggatggaccacatatgcattaatgtttggtataattttggtgtttaaaattatttatttacttt

SEQ ID NO: 2138 - DNA, 1100 bp, Glycine max
  Soy_ogl_6742 Gm20:34336701..34337800 Cluster 9
tattaaattttaatgttatttttttctaagtaatattaaagtgtttaacatgacttgtctccatatcagaaagaaattgtcaaaccgtccaattctaaagaatcttcttatctgcatgtgaatatctctgggaagtaatataacccgaaaagacggtctctttgccccatcttttggcaccattccattcatacaatatctatctaaaaataataatgataataacaattcaagttcctataaaataatcagtttttatgtagtgttgataaataaagatctacatcatcaaataatacaatcaatcaactcgaggggaaaaaaaaaatcaaagcttatatcatctgcgaggaataaggacggtgcatcacatcttcttattttattttattcttccaatctctgaatattttttttaaaaaaatacactgttcgtataatgatatgatgacgagaaagatagagagacgactgaaacatttaagaaataatacaagtagtacaattgaagtatatagttcttttttttaattttattttgggagagtatttttaagaaatgggcatactaaaaaaattaaataaatgggagataaagattatgtcatttcttttaaccaaacacatcctacactcttcattgacctcaaactcattgtgggtaagcttaaactccaaactaagcacttgggatgtgtttgattaaggggaaaagggaaaaaaatagaagaaaaaaattatgagtctcacacctcttacactctactttaattttattttatttttctatttttatcttctcttttttcatgtttcaaaacaaacacatcattaactctagaattgaccttaagcccatcgaggaccaaactcaaactctagactaaacactttactcttttatcgaatttaaggttatagcgggccaaggtcagaatctagaccggtcacttagctcttctgttgatcttaaatccatcacgacccaaacccaaattcttagttgggtagttaagcccaatttgcaacaatcatgagctgaacttagcctccagacactaatcatgccataaactagaagatatacaactaggcgcata

SEQ ID NO: 2139 - DNA, 1000 bp, Glycine max
  Soy_ogl_2408 Gm07:38105101..38106100 Cluster 9
tagcgattgttctgctttctacaataactttatatatactcatgttaagctgcaaattgaagttcaaagaaatccgtgagtccacattgaatccttatgctctaaatataattgataattaatgtgaggcaattccctgatatcatgttcttacttttattttattttttaaagttgatcagtttggttaaacatctcatcaatttgcatgtagcatgaaataactgacctcaataatgcatgcttgttgtgggagctatggagggaaaagaagacaaacgtggatcaacaatttgaatgccgcagcccaaaaagagaaaaggctctcaatacttggtttgtatatcgacatattttagtttcttttcgagaaaatcaaaaataattttgtggaacttttttacctttgaggcaaaagtttaacaaaaatagttttatcttaccaattaaggattaaaagataagcagcgcctgccgcggcaaatgccccttatgccttaggttactaattaagaaatcaagaaagtatgattattatactctttatcataattttcatgtaccttaaacatgttaatgaaaactttatttattatttgtttaattaatgcattagaatattggataactagagtcaatttttattgaaatgtgcagaagatatgtataagaaattaaagaaagcacagggtatgactgtcttttatcattaattcagaaattctatcacagattaaacagaagccggaagcaactcttttttgtgtagggttaatttaatttccttcatttgtatcttaattaatagctctttgcagaaaagggaggggagtaggcccaccaaaagccaaaaaatgtattaactattctgtttccttgcaggtgttccaagttacgcaagtactgcaaattttgtcgtgattgctttcatccaacttttcttagagtcactcaccctttcagcatttattcatcttccatgcatgataatgttgaattt

SEQ ID NO: 2140 - DNA, 1122 bp, Glycine max
  Soy_ogl_4530 Gm13:37909201..37910322 Cluster 9
gataacaaaaaatgtaattgaaaacagttattaaaactttttaaaaactattccttttgttacacaaataaaaaatgagtaaaaggagaagaaacccaaaaaaatttatctcagttcataatcaaactatcaatgttacaaacaatttacatgaattaaaccaccgtctaatgagttttagacaccctatttttttaaacaactcattaatatttttaatttttactctttttttttctgtcacattattttttacaataattcttatatcacattatttttttaaaataattcttatatcacattatatatatcacctagtatctatttttttttatcttttatccctctcctaagtgttgagtagtatttgaagtgtctaaaaatcattgttgtactttgaaaaaaaatcatttttgtaaaccatataatccctcccaatacgtcaagatatcacagaaagtacgtgccaatggtgccatgaacttgtaaccgagacataccattgagaagtacgcacccaaatgatcagcataatcaaaccaagctacattgtatcagagttccttcaccctagcttgatgcaggattctacatgtataaacagggtttgccacacaccaaagctccaactgtacgtgagccaagaatattgcccgtagatcccccacaatgtgtttaccatttgaagctcgcttccatatataatgttcgcgtattcagaatttgtgttgttggtaaacctgattgaacgtattgacatggctgaatcatatatatatatatatggagttcaatattgtttcttcaggaagtacttgaaaaaaaaattgaacaactcaactgacagatcacttttgaatttttgagcccaccacatttagaatgtaacaattagaaactccaaaagcaagaacaacaaatggcactgaaccataacagcataaaaacaatgccaactgaggtatcttccttccaccatctagattctactccactgaaataaatgtcccaatacacagcaccgacacttatgaaatggtaatatcaccacaacgcattagtcagaaccggagtcataaatatcccgaggacggatccagaaaccttataaggggactg

SEQ ID NO: 2141 - DNA, 1500 bp, Glycine max
  Soy_ogl_5579 Gm17:8161301..8162800 Cluster 9
tatttaaaatagtaatcactttttaaataaaaaaggataagaaatatatagaaagtgaagagactatcaacttcatcaagcatattctccatccaaaagataagtgtcttttcctccatgatgatagcttcctccacatcttttcaatcaccggttgataagtgctaattttctatgcaccaccccatgggtaggtggacccaaataaacaaacaacatgcccgagattttactatgtaaaaccgaagcaaatctatctaactttgcttcttccacatgtagcccattaagttacttttggcctagttaaccttgagctcggatgctaattcaaagcacctaaggattattttaagggtgatacaatccttcatgtcatccctaagaaagaagatttaaccttgagtcaagatgctaattcaactttgagtctctgtttttattttttccctttctttggtctcaattaacacattaatattggaaaagcaacgaacaattgcattgttatcggtgtactccgtttccacataatacgttccaaaatccaccaaaaaaatatatactagtacgaaagaaattattcttttctctctcttttttttttcttcttttacacacaacgcgattattaaatatatattactttgaaggaatttataccaaaattaaactagaaattaattaaaaacgtttctttcggcattatcaatctggtcaaatcaaaatcaatggtgtgattgggaatggactgttccatagacgacataattttttttctacaaaaaccttctcaaaagatataattaatttattgtttttccactgtaatttgaacaattagcagcattatttgacattttgacaaaaacaaaaatttaaaaggacatgatttatttccaaaagactaaatacaaatattattctatttaaagtcaaatattatttgacattttaacaaaaatttaaagtctcattttgatcccttgtttccatataacgcattttcataaaataggaattaaaaggacatgatttatttccaaaagactaaatacaaatattattctatttatgaggacaattcaaacatatttaactcaattataaaaaaatatttaactcaaaattttaatagtgattttggtacaagaaaattaatatgcaccggaaatcaaaattagcatagttaattccgaggattttcacaacggtgaatttgggacaagaagagacaactatgtgatcgacgtcctgccatggcatgttggtcatggtcagtgagatcgcacttgaagacgaatggcacaggagcacaatgtcataaaccactctaccaaacaaattatgataaatttaaaaggattttcgtgtaagtttcacatcattatatgtgtgttgcacatgtttcatcaaataatatacaaaataaaaaagttattttgtaacttaggtaattatcgtgtcatgtactcttcttgtcctatgccacaaaaaaaa

SEQ ID NO: 2142 - DNA, 1755 bp, Glycine max
  Soy_ogl_3182 Gm09:38929160..38930914 Cluster 9
gataagattaatgaggtgatataaaaagcaggaagatagaccatttaggataaaaaaaatatcaaattattttacataatcatgacaactcaacaattcaccgtatatgataaatttattaatttttaaaataattcaaatgtgatttgtgattgagtttattttatactatcattacataaatattaaactcattattattattatcattttaaaatgctgtaatggatttttcggattcctataaaacttgacgaaaatgagattgataatcttaaaatataaatttgtttcttttaaacttagatgtggggagagtcaaacttgttccgctacctctcgatctctactgctatgtccaaattggactagatttcgttggcttcttacacaaaaaatgaagtcattttagaagattgtttctgtaaagtttgtgttgtcaaaaaaaccaaacacttcccacaccatatataaaagaataaaaaaagtggatcgatgaatcaagaatctaagaatcaaataagtggatgaatgaagaatcaaacggtaaaaggcaacggcagtagacagatagataaaagtggttttgaaaatatattacagaattagatgctacatagttaaaaatttcttttagaaattgcagaccggtaacaaaacatttataatgctcaaccaaaccaactaagcaccttcttggtataattaaattattctgcagaagaataacgtttccaaagactgacaattctgcaatgtgtatttataattttgctatgtgaacatacaagccattctaaccagtttggtaataacccaatattaatttctcagtaagtgcacatgcactacattcctcatattgaaagtgatctccaccctcaactaaacttatccattccattccactttgttgatcagtagaaatggggaacagtctacgtgttgttctggaaaattatattgggagtgctccatttccttgccatctacagctccaaacatcatcattggcctttctgtgaatcatcgttctaacaagtggatgaagacaaacacgaccactgatgcatggggtggcgctactgacaccaaggtttacttgtatgggagtggaaactgcaggatgggtcttcttgttgaggtgtgccagaaaaacaaaaacagtgcccataatgaagaggttaatgcagtagttattatggcgcactattttgctaacagtagcagaacagcttttaacggatcatcaactgaatcagatattggcctttctgtggtcgcaaagtttggatcattatccaatattaatggcgatttggatataacagtggagggtccttagcaacacccttcttctgcattattttacatgtttgatcaagtcaatagaaccgggatttggaagcctaccatgtgttggcaaatattttatttgtaattttatattttaaatatatattatccttttcttaaacagtttttctaaatatattatgtttaccaactcaatttttttaatccgttaaactcctattattttgggattcaatattaggtgaatattttattttattaactttaattgatttgttaagcttgtttttctcaatattggaagtaacattcacagtttaaagatactacacgttaggttgagcttatatatctctttgtttgtttagccaagaagataagtagaaaaaacatgtttgttatgcactacaaatgacaatattttccttcatctaattt

SEQ ID NO: 2143 - DNA, 1500 bp, Glycine max
  Soy_ogl_2628 Gm08:12354301..12355800 Cluster 9
ctttataggaggtcatgttttacatttgtgtcattttcaattacattatttcatctttgttttgtagttataaaccataacaacttagaccaaagtaataaatgaatcaagctaatgctttatatcttttgattccttttgagttatggttcattctggcatattgttggttacaagttacacaggatgcgaactataatgcaataaacataactaatatatgccgaagaagactaaaccaaaagaggaaatgataagttcattaacttaagtgttgtcttgtttttgttctgtagcatattaccttcataaatatattatgttcttcaagtagtgctaagcttcctataagagggagaatgtctttatttgtttatgtatatgcaaaaaagaaaaagaaaaatttatacttttcctgctatgtttccaaataaacaataaaatctttttaaaaaaaaaaaaccaaaaaccaacataaaatagaggcacatgaaatgggatacttttatgtaactagcatatgacactttggtctttctacaacaactcttcaaacttgaagcatggacaaagcaagcgcattctcaagattagaggaagcatggataaagctctaaccgtttgatgaaagagtccacttagataccaagtcaaagattcatggtgtataaccctaatcaaagattactatcacagaaatccctaatctttaatatgagaagctcatttgttcatgttgtatagtccacctaagcttaatatcaaccaagaatttccactccagagtctctactaacatcattcacactataaattacacaaaattccagaaaaagaaactgaaacgaaagcgtgttgattcatctaagaacttggaatttaattaaaaacccacaaaagccacaaatccataaccaacaacttgaagaacaaagaacaaaaatgaagaaaaatggggttacataaatgacatgaacaattcaaaaaataaatgaaaagaacaaagaataaaaatgaacaaaacttgagaagagacaagaacttggcacttctggtgaacaatgaggcgcattttagtgcgattgcatttcaacgttaatatgatttgagaaatattactgtgatgtcataaatggaaacaccctattttcgtgttttaatctcttttcaaaagataaaaagagaaactaaaaacgagaacatttaaaaccttttccccctttttttagttttaaaattaaaatttgagaacagttttagaagacaattttataaaatttactaaacaaaaaagtttttgatttttaattttttagaagctaaaaattgttttcgaaaagtgtaatcaataaagtcctaacaagttccagagggaggatagttttgaaaaaaaatatataaaaatttggagaaaaggggtgtactagtaaaaaggggtctatatagcaattactaggcttgggcttttcggttaggctaatacctatccccaccccaagt

SEQ ID NO: 2144 - DNA, 1600 bp, Glycine max
  Soy_ogl_3651 Gm10:49399101..49400700 Cluster 9
tagacaaaagcccagtctattacaagtaaaaattataaatacacattaaagatctaattccaattattattcttacttgcactacttatctttaaacactaaattcacctaaaagttcaacgatgtgttaaagaatattaattattattcaacatttcaaaaacttcatatcgtattcgaaaatatgatacaaaagtgaatgaatttttttttattttgctgtaaacatggaaaatattcttcttcccatcatttggaatagatttatcagtgagattttcaacagttaaatcacgtgcaactgcatatgttaattaatgatttttgtttccaagtgcaagtgcgaagctttcaccgaggataaggtgtacacaaaaaaagaaaagaaaagaaactaacgataagggcataaatatatgattagtttctgggcggcttttatattcgcgaccaaaaggcaatgcgaaagaagagaagaaagacggccaagtggaatgaggtggcgattcgatcttatccagaacgaacctagacgcccacgagtaaaattcctagtgggatcaaaagttgttgcttcaagtgttttgtcacttggatttcttaattagttgaaggaatttctcacttgaatctcttaattaagatataaaaagtgattaattgaagtagttcccttggatattttttaaactgaggttgatactttccagagcgagcgaatcagaagagggagccatcaagccgcatttgaaaggtgacacttgtttttaacacgtcattgtcattcccacgagccagacatcgccgacaacttcacacacctcaccattcaccaacccaccccctcttcaaccctatctttctttttcaccccaatgttttcaataaaggcaccgaataatatcatagaatgacaattgaaaattcattatccatgctagcaacttccaaacatttaattattgttttaacttatgtaaaagtttactttttacaactattcttttgtattgtgaaccaaaaatatgttactaggtggagtagaattatatttaaaacttttaagtaaaatcttgtctgcaaacttttaaatggacttttttatgttattgttttattttgtgaaccaacaataagttttcatatgtaataaaaaaatcatgcacgtttaatatttcaatttcaatattatcatatactcgtattgatagtagaaaaccacaataaagaaaattaataaaaaaacttgtttcaccactgtaattctaaataaatactagctaataatgaacttgtataatttatataaccgatcttatttaattagtgaaatgaaattttatttttgttgttggtgatgttgctgtaagaagaagaaaaaaatattctcttgtgatttaaattcaagaatagatataagcataaatacgttgccggaaagatgcttaccccccaaaaaaaaaaaaacgttagatgcttaccccccaaaaaaaaacgttgcaggaaagatcaaggacagttatattgtttcaaagccaagttttttttttagtatgtagaataccattgtgcgcatacttcttaaaaaatctcattaatt

SEQ ID NO: 2145 - DNA, 1602 bp, Glycine max
  Soy_ogl_6240 Gm18:58097499..58099100 Cluster 9
aggtatgaaatcaaaatttgaaaattatatatgatgtgtttttgttttttagttttaaaatttaatttagaaaatatttttcaaaaattaattttcaaagagtagaaacatttgggagtacaacaaaaaaataagtagtagaaaattggaagtaaaaaataaaataatttaaaataattatagtttttattttaaatacttaaaagatatattaattttgaaatcaattctaaagcaacaaaacacataaaaggttgagcttcccttcccttgttaagttccaagcttggatttccttaaatagagagaaggaaaggagggcacttttagtcagaaggagaagctttttttcaacaatcactctctcactacaaaggcacaaaatactcctaaagaaacctcaattagattttgaaccaaacatctctcatttgcccgggttagctcatagaaggatgaaggaaaagttaaaaaggaaaaaacttgctattacaattgagtcaccaagaacccaatggttaaggaaaacaattagattgtgaggaggctccacaatcttctatagaggaatgggggtgattgaaagagatcagagaatgacttggggaggaagagtgtttttcagattttgtgccttggggcaaggttttaggaaggtttaagggcttttcttcaaggttctacttaccacatcccttcctcacaactctctctgaggcccaaaaaaacagcccaacacaatacatttaatttctcctgtaatttaattaatttcacttagtaatgcattaagaaaattacagtgttataatttaaattagatcggttttcaacataggaacttaaatttaatataatctaatctaatatgaaaatcaccattttttggtttagttttttttttttttttgcttgttgattattagtaattcagtttgattatcgtgatttgtattagattaaattagaatagttgataaataccccacccctaagaaagagaaaagagaatagactaacatgtttcaaaattgaagagtataagattaactaatgcaaaaaatatatttttttcattaaaaatgttccttttactttttttaaacttttctaaaattgtatgtgacgtaacatttccatttcaaaagaaaaaccattacaaaagccaagtccaaagctaccacaatatcaaacatatcttcacctactaatttaccttaagcattttttttataaagatcacaagtattttttttccaagagtttgtattattcaaagtaagataggataataatgagtgataaaattttccttctgagtattatacaattatatatccaaaacttaaattcatataatcgattaagctagcttttccagtaaaaaagaaaaagaaaagaataagctagctctgtataagttgatttgctaaccattgttaatttctggcaattcagtctaatttaggaaaacattttaacgggtatttataaaatgagtaaatcaaacttcttttttttaatttaaattgaacttataccccttgacttttaaaagtttattcatcgaatgtctttaaaaattaaaacgtatgatttaat

SEQ ID NO: 2146 - DNA, 2640 bp, Glycine max
  Soy_ogl_1351 Gm04:42657561..42660200 Cluster 9
caattgatatccaaataccatatctagcatgtcattaattggggccgagcttcttcatcatttacccaaaaatataactaagttacatctcatttacatttcattttagaaaaacattttgccattcaaatagcatgaagtgagttgaaagtaattttgcatgcatagtataaaaaatttgtgtttacagcgagaaatacaactgatccagacatttctccacaaggtaattattgttttatggattgacatgaagatttctgtctcgtgcaattcaggggcagctagctcgagaaattctccacttctccctgcatttttgaagtttcaactttctttgcctcagctgatgctgcaagacactctttgcagttctgtaaattattacctcattctcgtatctttaattgtttttttagccttctttttttattccaaaacaatgagtgttttaaaatttcaaagttatatttttaaaaaaaatatatccttattttaattgatataggtatcaaagataaaagcattaaataagagtattttaatctccatgaaacagtatctaacttttatcaaatatttatttatctatatacattaagcttgaacatctaaagatatagaaatgtgatattaattactagctaatcctttccatctaatttcaaaactctaacccaaatctcacttcaccaatcaccgacgttgatgctactcacacccttcccaaaaagagcgtcaacatccccatgttttgaagaagtggcttggttggaagccttaaagttcattcccccaaacccatattgttgcaccacaagcactgaagagcaataaccaaagctatttgatgccagcatgtcccctatgaccccaagttcagggcaatcagtccagtccatcaaattcgacaacaccaaaaagttccttccctttccatgccctaaaatgtacaaatcatagctccctctatccaactcgttaagcaccaaaggaatatcatcacataggttattgaatccccattgttcactgccatgagcctaaacaaactcacatactcctcatccaactccttctccttcccactatcaattactgtagacaatatcccattggcttcatcatttgttgttgcatttgtgtccacttcaactgcctttccgtacaaaagaacatgcaccaaccagagatgaatccccgggtgcttcgcggtcatcggggccgccaatgaagacgatgcagacacgcaaactcaccttcgataaccacccgtgcccgcgatcaaccaatatccccacggagcacggcgcgtggtgcatcacgttctggttgatgcctaagatataaaattgattggatagttaaaacaataagaaaaaaaaatcacggattcgatttctgctaataaattataaaatcaaaaattaacatttgccaaaaaaaattgtagtacaccttccacggtcgagtgtttgtgaaagggaaggagaatcaactaggcgtgtctctcctccgcaatgttgtaaacatccttgtgaatctgtctcgtaggaggacacggcgctgagagtctcaagactggtgtttgtgtgcccttgttccggcgaaatttctgcgaaaatatttgcaatgccctcagtgtcggcttgtggacacaagccattactgggatatctgcatcagccctcaggttctgtatagtcctcagcttatccttctcaaaccgctttcttggcttgtatatgtagttgatgattggagacactagtatggtcatcagaacattagccgtcaccatgattgtatataaatccctactcaaaatctgaaaataaaaattagatgtagagttattcatttgagaaaaaatagtatatgtaccaacgatatcttctgatcacaaattgttatatataataaatacttatttgtttgaaagtttatgtatgtaaaattaaaaaatttgaaacacattgtctttctaatcacatgaagttctatgagaaaatactaaatcaaacaagcaataaagttgattaacttttaaaataattattttaaaaattatgttttatgggtactaactaaggagcattactagcagaatgaaccacctttacatgtggtttaaaattgttcactattctttaccattagatccatctagttacatttctcttatccttacacctttcttaccatattcatgtttctttccggagccgccgctgccggagataatttccaactgcagtggtctttttcccccttactcctttcccagatctgtccccgaccgctaaaataacactgcatgatgtcatcattagtagcaccaacaataccagttacgacgctgttgggttgtcgttaccgatgtcaatttcatgctccttgaaggggctcttccgaaaaacatgctcggaagccagaacttgaaactccatagcagagacgggaaaggataccatactcgagaacctcctgacggtgacggagatgtcaagtttgcgaaagcaatcatcaatacgcatataatgaaaacttgagtgtacctaaagcaccgtagattaatcccatttttctttcttttattgtcatccacaaatctcatttactttcatactttctgttgtt

SEQ ID NO: 2147 - DNA, 1500 bp, Glycine max
  Soy_ogl_812 Gm03:2898501..2900000 Cluster 9
aactaattttaaagtatgaatagtttaaatttatgaaaaaataaaaaaattaaaatattaaacaatgacaaagacacgtgtaattaactaatgaaattgagaggttttaaaatattaaaacaatgacaaagacaagtatcttaaaaagaagaaaatacaatatgagatattgtcattcttaaaagtaataattttattttatttctctattattatatataagtgtttgagagagagaaataggaaatgttaatagctaatatgggggtcggtcgtaccaatcgtacacctttaataatcgaataataatatcctaaaatcaagtggttgtcaaaattagatttcttattatcatcttgactttaagggtttttttgcttctttgtactgcaacgtgacttaaggtttgtatgagacttaatttcaaattaaaagtgagcttatgtaaaaaagaaaaagaaaaagtgagccttgtattctaagaaataatgtttatactactttatgtacattaatcttcatgaaaaagatcaaacaaattaatgaagagcagaagaaaatccacggacactaagaagaaatattgtagcaagaaatctaagtattataaaatagagtagagaaaactttatttatggtgtatagatatgatcatatgaaacaactttaattgtggccgatcgttagagaagttgaagagagagagggggccagagaagggttatcaattagtgagaaggagaggttcactttaacagcaatggagtactgtgctagcaaggggtagaagagaaaaggcatacttacaattcagtgatgaatccagaaattttctttaagagaacaaaataatggtctataacatatttagggatggaaaatattataacttttacaagataaataatctcatgataacaaaagttaaaatatttaagtttctataaattttaaataaaattggtaaaatttatactgatattttctcttttctctttttataattatttacgttcttttttaagaaaataattttatgaggacaacatttatttttcatgtgacataaacaataattatttaatatatttatttaaaaaaattacttagtgggtgagacaattgtcctcataattaactatatatgtagatctgtcggcatgcaaaagaagaggaagatgatgaacaagaaaataaaataattgttaattgggaaacaaaagaaaaaataagttttttttttaactgttgatgtaaatgtatacaaacctaatagtctaaaaaaagcatttctattgtggaagatatgtgaagcgctctttcatgcttattagaatcctagatgaaaacataatctcacttcttaactggcaaaaacttgtcttaccatacatatagacaaaaaaaaatatctagtatatgatcggattcacccaaattctctattttgaatattgttattaatacattatcaagactaataataaataaacaaaattt

SEQ ID NO: 2148 - DNA, 1600 bp, Glycine max
  Soy_ogl_4786 Gm14:46152901..46154500 Cluster 9
acatatattaagcgttgaaaatatgtctagatatctttaatttgaaaatgaatagtgaatttagataaataaaataattcttatcatttacatatattaagatccaaggtagagcgttgaaaatatgtctagatatctttaatttagataaataaaataattcttatcatttacatatgttaacccgaggtagagcgttaaaaatatgtcttactttaatttaaaaaagaatagtgaatttagataaataaaataatcttattcttagcatttactacatttaaagatattattaaattgtttttaagattaggatgctattagtatttgaattttgtattacacttaatctatatatatatatagagtctaagagtagaagtttatcaagctcatcagcaaaatatatctccacttctttcgaaaaataatttttctaccgagaatcccaacaatttgttgataaataagaaggggaaggacaggaacaatttgaattttgtacaatgaaaattatcaaaagaatatatttctaaactctatagatatgaaatgtcattcactggtctaggaaaagctagattgactgaagttgaaagaaaaaaatgagaagacaacaaaggagaagatattgggaatagtttagatttgttgacattaatctgtaagatattgttgcaaatttcgtggctggaaaaagtattacaataagatgacactaatggcatcatcgatctgaagtaatcattgtcaataattcttgaaacagaacatattgaaacccagtgaacttttttttttttttttctagatacacatgcaacacattgtactggaattcaaattatttattcagaatatacttatatttttgctgaattgaataaagattgtaaatggccattaaaagggtaaaatcattaaaagaaataatattgtgatactccttttccccatatatagtgattgaaactactgcaggaaatagaaacctaatactacacaaattcacatatcacagtaatcaaattacataagtgctaaaaaaagaagattaatcaaatacttaatactgatgtgcaattcgattcaatccttcaacataaattgattttcctttttccttttgtgaatgataatatgtccaagggtagtaagtgttataattagttactcaagagccataaattgaacctgcaatccaatcataatgccattagagggacaaactgcaagttatgtgaataactttcaatatcataatacatggaaagtggaaaaaatcaatattaagctgctgaattgtcaattccacagtctgcattttaatttttataaatataaatagatagattgcaaattacttaaacaagagacagaagaccacagatgctatgcatgcatatgttgatatgaaagaagaatacttcacattgagatgatgaaattttacaactacatgtggaaaatgtgaaggcagtgaagaaagtaattgcacatgaagacttctttgcatttcaccaacatctgattcctggaatattgtttagcattgatatcaaaaatgagaaagtgggatctagtcactccccttttattt

SEQ ID NO: 2149 - DNA, 1405 bp, Glycine max
  Soy_ogl_2705 Gm08:15547870..15549274 Cluster 9
ccgaatctgactcttgtaagtctatggttagttttcatatgagatatggtcaaattaaaattaaatttggaaaataaaaatattaataatatattctcaaacattttctctgtaatacattttatattatttgttaaaatttattaaaaaatatataattatgacagaaatgagactaataaaaaaatttgattcttaagaaattttaatcattaataaaaaatatgttactaacatttctcgttgaaaaaaatattatttattttttgcctcaatttcacaatttaggcttgaaatagaagttaatggagtttttttttgttttaaaattaatttagaaaataataaaatttaagtttgtaaactttaatctaaacatgtattaaaattatcaataaaataatctaagcatacgtctgtgttactgtatgaaaatttagtttaatttagtttgctctctttcaaatacattgactagggtaaaagatacaaagtaatttatatattctccaataataagtttagcatcctccaatggaattataatgatactcctaacatatagcttcatgtgttagagataagtgcattgaaatgaccactacaacagtttgaactttcaacagctgtacaaaagatacacccaattgttgaataaaaaatttacgaccaatattacatgcacatatacgacaaatcatgcatacatccaaatattaacaattgatttcttatgaatgaagctaagatactgagggaagtttgtttaaactttaaaaaaaattaaaatttatgaatgaagctaagattttttcaaaaacatttttttaaatagtaaataatattttttcttgaaataaaccaaaaattatttattttaagtaaaaataatttaaacaaacatatttaaaaagtataaaactgtttattttattaaaataaaacctttttaagaaaaaacaaacttaaagaaactcactcattacttgttttagttcattctcaaaaggagtcagactttaataccttacatgtatatgaactcactgtttatttatttaattatttttttgtaattaacaaggatgaagctaaatgatatggtaaatagctgttagttattttgatgcaagtgctgagaattctttcattgtgtgagaaaaggaaggtgcatatatagacaaataaacaacaaagaaggaaaggatggtgggctaggttgtgtaggtagggtagtagcattagctagcaaggtagagagagagcaatgcgcaaagagcaaagagcaaaaagcacagtcccttatggcatggccatttgatatactccttcttcctcgctatcttctctatcgttactgtttgtagaagtgctttttgtctcgcagactaaattagaaaaagca

SEQ ID NO: 2150 - DNA, 1057 bp, Glycine max
  Soy_ogl_3145 Gm09:36926377..36927433 Cluster 9
tcatttataataatattatctaacttaaatagtattgtttttttaaaagatatttgttgtctattcaaaaaataaaaatgtaagaatcatatgtttttctataaatataagaatacttttaataatcaatgattaatgttcggctatacattttaatagcacttaattaatcatttgaagtcgtccaaaatttccaattatttcgttcgagctttcaacttgttttctaaaagttgccctaattcatgaggcataatctatactagtatcttgctaaattttgtgcacgccgaaaggaatatatatatttttttagtcatgttgttgttttgttgttcaagtaaaatacatcaatatgtacatgaatcattattcggttgcgccgtcgacccagattatacttgctaaatttatttgacataattgatgctttgcgacaaaatattttcagaataaatctcaataatcatatattaaaaatgccatcagaaaaaaaaatagtctttaatcccaccctgtatactcattctataaatggaataaaaaaattgtttttttactgaacttttgttttgtaatgtccctaaattacatgtactttatttaatgattttgttcttgatttgttttcttttttcgttctcaagatgattggaaagtggggctcttgggattaaggagacgaacctcatcgccaaagcacatgctgtcagatatatatccacacgaatgtttgggatgaatgtatgcatccaacacaaacttcattgcaagtttgcaacaattatttctcagttaaatttaatcttggcggctattaattaacgtctttaatttctcggggttccattaattttcccacaatattcaaacaaaaattttggactttttttcccaatggaacaaagaaggaaaaaaggtaacagtgatgtaaaagaaatttctccaatgatacaacgaaggcagctccttcattttgaaccttttttctcgagaaatacatattaccatttatttattatatgaatacattcccgtatctaattatatgaccctc

SEQ ID NO: 2151 - DNA, 1100 bp, Glycine max
  Soy_ogl_6899 Gm20:40740701..40741800 Cluster 9
ataaaataataaaacttttaaaactaacaaatagttatttacgtacatgaaatatttgatggaaaaaaaaaagagacattgaaattgattgtgtttaatttaacgaattacagaacagttatcccaacaaaacattaaaactagctattgacgtgaagcacacatattcttacagaaatataaatgagtagggtttttttaatgagtaaaacacgaagtaatttttttaggcacataatttaatgcatgcctaatacagtggtatacactcaatcaaacgccataagtctccctaattgcatctctcaaatctaatcttatacagtgacattagtcataaggctagccataatcaaacctaattgatgaaaacaaccattcaattattggaatctcagtcaaatccccctttaagcccctttacttcttttttttttttttaaagggtaagtgggtaactatccatcagcagtagtaattcataattttcttttgataaatacttaaaaattgattaaagaatttaaagtaaaaatatttttattaaaaaataaaattacgatatttattattttatttatatttttattatttacacaataaatacttttcatttttaattccttaatactatctttttctttttcctaatctctctcttttccccctcaccaataatgaagtgcctaaataaaataaattatatgatcaagttggttagtggaggaagtggcaacatgccataacataatatgaatgtcaaaagtatatatttgccttgattgggtgtgtctataatatatatgacttggttccatgaactggcatgaccctcctatttggtcaacctcctaaatcatatttaccattgattgattcaacttgatattaaaaagcaaaaaaagtagtactaatttcattaaccaaaataattataataagaaaaggtaaaataaaaggatgaaagaaacaaaaaaaaaggggggagtaaaagaaatttaaaaaaatcgaacgcatgtgatgagatctattggcaggcactaatgtcaacagggttgacatgggtaccacaaaacgactgctttgatgatgtgcacgtg

SEQ ID NO: 2152 - DNA, 1077 bp, Glycine max
  Soy_ogl_2609 Gm08:11463150..11464226 Cluster 9
cacttacaattcaatagattaaattaacatcttttaactatttgctaactttttatcgttcaattagtatttttaccacttttgtcaaacatgacctaatttagaagaccatagacaaattttctaattcacatcttcttaaattagagagggatgtttacattgtgcaccaaaagagaaaaaaagatgtggaggctaaaaatagcaaatggaggaaaggatccgtacatatttagcacaaacaactttctgggttgggaaatatgggagtttgatcctgaggcatgcattgaagaggagaaagctgaggttgaagcagctcgtgaaaatttctatgacaacctcttcaactttagagcttgtggtgatcgactttggtggtttcaggtaccgattattactgtaacgaattttttcttactcgataaagttttacatgaaactaattgagttttttattttatatttatatatattttttattgtcaaatgttaattgttttagtttatcagtggaagaaatttcaactagcatcctctcattccccttatcccttcaactaacaaaccaactttaagaaaaatatgaaactatttatactctttaaagtgtttttgaaatttattacatatatatatataaagaactatatactttaccacttgcacaattcgatttgttaaaagttataacaaatcataatgtactttacccatcatatatatatataaagaactatatactttaccagacttttaaaataattattatattataatttttattttttgatatgtgacaattattttttagtttctatatttctcaacaactttttactaattttattaggtagcaataatgaagtgaacatcaaaaaaaattatcaatgaaaaattaaacttttctaagggtgggtcttcctctgctaggttataggttacttatttagagcattgaagtgtgtaatctgccctcctataggtcaagaatagacttctataacaatcatacgagagtattacctctaggtcgtttctatttataagatgtagatttaaaataatacttattcc

SEQ ID NO: 2153 - DNA, 1000 bp, Glycine max
  Soy_ogl_3397 Gm10:6605601..6606600 Cluster 9
agttttaattattaatttttaaaaaaaatatcattattttatatgcttcaaggcacacaacattagttgagtcttaaatgtttattagaatgtaatatttgtctgcttttatttcatctatcaaacatatatacagtgtattagtatgataatatataagatgcaagttttagtttttgtcattatttatatttaataaaaaaaaattaaaaatcttgattcgtgttatgactgaagaaacttcaatttaagaatgaaatagaaaaagtgtaaatgaatataaatgatattattgaaaatattcatatgctaaaattgagataatctataaattaaaaaaatgaaaaagaggattaaacatcaagacataaagatatatccagtttttttttttttgccctccctatttttataatttgactccattatttttaagtttttagttatcattagttttcatcttttatattagtttattttaatgttttgtttcgtttacgcttatcctattagacattccattcacccttggctgataaatatgattttagtccctttaaaatttgtaagttggattttagtccctctaaattttgttagtccacttcccgtcttctaattttggcatgtatcacttttactcctcaaaatgatttagatatccttttatagtgggacaaaaagtggtttagataaggctttcttgaggactaaaagtgttgaatttcaaaattgagaagaaaaaaaacaattttttagaaaaactaaaagcaaacttcaaaaattttagaaacacaaaacatattttaccctattttttatatttcatttgtatatgtatgataataaaaaaaattgaacccactgattttgggtcctggatccttcactggggccagaggtggtggtggactagtggtgcctgtggtggaggtgcacaaaaccatcaagatgctaagctcactaagctggcaaaagagctttgagacaaagttcttcc

SEQ ID NO: 2154 - DNA, 1200 bp, Glycine max
  Soy_ogl_20 Gm15:15944901..15946100 Cluster 9
tgtatattttggtaaaatatataatgagtatattttggtaaaatatataatgagatcaaaagtttgttatgtaatttttaaacctttgattttcataataataacacaattccattatacagaatcataattcttatatatttttgacaaaattcacaacagttttttgaacaaatgcataatgatatttatacacaacaaatcataattctattatgtgaaaaagatattttgggaatataaaagaattagtccctgttaaggaccaataacaatgagaaagaatcaataacaactccctttagaaaattaataatgacgtagacaagtccacctgcaaattaatgaaagatccattttcagtgactatcacatattcgtattcctttgtcaacatttgcgccttttcaccgcatctatattagaaattatttaattataaatgatacgtatatttaaaagccgttcttggtaataatgtaagttataaaagaatactaataaatatatattcataagtattcactctgtttaagagctttatttaaatttttaaaaaattatctcattcattttttaaaaagaacatatattttaaaataaaaatagaaaatataatttaataacaatactgtttaatacgaaagtttgtgacgaaaatgaattatgatgattaacaactaatttcagccaatggtgagaatactccgataaagtaaatgtaatcaaatcgtggttgatttacgtggaactcaaactctttaaataattaagtctcatatttgagttttataaataaataaaaaaaatatgattgaggttgaaaaatcgactacaagatatcaattagattattttaataaaaattaatcatgaatacaattaataaatattttacactaataatataatatataaaaaaagtagaacgacccagtaacacttattaaatctggttaatatcttttgccattctcacctatagtttttcataattttaatatgtcaaaaggaaagaaaagaaaagtttctcctgtatttatttatttatcattacgttacaagtgtgttgcacgttcataattgtaccatgacttgcctctttaaagaacaaaaggcaaatttagcatgtgtcactcacatgccatgttcacaaggtgtgtcgctagttaccatggccgcatggcatggcgccatatt

SEQ ID NO: 2155 - DNA, 1200 bp, Glycine max
  Soy_ogl_4021 Gm12:7924101..7925300 Cluster 9
gctcatttcctacataatttttttctacaaactaaaaaataacaaaaaatttcctattatattttcctactaaaatatcaactaaaaaattataaacacaaaataacacaataacaaatcaataatacttatgaaaaagtgaaaaatagcatggcaagtgaacaaaataatacttactatatattataacaaattactatatactttaaatcctaaaatttaggaaattgataattaatattttatggcataaattggcaacaataattttctattaattttttctacaactatatttttttctatacattaaatttatattaatttagttcaataaaacaatatattttttctacaaagtaagaataaaatgccaacaataaatattttgaaataaatatttttctacaactgtattttttttctacaaagtcaaaaacagcaacaaattttaagattatactttaaaatacaaactaacaaaatggcaacatatatttcctattttcttgattttttcatatcttttctacgatctcaaaataagtcaataaatctcttctactgtaattttctaaaatcaacaaaaaaaaaaaaatacatcatactgtaacatggaaacaaatattttccacatcattttttttcctacaaactaaaaaataacaaaatatttcctactacattttcctactaaaatatcaactaaaaaattaaaaacactaaataacactaaaacaaataaagaagacttacaaaaaaaataaacagtaaaagaaagaggacttgcctaaataccaaccaagcctccaaacacaaaaaccctccaagcacaaaaaccaccacaacaaacccggcatccaagctaaaaaacgcaagaactccttcagaaacaacaatgcccagcactcctctttcagcagcgttttatagacaaaacatagcaccagctggcgtcacaaatcagctggtgacaacctgcattgttcccttcttaggaacctgccttgaccaccttggacaacctagtacatcaaacatcatttagtgtggtgcctcctgttcttgtttgttggaaaatgctttgacgtagaaaccaagtctcagagtgacgctacctgttctaacacttaacctaaaaaggtgacacctcccaggtggagttgcgttgaccaacatcacacatatctaccatctaac

SEQ ID NO: 2156 - DNA, 1780 bp, Glycine max
  Soy_ogl_6002 Gm18:8994501..8996280 Cluster 9
taaagttagttcatataaatatgagaatagtaaaatcttggtataattgtaccccaaaatcgtataataaggagttgttaataaccgttaaacatatcctttgctctaatgtttttttgggtcttgtagtcattcacttagtttgagattggctctcaagtttttcacttatatggattttcttttctttttaatccacagtttctcagttgctgtttgatagttataagctagttagatgaatcaacaaaagctttaactaagcaagaagctgagattcattagttaactagagaagcaaaattgatgaactatatattcattgttgccctggttaaagctgaattcatttgtgatttactgttggccctattcccattgttaatggtccctaccaaaggggcttacacttattttttgtccaaaaatgcctcttatgagaaataccattctattatataattatataatggaatcgtgtttccaattatatcaaaaaggttgaaaaaaaattaacaacgaaaatatgatttcattgaaacaatacaataaaatcatattttcattgttcattagaggagtgcaagaaaaataacaaccaaaatacgatttggttgtattgttttaatgaaattgtatttacattatattagaggagtaaaaaaaatttatcaacaaagatacatttttgttatactgttttaacggaattgtattttcgttgttatttcaacaaaggtggtgtgcatcatggacggagttgcaaaggtggctttgggacaacaaagtcttttctagaaatagggtcacaatatgaatgtgaagtgttgaaacatacctgcaatatggagaattgaaggagaaggacttctgcgttggaacccttgataactatgcatgggaagaagacttgacttggagaagaagcgaagaagtggaaagtgggatgcccagtgggaagaagagaagaatgaatgaaaggggatgagtctgctgctgtagaaaaaagaagatagaagtagattagaatttttaaaaaaatggaaagtataagataaacatagagaagtatagaattcaagtccccaattttggtacacttcaataactggcccaatagcaacaccgtatgttataataaaaaaaagtggatgggcacatcgtatgttataatctaaaatttcagctttttgagatcctagcttaaatatagaaaaagatttaaaaaaaaaagaaaaaaaataaaagttgttttatgaagttgaaattctgtatcttattattattttccaatcgcttgttttttcctttcactggtttttatactattttactatgtacaaacttatttttcttacatccaaacgaaattaattatttttaaaccacttttcaacaaacttagtaaaaattgattataattataattaattataaaaataatcaattatacatatattcaattattaaaatattatttaatttttacaactatttcaaacacatgtaaggacagatctaaaaggagacatacaagggtctggtccccctccccactccaagtttgaaactttttcatgtacatacatatatatttttaagttaattagtataaaattatataaaattaattttgtgtattattataataatgattaaaactaattagtataaaatgatgcaaatttagtcgtgtttattgttttattataattattaaagtaataactagtgtaaaattatttaaaacaacttttgtgtttgttgccattatgataac

SEQ ID NO: 2157 - DNA, 1125 bp, Glycine max
  Soy_ogl_476 Gm02:10483076..10484200 Cluster 9
agaacttttatgactttatttttttatttgtcttttaactaaacaaactaaagttgaacaatcctaaacaactttaaagtcgtgtgtcttattttgaagtatgatgaatccatacatgaccaacaaaatgattcctgtaagatcgaagtaataacaaatcaattagacctccgaggtccaacgatgcctaatggttgtggctttgcatgtggtccctgtggctttgcatgtagctgtgcctctggctttgtctgatgttgtcggcctctgatgtctctttgcaacatcatcctcttcatatgagggaccctcatatgagagggattacgtccaacaatgtatgaagtttgttttgttcgaaccatgcgaggttaaacaaaaaaactaaactattaataaaaaataacaaaaagaaacacacaattttgatgggggcaaattaggtatttcactttagtgtagggaccaccgacaaaagttgtaggggccaatagtagtcccttttttctaaagtatgggaatccatgaatacaactatcaaagaaagacataatttttgggtttgtttgacttgaaaaaaaatttcaggaactaaactaattataattggtggaggattactaacaatgcaccctgtgacatgctttctaacattaattgattaaatttttttaaaaactataaaaataaaacagaaactaaaataagatgggactcacaaaaaattgtatttttttaaaataaattttagctaataataaatagtattttttaaaagagagtgtgaaagtatattttctcttccggactgaaatataaaaaaatcctgattcaagttaattaagaaaataagttatatcatataattttgatagtcctaagtaaaaaaataatttatttcttaaaataccttttacatttcattgcataggaaaaaaaaatagaaagttgttagaataaatttctttttaaatgaaaagtgttttgaagatgatattattaaatataaaaaagttagttaaataaatttacttatatttttgtttatgataaataaatgttttttacttatattttagtctgaaagaagtactaacatttctctaattgatttggtttgatttt

SEQ ID NO: 2158 - DNA, 1000 bp, Glycine max
  Soy_ogl_1023 Gm03:41676601..41677600 Cluster 9
gattcaaatatataaatatttgttgatatgttatcaatccaataacctgattgctgagggaactatgtttgtgttttggcatcagaacgtactaggaggactgatgtacacattttagcgtcacattaattgtatggaccccacacaatatactagtaatataactaataaacggattcgacctaaatttttaaatgatggttgtagtagaggttaccccagttatggccttgtaagcaatgtagtgagtgcaacaagtcagattaagaatatctcgtgcaaccatatttttgggaaactaaccaggttgcagatgggttgacgaagagaggcctaaggatggatgaaggagtccattccttttaaatccccccctccacgaattcaaatttctttgttggctgatatttcatctgtttctttcttttttcgattttagcttggttttttagtcctccatgtaccaaaaaaaaaatgtgatttatagtatattttttctataataagtttatgataatatttgttgtaataattattaaataatttatgaaattttctttgctttaaaattaagatacatattttactttcgatcgtagcattaagtcttgcattaataggcaatggttgataaagggcatcccctttccttgggcttacattgtttggtgttgcctccttctgattgtaacctcctgttaatgggtgacttcataggaacttcctatcctagaagtcttcgtgtgtagtggccttagcttgggcttccaccgaatcaaataaagaaaaaggtaaatttttatttttatatattaaaaaaggatagatgtatcaatattattaaaaatcagtattaaatttcaaataattacaatgatattacaaaagaattgttaatattattttataataatcctaaatagaagtaagaataataatttttaattaaaatatattccaaaaaattaataaaaaattattttaaaaataatataccgta

SEQ ID NO: 2159 - DNA, 1149 bp, Glycine max
  Soy_ogl_1336 Gm04:41534201..41535349 Cluster 9
catcttaataataataattttctgaagcatgtatacatataaaaatatatttaaatgtttattgacattaacatatttaaatatttattgacgtaacatgtattaaaatttaaattaaattattgaaaattcaaaataatataaaaattactctataaattataaagtataaatttaatatttgtacaaaacatggccactaagctattaaaatatgtatttgtacatcataaaaaaataatatgtatttgtgcagaataactcacccacaccaacgtcatccggattatgcaaagagaattagagacccaaataacgtaattgtaaaccgggtcaaaacacgcatcggactcttttttcaacaatttttgtaaaatctaccgatctacgcctcgtcagctgatagtgtgtgatcaatattaaacaaaattttaaggaattaatgcttaattttatgataaataatttttttttatatttgtaccaaaaaattgtacttttttttggtatatattcttaatttttaaagattaataaatacttttgaatatttagatattttaagttgtgcttacggatacttattaacaaaatttgaaaaaaaacatcatttggaaaaaaggggatatacaataaataactaaaaaaattatagagctacaaactatttttaaattaatatattttgcttcaaaagaatatagtttgatttgttacaaactatttataaactacattattgtaagataaagtttgatttgtttgttgattaatatattttgcttcaaaagaatatattttgattttgatttttttaaaggttattttgatttggttaaggaagaaggaattgattattaaaaacaaaaaaacaaaaacggaagaagaatacttaaaactcaagtgtgcacgcatttacagaatttggacgtaagtttgaagaacaagaaacttggcgaagggagggcacgggatttgattgaagactaaaacccttggattgtgtggattgtagcaattaatgggcccaacaaagaaatgcaaatgggacttctttaatgggaaaataagagggaatgagaaattttttattatttttggattaacacaaaaaaatgatacacttgcaataatttatataatattata

SEQ ID NO: 2160 - DNA, 1278 bp, Glycine max
  Soy_ogl_5661 Gm17:12982623..12983900 Cluster 9
actttgactcataaaaaattatattataaattaaattatttaaactttattgcataaataaaacaatattttgtataatttattttaaaatattttttataattttcataatttctacaaaataaattaaaatttatttttttataaaattatatataattttaacgaaacaataattttattatttgaacacaatttatattataacatacatttatcgcacaccaaattggatatgattaaaacttattctactcttatcatacatgttcttgttctgttttgggaccaccttccaacttcatgttagcaaatgaacttaatcttaggagttgaaagaagtttataatatttttttctttaaataatgaagtattcttttgacaacatgcaatgacaagtcggaggtgaccatgaagtgaaacactttgttaacactagaaatgtaaacactagctagtatcttcaatgtaatctaaacaagtttagagagtttgatgccactaggaagaggagtggcaattggatcaacaatgtcaattctatattgagaacgagatatatatcactttcatgaaactcatctcaagctttatattcagccatgtttctgaggatgttattcttagaggctgccaagtcagagtttttaatataagaatatgttattctcgtgttagtggattagttagtttcagattttattgtttagtcagtggttctaacttcagtgttagtatttctaacttcagtggcaattagattcaatagaatgatgtacttgttaattctgattcatattgattcctttctctcccgcttttctttctttatctttaaaactaaaatcaagttgtttcttctttcttttgcatttctaacgcatgaaaagaatgtaaaactgaaactaattatactataaggttctctattcgtagagaatacaatgtgctaacaatggcattggccattttgtcttgcttaaccatttctcagacccatcacattgagatatgggtgtgtttgaatttccggtggacgagttccaaaagtgcatttgagagtaaaatgagtttgggtgatgtttggtcaccctcgaaaatatatttaaaagtaaatttttgtcttgaaattcataaaaataagatttgagatactcatgtaaacttaactttcactcaaacttaaatttgtaaattttaatttaaatatgcactgtcattctcattttcattccctaactttctaagtgaaaaaatcaaaattcttattacaaaa

SEQ ID NO: 2161 - DNA, 1697 bp, Glycine max
  Soy_ogl_4221 Gm13:23394904..23396600 Cluster 9
gaaatagaatcaacgagatacaatagagaatccccttgattgtacctcctttggttcaagaagaactcttcgcaagaacccaagcctcgtactcttatctctcttcccttatgtatccaatgtttcctctcatgtttctcgcagcaatcttgatacctatcatactgattatagttaattatacttttacagagatctcataacctctatttataagcctcaaatcactaagactcaataacataagtctaatagaaaacacttaacaggcataagcgtatcaaattaatgaaacaaattattccatctgactgagcatcacactgccctcagtctaatcacaacagacgatccccatcaaataaaatatccatcagactgaacaacaataatataattcttgattcattacctaagcaaattagtttctccataatgcagaaccataaacaatcaaatacaaagaattttttaggatttctaagtaagaaataagtttggttaaaactaaaggcgattggatgtctattagagatttgtagacataaagttctagatatataaaataggtattttgatgtttgtgaagtgcttattactttttagggtggaccacttaataaagagtccatgaagaaccctgtttgttaatcataaaaggtcaaaaccatgtctcacgcagatttggagcgttaaatcgtgcaagcctgtagtgaagtgaaagggcaatgtgttgtagaagaactgagaggaattgttgttttttgtccaacatgtaaattaaccgtaaaattggatttttgaggggagttccattggggtttttgttccctctccctactccatttcttttttatttctcaatcaacattttctgtcaagaggaactgtaaataagaaatagagtttggaatttgaatctatttcatgcttttgatgccttgttctacattctcaaattaacatcatcttcacacatttcatatttgagtggaaccataataaagtcctcatttttctattgttgagttttcgttattcactttcgcgacgttgctttacgaacctggattgaaatcctatgctggctttagatctagatttggggaaggggaaattgaatcaattttggatttattgtgggctcttgttttggtaatggcacaaggtgttttgtcactagcagtagattgaggtggtggtggttgcaccgccgttagaaaattgctctggcagtggtgaacaagattgctttgaggagaaataatctagtgtaatagatgtaggatatacttgtttacataatattaatctaagaattaaaatttatggttctaagtggaacttgaaacttgggatgagggagtagaggtgagagaaggaaggaaggggacaagcctattagaattgattgtttgagattaacactcgtaattttacaaactagaatagtgtgctcatgctttgcatattcaggagagagaaatatggaataaaagagagtggccggtgaaggaaaaaagaagcagcaaaccatgttgcataaatattgacgcgtgtaagtgtgaaatggttgctagaaattgacgataggtttgaaagaaaatattaaccctcatgttatatataagaaataatcacctaatttattaaaatcataaaagtggtcaggtaatttgttataaattttaattttg

SEQ ID NO: 2162 - DNA, 1581 bp, Glycine max
  Soy_ogl_4244 Gm13:24105901..241031 Cluster 9
gccttgacatttataaaaatgaacatgtgtaattgatttgataaccaattcataaggaatgatcgaataggccccacaactattaagataaattttgatattattttaaaaattatcatcttagaatttaaatttaaatttaacttaacctcaaaaataagtttcatgagagttatcttcttgtatacattatgttagttatgtcatttttaatgtgagatcttcagcaatacatgagtgcgatgatcccgacttttacatgaaatatttaaaccacacaggtcattaacaagtaaaagtcatgttcaattatttattttttatgatatcacgtatcagttattgttttaaaaggaaaattaattgaacaaaagattgtattgaagaatattcctatctcgtgaaaacagcagattcaattcctaccacgaatttaaatccattatgcaaacaccatgaacaaatgcgaaaattttcacctgttagcagacctggttttaccaaatcaaccattgaaatcaagcaaagggaatgaatcagataaattgaatcaacgtagagaacaaaagaaaatcatgcaaagttcaatagcaacatttcacccgatacattttgccgacacttggatcattgatttatataaattccctcgaggtaccaaaaataatgcaccgatgagtatgaccccctcacaaacaccacgtaccgggtacacacgcctactgtctccatgagtccagagcttcgaaaaggactctcaaaagctgctgcattaacttgcactgtttctcactgatgaggctccacactgcctctcataaatttcgtgaatgtttctccaacttaagtagctagctttcaaaatcgctaaatcactaaacccatccttgaaagaaactcatacttattagaatacaaattaacatcaatatgcttatagtcttaccttaatatctttggcaatacgtacaattaatggtttctcagtctttgccccgtggagatcaccttcattaattcggcgggctacttgaaaaatgatcatcaactgcatagtgcaacaattttgacagagatacttttatatattgacatagttcaacataatgagaattttagtgaagtcaatgataagtaatgagtaaagcagcattttggtctttttagagtgtaatgcattgtcacacgttattctatagaattaagaaatcctaaataagtcctgaaatttataattgtttcatctattaattgtcactttaatttggtccatgttgaaaaattaaaagtataagtttttttcacataatatcccttcctcaagattcacttgaaaaatttatttgagaaagagattattctgagcttaaatgtaaagataaagtctcacactataagtaagtaagttgagtaatatatatgtaacaaagtctcatatttattgaagcgttataataaataaaaataaacaacttaaataatatataagtggattgaaagaccggtgaatcaaataacacttatttaaattttttttacttttaaagatgtttaatgtgataatactgtaggttttcatgg

SEQ ID NO: 2163 - DNA, 2118 bp, Glycine max
  Soy_ogl_2100 Gm06:47064883..47067000 Cluster 9
gcactcagcgcggaaagtgcggtaatatgcctttttcattagtctttagggttaattattatatatcggttttattttttaagtaaaacttttaaaataattattataaaaatagtaattttattataattttctcatacatgagataccataaaaagttttatatgataaatatatacctaaatatattcttaatggatatatcttgttgtggtacacagtgaaaataaaagaaattaagaacccaccacgtaacataaatagttagtagtttagatcttttaaagtatatgatagaagtttgattattgactatttgattacagtaatgcatatgtaagaaataaattgtcccttgactaaaaatcctccaaaaaacaaatggacgagctacctgtgggtataagttagtgactagccctcggtacatttgacaagaaacaaaattagaagagagggagaaatattaattttaaattaaagagaaagatataatgtaaaaaatgaatttttatgtttaaaattcaatttttcattttaatatatagttattcacactcctccaaccacacgagatgattaaacctttcgctgttttgggtaatgttttgagaacacacacatgtacatctatcaatatatccagaaagataaacgtacaaaactagaaaagtagtagagaaatggacaaagatggaaatatcacataagtgtttactataagaaaaatatctatgcatcattagtactcattaaacttttcactgttttatgttgatggatttaacagtgaccatccactatatatattcggttggttgcattttatcaatcaaaatgtaaaataagcataagtatcaaaagaaaaagtattagggggaaagtaaaagggaagccatattctccagtcttgacggccgtaccctctgctctttgattttgcttttacttttgcctacgctatggcttgtagggtgggacaagttatccaatgattgttcacgagtataccacaaaatctatttaatccaaaacatagaaaatatttgaagatttgcaaaatgataagatgagtatatataaggaatatgggtcgatcgaaagatggttgccattattagtctaggttgtaaaagcttcttcatgtcacgattcacatttttcatttgatctgacaacagcaattatagttcggcctttgggtacgtaccaattaaaatttgtgtatgaaatatatcttattaataaataaaatttagcttgtgatttttatgtttcaaagggaataagaaatttgatttagactgttcgctacatttttttatttttttcactactacaacttttttgaactataaggacacttcacagtgatggtagtgatggttttgaacataaaaaagaaagtcattttaattaaggtgacatatgcttttacccacgtacactgcacaagttgataaagtttatatattgcttaaaacaatgactttttttatttaatgactaaataaatatttagtatatatattgcaattataattaataataatgaaaaaattataatattcgaaagagaaactttggtaaaaaagagattttaaattcattatatactgtgaaatttctattaaacttgttattatatatatatggataaaaaccttaatacctttccacaaaaatattattaaccttagcttgtccttgggtaataaaaaaaatgggtcgtgtttctaggattcaacttagaataaacctggtaaatagtatgaaaatggttcttcaaaacaagaaatttgacttagatcgagttacacccaaaaatcttttttgacaattaaatttaatttctcatatactttctagcttctacaagatggtaagcttttttcattgttgttgttcttggtactttgtgtaatgagttatttttattatgcttctaatattttcatcttgcatttttaatcctaggtgatttttttattgtctaaatatctaattataattattggttttccaattgcatcccaaatgtatgctaatttttcttgcatcttgtaccttctttctttttaatgtctattaaaggtttttgaattgcattccatttat

SEQ ID NO: 2164 - DNA, 1919 bp, Glycine max
  Soy_ogl_4320 Gm13:28162701..28164619 Cluster 9
aattcttagcacatttcatataattataggtgcgtacgtgatacatatcttaatcttaatcttaataatatacggaaccattatgcttcttaccacagaagaagatccattcccattaattgcaccatgaataatagtttatatattgaatcttcatcagaaatgcacatctaaaaaaataatctaacctatgtatgtgtatgtgatttttgcgccaaactctcggattgtttttatacaacagaactttgtatactatctgcatggtacgtagtagtcactacttgtggcttctgttatgctatcttaatcaatatatgctttctgttaaaaaaaaacttccactattgacataagacatgccaattgttgagaaccaataggaactttcaataccacaggaagttggcaagagagtctaactcagcacagcagaatctcaaatatagagatcaatgaaaatgaaatacatctattaaatttggaatatgactcttcctgagatatatatatataatgtaaataatgcaccttagctagtgtaatttgaacgtcgatctaagaatattttcgttggtggataagacctaggtgctctttatgcgagcatttttgtactttttctcccgtttaaaatataatatgtataatatttattaaacgtgttatattttcgttgaaaagtaattgtaacagtacatgtgaaacaatgtcaaaatcctgtcctttaatttatatttcttcaggttcttagtgattattaacgacgatagatgctatataacattaataaaaattccatcaagatatataatgtactcttcgtttctcatttatatataatttcaatttcattcaacaaattaaatatggttcattaattttagtcttaaacttttcttgaatctactagattcatttgtcaactgtttgatgttaactatgttgaacatgcagttattggctgaatactactaacagaagtagacagaactagattaatttttagtccaaccataccatttctccaaacagcagtattcccttttaattatcatccccagccagcaaactcttgttattaagtgaaaatactaattggttactatataggaaatgaaaactactttgggtgatcacttaaccataaaaaaaatttatcaatattaaaatttagtggtcacatgaaaacttaagagttatttgcatttatcttttaatcctcaccatccattcaaatataatataattatttatttataatactcaataacaagaattcttgatactttcttatatatacacacacaacagagcaagaaataatgtattaattatatttttatcaaaaaatattaattattaatttattcttcacaggatattgaaccgataattattttttatttttctttaatcatttaactcatcttatattttcaaatattttttctgctattactttaatgtttaaacaaaacatgaactgtttttagtttttaattttgttagctacataattataaatgtttgcttttcattaaaacaattggaaaactgtctgtataattaaattttgaaataaagtaaatgatttaacatgcattgtcctttgacattgagttctctgagggacattattcaaggtttgcacattatagtagacacctaaacgttaccccaacattaaagcattcaattgaggctgccagctactttaatgggtttcgtcatctctttattcctaaaatctctcgtaaagtaaaggattattgactttgagaagacaaggatgttagtaatctgttagactgttaatattacgtcttaacgacgcggaattaattacttcgaccggtatgaggaatttttttgtggtttttaatggtcaaaaaattaattaccgttaaacataataa

SEQ ID NO: 2165 - DNA, 1574 bp, Glycine max
  Soy_ogl_6136 Gm18:52425334..52426907 Cluster 9
agaaaacctaatcacttaacctactttgcggaaggataaataagaggtgttcaaatccaagtggcaatgagtgaatccaaattgtttgttgtcatgagacattcacttcacggggtgtttttttcaacaccttcggaattacttcttctacttttcatattgcttatcgggggttgggttctgacacaaaccaaccacgacattttatggtccatttccaatagattttaggaataaaagttctttgggcagtcactatttaatactttcactccctctcttgcttacacactttctttttcaatttgatttttcaaaaaacatcctcttttaagaatactctctcctattaatataacatatgggatactacctatatattttcaatacttgtaatataattcattttgattttactacctaaatttcaccttttctttattttgcctgaaatattttttgaagcatctaaccaactcaattagatacaatgggatacttaattttaccctcgaaaaaatgagatatgtatgcatcaccaataactttcttaccaattaaaatattcttcaaattttgaaaataaaaaaaaaatccacatatctatgcttttcattttaaagttaattttattattaaaaaatctattagttaaagtaattttctcttcagtattttcataattcattgataattaaaatatccctctaatgtgtaatcacacgtgtttaattcaatttatttcaacaaaataataaaaatttattttggacaattttacgaaaagaatttcaagaaaaataattattcttccccgaatagtctctctcaaatatgcacaaaggctaggtactcctttttcactttatatacatgatatagtttcggagaattcaattaatttttctaaacaaatgatatgatatattctcacttctacttatatgcatcattattttgaagaaaatgatggtactttttacaaaacactttataatttccatataacatttaattttttttctccattaattatttttattaaatactctcaagtatttcttttttattgataataatacataatacttttaaactttaatattttcacattaccaataacaagttaataactattaataaggataaaattaatacatgcattattaatatttaaaaaaaaaaccaacaaaaccaactgcattaactctttttattggtctacatgatttatatccaaagtgtcatataataaagacccaagagaataatttataaaattgatacagtagtatagagtcttattatattcacgtgagggaaaaataatttatttaagataaaaatctgtatttgattcgaaacatacctaaaatttccattgggtagtttctttgacccaaaacaatgatataggagttttggatgcactactctagaagatatgaatggaaaagaacttattcaaaaaccttttattataagaagttacatttatataagttaatttaatgtttggatgaaattataaaaggcattattaaaattaataattaaatgttttaacattatta

SEQ ID NO: 2166 - DNA, 1938 bp, Glycine max
  Soy_ogl_6187 Gm18:55663463..55665400 Cluster 9
aaataaatattaattaatttatgcataatatatttggtatacgaattaagtactgcattaatatataattttcttggataaattaattcttttaaagaataactatttgttaataattttcctaaagaactattttataagtaattgtttttaataatttaaagtttcccgcacactaatgtttatataattggtagtactaagtaattactaactaccagctcactaactacgaaacatattttaattcctaactaccggcgggactatgtttttgatattttttaaaatatgcatattacatcgaataatagataaccaataaggtgatcaaatgctaataattaatcataagaaaaataaagagaaacgtcatttaatggtcgaaagataaaaactaattatataatataattaaatgttaaatttcaaattacatgattatatattataattaaaattgacaaaagtcaatgaaaagaattttcataaacatatagtaattgaaattcactctgacactccccgattttttgaaattataaattaggtaatcaaagtttatatgtgtatatacgtgtgtctctgtgatatcacacttgtgtaaaaccaactttaatcttgttgaagaacttcattggcagcttctatgattttaactataattgatttggccaaagctatatatatccagaccccttccttattcacaagttaaatagttagtaacagtattaatttcacattcatctgcagttctttactgatagctgatagcaacaaatacaaaccctacctattgtttgaattgaaatatataaaggctattatatatatcccactcgacttgtcaatccaagtcacaatgaacatgcatacattgctttcaattcacagtagaattcagttagggcagaaaagttttccaggcaacaaagtttcgttaatttattttcttttgagaagagtcacattaaaaacaatcgatccttatgaccttatccctccaaaaacaaaccccgaatgtgtgaatcaaccaaccaaccaagagaaagaacaaatgggtaacggatatgaatatccatcttgtgcataggaagagagtgataccttttataattgattaatactccatattgtgtcagataatgctcgtgtcagagtcttattgggttggctcacgtaaccatatagacgatgccaaagccatagcattaaatgatggcaacgcttctcccaacagcttctgctccctcatttaatgcaatgacacaatcaccaccactcaccttctcctcctccactacatggactattatttttaattgtgtttaaccatttaattgctattacttttaccataaacacttaacagagttttcattttgccactcatgcaattgaaaagataaaaattgagtaatataatcaaaatattttttctggttcaccgtatattagcgcaaaattttactaactttgtaataattaattttcattgtaaaacaaacttccctcttcttaataatagtgtttactttcttatttacaaaactcaaatataattttttacttaacaaatctgaattcagtattagtttgacaaacactatgttggtaaagtaatttgagtacatgagatggatgtaccacaaataattttttagataaaccatccttttaatctatgaaagtatgagatcgatgtcccacaaataattttttagataaaccatccttttaatccatgaaagtataagctctgtcaataatcaatattactcaaatacgattctacactgtgatattatttttatcctttttaatatgaattatatcacatatggtaattttttatattagttattttacttacatttttcattattataattttggttacaataataatttctcaattgatattcatccacaatc

SEQ ID NO: 2167 - DNA, 1597 bp, Glycine max
  Soy_ogl_6457 Gm19:39423001..39424597 Cluster 9
tattttttatttttggttcctgtaaatttatttttgtaattttaatccttttaagttgatacttttataattatagttcttataagatatattactcatttttattccctataagtttacattttctaattttaattcctctaaacatgaacttatgaaaattatacatgaaaatttttgaatcttaaacaaattaaaaaaaacacatacttacaaagactaaaaataaacaaaaaacttacagaaatcaaactaaaaaagcaaggaattaaaattaaaaaaaatgaatttataaaaactaaaaataaaaaaaatactaatttaaaatactaaaaacatatttaagtcattcataaaacactcaaattaaaataccaaaaagatctgagctttaatggagactttgctgtgccatatgattgctacaatgacaccatcctagccaaaagattggagcttggacactactcgaatattcaatgacttaaatgagatttaaaggttctaaaaccttaatgaaaattaagttcaatgcaaaacagtggccaagtagtaattatatccaacctaaaaaagaagtagtaaatatatcttattaaaaaaattattttcttaaactcccaaaatctaatatcatgctatatatgcaagaattacaaaaaaaaaattataaaagtcgaaaaaaaatcataaaaacgttacattttcatcgtactaactagcatatattaacttgaaaactcaaatcttagatttctaaatattctttgaccaattctgaagtatacatgattgggatcgaatatgacaatgaggtaggtctaaattcactgagaagatgacaacaagcaatgaggtagacgaagcacaaataaagaaagagatggatggggaaatcttatatagaaaagtgcttaaagagaaggagaagagtgagtgaactgagttttgaaccacctttaaacaaacccacacacacacacacaagttcattaagagctttgattaccccgaattaacaaccttagaaaaagaaaaaatattaaaaaaagaataatgtgagatttccatcaatggattaggagtgaattatttaagtgtattttaattcaaaatcttaaaacattaaatatataaatcctttttacttacatgtttgttaacttggttattcataccaaatgtgcgtgacattttcattaacatttgttattccaaaaacctctcccctatctacaagtccctttgacgtgttaagttctcccttaaaacgaaaattttattccttttcttcataagtattagattttgatactaattatatttatacttccattttatcttaaaacattaaatatataaatcctttttacttacatgtttgttaacttggttattcataccatattttttataaaaaaaaccattcacatttgaaattccgaagggctcccgggtatctacagggggctaggtcaaatttggcccaaccctcccccccgaaaataaaaattggttatcttcataactggggggtcttcatacgaacaattatgtgtggtccccttataacgccccccaggtctcaggaaaaata

SEQ ID NO: 2168 - DNA, 1939 bp, Glycine max
  Soy_ogl_5659 Gm17:12926862..12928800 Cluster 9
gtaattggtgccctgagtaatcataggatatatctttcgattctttatttactaaatacttaattttattgaataaaaattatgtacattgagattttatattttttacgttcttgtgtaggttgctttaatttcgagaaagttattaaagagaaaccttttcaattatcctggacatgcaactttacccttccctcgttgcttcgtgttgttgcatcgtaagtggagaatggagaagtttggatagggagataagggaatatgaagatggaaaggtatcatatgtgatggttcggttttggaccgctgtgacatggcaaacatcatgcattggactttttggtttgatttttgaggtgtcttcgttgttctctattgtgatatatactatggagttgcccatcgttcccttccttgctgctattttctttcatgacaaaatcaacgcgatgaaggttatggggggtatctctcttatgtgtatcaacaatatctagagatgacaaaaaagccaaggcagatacaaatacaagtgatgatgatgatttcgttgttggggactttaggttacaagggttgaagaaatcaaggaactacggaccaactgtttgtgaagttaattatagcaatctcttttgcaattgagctgagacacgggcctcgacaaattcatgttggatgttgttgtaattttatgcccggtttttttttttctttctttcttgatggtacatgtaaaatgtgaaagaaaatacatttaataaatattaatttaagacaatttatttttattgatataaatgattccttaataataatgaaatcagaatgtaaaaaactatgtttttaaatcttttaattttagcatactttaaaattagtttaattaatagaatatcattctaatatgatttataaaatctcaatgtacgtaatttttattcaataaaattaagtatttagtaaataaagaatcgaaagatatatcctatgattactcagggcacaagaacgtaaaaattatgctcaagatcacgattcaatcccctctgctcagtgacgaccatgagcataattcacaggtgtgaccgtctaagactcatgtctagaatggatcaaaaaatttaaaaaatacatttataattatgtagtattttttttatgttacttttataaatagattaaaattgttacctccttttatgttttcttaatcaaattgaatataacatgtgataaaaaatataagagattattttttcaaacatgttatattcacaaattcatgttaaatgaattttcaagcatatattctaatagatacttttaaattaacacgctctttcaaataattttatcatcatgtagtgaacttattatctactatatattaaatctgaccgtcaccacatgtcaaccattagacagttttcactttttttattttttgatgtattttatttttgtttttaaaaaatttaaatattttattttattattttattctgtcactctttcatttactaaaaaaaccatgcattacacggttctaatgctagtaataattaataactcaaagtgtttgttttttaagaagataaaaaatacaaacaactcaaattataaagaactttaaactaaaattttaattgtcaattttaataaaattacatatttgtttttaatgcaaaatatatttgtaattccaaatagtttcatataaggatcccttatttattattttttggaatcttatctctaatgctctaataaattaacatttgcggataaataaaataaaaataaaaacctgcacaagacagtggtgcagggcaaacgtggctgatgcagcaagggtggagatgaacccatacatatatatgcttttcgctagagtgacccatagggtcgttagattcgccgttgatcgcgagaaggg

SEQ ID NO: 2169 - DNA, 1848 bp, Glycine max
  Soy_ogl_181 Gm01:47087301..47089148 Cluster 9
gcttttaaaaactcttccaagtgttgcacaagaatgcacccttgttttttgcgtgcacccttggcattttcctatactatttgagaacatctgttttgattattttaaaattcaattccattgatgccaatttctctggtttgattgggagaagatgcaaactaaacattagttcttgagtagagttatgcaaaagacacaatgagagatttgcagtactttcaatattggcttcgcccagactcgaaccatagaaccaactacaccacaaaaccatttgatgtaaaagcaccatatgctttttgtagtttaaatatttttgactaatataatatgctagcattttcttggataaataaaataggtactgtacaacatagcagcaacgataagcgagaagtataccgtaatagaaatattttacgttaaccatcaaactcttttagaatacactagtttttatttccatgaacatccttacaaaatcagtgacaattgacaatcataggtcccttaattctggaatcaactctatcaatatttatggataatcataggagaacgcgacaaatataagaattaaacgcccaaagagcattttctgtacaggtgttttataagtttttatcattcgaacatatgatttgacagtgtgttagttaagtaattttttatataaacaactattacttaattcatttttatcagttagagaatcatttttcaataacataatttaatgtgccttaagttaaacacttttattctatcaactttaatatttgagtaaatttgtgtaaatttttttaatctatgatattataggacttataaatttaagataaaaaaactcatttaagtaattatgtattataaattctcttaaaaggtatgcatttattcaatataattccaaaatacttaagtgttaaaggatgtgactcctcttgtctccttcttagatgttgattatgggaatatcatcataaagcatgacaatccaatggtcattagggttgtcatagcaaatgttgatgtaaggaaaagcttgatcaattgtaccattagactttttaatcaaatggagattataagaaggagttcttcttaccatacaacaattatcaagtaggattgtttagtgattttttttaactcttggacttgtggtctttgattctcttgtgaaattttaagatatttttataaattttaatcatttgagttaattatgtgattaatttttgagttcaacttactcatacttaaagatttttttgtttatactcaatgttatattatgtggaaattgaaccaaaactttctttcataaatttaacatgtgttatctatagaattattttcattgaatgagtattttggggaaaaaatgaaatcttgaacttttattatttttttatatttgtgtagcaatgctggcagatttagtttatggtgtgctcgtgaattaccttcgtgcactgcatatactttgaatagatactatcagaggtaacggaaaatgaaaattgattgtgaagataatgtggcgtcgcccggactcgaaccggagaccttcagtgtgttagactgacgtgataaccaactacaccacgacaccacttacgttatatctattcttcttttatcatttaattacagtatgaagtatgcacatatttttttttttttacttgataaatgcataatattaactattaagttttattcagttgcataccgtggaataccacaccactaaatgtgtgaaataaaatataatatttatagtacataagcatttgtactattatgcatgaatatccatacaaaattagccacaattat

SEQ ID NO: 2170 - DNA, 1786 bp, Glycine max
  Soy_ogl_3033 Gm09:6542815..6544600 Cluster 9
gcaaacacacaaatttatgaattttatgatttctatataaaaaaattgattttattatttgaaagatttaaaatttcctttatctacagttgattggagttatattttttaatttaatgcagttcaaagtgtttttatccctataaaaactaaatttttagttaaatttaaaattgaatgtttttaagtatgaggtgaaatttttgtagttataaagagcaaataaataattaaactaattttttaaaatcaagtaaattaaagatatttaaatttacggtaaagcttaattttattgaaattaaaaatttgctaatatcaatgttaattgagcgtatcataaattaatttaagcttgcattttaaattttaattatttctctccaatcactattgatcatgagaaattttaatttcacacaaataaatttataccgaaaacatttgtcagcataatatttgtatattgtatatttatttcttcttaagcaaggatattgtttcctcatttcacaaaattcagtttttggtaatctcttttaattcggatactttattttcaagttggcctaatttaagaaaaagaaataagatctcaacttaatggtattcttgttcccattcttctctgtatttatcattttgtttttgcttaatatttaacactccatcttattattgttaatctgtgagattatatgatagattataatgaaaaatgtgtacacaaaataaaagtaaaagtaattgtaattatatattgttatagattatagatatatatgataaacatttaatatacacgtgaattggatatatcaaaataagcaaaatatgatttatattttaaatagtttgatacttgtattaaattgttaataatttcttgagagaatcaattgtggaacatatgtcaatctggttgtacttagtattatttgacgtgtgagtagtattgcttatatagattctttctgacttatttatttatgttgttcgtcttttagataatttattttatttttgttatatggtcattctttattttttatttcttgtattttgtcttcatatttatttctgtccgttgattgttgattttccatatctttatgttacctgttgaataaagaaaaaataaaagatatataagatataaagaataaattgagcaagaaataactcaccaaaaaatgtggttgataaaatctttaattctcaaattggaaaactcttgttgcttgaaataggtgtagtctctcatttgaagcaatgacgcaagtgctgaactaaaaaaaagggtcaggttaatgagtttaaagaaggggataacttgattttaaaggagaaattaaagagagactcaaagagaacataagatatataataaacggaaagtacaaaaaagaaattaccccctatatccgttaaattcctttggatttaagatttattgaactattttaagaaggttatgatatggattaaactaaaaatgcacctaaaatatcagcaaaaagatgtaacgaatgaggaaaaataagaaaaatatgacatggattaaatatataacaaaagccacattcgatttggtatcctacaacattcaaaaagaaagaatgaaaaaaaaataaaaatcagatatgatcatgctcgcaagttgcagcatttgcatgttctcttattggcttcagcaaaaaataaattgcatgtgcaaactaaggcttcaaattatgcgttttgcttctgatatatataacaaaaaagaggaaaaaaagtgcttttc

SEQ ID NO: 2171 - DNA, 1700 bp, Glycine max
  Soy_ogl_3162 Gm09:37839701..37841400 Cluster 9
ttggctaatatgcttagtcatacatacctcaacaaggtcaaccgtgaaagcaagtgaaattaaaaaagagaacgtgtcgcaatcatttttattatttttaatcctaaatggaaaacataaagctgtaaaaacttgaaaatcatgggggctgatgccgagatgaattgtttaattacttttgcattttttttcgtgttatatatcgacaatgtgaatgttattttgaattgatttttcatgttatatataaccactgaattaatttagttaaattttaaaaaattaatatatgtttacaagtctcattttacgcatcctagatacatgaacctagagtaataattgaccttctccactcttctcttgctagttgatagtgataggatgagaactacccaacagtaacattattactagaactaaccctcgtatttcaggtaataatattttattggcatatcccaaaaataagaaaaacaagtaatgataataatttgccctgcgccatttgattatatcatcatgtccttagggtaattttcaacaaaaaaaattataaaatgtacataaaagtttgaatatgtatatttttatctttagttaccttgaaattatcatatcaaacaaaatgttactatcattatatatatatattgttgtcaatgcatcaataccacaaccgtctataccagataaattgagtcaagttatatattgtcatcaatcccgaaagtgtaggtcataaacattgcttttccattttaaggctatagtatatataataagaaaagtcaaattctcattaagctttcattcctttgaaaattttaaatagcaccttatttgttgaattgaatatttagagattaaaatattgcggaacacactctaacacctcttccccccttttttgggttacacacatgacacatcacaatccttttgaatatgggcacaagagatactcaacaagataaaagtttgatactcaagacaagataagcacaatcctatatgaatcgctggatgatttattaagggttgaatgcgtgggttgttgtgtattaatttaatcgtcatttttcatctattaaatgcaacaaagagtcctgataatttcaaatcaaattttattgcattaattttactcgtagcataattttctttttcaataaaaagaagattctcgctcaacgtttttaattgaatattactatgtcgaaggaatattactcatgtaacaaatactaatattttttatttttttttacgtttgtaacaaatactattgctcttgcataatttgagtagtgcaccgattttaggcaagaattaatgaatacaaacgttcagacgcatagaaaaaaaaaacaggaatatgggttaggtgtcgtgtatgtgtatttccgtttttattttactatagtttcaactatccaaacggcagtagaacttctttagggattattatctgttaaatgaacatttaatttgtttataatgtaaataatatatagaacttaaacagtagtctcacatttaagttctaataatatatcactgtattaaatattttttaaaaaatatttttcttctaaaaaagtatttttacctgctgaaattttcattagatttataatcaattttgacctctcagtatgttacttttcagtacaatgttatttctggtttactaatac

SEQ ID NO: 2172 - DNA, 1671 bp, Glycine max
  Soy_ogl_2076 Gm06:44814930..44816600 Cluster 9
caatatgagtaagagaaagacagatgtcttgttaaatttcacataatctcagataactacttaaaatattttctatgatttttatattttaattttaatcatccatataacatatgatctggggattaaaaaaatataacatatgatcttataaacttctcacttttgtagaaaaaacaatattctcacttaatatatcccatatataggtaagatatttataatttatttttatccttaagaatcaaaggtaccaagtgatttataacaacttatacatcatatacaatcaattaaattaaacattcttgatttcatatatatatatatatagttgtcatataagtaatttaatttgcctgattttttcatgtcaatattttcacattattgtcttattctcctccttcaacctcatatcattacgaaaaatgtatttttctaacttcttgatattcaatttcttaatcacactttatatttattgaacactctaaatatcatctttactcttttttgataattaatctttttttaataattgatcttctttattaacgacaataaagtaatgcaagcaagattttatttttctaattacctatatgattagttctataaccaatgaatttatgaaaactaattgtttagtttactaaaatgttgcatattaaatttaataaaactaataatctttaataagttggccaagaaaatattaataatcattactttttaatttaactttgagaaaatcctaattaaatgtttatttttatgtagtaagtttatcattttttttaaatggtaattttatatagcaattatatttgattttgatatgtcttttcgtttgcaacatgccactctaatttgtatcttctgttttaaatccattttttttctttacttacaatgtcaggcattaagcatatacatcttagggaaaaaaaagccacgaacttgatcaagtaattaaaagcacaatattattttctgaaagtaaaactattatcaattttggttttcatatatttcatatttcatttgctcattgttttatacttcaatacatgactttatattcacaatcatcaaaacaatttaacatagtttttttttcttttttgaaaggaaaaaataaattaaattaataattagaataataaaatttgacgtatgcaaaaatgttataaaaattaatatcataaaaaatgtcatgttaccaaatttgacatataagtgtcatctaatcttatattcttatatattccttttaaaaaaaaaaacagatagcagagagagaccagcccgcaggcgcagagtatgacatatgggtccagaccttatcttaaactgttactgttcaaatcaagatccaataaacttcaaggatggatataagaaacaaaaatgacaattaaatattaagaaagcataaaccacaactttgaatatctcacttctaaattccaattcttatgtttgtcctcaagtttacaatcacctttccaagctagaacccaaaccatggaagggtcacatgccatttatttgggttacattaaattacaaaatgtaacagcttgtcatttatgtacttcggagcttcacagtttgaggaacagcacatgtttagttaacatacaaggctgaagaggtcaactgcat

SEQ ID NO: 2173 - DNA, 1354 bp, Glycine max
  Soy_ogl_3396 Gm10:6603001..6604354 Cluster 9
taatagggaacgttaattcactgatcatttttttatatatattttgtagtatgaatcatgaaataaaattacgattttttaaattttttttgaaagaaaaccatattttgaaaagggcacactttgacgttgcgtgaaaatgtcaaatatacatcgtctactttaaatagcgacactttagtgggccccacctatctctgaactcgttcaccgataataaatatttttcaccgtattgaatttctcgtaccgcacaagataaatgcatgtcgttggtcactagattatgtcaaatacgtctctccacgtttttaaattagaaaaatgaaaatatatggttgaaattaatctatttttggtgcataaaaatttataagagcgaatgaggtctttgcctaaagtagcaaaagtcttcagactaaaagaaaacttatacattctgtttgattatgatgagagaaataaaatggataaacattaaaaaaaatagagtgaaaataaagtaaattattggattgtttgatttaaatgaaataaataagaaatatagttaaaataaaatagtacattataaaaatagtggtatacaagaacattatacctttttactgagggaaaaatgaaaaaggaaattgaagtcaattatttttctttttttcccctttttttcagaccaaaaatattatcatccgcattttttttttcctctttacttttttcctttcacttttttctctttcgaactgaccataatgtgaattagtttccttggtcaaaacagataagaggagagaaacataaatatgtacacctttaacaagaacaaattctttaattgtgagacctactgaactcaaattaattttaccttatatcatctttatcaaacattcaaaccaatttctatttgcgcctctcctctgaaaattgttgccaccaaacgagctataatttactcacatttgccttattttaaatacacaagtgaagactcgaaatttaaattatatattttaatttccttgagaaggggaaacattggctcataggttcaatataaattacttaacaccaaaaaattgtttaaagagattcctaagttatttttacttgaaatgttatgaagaccttaaaatatcataaactacaatgaatttttctatgaattttccaagacttttaaatatgaaaagataattttctcctagatttatttaacccaaattattgaaagagtgttcttagataaaatcgccctatcgtagatttagaaggctttatactttgtaaaactttaaactcaactgaaaaaagttatgaaataaattataaataagagatctacaattacctt

SEQ ID NO: 2174 - DNA, 1192 bp, Glycine max
  Soy_ogl_6591 Gm19:45340998..45342189 Cluster 9
taatggttagttttctttgttgcacgtatagcactgcaacgatagaaggtttgttgcacgtatagcagtacaactgtgaaggagtgaaaaccaataaaattctagactccgtgagttaaccggttaggaacgaggaggatgcttttgtgattttacaaaacggaattaatggttgaatatgtaggaataaaaataggtataaaatttaataatctatgtactcttgtttaattctttttttttatgaacttttctgttcaattaattgaactatacgtcttatgtgagaatatgataagtttgtttaaacttaaaaaaataattttaaaataaatattttttctatatgttttttttaagaaacacatacaagttgcttcataaaataaagagaaaattgttttctaaacagaataagtttagataaacatacttaaaaaataaaaaattacttattttattaaaataaatatttacttcaacaaataaatttaagcaaactaacccattatatgagtgacactattcacgatccaaactctaggaagatgtttacctaccctatattctctttatccctggcgaaaattgagcttcttgtctgtcatgtctttcctcttctgaagattacgggtcaaattcccctctttagatattaattgcaaaccatttgcagaaaaacattgaaatttgaagattaggtttggtattgttgtgttacatccaaattagtatgtagatatatctctctcaaagattataacaataaaatgaataaatttaaattccaccaatagaaaatggaaaatatgtataatgtttttttacaaaatattaatttattagttttattaaaaatattaatcgaaaaaatttaaacatgtgatatttttttcttttttccttcatccttcgtcaatagacaaattttatatcttttacaaaatatatataatgtatccgatggagattgatagatccacaaaactagggtcaaatctaaataatacacccccaattcatgcctttagaagcgtcaagaaatcatactctttcatcatacctaaagttcacttttaaatatttttggttcactaattggttgcaacatgcaagatcaagccaagtttaattcctgcgtggtcacatgaatttttaacgtaacatttctgaattcccattattaatatta

SEQ ID NO: 2175 - DNA, 1181 bp, Glycine max
  Soy_ogl_2073 Gm06:44325801..44326981 Cluster 9
ataataattgtttgagtatatttatcgtaactacaaggattcaaataagttaaaacaagtcacattaaatcttgtgtctttcatattttgcagatacactgttgaattgagaaagagaaatcaacatgtttcttccccatcgatcctctttcagttttaagtacccatatgattaatgaatctcttacaagtaataagctattatctttgtatttttttttcataattataggtttgtgaatgatctattaacatactattgtaccatttctaaattttattttattttcttttaaagtttgtcaaaaatggtactgtaattactttttctccctgcttgctaccacattctctctttcttttttccattctttccattctttcatctgctatcacaacttacacagaagaaaaaatattcccgtgatccactgttgccatataaggtaagatttttaattttaaaccaacttttaagaatggatatttttattttaaaagtggaaattatgattttaattttaaaattgaacccggatactaaaaccacatcttcatctggtttagtttttcaaattttaaaattttctttctttttttttaagttaaatagattttaaaactgcatgtcgataattataaaagtaagtaacccaccattttgattaaatcaagaatggatttcttaatttttattttaaaaatgtaaattattattttgattttaaaactttctcttcgtctaattcagttttcaagttttgaaatttcatttctttttaaagttaaataaattgtaaaactacatgtcaataattatggaagtgaataatccaatattttggttaaatgaaaactatttttaaaataaaaagtaaatttaaagtattgatttcttttaaaaattataataaattctagaaaactaaaatcaaaagaagaaaaaactttagaaactctacataattataaacctatttttaaaaagtacattttataattttaaaatcatactttttaaatgtttgtatatttcatgacgaggaaatcgaaatagaaattaaatcttactataaaaaaatggaatagagaaataaaaatgtagacacatcagcccaataacacttgtgtttttgttagtaataatgaaaacaatttcacctcattacttaacggccaaa

SEQ ID NO: 2176 - DNA, 1669 bp, Glycine max
  Soy_ogl_2092 Gm06:46325132..46326800 Cluster 9
ttaatatttatatatgaatacatcttaaaaattatttatattttttttatcttttatatgcaatcaaaccaattcaacaaaaaaaaatcttttatctgtacttataaatatatttcttaattaccatttgttttaaatagtaaaatatgttaacctaggttttgatgaaaatcaatgggtatgaaaacttatcaattatataataattatgtatgtaatattttttaattgagtccttgcatgcttgttagattcattctatacatgcaatgtttttttttttttaaatccacgtgtattttctttgaagataatcctatttgaaacacacttaattatgaacatactagaattggctatattatattttgtttgatagttgagattcttgattttcacattaaaatgaacccttaatcttagaaggataaaatacgtttttagtctccctaaaattattaatgtttaaatttagttcctataaaaataatattattttggtctctttatttctgaaatgtttttttaaaaaaaaaatgaataacttgtaagtcttaaagtgttctagatagcattttatataagggtaaagatggtttagataacatttaaaacaaaaataaataaatttcaaaattataggaaccagaataatacaaaaacaaaattagagggatcaaactcaaatattagtaattttagaggaacctaaaacataatttgcccatcttaagaaaaactaaatccagttttctttaatttatatgtattttttgtgagctggggtattttccagccaaacctcaggtattaattttttaagatagtaatatctatttaaagaactaatttttctaaacctacttgagggtagcagataattttctcgttgcaaattccttttccttactataatgccttctctgttctcggcttcttaagtctcctttatataatctttagtctcacaaatgttcgaaggaatatctgcaaaaaaagacaatttgaggctcaaatcagatctcatagcttagagagatgagtgtaattaataaataaaaatgaatagttgatttacctcaataatctaatcctttttaataataccttagtggacctttggatccatacaccttgttcatgatgatcattttgattaatctaggtttaattatcattattaggatcatggttacatagataatctttattattatatcttaactttttgtctttcgcgggcacagtgttgttatgtattcggtcattttgccatccgagtatccaaaatcttgtttcgataagtttttggaccaggatgatactagtgtcctcgtctctatgtgtctggatatttgaatatcttatgctattcagtcatctgacaatccaaatatccaacctcttgatggtatttgatcatttgaccattcgaatatctgaatattcctgtatccgatatggtataattagtgtatatattcttttaaaagagaacgttttttctttagttgttaaagccaaaatggctatttttccaaaattgaatcatccctggacaaacatattatactcttatgtcaaacattaaatttaaagtatctttgcctagaaacaattaatcttgggataaaaaatagatacagtatcacaaatactattaaagatg

SEQ ID NO: 2177 - DNA, 1168 bp, Glycine max
  Soy_ogl_4064 Gm12:33304230..33305397 Cluster 9
aatatatttataaattttctcgtttgatcagttatttacttattatatttcacctaaacaaaagataataagaaaaattgattttttttattatataaataattaatatatcttcgtataatcaaatcgttatttaaagaaacaaattatattatttctttattaaaagttaggtaaattctagtaaatgataaatattttttctttatatttaattaattatcaatttttttattagttatacgtaagaataaagtgttaaatttgtatctatctaaaaaaatctccatcaaatcatccataaataaacccccctatcaccaactcgtaaaacagtaccccaaacttaacagtccctcagagcatggatagcttttttgaaaagcagcattcaaattcaaatatacataataaaaggtaaccgtttacaaaataaaggttttactttatgtctggagttttcccccaggattttggaatcctgacaattgatttattttggttttcttttgccctttcgtttttagtttcatatattaaatttttatattaaaaacatattaaatttattaatttttattttgatacaaaagttactttaatataatttaatcttttaatataaaatagtatattctatttttaattaaaatgtaattttggctatattaaacataatctatttttaatataaaatataccatattagtttttatgttcactttatctatatgccatttaattggtcaagaatattttctttgtttactcttttatcattttaatttaagataaaaataataaacaataaactatattttgattagttaaattaaatctaatcatattacttattggaagatgctgttttgcacgaatttttttcgtgaaactctgttcaaacgtgttattttcttaaaaaaaatattttatatatttttaatttttcaattaatatttactttaaataatttaatatttactttaaataactaacagtcatccactaaatgtcagttggctaagataagtgacaattagactaatttgaccaagagtgtctccaaataaagaatattcatccatgagtttttaacttgattttagttcctttaaaacaaacttgattttagtaggtcctacattgtcatataaggtttaagaattt

SEQ ID NO: 2178 - DNA, 1000 bp, Glycine max
  Soy_ogl_906 Gm03:36544501..36545500 Cluster 9
gaaggatcaaaatgagagaatgttgattgccttttggtgtttaaggcataattttttatgcaaagagaagtctaatttttagttttgtttctttagtttctaggtcaaaacatgacttaaattgcttagaatttcaatgtacaattcttttatggattgtttatttttgttttatatgcaaatcgataaaacagagagatatcccctatgttatctagcaaggtgtcaatgatgtattggtgttgccaacaagccaaccaagaagattactacacatgcctaaatcattaacagttttgctcaatcatgtagttattcaattaatctttggacacaagggatctccttgaggagagttatccaccaagagagattttaattaatggcataaggagaatcaaacttgcatctatgaggaagatgaaagtttaactttaaatctttgaccactaatatcaactcacattaattatgatttttttctcattatgttttagtatgactatatttattcatatatatataaaatgagctttggtgagtatatgaactgatttaaaaagtttaatcctgatagaaattaaaatgataaaatatatatgttatgcatagagatttttttttatttataaaaaaagcatctttttctcaaatatgaaaaatcacatcaaattaaatttcattagtcgtactcgtattcaactttgctctcagttataacatgacataacaaaaggagccattagcaaaaccctttttggttaagggatcatttacagttttaattacagtatcaaataagaaaaacatagcagtatatcgttaatttaagatactaaaaggtatttaaaccgaccaataaagaaagaagagagacaacaaagacatgtactgtagtacatactacgtgggaataacctgtgtatttaatacagtcatcttggttaaacgacatatatttttactgactccaaaactgctttatctagaaaactgtact

SEQ ID NO: 2179 - DNA, 1002 bp, Glycine max
  Soy_ogl_3348 Gm10:3318399..3319400 Cluster 9
aagcccctcattgattaagacatatgctccacacatttacattaggccttactctcacaccagaataacctaaataagattaacttaattgacactctactcgtttgtgaaagagagaagcttaattatataattgatacgattgggagaaccctgtctcacttatatatggtggacatcaggaactttacttcgagtaagacctagctagctagccctggtatgtatacattctgaaccattgatcaagttgaagcaaatttaatatagtggtcatcgatcacaagaagattaatatgttccaaaaaattaacagtgatcaacagggtgccatagggaacaagtgttccaactactagctaattatattctctaagaattaggcagtaccatctcttttttattaaccaatctttgaatacacatgcctgtgaaattccagaaactgatcaattggatctagtatttatattctacctgtgtttatcttgtatttccttttttttcaacacaaaataaagaatgaatatttaaattagtatttgagaatatgcaggcagaccattttgactcctaaagagacttttaaatttttttcattaatttctgactttataaaagtcaatcatttacaaagttagggattaacgaaggaaatttataatctcaaaatctaaaatgtataatttatacaatcttaaaaaatagtttaaaatttattttctttagactaaaatgtctgatttgtattatctcaacaactaatttaagaatttactcgcaaagaaaaacataatatattctaggtgctgtcttgttttgcagcttcttttcagtgttttctttctccctagaggttgggtgacacttctactgcacacggtcttcttgtctctcttcacaaaaactagtgaagaaaggacgaacactaacagatatattgttatcaaagttatgtggatcatgatattccacggataaggttaagatttgattaaactt

SEQ ID NO: 2180 - DNA, 1700 bp, Glycine max
  Soy_ogl_6303 Gm19:313101..314800 Cluster 9
tatacacaaagtttggagattgcctaaattttcattggatattggtttgactagcctgagtctaatctaattaactctcagagccagaaaaatactttctttatggaatttttcatttttgtttatcaaatttaaaaatctttctttgagattcaaatgttaaaattttagataagttatatttttagtttctctaaatattacaattttttatttggtccttcgcttttttaaagttgtaatttaatcatcaattttttccccattttcatggagtatgtcttataattaaaatgatttataaaataggaaaatcataatatttggatagaataattaattgaaaactcattatatttacagaaattaaatagataaaatacttaataagtaaaatgtatgcataaagaaaacattaattttataaaaattaaattataaccttttgtaattaagagataaaaaagcaccataatgtttaaaagagttaaactatatttaaatcgaagtataagttatcaggtaataggagggaatgtatcctatacagtgaaaaaaaaagtatgagatggtaaagtgttacaactcactactgaattttaaaattttataataaaactattatattaattaatgaaatttaatgaaagctaaaaattctctacagtggtaattttattacacaagtttaattaatcatttagtcatatacttatatactaatttttcgtattagtcactgtactttcatattattaaaagggaagccgaatacaatcaggaatattattaaagaaatgggaactagcaaagaatcgaagtattatcacaaaggagtgagcgacttaattgatttgtctgagaataagaatcaaagaggagttgtgaactaaactcagattttgtttacataaagcaacgatggtgcctgtctaagtaatgcatggcacgagaagaagatatcatgttgccatgaagttgcttgcaatcaatcataaatacgacgttttgaagacgaagatctatgacccagctgatgaatgatatgagcaaaaacaaactcaccattaatagttatggatacaaactcatgcatcatatgatctcttctcagcataaattgaggcatctatgttgcacttaaaatacccagcagttggagggagtcactatacttaaaactctacattttagttccttttcaaacaatttcttatgtttttattttataactgttttacattgctaaaaaacctaataagaggaactaaattacccatgtagtgattaaaacaatttttatacagaaactaaaaaaagattatgctagtatatatataatgaacaaatagttaattacttttattatatcatttatttatgtattttcagaaattatattatgcattatatctatttattttcctcttacgtctatttcaattcaatcacttcaaaatgggtcgaggtctagcattttgcatctgatttagcacacgatcctagtctctagagtatgccaccatgcaagctatgagtctacttgtactggtattgtatgtgtcaatcagagtgattgatagacaaagaatatgattgcttacactattcactgaaaatgattgtttcaaacatgtttgagtgattagtggtcccacaaaatgcacactgtctattgtctactgtctgagaccccaccc

SEQ ID NO: 2181 - DNA, 1600 bp, Glycine max
  Soy_ogl_6772 Gm20:35368601..35370200 Cluster 9
gcgaagatggaggacagcatcgttttgctttgtgcatgctggatccaatgcgttgcgttgggtagaaaacataaatgggacccaccactgttgcctcagatacactctcgaggcctcacgcgccgctctttgtactcccttcttcggacacacaacgcacgtcctttgtgcaaccattttcctttttcctttttccttttcttacccgccatccactatccaatcattttaatttatctcccttctttttttattttgtaggtgaacatcatttactattttttaattaatatattaaaaaaattatttattgatgagcaaataaatttaacgttaaggctaattgtttctattgtcataacttttatgtaacggaaaatatataattattagtataaacgaagtaactatacaataataatatcctgtaccatgcaaatattctgttttgataatatttattaatataattgtttactagtatatcatattattagcgtcaacttataatatttatactaatcatttcttcttctttttgttaaacaaaagttgtatcaatagaaatttattcaatgttaaaccattaatatgtgatattttatgaaatgatataattaatattcaacttttaataagttttttggttttcttcttggttagtaattcatttttctttttactgttagcatatgcagaactgagatcctgagatatttggtgcatgccctaggtgaaccaaaaaatatgctcttataatcctttaaatattattattcttgtaattttttttacaaaactcattaataattttttcataactaagattctttataaatttttttgatagaaattaaaacaaaactttttaatctaacctgtgatcgcacatagaatttaatatttccaattttaataaaaaaattagtagatacgataatatgaaaaattaatattattatataaattgtacatgcattaacaattttaaagaccatgatatcgtaaagttgattcagttgttaacagttttttaacgacttttaattctttaaataaaattaatttcaccttcaagatcataaaaattatcatattttatagaaatttaaattttaatatttatataaattaaataaaaaatttggtgtccctctagatatgaaaacttgggcaaccatccatcttaaccttgctcggcataccactgattatatgttaaaaaaaaactcctatataatactagtaaatcatatatgcacagaaaagaaagaagatgatcataccgttcgagcatattcaattattaaccacaaatttgttgcaactggagtataatgcatgtctacaattttcattcggataaatctaaattggtgattaaaagtcaagcccagccagaggaattaaaacgtaaaggtgagacagcaaaactggagagtcttgtagtgtaagaggtggtctagtatcaaagtcattgctgcacctttttaattaaggggataataaaacacacacaatttgatcaaatccaaagctgatttggaccaaaggattggctctcctagtttgttgttttgatcattttgttctttccacc

SEQ ID NO: 2182 - DNA, 1200 bp, Glycine max
  Soy_ogl_1580 Gm05:3549001..3550200 Cluster 9
gcaatctttatttggcttagtttaagaatttgagtagaaatggttatataaaaaaattatacttgttgaatgaaaattgttggttttccttcctgctcaaatttatcgaatttgaagcatcaaatttaaaaataatacaaaaatgagcatattcttttaacttaatattggcccactttatgaatttaccacttgggtatatatgactagggtgaaatttgagttcatgtcaaaggtttatttatagtgaacgagaaaagtctggtaggcttgaatcatatcagaattggtcttggtatagagctatggtgaattttgaatttgtagattggagaaaggtatattgaccagaggaattgactttgatgatgtttactcggctgtttgatggcaagaccattacgaaagctgcataagcttcgttgtaaagtaatttgttgccatgatgctgaatgtgaggcatttatatctggtctaaggttctctacatgcataatatgttacatggaaagattatgctattatcttatcatactaagatatatatgtagaaaaattgcttttaaatcttcatgtttttaaatattttttaaacaaaaaataacatattttaagatgatataaaaatgatatactaagatatttatttttcactatagtgaataaaaaatggttaaaaatcattgtaaaaaatgttaaaaaaatcatatttaaaaaactttttgtagtaatgatttgagatgtcctcataagcataccctttacaaatacattctcaataggacaaaagacaattaagttatttcattcttatcgtacaaaagatattttcttttcatatgcgccgatggaatgggctgcacatgactaggatttctattaaaatgttcatctagcctatgactaaccaatcctttgtaagaattatatgacaaattgaaacactcatgtgccgcaaggataaaattaatgataatttcgtatgaatacagtctacactttggcatcagctaaatccctccattagaagagtgtacaaaaatgttggcatcagctaaatccctccattagaagagtgtacaaaaatgttaagttaaacataacatcttaaaaccttgcgcgagagtgtgaattaagattttgttttcctcctttcattaggctcaacaaattggcctaagttattgaattgtctctttt

SEQ ID NO: 2183 - DNA, 1065 bp, Glycine max
  Soy_ogl_3438 Gm10:37978791..37979855 Cluster 9
gtataatgttattgagagtcaacgtgagtgcgttaaaagcaaatgaaaaagggcccaacaatatctacaattctaccattcctttccagctggtatccaccgtggggataccaccaccacgtggccacgtcagcatgacacttcgggttatatatactttttcttttttcatcaaattcttaggataagccaatatttttaatttttaatattttatttctttttgttgaagatctggagagaaagagagggaaaaaaaagcaacgcaaaatctaaaccaacaaattacgatccttagtctgcagaacatggagcaacaataaatctaccactgagtatttgttagtctatgatttcatgaaacattattttttatttttattttaatgtttttcattttatattaaaaatcattaaaataattaatgttggctaaaattaagaaccaatgaaggtttttaatataaacttctaaaactaatttgaaggtttgcactggaaaacgaataataagttagttttaatgaaacttttttagttgatttttaatttatacataagtttttttaggacaaaaaatatattttaataaagaccaaatgataccagaaattttaaaatttgatcaaacatatacaaacgaacataaaaaggaacatgaaaatatctcttcctaaacacatgtatattctatagtgcaagacatccatatgacaatccaaataaccaaaatccattaatacatgaatcccctatgtgttttagtttatgaaaaaactttttttttcctcctatgtgtttattgaaaaaaatccaaaaaaatccatgaatatcttcaatagaaaaataaaaaaataatggtaaaattgtcttttaatgtaaaagttcccttttctcttatctcttgtttgttttggaaagtttgagaagttagtgcgtttcacgtaactttttgtgttttcttcccaaaggacgaatgaaaccttaaattagttttttcgttgctatagatattttttccttctcgttctactgttctaaatatatatattaatatgtgtaaag

SEQ ID NO: 2184 - DNA, 1200 bp, Glycine max
  Soy_ogl_6737 Gm20:34245801..34247000 Cluster 9
ttcttttttatcggttaatttttttttaagaaatctaataagtaaaaaagataaaagtaaaataaaataaagacactacaataaaaaaattaacgaaaaaaatcatttattttttttaccgtatatcaatgaaagaataataattttttaactaattttaatcattcatgcttcgttttctagtgatgcataaaaaatgaaaaaacaagagtgctttacacatttgaatgaagactaataacaacaacattagtgaccccacacaacattgatggtgtcaactcgcaatccaaacactagacaacgagcttgatgcatgacgatctctaaacgcatggttcaaatggcatggtttatatatgtgtcattagatctactcccaacataatctaaaggtcggtctcagacacggtggctagtgtttgcttgtctcacatagcaacattatttctcttcttgtaggtcacaacaacaaacatgataaaagaacgtgaaaattttaataggagattgaggataagggaatgagcttaatttgtaatgtgttttttttgtttaacttatttggttttcttgtacagtattgatgataagggaatgagcttgtggttcacattgtagtttacagttacataataaatatttaagaagattactttctagtattttgtctacatatttatctaaagaaaaaggaaattgaaagtcaatttattttagttttgaatgaagggagatatagaaccatcagtaaaatgtatgaaaggtcaatttcattattgttcatcggtaggctcataaaaaggtgtaagtgtgtaattactccccatatcacaaattactaggtagtaatactattcagacgtatgcatgaagtgtaattgatactgttgatatacattaaactgaaagaggttttatgcagattatagattataaattaatgtagagtcataactaagtgctagtagtaattgtcattgtaagtatttgggatgtggacaatagggacctgacatggccatttaattaccattgaagaattcagggttgcttgcttccagttccagatgcgcacccggagttctatcgcatgcagattctggaatgtccatctgtgggcgcgagttaatgacacagatacccaaatctatgaaggaatatctctatgtaacgttgcctccaaaggaattcgatctt

SEQ ID NO: 2185 - DNA, 1700 bp, Glycine max
  Soy_ogl_2602 Gm08:11025901..11027600 Cluster 9
agataaataaggagtattaataagatgttggaattatttaggtgtatatccaaaaattaacactctaatactcatgttcacctcatttttgaagaaaaaaatattaagtggtctcaaacaaagcgtgtatctatggtttcagctaattgatcatttgatctctatgtaataatgtttaaatttttgaatttactagaaagatttgagataatcctatctagacttccatttttaagattctctttttacaattaatattcgaattagagtattttattccacgaattaattagctttgatgtgcactcgactaacacctgatcccgtagagcactaattataagttatggaatcatgcttctgttaatcacgtacgttagtgtttttgaaagtcatttttatgttttgttagtgatcgactactgtaacacggtaattaacaagtacaaactaatgtgtgaccaacaaaaaccaaatcaaataaaataaaagtagaggattaaggtgatggagagaagcatatgtatatgattacgcgtgtcaagcttagggtgctaagttttactcctaaaaataaaataaaaaatatatttgcaaaatacataatatacataataagttagtaaaagaaaaggggatttacaatatacacactcattacaaaacgacgacatatctggattggggttcgaaatgtagaatgagtcacagcaggtgaggtagctaggggaagcagtgtcttgtcacagcagcttgttactgtgaagcatgggatgtctggcaaacacaggaaggatgttaattggagtgagaaagacagtatatggacaaaatttgcacacacacacactagagcaggagagggggcatggggtaatcattccatagtacaattggagatgattgatatttattatatttgtgttcctcttcctcgtcatcctaaatcattgttccttaattttgcagctcaccaaaaataaaaattaatatagtattattttcattcatcaaaaaatatagtattgttttcctaggataatatacatgatgattagtattaattattatttcaaggaacaacgaatgagatttcaaaaagtaaacactatcaaagatcccaatgcaatatgacctatctacatatatgaagtgaataacttcaaacttatttctaattattttctaatgtaatctcatttttaaatattaatatcattcctaaattatataaatgtgtcacccgataagagatctaattaattaaatacgatgtaagagtgttataaattatctgtatttaattttgacggataaaaaaaatataaatatgttactcattaattttttttttattgtagttgatcatgaaacaaatttatttaaatatgctagttttttttaatctaattttacgataaagtatctatatatattaaataaaaagatatctttatatacatataatattataaaattaggtaaaaataaaaattaacatatacctttatatttgtagttgtacaatatgagttaaaaagaaaaaaagttagccgaggtatagattaatagggggtaattttgaatgtaataatggcaacctataagcagagacaaaaagaaatgattcatgtttgccacccctatgccttttccccagcttacttagggctcaaatcaaaaaagaaaaagcatcgtca

SEQ ID NO: 2186 - DNA, 1417 bp, Glycine max
  Soy_ogl_4620 Gm14:3620584..3622000 Cluster 9
cgtgtaaataaaatttatagttgtctgtatattaaatcattacattgtttttgttttttggtacaggttatggtggacaaatattttgtgaatatgatgcacatagaaaatgtaaccgattgcggtaagtatttcctatatttataattctttatattatcattattttaattatttatatagaattactattgtgccatacagagggatcccttatgatgaatttggaaggccgagagtagacgctgctgatattaaacacggccaccattggcctccgccacaacaccaccacaaccaccatactctggtgcttggacttgccgacgtgctacttctgcggtagtgccaccaccgtgaacttaatctttgatggtctaggagccttactgggaacataaaatcacaaaaatagggtggagcagataggtgtcattggaaggaagatgcttgaaagggattgggattttggttgtttgactgtgagtgtgatctgtctttgatggtttggggttggaagattgaagcttttgcttgcttcttgaccatggtgctgtgaaggtttcatagagttgaaattgagagtgaaagggttgacaagctgagaaagaaagaaagaaaaataataaaatatacaaaataaaatatacctaaaacacttaccatatttaatttgattatctttttctttgaccaccagagataagaaatttaattttccatcataataatctgtgccttttttttttgtatgttttccttgtgcttgttttatgcagttacatgaaaaaaaagtttccatcagtataaaaaaactaattaagaggttattagaatttagaattatccccccacgtcatcagttattttttgcacaagtactcaggtaaatctgttttaatttgtgggaaaatatgccgatcatcattataattatacatataataatatcttaattaaaaagtattattaggttttgtttaattaaatttagtattggattaaaatctaattaaattatattagctactgaccggttcatatgataacaaaaagaatacaatattgttaattaaaattataagtgcgtgcttctttaatcttcatacataattctttaccaaaaaaaatcttcatatataattatatgcttttaaaaatattattctttatgattaaatatttggattattttttagtaaaaaaattaaattggctagagtcaaatgttggatacgaaaatatgaaaatacgtgtactaaacgtggccttagtctctaccctccaatagagttatgaaaaggggtcattccaacctgtttaaagttcgaagtttgtctgcattattgactctcatttttaacaagctaattaaactgaaaaaaatggacttcattttttgtcttgcatctgtctt

SEQ ID NO: 2187 - DNA, 1677 bp, Glycine max
  Soy_ogl_6774 Gm20:35404101..35405777 Cluster 9
acaagttcaaagtctttccgatttgctcccagctgcttgttgctatcttacgtcgcaagcaacttctccacgtcatgtttaacttgcaccacaacataagagagaaaggacacaatattggatattaaagatagaccacacacttagggaaggaaataatcatattggcaatgatgagagcaaacgagacagcccacatgatgatcatacaaaggcctcctcctgggattagtaatcaactaagttgccattaaactgtacggcaaaaaattgcattaatttgaccgtagttgatgaatccaagtgtccctttggctcaagtatcttgtattttggggataagaattttatagagatcgagatgaacacacagtggctaggttgacagattccctttattagattgtattatgcacttccaccatgtcatttaacttcaacaaattgaaaagatttataaaaagaaaaaataaaattgtatttatggttatcaacagttgttaaatttgtaaaatactttgatttaatcaaataataactctgccacacaaaaatgcgcgtaaaattttcatacagtttattattttaattttaaaaaacaaaagattaagtaaaatagcaataagtttgacataaattacaaatatagtgccaaaaggttcactacaattagtagacaactagatgtaacacaacttcgtatcatttccttgttaacataatgcactgttggcattctaatgtgaatttgtaatcaagctactatatttataagaaataaacaagacattttttataaatataatgtggtatatatgttgaagaatgcatatgtattaactttatgtttgtatttgaatataaaatcagaaagattaattgaacaattattgttatctcaaatttatgtttatttgtaaaatttcttcaattattgtcttgatgaagtcataaaaccaaccatagttgcttgtcacaactaaataaagttgtcaagttgactgttggcagtcgtaactagtgaactttttttatggcatattaaatgtctttgctaattgcacggttactttgtgtgttatggataatttacggcgtgccacgacctataattaagaaaacaaaatttggtttaagattaagaatattaaaccaattaagacatatagattaacatgcagaataagactaaatatgtgttcagattagtatgttttgggctcaaaaaagtatacaaacagtataatacaaccaattctttaaaacaaataagcatttaaaatgaaagtatacgccatttttattaacttaatcaattttactaatagaccttatggataaccattttatccccaaagatcacccttaccttcttctttagagaatatttaatcaactcatacaaacgctcacaatacataaactatagaataatatggtgatttatgctgttaaagatgcatagtagattttaatagaagatataatagagaaaagaaaggggagaggaattagtttcattaacccaatacaattttgtattttatagactagtcagtcagaacaactaactaactctaactgactgagtaactcactcttaaccaacacttttagctcactaagctaacctagctagttcaagttataaaccaatcagaggattgcagtataata

SEQ ID NO: 2188 - DNA, 1200 bp, Glycine max
  Soy_ogl_6330 Gm19:1923701..1924900 Cluster 9
tgacatatcaaagagtttgggtaagtgtgataggatgggggaaagatagaaaagagtattcaagagaaaattatctatataagataattcagtttatactcattttttatgtctttaattatttgaattccatccaaactcaataatattaatgggattgactcgactcaatttgcagatatcaattttaatgttatatatataactaaatagataaatagcaaactaaagtatattttatatacgagatatatttcacaaaatctatacaaaaataaataaataataacgttaggtttgaggaagaaaaacacagaacaatcaaaagagagtacagagcaggactgcagaaattcttttacaaaattagttgtctcggatgcaataggcgtattggttcaccagcaacgtttgtctcggagtaatagttatcaatattattattttttattttcaataattagcaaaacacatatataaaataacaaatttgtattcttattattttctttgtaagctttaaaataaaataaaaggaaaacgacatctttttttttttttgcttttataagcaaaaagacattttattaataaaaataaattaaatgcatcgtgctttctaaaatattaatgaaaaaacttttgaggttgagggtgtggctatttatttatttttataactaaatatattttgttaatcttttttagacagaaattatcaaagtgttgccttttaatttattttttttactgtgtatgatccgtgattaaataaaggatttatagtgaatactgtgactctttcgtgttgcatctatgtccatttgaagtttgaacccctcctttctccattataggagctgctaaacaatgggacctggaaagtcaactacacatgccatgttttacccctagtagtagtctctagaacaacatatatacgggggatatgatgacagcctacatttggaatcacgtacgatagattctttaagaataataattttaaattctcctcttgattttaaggatctgtttaggataattccaaaaactatgttatattttttataaaaaaaaaactttcaaaagcatcataacaggaggaagggattctaattatgttggcacaggtgcatgtagtagttcttcaatttcttcatagtaacaatgtgttatggtttttcggttggtgtggga

SEQ ID NO: 2189 - DNA, 1525 bp, Glycine max
  Soy_ogl_2075 Gm06:44460101..44461625 Cluster 9
tagtgtcttatatgatgcaagatctttgtttatttttttttctagtgataaattctaattcaacttctttaatcattttttttttagtttcacatttcaaattaattaggaaacaagacattaagaatacattttttgagaaaatatgagttattagaagttcttttccttgaaccaacctcctacatgaagaatttctttattattatatttttcttttatcattaaaatatttattaaatttctttattacgtgttgtaccagacccacaggtagtcggtctccatagtggataaagtgagatagacatcagagtaggaaatatatatctcaaacaaatatttatcttatgattcttatcattgaagtttcttttcaagtacctcattttaaatataaaaaaaaaactcgacctaaagaaaaaataatacttaccctatcgaacaagcgaagaattaagtaagaacactcattttaaataaaatatagatttattattcatttgttttttcactcatttgtcttacatatttttatcttatattatttattttaaccattgtaaaattataatatttgatttattattttaacattaaacttcgcaaatttgacagatgtggacacttctcagcccgagcctaagataatctctctaaaatacacattaagatgttgacccatttttttctttgttgatttctctcaattaaatttcccatgttgcactaagttacttatgtatagggtcaatagttccgtaacatttagcaacaataaaatctttaacccaacaagtgctctccgatccaagcgttttcattagtttttattagatgatttattttaattattatactaattaacataataaaacataatgagtgtatttgagaaattatttcagataatttttaatgttttattagctggaaagtctgtttgattggttgagaactcatcttagttacttttttaactaattttggttatgtttgataaaaatgagttgataggctaatagttaagttagttgtaacaaaggctgacccagcaatataaagttagggggcaaaatataacttatatgatcttgtaataagaaaattaccttgattatttattttataaaaagtctaaaatccattaaagtaaatttcaataggtctagtagaacttaatatttagtttctatttccaaaagtttatattagtttcataaattctaggtggaagtcgtaaattgattttgatgagaagttaaaaataaaaaaattcaaaaatcataaataaatatatgatttctagaaaaaacaaaaacatggagaagctccaccaatatatatatgacttctaagagaaaaataaaaatttagaagtcgaaattacgtttacgacttccactgaaattgtgtttccatttatgacctaccatgggcggctatttttattcaaaatctaccggatttgctagttttgaaaaataaaagttccccttataaaaaaaacatatattttaacatc

SEQ ID NO: 2190 - DNA, 1100 bp, Glycine max
  Soy_ogl_6896 Gm20:40697501..40698600 Cluster 9
tttcttaaaaaccaactatatataactattatttcaaaaaagtcactacaaatataaacaagcgagtcctatcaaacttattaatgaagttacaagttattgagttaacgatgctagtattatatcatcagttaacattattatttgacactaaaataaaaaataataatactatagaaatatcatggttaacgttattatttgacactaaaataaaaaataataatactatagaaatatcatgtgcaattttcaaaaaaattaacactagataagtagaggagaaagatactcacttttatacatggaaaaaaaataagaaatttttataggattacacaatataggagtatcgagtttatcaagttaaaaacttttagagatacacgtttgatttactctaattattataaagattaataaatatattgtacgagataattggttattagcatattatagtatataaattatttactctttaaaatacttaccttaaaaatcaagtaaatttttttaattaattgataatgtatatttttttacaataaaagaacattcatactaaagtctatgataccattcatattttaggagattgaatgacaaagctagcgaatgaacaagtaacaaaagaagcgatataacctttgtaccttgccatgttagcgtgggtcccgcgttgcatgttggatggttcggtccacacgttgatcaacgtggcgaatatggaataccccaattaccgtggattccacccactgaattccagctacttcagcaacagcacgccacgtggggacttccctcacgtgaccttgccatcgccatttttgcccattgcttctcgcccctgtatcgaatcgggtgctgccacgtgttatttctgacctttttttttacgtcaaagcaagtaccatgtacctatctatctctttgttattcattatttttacatttttatttcggaaggatgatgagtgagtattaagatattttccgttgttacagttttgaaagggtgtatttgggtgcaacatgtggtggtgggtccattgctagagccgtacctaaacatggtccgggacaaaatgtgatct

SEQ ID NO: 2191 - DNA, 1190 bp, Glycine max
  Soy_ogl_5018 Gm15:12675701..12676890 Cluster 9
agaattgaaataagatgattcttcatacctacttgagtaccttccttgctgtttgacatgacaattacaattgtacaacattaacttggtcaatgctctattactccaatagtggagctgcttttatatgggtccattaccccttttgcttcatggtttttctttttcttttcgtccactactagctcaatttctcaatacagtttaattaaggaccactatattcatatctgcatagtactgcatgtgctcaactttccctttctgcatttcaattgctgaccaattccctttataacaaaaagaattggccattatcatatgcttaacgtaaagcttaattagccatgcacagtgaactcaaagtcatcaaccattgactacaagcctcgagtatgcttcatggatcctctagttttcaaatgaatttaccacccgccagtattttactgtcaatggatagatcaattccggtgtttctttgtcaagttcaaaagattttcaaaccaaacatccaaagtgggaacaaaaccaagtagtaaaaagcatccctcgtccaaattaaagtccaatgaagctttactgttctaacaaatctcttaaaatttggttaagttcattaactgaaccaattttcttattttaagattttttaaaaaaaaattatgattaattctttaatagtgtctataggataaaagaaaataaagtttcaacataaaccaacccaagttgattcggttcaggttggccatccttaaccctatactatatatctaaggggtggattaagatattttaataatgtcaaagagcttattgtcttgttggcagaaaaaaaaaaaaatagcttcttgtccattagcaatgacactaccgatcaaagatggggtggaaatacttggcaaaaaactttaatgcttaagtgaatcataaattatgaaaaagaaaaatatgaattatacatgaaatataacaaggataagactcttcaaattaaagacaatcggtaaatttgtttaaacataaaaagaaattttaaaataagcgcttttaaaaaaagtagttttttaataagcaatggaccagtttatttaaactaaaaaaagcacaaataggatttacttcttaaaataccgaaaagtgattattttaattaagtaaaatcaatttagacaaacacataaaag

SEQ ID NO: 2192 - DNA, 1700 bp, Glycine max
  Soy_ogl_6004 Gm18:9023401..9025100 Cluster 9
attgaagaaaaagttaaagagtaggtggggccgagggggctagtggggcatactcttgggtatttttgtgcaaaataaaacagagagagattggcttgaaaaataaaaagactgaaaatatgagaaagttctaagtcaaataaaaagagctttaaaaaatgaaaatacattaggcctctaattttttttataaaaaaacgcataaatctaggcaataaataaaagcaaaacctataacctcttgagacctaaacttgaaatacaagtccaggctaaatattgaagacaagtaactattggatcaaatcccacaataagtgtggggaaaaagttaaagggtatatagacaaaatctccatgagtttaaagttatttttatataaacaagtagtttgattacattaatcaagggattggtaataaaacttatgaatttagattcgttggctcaacaaattaaggttagaataatttgtgaattgataataacataattttatttatatgagcaatactcattcgttggctcaacaaattaaggttacaataatttgtgaattgataataacataattttatttatatgagcaatactctttactacataaaaattattagttacataaaaattattagttatctttttcattctgtaattcagattgaattttccaaaacagttgaacataaaagattgaataattaggaaattaacataaaaacaagtaataagcacaaaagaagaacaattaaaaaaattatttaataaaaaatgaaattacattaactccaacggagatggaattagctatacttagccatgggaaaagaaactgatgaagagaaagagtcttgagcatataaagctaccacactcttgttctctcccaaaagctctctcttgtactctacaaatccattcctccttttgatttttagggtgcttttaaatcaacatctacattaacactttgataagttcacttaagtaagcttaacatagctctcgcataagcaaatataacatgaaattaacttattagcttgcttaagcggccaaacatggcttgcttaagtgagcacaataattttttcaggttaagacaattgactcacttaaacaagaataaatgtcttgcttaagcaagataaacatctctctaatttacacatttcatcttctcttactaacttgggtgttggaatccctgtaggtttctcatcagaatttggcatgcaaagaccattgaagattcttgattccaactcaaagattcctaatctcgagtttatgcgtgctaaacattttattaccgaatgttaatagctcaaaaacaagtgattgacaattgaatagaacacaagtcattaaagaatttataatgtatatattatatagcttaattagtacacataacttaaaaaggaaaatttataatgtacatgacatacaatgtattcaaattcagaatcacaacattgatcttttttaattaaaaaaaaacagagattctcatttctcaagcattcaaactatttttgcaatacccaaataattaagataataactgagagacagaattgcactttgttatacataagttgtactatatgtttattgttgtaatgcagcttgagggattctagggacttgtgtatcttacttgtcattatctacaccaaaatgagtgactggccag

SEQ ID NO: 2193 - DNA, 1658 bp, Glycine max
  Soy_ogl_6364 Gm19:5418201..5419858 Cluster 9
tgggctaatctgagtttaggaaatgtactttggatactcttaagagtaattctcgtatccacgtttggtctataacctggtttttggacaaaaacaactaatgatatgtttttcatttttcagtttccgttgagaacataaacttccaaaattattctttatcattcttcacttcacttggcatatccaaagttaactgttttttttttaaaaaaaaaaaatcttttaatattcttagataatttgattcttcattcaacgcgatgtggaaaatagcgaataatatttgtcatatgacaacgtaattgaagctgaagcacagaatatatgattcagttaaataaataaaaacaatccgaaagttcctttttttttctggttcttgttctgtatcaataggctccatgcatgcaaagagttcaaacttacgtacccaaaccaagtacatcttgtaattacgtgcgacgacatatacagtttcatttgaatttagtgaaaataaaattaatttgtaaataaacttggtgtccaagttgtgtacgcgtctgtagcaatagaagcatatttagtcaaatgtcgttgacacgtttaaggaatagcgtgacacgcacgtaaaatacgtgtagatatagtagaactcatgttgagaagatgcaattatttttatcgagaaaaacaaagagaaggccacgatctaaagagttttaatgaccttgctccgagttttcccttataagtaaaactaataaattctcttagagtaaaatattcatttatttaaaaaattacaaaattattaccgtttattatacacctaatgaaaacttatcttggtaactttatgattatacttttatttattattttttcagtaaattattatagttataatgttttacatttgaaaagattaaacttactaacataatgtttaagtaaaattaatctgtaagttcttaaactatttgttaattttttattaggtatgtgaattttttttttcttggatctctaaattttaaatttgttttgtaactgaatcctttcgtttaaatattattacgaaaaattaactatttgaattagttatgtgagtttacaacgaaatttttataggatgaaacttgtgaaagaattactacatgaactgagtcgatctgcataagtgatagtattagttgaaagacctaattgaaatactattggattcaaattctacaaagtaataatgttagtttgaaaaggtatgaatattcagtacaaatttatatatatggaggtgacagattcaaaaattaattaaatttttgtgattatttttcatattaagaattaaacacaaaaattcaattagataacaaatataaattcaagaatctaattaacaataatttagaaactaaattaaaaattatcaaatagtttaattaggatttacacaataatttaaccaatcatttcattcatttgtgtctctgttttttaaaaaaaaattgaaatttatccctgatcttatccaagtccaacagaacgcgcttgcgcttgcgcctgcttagttgctaggctcaacgtagcgtgtctccactctcctgattcgctggcctatcttaatgtttagggtaaggatattgtcgttccatttgagccattttgattta

SEQ ID NO: 2194 - DNA, 1237 bp, Glycine max
  Soy_ogl_2299 Gm07:8865801..8867037 Cluster 9
tactttttttgtctttaatttattctgtctatccgttcaacagacttttcctcttcagtattttctagctaatgtgaattttcttacttttgtgttgtgaccaagttctctgcatatattagtccatctaaatctcaatgcgatatattgccagctaattgacaatagcatggcactctcattaatatgttttgtatagggactcatttattaaaattttaaagttttcgtgttggagaggaattgcttaaattgtaaaagaaaacaatagttgtgtataatagagggacccgtttaaatttataaaaagtaaaaaagtgatgattgaatggagatgatctaattaattgtattaaattttggtatgtttctgagttcatttctttcacagtagatgattgacttttatttatccctatttggtctattggttcaacataaacaacatgtagttttttctagtgtcaattttctgacttttgtaactgtattaatgcatttaaatctagctcagtgccaatattgatagctaacaatagcattgcacatttgcactctacttaatatcatatgaaaagttaatttttgttaaacaaaagggttagattcgtcaggaattgtttgagatctctaagaacgcaaggagttctgatttttatgcggagaaatcaaatttgtctaattagtctggctcctcctttatatttctggaaaaaaccaacatacttttacttgtagggcatatgttaactgataaaacaaaaaactggggcatatattaatatgttattatagttttaattaacagccataaatttatttgaagccttactaggccattcaaagacattagtaattaagagctgtctaaaagaagcggtacataaatattaacattttaaaagttatcaacaaagttgtaggtaaagtaatttattatatacatgaatttaacaaatgattcttactattaaaaggcggtgtggaagaaaaattctatcgttataatgaaaatattttaataattagacgtagacataaatactaaaggcaaagaattttacagtgtttatcaaaaaaccgaattatataattacgctagttgctacaaaagaaaaacagaaaaaaatacttcttcgtataaatttacataattaattaaatcatattttttttatattcaaataaacccatagaagacagcatattgcatgtagttattacaaaagttgactgc

SEQ ID NO: 2195 - DNA, 1000 bp, Glycine max
  Soy_ogl_3155 Gm09:37591601..37592600 Cluster 9
ctctttctctctctattttttagttttcttgttttctctaacctcttataggttaacctcttattctttggttttaagggtctctagatgtgaatgagattgagggtgtgttaaagtttcacattaccggaaacatgttggcaccactctctcatggtttgagcattcatgtccatctccttcgctgtgaaaatgtgtgagagctagtcagttataattgaacctcatccattcttagcaaggttttatttcgtcgtcgatggcggacatgaatgtggcattgacggaggcagcggaggtaccgaggaagacattcaatagtgtgaggcaaaaaagagaaaagaaaaaaaataaaaatatctaacgacacatagaaactggcgcactgtgcaagatcgcaagctagtttccatcatccaaagtctctgtattcttgtatacttggtcattatccaaacttctgagccactattgcgatcatcaaagctaatagtctagtcattttcaaaagctccaaagggtttaagctcttgccattcctagctgctgtatgggaatttgaatcatttaggtcaagtttctttatatattaatgattaatattggttcaaatttttaataggctcatttattttaattatatttttatttatttataaaactcaaatataaatgttttacataaaagttttgagtcagattccactcaaattaacataatataatattgataacaaaaatgttaaaattagggtggtgtcatattatgaacaattgtaaacaatcgattcacgtcaaacctatagggtgtaacggtaaacaaaccaatctacatagagtcacgtttaaaatataagtcttcataagcttgtaataacatgagtttgtctgcaaatcattagtatatatgtatagagaaaaatatatattagtggtctaattaattagtcatattttttaaaaattatattattaatataaaatattcatcaactttgtt

SEQ ID NO: 2196 - DNA, 1100 bp, Glycine max
  Soy_ogl_6455 Gm19:39416901..39418000 Cluster 9
tgatttgtgtcacaagaaaaattagtaaagagggatcaaagtcacacattccctccaaataattgtgaaattgaattgattatgaccttgaaatgaattgttcaaattgcgaaattgtttgagttttgatattgattagattactcatgataatgtatttgtggtgattagctaagttcgtgttgtatcagtatcaattgtttataatttatatcacactaattcatgctattgcacatcattggactaagaccattgcacttagaaattagaataaatcacgattaattaaatttgcattaaaacattcatctgaggttgatagaaagcatacctcaaagaaaattgaaccaataaaaagagagacaaattattttaattttttcaaaagacttttgcaaaagttttaaaaggttttaataactcaatttaccctttatttggcaaccataattaggagtaatttttaatctgaaatttggtcatacttaaattattatttttttcctcttttcatgatgtatcctatgaaaattgaatgtaaaccgtccttcacaacctgagctacaccaattaaatatttaattacccttttaaatatatatacgtattatacatactacaaagaaaacatatatatccatgtattgcagtccagttccccctctatattccctatacatggatagtgctgcctagctaaatgcaattttttttcccttttctaatgatttaaatgttgatgaatccattaataagatatttatcaaatcttttatttatttatcctcttggtaccacaattttattgagcaaaatcgctatattgacagattcagacatgtcgactattgtctataatatgcaatgaatgaacatgtgccacggttagtgctgaagggcatccataaaatgatggcaaaaaaacgaataattttttccatgaaaacaaaaagggcaccattttttgttacaataacattgcatatggatgctaagtaaagtttgtgacaaacatgcaataaggtgtgacaggtccaaaggcaaatggaaaaggtcttaatcaacaacctccgtattagtgctccctcatattcaaa

SEQ ID NO: 2197 - DNA, 1670 bp, Glycine max
  Soy_ogl_882 Gm03:34886931..322600 Cluster 9
ctttcttccctgacaaaggtgtatcaatatggtcagtgaaggcatgtgatcagtgaggcatctagaaataaaagaaggaataaaatacagtgtggtagcacagacaagacatacaagtgctcccaactagctctcactcactcctcacctctttgaatttgaagatgaaaacaacaaaacccatagcaaaagggcaaagacggttaaggcactttagttgcaactcaccaattcattatccccacaaggcacgtgtagaacccacaactcatgggtcacacacgatattcttttttttttttactaaattagaaatcatggatatgtcttaatttatgagatcaaagatgaactttaatcgtgatatataattattattaatctaaaaaaaattaaatataattttttttattaaatatatttttccattcatgtgaatgcggatgagtcttttatcctatgtcaagcatttggttatgtttttcaatcgattgattattacaaaacaattttttttttttttttgcaacacatgggtactcataagtcataacgtggtacatcgtccttttatgcggcagggtgcttgcttgaatttgattgataattttattcttttatttttagatataagattttaatcgattagcgtgctaaggccgaaataataaataaagctcgtaagaattttaaaatataaataaatattttataatagtattactctcttgtttctgttataagacacttctaagaaaatttatataaataaataaaaatgggtaaattagttagttttattcaaagaaaaatattattaatgtatcaattttatccttgtcattaagggtcatgtgaagacattaaagtataaaaatattatgtatcactgtcagtaaaaaaacgtaaattcttaaaatctttaataagaaaaaagaatgaaaataaaattaagtgttttatataaagtataaaatgacttaaaaaataatcagtaattccttttagacgatgtgttatattaataactggaaatagtacatacaatatatttttttattcataaacaacacaaatatcaaatattaaattgcatgttaatagaagtttaactttttggtagaaattgaaaagtttgttacttataatgcttggattgctttgataagtcaagatttgagaatttaacagttttagacaatccgagaacttgaagttgaatcattaatatcaaagaaatttaaaaaaattcttatatttaaaaaaattcttatattaatgaaagtaagaaaaaacaggtcaactttttctttcatttttcttcaatcttctctctaaccaatcagaaaaaatacattgtaagtcatgttttctttcctcatactttctctcctataaaagggagcattaaagtatcctgcagcagctaggagggacaaactcaaaatccaagaaacaaattactctacacaacaactacgggtgaacaatcccaattgtatcataaaacaaacccaatccaggaagaatgtgtatagaaaagagtagatgtgcattaagatgtctccttgtacataaaaggaggtgaagaagataatgataaaaaggaaaataaattaagaaaatatattggactatggttttaaaagattgttttaacttagaaaaat

SEQ ID NO: 2198 - DNA, 1500 bp, Glycine max
  Soy_ogl_2310 Gm07:9568101..9569600 Cluster 9
atggaataaaaatatatttctacattataaatccaaatccatatactttgaacacgaataaaaaaaaccttatgatataaatatataaatttaaaactttgcaaaacttagttgctaataaaattgatcttagatgtttaaatttaacaaaatgtgttctcttacttttaccttttaaatcatgttactcttgtttcttactaaaattacaattcatgtgccaaatcttattctcactttaacaaaaactctttgattactatctattctcaaagagcaatgctatattacacgaaaaaaattcctgcacgaaattacacgaattttaaatagaccaataatgagaacatgtataatccttcaaagagggagataataaagtatattctccaaaaaaaatgcaactgtttgtaactttcttactagaatattttggtactatgtagcaattttcattttcaaaactcaagtttaaatttaactgattctcttgattgctcaattaaaactatatattagagagagagagagagaatgtacaattacaccatcattgacacactcgcaccataccctgcttgctccaaataattttcaaacttctaagtgcatgcttgagaaattaatatatcagggaaaaaaatgtttgaggcagaaatatttttgtaaaagaatttaatccttatttttatcgttagactgcattaaaatacatatgacaataatttcaattacaaatcaaacatccactaaataagacatgccaaacataatctctttgtagcatgcaaaatgcttttgatacaagaaactgaccaaacgttaaccataaaataaccatcgtttgctcagcttaaaatttgtgcagagtgacatattaactatttacagagataaaaatatagactgtgtcaaagttttttttttaatccgttagatttattagttttcaatcaaagactccaactagttgtatatgtttatttatgtggaccctacttagcaatgcttcattgcttcctccaagactccaactagtttaccaattttctaatttacaatcacaacttcctccaagacttcttttacactaaattttataattaagaaaaaaattgtaacaaaatacagaaagaaagaaaaatatcaataataaaaaactggtgtagaaataacatgacggagacaataatagctaaagaaaatcagtatgcatattttagagttatagattgcgtaaatttaaataagtattaggtagctccgatccgtagctgcaagtttttgtgtatggttgatattcaatactctatttccagactgatatctactatttgccttatttattcggcatactttcttccacggatacaaagtactaattcaccaagccacgggtgatttgaaaaatgtacccgtcaattacaccaaggagactataaataattattatgccaaaccgggttaacatcatccaccacaaaaggacaccttttgcgg

SEQ ID NO: 2199 - DNA, 1224 bp, Glycine max
  Soy_ogl_8 Gm06:8828177..8829400 Cluster 9
agaccaaaaataaacttatccaaaatttgagacactaaaaatatatttaaatttttttgttaataattagtggttacataactatttaaaaaagtgatgctcatttttttaatatattgaccattcaattgtaatctaatgatttatagttatacttctcatttttttacaataattcagaagtattctcatttgatttactatcatatgtataaatagagattttccggcacaatcgtactattttttatagaaagaatatcgttgacaaattataattataattattttaaaatatattaattcaaggaataacttactaaagcaccgtttctaaaagaatgaacaaatatgtgtaaatccttgttaaatttgctagcgtgcgcgtacactcaattgtttttttagaatgagtatttcaagcagcaacttcataagaattattgattgtaacaaaaaaaaagaaagaaatgttgattaattatacttattctacctccaattaatccaaagtctttgtaagagcaattattttgtgtttgtttgacatttaactgaattattattattattgaattccaaaaacagaaggtgagtgaagggttttggaccaaacggcaagggatagtagtagtacgcatgaaggacccactgaacctggcattttagttgtcttagcggacattaacgtcattgtcggttctctttcttctccttcttcttaatttttttttgtgttaccgtcgctttccaacacagacacgcagacgtgcaatgcttcaaactgcaacctcttttccccgtcgattcgggggacatacatcatcgtcctcttcccacgtgtccctcctcttccctcattgctattcttttgtttcttagttacctaatcataacggcttccttaaataatcaactttaattcttcttttgcttctttgctagtttcttctttcttgtttcattcattggtcatagcaatatattttagtcttatgccccaaaaataaacggtatattatttatttcgtgacacacaatcacattgatattctatataatatatatctatctctcttatgctcatcattatgcgacctaatcctccaatctatactggaatagccaagtgttctgacttaaattttatatacttttcttctaaaataaaaactatgtttctatcaataatgaagtggtcttcgggataacaacttcgtgggt

SEQ ID NO: 2200 - DNA, 1500 bp, Glycine max
  Soy_ogl_2730 Gm08:16567001..16568500 Cluster 9
cttgccttttgatcccttgtcgatcacaaaacaagcttgaattaagatgtaatttggatttaataaaaagcctataatgaaagtcacaagtcacaaaaaatcaagactaaaaattaaaaattgaaaactatttttaatttttaagaatttcaaaatgtaaaactaattacaatcatatggaatgaagcctaatgttttaattttaacttttgacctataatatcatatttttagatagagtgatgatttgtcttcaaataattttttaagagaatttctatcgtgtccctgttaatttgtttacatatgataaataaaataagtattataaaaaacgataatggaatagtaacctactggttttatttttaagagtaaactatattttcttataataatttaaaatatacactcctttttatatgagataaatatgaattgtagtttaatcttttttaatataagtacgaatcacttaatagtggagaccaaatatgaaaatgtctactgatatttatctttgtctataacttttaatgccaattttgaaatttcttctaaaatctttatttcactttccaaaatcccaaaattgataacggataggatattcaaaactagtagttaatcatgtaaaaaaaataacaagaaaaaggcttccgaaaatctcatttacattaaaatggactcaaattacatacatctttcaagaaagaaaaatgtatgtcctaaaataaaaggagagcgaagtataattcaaactatttttttcagaaaagaaaatataatttaaataaattctgaaaattaatacataactcgacgagagtgataatagattttttttatgtgtgggaaattaacaaaaaataaagcagaaagcgaaaaagactcgctttgtcgtaggaaacatactcacagagcatcatcagctattaacttatgaataagagctggcgggcatgcatcaaaaaagattaaaggattctcttctaatgctccttttgttgccaaccagtaagcacacaggtttcccttcctcatagaatgttggaaaacaagttgctagttcaagtctttgaaactttgaatcttgcccactatagggaagtaaggatgggtgggcacaactccattgcagatgaagttgattgtcatttttgaatcggattcacccgtgatttttgcggatcccctctagtcaaaccatgctaataccatggtatattgcttgaagttttgagttcattattgtagtgacacacacgaacctgaatagccaaaaagccactggccataatggtctcgaaccagtcctcaaacccgaacttaccaggattgccaatagatcgagctcccatctttgttcagtttgtatccatttgtctccggaggaggccatcgaatttgtctttgctgcggagccttcttctgagtttgaaacactgtagaaactatgccatgcagacttgccacatggttcagtaagacgatgtctaa

SEQ ID NO: 2201 - DNA, 1286 bp, Glycine max
  Soy_ogl_3303 Gm10:1409001..1410286 Cluster 9
caacaacacgaacacatcgcgagaaagattatattctcgttcaatgcattgagaaagacatctgtagtctctcacctaaataaaaataaatttttaatcatttaaatttaaatcttcttttagtccttcgaaatttaaagttaattttttttattccttaaagtttacaaaatattatttttaatccttatacacgatatgagccaaacaagaattaagagatttataatttgtagaaacttttgaccgtcattttatattttgttttaaaatacaatttacaggaagttaaaatctgttaattttaaagccaaaaaaaattaaaaacccattaatcgttttaattttttttattcatgtgattctaagaattttaaattgtgctttaaaatataaaataatattttagtgatcaaaaattatcacaaattataaatatttcatttcttcgttgactcgaaggactaaaaataatttttttaaaattctaataactaaaaaagtaactttaaatttaaagaattacaagaaaaataactcaaaagagactaaaaagatacttaagttcaagttaaatatcctcatcaccaaatgaaaactcacagaaattgttcacaaaaataaaaaccgaacagaaattattcagttgctgactattatcatgtaaagacaagataactatcaccaatagtagcttttgcaaaagaagtggataagaggataacgaagacgctgaaggcgtaagaagcacatttgcatgttccctacacaccttattatcatcttgctcctttttatgcctcatgaacctagtgcctgtcccttgcacctgtttccttggaaggaaacacggaactagacccattattattattacgccaagtctgagaaaaccatctagaagaaggaatattgttgaatggtggtgaattcggaaactgtggaaacactgaaggaccaccaggttgaggggtagcataaggatatgttgagtgcataggagcggaaaggcatgccagtagcattattcaaggaagagcaatgaatttgggggttgttggaggaagacccaatattcatgttcgtgttattgttgaaagttccaaaatggttgggcctcagaacagagacctattggtggcaaattcaggatttgtgtcattgcgaagttgaagagtgtgaacttgaggttcaacagggtttggggtattgagaaaattcccagtcccaggtaatattaaagtcattagagcattggcagctgcaagttcttcaccaccatcatg

SEQ ID NO: 2202 - DNA, 1704 bp, Glycine max
  Soy_ogl_5140 Gm15:47617233..47618936 Cluster 9
aacaaaaaactaaataaattaataatataaatatatgttatgagtgtgttatgtcaaccaccaaacaattgttcatgagaatgagaatttgggaatgtattataatgtgttgagggtactatttatttcatataattaaaatttgtgatatatgtagaattattttttgatatataaattattacgtttaaaggtaaatttgaattgataaaaacattcttttgattggttgataatttgaggtccaaggatccaataatctgatccaattaagattgtgagattttaattgaattacaccctaatttccctctatatattaatgtaattcttgctttcctagtttcttggagaggtttctgtctcttccaagttagatttctagttaaacttttcattcatttttttcccttctcccactgtgttatgaattatgaatttatgatcacgttgttttattctatttgcatgcattgcatgtcccagttacttttttcattaactattttgctcattcacgagcttttgcattttcagtttaggtagaaaatttggttggacgaagtatacaataagcctttagaaattaaaattcagtaatttttctacctcctactttgtcccgcaggttttagatatttaaaaaacagtacgttgataatttgataattgagcaaatacaatgaatttctctggtgatccacttctttaaaacgatggtgaatttttcattgtcgacgaagacatcgtgtacgaagttccctcggataatgaagaacttcctgatgcatccgatgatgattctgaacccgcacatgatggtatatatgaattttctacatgaaaactaagattataaattgcacttatagaaaattagaaacaaatgtgactgatatatacaatatgattgtggccacaatgcactcataaagatctcataaaccttcatgttgcagccatagttacatttgcacacaattcacaattttttaaaagagagaaaatagtatatgcatgtaaagattttctacatgttatattaataatttcagaggtgtttgatgatggttctatgcgagtattcaaacttcatgctggtaagatttcgatttttatgctacccatattttttactgataattaagttcatataatatccaaggtttttaagtaattggatattgcatcaagggttaaattgtctggttgttttttttttctgttcctaattttgaagctatgtataatatgtatgccaggtgcttccagggaacaaaattcttctacagagccataatacacagttgcatgcagcccaatagatgcaacattggtggcagcagagggtggtgaggacaaaggatttctttggaagattgccataagacacgatagcatgtttatatggtggaatttcagctttctgtcatgttccgtcattcaccattgataacatttttcgtataaactatttaagatttgaagtttaaatccaaattaacaattaagatttgtaaatttctgtctgttatcattattttataatgcaaatacttgtctcttttatataaacaacaaatattatatctttttaggaagatatatttatgtgatctatagtcgaattttattaattttttgtaaattgaaaaattcaacttgttacatgaaaattgattgaaactattgacatgtgtggta

SEQ ID NO: 2203 - DNA, 1110 bp, Glycine max
  Soy_ogl_238 Gm01:49919601..49990 Cluster 9
acaaagtgttagtcaaacgttacaaagcatcaaacttgctaatactaagtttagcattgataaaaactaacgctaatttagcgtcagccagctagtgcgactaatgctaaaattagcttcaactggtttattaattattggccaatgctaaataattgtttagcgtcattttttccccatgtattaactttcgcttggtcttgaaagaaaaatagaaaaaaaaaacttttttggccttgtcaaagctatttaattttttttgcgaggcaaaatgaaaacattttattaatgggtaccaggaattcccgaataagaaaatatcatttttctttgctgcatttctttacagttttaatttatagctttcaacagttatttttacgcaactcttctccttctcgttaaaaggtatttcatctaattttaaatttttaccggatctcaaacataacattgaaaccaaatacatctaaactttttgttttcttttgggtatcacttataccctttatcaatattattcctttttgctgagaaaaaaaaaatcataaggcttttgaaaaagttcattactaaattaagtatttacgatataaattctaatattcaatataaaaaaatatataataaattctgaccatgtgataaatatatacttgatcacacagaacaacacatatatatcttctatggtttgtttggttggttgggaaagaaaagtatgtgagggagagaattaatgctatatatatttttttgggtttgatattacttttttggaattgatgctatgtttggttagaacgaaaatgcaaagaaaaaaagggaaagtatgtttcttgtttagttttcatataaaaaaagaaaaaaataaagtttttgagaactatgttaaaatttgtttttttttttaattcggaaaaagaaaaggagaacaacacagaacaagtgaatttaaattaaaaaaacaaaaatactcttgagttattttgtattgttatttttgttttgttttcattccgagtgtttttaaaatgtatcattttaaatttttttaaattttatgttagaaatattagtgttttattaactttttagtttaaaaataat

SEQ ID NO: 2204 - DNA, 1151 bp, Glycine max
  Soy_ogl_1206 Gm04:3945958..3947108 Cluster 9
gattatgattctgaactgttggatgcaaagattaagagtgggaaaacaaatgataaactaagatgtgatctgaaagcttgagaagcatgtttcatagtggacgttgctttcgtttttcacttgtcattcctacttgcttccttgatggatgggtgcgtagctgcctttcacctctaaccaccaactccgatatttaattaaaaaaataaatagaaatctaaaaacccaattgaaaaaataataatttagagatctaattaaaaattgtcaaataatttatagatctaggttaatttaaccaaatttttttttctgtgaatcctcctcattaatagtccgattaatatttatgaggcacaaaaatgatcaaaataacttatattttttaataaattatgttttgatgaatatatgtttaagagacttaactatttattatttttgtcaaactatattaattaataatatttttgtaagcatattaacaatattaaatttaacattaatatttgagtatgtgcacagcaaatttcaatacatggtggcatagatataattttttttaataaacacttattttagtttctagaattataatttaattatttaataattgattttatgaaaaagatactaaaataaatatgtaatattttttattatagaaaataaataatattttataaaataaagtattagtgagactttataaatttaaaattaaagtaataattactccatgattttctgttatacacattcgaatatgcacaatttgtactctcgcatgtgccgtgtggacaaggttataagattctatacatcttcttttaaaaaaaaatgtatcctatattcttatgcatgaaggaaattgataaaatgttttaatcaaaaaaacactttttgtggtcagccaattgaagcgaccgttctactggtcaacccactatcgtcaaagacaacgttgtcctgtcacacagacaaacattatagaatggccaatgagtgattagggcattcacaatggtggaacttatttttttcttctattggatactacgtgtacatattatttattttattattgtccaataccaacaccttttaatctttaaatctttacaactgtgcaactttcttttgatatttct

SEQ ID NO: 2205 - DNA, 1000 bp, Glycine max
  Soy_ogl_248 Gm01:50518801..50519800 Cluster 9
ctgtatcattattttgtgtaaaactaatacggtggaaaagcaaaaattctaccattgccatttatggacaaaccaaactcgggctgcaaattcgctatttggtttgcctctctaaaaacgtgatggcaataaaaagtactcctttgagaaataaaaggacttaatcctacaaataatggggtaacaaacatgattgggggagtaaccattcttcaacgtttgaatagacagaattgaggcacgtgagtttggttgcaacaattttgaagagaaataacatacaattgctctgggatccagaaagtaaatttctctctccacaaaaatcatcttgaatggtagaaattgattgtttgtacttaaaaccaattttttgaccaaaataatcgatttatgtttggtttataatcgattttttttattagaagtactcacataagaacataatgttattcttgtgtctcaatttaattccctcctctctattttagttataccaaacaattttataatatcatttctattttatttttaacctattttacttaaagcaaacaacatattatatcattttatttgtactctttctctttttttaaattatttattttctatttttatctactctatttcttttctctaaaccaaacacaaactaaaaaacttaaaagttaaaacctcttgcccaaatagattgtatgttgaggaaaatgacccataattcgaacaacaaccaagatttaggccataagtcatgatcatatggccattatggtctgtaaggacaccaaattaaaagattagttaaatattataatattaaatttatactgtatttattttaaaaaaattattaaattagagtatatttattgcaaataaaaaattctcttcttttcctttatttttaaaactcttccaaacaacacctttataaaatatcaaacattcatctcaaggccgttgaaattggattcagattcttaaagcaccatctcat

SEQ ID NO: 2206 - DNA, 1200 bp, Glycine max
  Soy_ogl_2937 Gm09:1711901..1713100 Cluster 9
agatttagaaaatgtttggtagaaaataattttttttcttgtccgaaaatatgattcctgcataattcctaggtatgcacgcttagtcacacatttatagctcatgggtttttctatagagcatcaaagtgtttatatgatttatttaattttaaataatattgtttaaatttttttcataaataacgtattttttaagtatcataaaacccataaaaataatttaaatattcatgttgacaattttaatattgaggtgatttttttaaaaaaatattaaaatttatataaaattacaagacccataaaattataagaaataactatatacgatagatgttctttgacatcaataaattaaattcaaaatttttctcacaaattcaatacaatgtatattgttaattaagtcacatacaggaatacaaatgtgtgtataaaagaattgaatgaagtgacttatgaatccaatcactatttatttttacacgttcgtgtatatatgatcatcatgttttgagacttgcattttcgttactatatatttttgtaccaacaaattcgtaccaaatagtggtgatcccacaaactcagatcgtgtgaccaccaccacccaaacactaccacaaactcaatcctacaattcacaaacacaccatacccaaacctccccacccagattcgcccccaacaccacacacacccaccactgtgatcacaaatagactaattatgacattttcgttgatgattgacttggtagagtggaagataataaaatgaaaaagaattgagataaagcatttaaattaacgtagtgtaacaaagatgtgagactacacatatttttttttaaaaattatttttcacctatttgttcacaatcaaactcactatgagttcttattcttttaaaacctctaagattatatagataattgaaaatgtatagatgaaaaacacaaaagcatcatagcattaccatttattagcatgcattttaatgaaatagaaaaaaaaatttatatacccaatataattgaccgataattttatcacttaaatatgtgtgatcataaatttaatttttaggtatatatatatatgagaaattatttattggataaaataaatctcttaaaaaaatctcaatacctcgatgaattagtccttgactactgatctaggaatagattcacc

SEQ ID NO: 2207 - DNA, 1149 bp, Glycine max
  Soy_ogl_6777 Gm20:35917201..35918349 Cluster 9
taatgataaactgcgacaggaattattaactagcacaatttttcggcggttggcaaaagtatcttaacgtgttaacaaatagacaacgatttgtcaacggacctatcacgtatgcatggcgcaaggcttacctatcaagcaacaatatgaaacaaaaccactccactaaaataaaagtttcagaagaagattgttaatataaacaaatttcttataagaaaaataatgttttgactctcaatgtgtttttctttcgtataaataaaaaataatgttaaatttttttataataattcatatattttattcaattaaataaattatattctgtttaacaataaagcattcaatatgttaaataacacttattgaaagagagatatatagataaaaaagtattgacttctttttcatagaggatgaagaaacagttttatcaattgttatactttgattgcagtataaaaatcaatttatctcaaaaacaaattttaaatattgtaaattcttagttaacagtaaataataaattaaactagtcacaaaaacaaattatattaaagcaatgcaaatttgaattattgcctaactcattcattttacaaggaccattagaaaaacaggtgttaccgtgtgttgtgtgttcacatgccttatgactctttttttttttttcttattatgcattgatgtgtgttttttgaatacatgtttatttacactccttttttacttaatagattctactaattatgggacaaaaataatagttttaaattttagagggatgaaaataaagaaattgtatgcaattacctttttttataaaaaaaaaactccaatattttagacataattgttttcaagaaatatatatacaaatgccaaaataaaaaatactcctcccgtttcataatacatatgacgttttagaaaaaaatgattcaaaatctatattattttacaaaaccaatattacataaaataattttttcaagattatccttaataaatacttaatgggagtaatgcataagactaaatgagtagttaattagaaatatagaaggtatattagataattacctaatattttttaaaaaattcaataaattaattagatttttaaatacttgtacaaaaacatta

SEQ ID NO: 2208 - DNA, 1000 bp, Glycine max
  Soy_ogl_6975 Gm20:44112601..44113600 Cluster 9
atcattccaaagaaaaacgcacccacaattaaaaaaaaagaaaagtatatataagtttaatctgttggagattctggatacaggcagcacgggcctcaaaggtacgaagacgatcacttgggcagttgggcttaagttatatataaatataaatatatttaaaaactaacattttaaaatacacgtttatataaattagaattatataagatatttgtaattatataattatttgaatatatttcttgattaaggaaggagactaatcaactaacacacaaaacttttacctgcgaaatagaaataagaaaaatggactcgagaagaatgcgatgtgaccaaccaacgatgtaagcagaacggatcgagagagggcgaataaggatcaaatccctttttccttgaaatttttcataaaagttaattattataaaattatataaaattaattttgtatattgctattataataatgattaatgttaattagtataaaattaattgtatttgtagtttattgtaatgattaaagtgataactaatataaaattatatatttatataaaattagttgtgtgtttattgttattatgataacaattaacattatcatcatttaatataaaaattaatttcaatttatgtgtaaaatgtaatttttaaaaaattattatttattgaaagttaaatagttaaataattgtaaaggaagaaaaaagaattagccccttataagatttttgaatccatccctgaagctagaaaaagaaagagaagttaatttaagatacagtgacgactgacgtgaattagcataacaaaaattgttagaaattgaaggtggtatatattttgagcattggtgatcatgactcatggaggaagcctatcataagacccatcttctccaattttgcgaatgacaatcggataggattttgttggaatacaacttgatcctcaccgattaagagtaaataaaaggataatggggcctcta

SEQ ID NO: 2209 - DNA, 1311 bp, Glycine max
  Soy_ogl_2862 Gm08:43041290..43042600 Cluster 9
agttgttcctataaaattatacataaggatataatctaatatgagtttttaatattgatttagtttgaaaatttaataattattagattattttaccttttaattttaaattgaaaaaataatttaattcttgattttgacgatttagaagttgattttggtgtgtattaattcattgttaaagttagaaaaaaaatcacttataagaattaaattaacccattaaatttattttttcatggtatcaaaaaataaattaacctatactaataatttcagtggaaaaattcacgttttattcaaacattatcttgaaataaaaagaaaatgaattttgagattaaactagtaaaatactacgtagtagaaaggatgtgtattaagctaagacaatagttgaattgttgtcttattttatttaaaaccaacatataattaaaattgctttttgttattaaattttggaatgaaataaacttaatgaacgaattaatgtcgttaattacttcaattgaaaaagaaaaaaaaaccacggtttaggatttctgttggaaaagaagacaacaataaagagagagatataaggtttgctctttgatggttccttccttttttttttcctccagcgttgcggtttgacagtacacaaagtggcctccattggtgccataatcggaaagatgaaaaacccacaaattggggcagaagaacagggctgcttgtaccctttaagaataggtcagttttgtaccaagatatagatatcataaatcaactaggttttaagttttaaccaataagtgcatgcatcttttcctcttgaagcaaaaaaaatgtgtgcatccaaacacataaatagttttattatatgattagtttagaatttttttaattttttatctcaatcttaaaagttaatttgatatttttaattaaaaacaaataaatcaccactttcattttcttttgtctcccaattatcttactacattatcctttactttttttaaaaatcatatcttttaattaaaataaataaattagtttttaagattaaggcaaaaataaaaaatttcttaaacaatgtatgtaatatataaaactactaacatgtacacgcatgcacatgttagctaatccaattaactatcatattatacgtaaagccaaaaaaaacaatagtttatttttttaatattatatattttaattataacttaaatgttcagcataaataatttttattttacaaaattatattgtcataataaaattggtttaaataattactttatgaatatcatttttttt

SEQ ID NO: 2210 - DNA, 1000 bp, Glycine max
  Soy_ogl_3559 Gm10:46067301..46068300 Cluster 9
aatttgatttttttttttttgttgaattgactctatatttcattaatacaccccaatttgagcaatcattagatatgatcaagtcaaggattcccacatggcttgggatttacgtaatctccaattagttattacatcatcctttctcattacggacaagatttgtataactgactcgtacatcaaactattatcggagatgaatatcgacatatcgtttaatttattgtttgtaattatgaaaatatcattttattacttaaaattaataaatcatgtaaaattacagaaaaaatttatggaaatgacaaatgtataatcatttcaaggattaaaatagtttttatttaataattttagaaattaaattaattaatactcttatttttaaagaataatttaatatatcactcatataaagtgactaattaatctaaatggacgaatgtattttagagaaaaaattataatttttaattacaaaattagttgacattttttcatcatatttataatttattattattaaatatattaacacacatcatgtataaaatttaaaattggattcaaaatttgaccctatatcttaattattaatttttttgcacataataatgcctattttagggtgtacttgcataaccccacttttaatctttgtttaatgaccacctccggctggcaaacattgtcatcatgcatactgcattagtcttcactttggtgactattatcctctaagaccactattgatccctagctagccatcgaatattgaccatcgtatagtagccctttcaattagacgacaattagcacaatataataggcaatgcttagtgtgtgtgtgcgtgtattattaacatggggcattgtatgcatgctttcaaattttctttggaattttactgttgtaaataatttctttattaatttttcaaagtagaagttggtgctgtgaaaatcttcagagacccgagaccacttggaagacgtg

SEQ ID NO: 2211 - DNA, 1451 bp, Glycine max
  Soy_ogl_1879 Gm06:9227950..9229400 Cluster 9
atgattaacacttttttctataaaaaaatagtattttttagtattttttgcattttttgtgttcctatgattaacattctaattataatagatcgtaccgtaaaaaaaaatataatagatcgtaactttcagtgatataatctggaaaattgttacagtaatagtaataaaacctttcgagtatccaaaaaaaagtaataactcctttcaaccatatgtacgtttactatatatacacctatcactacccaagtacattcacatgagatatttgaaaaacaaaaattattttaatatattcttaaagtaatgctataaaaaaaatttaagctgcatttgaaaaatgttttatttttaatctaataaattttatagttacataatttaatgttttatgattactaaaatcatacatattctcatattacgttagaatatccatataaaaaaaggagggtattgttcacgacaataatgcaatcattattggtccaagaaattcgtctacaaatatgtatgatagtgtttgagtaaaatttattttttatattcatagtaattaaatacgatatcaagagattataatactcataggctcaacttgattatatccttttagtgtttgagtaatatgtataagttgatatgctttaattttaatatgacttttgtacataaaaaaaaacccatatgtattattaatctgtatataattaagcatgcatattacttattaaaaatgaactaccttaattatagtaattgaaaataaataaatttcctacaaactaaaacaactcatttatttctgaaatattttatgctatattaaatatatgttgatccaataggatagccttatgatattcaattattaaatgaagaaaacaatgaacatactctctcggcacttttttttatttatttcataatctttattagaagtattaattgcgtaacaaaagaattaccaaaatacaaatattggttggtataaatagtaaaaattgatgtttcagtaatttaaaatttatactcatctcgagtgtactgatgacttttaacctgctgcaggtgataaatattttgtattaatattatgattaaattttttatcaaaatataatatatataaaattccttatgagaatgttttaactatcaaccgattgaatttatgatcattattaaataattaatgttgtaggtgggtaaaaaatgagtgaaatgtgatcctggagtgtggacccaagcatggcatgaccaattgagcagaaagacactaaggttgcagtgagacgcaagtgaacaaaccaccgaacaccgaaagtgaatgaagcggcatcagatacatccacctcgcaccactcactcaccccacctaaggaccgtacgcctcacatcacatgcttatctcctctccttttttttgtctctttaaagtttcaaca

SEQ ID NO: 2212 - DNA, 1300 bp, Glycine max
  Soy_ogl_4109 Gm12:36063401..36064700 Cluster 9
aagtgtaacacataaatttaattttcatgcattatcaatcaacttattaaaataggttggctactcggatcatttcattcaatcttttaattcgcacaattcaacccacataacctgctaacccgtcaccaccattaaaaaagaatattttggaacacaatatgttttcataatccaaatagactaaatcacaacgtgccaaaatatgttgttaggtaagaccccaatataaccaacaaggacgattttttattggtggacctaatacatagattttagttgctttactcatagactaaacttgataaccaatcaatgcagatattacatatgaaaactagctagttcgtcaccattcaagataaaaataagtgattactatctttcttccaaataaaatacaagatatatgcataagtttactaaaagggagtttgaatttttttcctttataattctttaaatatttaacttcttataaatgtagtaatttccaaaaaaaagtatttattaattttacacttaaaattattactagtttttattttaaatggtaataagcttaaccattattataatggacacaacataattttatactgattatagccttagtttttttttaagattatagccttagttactattaaaataaaaaaatagaattaattttccaaaattttaccttatttaactttaattattaatttaatagcaataaacataaaaaaatttacactaacaaatttaaaaatataaatatttagacattataaatttcaagggagggagctagggaccctgcatgcgccctactccatccgtccatgtaccaacacatgaggtaatactcctctattacacaaattctaacttgactcgacaacccatccaaattaacccgtcaagataattaacgcaagtacttttagaggatgagaacatttccaaattaaaaaaatttaaaacaacatactaagaaatcaagagttgactctttacaatacccgtgcctttaagaagttgtaagctgatttaattgcgaagaggcttctacatccagcatcccttgctctaactaacctctacaccaaaagaaagaacctaaagtattaacctaatctaccaacatgtatgttttttggtgatgttaatctttattttggtaatgcaccaacatgcgtttatttatttattttacaatagcagcaatgaagatcaaacttaagccttcatgtatctatctcaacctcccattactaggacgatcctacactagtgagtttcaccaacatgtatt

SEQ ID NO: 2213 - DNA, 1000 bp, Glycine max
  Soy_ogl_5386 Gm16:31044001..31045000 Cluster 9
acataaatcccttaaaatgataaaaataaacatcaacgtatcttaaaataagcaattcgtcaaggaatgagagtactaaaaatactctaattgcatctcgcctaattgttattctttaatcctaacaagagaaagaatttatctcattaatttttagcatttattattttttggccaaaaatattaatgaattaaggatattttatgcaaaggataattaaaaaatagtcttatgaaaagaaataaataatgttttaaaaatgattttatatatagagaccgatggagtacctaatggttaatttaacttttttggcattacgaaaagcttatgcgttaacgcttttttttttttataggctcaatccacttctttataacatgtagaatatttgtataataatattttttaaaaatagtcttttattagtacagtttttaaaatatttatacattatattttttgtgaagaattttattttagttttatacattataagattagacaccaaaataaaaaaataaatactcaaattgatcattaaaagtatgaagcctgttctatgttaaaagatgaaaaaataaaatttaattttcaaaaatataaaaatataataaattcatttaaccattaactcttatttattaaaataaaaccgcctatgtaatatttgacttttgactttgttaggtgataaagttaattttatcttagttttatacattataagattaggaacaaaaaaaacgataaataccaaaattaatctttgaaagcttaaagcggtgttatttgcatccccaaaagattaaaaaaaatcccaaacctaatgacgtcgcgcacgcaccctctggtctcgtccatcgctaccactaaggaagaagagttttgttgcttacctgcacgcagaagtcatccagcaagagcgcatggcaattcctactaaggagcgacacacctttgaggccttgttgcagccgcgccataacaagaggaacc

SEQ ID NO: 2214 - DNA, 1054 bp, Glycine max
  Soy_ogl_4587 Gm14:409001..410054 Cluster 9
tgatccacgtttaatccaaattcactctaaagcaacctaaaaacaaataaaagttatttcatggatccacgtccaataccattggacacatcaccaaacatactatataactaccgcatccaaagtcatatgatctgaataatattattttcactatatattttcacaatactttaacttttatacattttttctctatcactcattatcacatcattttatcttattttacacttttctttcttttcttcctattctttctatgtttgtttttgttgtataaattgttaatgttaataagctttactagataactagtgtagtacaagtaaaggaactaagatccgagaaaaaagtctaaaggggaactttattgggatacacacaccagtgcctttgctttaacaatgcagtatttggatattataagagtaagtattaatttagttatttttaatttgtattatttgttaatttgatactttatattataaaaaataaaaatcaaaagtaaaatattttgtatttaaataatagtcaattaatttgttctatgtaattaatgatattgattagattgtttcttagaagatctactatagataattgtttattttaaatttatgagacttataacgtcacataaatttaaaagaagaatttgggagccacgtcgacatcaagaggccggtccagcccaatgtagaaacgaagccggcccatggcacaagaagaaccgctgaggcaaattcttaataaagaaatgatgcaatgcaactgcataaccccaaattattcatattgactccaccaataaaacgattaatagccttcttttgtttacacggtattaatggcaacatgactactgcattgagttttaaatcactgttatttctcctcacaaaaattaaccaaagtgcattaaaactcagtgatttgtactttttgaataatatttataagtttaattttcatttataggatttttatattatcatctaaatataagtaaaacaaactaacaaatgatagcgagagaaaatattttgtc

SEQ ID NO: 2215 - DNA, 1000 bp, Glycine max
  Soy_ogl_1127 Gm03:47277401..47278400 Cluster 9
aactgaagaattgacaatggagcatccaaattaaaatgtccaatgccgtacaggggaaaaaaggataataatactttgtttgtacggaaatctttgcttttgcaggaatacagtacttttactttaatcagttggaagaggagctcccccctatgagagttagataaatatatatagaatataccattctaatgccacttttattttacatctttttatttttaaatttacacgattttttttgtattttatgaatatgttatactttaattcataacttttatttctgaataaaataaaattcatataaatgttcttattatagatttttttcattatataacatttcttctacttgatagaaaatttaatgttacattaaaataatgtatggtaataattataaaatatttataattttatattttcaaaataaaatgaattattttagaattattgggattaattttattaatttcctattcaactatttaaaaaatccatgttgtataaaaagtatgaaattatatacaatgaaatgtctgaatatcgatgatcattcaataaatatgaaataggaattaaacaaaacattttaattttaaacaacatttagtttgggttttaatttacccgtggtggatgggaggaatgctaatgttacttcaacacggattccagcatcaattgcttaagttattattaaacaaatccttatgatcatttttttggggggtagggtacgtacacacttcaactgcactaaaatccagatgaacccaacctcaattaatacaaaaaaattagtaaattaaatcaaagtaaagcaaaaagttattaataaaaaaaaagtgaccaagcctaagagcaagtgtgcctatgtggtgtttcatgatgtgtacggtttagggaagccaatgagcacgtacaaaattggtttccacatggcgtgtgcattcaactcatgccccaccagtattctagtttcctaacataaacc

SEQ ID NO: 2216 - DNA, 1544 bp, Glycine max
  Soy_ogl_2490 Gm08:3327301..3328844 Cluster 9
ttatccatactattttgtacaacgaagatccacaattctttttacaattatatagaattaagaataaaagaagaaaaaaaatataagataaaatgagctatatgatagctaaaaacacagaaaaagttaacttgcaagtaaaaaatgttaaaagaaattgttatacaataatatagatttatcgataataaagggattcatttgcaaaagtagtagaaaagtgcatgtccctcttttttaatcatactaaaaatcaaattaggttcttataaagtgaaaaaagtaagaaaaatatataagattttgagatatttcgttcatattttagtttgaatcaaaagaatgtattttcactttcttattgtacacattttctcaaagtttaagcaaaaactaaattcacaataatcaattataatgtctaaaaaatggtataagtaaaataaactcgttatcaatcacccattgttttagcatttgataaataagttaatgaaatgagttataagctaattaaaatgaattatgaagaactcatatatatagactcttccaaatgtggcatctaaagcttatccaagttcacaggattctaacagttcatttgttattttattttttctttaatgttgacatataagtttatcataaaagtcgttatgcaatcatacgcgcttttttacttgaattacattggaaagtgataaaacaaagggcatgccgataaataaataaataaaaaaaaacgagtatatgaatctagctacttttggaccaaaatatcatttgatattgtgcccactgatttaggtaagagctatggatgtccaagtgccatccttcagatcattggtggagctgaaggaaacattttctaggataaatttatttgtgccctagtataagaagatatcacctatatttgaaccatcccaactttttattgggccaaatacacctttaaagatccaatttgaatccataaaaatacaccaccgaagagaggtaaacaaactgaagtcaaattatgggaattacttcctataccacctattttgcttccagcaccccagaaaaaccaaacagacaacaataccctcactaggcaccctgtgtcccttagaagtcaagcttccataaccaccgtgagcatcgacgtcgcgccgttcgcaaatgattttgcatcctcctcaacgcacacatgaatggacatacacgaggaacagggggaataaagtaggacagatgcaaagggggtgtggaatttacacgaaaaagagaaatgtgtcacctatacacttctagaatatctattttagaataagattttcatattctgaaataatttttttgattatttatcaatattaattttagaatacctattaaggaatatgataaactcgttatcaatcacctaggtttttcaattatttatccctatttcagaatatttattatgaaatatgataaacataaaaaatatgagagaaaaaaaattacatataatttctgttataattcatgtggcggtggattggtgg

SEQ ID NO: 2217 - DNA, 1000 bp, Glycine max
  Soy_ogl_3452 Gm10:39129901..39130900 Cluster 9
aaacactcgaacggaaattttcaaggccatcttatcgtccattatgaatttgtggactgcggtgacgactaaacatgcatgtcgttgttaattgagctcatatatattgcaggggctatagctagcatgcaagtctaagaagaatgattcccgtgggttatttttactagcatgatttagcaaagtatacgtacaagcgtaataaagttatgttgggtagttaccaattgcatgtgattggaaggaaggaagactgttgttatatttcgtttcattttccataataaatgtaaaaagtcatttgaatttctctaaactctaaaaagtttttccttttattttccttttcgagcttgaaattaaagttgcaatatagcggatgcatatgtatgttgggttaagattcatgagttcttgaattttgctatataaaaaaactaataatattaagaagtaataatcaatatttgttggtaaaaaaaactcatggcacgataaatttgatgaaggtaaatcaagaatagcttttataaaattgattctaatatgagttaataatctattttaaaaataattaatagattaagtttaacatgtaaaattcaacgttttcctatattaattaaaaaacgtattgacactcgtgaagtaaatcaatctgcactattgggtatacttataatgttgtttagtgactatttttttaatttccttccatttaatatagcctgtgtgccacactcttgcatttacaaagatttatataaactatttataaagagagagatattgtgtcaaaaaaatattataaagagagaagtgaggtatttatttctcacactaattgatgtctagcttcttttattacaaaaattatgacctatctatataagtcataatggaaccaacgtaagcagtaataagtattgcagtaaaaaaagaaaaaagaagcagtaataaataaagataaactgaagtacacttcagcatatatacctca

SEQ ID NO: 2218 - DNA, 1318 bp, Glycine max
  Soy_ogl_4857 Gm15:1569701..1571018 Cluster 9
ttatgcataattagtagaaaagagaaactccgtgcatctgtttaatttttttaacataaaaaaagaaaaaggtaatagaactacagaagtacgttaatagcggtggagcactgggatgtttgtaggatgtaacttttattatgagtagtttcaaaagtatagttaaaggggtaaaaaagataattatgtagaaagttataaaggtaaaatgggataaaaatgtgtatagcaatacttggtatgttttttatataataattatagattatatattttcaaataagtaaaatccattaaaatattactatatttttgttaaaaatttattattgagttatacgtaatatttaaatgttagtcgatttaagcgtaaacaggaaatagagataggaaaagagagagagcgcaaggacaataccatatcagatgaggcttgaagtcaactacgtcaatattacaatttataacccaaaacgctttaaaaaaaacagcttacaaacttctttctaaactgtattgggagacattaatattttatgtataaaaggcttcacgcattggcgcattgcaaaaaatatgtttttccataataaaaaaatgaacgatgatgtaatttgcaaaacatttgaataatttactagaaattatttgcagggtaggggagtgataatacaacacagcttcattttcaatctatatttttgacgtaacagtgtacggaggggattagattacgttctacgttgccgctgtactgcttgctaggacttcttattattatatctgtcatatttactgtacaggaatttgactaatttaactaactactttagtatgattttttctttaaattattttttttcatttttcattcacaaaattaaaattaaaaattttatttaaagaattcaaattcattaaaccaatgacttattgattgttgctgcttgctcggattgaatagcaatgagggatttgtttcaagttatttattcgaagtgagttgaaaatgattcatttatatttgttttttatagagaggtttgttttgcttatacaaataaatagattgtcttttttaacatttcaaagataatttactttactaatctaacaaaataatatttttcttcacaataaaaatattttttaacttactttaatatcatattcaaactcatttttttttaaaaaattctgacaaatttaaaagcaaataaaacctaaataattcctttatcattaaacaaaaaggaaaaaacagcaaaagtagttctcctttgaggtgtgaagtgcagacttcagacagagttttctt

SEQ ID NO: 2219 - DNA, 1200 bp, Glycine max
  Soy_ogl_6266 Gm18:59057801..59059000 Cluster 9
attgacaagatgaatgtgaaagtaattgaaaagatgttagagattttaaaaataactaaaattagataacctaaggactaaaactaaatgttgaattttatgagtaaaattaaattttatagacactaaaatcaaactttaaatttgataaatgtttaaactagacttgaaatatttctataaatgaaaaacaaaacacttgctatataaatgtcatgtataaatcatatgaatgttatatcacattaaatgttcccatatataatactaatgttacatcactattaattatattaaaaaaattaataattaagatttaatgtaacagattgtatgtatgtgagatgaaacaacataagcagggctcacatttccaaatctaatccaactttcataaagtgggaaaaattcaaatataataatcaaatcaatgcttttcatcaaaattgagtgaaaatcaaataaaaaaattgaaaattaagatttttttaatcctaaatcaaataaataatatttctataaattatattagatcacaacctaattccatttataatacataattgttgttagtccaaagatattttagacatataaaaaaagtaaacataaattctattattaaataaattatttttttaacatgtgaatagaagaaaaacttaaagaattatattacaaatcagatttaattaattgacagaaatgacttgattctcgggcctcattttgtgcacgtagcgtggatcttcttcttattgatagtacacaacaacatgtggagatgcatatgcaacgcattcgtccgtacctaaatttccgaaaaaaagttttaagagattacgtggacatgcaatgccacactcgcactctttccttggttccgaatctagacctcatcattcttttatttatattttgaattcaattcaggtttaatatattgtggttttggaattattgaaatgtcattgtataccctaattattacgtagggatacctttttagtgtttattgcattcataggccccactaagccctatctatatctattttatctgtaaaatcgctgttcaatgctttccggattgacccgtgttctacccaacagtgtaaattggccttgctaatcaagcaggtcatcatttgtagtcagcacagcaagtattattcaaggtcttggagaattttttcttcca

SEQ ID NO: 2220 - DNA, 1171 bp, Glycine max
  Soy_ogl_6569 Gm19:44707640..44708810 Cluster 9
gatttcttgtgtaaaaataaatttaattaataaatagagaaaaaattaaatgccaagtcaaacgtcgggattcatatctcaagaatgtgagttcacattctactttcgatatatgaatcttattggtgagcgataagtaagtgtctctattagtacttaatgagccttgcgggttgagacatgtcatgacttggtaagccttgagactcaattctcctaaattttttataataaaaaaatcaaatatcagatgtgaatgcaatgctaatttaacacgatctagaaagaaaattataggatctggaagcagcagcccaacaatgattcccatggatgtttcttgtctcaatagtgcatgtttaaattaaagttggaagaattcaaaagtatatttatcttagaagctacaatttttttcttcttcgactggtgtattaatccaaacataagattaacatgattattagccataaaaatcgtggatctattttttaggcaagccgcaagtccttttacatatatgacttattgtattatataatacttctctttttatataatgtttaaaggttttgacacatcaaataatgtaatttgttgaatttcaaagaaaacactaggtaacttttaaatatatcctttatctctctaaaatgtatttaatgcaatattgattttgtaaaattacctaatttttgtaacaattttttctctataaaatgttatataatttgaaacgatgggagtatatgcaataggcacatgatcagaaacagttataatatggccttcttttctttatgtttattaatctgatacatctttttctttatttatgttaggtctagggcttttgtgttttgtctttaattttttgaattataaaaaaaaaataactatacgtattgttattggggatctggctgtgaatatatccaccaatgggtttccacactcatctaaaatgctcaagtaattaaaaaataattgtgggagtcaatgcaaatgtcattgtaacatgcacgcatatgttgtaatgtggtatatacttcacatgagtggaaggtcattataaattgaaacggattcagtgattttaaagcgggaaatcactgtgacttttctcctttttaggccattagattaatttttaatggtctaggtttttgcc

SEQ ID NO: 2221 - DNA, 1100 bp, Glycine max
  Soy_ogl_285 Gm01:52161801..52162900 Cluster 9
gttataattgtgcatggtataacggtaacaattataagtgcattcgagaaatgcatacatgataaattacaggtcggtcggagtacgaccacgaacgacattgggatacaaatttacaagtgtctgctcaagcacgaagaggtttggatatatcgtcagaatctgtttgaccaaaattctccttgactgaaggtgcacgaaggtcatcagccgaccatggagggtacagtagcaaatataaaacttctccaaatgtattttttataatttaattaaaaataaaactctaatcctgacactctctaaattaaactttcttaaatagtgataactgcagtctaaaaaaaagcagcaataactaggacaggtggttttggacatgagggtagaaagagggagacatatggccggtaaaggtagctttctattctagtttttctttttgtccccttcataaagcatgagtgtctcttaatttatgaaccaaagattaatttttctagttgtacataattattgttgacctaaaaatacattacacacgaagaaaattaaacagatcgatgttatagatcatttgatttcctagcatttgaatgcagaaacaaacacattaatgcagactttgttaatttcctcgcatgtcgaactattagcattggctttttaacattagcgacgaccattaccataattatttttttgattttgttgtagtgtatatatatttaaacaatctaagttccaattagtttaaaatgtgtgccagattttgaattgatggatacttgcaattttattgttaagagttaagtaaaaatacgccttttgaggtaaacttattcagagaggcttttaggagaagaaaaaaaagaagttaaaattaacttatacataaattaatttgtaaattttttatataatttctccaaaaaataaaaaacttttttttataaattagcttgcatataatttaatttgaatgccatatatatatatatatatagacaaaaaaaactcaaaacataaataattcaaaagcaaattaataagttttggagaataaataaattataaaaaaaagcaagtttacatgaatg

SEQ ID NO: 2222 - DNA, 1109 bp, Glycine max
  Soy_ogl_2873 Gm08:43495362..43496470 Cluster 9
aaaatatttttaattgagattaatataattacatgtaattaattaattttcttatctaacgtaattttatttttttatcttatatttaaaactggaggcagtacaaaatagccatgatgattttttgcaccgcaaatgatttcgcttccatgaaaattacggtggacctgaatctctcgtggtcaaaatgtgttgttatatagtaatgaactgcttttcacaaaattcgattttatgtaaggaaatataagattagataaagaagaagaattaaaatgaaacattaaaaataataccataatttatgtgcacacaagtaggaattaaaaacaaataacatctaatttattcacgttactcaattaattgggttagtctctttaacaaattataaattataaataactatgagaatatgttgatatctcttagaatttgtaggtttgcactcaactttaaatttaaaaaattaactaataaattatagttattttttatttatacatcttatttttgtcatattatttgtttatataagatttttaacatagtttaggctgaatattaattattttgagtgtaacatttgtaagacacatcatattagcaaataataatgccatgataataggtcactcaataaattcaactacactaactagataaactgatatcagtcttaaatttgactcaagcacaaaagctggaactaccaccaaagctagttcaaatgcatgaatttcaaaacaagaaaattgtatgaatcaaaactttataaattgtatatatcgaaagaaaaaacattataaattgtatatatcgaaagaaaaaactttataaattgtgagtatcatttttttctctctgttcataaacgtctctagatttaggttttgtttatttgtttagaaagagaatgaaaaaaaaaagcaagataagatccatatctcatcagttatcacatcacatgctcttgaaatcagttagaacatgctcttgagaaaggaatttaaaaatagaatcccttaagtagaatagaaaattagaaagttggaatatagaaacataactcttgttgattgatgcagaggcagaggtgtgggactgta

SEQ ID NO: 2223 - DNA, 1303 bp, Glycine max
  Soy_ogl_3657 Gm10:49677401..49678703 Cluster 9
ttaattttttaaattgaattttaatatttaaaaaatacggattgttaaaaataattatattttataatacaaatgatttattgtagatataaaacataaattttagtcatttaaattaaatatttacccactgaattagacatgctaagaagattttattttataatataaattatttattgtagatataaaacataaattatagtaatttaaattaaatattaagaagaagatgatgatgatgaaaccagcagcttagaatatccttaaaatattctttacatgtgaggggctgcgctttgcttaattgtcgagcttataatttattatttagaaactttcataaaaaaatatttactgactggccagtgataggtgtgattttgttttttgaagtaggatcagccataaaatattaccacatttgttgacaaaaaatcaaatattaattgatcacgtttctagattacattaataacatgcctttggtattttattctattttagttcatctcattttcccccatatacaagaggagatgatggagtgatcgatatcgatgttgggttggtgggttgcatagagcatagtagagggaagcttgaattaatgggtagttagccatgcttgtcttgacggacaaaagcaaaggctaattaaaacacaaagataactcattctgacaaggaatgaaaaagtctctatttattattattgttaaaaaaaacttactaacataaattgcgccaaggactcaaagtgtccatgatgggattaatttattctgttaaaatattatatcattttggttatatgtttttctttaaaaaaaacgataaattgagatgcatgattaaaatatctatgcctaaaccaaaatattattaacaacgcattacgcttaaaaacctgcaattatattgcagtaggtattaaactaaaaataaaaattattatatttataattaacagatacatacatttaatttaaaactatttattgcagtgaaaaataaaaaaaaataaaagctagttttcatcacaaaataccagctgtcaaaaacttataaagtatattatacgtgtaattttcttcaattcacgttacctctaaatatatttgtttttcaacacattgttacaacactgatagaatacgaaacgcaactccgaacaaataatgaacatcttatctatactagattttaaatccgtggattgcacggatttgtttaaataatttttaaattaatattaatttttaaaagtttgtatgtaattaattttttttaataatcaatg

SEQ ID NO: 2224 - DNA, 1203 bp, Glycine max
  Soy_ogl_1199 Gm04:3620801..3622003 Cluster 9
tccaagtattttagttagactaagcttacgtttagttgtagattgttctggatttctggttgtgcctcgatcgtacaatttgggatcattgttaaatgatatggctctcactcttttgtggtactcatacccatggcacgcataagattatcttgaacaaacagttataataacatttcattttttttttagatataaggtattagatgattaaacaaaaagaaatgaaaaaaatgtcacaggtttttttactaataaaattaacattctaacaattaatatttttccataaaaaaaaacacttcatgattctggacttatataatctttttgacttattccgataaattgatttaatttactaaaataagtttttttaacttattcaattaaatttcaatataaaacttatggtacaaactctcacgtgataaatactttcttgaataaacatttaaacgcacctgtaaaacactctactatatgttggtgcatcagtggatctttgaacatgaaacatatgatatgagtgtgttttggcaaggtacttagacagagtataagttattttgactagcttataattgaaatgtagataatttacccttagcatttttaaagttttgtaaaattataccaaattattttttaatcttaaaattgcggtagctttttctgctttaaattttaattttccgatatatccatatcattctatgttaaaaaaaaacaaagaaaaaagaatactatgggagattaaaaggattttattacagggagttagaacagaagagaaatgtaggttcaaattcttttactaatattctaataaaactaaaaaattaatattgactaataaaaaatgattatattaaatttcaaggaaaatcaatttcctctttgtatataagtcgcaaattaaatgatgataaggatacaatactctataaacttaacctgctggcttttgcgctataagatatactttggttgaatgttggtattttgtagtgcgaacggaaaaatattctctaatagtatgacttctgtgatcacaaagcttctagatttatggtaactggtaagactatggcgagttattggggatcccgtagaaaatgcttcttttatggaaaatatcaatatataataatttgtaattaaatgatagtgtgacaaatttcacactgaaagagtattttg

SEQ ID NO: 2225 - DNA, 1283 bp, Glycine max
  Soy_ogl_3966 Gm12:1365118..1366400 Cluster 9
ggaatgaagaaattattattttgtgtcttagaaaaattaggattaagaagttaataaaatacattaaaattaggatgacaatatattaatgatatttttaattttaataaaaaatggttttaattacgtaattaaaattcattgatgagcaacggctagtgtgaaattgtgtgcgttgaaagaaagtggcagtggtattactaaaaaagttaagatgaagaatccaaaatggacggcacggagcagttattgatctcatttaatcactgattaatgagtgacaaacaccttcttatgtgagacttctttcaaaacatgcgctgacaaactcttgcattttcaaaactaaaattgcgtataatcaaatcaacctcatgcctgacttaaatatagtaaatttaattttttttattcatgataataaattatattttagaaataattttattttttatttcaaattaataaaattagattatgttaattaactttcgtagtatgaaattaattatttttatttatatatgaatttaaagagaatactacttatacaagtaatttaaaatgccttttcactcttttgtattgacttttaaaaaaatatcatcaattttgaattaatatttctttgaatttaataaataatactagtaagtgatttgtaagtttcttacaattaagtctcattggtttcactctttgaattttcgagaaaatataagattaacatactagtaaaagataagaaaaaagaaaaaagattataaatttaaattttttattaacaaaaaattaataataataattaataagtaatatattgattacaaattaaattaaatttgactccataattgactcttttaatatgtctatgttgtcagtatcaaaaaaagaaaatctctgttatcaaagttattgataagactaattcatctctatagataagaattatcggtaatagtcgtttaataatcaatttttaaatcatgcaaccactactgtcacaaatatgtacacgtgaaataattcactaatctactaataattttctgaacatatatgatcaagtgaacatatttcttttagagtaatcaaacatattacaaaattgagtttactccctaaagtgagtttagaacaccccaaacaaaaatccaacacatgctcctcacagcaaccttgaccaagtacgtacacaattctatatattattctgttgttctaggcaggctaaaaaatacaatatattatactaaaaacttatttgaacattaaagtat

SEQ ID NO: 2226 - DNA, 1200 bp, Glycine max
  Soy_ogl_2847 Gm08:41216501..41217700 Cluster 9
tgaggtattgacgagttgaatagattgttgggtttgttgtttgatgaagaggatgagaggaaaactaaaaatgacattttagatttagttaagatggttctcaaggtaaataacatctaccgcagtgtcctatctttatttttctttccctattgtccatacttagttagatttttaataaagaatttgaggaattggctatctacagcagtgtcattttcactctcttgttactgacttcagtcagttcagtggttattggtgatattttgcgtttctgcctgctaagatcgtgattctattatttccaaaatatttcattgttgttgcttactgtgtgtctcgttgattctatttttgagaaagttttactcgtgtccaaacaatggtatgaataagatagattttcccgtaacgaataaaaaattcgtaaaagacaattttttcttattaaattataattttagtcttttttaaaaaatttgtgattatgatccttataaaattttactataacatttaatctcttaatttttaaacttgtgtaattttgattcttttatcaatttttctatcttgactgttatattattgacgttgacggtctattttgatgacttatttctaatatgtgtgattatggtttattttaattaaattaagtaaaaataataataaaagaaattgtgttaaattgaagagatttgacagctcaagaactcccccctcaccacgcttagctttatccattcatttgttatcatcttcatcattttctttttcgtctccgctgatgaagcttccaaaatcttcatcttctgcatggattaacgtgtttcctggcttacttagttggtgtcgcaaatgatattggaattcctttaacttttttaaaaaatgtttttgacttaattaattaaaattaaacaataatcatatttttattttaataaactcatcttcaacgttccaagtcatcttgatagacagtcaacaccaataatataacagtcaacgcataaaaataaaaattaacggaaggatgaaaatcataaaatttaaaaattaagaaaattaaatattgcgataaaattttagaaaattaaaatcagaaatttagaagaacgagagaatcaaattacatttatttatttttatcttggaacccacacctaataatgattcaatgacatgatgtat

SEQ ID NO: 2227 - DNA, 1000 bp, Glycine max
  Soy_ogl_1408 Gm04:44908101..44909100 Cluster 9
tggttggagaaaccttagaacatccaacatgagccaacatgtttcatgagccatgttcatcgtgcctttttatttatttatcgaatgtcaaggatgtataaggttaaaggagagggcatttcaggaaacaaaatttattaacagtcatgtgacccttctgctaaaacatttaacggagttaattgatgagagaattccactgtaacttttggggggatctgtgtaagtgttaaaaaggaagaggaggttttggtaatttcatgaaatctaatttactttagatattaaggttgttgataatgataacagcaggtgctaccttgtcataatgatgagtgacacaccgacactgcgtattagtttcccaagttagaaaataaatccaacaaaacttatgggtctctattgtaaacctttttgtttcggtttaaaaaattacaaaaattctaattaaatattattcaaatagaaaatggcattggaaataataacaagcaaggtatcggtttccttgtaattttctttatctttaatgtccatattttgttttaagaagtcaaatatattattatgtatattcttttctaattacttttataacactttctgagttatgtttagtttagaaaagagaaatagattaaagaaatagaagagagataatttaaaaaggaaaaataaagtaaaaatgaagtgatataattttttgtctaatttaagagaagtagagtaaaaataatattttttcccaaagaaaaccgattttttatgactaaaattcttatatatttatacttagtatataataattctagtgattagagctatatatatataatttcttctacctatagaatcgattttgttgcctaaaaatcaatttgactgcaattgagaagacagaaattttaactcttgacctacaatagtttgttaattctcttataattaactgaatagactttgcaaccgaatacagccctagtacagaaagtttcca

SEQ ID NO: 2228 - DNA, 1278 bp, Glycine max
  Soy_ogl_2516 Gm08:5121536..24813 Cluster 9
taatctatctatttttttattatcaacccttaatatctatattaataggataattttattagataaaagatatctataagataaactttaaacctaatatgtgatttttttagtcgagatatataataaattattattgtatatttatgagcaaattaaactaatcacatttgaggttttatatacaaacatgatctattttttaaccatcacaataaccttgtaggcagtgttagcgtgtaatatataagagaatataagtgtaaaaacaaaatcacccgtctcactcttcatgtctcacttagtgtccaccaattaaaacttgccgcatcaattaaaaactacacatgctttcacttgaattagttctatacagtgactttgggggcaccagctgcagttatctatctatcagtgaagataaggcattgtttgtatcccaaaagccttctgattcaggcatgtgaatgaagttctgccattgacattaatttgataatgtaattcgatatatataagataatttatttgacaacggacaaaactaaatagttaatttgatgaaaactttgcagagttttgcacaacattctttatcacatcattatgccaggaaaagacaccaaagatcatctatcatcaaaaggacaaattttgtataaacgggttgatgatatcaggaaccttgaacttaatttcattttttttttttatttgaaacatttgtttgtgtttcaatgtttgatgagaaaaaaacagagtagtcagtaggtttggggttggagaagttggagtcatggagggagtagaggggaagagagcgacaacagtaccagcagaagaaattaggacaaatgggatgagaatgaaaaagaacaagtcttgtgaaagtcaagtgtagattttaattgacagtaaatgagaaaggaaaagtgaaattggtaatttcgctaagtgttaacatataagaagatgtaagtgtttcaaacataaatgattttagtgtaagaaatatgaatagaaaaaacaacaatgttatatataatttgaaaaaaaaaaactcaagagaggagaatcgagtataatttattatatatttatatataaaaatcagaatttttatacaattttaaaaaagagtgtattttttttggaaggagggggcctgcctcccttgaatctcccttgtccatggtatcaaattcaacccgggagggattcgggaatctgaaaacaattgcattaggacatcttcacgtttattgccacttttaatta

SEQ ID NO: 2229 - DNA, 1233 bp, Glycine max
  Soy_ogl_2119 Gm07:1653268..1654500 Cluster 9
aaatgactcatataaaactgtttctattttttatgagtggtaaatacgttaagaaataaaatacggttgcagctagggtttatactgaataactcttgtggcctaaggattgtgattggggagtggaaaatggttgttgtttgcgttgaagtttggtttccacggagcctttttaacgagtgatgccagtgtttatttaggaaagaactggtggattgttcttatgaatatatgtatatttaatttagaacttgcttttttaggtccaatgtcattttgagatagctaatggcggctaattctttagtccaacttgctaagcattgaggcacttggatttggctagatgattctccagactttattatccatctcttatctttcttcaccaataaaatattttttccatttttcaaaataaataattgaactaataacttgattatatttttttctctctatataagtatgtttttcataaacaatcttatttaaaatactatcggacactaaatatttataaatttcagcaaagattaaaaccttaattatactagtaacagtatcatgaagataaccaagtcaagaacctaactcatctaacataactttatatgataaatataatttttaagttatttttataaaggtcaatatactttttatacattatgattttttaatagaaggcagtataaaaactttttatccatacatttgcacttatctttgtcactcgttcaatgtcttgtctttttatttgacatcatgtattctgtattttttttatctatttaaatatatctcaaaaacatttatacttgtagcattcttctctaattaaagttaccggcttctttgattaaggaaaaagcatatgcaagtatgcaactatattcatataagacatactttggatttccatcaccatcgacttaagataaaaaaagtaccatattatgatttatgatggacttggaagactttcccgaactattcttcccatattatacatgttctcattagaaactgataaaaatatcgcagactctgttcgtttaagccaccaaaattgtctctagttattttcataataagatacttaatatatttcaagatcacatttaaacacgtgaccaattgtctattttagaatttatgcaagtatcaagggccagcttgttttatgaataaattttttaatcatgaataaaagaggaaaataatttatgc

SEQ ID NO: 2230 - DNA, 1000 bp, Glycine max
  Soy_ogl_2191 Gm07:4569701..4570700 Cluster 9
gtttaaatgtttaaatgggtcaaataataccaaattataatcctcattaactgtagctaaagcataaaggacacaataaatgagaagattcctccaactctttggtagatacaagatgctgtacaaatggacaacacataattctacggcatcagagtcaacgatattgaaagaagtaggccacgcaggtaaggggtctctattcttagatttggactagggatattatcaaactatcaacttaattgtataaactgtgcagtttaatgctcttgctctcaattgttgttagggaaaaaaaaatagaagaaaaataattagagaagagaaaaatagagtaactcaattataaggaggagatcataactgtaattgtgcatgttgggtcaccgaagatgtattggaattgtgagactcactttatctgaacttatttcctttataatttcagcacctaaaacaaattagtttgaccacattcacccaatttcacagcaaccaaacacaaaataaacggaaattccgaggacgtggggacatgttttgtactcaatcatttataaatattgattttggaagagtaattattgttataatgtttatagagaactcaacttgtaaagtaatatttttgttactttttattgagggatttttaaaagatttttatttctatttgtttatcattttcaaatacaaaattggattttaatattatgagactcaaatttatgcttaattttaagataaactagatactatatatcttagcgagcattgttagatttattggattgctatcgaaatcaaatcactcataaatttcaaatcctacaaaacttcaccttgagatgtattgttcttgacgtgaaggaatgtgttaaaaatttatattaactaatggtatggtcaaaatatattatataattatataagtggaataagaaaacttttaccttatgaaataattttatacgattaagttaaagttcaaattcac

SEQ ID NO: 2231 - DNA, 1153 bp, Glycine max
  Soy_ogl_3292 Gm10:9201..951753 Cluster 9
atctttcactggttttctttttttttttttttgcacggaattgaaagggatggtaaaataggtttaattcactagcttaattaattgatttaatccattactttggtcaaattttttttaaaggcataaatatattatatataatcatgaactgactattctgtacaaggagtacaagaaaacaacgttacaaaaaacaggacagtaacctaatgcactccctaacacatcccaaaaaaaaaaaaaaaactgattctcaaagtatcatcctcttgggttaatacaccaagaagagaagaaaaagcaaggtttgacaccaaatctaaacatcatccaatgccacgacatcatcttaatatgtgttagcatttccaaagccgaaaaacatttaatttgttcctaaaaagaactaaatttcttgtaatccagatgcagcagcatgtggcatgccacaccaagtatttcatttgtgtagtctttttctccacaaaacatctacctgtttgtatatacaattcttgtatatcccgcggcataacaaaagcaatgtcatctgatataacacgacagattctaaagtcttttgtagttgttgacttgttggtaatgtccttggatggagcttgtaaatataaaggtgtctgtttgttcttccgtgctccttataagctaagtccagatccatctgtcatcttagcccacccgcaaaaaaacttcacctaaaaggttagtcatttctcgcaatatcaatttaacttgtcaattttatgcgagagggacatggatatataattagaagttatttactcttgtaaaataatttaaagcatttaatattttctcagctcataccctacttatacagtagaaaagttccttttataaatacttgttcctatttactaagattaatcgttattctctgtatttttttaaaagattttttgtgtgaatttaaaaattcaagatcatattaatagtgcacgtggtaatgtgatattattaagttaaaaatatttttaataaaaatgagggcattgattacttttttttaatatgaattatcttttaaattacatggataataaaacagatggagtaatatattaaatttttatagtataatatttttaaataaaaaatattactgttg

SEQ ID NO: 2232 - DNA, 1500 bp, Glycine max
  Soy_ogl_6308 Gm19:525801..527300 Cluster 9
gtactgcatgcatgaagtgcacatgaacaacaatgtttgaaattgaagcattttagaataaataaataaaaaatgagtatacaatacgtaccctgtagaccctgcccgacatcatgtggcgttcttctgctacccaaccggggagcagccattgatagcctggtgatgtgttgtcatggattgtacacaacttcggttcatttccgccgcgtgaccgataacaatgccgttttatttttgatacggtgtcctttgttatctccgagaataatgtttcgttcttcttcctcttccctccctcaccattgctattgtccccaccctcatgactctccatcatctcaatcttaatttcacactttctccctctcaataatttatgcctcgcccctctatatatatacttacattccacaaattgaatggacgcttatcagatcaagaaccagctgggatatgcatgaatctgatgtaaacgtttatgaaattcccttttaaaagaaaaagaatgattaaaaaaatcttcatttttttctaaaaaaatataaacaaatggatcctaattaaatttatatctttttaatgataaacctttttttgttttctttcttacaccatccctccgttccagattatgtttgaatttgtttgttgaagcagcttttttatttagtgtattagtctgcttgtgctttaaaaaaataattttttacttattttaagaaataaatcatatttgtttcttatcttaaaaaccactttcataaaaagtgttttttttaattattttttaaaatttaaacaaattcatcgtatatgatgtttgagaaagaaaaaaataatctaaaatatgtcattttaaaaaatcaatattatttgtattaaatattttttttaagactatccttaatcaaatacaaatattgtatataaaaagtaaatgagttattaattaccgagattaattataaatatgaacggaaggagtactataaatactataaatatgaagcttctttttttaaaaaagaaatatgaaacatcttagaacatctatacaatacataattaattagatgagttacttattttaatttattaggtcttataatttcatgtaactttaactactttatattaaaatttattttaatattaatgctattaaaatgaatgtttaacttaattttgtgagtcttaccgtacttaaaaaatatgttatttatcgtacaaacttgttaagcaacgttattgtttatattagcaatgtcatcttatatatttcagtgaaaagaaaaaggttagtaacttacttaaagttataaaagcacttcattggagatgctagttaggtaagaaaaatattattttatttttattagtagtattaatacttaaaaggaaatattggatatttattaacagtaacgttgttggaaaaattttaaattaaggtaattagcattataaaaatttcaattaaaataaaatctataaaac

SEQ ID NO: 2233 - DNA, 1100 bp, Glycine max
  Soy_ogl_6580 Gm19:44889701..44890800 Cluster 9
cttaaaataaaagcctccaaccataaatgttattccaaaatcgttttttttatttattaaaatcaggttaatttttttatcattgaaatcaagtaatttaaaaagttacattttttttatttaaaatccaaatttcctcttagtgatgggcaatggcccaaagttaacaaaacaacagcaccgttaagctatgcatatggagtaatggaaggtgtgcggtttagcttagaacaataatggagccaccgggcaagtaggatgccttgtaaggtttttatagtttgtattcagatgcagtacagtgaacttatgttaatcattaatttaaaaaaatttaatttatattttttttatgaaagcaagaaaaatatttattttattaatcaaattagcataaaaacacagacagcttatgttttcacaaacgataatattcatatatttataatttactttcacttttatagtatcctagttttttcctatttgtcatgcatcatactatttatcacacattttagtttgtctttatcccctttctttttattttattttatttatatctctttttcttccacctcttgtactccaaaataaagtgtatattagcttcgattataatttcacagttagtcccaagcctagggaaaataatggccgtgttaggccattaacaatcagtgtaaaactcatcaatatactgaatatggatcacctatgacaattttttactaatgttaggtcgttactcataagtaacgcattatattgctgaagtataatatcaagtgtgctagaggcatttcatcataactcggatgtattattagatagcaagggtcttaacacattattggatagatgtggataaaaaatatagttaaaaagtccttaatttgtttttctacttgaaatattagtactttgacaagttaacctatggaggtcgtaaacatcatgacctaaggattaacattatgtgcctacaagagaataacaaactggagcaaagagttagatagtataggatttaaagtttgatgattatggctagggtggactcagaattttaaaattttaatgacatgtttctgttgttt

SEQ ID NO: 2234 - DNA, 1361 bp, Glycine max
  Soy_ogl_5232 Gm16:1448440..1449800 Cluster 9
cctgaaattcaatttccagtgagaaaaacttttaaacaaaaataataataaatctattaggtagagattcttcaactcaagaatctctcctaaaaatactcttaaaccaagaaggaaatagaaagagtcattatattttgacaccaaaatttttaaatatccaatgaatagttttttatttatttttctattacacaatatcatcaatcaaatcaatcatttatctatcttttttttttcttaagttatagacacctcaaggatatttaagaaacatttttcgggtaagatactcaagtagtacaattgattaagttgagttgcttcatcgatcttcttcaaccttctttgttttttctctatttatatgtgcgtattacacttcaacaagcaatgggtagcccaacttcaatgactgtgggatacagattcatcgaactgatgaagagcttgtggatcactacttgaagcatgagttgcttggtaatgagtccaaagaacacaaagttgagatattgatgtttgccagcttgagccttgggacttactaagtatattatgtttacagctcatcaattatccaaaaaaaataatcccctcccctctttcttttctttaccctatatttgatagaagagaaaataaaaaaaaaatagagaggagaagaaacacttttttgagagaaagtggaagaaaaaagaaaaaaaaagttgactcagaaataaaagttaaaattttttttcttctatatctttttttcaattcaaattaaaatttttctctctctctctcttattttctttccttccaaccaaataaatcattagtattttcactaattataataatattcttgatttaatggtgtattattttatttattccactataaactgtgctgtcatagcattttccaaggtgaaatcgaatgacccagaatggtttttctttagtcctgttggtttgaagttgacaaaggacagaaggaataggtgtaacagactaagaaaaccaaagctgggttctggaagccaactggtaaagaccgtaaggtccgaggcaccaacaatgtcattggcactaagaagactctggttttttactagggtcgtagttctaatgctatcaagaccaattgggtcattcatgaatatcatgcagtaacctttccggaagacaaggtgggaaatgttatttaatgttactatttttgctttaccattttgttaattaatacgtacttgatcaaaagtggttctcttttagaatttgtgtttttgcttaacttttatgcactaaaaatgactctagcttaaaatattaaattagaaatttattactttatcttatttttaagattc

SEQ ID NO: 2235 - DNA, 1200 bp, Glycine max
  Soy_ogl_2616 Gm08:11838001..11839200 Cluster 9
ctactcgtgttggcctttcaagggtaacatttgacatacattttgaaacatattctttattatcaattaaaagtaattaggaattatgaaattgtgtaagtttcactctatattcaatgaattccattcatatttatatatttttttaataaatttcaactgataataaagtatataaaaaacattatataaaagtgacttgttaacacttttctactttttttttactgaactaaaaatgatttttttattaattattttgcaatgtttggttagatattatttgtcgcttgaaatagagtcaccttatcaagtaatttcctattgtagcaaagaacaattctaaattcttgtataatatatttttagcaaaccttcttaaataccaaatgaaaaaaagtaattgattattttttttatagttctaagatactaaacttttactttttaatttaacatttattttatagggtattaggatgttgaatataagaatattactataagatatatcacctaagttttgtccttttttattttacaaagaggctgaattgcccagtatttgttgggtataatgttcagcaagagtgaaaatgattgaagtaaacgaatttagttaaacatcttataatgttgcgaccgggatagagggatcgacaaacatgaaattaatacgattgtattaaaaactaaaagatgttttaaacaataatgatctcaatttatgctggaaatttatcacccttgtcttgtgtgaaaatattgatgaatttatgagtaattgaatttaatatctttaggggcaaagcaagaagagagagagctaagctaacttcgtcaactcaatccaacaagatcacattgacaaggtaatggaagtaatgattttagtgttatttggacccacgcagaggatagtgtcatgtgtacataaatatgccttgtcggagcaacctttataagtctatgtctatcacaatactttttttttttaataaagtctatcacaatgctatctatacatcccagcggaatatgataataagtggagaagaaaaacactgttattatctcatgcttttcatcacgattctctggtacttcctagtttactctttaatgttatgattggaattggatttgaagtagaatatggaagaaagatataagagaaaaagaaaaaaaaaggatgaataa

SEQ ID NO: 2236 - DNA, 1100 bp, Glycine max
  Soy_ogl_6149 Gm18:53230301..53231400 Cluster 9
ccaacttatgaaataaacattgtttagacacatctatgtttaatgaaaataaaacagtaaaataaaaacctttaagaaggagcaaatacaatgtgaatttgtatattataaattaacatgataccatacaaaatagggtagccaaaaataaattttatgtttagtgtattacaagcaacaataaaaagatagaggataaaatttagagtacataatttaatttacttatgatcatcaacagacttgaattcttctttcaaatatctacaaactaaattctctgaattctttgatgttgttgcaaatgaatatgcagtttcctaataattcaatttaaatgtgcgttaataaaaaaattatacaatttttatataatataatataatatgagtatgacatataattgatgaaattaatgaaaatcaaattaaagcatcctagtttgtgatgaaattaatttactcatatttggattgaatataactttgcttaatctaggaacattttgaatagcaacctcgcctaataaaatgtggctaagaaagcaaaataaaaaaaaatggaagtaagaaattatataaatataatatagattatataatagaatagctcttgagatacaactaaccaaacaacatataactatatgggcttattaaggaaaagttaacaccaaaatacgtattaaggaaccttttatttttatatttttgattaattaaattattttttatgatattttaagtaaatatgtcatgtgtaaagttcaattaaactaaaataatatatatatataattgaggattttttaaagtaaaagaactaaaatcaagagagagaataagagactaaactcatagattaggaattaaggatacggaattacaatttatcctaaagcttttaaaaatcaatgtaaccaaatagaagattatctcagaacaatccctttcattaaatttttggctgaaacttacctttctaagccttaattaagatttttggatcaccaaatatttcccattcttacagccccccaggaccaggactgatcccttctacccaccaaagtagccatttagttggccaaattttaataa

SEQ ID NO: 2237 - DNA, 1064 bp, Glycine max
  Soy_ogl_4219 Gm13:23366837..23367900 Cluster 9
gtaatgtgtttattgaaataaaaaagaaagaaattcgaataaaagaatatagtgttttccttttaaaatgattactttgtttaattactaatttttggttattaaaaagatacaaatagagatttgtgttttttttaatattttatatttgagacaaaaagtttatcccataattttctaaataataaaaatgaggaaattcgttctctatccatacgcttgacttgagttgcccctactgttcttttcaaatcaaacatagaataaaaatatttattttatttggtagcataatttttaaccaaccaaatggatccttgttggatttttagctagttatctgttaataacaatttttatatttttttattaatgtttattaagacaaacaaaattaaattttatttaataaaaaaatatattaaaagatatattaataatatttcctataaatacatctctaaaataagtatttctaaaaagtgacatgcaaacaaacatttctctgggtgcagtttatcagacataaatatccgggggagggcttgatggaaatccaggagcactcaggatcgtatgtgttaacttctatcgccaaagcgtttgaaaaattgtgtgatgggtttcatttgaggttgggtgatggtgggagtagcttttggtttgaagatttgaatattgccctggaggtttcctttgtggatgttcatgacattggcttgagggtgtgtgatgtggtgaatggggatgggaactgtgacctctccaatgtggattctctgcttcatggggatctgatgttactgggttttgtgggaatatcgggcatgcagatattttgaaggcgatatcaaggatgggatataatcaaaattataaaaaaaagtgtaattttaattacagtatatgggtagattcaataatataaatatttttacctaataataaaggaaaatctcttacaatataaagacactcaacttgattaatttgcaagttttgccttgaaaatttgtatgatgttcctatttataggttatgttaggggactcttaaaacaaata

SEQ ID NO: 2238 - DNA, 1000 bp, Glycine max
  Soy_ogl_4249 Gm13:24370201..24371200 Cluster 9
acattaattatgttaaaaaaatgattgcattaacatcattacacttaatttcaccaaataatcatggaactttttgacttctattgttttaatccttcgaaccctaccaccatcaccaccgcagccatggtgacccacgccgccgctcctcaccgtcctttgcgccgcgcttcccttcctctctacgaaaccagatctgaaacccactctacttcaaaattaattttgaatagaattagtctctaaagttaacttagtttcaaattaattttgaagtaaaggaatatatgttttttatttcaaaaaatcgtaaaattccatatgattgttcatttaacattaaaactatataaaattgttgtttcaacttaaaattaaatttgaacataaaatcaattttttaatataaaattaaacacgtgaaaaataaaatagaatgaagttatgtgtagtttgataaaactcacggatattgtgtataatttgttctagattctatctacatcccgtgtacttactgcttacttagctcatgactttttttttttgaaaagtagctcatcacaatatttaaagatatatccatatttcaaaagtttttatcgttcaattgaatataaaataaagaaaaaggtttattttaacatttttttctcaatttaaattacaaattttcttttcttttttatttctttccttttaccaaaatttaacaaagtataggtggattgatgtgataaggagcgtgctaaaggaagtcaattttagattaggattttaaaatatttttttaatataaaaaatcttgtggatttcttttatattacaacaaaatattcttttatatttcaagaaaatcttgtggttcccctattttgtgaggatgtaatcacttttaaaattttcttgaaagatttttatgattttgaattttgtattttaaaatttaataaatttagaagaattttatggatttacaagattttataagattttatga

SEQ ID NO: 2239 - DNA, 1000 bp, Glycine max
  Soy_ogl_3977 Gm12:2343801..2344800 Cluster 9
tacacgaataaatgtttaaaattataaaactagttactatattattaattataaaatttcgctgggttaatttttgtcggtattatggaaagtaaaagattaaaaaaaaatgaaatttgaattaaaaggtctaaaacttttatcttatcaacactcggaccccaatgttgaagataagaacaaattatgtttgattcgcgcctattatacactcatccacatatcataaattcgtaccttcatcttttcaacattcaacaatcaagatgattatagataaggatgacattcttagaatccaattaaaatcagattttttttatgtaagaattaaaatttaaaaaagttaaatttcagattaaagaacaatcaaaattatatttttttaggaaaatgttaaataacttcacatcacacttttattttgagtgtcaaataaatgaataaatattaatttttataataattattttaaaaattatatcatcggtaatttaggattaaataactatacaaatattttatattattagtgtgatcattaaattttaacataaaatatatttttaattttttatgagtataaaagtttgattttaatatttttaaataaaaaaacaataattttagtacttcccgattatatgacttaggagcattggtcacatcaaagggcaaggcaagtaaatgtaacacaattattacacctggacgatgtgttatttccatttacttaacaatgtcgataaaaggaattacatatgatatatgatatacatttaaaagacaatgtactaaaacaatacgtttttaaatttgacgaagtaaaattaagtttcaaggaccaaaatttatatttcttttttattttattaaagcacgcacaaaataggcaattaattgatatagaggaaacaaaacttgttttgtggaaaattcagacttgtaaactgacgaaacggacagaagaatatataaggcagcggggcatgcattgtca

SEQ ID NO: 2240 - DNA, 1400 bp, Glycine max
  Soy_ogl_5330 Gm16:5932001..5933400 Cluster 9
acaatgcaagcactgatgatatgagacgcttctccagacttcgaaggtgaggggccatacatactatcccataattatggtaaatatcaacaaccaaaacccacaatgacttgcttagaccattcaggggagatatccagcaaggtatgatcctcaactacactagttaacatacttacacgtgtcttctttcaaccaatcacattgtcacattaatagtcttattcatgaatgtatgtcaatgacatgtttattatatgtttaaatatattttttcctaataagttagtattttttaatataatttaggttttcataaaaaaatttattattagtcgttataagttcatgcttttttttaattgtaatctcttgttcatgtttttattaattgtaatctcttcaactttgcccctttcaaatctttcaaggattaaaaataaataaaaaaattgaaatcttaaaagaattaaaattaataaaagtataaatttatagggactaaaataaagttacagtgcgtatctttattctttaagttctataccgttcttttattctaaaaaaaatattataggttgtacactatgtttataataatattagaaaatgtttaacttttctaattatgacttatatgcatgaatttatccaaaaatatgaattttatataagaataattaagatatattattttaattaaaattctcttctagagtatcattataaattttaataataaatttgaaatttatttcattggtgataaaaaaggtaaagggtacaaatgaccattggtttaacttcaattatataggaaacaaagtggaaaaaaaaataagagtagagaatgacttctagaaattataaatgaccattctatggaaatctttgaaagtctatttttcaaaacaagtttgacctttttgcttaaaaaattacaaaagtgatgataaaaataataagaaagctaggttaattataagcttctctatgaaaacatacatttgttttttaataaaaagtttactaaatgaggttaaaaatgggtcttttcctagctatagtgatttgaccaaggatttcagaataataaagtatattttccaaatctaaatataaatttttttttataatttttcttttcaagttagtctttagtataatcgtcaatgtcaatcaatatagtatcttcgccttttaggatttttaacaatagtaaatgttatttaaaaattccatgtaatatactatcttaaatctagaaatgtctattttcagttcatgaagaaacagaaaatagattattttcataaatgcataggaagctacaatgcttattcacattttaagaaggtcaaacttgtttagcctcatctcaatcatttcttcatcttttt

SEQ ID NO: 2241 - DNA, 1269 bp, Glycine max
  Soy_ogl_1335 Gm04:41485420..41486688 Cluster 9
catagtcaaaagcaggtacggttgatgattcactaacattaagaaaataaccatgtctagaacgtgaaggattttttaaaagtgatttaataataatcataataataatatatgattatccaattttactttgttttgttgatattattttattattattgtatattcatattcaaaagcaatgtatgattgataactcgccttacattaaataataatatatgattatccctattttactttgctttattgatattattttattattattgtatattcatagtgaaaagcaagttatgatcaataactcgccatacattaaaaaagaaaccccgtctagaacatggaggatttttcaaaattgatttaataataatatgattatctcctatcttattaaatatgtgccgtttttagccatttctttcttccttgagtgagtcacttgtcaatctgaagttatatttctaaatttatttacttatgttatttgattatttcatgttctcagtatgtttttgggtgaattagaaaattattttgttttttttttaatttagaccattacttctaataaattgtttttatatacttttaaaatattaatacatcattttgatttgagtagtattaaggatcaagtctttgataataaaaaaatatataattaaaataaaagatccctacactaaatataactaatcagattcctaaataaaacttagtcagcaaaaaagttgatacatattcacactaatgctaatccgatggtgggaaaaaacttttaaaattgaaagtgagacagtgaatttacttttccatgcataaaataacgttaactttttttaatgaaatttctaaatcaataaattttgaatgtatatttcaaatttaataaagtaaagcatcattgacattattcgctcaggattaataatgaattagtgcatggaaggttgtgtgatttttttgatcagttgaaattttagtcaccaatcccttggagtttttttttttttttttacagtaccaacccgtttgagaagttgtgatatatttaacaaaattaacaagaacatctataatatatagttatttaaatgagttatttatattgattaaatttatgggttgtattttatatacatttaagtattttacacaattattataatattaaaattgttaaaataagtgtttaatttaattttattagttctactatgcttaaaaatatactatttataatataaatgtgggaacaatgag

SEQ ID NO: 2242 - DNA, 1020 bp, Glycine max
  Soy_ogl_5135 Gm15:47159281..47160300 Cluster 9
ttctaccattttttgattgttagaaagaatcatatttaataatatgacgtgagacttaatctttttttgttaattttaataaaattgaactaacaaaaaagaatgtatttaaaaggggtttctagtatttttttttataagtaataaatatttgctaatcagtattgttataagatttttcagcaactcatcatctgattaagttggtattaattcctgagcacaacatcaattaccatattttcttaagaaaatgaaagttaatttctaaaacgttttcctttaaattaagataaaaaaaaattatactttgataatgtaaaattttttcttatcccattttccaattacaatttatcattataataaatttaataacttttatgataattactttaaaaatcataataataacttgaaattggacgacttacagtataaaactaaaattctttaaacaaaatacaacttaagaaaagttaataaaatagatttagttgaaaagttaacataaatgctatgtattgtcagggtacttttttttttacactaacaagcaattaaagtgatttattttggcatataaaataatattattatatttaaattaaaaataattataaaaactaaaaaaaaaactgtatcctatttgcactggttgttctatcttcactagaacaaagcataccttcatcacactacaccatgaaatcctacctagcttgatgcatcgtcatccacaatatatacttaccttttcagcacgcatcatccatgattttaaattgtagttggttgcattgagtaaaaaaattaaaacttttatgttgcaggtatctgtagaaaaatagctgatacgattacagttactatcataatgattaaaaaaatctttatgttacgacaattgtaattgtggatcacaatttaaaaaatttatatattaacaatgaattaagattaaactctatttttagctttaatatttaattcaattattatagtgtagactctagatat

SEQ ID NO: 2243 - DNA, 1200 bp, Glycine max
  Soy_ogl_3810 Gm11:9129201..9130400 Cluster 9
ttgtgtatttggttttatttatttatcttataaatactagtattttttagctatttttttatataactaaaaaacattatgataaatacttcaaaatatataaattatgttataattaaaataaataataaatacatatttttaaacatataagtgtgtatttaattttattataattttattttgaatgctaattaattcagtttataattaagttaggaaagagtatgtttgtggactgaactttgtactttgtgcattgtaagcatggacatgggattctagttaaaatgcaacaagtgtgttttggtcaagggggccatggcctccctcattgtttttaaagtttcgtaattaatatcaatattttgattatttttttattttgttaattttaattattagataatattttactctattttgaaggttttttttaaaaaatattatatatgtcctgtgggatttttttttttgccccagtccattattgaatttatgattagatgaatatataaaattattttataattttagtacatattccttttttttcatattgtagtattaacaaatatgttttgatagttttatttatttcttatctcataaaaaaactatttatttattttcatgtgttactttgtactgtatcttaaatatttgtatcataatttaattattttaatttctgtatttttactgaaaattattttagtttaatttctgttatgaactattgttagtgacaaataaaaataattattttaaatttttttattactgccccctattttttaatcctggatccgcccctttataagctagtttgattagcttatacttgttaatctttctatcattttcttctcctttaatcaatcaatccattttaaatatattatggtaattcgtgtattgcctcgataaagcattgacttgcttccgcaacgtacgccactacgcctgctgaaactcgtcacgccattggatgagatgaatactccccccatcattggatcaagggtctactctctactgtactcaactaaaattatttactaggtaacgcctatctccaactaggcatttcttatactaatcctatttttttggattaagctatccttatcctagattgaggtgtattgctaaataaaataaaataactaattagcgtgataattcttgttattgaaa

SEQ ID NO: 2244 - DNA, 1406 bp, Glycine max
  Soy_ogl_4315 Gm13:27887501..27888906 Cluster 9
ctattttatatttttgttacatacttgaattttgttaagattaactagtagtctggtgaagtaattgtgttagaaagtttcataattatttttatcgtgcaaaaaagttataatttaacataattacatataggattagaatccgagattattggttaaaactaaataatctcacaagtcatatccgctcacttggtcttaagtttcataattattttagtcctttaacaactcttttatagtaatttcaaaaagaaaaacaactattttatattcgaatttgaataaataaattaaattttagtttttcttgttaattaatactttagtttttgaaaatattatgttatttttgtcgtgcctgatatttaattattggcctgcacaacttggtcttacacttcaatatatcatcaagttttttccaagtaatgaaagaaatacaatattgtcattttaaaaaagcccattctccaccatagatatcaaaagactcaacttttggattaacatgagtttgagctgactttcaaattactcgtctcgaagtgtatacgtgtaaagttttcagacttattatattaaatagtcattcaattttttgtacatatatttatgttatagatattattaattacataatagggtacatgctgtgtaaaaggtagaaagtgataaagaagaaaaataggatgaacgtggattatgagagaataaaatgcatgtttataatattttttaaaaatgtcttaaagtttaattagtatttgtaactaaatgaacatttataaaatcttaattaaatgtaatttattttgtaaaaaaatccaacttgacttttttcttaatagaatataggtcagttatctatctgttagaagtcagttataggggtcctatattaataagagattaatgtacataattttatatcttttaatcaatctatgagtttttatgaaattacatttctctcatattacttgtccttagcatatgatttgtatcctttatattctaattaccaacatgttattagagtgacactttcgtcttctgctatggtgccatcatgtttaatgttttaccatggttcactccaccatctcccatttatggaagagagcaaagatggaggagaaggagaaatccttacatacaactacttgatgccattaattaccgtcatggaaggaaggatctctcccttccaatggtcacagtagcatgttacatatacaaatctgaacacaccaaattaataccataggagtaatcaatcaatcttacaatattatttacttaactatatattattaataataattgtaaagatatacataatcggtacgggaaaggaatgaaaagtgacatacccatatctgcaatggatcccgctatcccaa

SEQ ID NO: 2245 - DNA, 1200 bp, Glycine max
  Soy_ogl_6329 Gm19:1920801..1922000 Cluster 9
acttggctatttgtgataagaacatgtttcatattctaatcatggattacgtttcactagtgatgtacatgacctcaatctatgaaacacaatgataataaaactaaaactggcatattatattggagagttgttttcctgcctcatttctagctgttttcagctcctttgacaatttaataatgaaattattcaatcattcgaaaatccataaatatattcgtaatatcttacatacacatgattattaatcaatgcctttaccaaatagtacctaacccaagtcaattgattggtcttttgagagaaaaggataaaacctagatataatatttatttattgttagcattgtttttatttaatgaaaatcaatattttatctccattattattatttatatctatataacctaaattaacaaaaggtattaaaataaaatgttgatttttattaattagagaaaaaataaatagtttatgcaccaacaatgtaaataatttttacattatcatcgtattaatttacacattttaactatctaacaatattttacactaaagtgcatagaaataattaaagtcttaataaaatgagagtaattataatcctagttatatgtaaaatattgtaatatgaaaaattgaagatatatttatataaagccggcctttgggaatcatctgaagatactaagagacccttttaatttcccctataaatatggtctttctcttgaaaaaatagaagcatgcatgagagattgaaggagctagatgagaaaatgttgatagaagaaaggtttagggactcctgtcgtaggagagatgacgccttctgttaggtaattaatatgttgcaaagccaacttgaattagcagtagctgtcatctttcctcggctgaagccccttcacagatttctgttcaattcctaacttggctgagttatttccaaggtaagaacctcttgcattttaattcattgtgtttttgtctgtcaaaggttttactctattcacacactaaacaagaatgcaaatggacaggcatgctgatcatatgcaagttaatttatcattgattgcgtagataaactgatattaggtttgaggttcttcaagtcactcccagtcattatgagttcgagtattttatatgtacttaaaggaaaaattttattgtttataataattttgttt

SEQ ID NO: 2246 - DNA, 1067 bp, Glycine max
  Soy_ogl_6164 Gm18:53960801..53961867 Cluster 9
tgccttgtcattgacttggttttttgtacaagggagggtaggagttcaggcattagctttaacaaatggtgtaccaatccattagaatgcctgaggctaagccatgcattctaacttttgatttatgcagggactgttttatggtgcagaatatatacactgcaggtttttgattcgggcacatttggtcatttggtgcaagtatgtttcttctgtggaaatatatatgattggttggagagaggatatgggaagaattgctgaatgctgattttttctttctttcatttctgtagctatgtttcatgctggttttcgtaataggtgtttggtagatgaaaattttttactttttagaaattttaaaatgaaaaactatgattttcatgtttgatatgtaattaataaaagaaaattattagatatccaactttcttgagtagattttttttaattatatattttacatgaatcttaatttctaataaatatattaagactaacaaaatgtattttaaattcttaccaaacatctctaagtgattctgtaatgggtttcaggacatcatgcttctgatgtcctatttggggtttggtttagtccggccttatggctagccaaatcttctttctccaatatgtcatttgtcttgggcttaggccccgttgttataaaaaaatgtcatttgtcttgttaatttttttttattatgatcaatttatagcgtgtataaattaattgaaatttaaaataatttaattttgataaatttatattaattcgttgttttaatatattacataaatatcggcgtatattcaattattattaattcaattataatttgatcataattaaacaaataaactaaaaataacattttttaccgattcagtactatgatccttttttgaagacattcatcccaagaaaaatctcagctggagacaatgaaaagaattaattataaagaaaaaaaactttaatttcaatatataaatgcacgtttgcttcaatttttttaaattattaatttatttccttttagcttcctgaaaatattctg

SEQ ID NO: 2247 - DNA, 1100 bp, Glycine max
  Soy_ogl_5166 Gm15:48969901..48971000 Cluster 9
ttttgttcctaattgatcttatctcatcaagtttttattttcgattttttctatcattgttgcaccttcggtgcctgtaactgcactaggcatgttgttgcagttgttagttttatgcgcctttgaactgtatagagcacaactcacgcctaattaaaagcaaccatttttaattaaaaattacttagctgaaattctaacttgatagaactaaaaaataggatgttgaacaaaaaaaaaaaaaaacaaggacgagtggattcttgttattttatttgatgtttttatcttaataatttgttttataaaatactaaaaaaactacaaaacataaaaaaaagattaaaaaggaaacttcaaattttaattaattattggtgttctaaatatttatactgggtggattatcttcaattgcaaaaaacaacgagtatatacctgatgatgacagagttgaagctaatgcacatcaataagtaaattttgattttttttttttaagttctagcacatatttactcttcaatcttttattagttagtaactaatatattatatggtatcctggatgcgatttatgtgtgcctactaaatgcagaagttttaaatggccgaaggatgatatcatgtgtgttatgataatgtgtctacatgttatttgtgatttcactttgcttgatggggtgagatcgtttctatatacatgggaggagtgtggttagtctttttaggtactgtcatttgtcctggattctggaaaatcccaatatcttctaatatgccacgccgtttgggatattataagatgttggggttgaaacttattagtattagtgagaaagttggggtgattttggttttatgtgggggattttttggactttctcaaacttgtatagttacatgcacaccttatgcttatgcttttgtatttttgcctataaaaaaaaagtgtctacatgtatttggtccaagaaaaaagtgtctacatgtatttggtttaggacttgggtaccaaaatctgcttggggggtttgataggcattaattattaaatgtttttggtcttgtcttgcttggtccagtgtgttgtatttttt

SEQ ID NO: 2248 - DNA, 1300 bp, Glycine max
  Soy_ogl_512 Gm02:12095601..12096900 Cluster 9
aaaaatcaacaaatatgtagatcaacgtgagatttttcaaacttaatcacaggtctcaaggctcgaacagattacctccggtaaatgatacatttggtttattgaagaaaaaaaaaaaactagcataagtcttgcgatgagtgtagctaggtacatatttcaaattaatttttaataagttatcacagccaaaagtcatgcgataagtgtgagaaaacgtaagttttttaattagagcggtgaaatatttagtgatgagtacgtatagctagaaatgattaaaacaaaaaacaaaacaagcaggatatatagtgtgctagctagtttctggaatccaatggaagaaggactaaacaaaatgtatttttctttccccaagtggaagaaaccagggtcaacattgaaaaaatattatgttttgtctcatgttacctgatacaaatattttaatttcttacaatgtgataataatatattaaggaccggaagaaaccagggtcaaaggtttctcacaattttcatgcatttgtttcagattttctatataattaatcagaagctaaataatttttttttgacaggaagaagctaaatgatttaaaatttaattgttttcagattttctaaataattgttttcttagctgttaaaaaaattaatcagaagccaaaaaaaattaaaatttaattaaaatcaaaattagtttgaatagtttatcataaaattagttgtttatttaaaatatatatgattttaaacaaggatatactaattttattttttaaaatctctggaaaataattgctaaattattttacattataaatttataattattctttttaataaataaataaaaaaacaattgttttggattaatacaattaagatacctagaaaataaattatatgaaacaaaaaaaaaatcttttttgacagtaataaataaacaaaattcttgataaatagactttactgcgtctggataattacatgcatagcttgtgtaagatcatgttttcctatttcagaaactttctttccatgttcttcaagggaaactcttccgaattatttttgcaatattttaatgaccacacaagtgtactttcaacgacaaaagagaattccgattagaattggagacttgtgaaggtttcttgtggccactaatatgtttccctttccccaatttgagcaagaaaatgtttgtcctttataagcacatatagtccacaacgagacggaacccaatctagtatttaatttaatttgcaaaattcaacttcagctatctgtt

SEQ ID NO: 2249 - DNA, 1000 bp, Glycine max
  Soy_ogl_2382 Gm07:35734001..35735000 Cluster 9
tccattattttggctaggcttttaactgttttctacatagcatgtgttctttaaacttcaaacagttctgctgttatatacaaatgggcatttacacgaaataggtatgaattaatgtggcatttctatcttatttttttaagtaaaaatcaaaactattcatcaccaatggtacatacaaattcataaagattttcataccgaaatcattcgtgcaatttaccgttaatcaataattagtggttttgatttagtttttctttgttttaaaaaagtaaaatgggaaaggtatatcatttgcaccaattttgtgaagtgtcctagcttacatatctgaattgaactcatggcttcaggaatgaatgagcaactaatatggtttaacatagttgatatacataattttgtttctaaaatatgcggttataggtttgatttcaagtcctataaatgaaaaaaaatatttatcaggaaatatcaattccttaaaagaatttaatttcagtactttaaataattaatctttaattttcgacttaagcatatggtgggttttaaaaaaaaagaaatctgtgaactttttcaattcgaatgagatcacatatacacaatttttggaccatacttgttttgatgtcatcttgtagttgctcccactcgtgggtagagcatgcaccatgggcctactgtcttatgaaggctaactgttacgatgaaggtgtcggctgatataaatttaggtcttgctttttgtaactctcttttgctattcacataaatcacatcccctaatttttccttgtcaattgttattcaaatgattttcttttacatgaggttagttttatttctatacatttaaatattgcggaactacgaaaaatatatagattggtttccagaatttaaatttcagaactaggcaaaataaaaattaactttcaaaatttaagaatatatggtgaatagatttacgtcatcatttcaatatcattttact

SEQ ID NO: 2250 - DNA, 1400 bp, Glycine max
  Soy_ogl_1765 Gm06:2603901..2605300 Cluster 9
ccagtgcaagcaagacctacctagaatctgattcgaaattatgtccttgaaagttgaaactagcgtctcaggctgcatatgcctttcaagtcctgatggcaaccccgcaaacacacagccaatgacagaacgcatgattagagtgtgcactcattcattcttcggttcttaactaggaaataggctcacaaccttgtgggacggacatgattaggtgaacattttgtctaattaattaagtacattatttttactccttaaacattgttacagcgctctattgaaagtgaacacaaaaattgtcaaatacttctagtattggcattttttttttggggtgaagtcagtattgacctatttggtgtagtaaatgatcatttgatcacacggaatcacattactagggtgttaagtaacatattttatttagtttctaatttttttattagttaaaaaattatgtaattatttggtaaacagttttttttaataatttttagtattttttataagctactcgagctaagtcaattcttaacttttatttttatttcctatttatctttaaatattattagattttattgttaatattttctgtttaagacaaaatttgattattttattttttatataattttatattttttcagttagttcaacaaataactttatccaatagttacaattcaatcaaataattttatagattttagttaacttttcagtttgttttatttaacatattatataataacaagttattccaaaaagaagttatcccttttgtttttaaatacaatatttttttcttcgtcttaagcataagaaattttgaaataaatttgttttacttaatggctattattcctaaaatactattaatttaattgatatgttagttttaattacgggtaaattaaaaaaaataattgaaattaatgtaattaaatatgattactctcttatgtttcatttgagtggttgctagttttttatttttgttttaaaatgaaattttaaaatagaaacgtgtttgataaaaataagtttgaattggttttttgctttttttaaaaatcgattttaccccatttcaaaaataataaaaattagttttactctaatcctctagcatttctccctcaagccattctctctcggatcattggttatgatatttgattgtcgattatccgtcacaatgaaatgttaattatggatcactaattgttaattgtcaataccgattgtgatcgttgtcattattcgctagtaacaattgtgatagccgatcataatcacattttatcgactatcgtcagttcattagattgatatttttttaattataaaattttgacattgaagataaagaaatttatttaatttcagaatgg

SEQ ID NO: 2251 - DNA, 1228 bp, Glycine max
  Soy_ogl_5917 Gm18:3056501..3057728 Cluster 9
tgtgagacaagaatccagaatagctgcataaattaaaggagggatgaggcaccaagctttagcaagcttgtcggcacacatgttgccttctctatcttatgttgttgatgaacatgatcgacgtgagagaatctgattccacaatgaagtccatgataaatggctaggagttcagcgtggatgttcgttgtatgatcgcaagatccgtagaaaatgaagaatgacattgatagtggcctcattggttagaaattaaaataaggtagcaagacttttctcattcccaacgtgaacgagaaagtttaaatcccaaagatactaatatttaaatattaaaactcattttttcggttaattcaaaaaatcatcattatttttttttcaatttctttcttttcatatatcactatatcatataaactttgtgtaattcaaataatggcccctttaatgtaaagttttattgtgagaaacaaataatttagtaagataatatttgtttaatttttttgttatgtaaaattatattggatcaatgaagtcatataatatagattgagttagtttttaatctaatagattgaagtagagtcagtttctatgagaaaactcacttcatttaattggaactttggtggaaatttataaaatagttaaatattagaagtaaaaaattagtgaaaggtggataaactaattaattgaattaaaaacatttaataaaaaaatcatattatacaaagcttataatgaaacttcctcaattttagatttgtctgtaaggccattataagtataaataattcattttacttccagaagagattgaagcaaaacagcaagctatgaataactaatttaaccagtaaaactgattcctttaaagaaatcattaaacgaacccaaccatgcaagttatacgatgaaatactgttcattaacatctaatgtcgaacttatgaaacttaagccaaacaatggacgaaataaattacactgaaaaaacatccatgatacatgcgctctccaacactagtaaaacagcaaaaataaatatgaatactttagaaatttagtcaaacatcgatcaacctgcactcaaaataagctcactatataagtcaaaaatctatttagttcctgatttatcttttaaaatcactttaatccttcgcttatttaaaacaagccagtcacttctaatgtagaatcaaagtgaacattttaa

SEQ ID NO: 2252 - DNA, 1144 bp, Glycine max
  Soy_ogl_3269 Gm09:43397157..43398300 Cluster 9
tttccggcaattgttttgatattatagaatccataagccgatagaaaacatctttaaattgcataaggcaaatgttgggatatgaggatacataagaatatatgtctagaactcaagaactcttgtagaaattattaagtggtatgagattaagctctcaagtcttgactaatctttaacagacatataattgagtattattatttttttctgattaattgaaaagtttaattagtaaatctaatacaaaaattgaccaaaaaaaagaaggcaaaattaccaataaaatatatcaaaataaagaattctctaataaaaaataacatgcaggaatttgagccaaacagagcatgtttgcctctactgaatcatctgcaaaaaactctctcttcttctcaaattgctgcacctttgttttttttactcttcccagagccgtggcttcttggctgtacgttttccttttccagggatacataaatatctcaaaaccaaaataatgggcttacccttcaaactttccatctttttttttctttcttttcaattcttctatttcaaggttagtatgagtttaacttaaggagggactcacctaatatatctcccctttaaaattgctaaatatagattgaacaacactcattgaactacgatgtgaatttatgattgtgtaaatggatggggacggtctaacaggaagaggctagggggccaagtggtcctccttgggaattcatgaatagtctcatctcaattgatctcgtagaatccatcaaacgttggctatgtttgagccacgtaaaagtggtgactattaggtaggagattttttgtggggaacttactaaaagagataatgccacatgctttggatgtatttaacgagataaataaaataattagactaaattattaatttattttatagtaaaacaaataaatatattttatcaatgaatagaattttaatagcaccaaataattaattagttatcatcgtattatttaatttaaaaataaagatataaaatacgataaattttattataatttatttattttaatgatttaaaaataactaacattgttatatttcattttgtcgatcacatctctttatcaatctaaacattattataaa

SEQ ID NO: 2253 - DNA, 1604 bp, Glycine max
  Soy_ogl_84 Gm01:3355931..3357534 Cluster 9
aagcattggttgtaagtagggatattactattaggactatcactttttctattggcactaggtacctttttgttatatttctaaattgtcccttgggcagagatacaatagaaacatgttttcattatgtaaatggaggtaaaaaaaacaaaaaacaaaataaagacatgatacaattgcatactttgatatttacaaaatgaaatcattgtttttgttataatattttctgctcaatcctatttacacaacaaaaatacgattccatgattgacttgtataattatcaaacaaaatcattttttgttattttgtttctttgcatacattttataaaataaaaatatatttccgtttgttattttgtttctttgcatacattttataaaataaaaatatattttcgttgtacacttgcacaacggaaatatattagcatcttataaaatctgtgaaaaaaaaagtaaccacttctgttgtttgtttcttcccgtcagcctcaagatttaaatggcttacaaacttggcccattattttttttctttgcacaaattggagcacacgatattttattaaagaaatatcaataagttgaatttgttatgtgagaaatggcaacaagaaaaaggtaagcagacaattatatgtatatatatatcagataaaaataatcagttgtgtccaaataggcctacacaatttttgacacaaaaaatcatatcaaatagttgaattaattttgtgagagatgaggcaccaaataaaggatacgagacaatacattttctaacactttctgtacgttttatattagataaatttatatagctttattcaataataaatttaaaggagaaaataatataatttgatgaatttcacgaatgatggttaatcatgtgtttctccctaaacttttttgtaaattttaattttagtttctaaacaaattttttagcattttggtctctatatttcccaaccaaatttttgtccatatcaataacagtcttccaacttgtttttcaactatgaaaattcaacctgaactcctaataaattgtttttccattgccaaccttttctcttctatttttttttttttgttgttggtggcagaacagggtttaatgttgaaaatataaatcaattgttagacataaaacccaatcacaaaccaccattaaacaacttaaactggtgatttggttcatgagatggtatcaaaacatgtattaccaagtgggcaagagttcaatctttgttgaccccattctttcaaataaaaattgaatttcagcacaagatatagtgggtgaataaattgtcatgcttcaagctcaaaggattattgcatcaaacaattatattttagtcccctgtaaaaaataagacatttgctctcttattttttaaaatcaaggatttgggtgttgaactgatgattgttaatagaaaaccttactgctaaattgctaacgtaacactaatatatttttggattctgttcatattccttatatatctacaaataattttgtatattatgatcatcatgctgtggagattgacttctttcactaaacccaacgcttactggtaa

SEQ ID NO: 2254 - DNA, 2209 bp, Glycine max
  Soy_ogl_214 Gm01:48898292..48900500 Cluster 9
gcttacttctagtctcatactattgttaaaaattaattttgttcttcttattcttattttttttttcatgcatgaatttagtcatatgtattattttaattgtgcaatataatttaattatgtcaacttgttaacttgacatttgatgtttaatgaaatgctaacttacattgtcatgcattgttacatcaatatttctattcaatattcaacattcaattcaaagttaagaaaagaattaaaattacacaattaaaataataaatagactaaattacaaaaaaattaaagagatcaaaattaaatattaacaacaataaagagatcaaaagtataattaattctatttaaatattcacataaaaaaggcatgtgtgtagccgtacgtacatgtacatggatgtgtgttatattactcacatcacattaaatttctagattattcactatataatgttattttatatctattaattattttgtatcatggttgtcattcttttctattatcactccatattcattttttaaaaggactaataatacataaattattttttattttaaacactttatcaacacctataactcttatttatttatttttttctatcacattgtaaattttattatacatatatttttctctctagatctaagatagtgtatagataagcatccaatatatgttatctttcaactagagtgtttaaaataaaaaataattcttttaaagtaattccccaaaacaaccattttataaattttgagattttatcatccaatcaaacatgcatattgtaatttaaaataaagtagaaaaaagttactgaataaattgcacttgaattgacaataagattctcaatatcacaagaagaatgtatgaacatgtaatttataatccatatatcccaaaaaaaatattgatatttacagctaagtaatacccaaaagaattttacaacctgcaccaagcaacatcatatctcacaaacaaataaaagctgaaagcaaaaacgctaacacaaagggtttacttgtgtttctttcagcaaaacaagaagcacttttaaaaacaagatttatttctttagttcttgcaattgaaaatacaaaaacatctctaaattattgttgttccttataattgaagtcttatcttcttctctcactcccattatctaaaaactagaatacaaaaactcaatcatcaagtacacctgcatggaatagttaatttctcagtactagttttcatcattgtatccaggaggagttttgttgagatcaataacatagtcccttggaggagatgtctccacttcatcattttcaataacagcaggaagtgcaagcacaacttctctcttctccatctctacaccatcatcatcctcctcttcattgttctcttcagcacattgctcaacttcaaccttatcagcaccacaagactccacttcagtcttcttcttcaatccggcattagctgcaggctcagcttcaatctcattttcatcagaaaaagggtctgcttcttcgttcaagtcgcaaagaagctccactcccatttggaccattttctctattgcacaattcacttcaatgttttctgcaacataaggctcaacttcaatgttctgatccacagaatcatgttccaccatctgttttcctttgtttaggtccaacaaagaatgacattcatgaggcatgcccttgtgtccaatttcaggctgcactcttgtagtttctctttcaacatcattggaggagtgctgcatcattccttgatgatcagcttctagatttagatcaatccccaaaagtctcactacacgaggcatgccattgtttccttgatcagcttctagatttagatcaatccccaaaagtctcactacacgaggcatgccattgtttccttgaggcttcacatccacgctttctatagcttcagtctccacttttgttgtttctgtttcaacataactgggagagttcactatttcttcaactcttcggtttaggtccaattcaaaatgtcttccatgagaagtgcccttgtcaccatcatgctccacattcatagcagcatgatcagtctccactttctctttttcaacatcactgggtgagttcactattccttctcctccatgaggcgtgcccttgtcacctttaggctccacattcatactctcag

SEQ ID NO: 2255 - DNA, 1806 bp, Glycine max
  Soy_ogl_253 Gm01:271295..273100 Cluster 9
cctttaacaataataacaatttagaattatataggattatttaaattatacatttaaaataataagttcctttagttataaattatgaattaatttaattcttaaaattatactcccttcatcatattataattattttcttaaattgttttacatggataaaaaaaatagattcttaaagttaaaaaaggatatattgaacaatttcaataattgagttcatcgatagttatagaatggtagatactataaaaaaaaaaatcatatttaatagatgaaagagaatcttaattttataaaaagtaaccttgtcatcattaatttaatttttttaactatatggttgatattataaatgatatacttgacaaaaaataattaatattatattaaaatattaaaattattattatttttaagacaatttttcttcttataactcatgctgatttttaaaaaaaaaatatataaaaaaattgaaagaagccgccgcctaatgtctgatttctagttttcattaaaaaagagcccacttgcacgttcatttcaattacaaaaatatcccaagcaaatgtttcattaaatacttcttaaaaaaataatatcacgttatcatcttacgaggaaaaaaattgtagatagagatttaactagttttcaaaataaaaactatataatatttacttttcaaataagtttcaaccattactgcactttttgttttttaacattgcactatattgattttcgatttataggcagtacattgcctatgcttatttggatttataggcaccaaataagaaacaaaactcagcgtttgcttttgctgtataaaaaaaaaacatatattgccttttgttttaattgcagtattttgatactactactaattaagttgaattttcgaatgttttacgggtctcaatttccatacagttttaaaaatgcataggattatcattctcataatgcgtgtttgctaattcgcaatagacaacagctatcaagattcattgaaggggaatgctgctgtacaccattattgccttcttactaaaattaagttttccatgtacagtgagaggtgagaggagacagaggggacgagtagagcacgtgggagaaagaaaagaacaggattaataaaattaaattaaggtacgtaattaaaatacaatatatttatataaatagtctaaatataagaagaatgattattttgtccaaataaaaagattagctcacttgtacctcttaccttttttttagtgagtatattaaaaaaatacctacacaaaggcttgtatcctgttagatcaagttttatccttattgaaaatatgagtttttcgtaaagatgcacgaaggcttgtatcctgttagatcaagttttatatttttttaatttttttaataaaattcatttataaaaaaaaaaaaaaagattatggtcctcctcagtaattcgtttacttcgtgctatatcctttcgtaacaaacagcacctgtggtggatgattattattagtcatataattatccatagctgtctcaactcattcattaatgcagccacattcaaattcaactactgccatggtcgaacgatgcttacttgcttaacaaagtcaatggcaacataaatgcagccacattcaaattcaactactgccatggtcgactatatattcagtattcagatctcactcaaccttccttttcttttttaggcggcttaattattaatcctatagccatgactatgagaccatatttctactagccaagaatcatacagagttg

SEQ ID NO: 2256 - DNA, 1708 bp, Glycine max
  Soy_ogl_2893 Gm08:44711893..44713600 Cluster 9
gaatacgtttttgatgttcctattcagagcattggtcaaaaaaataaagcaaataactaattggaccaatgcaatcatcaatgttcccaagcagcttatttattgggtgagcaaaaacgaaaatgtccaccacccacttcccaagcagaaaagaaacgtagactagagatgttgttcaaatttaggataaaattaaagatgaatactatcatatttatttgaattgtttttgtttctaagttttttttttttaaaaaataacaaatccaaaataaactgactgaaatcatattgatttagtctcgtttaccaagttaacaaaaaaacaaaataaatttcaattgcactttctatttttttttcaaattttatatcatattatcctttttttctgtttttagtttcaaattagaatgacactcatttgaccaaaaaaaaaaattacaattgcactttgaattgtcgaattttttgggtttaatcaatattataaaatgagtctagttgaattggttgaaaaaataaattattataaattcttaacaatgtctttgattcttaacaataaaaaaatacacaaaaaaaaaatactattagtacaataatttatacaacagttgttaaagcgatatattttttgtgtctattaacaaaattgtattgtttttaataaattttaactgataaaataaaatgtatttaaaagagtattttataggatgtgcttctagcaattccttatcatataatttatcggattatatgtcttgtgaaatatgggaaaaataaaaagtagcgctgtttcatttgtgagtttacaactgtgtccgttgggcctaaaaccatgcaagcccatgacaaaacatggggttgttcctttcttgggttgccccaaagcaaaaaaaaatatatatatatattatccaaattggtatagtgcctcagtctaaataggtaaaaattgatatacaattattcacccacgtataacaatcagcaaaattacctaccaattttggaccactagcagaaattgaattgaattcaaaacattttctgggtcttgcttattagtgttataataatattgataaaagaatcaataaatagataattttttttgaaggattgcattgaaaatatgggagagtatactagtacactttttaatatttttttttcttaaatagtatctttaggagactatgtactattttcctaattctattggagcaatttgattttattaattgaattagctctcatttttttaaagaaaaaaatatgtttacaccattgatgaattttaataaaaattctaatcataacatactaaagtattcatactaaaatctaaatgtgtgtacttaatattttttctaataacaaaaagattaaaatatgtttttctttttctaaatatcaaagtgtttaaaattcatccttataaaatttgaattttttttccttacgaaatcaaaagatcatacataaattcaaacaaatctaaacctaagattttaatttaaattttaaaatataattttcagaaattaaaagtcgctataaaataaaataaaaatcgtcacaaatatttgaacccctcttccccaacaacctactgcggaagctaatcattttattactcctactctttgaacatgtgctaaatattatcttcaagagagaggtaagactttaagtttcc

SEQ ID NO: 2257 - DNA, 1800 bp, Glycine max
  Soy_ogl_4142 Gm12:38114301..38116100 Cluster 9
tgagacctatggcacaatccacgcatacccacttactgatgctgaaacctatgagctttaaatggaatgacgatacccactcacccagtcagcattcaggttcagataacagaccaatcccctgctatattcattaatgccttttgtgcttatcattttgccctactcgaattccatgacttataaaagcattcatcatacacaccgtcaagatcacatactccatccttgaacagaatagcattctgatgctgccatattgcccacaccaaagctacccaaacagcccaccacaaagttcgagctttggccccctttatacgtcctatatgctgccaaaagtggctctggggatatcccttggcaataccttcacttcccctgtcatgcactacatctattccataatttgtgaacaacactgcaatggttttgtgccaaggtaaatttggagatggaatatgtagttgtttaggtgttaagagtttaagagaatataatatggtgaaatttctaattgctcaagtatgttttggaatgcagtgggattgctagaccctatttaacgttgctagagatttaatatttattgaatttaattgattttaaaagaattgatatgaacaattgaaatcagattaactcgaatcaccttattttataaattataagaaaaaacaaacaagccaaaattaccctgtatatttatatttatttgtattggacaaaaaaagaattaattgaaaataaaattctaattaaatgaatgatattttaaaaaatatatcattaaataagagataattagtttttttaagagaaagagagaattagcaaaaatttatgtatattttagttcatcacatatttacatatagattttttttctttaatgcctatgcacgatcacatcatacaaataaaaaaatttacattggatttagaaataattagactctaacggataacttccaccacatcaaggtgacgctctaccattatatcccttgcctccattgaaaaatagaagtgactaatctaagacaatgggtcaagaaattcaacattactattcttaaataacttattaaagttagactttcttttcacattattacaaataagaaaattatgtacacatctaatcacaaatcactttaaaataattattttaaaaattaacaattttatatttatagtgaattgtgatttgatgattatataaaaaaatttacaatttcagtttataatttttttttacttatagtttggttcggagataataatataattttttctgtttaagaatatatgatgtttaaggtttttgtataagtattaaagaatacaattaatttattgaatttcaaaggaaaaattagataactttctaatatatattttttatctctttaattaatgattcatttattttgtttatgtattatttccactaagtatatattaagagtattcttaatatatatatatattaagagtattcttaatatatatatattaatgtatcattgattttgtaaaatcatatatatttaggaataatttttttctctaaaactttatatattttgaaattgagggattgggaatttaccgtaacaatcagtagacaagctccactaatcccggtgttccatgttttcagctttctaatttcaagcgatgaatattttcccacgtgcctttggaaagtatagggtgctttctttcaatgtaattgtcaagtcttgacgtagattctgaagtaaacttgaccaattaacccatcctttgctgcaa

SEQ ID NO: 2258 - DNA, 1506 bp, Glycine max
  Soy_ogl_5185 Gm15:50122195..50123700 Cluster 9
gaaaacacactagctaacaacctctcaaccgttaatttgataataaaaaaaagtccagtgtttctttcataccaaaaaatgcgcccaggtcaatttttttttcaaaatttgttgggatactcaataagtaaacagtttattttccctattcatatcaaactagccattgtacagtagttgcagttcccatggccgacattatctgcaatttctctttaaggatttgaaaaacttagacccaaatattacgtatatttgtttgttgccattcatactttctaccccaacttgggtcccttttgaagacttggactttggcctttgtcttttaaatcctcaattttgtcccaaaaaataggtgatttttcacatgagaaggggataaaaacatcctatagtgtcttatatttatataacttctgttcttgcattatgagtgtttcaactaaattaaaatatggtaatctcagcgttacataaatatttatataacttctgttcttgcattatgagtgtttcaacctagtcgtattatttcgtaatctatattgcacaaattttcttttctttttttcaagtaaaacatatcatatttaagtgaagggtcgttagaagtatttatgttgagcacattaaaatgtattggtgcagcattttttaaccttattttaatatgtttttgttagcttttattttaagtgaagggctgttgttttctttcggagagacatccttattaatctttcttatttttatattatatttttgtttaattagtttaacttgacatagaatgaaattttagagtcgaataagtagaaaaaacttaagacatacatataataatactagcctattctagtaagagagatactttgtgtatggcatgtgtataaaagaataagccaaatttagtttattctatttaatatttttataaaaaaaataattaatctaatcactaatcaatagattatgtctataaaatttcatatgatttaaaaaatgttttatgttatatcaataagctttattttaatgtatattaatttctaagatataaataaattttgattataaaactacatatatttataaatttttaatttatttaaaattgaaaacttatgattattaacatgacatcacataattcaatgattagatttatgaaatttttattttagaaaaacttattcttctcgcacaaaactcagaagaaaagatagaaactcatatataagtgtgaaaatactcattttttctttctcagaatcttgctccaaaacacaaccatgaatttattaaagtagatttttgtctttaaagatgccccacaaattaatataacatttgggacaatacaaaccgttgagattcagatactcttgacggccttcaattagtcaaagcgtgtgaactgcaaccaaatttaaagattcaagtttgattcacttggaaattggaagggtcgtgtatgaaggcttaattagcaaaatctgcaaa

SEQ ID NO: 2259 - DNA, 1800 bp, Glycine max
  Soy_ogl_5465 Gm17:2651601..2653400 Cluster 9
gcaaaggaccctgtacatcttgctaaatcggtgaattgcttatattaattaatgttttttattctgcaagccaatcttataaagggacagagtttattgttgttcaaaggtccactttaaagaggtctttagtaggtaattgtaaatgtcattactgttgatcctttaaaaatacatagttgatttaagcttttctgaaaaaagaacaggggcaactacagctacaaatcaatcaatcattattcatcactcttgcttttaaaataaaacaatatgaatgtgtaaaagttcatattttcttttgatacctaaacttttagaatgggatgaccgacggtgcctaaattgtctaagataaaaaaaaaaaagcctgcaaacttaaaatatttaggtagtttcatttctctgtttatactgtctcactagcaacttataatttcaatttctattactatcctatcctaaaaaaattcttttgataggaatcctaaaaaaattcttattaaactttaattaagtatatactcttgcaagttataattataattttttaaattaaccttttttttaaatattgaataaagttaaaattaaacattttttactggagttaaaattaaacataactactataaaagtatagataaaaattaaaaacaaaaatgtacaattaaattaacataagtttgaaattaagaaaatacatcatgttaaaaaaatttgctattaaatatatgtattcaaatttagtaaataaaaattaaattaaattcaaaatcactgtcttagctacagtacatgataaacatatatacttccacttccattccattctttcaaccacactattcaaaaagtgattgttttatttgtgtctttttctttgaacgaacttctttccgttgccttctttcgtcatgctcaacatcacctttctatagggttggtaaggaaatgtaaacaagtaaaattagcttaaagcaagtgtgaagtagagaaaataaaaggaaaatattgttaggctattttcaagaagaaaaaaaagcttgagattgaatggtaaacatttatagataagttatataaaaatatatatatactacaatgaaaccagcagcaagatgattgagttttaacatatatatgaaaactcctctttgattttttgtaatcaatatataatatataaaaaggttatggttagctaactaataaaaacatgattatatttttataaaagactacatgtattttccaatcctacaaaagttaaatagaaatagataaaaatgaaattttaatttgaagttgtggtttcgaatgtaaatgtattttccaatgtagataaatatatatatgaaaactcctcttttattttttgttcttagttttaacataatgtcgagtggattattgagtttaaatttttattttatcaggaaaaaaaatactttttacatttgaaaaattcacattttttttaaaggcaaagagcaatgagatttacattcataaactagttaactaggcggtaaattcgaaaccacaacttcaaattaaaatttcatttttatcgatttctatttaacttgagtaggattggaaaatagatgtagccttttataaaaatataatcaagtttttattagttagttaaccataacctttttttttgttatatattgattacattttttaaatggcaaccccatgtatcaattggaaaagttaatctctatgttgagaaaatctataatatgatgggtttgttgttttaatgattttttttataaacaaagt

SEQ ID NO: 2260 - DNA, 2100 bp, Glycine max
  Soy_ogl_6982 Gm20:44291101..44293200 Cluster 9
tatagaaagcataacaacgtggttttcctggcgaggtgatgtagattctgagaatatttgagctggaaaatctcttgttatccaaatcgatagtaaaactaaaaaagagaaggggtctaaattgagttcttttgaacaacgtcttcacaaaatattttcccaaattgttaaggataaacgtgaagaaaaaaacttagagaaaacccaaattgattcaattaacaatcaaaataaaataagatattaaatcaaacacaataaaaataatttttaagtgtgggggataaaagaaagtgtaccaatgatttacagttcggtcgccaaaacaagcaagccgaaggctataacaaattgaaacaataatggggtcacctcaaccaaaatgactcaagagaaacattgtaatccaattgcttttctctcttttcctcctattagattcttagaaaaatgtcaattttatataagctttcaaagataatcccattaattatttgaagcttgattgattatttaaattttaaaaatatattgatttatataaaaatattacttttcatctcaaataaatgtgataattgtgataacaataaatagattcagtttttttatatgtagaaatcaaatataagtataaaaaaatatatattaactcacatattttactcaactagttaaattaaattattttgataaaaatggattgagttagataaaatgtaagggatattataattaagataaatctccaaattcaaatatttgcaatatagaaatctttttattagactaattggtttggatgataatgaaatcacaattttaattcaagatatgtatgtagataaaaagtccttttttctggtattatctcttccaatcctttcaatattagagggacaacaaaaacaaaaaaaaaataataataagaatttcatattaaaaaatttcttcctcaatccctttcattctattcccctccaactaactaactgtgcattaatactagtcgtttttccttactttttcttttttgttccacctgattggtaaacccatttctcatcgcaccttggtttgggaatcccatttgtagggtacctttgtttagataaatcaatttctcgaaaaaactgtttcgagcttctacactcttaagccaacatgattttttaaaagcaataacgtttgggggataaatgcttaggaaaagataatccaacattagtttttgaaagcaatacaaacttaggaacaactattccgggagtcacttaagataaacaccaaattcgaactcatcatgaaagactgttcatagtaacagggatgctcctacagtccttaattaacgggacctataagggggcacatgcagccattggaatggtccatttggtcgtgaccaaaagatgcctttggagcagacttctacgagctcatcttagcaaacgcaagcaatgcaatgggaacaaatagaaataataaaatgctaggctataacagaagcgatagagcaattaaaaataagacaaaacaacaagttacccggaaaaaaaattggaatttggtgaagaaggaaagttcgtctacaaagaaaaggaaaacgaagcaaggacaacagagacttcaggaaaatacaagttagactgtttggttaaaccaatatatacttatatttaatactaaagctcatttactaaaattatcgcatgatatttttctaaaatctttcaatttaattacttctcttgattttcttttatttcacaatatgttgttttgactttcatatgtaattttcaacttgtaacttttgttataattatttttcttattttaaattctaaataaatgaaaaatgtcattttccacttgtgagtatattgacactccttaaccaaccatttggatcatttatattcctcttaaattaaattttattcaaagtcaagcaattgtcttctactattcgctagtcaattcaaacatctggtcaggcattaaaccttaataaatatgaggttttagttagctcaaatacattggagtcgaagaaagcctctcttgctggagggttgggggtgcaaaatatgcttg

SEQ ID NO: 2261 - DNA, 1428 bp, Glycine max
  Soy_ogl_817 Gm03:3973..3208600 Cluster 9
ctattagccttactaaatacttttaattaaatcagctaacttaaaaacttacaaccaatttttaattttaacttttcaaacttagcttataaactaacttataagctttcaatgcttataaactagttttatcaaaaataaaataaacaaatgaaacttatttgtggaatatatttttttatatgaatttatatatggaatatattattagcgaaactatgttactaacgaaatagttataattgtaaatgctcgtctaaattcaatacaatacgctgacaagactatttttctaagaaaatgtttattttaattatgtcccaaataatgatgatgaagtcgtgaacttattaataatttaacaaaaaaatttacgatttcaatattatgtatagtgaaatcataaaattttaaaaacataaaactaaagttaagacaatatttacaatagaattaaatttaaaaataaataatatctaaatataatatattaattaatttgaagatggtttatggttgttttattgaaaaaaagtgtgttattcctttctcattggtctatttgtgtgtttcttcttcttcttcttttttttatcgttgcatgacaattaacaataaatacttaaccattaaccaatcttaataaccgaggcgtatgatatgactttagtggctcataatagatggcctaaatgagaatgcatatagtcctctagagccttgaacatgaaaagcaaataaggctagaatgaaaattcaaggtcagctatcaaaccaagagggtacataatgcaaaatgtattaattaacttcaaagaattgttaataattataaattttaaaatattgtgtattggatgagtttgcagatgacttaaaatccgaccttaaaatataccctaatttttataagacaagcttgtgtcaatggactttattaggacaagttatcaagatggaatgggtcttgaaccccttaaatgtacatgctagctaggggggaaaattcacttgggttaatataaagacaagcttaatcttattagttttttaagagaaattgtgacagtcaactttctatataattaaacaccttatctaatcatgtatgactttcagtacttggtagcactcagttcaacttttcttaaagtctatgacatctcctttttagctataataactcgaaaactctaattcttgacaatttcaaatccacagaaaaagaaaagtcatggactcgtagtcacgtacgactttgtttgtatctctgaaaactttcctgtttttttcttattggcacaaatttagagttttacagtgggctaactattcagatttgggagttgttattggtccattggaattgctcttgacccttaccagtttcctatttttttcttattggcacaaatttagagttttaca

SEQ ID NO: 2262 - DNA, 1600 bp, Glycine max
  Soy_ogl_2890 Gm08:44661601..44663200 Cluster 9
acagaacaaacactagccagtgagatagagaaaaagagaagaaaagatgaggagataagaagattgagattaattggcgtggcaatgctattatataatatcatcagtttctgcatgtctttgtcccataaagataatatgtttgtgcgtgtagacccatgtgaatttgtgactctattaattattctatatatgttttggccaacgttttcttttcagttgtgatgggttagtttatttgatttcttcatgattctgtttgcatgcaatcgcttctggacgaatcatttcctatctccattgaatttttaagtgacattgtgactactaatgtaagccacaggtatgtcacgcatctatatctgtctatttattgttcatgagttaattaatgaagatatagaaattcaaacatggataatccaactaccaagcatctggcggattagttgtgtgaggttattataacttaattattcaaaagttttaagtctaaattttaaatatataattgtattaaatatttagaaaaaaaattaatcacacatataattattttatctgattcaaacaagattatctctacggaaacatatatttgtatggttgaaaataaaatataaaaaaaacatggatcacccttcttttctattttcaaggttacatcgcccttcttaattttgcgcttaaattctagtgatgtgtaaaactttaattcaaactatgtcactttaatttatcttcaaatatatactaaaaaattaatatattcacatgtatacttgtaaggtaatgcgtgtgtattgaagttggatggctcaagtgacaaggagattttttgctaaattcatgaattagttttatgaatagaaaaatatagcaaggtaaataggcgttaggagatttttctcttcataaaagagtttactctagttggcttagattagttaagatctaatgtgactttggaaaactaaatgtttcagattaaaaaaaaaagcaaacagataattaaaaggtaatacatgtaaattatatgtatgtagctagcgatgcatatgttactggaagagaaaatatgatgcatgcttgacatattgatgcttatgaacgaatattagaagtcatttttaatgtacacaagctattttttctccaattcaaagcctactagtgtacttttagtgaaacacggtagcaatgagtttatatttttgtttggtaaagatgacatgaatcatctttgcgggaatcgattatgtttgaactaagttctatttttatattaagtgtttagatatttattatttattaagtgttttatgatgatttgttaaatatatttttttgctgaatggataaatatttcatctgtacaattcttctgtatagcactttttaaaattaagaagataaaaagaagtgtaaaataaaattaatgatgcactgaataaaagtaaagaaaaaagagttataagaatgcgttataaaaaattatgagtattaaaaaaataatatgattcctaattttatgaatatctttagtgcttgggtttatgctagggggcaacgtgtacaagttggctttctctgcttaggt

SEQ ID NO: 2263 - DNA, 1449 bp, Glycine max
  Soy_ogl_4649 Gm14:4382252..4383700 Cluster 9
ctcttttaagtcattcaaaagatttatttttgaaaataaatgtttagattgatgattaagaaagtaaatataaaaaatgaatttcttaacaatatgaattgttttttattttatttttggtatgtaagagtataactcaagtactaaagaatttatagcaactctatatactactcaaccatctaggttaaagtcctttagtataatatgaattatttgattacaaaatcatgttaaaaaatacacatacaatcaattcgaatttatttttgttttttgcaaaaaaatttaatgctaaaagatcaatcaatttgaaatgaaggtaataatattttagttaatacttttaagacaactattagtaggctttgatataaagatatatggtttaagaaattcagtatattttatttaaatatatatttcataagacaactataatgatataaaatccatgtaatatttactttttaagtaattcaaaatatttattttttcaaaacatctaattaaaaaaaacaagtactactattatcttagagtacttaataacatatttataacactggagaaagaagtatactagtaaatttgtttcactaattaagacatatttttaatctatatgtgagaaaaacttttaatttctatcaatatagatagagaggataataaattaaaatgcttataaaaagtcaatataatataacactgtcataaaatattatgctttattttttattacttttaatttcaacaaatgttaatcaatatatttaaaataaaacatcatgttgttctggagatggattgctgggatgttttgcatgtgattcaagggaggaatccagttcctagtttctgccaatctcttgtgagggaaatcaaagcttttttttgaagaagaatgattggatgatatctctccatcatgtttatagagaagcttcttttctttctctcttagcttttgatgctagtgaggtttcttttgcgcattctgtagcgttgtagtttcttttttcgtttcacttgctatcagaaaaataaattaaaagtattggttaaaaaatcaaaaatataaaacattgacaattatcattaatatacttccatataaaattttaagatattttatgttaattttttaataaaaaaatacttatttatttctttgtcgacattgtgaataacttattggttaataaaatccttaattatttaaatcctaatatattttttttttaaatgataaaatcctaatatttaaacatataagaattaaaaaaatctttaatttcgtaaatcctaatttatcatgtcccccatatacaacatatagaaaatcccaacagggcaactggtggaaggcaatagtcgctgaattgtggaccccaccacctggccatctatgaaagttaatgaaacaattatttaccagtcattcac

SEQ ID NO: 2264 - DNA, 1800 bp, Glycine max
  Soy_ogl_6341 Gm19:2411801..2413600 Cluster 9
aagttaatgaaatataaatgaaaaataataattgagccagggatcatgaccttaggaatgacttcatgaaatttgaatacagaaaatccaaattcatcatagtaaattattaaacaaataattaagcactgatattatgttgatataagtgaaactgattttagattttataagtaaattcttatgtctgacctttgcaaataaaaaagaaattagttgaaaggaaagaccgattagaaataatcaatattttttttgacaaaactgattaataattcgtatctataaatggtaaaaaaaaattaataattaaggaaatttggtgagtatgataattggagatagtgtaaaaaaatttcttccttataaatatacctgcactcaatatcatgtttgtcctttttttcttctatttttttccaacaggtgccatgcgtgcatggatgtggctgtatacggtatgccacaaaaacagtgcatgcagatcaatgatttagtgatctactttaaacgactactactcttgagtgtaaagatggtaccattatcttaaatcatgtccaaagaaaaacatgaacttacaaaaagagtcacatgatgatttggagggattacatagtgctgccaagctgtaaaagtcgattgataatgataatcattgagataattggctgggttcttgcaaattttgttctcaataagatgtttggggacagcttattattcatatcttcagttgacttgtgaaggttttttcaataacattatgagtaaatttctcattaaagttttaacaacttcactaattatattaaggaactgtttaattattatataatgtacacattttcatatacaatatattaatttagtcatattgtaattacgtttaatgatttaaaatgaatactatcaaaaataattttattgaaaatgagcactaagtttgtgtgctttattttagggcatgaatattatttggataaaatatgtctagtccttcgatatatctaaaaaaaattgagtcaaaattttaatatatctttttatatttaccaaacgttacgtggttttaatctctcattagagattaaaatacgtattcttattaagatgcaaggatcaaaattatagtattggatttttatagagattaaaatcattttttgaaatattttaaaagactaaaaatatattttataaatattatttttaatgaatctgttatgcttcttaattcaaaagcttgattttgcacgagccaataggaaatgggccgaaaattcagtgagaactagaggcttaaacggttaaacccgtgaggggttgcaacttgaacttgtcgtgctttaattttaaggctaatcgtagtgatagtgatggcaggatgttactaaattcaattaggaggctctgttcacaaatttgtattcccaaccacaaatataattcaaaacacttgttttgttcataggtttctatatatgggagtggttttatagatttctttatgtaattttgctatctttgggtgctttaggccggtagaagtagaatacaagttttgagaatcaatgttcaatatataattgtattaactactcaaaagagtagtgttcatcagaataattttatctaacttaaatacgattatacgattatcttatataaagaatatttttgggttgtaaaagaaattctaattaatttagtgttatgttaagttttattcatcataattttagatttatgtaaaaatataagattgatttgatggttaaaaaaaaaaagaggaagaat

SEQ ID NO: 2265 - DNA, 1556 bp, Glycine max
  Soy_ogl_6516 Gm19:410501..42483056 Cluster 9
tacattttaagataatttttggaacctcattttattattgtaaaatgtaattttttactagtgagagagtctgaactagacctcaccacccatgcaggagtactggagctgaagaatgatttatgctggcgtctgaactagacctcaccacccatgcagcttcttcttgacacggaagatacctatttttattatatatctgtccgcgtttgagaactttgaatgtgaaggtgaggatttgagacggactctccttaattacttcttaattctattatacgtaagaaccaataattgattaaaaagagagagtattacattacaataaagctaatttgatgcagtcatactccacatgtccttctaaaatattacaattttaatggtgacatagtattttttttagtcattatgttattgctcggactaactacaagttagttatagtaacataatataataataccggttaaaactcatgatgatgggtttggctgttttggaggctccaattaaactgattaagttgcagagtaattaaaaaagaaaatttaaggatataaattaagcttaacgtaccaaaacttgaatggaataattaacataggggttgtttcatttatttcttattttttagtttttaaactgttttctaaaacaattgtaggttagtcaacgtctcaaccaaaaatttattaagttttaaaatttatttttaaaacaagcatttttttatggaaaaacaaattaacatatattttaaaaaccaaactgttggaatgttctctcatcagcctcttcttctatatattctataatcctaactcaaatatgagtcatccataatattccatgtattaaggcataagtatgttatttttacaaaaaaattattcaagattttaaaaattaaaatgaaacacacaagtattgttttcacacattatcaacacaaagaagatatatgacgttaagactgacatctttaatcaactaacatttctcaattaaaaaaaaaacaatgctaagacgttaattattattagaattaaaaccggacttctaattccttggtgacgcatcttcaaatataatatatatattttttaatacctggtttgatccatttacgaggttttactttaacaatgttttcagtatctgttattttctaacagttgaggaaaaggattgtacatcagtcccatcgtggttgttgagaggaatattcctcctgcactttgttaaatattcgaatgaaagattcccatgctaggtcgatatccatagtcgttttaatttatatttcgtttagatagttagatgcacatttaaatatatcaaacattcaaactatattaatatctcctcctttcccccaagcatgcacacgcatttctccacaaaaaattaatgtttgttaatgaatagacacttaattttaatttttaaagcaatatatttagcaatataattgctttttaagcatttttttttattataaaaaatactaatatttttatgtaatattttttattttaatgtattaaataatc

SEQ ID NO: 2266 - DNA, 1518 bp, Glycine max
  Soy_ogl_6822 Gm20:37927983..37929500 Cluster 9
gtgagtttgctaatatatatacatttatttttcaatagttggattgcattagtaatatacatcaaaatatttagggaaaaaaccattatttttctattttagttaatttattttagggtattagagtaatttaagatatttaattaaagaaaaacaaaaaaggcaattctctctcctctgtgactctcgtattaactgctagcgtgtttgagagcgacaagggggacaaataaaatgagaatttgagtggattggaactgatgtgctgcaaccaatgtaacactctgaaccatgaactgaaaaataaaaatgcttactcttcagtggctaggatctgggatcttctcttctatttctaccacttacctttttcaacaacatatttgatttctttgacagtaatttctctcaacccaatcccaccacctcataaaaaaaaatgagaatttaagttttgttagttggagaagattgagaaatttattatgcttttctaatgtagcacagcgcaacaattgaaatccttacaattccaccaaattgtatattttgttaacaattgattttattcactgtataagatattatcttgagcaaaaattttgcaatgtgcatactgttgcagccggtgagatcttgacagtggtgggtgggagaagatgaagaaaaaagagaagggaagggatatgcttccaaaaacgtgagagaggagagagaaattgattttttattatctaaaaaaatttaaaaggtgaattataataatatccataacttaaaagaaaagaaatcaaagagatgacagtattatattaatatttttctgatctttattttggagggttgaaaataaaagccgggatagagttattcagatgaaaaagtatattttcatacataaaattatgagtttactaattatattagtaataccataataatttatgagtttaatgtctattcattgttttatatagtcattcaatcataaatcatcatttaaattattttaaaatttaacaagcttccatatataataaataataattaaatcaccgtgtaaaattcattatataattcttttctcataatttatttaccttttgttagttaaggttttgggaagggggccggatactatagtactatatatatctccttgcttatttttcaagctcaatgcttgttaactatgttatggctttcaaattattagcaattttaatgtaaaagtattaagtatgtattctttataagaatgatctgtttgattgtttttgtagcgggggcagtggaataagaggagtagatagaattatgctgaattgaagctgatcaagtgctgctgcactttagttggcttgaatttatttgatcagatttgcgctcgagtattgaacttgaaaaactaaccttcagtctgagctatgattcagataattctcttataggccaaccttttatacattatccatttttctcacatttaattcacatgctaactgtaacttaaattga

SEQ ID NO: 2267 - DNA, 1500 bp, Glycine max
  Soy_ogl_11 Gm01:795101..796600 Cluster 9
gcgttcataagaagaatgagagttaactacttaactccaaatgcttaatcacttcttccaactcacacattatcccattatttaaatctctaacaggcgtgcattcagcctagttaggcatgtaaccattctcaacaaacaacacgtttcacgtggacttttaaacctaaaaaataacactaaaccaaaataaatttacctgtgtcatgtggtggaccaatctatatagctacgtgaccaagtaaaagttcacttttacttgaaaattctagactttgtagggatttttttctctccaaatagtactctacaaattaagcaaaaagtttgcataacctttgataagctattgcgcacctaacctagcctaacaaaacaaagtctttacatatctggctacatttaaggcgaaaataccggatcattgatagttgatagagtttggttgggtggaaagaggaggaaagaataaagaagaagatatatttaaattcaagtagaataatagaggtttgagatttaaaattaattttttaattttttttttctttccacactattttttatctatcaaactcatcctataggaggaggaggagaactaatgagttaagagtatgtttcgcctgcggaaagaaatacagaaaagcgaaataggataaaagaaaatagttgaaaataaaataaggttagaattgttttatttgaaagaaatggaagtgataactctataaaaagatttagaacaggcacattataaatatagatttatagtatttatattaaaatttcattttccttacatgaaatttttgcaaacaaaattaaatctaactatttactgttattatttaatagttttttggtacaaatgttcagcatcttaacaatttttaatttgtcaggtcatctcgtcatcgcagactatcactgcattgtttatttgtagagtaatatgtttctgaaattcggttacccttcgctttgctgtaatcagtatagtttttttatttttttatttttaaaaccagaagtatataagacttcattttatgtccaaaccaaaaatcaaattccagaaatcttaattaaggaatccaagtgacaaacaatttgtgctaacaatttttaactgtaagtagctatagatgataacaataatgataggaatcatgcattcacaaattttttgtcaattaaacatgataacaatcatttcatatacttaaaaataataatttttgaagttttcaataatatcttcatacttacatttgataaaaaaaaagtaaatttttatattttaaagataatataaatgcatttacttttttatttaatatatatttataaagtagatatggagacattaataaaaatattataatataacatataatcttctggtataaatgtttataaataaaaaataaagtaaaaataaaatgatatttttacaattattatttatacttaaaaaataaaaatattttttcaact

SEQ ID NO: 2268 - DNA, 1600 bp, Glycine max
  Soy_ogl_652 Gm02:44739801..44741400 Cluster 9
tgcattttgagtgtgtgatcgcggcgggtggccccttcttaaaagttaaaacacgagattcttaactcttaagtgaaagttttttgttttttttaaagagaactcttaagtgaaagtaaattaaaacccgcacccaccactcactttctgcaaaattatagttttataattaatgatgagattgccataactaccaaacaacggcacgactgctgccactaacaaagagtcacactacatgacaattctaaaagcaacttttgagggaaaataaaaaataaaaaaccctcttagttggaatcatggccaaattgcttgttattaatggggtttatgaaatgtgaaaaacatcatttgaattttaaaaggtcaagggtatccataattgattagaaaaatagtctcacatttatttatttttaattaatagcagtaaaaacaagacaaatatgaattgccttgtttcatcaaatttggagacaaacacagaagaaaaaaaagtggcaccagataaacatttttcttactaagccgaaattaatagaagcaaagcatgtatctggttagtttgtggagatcatagaacctaagctaactaaataaatataaataaatatcaatataagattagatataagtttaataggtatgtaccattattatagaagttctggcaatgttagccgatgataaatcatctttaatatgattttgaagattttttttttattataaaaatcaacaaattatcatatatataaaataaatttacattatataaaaatggttacaagaagaaaaaaaacgtattatttttctattaaacatttcattattattaatgagaaagtttaatttcattttattattatatataatggtagtttctcttttatttcttaccttatgattttactttgtatcattttaaaaaaaatcaaaatttaaaagttaatgaaataatgtgatactttacaattagaaacacacacgcacacagttaaatagaaacaaaaaacaatccacaacgcattatttttcttttaaaattttttacaggtacacacaacaaataaaagaagaaaaaaaatagagtgtcgtccctgaaagttaatgaccatcaactcctgaacgaatacactcactggatactgaggatagtgtggcttttctttcttactaggaatctagggtaagaatcatgcatatgcttcaggtttggttgagctaatagttagactcggtcttaatcataaattgactcaaaataaaactgatgttgaccatgtctaaaatttagacaatgtataaatatataggcaataaatgtatgtgacaaaataagattttgaaagaaccaataaaatattaatttaaactagatagctgtatacatatactttttgtaaaaatatatgataaatctaagatatttaaaacattaaattgagttaatccaaaatatttacaagtcaattctgatataaaaaaaatacatcaaacctaattttcaaattcaatttggatccaattaacttcatgccatactgagctatcacacaatttaagtatttaatcactcctattttgcaccttttat

SEQ ID NO: 2269 - DNA, 1657 bp, Glycine max
  Soy_ogl_1021 Gm03:41638527..41640183 Cluster 9
ggataatcatcaaataacagtttttgatacgatctaaaaatgacagataaactatttttttatttggtttactattaaaaatagtttgatttttaacttctaattcagtttaattcatgattcagtaataacttttgaacggccctgtgaatcactaaagtaatcgtaacatctaaaattctttttttatttgaacggaacatctaaaattcttaatccgtgcaacaagcattattcttttcacctactgttaataattgggtaaaagttggcctctattatcttcaataagttacgttgactttcaaggtctgagtccagcacataatggaggcttttttttgggttacagcacataatgaagtttgccatccattataaaatttgactgtgttaaaaaagaattaaaataaatattaacatggaaagatcaaattaaaaaatattttaaaatcttatatattggatgctttatttttaagaaattttgttaaagataataaatattaatttcttaacatatatatatgtcttttttgaggagaacatatatatgcatgtcttaaagatacatgcactttactaaaattcataaaaatataagaataaaaaagtcaagtctacaaatggctaagcattagaaaatgcacactcaactgagtgcaccaattatatgcaaaacccatgtttgtaatttccatctctcaaaagaattactcttttaattactattagtcggtggataaaaataaaccacttttgatataaaataaaataaaaacataataaagtggatgtttatatgcttcatccaaaattcagcaaaaaaaatatgcttcatcccaagaaaagggaagttcatatgataaacttaatatgtagaatatctaaaaaaaatatacttaatatgtagaaaatgaaaaacaatttacttttattcttctttttaatcagtattaatgcttagttatcattttattcaattattttttacttaaacataaggattgtgaatatatctttagtcgtctttatacccacttgtaaaattggatgcttcccaatagttgttacctataagttagtgcaacaatttaaaatcatataatttactccagtatatttgaaaaagacatgttccatatcttaattagattctttactactgctagggatcattttcggacctagatcaactagaatttgccattttaaagttaaattaataatataagaactgtgttatgtgcagaaaattaatattcataaactacaaataaagatgttacgtcctaaactatagaaaatatagcatatacagggaaatgtatttaagagtatattttaggtgtaataattaacataaaatttgttccaatttaattagtagtcacgggttcaaaccatggataaacaatcgtgataaaagcttgaagaaaaaaagttatctcccttaaattatacatgtaatttttatttaaaaaaactgtatatctattttctaattaaggatctaaaatgtaaaattctagagtaaactcttttagagttgtttttcatctttattatttatttccttagaatctaatgaatgatttattacaagcattgattttaataaaatgaatggtgaggtttggtgtaagttgatcactcc

SEQ ID NO: 2270 - DNA, 1900 bp, Glycine max
  Soy_ogl_4463 Gm13:35827101..35829000 Cluster 9
ttaaaatggatattgattccttcaaatattgggagacctaatgaaccgtgaaagacgcacgtgctaatgaaaagggtcccttaactgcgttgaagatgcgtggggtgcaaagcaatgaaggatgaagatggaatgatgattgttattatctattgataaattgttgtggggagaatgcactatggagggtcccaatccaatccaagagtctcttttacgttgatcccacctttctttgtctaccccatggctaccatactaccattgtttcatttctagttaaccaaaatttctctaataacaaacattctagtgcatggtgttaaattgagtttggtctaataagcttgctccaacaacctataaataagagaagaatggactataattttgaattttttagacttaaaaagaatgattaaattgattctattaagatcgtgtttgtggtaccgttccaaaatccttcaaatatagtttgtccacaccaaggcctttgtatcttttgtgtctcgtaatttgtgcgaacaagatttggatagcaaaataaacatataccaattaggtcgggttagacctataaaatgtaagtatgaaagcaattgaaccaattcgctataatattatatatcataaaaattgtatacatttaaatttgaaaaactggtcattaggctaggctaagacaacaaatcttcaactcataaaaatttgatctagtttggctcactttcacaccttggtcagatagagtcgtagctcaatttgtctcctcttttagtgcatctttaaaaataaatagataattttatattataaaaaatgtgaaccaccatagtctgattttgttataaaaaaatattgtaatagtctgattttgtaaaaaaaaaaaaaacggttatagtttatttggttcaagttggtatttcaggttttttaatggaaattaattaacaataaagtcaatggatattttacattaattttatggtgatagaaaaaataagtatttaattaatgaatttctagtaatgtcattcaatatatttttttaacattgtataattaattagttgggcaaaaaaaatgttgtataattagagaagaaaattaaattacttaaaatttataaaataaaaatactaaattatcacggtgggactcatgagatgagaaatttaacttaaagaactcatcatggttgttaattgcatcattataaagttactctaaataaaaattctgtgaatttttggaaggatttttaaagatctaagagctactccttctgggatcatttcactttataagttaagcagcagtttcttattaaagcctcgtagtagtgcaaatgaattaatcgcgtgggtggtaatcctagttgattgtgcaagaggagaagaaaaatattgagtgaaagagaagagacagttttgaaagagggtcaaaggaagggtgacaaaaataaaaatagaaatcagagataattaaagacatgaggtaatttatgaatcttaatttttttatgcatgagaataaaaatagactcaacacattatattcaacttagactctctgattatgaattcatatttagaaaaacttttagaattgttctgtttgaaagaaaaattattaaaaatgtaacaagtaaatgaaaaaaaaatgtcattgtgatttgtgaggctcatacaataattatttagtaaaaataaattaaatatagcgtattgatattataaaagctcacttttacggtgttatttaatcatgaactttaattttatatttggtaagtttgatttttaaaaattatatattaaatgatttataattgattgataaaaaagtacactaagaatacactaaaattgaactaattttcttaagaaaaaattgg

SEQ ID NO: 2271 - DNA, 1519 bp, Glycine max
  Soy_ogl_416 Gm02:6470182..6471700 Cluster 9
gattttatttatattacattatttttaatttttttaataaagtgtaatattagaatttgttcaagtggttcatatgtatagtagaattacacttatgaaatttgagtgactaaaatcatacaattataaaacatgaataaactataattacacatgaaaaaactatagtagaactcaattgaccacataatcttttccttaaatcaattgcctaagtgagaattgacttgttgatacacactgcatagtcgtcacaatggctaggcaatcccaatattcacactaacaactcctaaattcacaaaattttcaaatagtttaaaaacttcacaacataaattttagaattctaaacctaatataacctacatataaacggttaatcaaataataaaatactcaatatttatatataattgcatgtcttctaaaatcattcttaaattcattattgagagctgattaagaacacatttatcagacactcttttgaatatattttcttttattaattaaaatttagtaaaaagataaaaaaaaattgaatcacacatcatatttaattattctcttatgattttataattttcaataaattttaactaattaaaaaaaacatttgaaagagtctgatcctaacacttctcttcattattttacttgatctcatgtacacaaatacatgcaagttttctattgataatacagtgagaatgttatagggttgaattgaaatcctactcatgcaacctaatatccatggatcatgtatattagatccattagactttcttttgcaaaaagaaccattagcgtactctacagaaaatacacttgttaattgggtccaaacgcaatatatatacaggtttgctatgtttttaaaaaattatatcgttttatgctctcattgaaaatttgtcaaactactcgtttaaggaaaccacccatcaataaaataaagattaacccaaaaaattataataggtattgtggtatttttgttatgataccataaatattctctaatagacaattatatatatctgaatcaagtaagactattattggtagtaaaaaaatttctcaaagtatttcaacataatcaatgaattacatggtcaaaacttaaattcgaaatcattagttaatataaaataaccatggaccaaactttgctatcctactcctatactataaattaaaaaaaaatgctatttggtacgaaaccaatatcacgaatcacttgaattttaaatcacagcaataattttctttgaaataaatcttaagtaaaatttaaataaactatttaaatagatttcaactgaaacgaacgcattcgtgatatgttatgaaacagtttaggattatcataattaaaatcctcaagttggacaatatgactcttgctcacttcactctctcgattactctcttttttctttggaatgttcatttcacacattatatatctttgcaactagccaaaagacatgtttttcacccatttcatcaa

SEQ ID NO: 2272 - DNA, 1273 bp, Glycine max
  Soy_ogl_4435 Gm13:33680801..33682073 Cluster 9
atgcaatgcaacctaacagataattgatacacagaatgagaggatcattccagtcattaggttgttaattcgttatcagaaagcgagagatttgtatttgatagtgattaatgttggccgttgggtaggtgaggtgaaagcaaattttgaccgtgaattaaaaaaaaagagagtacatttatgataaagattaagtacaattataataaattttgaaatatatatatatactttatcttttaaagtatatttcccttatcttagaagagacttaaaagtagaatcgtatttatagctagacaataattgtctttttaagttcacgagtttttctggccctactttttcttataaattcttttatttagtaattagtcgatgtattatttaaagagtgaattatatacacaagaggtttagacttcctctaaaattttttttatttaaagcaaatcttaagatgagacctttttaaaattaataatattttttgacaaaaaaaataaaacattttattaacattttttctttcaagcttatatataagggtacaaaattattcgttcaattattataattgatttgtttaacattttcttttcaatttcattcaatctttgttgaaatatttgttatcttaaataatattatcgaaattattaacattattctataaaaatccattcaatctttatgacatttaattaattttatttaagagaatcaatccttcttatataattaagtatgctaattggtgtattttgtataatttttcttataattccaattaaaaataatataaaatacttaaaaaaatatcatccaaattcaaataatgaaataaaagcaatcattatctataactattataaaagaagtattttcatttggtgtcgtatctcttctgaatatttttattctcaattattataaattactataatattttattttaacttttaaggacagttatatttttttaaaataagttatacccaattacatatataattaattttcaaatctaggcatcgagtgctttttttttttactagtttagataaaaatgcaaccaatagtagatatgagacgttttcacgagttcaatattttttttcgtataaggtcatgagctcaataactgaagaacatatccactttgatactaaatttggtcggcttcgatcgtagcttgtcttgtgcaattgaacctgcgtaaggaaagaatcagcaaaattaagaatgcatgtgaatgattccaccgttgtat

SEQ ID NO: 2273 - DNA, 1070 bp, Glycine max
  Soy_ogl_6206 Gm18:56766031..56767100 Cluster 9
acttaaagattaacaaagtatataggaataaaaataaaatatgggtgagtttatttaaatttattttttaaaaaaagtattatttataattaaataatttttttctatttttatgttttataatctaaaataggtattttgggtcaatttgaccaatactaaatacatacttgatatgcacgtgttaaaaattactcattttaataaatattttgttgaccaatctatcatgataattagttttaatttttaatctatttttataaaaaaaaaaaccttaaaatacctcatagttcttccaatgacaacaatgtcaaacaccttatcatcatccattggtaacatcatctttctctctctctctcttgaatgatgtaatactgtgtaatatattacggtgaaaagaaaatcaacgattgtcctttgctgcttgctttcttgtctgttttataattaaagaatatcaagaataataaagtatgattcaatattataattgaacacttttgatcaacaaaataatattaataatttattataagcgaaagcatcttccaagtttatatgtaggtataaatcatttatatatttttgactaatttgactactttgtgaataaataaaatattgattttgattttgatgtgtttttcatattcaaatatattaatacgaccatgatgaaagtttggagtcaaatcaacgctcaatcttgaagaacacaatatggttatgatgaaattcattggcacacaaaatcttaactccatagacaaaattgcaattcatcaaaaccatagattttcagttttagcatattttgagtccttttttcttaaaatacttcaactgtctatcacaaactaattgaaatatgagttacgtcagtaaaatataccgtgaatgtatgaaactagcctagaataacatatagaaagatgaccaaatcctggtttatacattttactagatttcttcacaaaacatttttttttggaaaagctaataggaaacttttattaacaaaatgagtcaagcacaacaaatgtcttatattagtacacatcttc

SEQ ID NO: 2274 - DNA, 1986 bp, Glycine max
  Soy_ogl_946 Gm03:38104657..38106642 Cluster 9
gtctatactagttaagctaatgcaagacacgactgcaggcattaagggcggcggtgtaaggatttatcttcttacgtatattattaaataagtatttttttttacattattgaatatgttttacattaacttatattaaaaatgtaatgaatttaaagaataatgttaatagttcagaaatataaaacatggtttactagatcgtccagctgggtacgtaggccgattgatcatagtaagcatccccagctttttaggctcaactcttgaagggtagaccatttggctaggtaggccaaccaaaattagtgaatcaaatgagatagttgagtctctaatattaggtttgatgacattctcctatagaagatgattaggtttcacatgtgaacacttatatttataattttataattctaattgagtaaattatttttttattaagcaagttattctttcgtaaaaaatcaatgactaaatttaaaggagtacgatttatttgtgagtttaatctctctcaatagatattgtttcatacgctggagtcaatgattaaacccatgactataaacatgttaataattaagtaaacaatttattcaaataatttaaaatactttaggaacaaagttatatatcaattgcatcacacatgttaataattaagtaaacaatttattaataaataatatttatgtaatataaaaataagatcaagatgtattcatgtgagagagaaaaaatatataatagatatatccatttaagatgtgtaaaaagtagaaaagaaaataaaaaaaaataaatttatttcttttcactttctctactatcaaacaattaatattattaatctcattttttatacttttactttcgcttttctttctacaccaaacacatattagagagagacgagagagaaataaaaacataatgaatactctgatatgaaaaaaagaaaaaatacagaaaaataaaaaaatatgaaattaaatagacatttgtaatatgaatatgttgatatataattgttcacgaaataaagggagataattttgaagggtaatagattttgggacaccactgaagaaaacttatttgtttttcctctctttctatgtctatttctattcaactgttgacacccatggattgtataaaaaaaaaattcaattttgagtctatcatgtattaacgcatagtttttcgtttatttatatatttccattcatttcttaataaatcaaacacaggctagaacttttttcattgaataataaagcaataaccctttgttttattgtattttttttctttctttttgcttgtgtttgatgaaaccgaacgaattgaagccaaacagggcacacaggattaacaaaatggtaaagtacgtgatttaagcgaatatggatgcttagccaagctgaaaagtgggacaaaaggaaactttatattaaccccctttcaaccacaatcaaagactcatcaaatttgtcttccgtagttttcattaagcccaagctagctaggtattaagattccatattatacgagatttgttttcaaaagtttcaccgatcaaaattccattgactagaaattgaatatagggtcacagcaaatattatggcaattgctatactctcaagtcaactcagtttgactaagtctttaagagatgaatagtatggatgcgattgatttgcttaaatatatgatattaaataatataaatatttttttttaaagtttgatttgatgaagaaaaaaaatcataaaataacacaaattaatctaatgagtacatcataaaaacttaatttcttgttattcaaaaaattatgtgacaattttttgtcttggtataaagtatttaaaagacatatatttctacttcattttagtttctcaagcattatttgttagttgtaataatcatattatgtcatgtattttaaatttacattatttactagcaac

SEQ ID NO: 2275 - DNA, 1431 bp, Glycine max
  Soy_ogl_2272 Gm07:8047701..8049131 Cluster 9
ttacaagtttgattggccttctattgtttgaggtggagtatttcttatacccttcctcttctattttattaatatatatttgtattctgataaaaaaaaaaaaaagagtgggttagctttaaaatattgaaagttccaacttttgcattttgtttttaatgagttatgcaccttgtaacttggaatttttaaattcttgacgaccttgtcaagaatgcctatgaggaacacgttgaaggatatgataaatcttaacagtagaaacaaaagtctaataccaaatcatgtcctgttcaatggtttcattagtatttttttattaattattagtttacattaacatgttattacatattttattctttattacttcagccgtgatagagtaagttatttttttattagtaaatattaactattagaagattcgaatctacattttttttcttttcttttttttctcacatcaaatcaattttatatctcttaaaattatgatattaaataccatataaatatcactttataattataattataatattattttaatacagtttgttcaaaaataactataaattcagtgaatttaactgttttgaaatatctaaacaattaattaaaattataattttgactaatttatgaaggttgtttaaactttttcatcaaataatcacttttatataaaacaaattgatttcattttttattttaataattcatttatgataaagtgttttaaataacttctgattacaatcgaaagttttcggcatctaattattttgaaaagttgtaacaaatgattaggaattaatccattttggtaaaaaaaaaactaatccacatgtgggttagtgggtggctgcaattttgctgcatttcttcacttttttgtggctgaactgaaatttttgacgggtttcatctaatcttttttaatatttctctgcactttgggacagtcaaataatcattattctctcattttcactattttctttcctcttctccttatttttttttttctataccaaacaaactgttaatcaagatacggagtttatttatctgcttgagaatgaattcaagattgaagttatcactatattctaaattaagctggtttgataaaaaggaaatgagttggaaatcaaataaaaattgaaatctctttttagtaaaagagaaagaaaaaaaaaactgtatacaaacacaaatttttaacgtctttgtctgatttcacattggacaaacgtaactatttgattgaccacaatttagctttttgtttgtggaatcaaacaatgatgacgttgattgcgaaaactcattccagtttcccctacttacgtcacggataagtttctttttgagaaaaggtaagcgtggaactcgggggtaaatgaataaaaaaaagaagatgtg

SEQ ID NO: 2276 - DNA, 2000 bp, Glycine max
  Soy_ogl_5638 Gm17:11859601..11861600 Cluster 9
gttcccttttttcttacaaataattttaactgtgatattttaatatgttactccacactaatcgtttttattcttatcattttggttaagcttcttttttttcttcttctgagttccattttggttaagctaagtgcatgcacatgttaataattaatgttattatactccttaatccttaatttataattatttcataactttattttaattatataattatttttatttaaaaaagatattttttattatctcttaataaatttttgctattatttttgttaaactcgtatcatttatttttctctttaaatccaagatagaaataaaatggttatgctgctgtaaagtataataatgtaatatttaataaaataatataatattggtctatacagcacttttctttatacaattatataacactttttttttttttttacagaagtttatattacataacacttaaaacatagaacttatctgattttaaaataaaaaatagaatttgttacccataatctttttttctgactacttaatctacttgtattatttatacacatttattgtacactaaaaatgtccaccttagttggttaaataagatgtctaaaaatatctttcatagttggttaaataggatataaatattgtaaacttctagtatgttatttaattcatatggataaaaaaatagttatagtactttcatatatttttttataaaatcttattccaaatgaaaacaatatattgcacacggcacacaataccctaaatttaattccaccaaacttgtttttagttctataattactgatgaaactttacatgaataaataacacatcacatggcaaaataataggatccttcattaaacatttggtgggcaaccaatgaggttatacgatagtgagaaatattatagataattttattcttttaaattcttcgttggtcttttttacttagagtgtttgtaaattttgactattgataggattaactaaaataactattttaaaaaataaaataaactaaaatattgtttgttcttttttacgtagagacaattttttttttttttttacagtaacgtagagacatttgaaaaatattgtttggtcatctttaaaaatcaactaaaataattattttatttacattatagatatgatcgacccagtttaaatttgacttttaatgatagctattttgactttcataggaaacctatttcttattcttaaaaaatatataattaaatgtttatttacttatttatgtactttatgttttaaaatgattaattataactctaaacttattgttacaattatttttaatttaaatatttttttaattaaaacaataattgcaactgtgttagaattttaaatttaaatattttctaaaatttgaagaaattataaaaaaaatgtcatttaataccaataaaatgttaacctaagaaaattccaataaaatattaaatatttttaaaaaatattttttatttttataataatttatcataagttaaatatttaaataagactaaaatatatttttggttcatgtaaaattatcaaaacgtaaatttttattttttttcattcttacaagattgaaatatattattttttaatctgaaattagatttggatgattctcatacttaaagtgtcaatttttcattggttcaattgttgttacgatttttcatgggattaaaaccacccacaaattaaaaagaatccttgcaatttttgaaacttcacccaccgccccatttcctatcttcaacaaatgtcccccctcactcaatgccacttgaaactactccctcttttttgtttcctttttctcccaaaaaagtgaaaaaccaaaagcccatctcccacatttctctgtgaaaccaacccaacaggttagaactcagaccccattctcattcattccaactccgaccgaacgtccaaatcctttcccacat

SEQ ID NO: 2277 - DNA, 1900 bp, Glycine max
  Soy_ogl_956 Gm03:38996701..38998600 Cluster 9
atattattagtattatttgaatgcatgcaattgtacaaatcaccaaatcatcacctctgctatgacctaacaatggattccattaattgttgagtattatctgaatgcaagagatctgtccaaatgtgtatggatgcaggtgaggtgatgggaaaacaccacaagaagttaatttcaggtaaaacagtgctatttgatacgaaaaatatttcccgaaaaccacacaaattataacgtgtgaaattgagaaactaattaaaacaagtaccatatgataaagggaaaccgtctattgataccatattcacaaattattttcataattaacatttaatattcgttttacataaatggagggttttattagaaggattcattaaacatgtgcagctttttattatagacccaaagatggggaacatattttagatatatgtattgtctaccatagtcatttcatccaaaagttagaacgtttgaaagtattcttcacgcgcacgggtacatttttaatactaacatacatgatcttgagcatatttaacgtcaattgaagtgcccaaaagcagcagcatttggcagcaaacttttcatattcaaagcattattaaaatcagataggatgctgtcttttcattgaaaaaaaatcataagctgtactaagaataatactttcgatgattaatttttaaaaattttgttgtttactatttctaattcaatttagtggtagtacgtattataagatatttaaatttaatgttgtgctcggggtattttgagtctattagatgcaatgatggatctaggaatgtataagggggaataatttaaatatttaatttttgataaataatgagttttataaaagaaatttattgattttgtgtaaaactaaaaatatgattgactactacgaagaaattaagcaaatattaattttacttattaatttttctcaataatttttaattttttatacatatacacaagtagtcttgagggagggggtcaaggcctatgaatttataacccacaacaattacttaactaactttcatgtctacatatatttatcctaatcttattttttatgaacatatcctaatcttattatacacctcttacactatctgactctggcatctaggtatttgtacagatgtatatatgaaagtttttttgctcatcgaaaatcattcctattgctcctccgaaacattgttcctgcccgcttcattcattttgttcaaatcctttaaaacaaatgtattttttctgtttttatttataaaactcaaatttaaaatgatatttgtttttttataaaactcaatctatagtatcttttattaaatatttttagattaaaaatatcattcatcaaaataaaaaaaatatattgataaataattagaagagagaaaaatattaatacaatgatagatttttaaaaaatatataaatttaagataaatttaatatcatcaaagtaaattaattaattatttaaattttaataatttaagtaattgagtctatacagtaatgagggaagggagaaatagtttaggaatacataaacgtttatatctcctcacattacctacaaaagcaaactagctttggtaaaacctacccaacttacatatatatgaatatagtaatattcacaacctagatatttattgagcttcttcttcacttggaattataattttaagtatagtaaaacaatgggacccttacactctcacccgattggatttcacacctaacgcaggcccatgtttattcatagccgacaacaggggagtaattgtgttatcctaagtgcaagtttgacaatatccacacacaggcttgggtcgttttggttcttccatagtgttatttagcg

SEQ ID NO: 2278 - DNA, 1452 bp, Glycine max
  Soy_ogl_655 Gm02:44752850..44754301 Cluster 9
taagaatgcttgcatttcctttttaattccaattttatgctttatatatttaaaaatgttaattataggaactggttgattctttttaaagaaaattggaagttgttttttttttattattttgtttatatttatgatgttttatcaatcgaataacaatgtagttccataaatataaattatgggttaaatataaattttattaacaataaaataattttatttttttatagaaatattaaaatattttttaaaaaaatgaaaatccagtctagatacaatagttttgttttttttcattttattttcatttaaaaacaattgtggatgtattgctaattttgcatgattgaagaagaagaaaaaatgataaatttcataatccgcatgaactaacatgattaaagtaaaaaatataaaaaaaataacaacaaaattccaacgttaaattagaagtttagagaaaacataaatatatatgattaataaaatgaaaatacaaagaatttttactcttgaaaaatgaataaacaaaaaaatgcataaaattaacaacaacatatgtcaaataatatttaaaaaatgataaatatatacaatttaaaaaaaatgatataaaatgtataaaaaaattaaaaacgcaattaagaaactaatttttaggcaaccgatctcaaactcatgtgaaaataataataaaaatgacacctttagagatcaattccgtgggaaccgatttcgaaacacacgaaaaaaagctgtacaagtgaaaaaaccgttcttataatgaatcaatttctcacttaacacaataaaatttctcatttgggtaaataaaaatgggaatgtattatttaggtaattttttaatttcttttttgtattttaggagtaaaaaagtcgaactatgatattttcaatagttaaaaaaaatccataaacatttaccttacgagtggacaaaaataaaaggagataaaatcttaaaatttgaatgaaaggggaagaaaaaaaattattttaaaaaaaaattgtctttccttttttattttcttaaaaaaccaataaaaatatattatgttccatattttttttcttctcactattttcttttaggttggtttgaaaaaactttgtcatgggaaaacgttgtaatgaaatgaaactatgaaagggaacattaaaaaaaaaaaaaaacaagaaagaactatgaaagtggaaagggactttgcacgccaaaaaaaacaaaaactattttgaacaaacagtgggacgtgtttttcttgccttttctattctgttttgttttctacgacttgtgttccttggaactttgtaattactgatcagtttatgtacggatcattttaagattgggtttctttcagggtttgcatttttttttatatgggtttgtataaatttattaatgaccttggtatgtattgttag

SEQ ID NO: 2279 - DNA, 1700 bp, Glycine max
  Soy_ogl_4906 Gm15:4440801..4442500 Cluster 9
tatttccttttaatttgttttctttaaagaaaaaatcttctttggttttcttgtctgtactaataacaaaggaaataatctaattttgtttctacgtttttttttcatttttactctttataactgcataaattaacactgaaataactgtagttattataaaaaaatctccttaattatgaaaattatttaaacccttaatctaattttatttttatttttaaatgtagataaacagggagtacttgtttttcatttattcaccattttttccacacaaaaaaaccgttttggttattaatataataatgctaatttttttgtgtataataattttagtttattaataaataaaatatatttatattgtcatccaattatctatcttgtaaattttttaattttataataattatcctaaaaatcatataaaaattatttctttttggttttaattagagtaaaaacttttatatttacatttgacgctccatacctgttaaattctaatttatttgcaacgcatttttttctagtataattttgtagattagtttttacagacaataatttgtttaaagtgacatttattaataaaatgttaattaaatatgaaataaataatttgctgcgaaaaccaaaaattttaatttcctcttatgaacactttttaccactgctaagacacattttatcaaaagctaagacaaatattgatgcatgatgattgggtttttttaacttgaattttcagttcattgtatatttttaatttatttaattcaatttccaatttattatgcatgcaaaaatatattatatgagttattcttattgtttttcattttttatgtatgtaattgtacgttttttattccgtagaatatttttttttgtcaaattttattatctaaataaatttttaaataaaaatgaattactatttttttaatattgcaaggttttcatctaaacagaaaagtttaacattattagatttacaagaaattcggacttaaaaaattacattaagatttttttatgacagtaatttaatggtaaataaatcctggaataaaaaagatcaaactagaaaacaaaaaagaaaagaaaggggagaccgggagggtggctgtaaccgtggtagggtgcaacatcacaaagacacaaacaatctgaaaaaagtttatccaaaaagaagagcttggaaaaaaatatggccaatctttgtctctcctactgacaaacttaaattttctccaaatgttggtctctcccactttcctggaagagaaatctatgacatatgaatggacgaggattggtatgttttggaaaggtttcaactctcttttttattcttggtttctttccaaggttatggattgaagagaataattaagaaaacctctttcaatttttccgcatcttctagatactaacaatcttatatgttctttctcaagaatattctatttttccctctatttaactataagttagtctttgtgccctgaaaaaagttatattttgtttgtaggccatgatgcatatcacctccctctacaacataagtgtagttcagcatctggtgttctgattccggaaactatgcatgtttctccttcaaggttttgatctcactatttctttttcatgaccataaaaaaagaaaacaaacctagctttctgtaataatg

SEQ ID NO: 2280 - DNA, 1500 bp, Glycine max
  Soy_ogl_5543 Gm17:6079801..6081300 Cluster 9
tgatcaactaaagtttagataaaagtaagttgaatataatttttttttttatgtttgaatactttgttttaaaagtaattatatttttttaaaaaaaatcttatatttctaaagtatccaatgaatgttgataaaaaaataatccataactaatcccaattaaacgtcaatttgtgtacaattcatgttcagttgaactcttgtttggaattatcaaacagcatggtactccattccatgcaacttcaacgaccttttagagacccaagctgaaaaacaaagccttagatgtctctcaacaatactaattttactcatgatgttttgacttcgttaatttaagaaaactttataaacaatatgaattaaacatgatttttttcattaaaaaaatatttttattcatatcaacacaataaaatcttacatgagtgtcgtgtttactcgtatgtcaactcttttgataaagacaataatcaagataattaattttgattttttaaatattataaatttataattgatttgtttcttgttagtttctctttattttaagcgttttattttttattctaatttttcataattgaattaatactttttttaaaataaaatcatttcactttaactttatcggtgagtatgattcaataagcaaaatcaatttactaatcttcaaagtgagcataagacatgcctagccacgattgtcatctcctcccacttataccttcatatgttaaagttttattgcactttacattatattaattacgaatttgaatttttttaatttagatacctctgtatgtttgtgctaatttaatacttttattatacatttcgtccaaatttaatattttataaagattacgacttctattttaaaagtaaaaatattatagcatattatcttaattatcaatatataatagaaaataattatacatagacattaaaatccattttgatagttacatgcttaaaattattttttattcaaacaatattttcttataatttttaaaaaatttatgttctctaaacaaaaatcatcttatttcaaaaataattttaatcataatcatttttataaaatcttgttgatataaaattaattatatcaacacacgtccaaacatttcccctcctgtgcttataactttaaaatcatggatgtatgatattttgcttgtgtacattctttttagtaaggcttgattgacaggaacacaaaagtgatttaactgtatgttatatattttttggtacattaattaatgtaacatacacctataagtttgatgtatttgaaatttagacaaaattaaacttcttgttcttcttcaagtgttttatgagaattttctatttattctataatattattgtaattatagtcataatataataagagtgtctagtttatagattgaataaaatgtgagtgttgtaaatattcttatattaaattctttgaacctccagatgtattataat

SEQ ID NO: 2281 - DNA, 1772 bp, Glycine max
  Soy_ogl_1149 Gm04:905483..907254 Cluster 9
catgtatataatttcggtttgaactcatttctaagtttaaatccaaaatcaaatcgcaaaaaaaaattaaatttttcaaattttttatccgaatgattttcattcttttatcaatttttttatccacagtgaatttgatcgatttataaacacttatatctctacatctaataataataatatcaatccaaccattactaacttttaatattatacacaaaagaaaaatataaacctaaaataaaagacgcggcgtgcaataagatctaacttctttattatctttttttatattagcctcgttaaaataataatatatatgagttatgttaatatttaatggtaatatttaattttaaaaatcacaacgatctaactttagagaacaggaaaagacaacagaagtcaaatcccgtgcgatgcgggtggccatgtgccatttcacaaagcaagcattttaaaactagaatgcatgagagaccctttaaatacacacacattgggaataagatactcttatccgttatactttctttatgcctcctagctttccatattcttaattggtgctatgtattcagtttcagttttaaagacttattctttgcatacttaatgcgcagctttatgcacaaccaaaagctaatctctcgggttaatgaagctccaacaaatttctaaccaaatctaaacagtagaggctaactcagttagtttcttatggattaaaaaaaaaaactatacggttacaacacgagttctctggccacatcgttcgaacccagcaacaaagaaaataccgacacaagatagatattcatattaacactaatccgaagaagaaaaaaatgatgtaatcaaatcacaatacagtcatgttgaaagctcaatcacaccgcactgttgcacttaaacccactcgcaatgtggcccttggctgaagagaactcggatggcggagaaagaagcggcgaccgcagccttcaaggtcacttctcttcactctgttttcggattaatgaaaaccaaaagtgcttttatttaacggttttgttaagatacgggcttattttaattaataaataagcaaaggagaaaatgtttgttataacagtgtaataagtcctttttaattcccccccaaaaaagtcctctttaattcaacattttttttcattcaaatcatactcattttaagtaactaaaatatacagtatattttattaaaattagagtgcgtttgactgcatttccaaccgatgctaacctacaggcaccagattagtatatcaacaaatttttattagacatttgatccctaaaatctttaaaatataaattttaataaattggtaatatcacatgttagtaatgatatgataatatgatagtctgacacacatatattacattaaaacagatcaacttcacattgatacattattaatgtcatgtcaatatatatatcaaattatcacattcacatatgaatatcacctaattataaatatgtcacaataaataatttttattaaaattttaacagcatactaatatttaacttaaaattattttattattcaaaattctatcagtaagccgattttagtggattgaaatctttatttcttttaacactttaccgtttttttcatttaccttaaatttttaccttatttgaccctttccaaaattctaataatttgaattatataacttaaatcaattcgatttagctccaaataacaaacttacgttatgcttttaacact

SEQ ID NO: 2282 - DNA, 1822 bp, Glycine max
  Soy_ogl_2987 Gm09:4249848..4251669 Cluster 9
aaccgtgaaaaacttaaacagaacaaaagctaccaagtttctatctaatcccgctatttatatggacttaattaagtgacaaatgacgcggcagaccacgagcaaggtccttgagcagactgcattgtggcaatgaccacagttgtcccgaaacccccacgatcatggtaaagtttgtaagcgttgatcctaaatttgtagtcaactagccatggtcattttgaccacgatcgaggtggccagaatcgtgattcctccttcagtgctccaattgctccaaatttacatgttattcaaccctttttccacatagaagctccagaacacctatctatcacaaactagtacaaaattgtgagttttgccaagaaaagcatgtcaaaatacatgattatgacatgaaaaatcacttttaaacaacatcaaagttgggtttattagttgcctttaaagatgatgatctccatttcaagagcttttgttctctatctttatgctttgataaaaaaaaattaagacttaatggtgtttttaatgggtgcttttgacctattactttttctctttaaatattttatatcttgatctttataattgttaaagtcacaatttttttttgtcatttttccttgtgtataacatctcaaatctttgtttttccttaaataattagaggtttcaaaatatttgagaaagagaaaaggaaatttaccaatgatggaaaagtttaaggtaattttcttaagagtgcaaaaaacctaggcatctcaaaacaaaatgcccaaacctaaagaaggataaaggacgacatataaagtgttgtatagcattattaggaaacagttgcatacaaagaattaggtaaaataaaaataaaaacatatatattgttgccagcatatataaaattgtagtctattttatgtttaggcaacaattttctaactatatgttggtgtgtttgacgtagactaaagtgtaaaatgctgcaaataaggatatattgactacatggaaagactttaaatatagctcatctaacaataatgaagaagtatatgatgttgaacatatgatatctatatatcttaattatgataaatatatagaaccaaaattagatttaggtgatgaataaattgagataatttcaaaactcactaattaaactttaaaaaaaaaaagcacaagctactttttgttgtgtttgacatcctgatgtgtaaaacgctcacctgcagacttcttttgaatgattttaatgttttacgcaatgaaatcttgtggtttaagaagaagaataaagatattccacaagatctagagctaactaatgtgtaaaatgctcacagacttctttttgttgtctttgtggttttctcaggtgagattttttactacgtacgtacccttcctaatcctttacctccatggtttatgtcattttcgttgccaattttattaaggttatatatgatttatatggagatcaccaatttatgaagtttgtgagttaattctctattaaattgtacccatagatgtaagctaactaatgcctttgtttcacttaaaatcaatgtttctataactcaagatatggttatattagtaaaaatttatacacaatagacagccaaactaggttttgaggtgaatatataagttataaataatcttcttattatgtgtacagtggaacataattattagttaagtccatagaatagtttatttaatgtttatcttaaatgtccatagtgaaatattattgtctaaatgaatatattccctccgtcttaaaataacggttggctttagg

SEQ ID NO: 2283 - DNA, 1900 bp, Glycine max
  Soy_ogl_3324 Gm10:2572001..2573900 Cluster 9
aagtattttttcttgaaagtcgttataatttgtgtcaaatcattatttgtaggctgttgaatttgaaacacgagtgacaagtcaagccttttacgaaataggacatgctttcagttatttgtggtgcatcatcaaaatgtagttacctaataatatttaaaaaaaaaaaaaacagaaatctgcccgagtattgaattatatatctgtaaaactttgtagctaaacctgcaacgtggaattcaatggcctctcccatttctaactgtgacaagctgctaatgtaagaaacagatggagcaacagtctttagtattaaaattgcgaataaaaagtgacaaagaatatacgacaaacattgatggcctttgtgaaaactaattaatttctcaaaatgaagtgacgttaatttcaagatggctaacaatgctagtaatttcctccttctcaagcacaatttgcagaggtaacttaattctgttgtatcacaggtgagggtgaggttgttgtgctgatgcagagttgcaaaaccatactatagactgttatagacatagactttattagccaactatagagaaggaactaattctatttaattatatcaattagttagagctagagacccttgtaattcattgttcagtccagataatcagaattgaattctaactcaattactagtcacattattttaggagccgatgtatctcggtggcttatgagtctactatttttttttttatctgcaaatattaattgttaatttgataattttgttagcaaaaaattcaaacttgttatctattcctctttcattttatcctttaccaatcttatatctccattattctactatcattaatgactaaaccatttggcagaggctaaatcgtacttcattcaattcatcaaagtgcgtacgaatattttgtactgtgatgaccgtctctggaagaaaatgattgatccttactctgtcttaaaaattgaaagcaaccaatccttgtgcatgttgttccaagcattaacaaattggggttttagaacaacaaacagcaacacagcatgcatgagtcatttccactgcagcgttatttgacagatactgttcgcaatcattcctccaacaatcatgggcaactacactccctcattgttcataatcatattagtctcccttcctattttaatgataataaatatcctgcattctcatggaaatataaattattttctataataataattgttacttatctctacttctttcttttacaattcttctttcatttttatttttcaattatttaattaaataaatgttaaaattatccaaaattattaaatatcaatcaaacatgttcatgaaaatagtattcatagtcacaaatactcccaattttttttatttacaatcaggggtggattcatttttttaaaataaaattataaacttttaaaaaatacataatttcataataataaaagttactataatttcataataataaaagttactttaatgcttatagttttcttgatgactgataagttgatggattttcaatgtcaatgtgacattatcacttaatgatgttatttaaccaaagggattaacaaaaatctttaaaggagtaaaatcaaaacaaaaaatttaaatgattaaaatttaaaaaaaatctcctattttatagagaccaaagattatttaagcttaaaataattaatgatcagtctcgcttaagggcttttgcaaaaaaaaataaaaaattacgatacatatttttaatataattaagtgaaatatttatttagcacttatcgttaattggttattacatttatttggtggatgtagactccaaagtttttcctaattttattccaaatgcctttggta

SEQ ID NO: 2284 - DNA, 1300 bp, Glycine max
  Soy_ogl_5817 Gm17:40418701..40420000 Cluster 9
aaattaatttaaatgaacaaatttagttagagtaagtaaactatattaattgtttatcttaaatttgattttaatataaatttttccattagtaaaataatataaacaacataacaaatatgtattttgttttttaataacactataaattaaaaaaatacaaagttgaatcacttattctgactcatcatttttggcgggctagtaggatgatctgctgggtcaaggcccacattgccattcctaattttggttgagccttgtgctattattatgactaacaaattgtccttttaaatatctaacagaattatatacttagaactcaatctcgagatcccgagtacgtgtctgctgatttatgcactcaatatcttataaaatactgtatgtcaattttttaaaattaataaaaaagtataatcttatatatgattaatattacttttatatgtaaatatattactcgttaaattatattataaattaacgagacacacataatttaacgagtcacacataatttttatttaagataatattttgtaagtactttgtacatttgtaatgcctctaaaaaaacaaaaaacttatacatttgtaatacattttgtgattcaattactaaaatgatttatatattttgtcagaatataagcacgtcccggaattatatgaaagaaaaattgtcatagtaaaatttaatcaactctttccattcttctttcatccttaaactttattttttctcaaccatcaagttatactataattaagattataattttttatataaacattaaattgttaatataaatattataaactacattaataatatgatgtattaatactgtataatgattttatataaagcctaactattaatgtaggtctttttctttttcagagttaaaatttctgtcaaggcagagatcccacgttctaaaatctcaaatttctgattaaatttgaataatacagggagatacatgtgaagattgaagagtcaagagtggacagaataatagcagttggaaggtatcgtctgcttggaaattgattgtgacgaagagcataattctgcttcagatttcagagtagtggctgttcaaattgacaaggatctatagcttatgatgcttcgggtgtcaattactttggtctattgttctcagaaggtgcctatgcacaaaacaaaccatgtttattggtcggggttcttcatgtgggcctatttttaggctcactattctctggtcttgtatttagcacagtaacacaaaaactaatgtaatgg

SEQ ID NO: 2285 - DNA, 1000 bp, Glycine max
  Soy_ogl_40 Gm01:1898701..1899700 Cluster 9
gtacaagaaacattaaacacaaataagtgattttcgtcaaatctcctttagtatttttctaatttttaattaatattcatttatttataagaaaaatgacatattccaggttggctattcgtgctagcttttagtatgtctgacgtttatactaaacaacacaactcatctataaatttaagtcttgatcaaatcagtggacaacattcagaaaaaataaataaataaagtccgtagtatgtgtatattgcatatatatcatgtgtaatttgatttcagttatagcctactcataggtataaacgcaattcatttttttaaaattacactctccgtttcaaataatatggtggttaaggttttgatacatgtattaagaaatgaaatcaatttgttgaatttaaaaaaaaaacattaaataatttcccaatacattatttgtctctctatttaatcacttatttgtttttcttacaccatatatattacttacactaaatattgattaaaaataatcttaaaaaaatatttaatacaacattaattttataaaattacgtctattttgaaataatatttttctctaaaatatcatagactataaattaacgcaattaatgaagcataaaaaaggcacgatttatataaagtacaatgaacattaattaatagcatattttaggttcctgtttataagtgcttgaatatgtttcagttaaaggttgggctaagtggaagcatcatatactgctttgattctgtggaggattagataatggataatgccactgaagtgaaatgttcccaattagctagcatttgctcacacattgcaagacaaagcaaaaatatctgataatatagatgctcatctaatcttccaaattatacgtccacgagtccaaaaagtggtacataaagcattctctatttcagtttgtgctcacaatggtcccgaatctgattatgaagatttttttatcaataaatattaatttat

SEQ ID NO: 2286 - DNA, 1400 bp, Glycine max
  Soy_ogl_1931 Gm06:13858601..13860000 Cluster 9
caattaatcaattaattaattgtataaaaagaatttgcatggttgacattaagatgaggttcatgtcaataagcacagctgtggggccccctcctatcattgtggaaacagatatagattcggagtcatgagatgatatctaatgttggtcacaaatgccaacccaataattataacagtaagtacctaaatttatcaccagctgattaaaacaccatactctactctgtttcttggtagtgaaagaaaggaagacctatgagatctttgacacaaacaccaatcaacgcaagtttcaatgtgagttaaaagacagcaatggacagccaacgctatctctagaaatttccaagaattatttggaagataaatgtaacttcaccatacatcaattcattattattattattattttgattttttctacccacaattttttattaaatttttataattaaaattctaatatcagtacttttaatagaatatgagaaatttaaactgatcaaattatttaccgatcaatgttgcgtaattcacttttatatttttgcataaataatagtttgatattgagaattcacttcaaaagggtacgatgataaacaagaataaaaaaatacataattttgataattgaacaaccttattttctttggaaaaaaatctgttgagtaaaatgcaaacgatattagatgataattatgagaaaaatagcttatatttcgtagcttgtaatgacaataaatatagttattaaaagtaaagttatttaagaaaattctaacaaataatttggaaaataaaattgccaattgataataattattatgttgatagagacataattttgaaatatctcaagaacagccccttctaaaaaagattaaaataatatacaataataaagcttatgactactgcaattaatggcctacccatctaacaattggttggattatcgtattagcgataacattatttaattatgaaggtgaaatgagtaaattcaagaaatgtatctcctcaatttataaaaaaatataaaatctcaatttaaataaataataaccgttggattaaaattaatgattaagataaattttaacaaaacttatcattttacttttatatttttacttcatatttttataattaaggagacctgctcccatcataatacatagacagaggacgataaatcagttaaatgaaacatcaatgtgcttcaacggcgagttactccccaaatccctcggcaacgttccaataagtttgttactgaacaatttaagctcatagaggttgggagaatgcacaagaatcggtggtaagaccccttcgagcttgttctcgtataaattcaacgacctgagtgacaatttgcataactcggtcgg

SEQ ID NO: 2287 - DNA, 1432 bp, Glycine max
  Soy_ogl_82 Gm01:3319969..3321400 Cluster 9
aaacatattattgaaaataataccccagattgatagttaacattcaagtatgcaacctttgagaaaaaagaccagaagaatccctgagacactgaaagcatcatcttcagattccttggtcaatgtttttcactcctcaggagaaacatccccaagttcatctcctgggttttttagctccagaacaagaaccccattctgaagtgagtgatcaaaagggtgagcttgcaaactccaaaagttgataaaaaaaatatagcttggtggagtggtccatggcttttgggtggacctcgattgtttaggatgacgagcacggcggcgccacccaaaggaggagctgagtcacgcttttggactcggtggtgtcgctggagaaaagaggtttctaggtggtttaagttactttaggtggaagagaacatgatttaagttaatttttcaaaatgtgtttggttattgttgatatgttttttagaattaaatatttatataaaatatgtaattactttttttccactagacttagtaactgaaaataataaaaagtgagtgggtattaaaaataaatgataataaaaaaataacaagaaacattaaaataaagcatctcaataggagtaatttatttataagtctaattcttcatttagtgactactttttttaaaaaacaaatcctatgttttatctttgatttctaaacatttttattattatttcttgaaaattgataaaaatttcatttatttttccgattatagaaaactacatcctattattctatataaataacaagaagaaatgataaaaattaaatatgaataaaacaataaaatcggattaacaaagagtgaaagttgaatttttctcctttctttgggattatttttgcataatatgaaataaaattaattcttagaaatcataatttccttatatttttttattaattacatgtaaaacataaaaatcataatcttttactttaaaattcctgaaaaaaaatcatctatcaaacaccttctaagtgccacataagtacataagagaattattctaagcgtcacataagtacatacttaaccggattaatttgtcggtcttcttttacttttatgaactaatttttttttcatatgtaacatttttcatgaccaaaataagtatttgtccaaaattagaatgaaagttgttaataggaattggatctcagccctcaaaatttttaaatgccacatgtcatgtggaggtgaaaagaaacgaagatgaataatgtataggatctgaagtccattgtcacacttttttttttatcattttcattttgcggataggataagtctctctcagaaactgaactaactttctttcttttcctttttctttatttattttaaaaccatttccttgtaacgcggtgaccggataag

SEQ ID NO: 2288 - DNA, 1700 bp, Glycine max
  Soy_ogl_299 Gm01:52773501..52775200 Cluster 9
gacaaatgttgttcacatatatgacaaatatgttggagtcatacttgaacaaaatgaaagaaaacttctacattcacacagaggtcaatatgttgattggtgaaaattgcacaacaattttttatacaataattaatttgaggccaagttctcagttaattatatagaatgattcattactctcacaagtcgttctatatttttaatagatatgagaagtatttctgaagattctgttcgcttgcaacaagcaagcaatgggatattgaagtttaatttgaatattttttaaaacgtttttccactgtaaaaactaagataaaaaatatttgtttacctaattatttaaaaaaaattgaaaattctatacgtttttcaagtaaaaaaaatcaaagacgcaaaattatggccttagagcttcatgaaaatagtttaaatcaattttctgaaaaagtgttgcatataagtcactacaagttaattagttaagtaacatttctcaacatgaaattaaaatttccattaaaaaacatgaaattaaaatgtgaaatctgactacgtttttattagctgtaacgagagaaaagtgttagattattctttttttcatccgcataactaatagagtggagagacaactccgctaggaggagcaagagagatttagccatttatatcaaggggattgtttatctcaaataacattgttagtatattttattttttttatccgtaagaataaaaaaaatatcattaaatttataataattcatgtatcatgtataacaattaagcttattcttaatctttaattatttttattttaattaaggtagaggcttaaatgattaacagtgagagtgagatcttaacacttgagaatttcaagtttatttttcacttgtgaagatctcttcgcattacgtattgtggatagcaaaatttgtgccttacacaaagagactctttcccgtgtgttctatatattaacaccaattcaccgaatcttttatgagaaatttaaaaataaatgtttttgaataacaacattatggggagagagaggagggtataaaaaggaaaaaaaagaagaagctgttgcataaatttatcctattagtaatgcatatttaataaagttttaatgatattatcttatttaaggaattcattataaattttagaattatatgatttttaataaaaaaaaatattgatgaaattataagaacagcatatttttgttttggtaaagtataagaacacaaaactaatttaactaaaaaaataaaagactttttagattcttaattaagacattaaaatttatttaatattttctattaaatttttccatttaacaagttgtcctcaatctaatgtcactccttaacaattacatggagatggtacaaatactttggatgctatcctaaagagaatagaatagtgtgtatgatctaactgcccatcaagcaaacataattattatcttgttaacttggaaaatagaaacagtgtgaaaagctgaacagtgtttttcttttgagaataggattgttcaaaaactgatggatccatgagtaatgaaagcagcgaagactcccccgagccgcaaaattgaccggaggcttttctaatctaagcttgtgcaaattaaatcagaaccaagagaatattcaaattatgagatattttca

SEQ ID NO: 2289 - DNA, 1276 bp, Glycine max
  Soy_ogl_3201 Gm09:39745925..39747200 Cluster 9
aatgggagcttgcatgttgtgccaagggagcaatctattgccctcctctcgtctcatcggttactccattgatggctttcaagtttgactaaccacggttaaattattagtaaggaggcatcaagttaattcttatagagttattttttattcttgtattttttttaatctaaggataagggcgaggataaaaagttaagtcttttaaaaattattattaggtgaggatgaaaaggaccaacttacttttcacatttaatttgataattttaacgagtaattcatatttgatcgttagattaaaagaaaaaaaaaagagtaaagatggagagtaatactgtaagtgtgtgaaaattgtttagttaataaaaaaatataaaaatataatattcactttttttatcctttagctaagttggttcatttttgttttgtttttattttagatgtatgctatttttatttttttaaaaatgattatatatgttatgctatctaacactttctgtaaaaaaaaagaaaaaaaagaagagctaacacttgaaatattatatctctacatgcttcttaatctcaataatattttgtctatttcagttctaaattgcttcttttaatattatttggaaattagagaaaggaaccttcggatgatgttatgctatagttgtgttcctcatgagtgtcataagagagggcaagatagaaaaatatgttacaacactatcaattttccccaggtatgcttggtgaatcacatattaatttattgttcatttcttcttatttctaccatctttcttttttaaacgatcacgacctaaaaagttaaagaatatgtttttactcgtgaattccacaaaaatttatcttctttatcacttaaccaaaccacactatcgtcctcatttcccttgtcttccttgctccccctctctatttttaccctaccaaacaaggggccaatctatccatttaagtttgaaaataattaaattatgaaaatatatagttagttaatcttttaaagatttattaaaatgttaaaaaatatgtttttttaaataagctgtaattttaaaaacattatacgaatatgattactttttggctcaattgcatattttatcaccaattatcattactttttgaatcttatcacctaaatttttgttttcacatattttagcaccataattttcaatttttgtgtacttaaccgatttgttaaattttttaacgaatttgttcctaaaaaatgtcctaaaaatgtcat

SEQ ID NO: 2290 - DNA, 1319 bp, Glycine max
  Soy_ogl_5527 Gm17:5421382..5422700 Cluster 9
aaataattatttataaaataatcgttaaaatagatgcacgtccatctagccatctatcatgtaacataaactataagttatttaataaataattaatgttcctagcactcctctaaatttaaatgaaaacaaatcatataaaattaattgtgttacattgaataaatatcacgacaatgtctcaaatgcatacgtgttaaataacacaatatttaaataaataataaaacataaaactaactattatatatgaatttttatgcgttaaaatgtcaattatcttatgagttaaaactaactattatatatgaattttttatgtgttaaaatatcaattattttaaaatgaagagagtactttataaagaaatcattaaataaaaataaaatatgtttaatatctcataaatataagaagcattaaatacttatcatataaaataaacagaaagattaatacaggaatgttgtgagaaaggtttagaattattatatttatatatatacaatgcaattgtccttcattaatcactgtccccactaacttttgaacttgctcctccaatggacttatgcctgatgcctgtagttgtgagaaaggatcaaattggcgttgattgatcaatctacctactactgtttccttgttttgattttctgaacttcactcttaaattcgaaagcaatagtaacgacatcatcttcagactatggtcaatgtgcttggttgttactccaacagaataatgcagcgcggttttcttaaaacaaagaaaaggtttcatctccaaaaagatctctgatacacccaatcggaagctctcagttgactaacccaaatctagttgttaaactgtatgtaaactaggaaataagtgcccaaaagtttcatgtcctcaaatttagcaaataacgaactcgcatcgcaaagttcagagttttccaagttttttttctctcacggttttactgagaaatgataaggaattttaaaatagtatttcttttattaaaatgtatgatattgaatattattaatatacctttactacgatttttaataaaaaaatttactgtctggttagtataaaaaattataaatattcatagaaatcacttatactaatttactgtctccttttccatttttcaataaaaaattgatatgtggatgaaaatgacaattttctgtttctatctcttgtttgctattttttccatcgaagtattatttttctattgagaaaacaagaaaggaaacacatgaattggatgctctttatagtaaatttaatgctttttgatagttcaggtatttt

SEQ ID NO: 2291 - DNA, 1427 bp, Glycine max
  Soy_ogl_6856 Gm20:39075501..39076927 Cluster 9
aaatatattttacataatattataaagaaacattacgaaatgttgcaaaacacaaatcccataagaaatagaagcatttgaaataagcaaagtgacttcataaaaccctaaacgtacaaatcatacttttatttatatatcttgaataacacattaaccttgtggcctcgaacttgtcgaagtacggacatcaaggacctgcattgtacacagggtctgttagggtaaataacgagttgtttttcctcaaatttaaatattacttagatattatacgtgcaacgataaattttaaataatctgagaatttgtttgcatgtaatctgattgtataaatttaatatcgttgtaatattatatatttatttatattttaaatactatgctatatattaaaaaaataacgtaatacgataaaacatcaattatttttttaagttgtatgaaattttgtagttttgatttatctcacacacatactttcgtagtaattatcttctctcttatggatggtaaaaacgagatctataaatctaaatgtataatctatatgaatgattaaagttaaaaattaattagtggttagataattaattaaaaagctatgtatatttatcttttaatcttaagtattaaaatataatctaatgaggagttcttattacttaacacgcatatatctaaataatctgacaatgtttaaatctctaagaaaaaaacaattctttacgtaccaccacagttgcagtttcctagatttcaatagacggagttcttcttttggatcacaaagtcagaaagtcatagattcggtacagactctagagtcgatcacaaacaggattggttttaaacgtgccattctccttcctgttgtaagtctgaccaattcttgtgtctaagatatattcataaacactttctaattaaatgtaaacttatctatgaaatttatgtatggaagaggattgttaatcacactctctaattaacaaaataaccaatctatttcaaaatgcgaaaggtcaaattagttcggttcacatttaatatttcttttctaactgattcaaaaaaaattcctaaaaattcatccaccacgagttgcaaatacatggaaggtcatgaaaactcggtggctttttctagatttatggaaggtcataaatttaactatcagcgacacaaccatatttaattcaaaaaaatttcttaaaatatccttaatgtacttgtagaataggaatagaatagaaataaatgatttactgaaaataagattttattaaatgagacaaaagttagtatttatttatatttaagtccaaaattaatttttttcttatatttaagttcagaggaaatactgaattatgtattctctttcatacacgcacactaagcataccatattttttgggtcagta

SEQ ID NO: 2292 - DNA, 1543 bp, Glycine max
  Soy_ogl_5776 Gm17:39315001..39316543 Cluster 9
ttcctttgtgccaacatcatataatagaacctttggaactttggaagacctgcactgtctctcgttatggttggggtcacagtgaatatgccagtttgggtttggggccccaacattcaaaacttatccacttgctttttggatagcttgcctacacatgctcttatcttgcatttctcaagtctaaggtgcaaaattattggctttatatatgctatgcagaaccttcacagctgacaccttcctcttctattattatttttcaattaaaaataatttaatttgcatatactaatcaattagaaattattgttattataatttttcacatgatttttacaaaaatcaacttatcatgcacgccaattgtggttgaataataataaaaaaaaactagcaatgattagttcgagtgattgagacttggattgcttaaacaagtgattaagagtttgattcttgatgcttgtggaaaaatcattgttggaagaggataatccactcatgagtgccaacagattttttggaggaatttaaaaattttaatgatctaccgaaatacttctttacaatcatattgcagcaaaaaaaatccaaaaatattttatattatcaatatatttactatttaatattaatttttatgcacacttagcaaaacatattattgttaaacaatcataaatcaatttaggcaagagaacttctcttataagttacaacaatttattcacaccaactttactctaaattacacaagagaacttctataaaataaaataaaaaataaagttcaacttatgaaaaaagttaaattcattttttactttttattttatttttgtaaacaaggtatccacataatttgaatccataagagtaagattaatcctctaaggtctaaagaccaccaagtgagttttgtctctttaaaaaaaaaaggtatatttgagtaaatgtttaaatgccttcaaaatacgtttgcgaacggattgaatccgttacttcaatgttggtatgttggatttgcgaatacatacaacagcaactctaactgcaatgtacccaaacatgtgcaagtctttttcatatgaacacttagaaaatcaaatcagtatcaacatgtttaataaactatgttatccaattgtgtcgaatcttgatggttttttcttttctctaataagtatttatggaaaacggtgtctaatgattctgtcaaaaaaagtatatttcaatgaaattcttgaaaactaatttcatttcttgcattgaaattagtttaatttgtatatgtatttataaatttatcatgtgtggatatcttttacaataattagacacatgaggaaaagtaacaattgattagtggtctaaaacacgcgcacaatatgtttttccccaagaccgcaatagaaagaaagattatattcaggctgtttgatgatcactttatacaccttgtcggaccacaaatccgaagcctagctaggtcaatgatgaactccttttattttattttttatttacaacttaatcaata

SEQ ID NO: 2293 - DNA, 1300 bp, Glycine max
  Soy_ogl_5294 Gm16:4389401..4390700 Cluster 9
aattaataatgatataaggttaattttataaaattattatttttttatatgtttattattatttttatctatgtaaaacaacctatggagggagtattatggatccaccattttaatttgttttgtactattcttttaatcgacaacaagctcttttgcataattaacaaaatagtaatttgaaaataaatgcagtacaaatacaaatgcttaaaaagaaaaaaaagatagaatatgtttataactcacaactcttgaagaacatattacataggtttgattatcgttgaaatatggaagaagagtttagcttgtcatagaagttatgaaaatacaaaataaagaaaacagaagagaagagtgacaacagtttctaaaaagaatttctaaatcttttttatatgtagcatttagaaattaattgtgtctaaaatctaataaaaataaaagagttctaattaataaggacccaagccaatgagaaagtgtccctgctaattaccaaggaaaaaaacaattaagttacttaagtatttcattgagcatatcatattactcgatgtaaaacttagacacctcacaataccaaagttattgtcatggcaacggcactttagacacttttcttggtctttctaatcatcctttccataggtaacattttaatagacacgacaaccaatcctgataccaattaattagcacctgagtacttgaaaaatcttctattaaaggctagttatcaagagagaagaactaagccacttaaatactataccaagcattcagttgtcctctcaataaggcccaaaatataataaaacctaaaactcaaatatctcaattagtactttggcatttcataatattttgtttggtagaagagaatttttctttttttaaaaggaggggaaagatggaaataagttagttggtttggtatataaagaagattagggggaaacattttttaaaagtgtgggactcacttttattatttcttacctaatttcactcaaccatctttttatatttcattatctcttctctatttctcttcaaccaactacatttcatttcaactctatttttcactttttgccacttatctattttattttcatccactatatttctgttctctataccaaacgaagcataagtgatatgttctctccacacaaaaatgtaatggtatcatcctaattaacctccatctcatgcaagagttaaaaattgtcttctaacattaaaataataaaataaactaaaaaatatgtataatatactaagaaatgtt

SEQ ID NO: 2294 - DNA, 1400 bp, Glycine max
  Soy_ogl_1186 Gm04:2397301..2398700 Cluster 9
ttcttccatgtttgtgcattgaaattcaaaaaacttcaatttaatatagtctaaacggaatttcaaacacacactttaacattgaaatttgaaaaacttcagtttaacatagtccaaatagatttctaaacacacacttaacccatataaggtttaagttaaatgaactctatttactaataagttaaaaaaaacaatcgaaaaggttagactttagattatttaaaatgggtatttttttatgtttaacaataataataataagttattttaacgatattatattatcataattgttaatttttaaaaaatcttaaactttttagtttatataacaatatttaaatctatttacctatttaatgacaagattattggaaagaaaatacatacctctagcaatatggggttacaagccctacttattttaaaataataatattattattatagtgttatcatttaagcctcgttatctttaattttgtctctggtgaattaatttttatcatatatgaagttataggcttgaattatcattatagaaaaaaaattgaagttcaagataagcctttttaaacgttaggtctattagatgaatgagttggtcttaagtcttaaatttggaaaatcccatttcatcatattcaccgcagtgccaatggtgtagctgatcagctttctggtttaggagctcgtatgcagtttttgtatgagaaattcattgttcatcctgggagtaaatatggtgtctacattaacaataaattttaagaaaaaagttaatcttctgagtaaaaataaacggtgtctatattaacaataaattttaagaaaaaagttaatcttgtgaggaaaaataaatggtatctacatgaacaataaatcttaagaaaaaagttctacaaattattttctaaaagtatactaaataaaatagagtatttactcacaagattaaacaaaaattttcaaacataaatcatgttataataaacatatttttatcaaacttaaaatttacaacatacttttaattgaaacttatatttacaaactttattaatttagacatgcactaagaatatttagacctaataaacagaaaagggaaatgcttacgctatcaatactaagcaaatgtatttacatcgtgattatccatgtttctttagtgtgatttgtccctcctctgccttgtgtgctaagcaaatgcatttacatctattaaagtgatcaagaaataaaaaaaaaaaaaactgagaaggaagaaactcgcaaccaaatccaattcaaaccatatatatatatatatagtaagagagtagttaattattgaagtcatgaaaaggagaacccaaaaggctaaaagtaagaggaatataatgtaaaattatcct

SEQ ID NO: 2295 - DNA, 1525 bp, Glycine max
  Soy_ogl_1216 Gm04:4238976..42170 Cluster 9
attgagtaaatcttaactaaaaattattcaacaatctcgtaattagctcaaaaacaccgaaaatttgtaaaaatatactgagatctcactagagagttaaaaactctaattatgagaattaattaaaataataataattttacaatttattatacatgtgtctttatcatataaaaaagtaattactaattaaattttttagaattatacactttttctaataaaatgcacaatgcctcgtacttagggattttttttataaaaaaataatagtttatatttaagaacagagtaagatgtatatagtaaataattgggaaaaaaagtaggctagaggtataaatactaacacatttattttgttttgttaattttacaaacactattttaaatttataattaattaagagttattaatttatttcaattaaaaaatttataaattaaaaaaatatttaatgtataaataaaactaaagacactgattgccatgattaaaaaaaaaggcataaggttaaaaaaaaaaaaaactttccattttttgacgtgcaaagtgacatccccctttacaagtctctggtttttaaaatatgctttgtcatcatctaactacgtcgctatcgaatatcaaactccattgtcttgtacaactcatcaaaactacttgtcatagacattataatattatttggataagattgctttttattttgtttcactagaacccttattacttaagggtattcactaggtcgcaataatagtgaaaaactatttgctagtttacgactaccaagtttctatgatctgaaccaatttatgtaagttatatgagttttttagcttttgggaaaaaaataataacacttaattacatgtcatgtgataatcaattaaaaattacattgttcaagattttttaataattatatttttgatatggttaatggtattttttattctggtaaatttttaaattttaattttagtcttcaacttttataatattggttttaatctccaaattttaattattatgtatgaaaaaagtgtttattttagagactaaaaatgagatatttacaaaaaatacagaaacaaaacctattaattctaaaagtcggtggcaaaaaattaaaattggaaaaatttcttggaaataagacctacgcctttttaatatcctcaactctatccgtacgaaaaaaatggaaaaaagtccaccaattaagaaaaatgggtgcattgagtaattgtcggacgatggggcttatattgggccctcttgccatcctaggaattttccttccacgtttgtaattattcactttttagtttttagtgttctacaatgaggttgtattttcatggctcactattttttccggttattttattttctagtcatgaaagttgttcaaaatgttatatttgctaaacaattcgtatggatctttttgtgcggcgaactggggggacaaactagctaagggtgatcaagaatccatccaaaccgttcgaaagt

SEQ ID NO: 2296 - DNA, 1746 bp, Glycine max
  Soy_ogl_2470 Gm08:2642155..2643900 Cluster 9
gtctctaacgttagtttcaacggttaagtgattttgtgatgagtagaatttgaatatgaaattttgttggcaatcttagaattccaatggttcaaactcgttagatcttaaacaatcttttttttataatttatgcttattacgtgatcacttaacaattaaaattaaagacacataccaataacataatagaacaatttataagatactaaaactaatttattttattcttttaaaagaaaaaaaatgtaaatattttgcagttgagaaagagtacaagccaattccacaattcccaggcaagaactaaaaacatagtcaagatcctcaaaaaaaaaaaagtcaagtcttaatataattatgttgttttttatgaactattttttttactaaaccaaaataattattatatacattatctaatttttttagggatcaccatgcaatcaatccaattctcgcaaagctaaaatgttgtcgtcaggcctgcacaaacctctgtgtcatctcctctgatgtcgtcttaaattcttaatatgttatccaccatatgattatagaaaaaatgaattaattcaactcagaggcgagagctataacattgtacgttaaatagatattttaattatatacgtaagaaagaaataactattgattaaaaaaattagttgaataataaagtgattgaatacagaatgtgttaataaacacttttttatttaccctccgatcgatcaaatttcaaataaatgagagtcacttagctgactttatcgggataatgtcaaagacaatgttacaacttcacttttcaaaagtcataactcatttagatttgaattctagggtgtatttagttttttgttttttaaggaagggtatgtttagtgtatccattttaaataaatatataattttttaggtacgaaagagttcaaataaatattatctttgtcccaaaataatttaatttcaaaattatcgtctaaaaaaattgaaaataccaataattagtgttttttttaaaatcactaatttaattatataaattgtatatatatggaatatctgatcttgcacaaagtcatattacgatgtaaacttttaaaatataagtcatgcacttatatggaatgtatgacttatagaatcatgagatataatatgataaaatacagaaagaaaaaaataaaaataaatatgaagttggtataacaaaatattagtgtctattagctaggtgtttgaaattgagtattgatgcgtgggatagaaaattttcgatttaattaagatcataattttcatttgtgagaactagtcttatttgaataaaaaacattcacatcaaaataagattaagaacaacttgaatatacttatccataagtatttataagagagagaaaaagatagaaggtacaataaactgaatttaacctataagttaaaaaatcaattgatgtatataaattttgtaaaaattctctcatttaactttttcagaaattaaagtgcataatttaattttatttattaaaaaaataaatttattttaccttttttattttttataccataaatatttacgaaaatatttatccaaataacacttaagtatcttaacaaaaatttattttatgtataaagtttgaatttgaggccttattacttcagagaaaaaattatcaatataaatcaactgcttattatgttaagtttggaatacggctcacatgtattatt

SEQ ID NO: 2297 - DNA, 1580 bp, Glycine max
  Soy_ogl_3295 Gm10:982521..984100 Cluster 9
aagtatccaagaaactgtatatataaattttgtgctaatttaaatttgcactcttcagctctgtgtgacactgtgattggctatgggaggattcttcagctctctgtttgtcatactgtgattggctatgagagggttggtcactgtttgtgcttgcttctacgactgtaaaagcatgtaattggtctgctttttaacttagaaaagagtttgtgaaaagcaagcaagcaatgtgttccatgtgagtaggataggacacttccaacccagtccccaaatcaatggaagttggtgctccgggccatctctgaggttgacccctctcctttgttaaagatcaccatgaataataaagttctatcaagtatttattgtagctgcaatacgcaaaatgttatcagacaccttaaattgacatctgcacatgtaacacgatatcataagtaactttgttttgttaagattcttggccaccacatctcacaactttgcaatgatttgaaataaagggaaatcatgcttactacgaatttctccttatgtatgtaatattttagtaatttttgttgtcttgtataagttatttaaaaatatatacaaaaatattaaacatttttctaggtttattcttattttccaacaaatcacgttaaattattttatactttctattaaacttcacgtttcaatagtggttgtggtgcttaaatgaaaatcattatttcgagagaatgattttttttaaaggatttcaactttcgagaaaatgatgaaagataataatggatagagtaaaaaattaaagagattgatgaaatttaaatacaacttatttactgtgtgtttgtaatatgatgtaatttaattcagttagtcgagttatagtaaaattctttatttatgtttttgatttaaacagataaaaaaataatatacaaatattcaatacatttgtaaaatattttaaaatattattaaataacttttgtatttttatataaaaaatattttttgataataacttcttatttttgacttcatatcatgtgtttatgaatatattaacatgtaacataattgatacttaatcttatattttttaagcatatgttacttaaaaatacgaactcaattccacctgattgacaacatattggttttagctgtcgcttttgaaaaaaatatatatttctatttatttatcattttaagatttggagatagtattaaataatactttcaattatatccttataaaacaaaatattgaaagattatttctctctcttttcctatattaacagtgtatattatatcaaagtgaacatataagaaggataactggcacactaaaaaattcgaagtaatttcaataaaaataaatagtttttcttcttcttaaaatttaaccaaataagcagaaggaataaaaataaagagagatacaaattgctttttatctcttctatcatataggaatatgcactaaatttatctttcaattttcttctctacaacaataattttttttacttaacttatcttttaactttttttctataataataattttttggtaa

SEQ ID NO: 2298 - DNA, 1600 bp, Glycine max
  Soy_ogl_1193 Gm04:2670401..2672000 Cluster 9
cagaaatttgaaaacaacgcccgataaaatattgtagatgccctggtcaaactatcaagtactttgtcttagaaaagatcgtaaataaaaattatatatatgatttctctttgaattgaagcgtataatgattttaaaatattttttattcttaaaattttaaaatgtgattttttcaatttaatttttataaaaatattcatttttaatctctaaaaattaaaaattgttgtttttagtctcaagtttagaattttaattatgtcatttttgttatatataaaaattaaaactaaatattcttttttaggaactaaactaaaaaaaaaacatcatattttcaaagaccaaaaatatacttaaacagttaaacttatatgagtgtgtaaagattctgggtattagtaaaatggcattttcatgctcttagagaaggaaaacctatttacacatatataactttaaaaagtttcgcagcaaactgacagcctgacaattagaaaagggaagggaaaaagacatatacattttttttttccattcacgatatttcttaatgtatagtgcaaaacttaggtaatatatgtagtactatagttagttgttatggttttaaaataattaatattttacctcaataaatgttattcccgttttgctactaaaatcattagtaattatcatatttttttgacagaaattattaaatttgtttaatcttttataaaagataatcatgagtccgaaaaaatctttaaatatttaatataagtgtatatctagaatttgagcttaacacaaccgattaaattaaactaatctcacatcaataattatcattactataatgaagtattaattttgattggaaagtaatattaataatattttatttaagttttgtccttatgtatattgcatttggactgtcatcatatgcttgtttgttacaatgtcaagtacgaggaaagtctagcatgttagattcaaataaataaattaagcaatatgtaagtgataaaaaattatactcttcaatctttaagattgtgggtcaaatgtgaggtacaattggttttggtagttctcacttgatccattcatacagatcttttcgatgtacattactttattacaaataaaaaaatcaaattgagcttaaagaatatattatcattacaaattggaaatattttatttgaaaaactagtaaacagttgacattgacactgataatatagtgttttataagttttgaactaggaaaaaaaacttttgctgtcactcctcacatagttgggaaagaagaaaaatatgtatatatttacagaaaacaaaagcatttcggtttacttatattattgcaggtatctgtatttgtttaaattctatagaatagttgattttgtaaaaataatagtaatagggattcaattacaagtcgttttaaatataaaatattttttattttattgaattgagattgtcaaactaatcataagttgcaggtaaagtgcagtttcgggttttgaatgttgcatgactctcttcattaagaaaatgaatatgatgagatgaattgctgtgaaagactgaagcg

SEQ ID NO: 2299 - DNA, 1700 bp, Glycine max
  Soy_ogl_4391 Gm13:31730101..31731800 Cluster 9
tatggattgcaaatccataagcccattatggattgaatccatatgacatacggaatggcaatattaaaattattcatcttatactggatgtaccaccgattttctgggtgcgcaaaataatggctgtcattttattgttgttggacctaaaactaaaaagagcttacgtttttggtgtgctacagagaggtttcaacggacattacttcctgcatctccttttttttttttgcaccccacaatattttaaaattcccaaattaccctcactttattctgaaatagtcattatgaaaatgtatatgtattcaagaataatcattctgaaatattctggaatttatttctgaattacctatatacgttcagaataattatttcaaaagaccagaagtgtataagtatttcaaaaacctatttcaaaataggatggctggatcaagctacctatgaaattgaaattaatgtttcattttatatctttttatttaaatttgatgtgcttaaaatgtattattcttttggttgataattttcttcttcttctaatggttatattcatagatcaatgttaaataaatttttagttaattatcacatatcaacatgcaatgaatatttaataataaacgtattagttgttttaacaagataagaaacataaagttaaacttaattataaagaaattaaaacaaaaaattagtatattaatataaagaacataaatatatattaataactagtataaattaattgtcatcgttactcaagattttttaggtgtagggttttagattattttagaagaatgaaattactactattaggctagttcagggcaatcatgtgtttatagtcccaactattatctatatgatacatactcaaaaattttaatttacgaaaaaaattaataacactcaatgtgtctctgaaaattaatggagatcacatggtagttcagaattaccaagtaacctgttttaatatagccccaaaggtgcaccaaaaattacaatgcataaaaatatagttaattattacgccagaattagtttgaaaatttcatctattttgtctttacgaagctaccaattgctactggggcatgcaaaagggattcgatcttgcattcccacagctagattaccaattgtgttattgctaaagtggcagtttgatataatacacatagtgacccctgttttagttggaatgtgatatatagatgtttgattcttagtatatatcaattagatatactcaggtagtcaggttccatatgttttaatttgtgttctagatctttgaattaaaaagaaaacaagtatgactgatcgagtgcatagattagttggtaaggattcagagttatttaaacttaaaatagtagttttgaattcgagtttcaaaaatacagctatatattcaaatttattagcgagacctctctgtcatccttaatcttacctggtttgagcttgaatccaaaatcaaaaggaaaacaaatttattgcattaactagagcttaaccaaatttatagaattaggtatcgatatagagaaattacaattgagttttaaacttgaatcaaaatattacaggagccatgcaatgtgcttaattattacgatttactaagtttgccaatacaatataacaccaaaaaaacaataacttcaaaagttagtgttaaa

SEQ ID NO: 2300 - DNA, 1600 bp, Glycine max
  Soy_ogl_222 Gm01:49238201..49239800 Cluster 9
agtttttagttttaaaatttagtaaaattaatttaataaaatgatgttgaaaggtttttttcacctggaagcgaaaaactacatattatttttttttgtttttttaaagagtaaattaaaattaaaaaagaattatgattataaaaattctacttaactcatttagttacaattaatttcatttataaaaaaagttttttttaaaaaaataattatgtactgttatcgccatcacatgcatttcgatcgtattattttctattacgattaaaagtaacataagacagccaaacatattacacatgtttcatgattaatgaagtcacacaggattttagccagttgaaaatgaaaacaaacgggtttcgttgcctcaagattacaagcatcaactcgaaaatataataattaattatcggatttaatttttacatactatgcatcagtataaagatttttattattaatcaattaaaaattatattagttattatttttatggctagtttggtttaaagaagaaagtgcaaggaaagaagggaaaatgaaagaaaagtaatagaaaatgtgattttttaagtcgtttaatagaaaagaaaatgaaaggaaataaaaatatttattttgctcttattggttgtgtagaaaatgagagatggtaatatatctgtgcatgtgtaaaatgatataaatattctaaatgaaaaatgagatatgagatgtaacataaataaaaacatttttactttatacataaaaatagttttactccctttcttttctgcccaatttttgtcaaaaaataaatttatgtgggactcgtttctatcctttacataacgtctagtgatattatataaattaaactaactaaaaatgtgaaattaaattggatttacagaaaacattataattagaaatcattaaaattaaacatgtgtactttttaaatgcatacgtaaaacactgcggatctgataacataagcatcctaaaatagatgaaggcatgatgaaccatatcgttattgatagttgttttgctgcaaagtaggtatggaatgggtctcacagtcttatcttccttccaattttggatagaaaagaaaagagagaaagctcgtttttaatacatagataaaaacacctttatttttctcacatctcattctttttttacattaatttatacatatattgtttatttcttttatttcactttcccacacacacaaaaaaaaagaatttatcttttttttccttttattttcttttctatcgaataacttaaattttatttattcctatatcactattttttttatttcctaaagcaagcatacctttaagatttagctatctctcacataacaaacttaaacttgatacaatgcaaaaaaaacattttattccattaaccgctcacgatccatgtgaagttttccaattagtaattgaaatcaccttattgccacaagcacaacaaattatgaacatccatttaacattatttatgcagacatttggggcttgaaacaatacggtcataaatattttccaaatgtaaagttggttacaacacaaaatgcagatattactat

SEQ ID NO: 2301 - DNA, 1400 bp, Glycine max
  Soy_ogl_1378 Gm04:43934701..43936100 Cluster 9
attttgttttatccaactaccaaacaagatattttaattcaaactgatttcaattcttaaggctatttgagaagtctaatttccatctcttgtttcttcaagataatatttttactgtcacttttattttagcacaataaataaaatatagataattacgtcatcaattattaaatttaaaaaagaatgaaaagatacatagtgtggttatttttaatatgaaaagttagttaataattataagtaaaatgatcagtgtttgagtcataactaattagtaaattataaattatttttataaaaattgaggaaaaaatcttatataattgaaaaatactaatacaaattatgtgaaaataatactagtctaacgagtattttagggactaaaaatataaatcatgacaaaaatgagtgatcattttgataaatcatcttgtctaatagttttataataaataattaaataaaatattagcttgccatgtggatgtcaatgtacatatcatgtacataccatgagggggaaataagtattgagtggtgtacatatatcttcctaacatttttttgtaatactttgtagaaaaaaaagtaaatatattcttgaaaacttaaataatatttaataccgatatgtataattaataagtaagaagattttgttgaaagatttagaattattaagtatctttacctcaaaagccagccttaataacatgccaaatgtacttccaccattgaattattttgatgttattgtactgcaaatgaatgattaacttagcagtaaaaagaatttagaattgagtgagtagttaactttgtttataaccaaaactctaaaaccattacattaattagaaatctaattaagaagttatttttcaattggcttgatctataataggcctctcatttagcggaccttttcctatacggattgattttgttccttgattttgggtatctttttcacaaaaggttgttgaatataggtctggtctcaactttgatggagcccaagttaaatcgaataaaacaaatatatgaaagctaaatttgtccatatgcattatataatgcatggcaagattcatgaaagtctacattatatgtatagacagtcaatccactttccccattcataattttttttttcatgattaaatcaagaggagtttaagttgaactacattcttgaaatcgacgaatttcttaatcgcattatataggtagctagctagccatatataaggactaggaaggggaaggagggtgatttcgatatcacactatgtatttatactacaatactcaaacaataatgtttttctattttttttctttatagagaaaaatatttctttacatttaattgagtattttttttccccaac

SEQ ID NO: 2302 - DNA, 1400 bp, Glycine max
  Soy_ogl_1459 Gm04:47259001..47260400 Cluster 9
agcctcagtttttaaaatcattaattgttgggttatgatgtcttgagagtcccaattcctagcctcgttcaaataattctataccttttttttttaattggagaagccaaattgatcgatagctaagtgtatggtttgttagaaccataaataaacaaaacaaaatgggttaagaaaatcagacaaagactcaggcaaagttggggattaaagtctgcttagcctacgtacaagaagccgacagacaacgagtcaacgatcaccgacggaaaaggaggatctttgcaattgattttttataatttttttgaaatgagactatttaaaaggttaaattattttttatccttaatttagttattaggtttgatttatctcttttatttttaaaagttttaactagattcttttaggacagattcaatttgatatctttattttaaaaaaatttgattaggctctgtatttttttaaaataggctcaatttagttacattttaaacaaaatttaaacccattttttaaaatgttcacaactaacataaggaaaatgaaactaaattgaatctattttaaaaaataagagatctaagtgaatcttttaaaaataaaaaagatcaaattaaagttactaaataaattaagggaaaaaaagcaatttaaactatttttaaaaagaaaatatacctattatttgatatttttttaagtaatttacataaaatatatttaatgcttctgaaattcatatttttcaaaataacccaatttaaacactatatattatatgggagggattaaatgataaccgtataacatattacaccagtcaatatttttataattgtaaatatagaacaattattaaattgtcatgcatttatctgcattatatgtttcacttgctatgaaatatgggtgttgatgatacgaaggtcgtgataagtaacaagagagatatatactaatgaatattggtctaattgataaaaatgtgattcatctcatacaaatatgaattcaaattcacttatcatcattgtgagactctcgtttgtaaataataagtaatttgtaagtttttttttaagttatgagatcttatctaatcctaatgagggttgaagtttaactcatttaaactttgtattcacaaattaacaaaaaatagattatttttcttgtcctaaagtaagagtttggcttgatttagtttttaaaaatctgtacccgtacaatttaatttgtaagtttattaatttcataaaagattagtgatttaaatgtgaaatcgatcaaatttaaacattaaaattgaagttaataaacttgaaaactaacataccataattctgtcataaatttaataaattctaatattaaattaatacaagttacaa

SEQ ID NO: 2303 - DNA, 1600 bp, Glycine max
  Soy_ogl_1473 Gm04:47635501..47637100 Cluster 9
ggttaggaataaatacagctggtttacaccagagaatgacaaatcacaatagtattacgttagtcagctatatgccgtgagcttagcatcattatatatataataaaaaaggcagtataatttacgcatgtatgctcgcataataaaacaccaggaatgagatgagcaaatagagatcatgacataagtaaagctttgatgggaacattattcagaaaattgtgcaagactttgttaacgattaaaaacgtaattaatcatatcaagcccttcgcatctttccttcagaatttgtatatgccattcgactcttaataagagaagttttatttaatagattttctctctctctctctctctttttaggatgtttcttcctgcaccctataagtctcaaacgtcatctgctttttttccattctaaaaaaataatccaagatgtaattttattggaaatttatggattgcagcaagttgcagccttgtttttttttttttttttttgaagttgcaacgaaggtacgggtggaaaacgagaagtccaacaagatgttgaatagagaaaaaaagaaactagcccaccaacaacaaacattaccactagtccacaaaatggtgcagggcttacagttttttttattattgataaatataattttttttttgttgttaatggggatttgaatttatagtctttttatcttttttttactcttaagttaatcttataatttctaattttttcataatttaaaattaacttaggcataagttaatttgcagaaattttattatatttttaaaagattattttcaacttatacaaagaggtgaaaataaactaggtgatttcaaaaatcttttagacctaaaaaattaacttatttaaaagattaaataaatatttattgttagtatttaattattataacaaagttactttaatgtattaaaatattagatgtgtttatctttttaaatgttaagtatgttgatctatatgaaatagtcaagttaaagtttataatttactttattgaatgataaatttatgtcttgtttataagatttattgaaaaatatattttattctctcataatattttctcatgaatattcttaatattaaataaaatagttttattattatcctaggtacatctgaaaagaaaaataaacaaataatttgtattgaaaaataaatatttttttgtgaaaaaaactcattcattgcaattaactgttaccttattagaaaatttatcgtatatagttgattttaattacaatttctgataagcttaccaagttttaagttaatcgaaaatattgttccactatacctgtcttttaaaaatagttaaccttatgttccactataagcttcaacttattgaaaaaaaaaattagaataaataattacttttatgagtgtgtaaagcattaataaattgattcttagattataaaaattcaaattttaatataaaaaaataataaatctaatccatctattaacgcctctttattaccatttatcaaccgtccacagggatgaaatcactacttgtcttttttttttttttttacgtcacatgta

SEQ ID NO: 2304 - DNA, 1310 bp, Glycine max
  Soy_ogl_3636 Gm10:48963391..48964700 Cluster 9
tagatacacataagaaaattaagcataccaacttatgtaaactaatgtagtagcatataaaaaaaagatcagcagtaaaaaaacagtaaaagaaattataaaaagagaagggacaaagctacatgtgcatatggataaaaaaggactttgcaacctaatatattttgcatgatccaaattcaagattgaaaaaaattacaacaaatgtatataaaaggtataagaagttggttaaaaaaatggtataagaaatagaaaaagagaggaattcactcaatcatattcatactatatacaaagctaaaatttcaaagaaaaggatagaagggcaaacatgcaaattagaaaaatactaaaaataatccaaataaatccatttgaagaatttcttgttactttttgcctcattttggatccaacatagaaataaatagataagaaggaaaaaaaaatagaaatacattcaatcatatacaaataaaaatttgtaaaaaatatgaaaaataactaaaaatgtcttccaacaacatatatatttgttaagtagtaaagaatacacttctcttctctgattgagagaattgaaagagaagtatttaaatagaaattaaattttccaacatatggcataacaacaattacagatatcataagcaaacaaaatatagatatcaaaaaatattttaaactattttatttataattaatatttttttgttgaaatttgtaactaatatgatatctctaattacattattatcataatatattttaaactattttttttgtgaccatagtattttaaaatattttaattgtaattaaatagtgcacgtattattaaatgatagtttaattgtatcttttataattgaaaattattgttttaatgcatttaaaattattaagataacctcgaacttttatgagaaaatatgaatttgtgtatattattttattaagattaaatatgaatttgttatttttagtttttaaataaaaatctgatttttaatcttcaaacttttgtttcattaatattttagatttgctgtcaaatatcacctttaggtgacgatgtacattatttttattaatattttattgtatttgtgatcattaatttcgaaacagttaaaaatcagaagaaaatatttatctaaaataaaaatcaaactcatcttcttccaaaatcaaatccagcacaagaaattaacaaaaattattccattcgatcacatataaccgaaaattgccaaaagatatcatgatgtgagtgtctaccattaccccccattcagggatccaaa

SEQ ID NO: 2305 - DNA, 1254 bp, Glycine max
  Soy_ogl_4908 Gm15:8289001..8290254 Cluster 9
agcttgagcaacttacaattcactgcaaaatgaaaagtgaaaggttaaaaaaaagtctaaatgtttgaattgaaaaacaacgattttggaatatatacaatacaagtagttgaagagtaattagcaatggatgtaaaatcatggattaaaaatagaaaaaataaattagttattgttaaagagtaattatcaaccatcaataactgtaaactatgacaaaaaataaaaataaataaatttaaatggagataaatatctctgaaataatcttaaacacacagagagaatatacatgcaacatatgcgagagcacaacttttatatatgatcgagagtgaaaaaaagtaaatttgggtcatgtaatggtcaagtttaacatcatataaaaagttatgtgattttattaaatattgtctttaacatttttgatattgattatttataatgatatctaatttttaatatttattctttccactctcacgtaattttcattatttcagtacctaattttctcgtgtgaaacgtggagagagaagaagattttacttttatatgtgataattgttttagtttccagacacgcttaacaacggtaccgaggagaagatcttttactaattaaatcttctgaaaaatcctaataattaatgagaaagatatgtctgaaataatgagaagaatattttaactttttagtggaaaaaagtatctctaaaattatcatctgatgaaataatgagaattttaagtggagaaaaatatctaaaaaatactcctaattcttacattaatataaaaagattttttttactattgagtgtcaattgaaagtaacataagagctattttttaaagtccattttctgttggccatgcccatgggggtatttattcaagagcaacataaagtaaaattatttttattagtattatcctgataaattttattttatcgacatattttttaacagaaaatattaaaacataaatcatagtatagatttcttttattattaaacttgagtttctgatatatttttttttccaattaacttagctttgtaaattttaaatttaacatacatttactctgctcaataactgtttttatatattaagtttaaatggtcaatcattaaattaaaattttttattgaataaaataagtctaaattttttcatatgattttaaatttatttatatttattaaataaatataatatatttaacggttgaatcattgaaattta

SEQ ID NO: 2306 - DNA, 1400 bp, Glycine max
  Soy_ogl_4936 Gm15:9110501..9111900 Cluster 9
attcggtgattaaagaatcaaacagtcagcaaagggagagtaataataaataataaaaattaagtaaacgttaaattttaatgaatcttttttatttggctgataaaaaaaaagtaaacgttataaattcctaacttctatggtatttgattaaaaatttatcataattagttgtacatctttaaaaaaaaactccaatcatgataattcctataaaaaaagatttgtcgtgagttaactgccagtttctgtctccaagttttaaatttgtctcacattgcttattttttgtctgttatggtagaaatagtaaagaaagaagagaaggagaggatgggaacgactgaaagatagaaaacttttttcagtttgttacaatggacataacatttttttttttcttttagtctaaatagtaaattccaattttagtctctccttaatggttgattgactgacgatttttattttcttttttttttcatttttgtttcctattttaaaaaaaaatagtaacttagatgaatatcctaggtgattcaactgactcaaaataaaaaaataaagcatatgtaaaattgaggatccaacaaaattaaaatttgtgaaaaataaaaaaaatcatattcacaaattaaaaattaaagaaagatcaaaattataatttattaaaatattaaaagaaaacttcagaatctctcttcaaattgtgaagaaaagaaaaaaaaaatgaatactataactatacaaacacattactacttatcttgcagttgagtacaacaacactttggtcattaacaatgttaaaatatatttttttgtcctttattttttagtaacttttattttagttgttgcttttgataaaaaaaaatcataatttatttgtaaggaaaaaaagctaatcccaatagtacaaaaaaatgtttcttactttgataattaatcatattgatatcttgaaatcaatatagtatttatgcgagatgatgacatttttttataatactaagatggacattttagatctattgacagaattgatttgaaaaatattatctacattggttatatgaaaacaaatctagaatgtgtttctacattaatttttcagtaactggtctaaaatatgaacaccatgtagatgtcacgcatcgtcatatatcatgtatgctacacaaaatgtcatgtgatgtgagtgacatatggatgctatgtggctaccacgtcactcaaggtgtccacctgtattgtgttgtggtgtacttgctattaggcacatcaatcgtaaagttgaagcaccataatttgggtaattcaaatgtatttggtttcaaaaagtgaagaccaaaattaatagtgagtcatttttatagagactaaaaatatcattagcc

SEQ ID NO: 2307 - DNA, 1522 bp, Glycine max
  Soy_ogl_5493 Gm17:3703079..3704600 Cluster 9
gtaaagtggatcaagacacgagatgaatatatatgtgcaaaatagtacagatcatgggtttcttgaagaaaaggttcttaaagttaccttaataaaagtattgaaagtaagatattattgtatactagtttaaattttatgtatataactctattatccataccgatgatctctgcgtttcagaaccagctattcctttgccgtcatattccagcagacacgacacatcaatttgttttggttcctttccgacaccaaccttaatctgtatactaattgttctttgaacttaatgaactagtttatattaatcaacggttacctcaaggccttgacatggatatacttttttaatcaatggttctattagacgaagaactaaaaataaaaattcaataaaaaacattttatatactattttttaaaaacatttttataatgcatttataatttgtttaacgaatactttaaaatcattagtcaacatataaagtatataataaaaactcgataccacctttttaatttgttttattgaatcctaatcaccaaaatgtgataaaataaacaaactaatgttttcacgaaccaaataatgatacagaaaatttaaaatctatcgaactcatccttaaagtatctataatatatgattatttaaatgagttatttattcaaaatttatgaatcctataatattaaatagatttaaaaactttataaaaaaatttattttaatattaaaattgttagagtgaatacttgaatcatattaaattttgtaattgaaaaataattctttaattgataaaaataaattaaacaactattttagtgtcaaaccatctaatccaatgataaagaattattaagttatattacttaattttaagccattcatgaaatactcgcattacagatgctcttacctgcacccaaaaactagactgctaatcttgatcggcttgtgacggctaactaaccaagctaccatctctttaatagattagggcatgtttaacaatgcttaattttagacaagtagttgtttttcaattaaaaaataaaaataattatttcattataataaattaatttaagcagtacatatatttagtatgtaagtgttcattaaaaaattattctccctaagggactctcatatagttgtataccgtacgtttttaatatattttaacattaatatatacccggaataattctgtaattatccatatataatataattaacacaaagttttaattcaatgatttgtatatttagtagggtacataaaaaataaatctcaagtgccaaagaagtcagatgaatgattcttagaataaattacacttacattccgtaaaatttatttgataggtgttctcatgtaattgctctcctatttatttaatgaggattatttgttttttttttgtcccattgtgagatgtataatttcaatcttaattttccttctgattcatgttcacctcttggaactgtttccttatttctctc

SEQ ID NO: 2308 - DNA, 1754 bp, Glycine max
  Soy_ogl_1223 Gm04:4439147..4440900 Cluster 9
agtgatagataaataaatagagatatagataaatttatttatattatattatatatacaatttcagtattgtttaattgcagtattctttaaaaatattagtattctaaaataattaagtatacgatataataacaaggatttttatgttaaaaatgaaggttctgtattttttatttaataatctattaataaaagataagtgtaacaataaaagactaattaaaaataacaaccgtataataaggacaagagaaatatcaattatgaggaaagaaaaaaatagataataatatattttttaactaaaaagaggaaaaaataacaattttctctcttgagctttttgatcactttaagtttttctcttatctttttttttttcattcgaataagcataagataacggtgaataaaaaaaaatctgtgataaaaaattaacaaaaagtaaattattttaaaaatatgcatccggcaaaaaaaaaacagcatgcctttgattttgattacaaacattgtagcgggatatcaataaatgatacggtaattgatatcaataattttttctatcaattatcactctttcatatataagatccaattatgtaattaattaagattttaaaaaatagtaattaatttaattgataataataaatttaccctaactttataatttttttaagactatctaaaactatcttttaaggttattttatagaaataaaaaatacaataattttttttattttaattaaatagttgtgagattttctattttattctttttttatttcacaataaatgcatatataaattaattaaatattaagagataaataataatatagtaattgataaaagaataattaatataatcttaaactttacaaatcacagttagaacgaacattctccaaaatttgactattataaaggaatagaggttgtaataagtagttaaacgtttgaacagaatacaacataagaaatgttttatttactgattggtttatttgtaagaaaattatttccgtaaaaatttaagagatgattttaagcattttatagaaaattttattcgtaaaacgaaaacaattattaactaaaacgattttataaataaatcaaaattagacgtaaattttagaaggtgacaaaaattaatttcattaaaaagtaaaagcaagtaacacaaaataaaatcattttattacttttattaaaaaatactgggtgaaattttagttattttctttaatcttctccttacatcttgccatgcatgttacatatctctaaaaaaagatgtattgaatactacgaatcaatgtctctctgtgctcattgtgtggttctgtttttttattatatatcgtttaataaagagatacaatccttcaaatgacttttggtaaagaggtgaatccttttatgaaagaatacacattttatgaaagaattaaaacaatgcttatttacatgtttttatcaagagaaatatattttcatgaaaaaactcattttcattaaaggatataagatttgatacttgtactttttcatgcactcttttataataggtatacgaaagaatttcgtcccctaaaaataataaaataatcaaaagattcgtgaaaattcttatttgatcaatttaattaattagttattgaacttaattatttattgtcattttaatctaaaattatatattaatattttcatttaagtcacgttttttaaattttgaat

SEQ ID NO: 2309 - DNA, 1498 bp, Glycine max
  Soy_ogl_4103 Gm12:35873401..358398 Cluster 9
ttgaaaatgcaccaatattcttcttttacttttatttcattttataaattttatttatgacaatagcttttatactttagatcgaaaagtatatgtttaattactttaattgctctaattacttaattgctcatactaattttaactataatcatttcatgtttacgtcattttttaattatatatttttggagtctccggtcttaattgatttttttcatccaagttcgaatctgttgtttattggattaatgacatattagatatgtatttttggttttaaatcgtttttaatttgatagataaattaatgcatataaaatagctaatgtttaattactactaatcattcttaataaaagtgttaaatttttgtccccctaaccaaaattactagttctgtcctgcttgtacgtgtctaccacaatcactcaatcgctggcctttgattatcaccctcaaaataatttgaagtagttgaggatctaatcaatataccaaaacccacgtccttgttcgaaacatttatcaattaagtaattaattattaaacaactttttgaaaatttaaaaactctgttataaaaaatatttaaaaagaaaaatctttggggcctaaattagactagtctaaatatgtacataatatattttacttcagagtttttttttttaaattataaactttcaaataattttttttactgagctttcaaataatatttaaaataaaggtaattttttctttgttagtattgtctattataaaatatgcatttatttcaatggaacaattgcattcacagccgaggacaagtcaatacttaattctaattgagaaattggtctaaacatgtgcaagtgtgcaacatattaattgatttaagccaaattctacctaactattaattcccgggtccggaatgggctttatttgtgaatttacaaactattccttcaacatgcctaagtccaatttataaggtttattaatttattatgttaaaattataatttttaattcaggttgttattatcattttgttatattaaacatattgatatattttaatgtgatagattttattttaaaaaataaaatcaatttttttcttttaattttatacatttttcactttatacaaaatatattttttaagttaatatttaggttcgtcaactggtccatttactttaatcttacaaaaaagtccattaatttcatgaaccaaactgattacgaatcttaaaataaaattatttatttcatgaatcaaacttacctaacctatttaaaatacaaattttacaagaaccttaaatgaaccaaactaatttctctaaggagatatataacaaaaattcttaatatttcttgaacatccttaattggtgctgagctaattataacacaaagtcgtatttctttagtcaataaaattcaaaaagtatatcaatacgagagaattcacattcataataatagacataattattg

SEQ ID NO: 2310 - DNA, 1518 bp, Glycine max
  Soy_ogl_5011 Gm15:12374201..12375718 Cluster 9
catttataatcctgctatagccttatgtctgtccattgcaggtacacacataaaatgatcaatattcggattcattgatgtgagataaagtagctatttggtacaaaacatcgaaaacagtatatatagtttacttttagatacaaaaatttcttctttacattataccaccaaaaaatattgatagttttttttttttgagttcaatgcataactatggctggcatatttcaacttcaacacatcgcattctttcaaaggcttcatatagttaaaaacagaaggaaatcaactacttgtcctctttttctaattacatgaaaatgactattagattaggactgtcatggtagttctctacctttaatgattttttataagaaaaaattaattaaaaatagagtacaaattaaggtactctaacctttaatgaatgattaatttctcgtaggttgaaaaattatatattttcaatattttttttattctgtatatatattcaacgttagtataatatacttacctttttctaaatgcttgttttttaactagtgtgatacacgggctaaacaaaagatttgaatgcttttatttagattaatttttttatttaactataaaaataaacagagacgtttaataaagaatatgatattttttatttgatttttttgtcatataattaaagtaaatctcgtatatatgttataaaactatgtgcacatttgaaattttgggtctataaaaagaatatgtttaaacaacttttataattaaaagagaaaattcctacttttgatgaaggacaaattattattttcttattaaagagtaccatcttaatctacatcaggatcattcacgtttatatagaagaaaatgcatctttaaaaaatttccaaatttcgatttaatgtcacttaatgtattccactaatcatgcttgtgacaaaatttacatattgacattaaaagtaaacttaattgatttcaaattaattgttattggtgcacaaaattaatgttatttatattaaaatctttacattagacttattatagtatattgttatattaaaatctttatattagactaatcaattccttaaaaaaattaacataatcaatttaaaatctttaacgggtaattagatgtaataaattatttttttaacgtaactaatatattttattctgttcaactatatttattaacaacatttaatttggcaaccaattagtattaaatgtgtgaatatgatttgtaggatttttacaattaaattaaattaaatgttataaatttagttatatgcagcaagtgcatatataaatttaaccgtaattttttatattttttgaataaggtattcttttattgattcgtaaatatatttttgagatattttgactcaatcaaacgatcataatatatttttaattaatttttttatagaaaaataagaccaatgtctaccatttttaaatataaaataatttctttccttgtaaatgttc

SEQ ID NO: 2311 - DNA, 1700 bp, Glycine max
  Soy_ogl_1749 Gm06:714301..716000 Cluster 9
agtattttagcgtataattttttttttttacaaaattaactaataaaacatattattttaatactaagattaactacaaaagttaataaaataaaaaaatgaattaaaagttccacattattgttaaaaaaaatacataaatatcattcaaatattagttatgaaatataaacatatgtaattatccgtgcgagaggagagtatggatgggtgaggattatatataatatttattctttgcaaaaagttgtagataaattatttaggttctcatacacacccatactcaattgatgggtaacgaccttactcattgcatatatttttttgtgagtatccattatattaaatttgtattcaatgatcatttctatcatttcatccattctaatcttatttcatccatatccttatttttgggtaactccttatttgatttgaaaaggggggtgggggtggggtggacaagtgatttattaccccatcctttcgataaacaaacaaatcatcatgatcaagtattcaaattaatgctaatgcagtcttcaaagtttaacttttgtttagttaacagataaggaaatggtgagtaagaataagagtagaaaagagggaaaagaatttaaagaaaagagagtaaattttgattgagtgaaatagtaaaaaaaaaaacaatgaatttatgcaaaagacaaaactacttcctataacaaaagaaaattcactcttatatatgcaatgagaaaattttcatacttgtactctcttctcctttctctctctttccaagatgagaaaatttaatttttctaatggacttgcattgtatattgtgatactagttaaataaaaagtgatatctacaatttttgtttataatttttaataaatttcattctgtgttcaacaaagtttttgtttttctttatggtaggcagtgttttagttaatgtattgttggtatttctcttgaatatatatgatggtcgcctttatatgtggacaaaagctataaagcaaaatcgcaacattgattaacatctcaaaacataatatacacacattactcatatcttgtgttttaaaggtaaaaagataacggacaataattaatgcatttccaaaaatggtttttaaaacatttttaaattaaaatgattttttgttgaagaacaagaaccgcacctaataattaatgcatttccaaaaatgaaagacaaacataaattcttttttttttcttaagaaactaaaagcaaatgtttaaccaacccgatattttttgttttgtccattgatggagaatatgagatgggagagatagggaaagctatatgctgaagaagtatactatatggatgttgttgaaatgtgcatcttatgaaagttgaaaaggttttcacgaccagaaacttagtggaacttgcctacattctgtttgttatgtaggttgcataattcacatgggtcacataagtattagaaacatttaacgatgaaatggggacccgattgtgttatgtagcttggccttataaatacggtgacccctttctcaatgccagctcagccactcaatgcttccaacttgccaattatatactagtactttcttttcttttacgtaaataaatataaatgtgtcattgtacaaaacactaacacatttaaagaggcttgtacaatttgtctcttatttt

SEQ ID NO: 2312 - DNA, 1463 bp, Glycine max
  Soy_ogl_3014 Gm09:5539238..5540700 Cluster 9
gtttctccagcatttttatttgatcaaatatttgtaaacttgtcaaaaaattaaattgacaagtttattgacaagtttttatcttagttattagtttgttagtttttaatagttttaaaaacaaaaatactaattttgtaattttaaaatttaatttgaattatactatttattttaacttaacatatatatttttttagtgggagggggaaaagcccaagctaaaactcactacctacaatgctaactaacaaaggaaaatgaacaaggtctgaagctatgtcaaaaagcctaaaattagtatgcagaaatagtctaatttacttccctaagaatatcgcaaaactgaataggctgtcctgaaagtatgcactgaataattggctgtttcaataaagtggagagaaataatagaattggtagaattcatgccaaaaagccgtcaaaagtaaagagaaagagggaaggaattagttaatttgtaaaaggacctgatgaccaacttgtttttattttatacttttttcaagaatatttatgtcattttatatatgttttacctttctttctttttattttttaattaaataatctaaaaaaatcacctaattctctgtctttattttttttctttcctaaacaaacataccgagtgtaggaaggataaaatttatcacaattttaacaatttaatataattttattatattatcacatttcacccaaattcaaaatcaaattatttctggaattccggtagtatgaacttacaaagcctactttcccatctgtcgcgtgtgcagtgtactcactgtttcaataattagaagattggactttggaccagatttttttgttttttggtatattacatgatagagaaaggcacaaaaataattataattataataatatttattattaggctgtctatttctttctgtcactataaaccaataccattctactaatttggttgttgggcccggggtaggagaaagactaataatttatataggttgctgaaaacggctaagactagaagcaccaccacgaacacatgttacaagcgcatgatttgtgaaatggggagaatgattgatatgggttgactatataataaatcatgagaaatgataattcatatccttatgatatagattaaaaaattacaaaaaaataaattagtattctatatttttataataaatatttttttcttttattattataacataaaggttatatgctcgcatatatatacctttatactcaagtttgacatgacactgtattcataaaagaatacttgacaaattgttagagtttcatatatactcaacaaaacataagcaaaggtacactacttattctatacacataaacacttcagatctaactaacttaagcattaaaatttcttttgtagatatctcactgctcattgagacatggagattgga

SEQ ID NO: 2313 - DNA, 1299 bp, Glycine max
  Soy_ogl_3831 Gm11:10600897..10602195 Cluster 9
taaatattacttaaatttaaaaatatcagtgcaatgcacagaaaagttattaatatattcaccaattccaataattaagttatgacctaggattatataaaaaaaaagttatgcccttgggattggaattaaattgcgggttgctcctagtcaaaaagcaattgaagtgataataaaacttttgtaattttgtctcgtggttaaggaatttaaggccacgtcgagtggagagggtcgaggggtaagtaagtattttgcatttttaaagtgatttaaccttataaattatgactaaaacatattgaaaatataataatcctcttaggatttttttgtcatttattttttctgatagtactagtaaacgttcgactgtgttttattaaatataaatattatctatttatattcttactaaatagattcgtaaattaaaatacaatccataaatactaacttcctttttatatataaactaaaataaaataactttagggacacattcagcaaaaagaaaaattactttagggacaaaagtagtactactctaaacttaaatataagcaaaagaagaaaaaatcttagagtattttcaatttaactgtgtttatataaacaatttaatttttgtcaactttaacttaattaattttttcttcaataaatatttttattaaaaaattgtttaacttataaatatttcatttctctctcttatatttaatatagaattaagtaattcacaataataattgttcatataatcaattctttcaaattttaactaattgaaaatcacatatgacatattaaaataatattttttattaaacaaatttgattgcatatgctctcagcatcaaaaaaatataaattagcataaaaagttgcagatgctcttatatgcattaagcttaagtataactaagaaatgagatgaatgaatttatctcatttttcttccatcaatctaaacaaacaagtgagaagaaaagtttatttttttattttcttttatttaactttaaaaaaaataaaaatttactaatgttctgttgtttttttttcctcttttcattttcttcctactcattttctttcccatccacacaaacttaaaccaaatttgtaactactaacaaccatttaacttagaataaaatgcacagcaacaggcatagaggggcatccatcagatgcatcaaatgaatatctgtcactttataagtatcatcaaattcgaagtcagtagtgattcatattcagtcatgctctcctcttagtgctcttttgattaat

SEQ ID NO: 2314 - DNA, 1200 bp, Glycine max
  Soy_ogl_5791 Gm17:39651701..39652900 Cluster 9
tttcttacaaaaagatacatcacaaaatttcctgataaagacatgtacatatttcattaattatttaacaaataaaaaaaaaccttgttaacccctgtgtcctaagaaattaacagataaattattttttatagcagtttatttaaaaattacatggtagcatatttttctgtatctcaataaaaaaaaaatctcctcgattcacatgttagcattttttcaaaagaaattaataaattgtttttttgtttgaaatcaaaagaataatattcgtatatgactttgtgcaattgtttttcgtatcaaacaacatttctcctatgcttaatggttattaagaaaatcatggcaagttgaaattgttgttgaaagaagtatctatatttaatgttatatggtgcttcaaacatattaccttttaaaggagaatgaatactaacggaaaactaaaaggaaaatcacagcaacataaaaaaaataaaaacagataatgaaataaagggaaaggaacaggtagcacacgaacttggagacacccaccttcctagcttttggttgggtaagccaaataagccattacacgtccctaacaactactattagggttgattgaccgaattgaaatacttttataagctaaataccaaaatggggctaatctaaacattttatcactatgaactttttttttttttttacctctaattagattaattctccaattaaaccagtgacttgtttttaccgttaattagtttttttcgtttttttttttttttgtaaaaaccgttaattagattaattgtcctggtgaaataaaaaggaaaacaaaatactgcctcaccattggacacttggtagtacccgactgaaccaacttgtagcagtgaaaaatccgtgctttcgttccatcatctctccacttttttatgctaattcggacaggtatgttattcttatccggaacaaaaaaaaaaaaggaatagatgattttcaatcaaacaaaaaaagactaggcacaatagagattgagcatcaacacttgaaaatataagattaattaaatgattaagaagaaataaaatgagaaaaaaaatcatagattcaatttttctttctaataaaaactaacatatcaaaaattaattaatatttgaagataaaaaaaaaaaaaacttttaccttcgttcttggtacgac

SEQ ID NO: 2315 - DNA, 1739 bp, Glycine max
  Soy_ogl_3838 Gm11:10837901..10839639 Cluster 9
tgagggttgcttctctgttgcattgctttcaacgctttcactgtttggaattctgtttagttgaatagacaccaattcacctcatttcctccatctacattgagtgctttaaaaagtgagattttccatttacaacgcttttaaccgatttccaaacacaccctaaaatctaaaattcagagtgtagaggcgacacccaatgaatcaaaacacactcattatttgtaccttcctcccttaaccactttccctttatggctttatctctttcaaactcaacatgtccacataaaccacataatccaataagccctcgatcacgttggaaaaaaaagaattttgtttggtagaggcacatcagagatgtccatcttgtcttaaataagtatgttatttacaccaaaagttcattattcagttaagaagatatctttcttctattttgtttggttaaaatgttttgttatgtttgaggaattgggaaagtggtgagatttttttttttttcatgattaaataggctaaacgcccagaaacaaaacggaattatatccgattcggagcttacaaatcaacatgtcatccataaaacttggaggggaataaaaaagaatacaatcatatgatcaatagacggcaaatttacagaaataggattttttttaaaaaaaaatttggatagatttttaaaatattaaaaatataagtaagtcataatttaaaatacaactttaaaatatcacaatttcttttataaaaaaatataaaatacttaaagtcatatttttaatcatgacttcagtattttttttaattacaattttaaacttatattttaaaatatgacttatatgaattcgtattttaaaacaccacttattcatatcttataatatttttaaaaaaaatacttatttctataatttttttttaaaaaaattaccccatttgtgtaaatttagctcaatagaataaccaaacttaaactttgcaaaagaattagcaaccttattgtgttctctcaagacaaagttccaaattactttcttagcttgacgcgctagaagataaagggaaggaacaatttgattgagatataaaggaatctcatctcccttttaatatgatgtcaattctagagaaattgttaagcaattattgcggataaattgttttcttttctttttgaccgaacaaaattttctgcttattttcttcaaaaagttgattttaacttttatgtaaattaatttcaacttgtaaaaaaagtttaattaattttattttcatatattttttataagtgctaactggaaaaataaatcctaataggcatttctttgtgcctatttctcttcaaatttagtgtagcattgaaaaactaactcccacattctggcaggaaattatcttgttaagcctatttcacattctcatgtttatattatctgcaatgatcttgaagattatttatttttgaatttgtctatttctaatgcttgcatgataatctagttacaagtttattagttgatggttatttacctgacaccataatattggaattttctttacagtatatgtagaagcatcatccaataatcaggtagctacaagctttactcaacaatttcgacaatttgatgaacgagcctatttatagttttactcaacaaattttgtcaggactagtttatttaaaaaaggaccaaaagaaataaacaatcaaagagtattat

SEQ ID NO: 2316 - DNA, 1300 bp, Glycine max
  Soy_ogl_1469 Gm04:47381501..47382800 Cluster 9
atcctacttcagtctcatgtcaaattatcagtatccatcattcaagcctatattttttgcaaacaataaaacaaaaatcaattgcataaaatctacattaattaacaagtaacaacataaatttaaaaaatgttaaaaatattcactttcttgtaattatactttcattattagatgaattttaatttgaaaaatattgatcaaactaaaaaaaatatgaattattagatgaattatcaacaaaaaatattgagtagtcgcctacattgagttatcaaggcttctttaagagctttttatttcaattttacctacatatatttacataatatcaacaattaattcacagtctttgtaagaaaaaaaaatgggtaaaaactccgtctttagttttatctttggtgttgtaccctctacatattgatttcacttcccattttaattataacaacctacaaatactaaggtagaaaataatataggttcaataaagatgatgtatgtgtagagttattataaaataacacaacaatcacaggttaccaaacgtgttatcttaatctcttacaacctagatataaacatggccatgttttcttcgaaggaattcctaattctaaatcccaattcaacaacctatcacaaacttaaacacaccaggaggtggttgcaagttatacatattcatgtggtcatagtccttgtagaccaagacctagcgcatgtgattgtcgggcccgggcataacttttcatgtcaaagtatatggagttattcaaagaggagaacgagttgactttcatgtcggagcatatggacgtaattatatatcaagttttagaatcttagaattgaatttaagcttatccaaaagttagtttcagtaaggaattattccttgtttatatattttaatttgactttatttttaattataaaacttgaattttttccaacatcaaagaaatgaagctaaaggacgcgatcaaggtggaggtgtgtaggactgagtacaagttggaggtagattttgtccctaacaaaatttctcacaaaaggtataacaacctaataatgaaggtagaaaaaaatatagattcaataaagtctatatatgtatatataaattattataaaataacacaacaatcacaaaaagattatgaattacaaattattaagtaaaaaattggtctctttgtggttataattatgaattaggagtattcaaaaaactatttttaattgaacgatatgaaaactgcattgaactaaactataaataaattgaattgttttt

SEQ ID NO: 2317 - DNA, 1188 bp, Glycine max
  Soy_ogl_1834 Gm06:72001..7507188 Cluster 9
atctgcctcttccaccatcactaataacttgtaagtgatagcagttaatgtacttagttgcatcacttgtatctcttatttttcgaccttagaggtaaaaaaaagaaagagattcaagaaaaaaaaatataaatttataaatatgataattgcatttgttatactaatttattttccacacaacataattttgaattattaaaaatatccataatatgataaaaaaaatacttgagacttagtttgactattagatttgatatagattaattattgtgtatatatatattttggaatatattttactaacaataaaataaaataggaagatgttttttttaccagaagttactttcttagttttaagacgaattatatatataagtttaaataaaaaaaattatttataatgaatttaactaaaaagtattcactacataaaaaaattatttataatgaatttaactaaaaagtattcactacatgaaaaaaattatattataattttaacatagatttagaataatagttaaaaaacaaagatatgatataatgtattttacaagtcctgggggcaacggctttttttttttttttttccattttacatgttatatttagtatctacaacattttttattcgctcattgtttatggggtttgtatcctcgccaatgctgaacaattatagtgggagagaaatacacgcaaaagagtcaagtgtttaaaaaactaacatacttcactcttttaagttttatatatatttctctcatcccggaaactaattagtgttggagagaatttatactcttgtttgtaacggtaaaccagtaaagagagattatacatttgttgatatgattattaataatgttcatgttctttagaaatcgaattaatgaggagaaaaaacatattatgttgttatgagattcttgctcctgatggtaaactaattgtattgggataacaaattatatatattgactgttttgttatgcagtagatcaatagaagggaaacactagctaatagctatgccttaggaaaaacacccaagggcatcaactatcaacttagacctaatagctagctgtaagacaagaataaagcagtaaaggaattgtctttcaaagctccttgcttagccaatcaatgtgcgcagttgttatcttctctcatttt

SEQ ID NO: 2318 - DNA, 1300 bp, Glycine max
  Soy_ogl_6640 Gm19:50103601..50104900 Cluster 9
ttggagctagaggacaattttaaccagactcaaattccttttagcccaaataaatgagtagttgcaacccacaacccacgaatgaatttgttccctttgttttgtatttaaattaataaaaattattgtctccactttatacacttgaaataattgtacgtctaccctctgaatacaacctcacaattttcacttttgttatatatatatatgatctattttttttgggacaggaaaaggatatagagtcgtgttttacttgtgtcttcatctttgggtaagattttttttcacgtaatcaaacagagggaaaaacctttactaaaagatttaatgatacattattatattacttaataaatttaacatctggcttttaaaaaaattcactcataatcaaatgtattaaatatagtgttaaactgttaatatgtaataagaatttatctcaaattgattgagtatgatgcatgaattcttataaattatctgtctttaatatctatgggtaaaaaaaattattaatatgaatgactaaaaaaaatgttcatatgaaattaaaaaataatgtaaatttacactattttatacataaaaaaataattaagaatcacacttaaatattatctaaatgtgtttttgacttaataaatttttagtttccctaaaatgtgttttttgatcttctatttttttcattttgatatttttttattattttagtgatgattaccacacagtctttataaaattgtaaattttataagggtttctcttatatagaaaagattttcattcttgatgtgagagactaattaagaaaaaaaaaaatagaaacacaaaaaaaaaagatgtagttttataagtcctaaaaacttattcaaacctttgattttcacaaccatatatacgattgattttatacttttgtatctatatagcattaacattcattgtatgcaaaaaagtatttgtggatagtgatctatataattattctttaaataatcaatagacttttctgcaaacatacatgaacaaggaaggcgatacaatccacatgaaatgggattgaaagagaagggaagacaatctttaaaagcaatagaaaagcatgatctatcagtccactacttaacctcgacaggctatgatgttaattataaatcattgaaagaaataaatatctcacagttaaatctcataatctaaaccatgtgtttgtcttcacgtctttttttttttaatcttcggtattcattgtttgtaagaagtgttcatagatagagtttacataatt

SEQ ID NO: 2319 - DNA, 1200 bp, Glycine max
  Soy_ogl_97 Gm01:3920601..3921800 Cluster 9
tcaaatatcaagaagctcaaaccatatattatttaaaattataatagaaaataagggtaaagcaaaaaattaatatttataaaatatagaacaataaaaaaattacggcttgatcgacagaaaaattgtttatgcatatgtataacatgtaatgaaaattaagagtaatcacgtattttttttaaaagaaatttgtcttaataatttatattttcaaacaaactcaaattactcaaaaaaaaacccatcaatttttaaggttttctataggaaatagagaataagtaataataagttcaaaatatagcttaaacttattgtattaacaccttaaaagtcagtttaaactttcatattttacgtttttaccagttgtctcgactaacgcatactctacccttctagtgttcagtttgaatatttgttctagcttttatagcaacagattaccattaaatatttagctggtgatccttttgttacttcacttgccttggagcatgcagcatacacgtacatgttgctaggattgacatttaagcaatgggaaaattcaataggttaagaagtgacatgagggaagaaataaaaattgtaaaaaatgaagttttttggttcagcacaggaatccttccttacaaaaaaaaaatcatatccaagacattatataagtgagacactaaatatgtggacacttcttctaacgagtattgtcacatattagatatgtaaatacatatattttagtgaagatttgtatcttgatatatgttatattctaggagactaatttcttttattaaatccaaactccttggttgtaaataaatgaactaatgtggttgaaatgttgaattaattaaatctttcaggaaaaaaatacttaacatattttatattaaagatgagacgaaattaatcggtaaggtaaaattatagctagagtaataatgaatacgtttaatgttattaataatctaaaatgagaataatttgaaacaaaatatagcttaaaaatgagagatattatacgtcgtggctcatccccgccctaaaactttccaataatcatcgagaaaactgaacaacaataataataaaaaagaaaagctgataatgagacatactaatataaattccctcaatgctatcaagcttgtgaaggagggtgtgagtgattgtcataagcatgcttccatt

SEQ ID NO: 2320 - DNA, 1143 bp, Glycine max
  Soy_ogl_4501 Gm13:36995458..36996600 Cluster 9
agtcaaaacgggatcaatttggcagaaagatataccatgcctaaggactggaaattatatgctcttattttatttggcaaccaagagttcagtataaattcacaatatgtcgtgtgacacgcacaagaatttattataattttaaaaaattgttaaaaagatattcttaggtaatttcttaagacattaaaataaaaaaaattaatgataattttcatttaataatatgatttttctctgcatcaaatatataatgaatataaaagaaacaaaatattgtgaatataaattattgtatacctcttcaacaaatttctcataaagcatgtaggatctttgtacttatatacgtattttttttctaatttttttttatcaaactaaagaagtagtgagaattaatttttcacttattatcttattatatatattcaaataatttatcttttaccaataaattattaatttgagtaaaattagactcatattttttaagtaaaatttctccaataaagattagtcataataaatcaatgaatatttcacactaataatatagttatccaaaaataatatatattttttctttatttcgctcgatcttacttttctttcttatttcttcattcactattatttttttaagcaaatcagagcattatgttttttgtcattgaatacttttaaatataaattagggtgtatttttgcgaatcagtagtgttgattgaacgcaactggcattaaaaaaaaaaatccctcgcattgcttttgcttttatgtcttgaacacatgttttttccgttgaacatcaatacttaactagacacacacttaatcataagcattaagggacatatgcatatagagaagtgtggggacaatttctcccacaaagtaatcttttgtactaaaaatgtatgagagataataaattggtactaatttttgtcactttattcttctatttaatttttatcattctcactcctcaaaatctcaaaaaatggaatgcaccacagtattgaatgaatgttgaatgattttttgtgacataaatagagatattttttttagtactaacaatgaaaaaatcaaaaaacattttcaaagaatgaaaatccataaaagataattataatt

SEQ ID NO: 2321 - DNA, 1200 bp, Glycine max
  Soy_ogl_6435 Gm19:38727101..38728300 Cluster 9
ggtgtcatatttaatctcacgttttttgtgattaagttttaggtaatgggattgtatttttttatctcaaatcttatatgattattttgtctctcaaatatatgggagtcgttaccgttgagattgttgagcagtggtaaatattttacgaatatttaataataattggaataagatacatcacatgataataattaagcagtggtcctgttttctttgctccacatttatcgtttcaatgtcactctgtttggagctttagtggacgagttaaaatctttagttgcaagtggcgattcaacaaatgttgtaattgttgtgctcttctccaaagtcaaaacttggaaaggtaatattatagtcataaaaaattagagtttttgacgtatcaatatgttgtacctgatgtttttattgaaatttgtattagggacaaaaacattagcagtacctttggttcatgactgatgttgaacccggacattcctgaagtcgctaaattgaagtaaaaaaatggttggttcaatggaaactcctattaagggattcaatcatgtgcaatatgtttccaagatgagtttggatgatgaattcctacaatttacaccaaggactactctgcaagcaatgaaggaagcctaccgcaaaaatgatatgaaggaggtgtttgactttgatattaaaagaagaaatatgtcaacaaatatccaaactatgtttaattgttaattgatgttattttttattttcaggattttacttttgtcatactactactataaattcttttgttggtgaggaatgtactactgtggtaaatgtaagcacatcaaagtgaaagatgtcaccaaaaggtatttaattataaattgtaaatgttctttgaatttaatcattttaaaattagtgttaatacttttaaataactcatacaataatgatgatttttttaaaactatagtacttaattgtgttttaggttttttttttctcaaactacccgtcaaagacgatacaagtgaggtcaagtttgtaatgtttgatgatgaaacagaacaatgttcaaacaagacttgcgcggaattgattgaagctgtaaacaattgtttatatgttttatttttttcacgattaatgaatatattatttctaacaccaactctatttttaagattggggaattctagcaccaagtctaga

SEQ ID NO: 2322 - DNA, 1300 bp, Glycine max
  Soy_ogl_933 Gm03:37688601..37689900 Cluster 9
attcataattatttttacgacttaccctaaaagaaaatcaattcaaaaagttataaatctttatttgatttctacccgaacccaaatgaaaattaattcaaagtcatgactactaataattacgacttatccttaagtttaattcaggaagtagtctcatttattcatttttaaataaaatgagcctggtaaaaaaaacaacccgaaatatgaactaagacacaccttttgaattcactatttcacacacacacacacacattcactctccctttctatcttttgttttctttttccactacgtacaactctcattttccttctattttaatttttttatttcccttttctcttgatccatccatgagatgaggtgtaagagaatcatttttctctattagaaattgatttataaatgatattagatatttccctcctcggaagagtgaaatattatcttcagtagaggaaaaatgatattaccaagttaaagaaatgaggttacaatgttacatcaattgtgtgaattggtatttatttttgggaagattgcattgacttgtcttaaggtgttgtttttttttaaaggccataaggtatttttcaatgatactcacacactccttttaatttgtaaaaaaatattcatctctttttagataacattaaagaataaccctttaagattccagtattatcttcatctatatctgacctgaacatcaatctctccacacaaaaaaaaaaaaatgcaatgagaagaaaaatgaaagaaacataatgaaagagcaaacactgtactaataaataataatacatagcaaatttgttgagaatccgagaacgcaaactattgtttttcctctacaacatacaaagagaaatacccataacaccttctttaacaaactattatgatcacactctttgttgttgatgaaacttataaaaaaatttaattttgggaatctaatctcactcataattttatactttctaaaattttctaactaatgctaaagagtgtgtgttgcctgcagtcttcacatgcaaatgcttttgccttcttaagaattgagggatgcaaagttgtgaaagaagttcaatgcggggtgtctgtcattgacacaacaacatttgttattttatgtgtgtcacttttgattaaacgaaataaagagagtttgtatcacatgattaaatagataagagtcgcgaattgcattttattgatgatgaatggagtttattgaaaaatatactcctgaagttttgtgaaattatacaattttttaaaaac

SEQ ID NO: 2323 - DNA, 1379 bp, Glycine max
  Soy_ogl_1840 Gm06:7933501..7934879 Cluster 9
taaatgatattttgtcctttttttctacatttttagtatcactaactactaatattaagtttattataatattgtacaacgtaatatgaaattttaaacatcttattgtcaagtgtgtaggaaattaataaaaaatcattttaattttgtatttaatctttaaaatttataacatttgtagtatatgccacaatctggtaatcaacactgacatctaacaaagtatttgaagcaacaactacatctctacagaacatataagttagtagtttttctctattatttcatcacgaccagagttcctttttgctcaccttgaaaactccacctttaccaaatagttatacccttagagtcccgagtacttaataacatggtattcttcttcaaatatgaaacatgcttcacatacccaagtcttttgacaactgcatcaaatatctattcaacaacaacaacaacaaaaaatccatcaaatatcttaattttgattatagcaatacctataattttaaaggaagtgtcaatattgcccatcaaaacatcaccattgacctcagtttcatttattaaaaaacaatattgattaggataaattatgtaacttacaaccagaataaaaaaaatcatcctcgcttggtttggagtcattgcaagaaactacaaaatgttctttatcactgcaactattttcttgcaacattcacttgaccagagagagtttgctggttgtttaccttggtgatttgcaattgtcttattcttgttttgcaacttgtaacagacaactatgatgtgatgtctctttcttttacaatatatacatgcaaaatttatagttgtttttagacttcaatctacccttttcattaattattccctagacatgtctcttgagttcttcctttagcaacaagaccctcttattaagtctcagagtgaccaagaagttatttaatcttctccttaaagagaaatgcctcataaatatcttctagaatatatcattactgtataaaatttaacttgaattggtaaattatttgaatttcaagtaaccagtgtttttgccaaaagagtcattaataatataatttagtgtaattctgtagtgccaatcaataaggaactcaaatttttaatttgtgttttattggtaaggttagttaggggcgtggccgcgtggagatcaattaatgtttgaagtattgaaaatgctacttgtaatagttaggtttaaatacatttttttacctacaaattttttttttttgttcttgtaaattttattttttcgatttaatccttgtaaaatatttttttttattttcttgtcgttaaagtgttttagataacattttgtttattatttttgcaag

SEQ ID NO: 2324 - DNA, 1200 bp, Glycine max
  Soy_ogl_6311 Gm19:993901..995100 Cluster 9
tgttgaagcgtttgatcgatgttactgagaaccaatttcaagagtacatagttttgttttggcaaaatctgtgcaagttgcattaacttgggctgagcatgttaggagggtttgatcctactgcttttagagaatacagaattttaatttatattgatcagaaagtagaatatttttttatgtttgctctatttccctcattcctttcataaatatctgctatttttccttcacgcaatctttgcttaatttaaaaaatctgaattttaacggaagagagaaaagaggaaggaaaacaaaaaataacttgctacttttatcatatcaacataattacaatcgaacatgtcaagtacagtctagttatacagagtttaactttcacatgcaatgctatcgtaaacaatttttcaatggtaactaattaattaattagaaataattataaatatatataacttttaagataattattgtaaaaataatcaatttatgatatattgtgaaatgtaattgagtaacggtttaaaattttgtttaattttgggcattttaattaaattcttaatcctaatttacaaattttctaagtttttttgaattttcaatattagaaaagtgactagaaactaataggaggaattttaagttgtatttgctttctattttaaaaaattctttagttttttaaatcaagaataaatcttcacaaaaccaacagaattcatgcctcagcacacaccactccaataattactcacacccttgaggtaagaccgcagcagaagattatggggaaaaaaacatcttccaattgttttttagttttttaatacttatttttggaaacaattttcaaaacttaatagactttaaatgatacattcattgttaagtattcattgttaagtaatgtgaaattgttttagaaaacaattttttaatacaaacaagtgagaagaaaatcaaaagttaaactctgattttcaacttgtaaaatttcaatcatacaacatgggtgagataaaacatccgtaatttctgacctagaaaaaacaagtattgacctcctcatatttctctctttatctaaacttctaaactaaacaagatttcatttttaatgaaaacttcccagcttttattttcttgcattttcctttacccctaaaatataagtactagaataaggaggcatat

SEQ ID NO: 2325 - DNA, 1568 bp, Glycine max
  Soy_ogl_2102 Gm07:493133..494700 Cluster 9
tttattacttatatatatatatatatatgaatattgtgcttagtagtgtaacaggagataaacgtgagaaaatgtaagatgatttctaaagacggcttctataaaaaaatttattaaaaagtaacaaattacgtcaaagtcgtctttttaatgacctcctatttgaacacgatttataacacgacttacttattcttgtaatttatctaaatttgatttattccttaattttgtattatgaaattgccctacatctctaaaaaaattcccttaccatttctcactgttgatcttgcacattataaaatgagactttttttattgtatagtccttactacctttgaacatatatatgataagaaattaaaaataattttttcattaaaaggtatttattgtaataaatgttaaactagcttagagtatatatgtgatttagtaaataagtacttagacatgtaattctttctctctccataagaaacgtggcggaaatacatcttttatatcctcttcaattttttttttactttcgtaatatatctggatgataaatacagtaaatattttagtatactgccttgctagttgctaaatgatccttactctactatacagtaaatattttataaaatgaaaaaagaaaatagttccatcctctaaaacattttccatttcagcaacttctctggtgaggactccagcagcggaacaaaccattttaacatatgtacacacacaaagaaaagaaaagtaaaacattttaaagcatatgtactacaatgtaagagtctagagtatgtatcctttccaatactggacaattccattagaagaagaaaaccatttagttcctttgtgtctgtatctctttataggaactatccgatactaaagaagatacatactccttctcaacatgaattcggatcccttcctgtgtctattatgttttctgtatcttagtttgttgtgcaatcaagtactgaaatctagcgtgggagttattattctttaggacttatattaattacttgagaaacaatactgcttgttggaggttaattgattgctttgaactttttttttatttttgttaacatgggattaggaatgataattatggatagaaatagtccgggttgaataaggatttgtttcaaaatcaacataaacacgtttctgtaaagagtattttgtaaaaaaaagaaaacactaaagaagagtagtgtatatagaaaaacttgaactgcatttaacaatgctctttaatcttttcatgttggaccttgcaggtgtgctcttctcttttcttcctttttaaggtttgggcttaaaataccttgctcattatgaagatctaaccttacaaaataaatcaataataataataataaatgcaaaaagataataagtaatatgctaatttagttatatatatggagcttttcatattaatcctatgtttctaattaagtcatgtgaatatgttgagaagattcttaaacctcttaattaagtattttcattagaacttaattttcatgtagtattaatataaattgtt

SEQ ID NO: 2326 - DNA, 1100 bp, Glycine max
  Soy_ogl_3186 Gm09:39078201..39079300 Cluster 9
cactatgaaaaatgaaagctaccccatgatgattgacgacgactatcaactaaagcctattattctatgcagaaatggatgggatgctttgagtaatattgagggggaaatatgagtaaatgtattcgcaaatttatacaatagaggaaaatagaaatattagaaaaaggtgttaaaacactaaaattatagtgaaggaagttagttctctacgaattcagattcaaattttcatagtgggaaatatatttatatttaatatctgattgtatctcgattattaaaattattttcagatgaatatatttgtgaggaaacaatgtataaaaatatataagaatcttatgaataatattgcttaaataaaaaaaaaaaaactagcatcttgcaagtgaaaggttaaaagccgagagttcgtatccagtaagcacggtggctatactgtagcaaaagtgcaaggcaggttggacccacaaattgccacaaacaaacaactattaaacatataactgctggtaggagaaaacttcatgataagatagtggagtggagtggccattataattgttttgaggagagaataaaaatgttaagagtgattgatggagtgctcaatagcaatgctgttagcactactgttctttgggcccaccaactacgagttagaaacttagcatctctaatgtagtttttcaagtcacttttatattatacgtaaatttgtttgtttttttttttggtccatacacaattttgttttattggtaagaaagttaaaataaaataaaattaaaaactcatatttttgtttttatgtacttggctgatactagtttatggaaagaaaataactttttaatgctaagaaagaatataattttttattgctaagaaaatttttttatataagtaactattgttattttaaataaacttataatgtcactaaactgtctctaatgtgagatttcttaacgatttattcttttaagaaacccattaaaaacaccttttattgaagatattctaagaattttttcacacgaatccacttcatagatgtggatcttgtcttggattctcttggttagaatttaaaa

SEQ ID NO: 2327 - DNA, 1400 bp, Glycine max
  Soy_ogl_4096 Gm12:35565601..35567000 Cluster 9
tttaaacttttatgctgaacaaacagttgtccacatatacaacaacaaaaactctggcttgacggcccaatagtgttgtaccactttagtttagcccactacttacatcctaaagttagaagacgcgagaaaatggaaaatggccagaataatctaacatgttcatgctatttataaattccatttctgctaaggacacccaattaccctttttatattttaattggccattgtaccctttttctttaaagagatataccccttggaaatcctttttattttccaaaaatgtgtttccataataataaatacctattccagaaagaaatttataatattagaaaatgatcgtttatcttatatcctcatatttattagttttattttcattctatcactaaaaatcttatctaaaaaataattttaattctatctttattgttccttaaactctaattttgcactcatattcatcatataataatgtatgttacatttttagaatgggtatacattattctagaaacacgtatctggaaaagaaaagggatttccaaggtgcgtatctctatggaaaaagggtataatgaacaattatagtataaaaatggggaatggggttgtacttagcaaaacttggaatttaaatagaagtaccgttcataaaatgctatagagaaatttttcgtttcgactcttcctgttttgttcgttcacaagtgtcataataatagatataagtcataactccctgattgacggattgcgttgtttttgctttaatttttcatgtaaagtaagagataaactctttataatatgtttggtttagtttctgaaaagcttaaaatcataattttgaaacttaaatcaaacgtgataattaatggtgttgtgataaatttgtacaatactctgtcacatgtcaacttgtggttttcttctttttttccccacacaaatgacattttggaaatctgtgtcaactatgagcacctttgaatgaatggtttaactgtatctagtctacattataataaaattatccaataatatgcacatttattttataattcagaaaaaaaattgataatattaattttgaaccattaaatatagtttaaacatgtacttaaattaattttaatagtaaatttttcattaatttagtatttttgtcacaattgcactatgccattgtcaatgcagcttgtggttaacttttctcccttccaaatggcatttaattaagtattttcaaatggatggttatttcacttatttgtttttttttctttacaaagcacgggagactgtcagcatgtttggttttgcagtagtactttagttttaggagaattgattcagttttttactttaaattttcacgtttttcatgt

SEQ ID NO: 2328 - DNA, 1092 bp, Glycine max
  Soy_ogl_1449 Gm04:46897809..46898900 Cluster 9
ctaaaaaatcagaaatgttactttttaaaaaatacatataaaaaatgaaaaattaagttttccacaaaaatcaaaaacttttctccaatcaaatatcccccgttactctcttattgccaataatgatttgagcatttggagtttgcatgtaccctgctaagattaggctcgtgtggactagaatttcgtttgattgttcctcctcttctggactggtgctaaacataatttaattgcgacatatatatcgatgtaaattatttttacactcatctaaaaatatatttttatataactaaaaactctaaactttagtgattgagttctgtaaaaaaaaaactttagtgattgagtaaattaatttaatcattaaagtcaaatgatacgttaaagtcataaaactacttaaggtcatgtgatttccttgttttaatctcaattaatcgtagtataatcaaatgatcaatatgttttttgtatcacttacataaaaattaatttctcattcgatcagatatgattaaattatacttagtgttaaactagataaaatgatatctccattttttttatttgcaaaagttaaatttgatcaatctaattattgaatcatgctatagtaatttcccaagaaaaaaaaactcacatgtgccattttgtcatacaaagtttgtttaccaaaaaactcttgcatgatagcactaggctaactcatttgtctatatgcgtctcaggtagacacacaatttcctcctaattatgattttgttcttctattttttttttctcctttcaaataagttggatagatttcattattgctattttggaatagatttttgtaaaaaaaataaattaagtgtataatgcttatatatattaatgtgctgcattaatgcaaactaatacaaagtttcttttacaggactaatacagagttaaagcttacaagtaaattccttcacccagtattctaaagaaattttttgtgcacttttaaccaataaccatatcataaattaaattagaatatgaaaaaactatgtgatcataaattcaaatttaaatttgttacttttgaattgaaaaact

SEQ ID NO: 2329 - DNA, 1200 bp, Glycine max
  Soy_ogl_3938 Gm11:37078601..37079800 Cluster 9
tttcttgttttcaacaatggtccctttaatatttagttccccgtagatgagcaattatttaacattaagatatataccatcaaaagtcctatgctagcaacgtatgtatccaatagtataatcattaattttaatttagcccaattcagacttgaatatggtcatggacaattgggccagctacattagagcaactgagacaaatgattatttttattttattttgatagtggtgaatgatttgtttttgtgtttaaaattggtttagaatatgatgtttatccgtaagctgttggatttgggacatgggcacggtgcacctatacctattgtcttaacgaatattgtatgcttgacatatagaattacatatttaaatggtcattgacattgtgtgtgcattggttcagtgttcaactctacggagtatccttccacattatttgagacaataagtgattaacagataccacaaaaaaccagaatgagaaaacttacaataacatgtaatttaaaagggtgagcaagttatactattttttttttttttttgaaaaaagttatactcacttttcatgcactttaggcacaggtagtttggatagtatatgcaaggttataagttataacctcaatgtaattattttacatgcaaaaaaaaaagtatataaaagttttcatcagctcattatatagtgtgttatactgagaaattagttcatttcatattcttacaaatacgatcaacgttaatagtatcaagtctcagaataaaatgcgttatacttagagaatttagtccatttcataaatcatcagctggttataaagtgtgtattctatctgtctctgaataagtgttatatttttttaaaaaaagtccaaaatgattattttgttagtttttttatgaaatattaattgtttttttccactaatatccttgataaatatcacttcaactttttgatgtaatattaattaaaatatttgtaaaactattattcacttttacatatttattaactttttttaatatgtgtagaacaatctaagactacacttattttaaaacaaaagaagtattacataactcaaaatactaattttgttataaagtttccatacaattaataattaatttaatttttaaataaaaaatatcttacttcatcctaaacttattttcatcatgttaat

SEQ ID NO: 2330 - DNA, 1202 bp, Glycine max
  Soy_ogl_897 Gm03:36344099..36345300 Cluster 9
catcttattattttgacattaaaattaagattaagataaaatgtggaaagttaaatattgtaaattttgttggtgtacactaatatagtaatatttcttaactcagcgccgaaaattaatatcttcaaaatatgaggtgtgtttgatacaaataaaggtgccacataaaaagaacaacataaaaacaacgctggaattattacacgataattatttattctattttatacattgtttaactgacattattgtaaagttcccgtgttcttttcaaattatggagaaacacgagcactactccatagtttctatttgatgtagttaattaagagagaggggggagacaaagagagagaaagaaggggatatgtgggttaggagagagaaaaaataagatggaggaaagatatgtgtttttttagtactttgtatttaaaataaaatgttgtttcataatttattaagtaacaaaagtaaaaaagtgttgacaacacaaattatatatcctattagttttcatgcttgatttgaaaagaaattatataataatataaaataaataaaaataaaaattatgttatcacataatttctttctaaatcaagtgagaaataaatatatttatcctagtatcataaattttaacaaatcaaatgtaacatagaaaatatattttgaaaattttaaacttaaaaacataattgatatatacatgtacaacatttttattgaagtggactaaactaaaatatttcactaacttgctatcaacttttttttttcagtgcaaaaagattgattaataataaggggcaaacaattgtcactgcaggtagtgcaattgccaccatatccgtgagttacagaaaaaagaaaaaacaaatattccagcaactaccaaaaagttgccttacaaaaatatcaatcccctactaaatgaaatataatatgtgtatcaatacacttgctatcagctttgttatatgggtacgtgttatcattattaatttaattactttgagtctacctctttaaatgttgtcgccactagaaatagttgatttgtcctaaatttaaaatactttaaaagatatacttgtatgaggtaaaattagattgtctgcatgaattaatcattaggatcctcgatcatcgctttttgaaatgattcatatcaattaattttataagaaataagtgtg

SEQ ID NO: 2331 - DNA, 1900 bp, Glycine max
  Soy_ogl_1891 Gm06:10303701..10305600 Cluster 9
gtctcatatttcacagcctataaaatctccctcatttgcatgcaagtttttatcactcaaaatctgctaaccatttcggatcggtctcttcatttctccttgtcaactacactcgttttgtgtatgtgttttgtgtttgttttctttatcttttgttcagcttgaatggtggaatatcagttgttattttttttttgtttatttataatttctgttttttgttggactgtgaaaaagaattgatttttttaaaatgctcgccggtttttttttttcttttgttaagatctaaaatactcggtccgacgatataattttttttatctacatcaattgaacataaaaatgtttgagtttttctagcagtataaatttttctgatggaaagccatttttctctctaaccgtgaaacaatgtaagaaagagacaggattgagaggtggaccccacctggatcctttgttatttttaatccaccagtttacatcacccaaattattctgccagtcaattatccattgcaaatttgtttggttgtattgattggtcgattgattcatttaatcctcaaattcttttttttttctttaactgcatttaacgtttttcttttttattatcatatcttaaatatcttattaatgtattaatttttaacattttttcttctttaaatatttaattataacatttgaattttttgagaaaaataaaataattaaatgttattttattttttaaagaatgaattgatgagtcaactcaatctaatccataacctttcaaaaattgagattttcaatccaatacaaaaataattaagttaacttgacttatttttccaacatattaaaaacaagtgagttgagttgacctgaaggatattcttaacatgaatcattatatgtattttttattaataaatattaatttatttatgaaaaggatttttttattctcttatttcttaactactcaatcaactttatattttgttaccgttatatatgaagttataatagaacatggtactataatgtgaaaattgtcttaatataggttggtcgatgtatctttttatttatttgtttttaaaaaaattattatgtgtcggtttttttataactagcgtatatgaggagtatgttcgaataaatttgtgtaatattattactccattatttatttatttataaattaatttttccttataatttggactattttctagtacttattataatataatattgaagcgtcattatagtgatataacttctagtatatgcgcagctacagatgcctcatatatgtcaattaattttaatcttaggcattgttttcaaaaacagttttttattttccacattttatttgtccgagtatatttgaaagtatttgtcacttgagattatttttatcttctaatagtttgtctgtcaatacttgaataaaatacatgaaaaaatagaagaggtatcttgtaattgtttttgtgtttttggtttttaaaatatttgtttcgaaaataatttttatttttgttttttcattgcggtgaagtgagcatgacaaacagcatgtgacactgaacaatacgcactcacttgtgtagcactgtagcttcttaaactgcttgattttgatttttgagacatatatatgatgccaattctctcactttcctttgttgataagcagatagataatatttgcattatggggagtggaagtaactgtattccaatcggtatcgtgtctagtaaaacaccttatgttcccaaggtgcttgaccagaaaagatggtcacgagctgaagctagagctgcagagctgattgcacaaattcagccaaactatgcatcagaagcacatcgaaatgctgtcgtatttaaccta

SEQ ID NO: 2332 - DNA, 1457 bp, Glycine max
  Soy_ogl_2309 Gm07:95327..9536523 Cluster 9
gactgttgtaataacgagatttcttatagtgatctaacccaatgacttttcctttcttattctttgctccccaccaaaagaatgctttcatacattcaatataatcacagaaaaaaaaaataaaagggaaattatttaagttatatatttatcaaaaaattcatctccaaataaaatgtcctactcacggatgcattgcaatttattcaacgacattaaaattacccaaaaaataaaattatgcccaaaatcgagagtatgacattacaagataatctaagataaattaatataaaaaatttgagggataagccattattttggtctcatgtaaatcaatgataatttattttatgaaaaaaaataaaattttaattttgaacttgaatatttaaaaagtgtaaagtttttatttttgcatgttagggactaaatcagaaaaaaaattccttcagataataaattatcactaatttacacatttaagaaccaaagtgatcatttattctattttaaagtgtaaaagaataaaaaaaatgcaaaaaaaaatattttaaaattattaggaccaagaattatctaaagtgggccgaaaatgggccaaaaaaagcaagcagaagtttggatcctaaaaatgagttggaaaaaaccatgcaatttgacccgcaacatgtattatctacaacaaattaattgacttatttcacataatttctccacattttgatttataaatcttagcatcattgatttaatgttattttttcgtgtgacccatacaataaacctgtatatatttcctgaaatcggatgaccctctgaattatttttggcagcaaatgtattgtcttttatcattttctcgtggcatgattcagagcttactatactcttgggaaagaaagaatttttctcacaaaaccgagacaagacagtgtcacctgaatttgtgaaaataatgcatgcatgccaatcattacagaagtattagtacacatgaatatcatacgcaaattaaatatctatgtaaatttagctagtaaacttcatttttttaataacctagtaaactttaaaacaatcattatgtctaattttgaagcacgaggatgtttttgttaattcctcatccacaattaagtttatatgtaaaaaatacgtgtataaaaataatattttcttaatagtattagtcatgttggttaagataattttaagaacttttagaatatgataattaatttagatttttttataaaataatttaaagtttttagatatttgatttttttaatttttttttaaaatctttcaaagattcttaaaattatcttaaccaaaagaatgtggagacaaattatatgaaattttaatttaagtcatcttctattttaatttaactattgatgttagttatattcttactctcccgaaataaaataactctcgtgtgtgtg

SEQ ID NO: 2333 - DNA, 1300 bp, Glycine max
  Soy_ogl_2969 Gm09:3456301..3457600 Cluster 9
atttcaaatgcttaatttacaatcatttatataacattttaaaggatttttttttcttataaagtaaaagaaaaccaacgaatttatgtattaattataattttaaaaaatattgtgtattacctaatttatgtatatgctgcaataggtagtttgacgaaatatatttaactcttaatttcggaaggttataattttggtaggttataattatgtcaaagtaaattaattttgttaggttataatgttttataaattggaacaatatatatatggttgattgattggtgattagcataatcaatttttgtaaattaatgtattaattagtatatattattcgtaaatgagccaagttttaacaaaacatcacaccacgatacatgttgtatgaacgctactgtttgatcgatacgtgaataccgaatgaaaaaaattattcacaaattttattctattagattagatgctgtagtagatagcttggtgaaataaatttaaccttaatttcggtagattataattttggtaggttatattttttcataaattgaaacaatatatatgtgattaattgatattaattaatatatttagtttgtagccgaatccagtttttacaaaacatcacatcacgacacatgttatataaatctagggagctgctgtctgatcatacatgagtatagaactaaacaattattcacaaattttaattagatgccttaaaaaacatttcaatctcaattcttttaccatcgaaccatgaatcaattgatattaataccagattgtttcacattaaccagtgattttgagtttaattcatgaatacataactaatataaatactagtgtgagaatttatcatttgtaataatcctacaattctcaaatatgattgtttctcgcaaaattaattatgggtttaggggtaaaaaatctcatttcctttaatagcattggcattttctctatacaatccaagccaaatccccaccgccatgcattttgtaaatgtgaggtcccctacgtagctttataagagtagattgacttgattagtgtcattatcatcaatatgctctatgcaatatgcatatatatcataatgaattgcacatttcgaagggttttctgcgtttcttgtttcttcttgtttgcaagttgtgttcagccccaggtacctatgcaaaagatatttttttagccgcaattgttccaccttgcattcgtaatatatatgggtattttacaccattatctaattaaggttggaatgaaaatctggaagcatcta

SEQ ID NO: 2334 - DNA, 1700 bp, Glycine max
  Soy_ogl_5192 Gm15:50406801..50408500 Cluster 9
tatatattggcctggaacagacacaattgaaaatgaaacccattttttgaatattcaatgacaaaaaattgcagttttaaaaagctggaaattttatataggctttggataaattttattaataagtttattacaaaaatatcatagtcaaatttgctcatagttgaagttcagataccatgtaaataattccaagagatgatagatcccttagtgccccattcaccttatgaatttcaacagactggatttttccagggaaaatgttggcaacatggtgtgtcctgtcgcataaaacatcgtaaaattattcagcagaacatggtgtgtcctgttgcataaaacatcgtaaaattattcagcagaagccttgatgtgcatgtcagcttccaccttttgaagttgacaatatgccatatttgtttcattattgagagggtatagaaaacatgtggacaatgcagctgtatatatagttgtgaaaaaagagtaaccacacagattgaatgatatatctaatgatgtaataatatgttattttataggttatgcattgtattgccttaataataactaagggaaaaggaagagaggcactccgtgccactttatatattttaaataaaataaataaaaagaataagaagaaaggtttagaagttaaaaaaaaaaaaaaaagtatctaactaaaatgtagtgggcgggttgttaaaaaaaatgatgaaggataaaattatctaaaaaaaagtgtacaaatgaaatgattctcattattaatagttataaataattaacacaataaattataaaaaatgacagaattactttaagctgcatttttatatattttattgattaattattaaaggaatatgtgcttggagatgttaccagaaccaccactagcagtggcatcttctttccatttcagattccggcaataatgtgggttctgcgggcacatagcagaaaagggataatcatgcatgatataatattcttgcaaaatggggaaaaatgtggtcgatgtacaaatgcataatactgattgaatcaacttaagtcctagacattgtaagtgctaattaataattttgattcttaattttatactaaaactttattttagtccttgagtttacatgatgctagtttctcctatcaaaatgtctgaatgattttcagtcttgcctttcaaactcagactaattaaaatgctgttttagcattttaagagattaaaattatcaatgatcaaaatgtcagcgactaaggttaatttactaccataataccgtggagaattacaggaccacgaaatctactgttctaaaatgctatatgagtgttgcaatatttataatataagttttttttcttctaaaaaataacttaagagcataaaaatatatattctacatttagttttaaaagtaattatgaagatgacacaaaagaaaaatcgaaactttgaattgaaaatcctaaaatatttaaaaacccaggacattattttttttgtttaatacacaacattaccgatgatgggataaaagtacaaaaattacaatcttctacctgaccaattaaaaatgcaactgcacagagctttttctttaataatcccacttttatagttttctcttcttatttataatagttgtttaatctttcaagaaagtacttcctttatcttatag

SEQ ID NO: 2335 - DNA, 1600 bp, Glycine max
  Soy_ogl_807 Gm03:2170901..2172500 Cluster 9
aaaggatatttgagatgaaaatatctaattgatgaattagtataaagaaaaaaaatgaaaaataaagaggattaataatttttttttgaaagtccaaaagtgaatattaattattaataaggcaaaaatcggtaccagtaagtagtaccatgatgaccacattcaaaaacaaatccaagaaagccaaacgcatactaaaaattaacagctgcatagaattgcttgtcacaaaaatcatatgaagacaatgaagttccaaaaacgataagaaaacacacactaaagtgttgattgttcggagaggatagcttaagatctcaggcgttgcataattctatatatttctttttctcttctgactcagtatgcaataataaataatattgtgtttaattattgaaagacttttggaaaacgacagaagctataggggctaggtaatggattgattatattgctttatgaattaagaaatggaatttataatttaggaatatcttgtggaacacgttacacttgttttaaatattgcacgaatccttgatatattaatttatagtatctgcattagattactttatttgttctgtcgtcacttaatatcaacttttttaattaaagttaacgttaattactcttgtatataccagatgtcggcttcagagatctcatccctaaatagaataactactggatgatgttatgtacacagtatatacttatttattccttcaattgtttcggattttaatttttcgtccctcaaattttttaaaaaactcattgataacttttagttctcattaatttttaagtaacactttagtctttctattttattttttttactttttataatttttattgtttacaattgatctcaaatgttatggatctcgagagtggttgtcctctatgagtaatacatggacatatgcacattaattaattatatactgtttagcctatactatttacttatttacaggtttattgaatttttagtacttgaattgtttcagattctaattattgttagtccctaaaaaaattgataacttttagctctcatttcgttagcatttttagttcctttaatttttttttcttattttaattttttgctgattttttttgtttaaaattaatctcaaatataaaataaataatgaactaaaaataaacaaaacaaagactaattttgaaaaaaattgagagattagaaatttaatttatcctttatttattttatcttcttaatacattattatattaacatttctttctctttgactctctcttaaatctttgactctctcttaaatgtttagggtttacaaccatattattaatgtgtaacttagacacatgtcattatctttctcactaatatatatatatatatacacgtgatttatttaaatatagcgcattattttttcacacactcaaatataacatcaaaactaaaaatcgtaacataaagtaatagtcatagactttatttttcatatatattctgagtcaaacttctattccaatcaaactaaaaatgtgcaattgaaaacaagaaattcactctacttcattaattttcagt

SEQ ID NO: 2336 - DNA, 1400 bp, Glycine max
  Soy_ogl_1229 Gm04:5264501..5265900 Cluster 9
tgcgacgtttgaaatcacactcgcactcagacattctatcaccaactaacattcattttttttttcttttctcggtatacctaatgctttaattattttgaagatttaattgtttataattattataacaataactatcttatttagtgtaaatatttattattctcagtttatcctcaactgttttttttattactacctatttgaaaaaataaaaaataaattatcactctcaaacatgaacaacatacttaattgtttcgctatcacacaacttcaattattttataaataatgacccataaagtgcctcatttgcccctccccagtaataatataaagatttttatatcaccattgttgattttttataataattatttgtcatcataatatgtcaaattaaacttttattttatttcgtggatatattatattaactttttcggttaatagcgttcattgattatttatttattttgatcatcacttttgttttttccaaaaaaattaatgaaaaaaatgcacttgtactattacaattgaacgtaattgaatcactgtaaattgcaagataccctgttatgagtaaatagcataatttcttagagtaggttcaataacaatgtagtggtagtagtaaattgcaaccctcttttctgattatattatattattcccctaccttgtattaacctatgtttactgtttttttcaaaataatgaatgattacaattaaaattaaattaagttttcatgtatctctcttaactttctcattacactgatcctagtgagttgaaacataaagactatatcaaaagaaatagttagaaacaaaaaaaattcttagtaaggaaaagaaatgtaagttttgtagcttttttttttatgaatatcaataatacaaaacgaaacatgatcttagaaacatatgttactcacacaactagtaaaagacaatgcctatcagtttctggaaacaatacctaattttttacggggcaaacaatttttttattacatatatacaaataaaaaaatattgtgggacaattggcccacaccctaatacatggatgcaccagtggttgaaaatatacaattaactcattgaaccaataactaataatgcatgaggtgccatagatgttacaaagtgtttggtgtaagtgttttattaactaaaaatgaaatacaagagtcttatttataaaaattcgacgcctttattttttgttttttttttataaaacttcataaacatgtatacaagggcttcacacgattcgtacattgtgtcaatctatttgttaaaaatatctatactaacaatttctctttgatttggacttttgcatcaaatttgtttcctttgatacttaactagttagcctcc

SEQ ID NO: 2337 - DNA, 1195 bp, Glycine max
  Soy_ogl_2254 Gm07:7601901..7603095 Cluster 9
gtgtactataaagggaaggccaatgtatgcaggtgtattcaatcaatgtttgtcaaatctggtgagctaaactgatgttgggcaaattttagagaaggaggttgattttgtggttggaaaagaaaggtttgaaggacggagtgagttcaaattttatcactaatattttaataaaaattaataattaaagttgaccgataaaaaaagttatagaagggattttatatatgatgtgggtattatttctgaatattgtgtaatttatgcaatggacagactagttgtgtagaagggttgggtatatcatatacgcaatattaaataaaatttgtttcttgatacaaatatttttatttttataaaatatatattttttattttgattctttaaagatttttttttattattttgtttcaatctttgccgtaagtaatattgttaacccgtgatctataggaatgttaacaattcatttacttgtcacagagaagttgaacagaaaaatgaagattatatttttttattaattatatttttaagtttttatatgttgaaaacaattaaatgatgtcaaactgaagaaaaatcaaaaatatattttactcaaaacaattacacagtttaccacccgcgtacataaaaaaggtttagcacatggcgtgtggattgattggataagattgcgcctaagatctaaggcgttgcatttcttctctccttatcaagtctgcaatattcataaattaataatattgtgtttaattattagaagacttttggaaaaccgcagatcttgctaggtaactgattgattgctttatgaattaaaaaataatggaatttttaatattatccctgaaaagtaaatatctggtgaatcacgttatatttgtttttaatatgaaaaaaattaaatattaataatataaaaagttttatattatcgttgaatataactacctatcatatatcatatatgataaattatattatgattagactattaaactcttttaaaaactacaaatctttattatgattttgctatctgctttagatttctttcttctgtcagttttttttcttttttttttaagacatatagtgacattttttaaagttaacgttaattactcttgtaccagatgtcggcacacgatggatttcatcctaaatatcgatattgcaggacgc

SEQ ID NO: 2338 - DNA, 1600 bp, Glycine max
  Soy_ogl_2398 Gm07:36500001..36501600 Cluster 9
atattaaataatatataaacaacattttcattccatatatttttgtaagcatattattactgatgtggttgtgaatctgtgacttgtgagtaccccgcaagtggggaaaagaaatggagtagacagaagagataaatattgaggttaagatgattgaaatgagattggttatttcattttatgtttattttgagtatgaaataagttatattaaaaaaatatttatttttagtatgtttttatgattttcaacagaattaattacgactttaataataaatacttcatatgtcattcttaaaaaaaatctcagcaagtaatctcaaattaaagacaatatgtgctgataaccttatcatttccaacaattaaaaacttcaaatacacaatatcaggcacttttgtataaaattatgtgaacaataacatagtttcttctttcaattttgagatgctagtataaaaaatgaaaataaaaaattatatacgtcactacatacaactttaaattattttattgttcaaaaaatagaattgattagctgaaaatattggaataaaaaaatttatattagtaatatacttgttaaatatttgtggattttttatatagtaaatgtaattataaattaataataatataaaatatgtgagtagtcataaatcattaatcattagtatcataataaatttatcgatgtttataataattattttaaaaattatactaaaacatataattttttagtccttgctagtaaatgtatgttattaattatgattaatacataattgattaagtaacaatatagtatcccatcttagttttctttaaccaagtttaaaatatatcgtgtctaacagttaatagactttctttttatctacctgctaaactagaaaacttcacaaagttactaatgtttgttttcttacgcattttggtaataatccaaatagaatattggattaattttccatagactccattgtaacgttttcttacaaacctttgtgttttatgtcttgtatgttaaggaagctgacttaattgaataaaatgtataaattattattaaaaaaatttatattatatttgattcctatggattaaaaaaaaatatcttgtcttatgtttcgattttgctatttcctatttattatatttgctttataatttatatgggtgattgcttcattgtatgacttatacaaagtagtatgttaaggattcaacttttattaaaaaaaaaaatcctcaccaatgcatttgttgtaggtttgtgtatatttgaaatgtttaaaggtttaatttttgcagatgtagtttaaataactttcccccctacttgtccctttaaatcttttctattttggtttttttttatttgatttgtaactatttactgatctgacaaaaattagtaacaacaaatgcgacaataatgagttaaacctccgttaattttgtcaacaaaatctaacagcaaagaagtaaaaatgagacagaaatgaaaacaaaaaatcaaaactaaaagatccgtgtactatataaactaaaaagttgtttagttccctctagaaaaagttatttaattct

SEQ ID NO: 2339 - DNA, 1225 bp, Glycine max
  Soy_ogl_4389 Gm13:31509076..31510300 Cluster 9
ttgtttatttattttatttttattgtatgtcatgcattgttgcttgaatggagcatcatgtgtgaggcttgagcttgatagtggcaaatgtaccagaggagccgtgtcgggctgagaataaacgaagcatgacacatcatgaaaacaatcttgtgattgatatccgatttatattttaagtttttttttttctgaattgcttcagcaataagactttaaatatagaaaaattaggaggaagttttcaaaattgtttgtaagcctcacacctttatttcactatattattttaatttaaatattttttaaaattcttttttctccctttcattctacacaatcaaatcacaactaaaagtgtttagacaatagattaatgatgtaagaagtgtttggaaattggaagactgtcttcttcttctttttttcaattttaattgctcattttttttcttatgagagattgtgttgttagcataaaatatttataggttttgttaataactattttttattttaaaaaatttattcatttttaatggagtttcgttttctaactatttttttttactaaaaacaataaataaattgtttaaaaaaactaaattcaattatactcaaacgagattggttgattactctacactctaattggaaggcaacggcaacaaagtaagggaaaggaaaaggagaggaaggaatatacaattatagaaaaactttcccccactttactatgcaagaaagcaagggaggaaaaataatatatacatatatatgcaaaacaaatatatagtgtcaccaattacattaatgtcacatgctccattattatctttattgcatgttttgtatgtgttttcacttttaaatatttgatgtgtgctttctttttttcttatacattagtaatttcaatttttctgtaaaaaagtgttttttatacaataacttatcaagttatttataatagttaagtttttttttaaaaaaatatttaaataattaaacaaactaattagttacttgtacatacgtacaggtcgctccattatatttttttgttttaatattaaaattgtttagattaaagttaaaaagtaaaatatcgttttaatttttaccattttctaatatagacctctatctttcagttataagaacaaatttaatttaatgacagaaagtcaaaaactaatcaagtatatatgatattcttgacatt

SEQ ID NO: 2340 - DNA, 1400 bp, Glycine max
  Soy_ogl_1568 Gm05:3111901..3113300 Cluster 9
tttcaaacatttaaagtaatttttaattaattaacaatgtaaaaatcttttaattaatatactgtatcacaactaaattttaagggagtgcttcgcaaaaaaaaaagtttattttcctggaaatcttagattgaaaatttggcttctcatgtttgatctttcctattaaatgccccttaagatatttttaacatcatttaatgcattctaatgcacgctaatcagaaagaaaatcctactagtatgatttatgcactcaattaaagagacaaaaagtcaaaaacaaacattatttttatctatatttatttaatgtaagaattgaaaatagatatcttgttcaaccaactaagttatatcaccttgccatgttcacctacgtttaacaaacttggatgaaattttgaccatctcacaataaaaacattttttttttatccaacttctatagttaatctatttagatttttggtcaacggatgtacagagaataaaaggccacaaagaagtggcccaagacaacaaagtgagagcagttgagcaagtgcttctttatgcaaacttcttttttcttagtgcaccttccgaatatttttttatttttttaaatattctgttaagaaacagaaaattatgctactctactcctaagaaaacatcataaaagactaaataaagctatgaagaagataaaaaaataacttggatattttcattggttgactcctttacctaaaagagaaatacatttatatataaatctagttgatgctaatcaataaatactatctatccacatattaatatctcattatttaatataaaatctataatacaagtattcaactttatcttatataatttttgagccacttaatcattcttcattagggtctctttggacctatcctatcatatcccactctcattttagaaaaatccttctcctttccttttccgaaattacttcctttttcttcgcatccctttttttcttttttcattctctcattgccaagagttcatctctccctctcttttagcatttattttcgtcatttccgccctcctgatcactcactctctctggctctgctatctttgtattatggatcatatttatttgactcttctttttagttgtgtaatatttgagtctgatatcttatttattgagtgattttaattatatgattattcatctaacaacatgaatttatattaatttttaattgagtaatattttacttgtaattgttattttttttttcattactgtcgttctctttttaaaattattaaaagagttaaaatcttaatttctagaatttaatttttgaaatgaatttaatatattttaaaaatacgtaccatctaagtattaatatatttcaaacatt

SEQ ID NO: 2341 - DNA, 1700 bp, Glycine max
  Soy_ogl_2389 Gm07:35912401..35914100 Cluster 9
tggggtgtatatgatttcagaggcaagagatgaatggtttgatttcttgagaacatttcaagattgaggatagtgtgaaaagcaagagattaatggtttgatttcttgagaataatgttgtgaatttgcctggaaaacagacagcatgagcattagggatgttaggaaaaaagaaaaacactccattgttctcatggtagaatactagaatgggaccatgtggcttcttgagttagcattggattcaattgtgccctcctgtgtttgttatgtgaggagctcaaaaatttaattctagcaaaaaaataataataatcattttgtgtattaattaaataaaactcttgcagttggatacttattacataacaagaaagaaggacaagttatatatatatataatttttatccttcacagtaatgtcaatagcaactggagtgaaaattaataatactttaattaaatatatattcaatttttatccttcacagtaatgtcaatagtaactggagagaaaatttgacttggggaaaagctaacgtttcctaattattagttttttttaagttacgttgcgtttgtatttttaaagtttaattgagtaaagtgcatgaattataattatccacaaatagtaaaaagaaaaaaacaacacagagtaagctagactatcttagttgtctataatcttactgtttgctattaatatagcatattttaaatagactttgtttgtctctatccatttgtatattaaaaagaaaataattgattaatttattgctacaattaactattatcatttattgttcaaattaatttaataatttttcaattgatttttaaattttgatatttgtaatccatctttttttttatagaatacattttttttatttcagctatggtgataaaattaattcaaagctaaaaagttatttgaaaactaaaaagatacttaataattgaaagttaaaaatttaacttaataaatcatataattttttgataaaattatatgttaaaatagataaaaaattaaaatgacaaaaataaatatatttatatgttaattttatataaattttaaatttatgttatggataaaaatatatcctgaggtattataattttattttttaattaattttaaatcttgtaattttctatttataaataaattactttcattatatttttagtttcaattatcacatttttttttcacatttatattctactactaatatattatatcttaaattgttttcgatcaagcttaaaacaaaataaaaaaaaatacacttaagtacacattatatttttattgtgttaactaacataatagttaaaataaatcatataaaataaaattattcaaaaaatgaaaaaaataaaacatttattattgttaatttcgtgtgaagaataatgttgaaataataaattaaatattataaatagtaaaatagttaaaataaaatagtgtagtataaaaaaaatgcataggagaaatgaaagttaagaaaaaaaacaattaatttttgttattccatgtcggaatggttggcgaatcccttggtgtgtctagggggcaatccggtgtggtagtgtctctggtctgtgaaatgtgaagaggttgagttttattggatgtgtttctggtatatgttcatatgatggctacgcaggtgcatgt

SEQ ID NO: 2342 - DNA, 1148 bp, Glycine max
  Soy_ogl_3478 Gm10:40729801..40730948 Cluster 9
gtgcagactttctcgccaagtttgaacctaattcggagtcttggtttatgaagttggagttttctccaaatgatttaaaggggttgttgttgttagatgatgattttgtgcttcacccagtccctagagtgtagtcttttactttctttcttttttccttcatttaccaaaaacaaaaaaagtctaatagaaagtttaaaaatgcacctgctaatcaaaagaatttcaatcacgtgaagttatataagcgtttcttctttctttttttcagtaaattgtttcaaacagggaaaaaaagttcaccaatattaatgcagtactttctatcactcatatcgaagttgattaatttgaaagaaaactttttcttttaatcttgttcatttattgatactgtaaataaaattttcttctaaactcataaaataaattataattcaatatatattaaacagatgccttgaggtgaattgtatttattggtatcaagactatctagttcgatcactatctagttcaatcagttcaataaaatgtgtattataaattctttaatattttattgattaattcctatagataaaaatactgtatttatttgataaaaataggaaaaaagatagaataactcactcatcagaagtttatgaccatgctgacattaatattaagtttacatgtacacgatcgatcaaaattatgtaaaaataatttaaggttttttaaaagtctatttgatttaaaccaccaaattaaaacttttcttttactgaataactaaatttaaacttaaacgaggtaatccatatattaaattggattaattatgtttttattttaatttttttgaaaaaattatttttactctcttaacaactttttttagtatttttggttcctaccctttttctttattaatagttttaatcctttagtgtaaactaaatacattaattaataatgtaataattatattgacaatctagtaatttatcggatcatcaaaaagtttcacaagataatcacgtgtaattttttaaaaatatatatttttagtctttcatcaaaatgctggaaaaaaaatttagggaactaaaagtgaaatttataaaaagttaaaaaaacaaaaacatactaatttacccaag

SEQ ID NO: 2343 - DNA, 1800 bp, Glycine max
  Soy_ogl_5403 Gm16:32015901..32017700 Cluster 9
tcctcttaattgtttttttccctagaccctacaaatttggaggacattttgttggatactcgtattgtacattttttttggtctcatttcattgctcatttaaggtgatgaaacatacgtcttagaaaaatactgattatatcaatttccttaataaaacaatcttatcaaactaaaaatatctttatttattgtgagtagacagtaaaaaaaaaactaattaatgtattgcatattgaaatatcaataaataaagatattattaaaaaataatattttcttaatattctaaattgatgagattgagaaatatttttaatgggacaattaaagagtaatgtcttgcatgcatagtaatttgcaaaacagcaattgatgtatatgagtttgaacttccaagtgtccattctgcaaaaccactaagcccaatggcctcagtcaactagtcaatgatcccttctttaattcactcgcctgtcacaaacaaaaagaaaccatttatttgtagcaaaaagtttttgtttttatcacatgctacaatgctacatgcatgtgtaccattatttgaaaagttaacatataatgaattgataattaaagaagcaaaagactcagagtggattaataattgtaaaatatgaaaaatattagatcacataggtgtcttcaatgtaactcatgactagtttaacttgagctttatgcaaggaagttttgagtattatgatactgagtcaagcttccactgataggtaactattccaatagccataattaggtgcatttccttggtgaattagttgtaatcctttcttccactgataggtaactattccaatagccataattaggtgcatttccttggtgaattagttgtaatcctttgtaatatacctagtcaaatgatagataaatctagataatctttaaaaaagagatgtaacaattaacctaatggattgttttaagtccacattaaagattatcctatgattgaccacttaaaaaataggaacgaacaatgatgtcgtatggaacttctttatcaattgtcatgttacaccgagtataaaaaatattaatataatcattttcacactcaaagtttgttcttttcatgtatgtataatgaaaatgatgagaaagaaattcaatgttctttattcttctacttttttttattattataaaaggataactgtaaaagtggcataataaaatttaagagtaaaaaataagcactcatgataataaagttttgattttttttttttacattaatcttttatactctagcttctcatactttattttatttttatccatttttatcacactatatatttataatatttccttatttttttatgagtgtaattgtgtaaacattctctaggagtaaatgatgatttttccgactataaatacctagtatccttttgtcattaaccaataaaatgtgtaatattgtatagtttagatttatatgtatatatataaaagttctttttgggtaagttattctataagtacatctagtaggaaaaaaatgagataatttgtttcataaattaaaataaactttttattagttaatcattaattaatttgtaaaaaatctttcatataaattttctaaaaaatgaaaagacatctataaattagttaatagttactcaataaagatgtcatttaaacttatataaaaactcattttattttatcattctagaaatatttctaaataaacttattcaaacaaatccacatagttgcttcgatgcattggatgctctatgt

SEQ ID NO: 2344 - DNA, 1600 bp, Glycine max
  Soy_ogl_646 Gm02:44539301..44540900 Cluster 9
ttagaaaactcaatttgaatgttataaaacatgtttggtgagaatttcgggttctcagccttttcatgaagttttagtaaagaaattaaataaaaaataatttttaaattcatatcaaatataagaatttgacatttttaacttaagattcttgaaaaatattttaaaaattctttatcaaattctcccttaggatattcttaatggagagacaaagattaatctctaaaataatgaagatttatttatggaattgattgccttggaaggatgttttaactttattttatttatttttgtttgattgttggttacttatttgttaattttataagaaattaacaaggtttgcatgtatgttgtgattggcaagacttttgcatgtggaatatggagaaaatctgaccagaattgctacaactttattcgaagctatgatgaagaaccttgacatgaactttaaatattctaattcctacgcggcagacaacacgggaattgtgtgtttatcgttatccaatttgttccaatgttggtttgggaatggaggggtgcatacaggtagctcagtcttggccatattgaaccaagaaaatgaagtgagtggaattgaggtgctcaaggataatcaatggttttaagccagtttccaacacataattattattattctagtctgtatgtttacttgttgttaacactgcttcagtttgtcacgtgataattaggtacgtacatgccactttatacaattttaaatttttttaataacttatacaatctttaatttaattttttataaatatgtattatttttattttagttcttctaatatactttgtttttattttagtctctaacttagccatttcaagcttcagcggttaatcatgaataagcaacgacaagggttaatgtcaaaattttgaacattatatatccagaaactatttaaacaaaacaattaaaataaaaaggacatattataagataaaaaatacgtcttatattagttatattttataatcaaatattaattctttagtaacgggataacttttttgtttaggcaataagcgatgacaaatgcaaaagtgtgacacacagagtgaagctaaacaatcataaagaaaggatctcaatatgctattttccttgagattcagatctcctaacccttcacttataatgagtttagagcacaacttcgacaagacatgaagaccgttgcccacaaaattgggcttgcaaggtttgaacgcacttaggattgttagtcttattggcattatcataatataagtttaattactcttctcttttttgttaaataattcgtaccatatgtatgaaaatgaaaatagtatgattggcagtgcacaaaaaaagtatttgcaagccccaaaaaaaggtatttgagtctttgactcttgaaactgattttcattgtagtagaaagtagaatttagagcgtggttattaaattaataatcaattttacttcttgaatactgtgaccgtttcctagttccaactccaatccaatgctatagtaaaaaacaaaattcaatccaatgatatttaaataatttaatttta

SEQ ID NO: 2345 - DNA, 1100 bp, Glycine max
  Soy_ogl_2413 Gm07:38162601..38163700 Cluster 9
atatacattagtactatgtttggtggctgcacttcttgctctttaataatggacaaggttcaatccacccctagttagcacacatgtctagaatgaagagtagacaagatttgatgatgacatgcagtggcggatccagaagctaggtaagtggaggtaatttgtttttaaaaggtcaataatattaattatttagttttgtagttatactatttttatgttttgatccttatatattatatctagaaactagaaattttaaactttttagtctatacacatggaatataattttaattttattttgctatgagtagttaagtgtgttttatctctgttaattaataccaccaacttctattttctagccatgtaaaaatgccataaatttattgttaaaatgacaattttttacggttcaacaactgctagaaattttttggtgacaattttacctagtagagttaagtttttttttttacaatacttaacagatttaagatacacttaaaaaaaagacaaaaatggaattaaaaatacatgtgcgcgcgtcgactgaaatggctaatttctaagtataggaattaaaacagaaactaaagatttaaaaccaaataagtaattaaacttaattactctcatacataatgagtcaaatatgaaaaagaaactagtcatcaatattagggggaaatatgaatattggatattatattttcctaaaagtgcagcacccctcaactccatgtaagtccgccacttatgagatgaatatttacttgtgatgccgacagtcattttttccagtaattgaggtgtagccttatttagaggtgcatcatttttgataagtaacaatattcttttttttttatcattttttgttaaaatgtttttacttaaaaaatagaaaagaaaaagaaacagatgattcgtgtgataaatattttaaactaaaagaattagtttgttaatttttaaggtttatatatgtttttagtgtctctaaaatgagtgagttttaattttgatcctgtaccaattttttctttcctttaaaattgaaaataactattcttggtctttagtatcataaaatg

SEQ ID NO: 2346 - DNA, 1695 bp, Glycine max
  Soy_ogl_3465 Gm10:40092095..40093789 Cluster 9
tatgtgttgtaatttaataaatttcactaatggttgtgtattagtaagagtttgttaaaatgtgtgttgctagcattccttataaactaaataagttcagatattttaatcaaacttctggtaaaaaaaatattttaatcaaactctattcgttgccaatttttaggtgtaggctgtataaacaaggaaataagcgcgtaagaattaatcttttatatgacattactaaagaataatgaaataaattaaagtagggatattaagtaaaatagagaaaacttactatattataaacaaaaacatttaactggagtattaaatatgtttagaacatcttatacaaaaaaaaatgtttaaaacactggttaatctgtttaaaaaaacactcgttaaccaaactattattatacattatctttaatggcatcttaatttcttgtcctttttatcattcggaaccataatgaacttttgatcttatcttaaaggaacgaagtaatcagagaattattttgtggtagacatgcatggacatacaataataaaactcaaataattatttttagattttcatggtgttttttttaataaaatatgctacatgaattattctataaattatagctgaactgtaaaataatgatgtgtgattttttttttataaaaacattaaaatgataaaaaaatataaatttcaacatttttatttattttttaaaaaataagatgatttttttcctcaaaaaaaataaaaataagatgatgatttcagaattgtataaatgttgtaatcatttccctctatagaaacttttttggcttatacatacattgattggattaacagcatgcttaattttcaatttagaatccggtagtcttaaaatgtgatttgaagatttcccaaacacaaattacaagtattctatgacaatactttgtagaacgttttttgcgtaactgattttgttttgatagaattacatccattatcattaatatcgaagggaaagttaaagaaaataattaacatatatctaaattggattgcccccgagaagatacatgtgattattttttttgataaatatgacaaataatctaaaaaaaaattaagagaaaatagaaagaaaaatatgttaaaaaataataaaaggtggtataacaacactttctctaaaaatatttttattattaattaaaattttaaattttagtgaatctgttttcttaatcttgagagactcgttaaatgaaatatgagattcactaaatttataaatttttaataagattcaataaataataaaaaaaaattgttgaaaataaagtgttgttattttccctcatattaataatattaaatcttaaaaaaataatagttaacgcatattctcattacttggaaaagtaaggcccgctttaagtttgtcttttgatgaatgtctatgtactctgtatatatacgtggccttttggatgcatatgcacctgtaaatcagcagtttcggccttacatgtccagacttttctagagcttgataataaataaataaatcatattaattttaattgtataatcatatcatattatattgaatgatattatttcagatttctttaatttgttaaaaaaaatccataaattgacaattaatcattggattaagtttgtttccaataaaaataattttc

SEQ ID NO: 2347 - DNA, 1324 bp, Glycine max
  Soy_ogl_3477 Gm10:40726401..40727724 Cluster 9
gatagagtttggcctaagcactgtacttaattcattcaactcgattattgccatttactatatccattagtaggcttcctgtttgtctttaaaattaattagtagaagctaacatcattaaagtgccaaaatgataataacatctgttatctaagcactgtacttaattcattcaactcgattattgccatttactatatccattagtaggcttcctgtttgtctttaaaattaattagtagaagctaacatcattaaagtgccaaaatgataataacatctgttatctatactatttaattatctcaaaagtcagcttcctgattgtagtagtactcttaaagatctaatcaatgaacgtaattactgctttgttgagttagcataaacttaatacaatatcatattatcatgcattgttattttcaacatttcattagccaactaccgctttaatatgctgttaatccccccccaaatgcccttttattactgttatttgttaatgttttatgtgcattttcccgtgcaagatcatggtttgcttctgtagttcaaaaccaccaccctcatatgcgtgtccgataagccaatattgctaaatatcatgtcaacgaaaatcgttagtctatgataaatggaagataatattaagtgacatcatatactaataattttgttattgacacatattaattaattgttactattattagtttttttaattaaaaaatttaaatttatattttttttctttatcactagatcaattttatatattttcttttgatcatttttttaaagacagaaaaatcaaataaattgctatatatttttttaaaataaataatacaaattaaatattttttgtatctatatcatgtaaaatgacgaaaaatatatgtaaatcttaacagtcaagcatggagaatgaaattctcttgtatatatcatgtaaaataacagaaaaatatatgtaaatcctaagaatcaatggaaaagtatggtttttgttatatttccgacaaaaaaggagtactgtcaagtttaaagaaaaaattagaaaaaaaatatttttttcctttgtacttcctgtcaaacttatagtttcatatagataaatttggtccccaaacttttcaaaaaatatagatttagtctatcatttctaagaatttatcatattttttttaagttaagagagattatattttttaaagttttgagataaatttatgaatttaaaaatataagaacttcatcctatttgatcaaaagtacagagactaaattcacatttctctcaaaatgtattatacaataa

SEQ ID NO: 2348 - DNA, 1644 bp, Glycine max
  Soy_ogl_5943 Gm18:5413234..5414877 Cluster 9
aaatgtatcttcatctttattttatgcggttgtgagaatcttttcactaaaatatcttgcaccgtaaggaaatgttttctttttatgtacataataaaagtaatgaaatccgaacttaacatttcatggatttattctaattcctagccaattctactgggtttacggtaaggaaatatttgtcaataggtgggtgagctctgatgtaaagataatataaaattaataatgtatatgtatcatatccgtataaatataaatatatataactgttttaaagcaatgtatgtaacattatcatactcaatatccgtatgggagtgatgagcaacatactttatatttcaaaatactttgctcgtataataattttgtatactttttcatacaatgaaaaaataaaaaagagttgtaataaaattgttaatgcgatagaaaaaggtaaaaaaaaaacatatataatattgtgaaaagtgatatagataatataaaattgagaaaaatataatatatttttttgttaatccttcggttcactaaaaaaaagtgatcatgactcattcaaattttaatcagaaaataaataaaatttaatcaaaaattatttttttaaaaaaaataaactcaaatattaatgatttaactttaattccaatctattaattattatttatgtctaaccatttgttataattagtgaaaagttttaggctatcacaccaatgatgttaataaataatgaattaatacagactgaatatggaatgaatttcaaaacaaaaaaacttctctttgtcgacgtcttgaataattaattgaatgttgataaaacaggacatgaaagggaaaaaacagagttgtggagtttcaatcttcattcaattcttgtctatctcttttctctttcgcggtttctttttcttttctatttatacaaaaatattgaacaaaaaaggcaatctttatattattgaacaagatgcaaataacatgctgggatgttaacagttttatccaaatacaattacttaactagcctcccgacgttaaaagagattttctagaaaatagttatctaccaaactgaaaaattgacgttaataaaatttgaacctagctaaaaaaagatgaacgtttatactgaatttttaacttcaactagcatcaatctttcacaatttctttaaatcttcttccggattccagatagcttaggatgtgtttgtctactcgtatttaacatgagttccgtggcctttaaatgaaccataggaaaaaaaaaggaaatacagaaaaagaaactatactatttattacttctgcttcactcagatttaatattaattgtcaaatattcatgtatttagaaatttgaatagtaacgataaggacacacaacaataattaacgcttagatagactttttttttataaaataaagattttttattttggtatttttattttttgttttgaatcttatataaaaaaaattcattttaatgtctgatatcattgtttctatcattataaaattgtaaacttggtatagatttttttgggttaaaagattttcattttaattcttattatataaaaaataacaaatatgttcatcaatctttgttagtcccgtagtcactt

SEQ ID NO: 2349 - DNA, 1600 bp, Glycine max
  Soy_ogl_617 Gm02:42922201..42923800 Cluster 9
aaaaaatattgtagtgaggcttttaaattatgtaattttaaaaaaaaaatcattcaaaatataatgtgtttaaaaaagagtgttaaagattataattctaagctttctctttttaaaaacaaattatgtttaaagtgagattcccatttctttttagtctaataaaataatattttttttttaaaaaaaggcaaacctcataaaaaaaagttacttttgggcattggcgacgagatggaattgaatacctggaaaaaaggtgtgagcaatgcggttgagtgcctcttttgtttggcacttgcaatcacctaattattttgtcccctaccttcttaattatctaagggtgtaagaaggtacacaatcctccaatcttgagcttaaggacaaaagaggtaagcaacatctaagctataataagagcttagaagatacaccaagtgattttaaattaattaattatttaaaatttgttataaaaaaaatctttttattctcttaattcaaccactagcaatattaaccacattaataagattaaaggcatcaattcacataaacctaattcttttgggtttgtccatgatgggtcatcaaattttaaaaatgagttaagcaattaagttaaagactataaaattagtcgcatagtcttaacccatttaagttatgagccaaaccaattggttataggttcaatttttcttttttctcaatatgatttaataagtagattagtaatataataattaataggaaaatatgttgccatgcatgcatgcattgtcactaagtgataattaaggaccgttaattcttaatgaaaattgaaatttaagaagaacaaaactgataaaattatttggaggattaagatcaaattttaccaatttataaggattacaaatatatttaaatttaattaatatgtataaagcatctgtgcatgaaattataaattttctaacatattttaatattattaatataacccgacattaacatattatgtaaaaatattagatgtttaatacatttataacttttctataaaaaaaatacatttataacttaaagaaatattattgcaaatgttgtttaagttttttttttttatgatcgtactaggatttgaacataaaatctcatatatattagtaaacctctcatcactatgccgattctagtgggtttttttatatgtttaagttaaaatgtaggaaataaaaacataattttttttataaataattaaacctaatattttgaggggaaaatatattttatcaatttatttattacatatatatactcacaaattatacttaccaccgtgtgctatgttttatattaatcattagttaccattttttctgtgtataatttatttccactgcaaaattcagatgagatctaatttttcgtgtagtccgccctcaacttcacaatgatgcatgtataagtttatgaatgtaattagatctttaattatagtgtttggcttaactaaaaaaaaaacctctaagatcgaatcattgccaactatatcaagcaatatatatgtataaaaaaataaagtaatatatttgttcataattgc

SEQ ID NO: 2350 - DNA, 1243 bp, Glycine max
  Soy_ogl_1287 Gm04:7817401..7818643 Cluster 9
aagaacagccaccaagtatgatggatcaattaatgtgagatcattttttaggattttctctatcagagaatacctatgttttagtccgaaaaaaatagtcaataaaggattttttttagctatatgttaaatgaaattaatttttaaataaaattaaataatatatttaaaagaaataaagaagttcttgattattttacaagtgatattttttagtattattattattatcacctaatatgtatattaaataactaactaggaaataaattacgtttacctgcccaaacaaaataattgatttataatatatattaaactaatgtttagcaaaagaaaatatcaaatccaataaaaaattgcaattgcaatatcatcttaagaaaaagagtttgaaggcacatatctttttatttttcattcttatgtattcacaaactttaaactatttttaacaaaattctaattttgaataaaataaatattttttaatacctttctttattcaataattacaattatacaaaaataagagctatcttcataaaattgaagtatatattaacatcttttaatttaaaattaattaattgaaatagatctgtgtcatttaagagttaggtacacacatattttttaaaagtaatattattaatataaaaataaaaaacaattaatataatttattgaaatcaattacatatgcataactcaatcaaaatattttaaagttcaaatttaaataagaaattacttttaaaatctaaagaagaaattgggtattacatgtgtcattctttgagggtaaaagcatatatgtatatattctttcatgttaaaaaaagggttaattcgagcgtacaagtaactaagtttgggaaaataagaactttaacttaaaatggattttaagaaataaaaatacaatagctaaaagtcgagaaggaaaaattaacattacaaaagaaatttgaaatatacaaaatataaaattatttaataaatgtaaaaatacattctttaacaattcaataataaaaaatagactttattttattaaacaaaaacaaactagcctttataatattttttttacctttagaataactatgtgacagttaatcgattaactcaatgataactatgcgctccaagttaaaccactactcttttatttttaactaacaactgaaatatttctttaaaatgaaattacccagataggaaactggtaaatcgatac

SEQ ID NO: 2351 - DNA, 1546 bp, Glycine max
  Soy_ogl_6479 Gm19:40970890..40972435 Cluster 9
atagaaaacactatatacattttaatgactcaacacattatatcttttcagttaattgtgtatttaatcgtcaattattttagtcagaaacagtccaacaacaggtaaggccctaagtgaaatttgaaagaaacttatattattttaaatgagttatatgtgggacttttttatatatgttttaataaaaaaaaactaataataaatatttgtttattgatgacgtaaagttgaagctttagttacattattttttggagtgattttaattatagatattattaatgttgttggatgcttgttgtggctgaaatcccaataccattgttactttctcttgactcatatattagtaaaaaaaatattttgtattttaaattaaatataagaaaatttaactaattttatctatatttagtaatatcatttctaaaatactcttcagtaatttaattgtaactctatttttaaatattttattttattcatgatataaaattttaatgaaagatattttaaaaataaacttatttttttacttgaaattaataaaattaaataatttcatctaactttcttaaataatataaaactaattatttttacttatgtatgaatcccgagaagtatgaattgctctcaatccctcataatcgtgacctagaacagtggtccaattccaaacttgactacccaagctaatcttcttcacctccatcaaaaacttagagtcttcatcaaacgaagcacaagcataaaaaatttcacaaactcagggtaatactttccctccattaattccaacaaagaatgaaagccttgagacttcaattaatctggaaaaacaaatacctccccctacaataaaacataatgcaaataaaatgatttaagttcaaggtgaggtttgaactcactacactttgataacaccatgcataaaaactcccaggacacttaacctaattggtatgtgcataaaaaaaaattattatatataactcaaatatatatgtgggaaataaaaaaatgcacaaatatatactactagtaaataaataaaataatattataaagccaaaataataacatatactttttatttaatactgcatatcttaattataacttgatcttgtattaaatatttttatataattttttttgtttttttaattttttattttgatactttaattattaagataagatattcttattggtgtaatagtttttatttcaaaaaaataaaaattaaaataaaaaatttaaagcaatgtgttttgctcaaaaaattagtacattaataatatcttatttcaattactaatatagccttctaatgttagttttatatataaatttttagtgttaaactaaagattattgcaagaaattgattgtagaagtatacttatttttagcgaatttttttagttaaatatgaaaaatgatttattacgttaataaaaatatcttattttacttgttaaagtatccaaagaaaaaatacaattaaaaaatataagttaccgtttagtttagt

SEQ ID NO: 2352 - DNA, 1400 bp, Glycine max
  Soy_ogl_810 Gm03:2362201..2363600 Cluster 9
tcctctcagttgaaatggaatattcgttgggtcatgtgtggacgtgtggtgaatgtgaaaataatgagggaaggaagaacaatgtattttttctgtcacttcacaacaccttgcattggcttggcttaactcaatattaatgttgctttgaatcaaattcttggattcctatcgcttcctccatttatttttaatttggttataatataatttttgcttcctccaatattataagcaactaagcaagtgctgtactgtgccagtgtatcatttgactttttctttgttttgctactgttctacattaattatatggataatactaaatgcaataattaccaaacaagcagggtcccattaattagtactaaacttttaatgtgacttgtttttatcattgctttgcccatatcattccaccactttaaatgcactgaccctgaaccggttcacaattgatatatcttaactttcttcatttctttttatttgttaaattttaaaggaaaaatgatctgtaattatttagaagtttaaaaatattactattatctttttaattatactcttaactctacattttcctaaataatttacatcgttatcataaagttttaaaatattgctattatctttttaattatactcttaactctaaattttcttaaatattttatataattatcataaatgagaaagaaataatactaaaagtcgatcatattaagaaatgaaaaaatttaacatatactatattaattcattattcaccctatgtattattttataagttaatgttaatagataaaaaaagaaataattttgggactagccttacaaatatatagtttacttttttattaagcacgtgtatatttagttccctcattttttgaagtagatataatttggtgctcaataatttatcttaatacaagagaaactatatattaaaaacacttcatatatttctgtcataatgttatagctagctagcatccaatactttactttaaaataatatgtgacaacatttttaatttaagtagtttttatcctaattttcatcacgtacgtattcctactcctagatccgtacctttaaaatagttttcttatttaaacattaaaaatttaatatcacatatgattgtgtataatcatttttatttgttattattttttatccgtttcgtatatattcactttcaaaaacataccttaaaattaaaagggacagcattttgttctttcaaaattatttctaagagttttggattttggtaattcaactaggaagaaaatgacaaacatgtctggtcgtaaggtcccattggtggaatatccaaatcaagggatcaagtcatgaaaggttttgaatgttgttgttttcttgtttt

SEQ ID NO: 2353 - DNA, 1617 bp, Glycine max
  Soy_ogl_5757 Gm17:38317388..38319004 Cluster 9
ttaatgtatacgtaatcatcaaagatcaagatactattaaataagaacatattagtataaatataaaaaaatttaatttcattaatattttttaattaatgtacaataaccttaataattaaaaaaatggaatgagataatattattttgaaatggaagaagtattgtgtctgcataacaaaatttttgtctaggaatattgattaaaaggttagtaaatattttattaaaaaattaattagaatgcattagaaacatgttaaagagaatatgaataacattttcaatagtattaattaattgtttaaagattaattaaagcatgtttggatgggtttgtttttcaatattataatctaattaatagaaacaattgttagtgatactattcaaatgtattttgtgatttagattatagttttaagaattaaaaagttttttttatacgatatataatttttcagagactgaaaaaaattaacaaatcaattttcatttaactattgttttcctatttttatctctaataaatgattagtttaaatataaaatcaattactacatataattttataccttttgagtttcactataaaaatcaattattttaaaaacatttgcacaaaataagttattttgaaacaactttttttacataatatatttaaatataatttattacacaattgaatataataataattcattatatctacaataatcaatactactatctaaaaataatatatttcaaacccatgtaataaaacactatcatagtcatagaatgtaaaaaaaaaaaatgaaatccttcattgacaagaggagagaaaagttgaatgggtcgatgtggcacaagtaaatataaaagggaaaaattacgagtctctttcatgtacttggttctatgagtagcatgacgtggaaccaagtaggcattgggaactagactagaggggctaagctaatgatggagaggttttgttcctaaaataaggagcatgacttaatatggggaacagtaggcagattaagaaagcacttaaatgctaccattaaaaccttattatgggtaaagaagaaaaagtagtagtaaacgacaccaatgcacaagtgatgtagtagtgttgttggataacggaattttattttaggcctgtttgtatacaagttacaagtgcttttgagatcttttctattagaaatatagagtttttttcagtagagaagctcttgaaagagcttctaaccttgtatccaaacagactctttatttttttccttctttctagagagtggaattggtaaaatcgttggataacaagattaaaaagaattagtaatgttatattagatgcagacgtgaaaaggacgatggtggagaggagtgacagcaacgttaacggcgtcaggctttatgagaataggtaggaccatcatcagactgagacaaatcaccttcccgaggtcaataaaagtgacatgtttttcggttattacatgcaatattatcatacttgcacccatcattcaatcgctggctatactaagaaacataatctacttcatctatttattaaaattatcattattgtaaattcacagagatattctaac

SEQ ID NO: 2354 - DNA, 1778 bp, Glycine max
  Soy_ogl_856 Gm03:5219699..5221476 Cluster 9
tgcaactatcacaagctggtaaaggtttaaagtgaagatcgaattttaactctttacaaaaaaaaaaaaaatcaataatagtaaggctggattaatcattgaatagtagaaacagcatataattgtgtttcaggcttccaggagttgatgctccatgttgtatttttttttttatcgttctatattgtattgttttataatatgtaggaattttaaatataatattaaaggatttaatacacctataaattctgcttaatcaaataagttagaccctattagttatgtattgttttaatatggccgcattatttcttcttcggtttaacttatggataatttcggttgcagattacaggtgtgggaattaaaccgagcctcaagttacgactaaattatctaaaacgctaaattagctttaggtacacagattgaaacggaatccaacatagtatgcgacttcagttcttatgtttagtatactttggaaagagaacaaaacacacaacatgaggttaaaaaatatactaatattagtaaaaatacccaatattatactagttaaggatgttagttaagttaatttattttttttatatttcatatataaaaaagaattatatttcctaaactaccctcaattatatttattggagatgatgttcatatttgaattaacataagggtattatcataacaatgacattaaataagattaaattaattaaaatttacttatattaccatctaccaaacatagacttttttatacttgtatttgagtctgaatgagtaagttaaagtgtgacattagaaagaaaacaacataatatgattttttttagttttttttcgatcaaccgagctaagttagacgtgcttttttcacttgcattacatctagaatattctaatagattcacccattttttagttgaagtacattaatatattataacagaagattatcttaaaataaactgatgatgtagcttgttttcacatgtattgcatttaaattctagtgcacttactcattttatagttgaagtacgtcaataagttataaccgaattatcttaaaataaatcgatggtatagcttggtagcatatgtcaattaaaaatgtatattagcaaatgtttttgaaatttgttaattaatacacatttattttttagtttgagtatgttaataagttacaactaaagaccctaaattaaaatactcgggttaattgttaacatattttaactaaaaataagcatgtgcatattaaaaaaaaaggagttataactattttcttgtaagtgaactactatcatgctagacttgtttaatttgatagtagattcgactcttcccatccataaatgtttgcatgttttaaatctccagcaattatttatggtgctttagacctaatttttcaagtgtttatatttaagaaataatactcttttttgacactctctttcatatattagttataaattattgaaaattactaattttggtagattttattttcttaggtaatatttttctttccttatttatattaaataagaaataaaatttatcaaaattaataatttttaataaattttaacccatcacagaagagtatcactatcattccttcttatatttatatacctaagcatgtgaagggatatatggtatatatcctcaataagattaaaggctatataagtatatatagttttccccaacaaaaactgaacaaaagtatatatccacaacagcctcttatt

SEQ ID NO: 2355 - DNA, 1044 bp, Glycine max
  Soy_ogl_6816 Gm20:37747801..373844 Cluster 9
aaattattaggttattgagttgtaacaaaattatcacaacaagcttgatggactaaatgaccaaaattttataaaacatcacaataaacttctgcacccaaaattttataaattttcaagtttaatgagcattaggttttatttcgagagtcccatcctttatacacacattaatgagcattagctttcataggtcttatctttattgataatgctctttattatctgataatattatattaatctaaagattatgtttataatgatatcactggtaaaaattaaacatagctcaagtgattaattactatttgattatatagtttcctaagagttctaggccagtgggatacaccttccaaaacattaaaagtaatgaactgaactttatatatcttattaacacagtgtattatatatctatgattataaattaaatattaatcaatatactaaacaaaatttaaattctgactatccattcatggtgtatatttttttattcattaactcatatatggtatatttgaatgaaggaaaaaattaaaaagaaataaaatataaataacgttattttttcttttacttgattcaaaagaaaagaagaaagagaaagagaaaaaaaattgttcaaatttgaatattttcggtcttctcacttctccctaccatatagtactccatttaaaaacattacatttccatacgtgttccatttaggttaacttcagttatattcataaattttcaaattactatattaaggtttttttgtaccaaaacaccatttcagcaatttttaaatttaaaactaattaccacgactacaccgaaaaaaatctgacaaaatccaacagtattttgttcgtgtacaataacttgtccttgaagtacattaattactgttcaagtattcatccatgtcagaatttaagtaggtactagagacccgtgctgccgcaacaagtattcacgcatgtcagaatttaagtaggtactagagaccttgattaaaattataatctaaaatagaaaataataatt

SEQ ID NO: 2356 - DNA, 1200 bp, Glycine max
  Soy_ogl_1259 Gm04:6600301..6601500 Cluster 9
agttttgtgcattttattttaagttggtaacaaaattacatcattttacaaaaattgatgataaaaatacattgttttgttggggacatatcaacacttcgttagatatttaaattggtaaaatacacgaaaatttgaaatatggtgagaaaaaaatctgtgataaaatttgtaaaataataataatggtgtgataaaatatgtatttaagtctaaaaattattaattaataattgttctaaggaaaaaaaaataggttatcgaactaacctgctcctccaaaatcaggttaaacaagttggccaatcttaaactgtcatgccaaaaagaatggattaaaagggttggctgaacaagtattttgccacctctaattaaaatgggtcatactttactgagtaataaatttttcaaatataagtctcgaacttagcttatttacttgatatggattattattttcaaatttagcctagaaaaaaaataaataaaagcttaatttgtcataagaacttttaaataagcttacaaacttgctttaaataaataaataggccgaaactcatataaacttgtcggcttaagtctctaaatagattaataagtatattaaaatttacagtaaaaaaataatataacaataacagtaaattattttatttacattcatttataattttatataggtctcaggctttaaaaatcttttttagatgtgttatcctaaaactaacaaatgttaatacaagtgttaatggtctgtatctcttaaccaactaatttaatgtttgaatcataattgacatttgggtataaaataaattatattagaaaaaaaatacatatttcgaatacattcatgattccaaatgaaaatttaatcactacattgagctgggattgcttcgttttattaacatattaaaaaatatgctattctaaattcatttttttcgttaaatagatttaaaaaaacatcttaacttaacttatctaataaataggttagatcaactttgtgtaagttagcccagaaattcttgatgagtcacctatcatatttttatccttatttatatagaataatttgttaaacctcataaagtaagagtgtgatttttcttattttcttaatgtctcaaaagacgttctcattcctaggttaattaattacgtactctagctaaaaatgtttcactt

SEQ ID NO: 2357 - DNA, 1563 bp, Glycine max
  Soy_ogl_4225 Gm13:23520401..23521963 Cluster 9
ttctctctcgtatttattttatcaacttatatatctcaatgtaatatctctcttccaacttaaataacactaataattgatagttttttattattttagtgagtaaattcataaaataaataaaagcaatatttttaaaaaaagaatcaggattaataatcataaaatatttgtttcataaaattcagaaagaaaaaaaactaatggtgctgtttatgcaaggaaaaaaacggtttgaaaacaaaatgcaacaaaaagaaaaacacaatataggtttcaattatttctaagctaagctaagattaatgtgcggattcttcagaaaatgataaagttcatgcccttcacactctttggagaagttattataacaacaataaaaaagttcaacaattattattatattttaaatttaaaataattgaatcacggtagtttattaaaggtcacgtacatgcttaaaaatttatcaaatagggagtaaaaaaatgtaagtgaataactaaattaatcacctaatcaatcaaattattgtttttttaaccttgattgtccattttttcacagctcacatactaagacatcttatacaataataatttactgtaacttgtaatttctttggtgatcagaatgctccttagatagtcatttttaataccacaacaatatattttgattattttttagataaatgattatccctataaattaacataaaactttttaatttattttgtctacactaacaagttttttgaaaaatttttcatgtcactcactccaagccgaacacctttaacggtagaatttaagtgatgatgaactaccatatgtgatcttaactataaaattttatattcacatatattttggatttctctcatatgtgatttgtctggtgttacatatttcaactaaatttcctaattgatttgatttattctaaattacttgaaataaaaaaatatattgcaaattggaatatacattgatgcaccgtataaaactaaatactagtattaaattataattggaatatacataaaaactgttaattattagtattaatattattttaagggtcttgataaccagcagtagccttaaagtattggttaaaaaattataaaaggaaagtttttattgttaaatcatagaaaaatgtaagacactagttaatcaacataatttgtcatctttcaataaacatacttctattttaattttcttaatcaatatttataagacacaggttatacaaatcttatttgtaaaattatgtgcatttaataagtgtaataacacatagtgagtaattagccgtgaatgtaacaatgacatgctaatagtatcttcaatcattctaattataaatagcggaaagattacacagaagattattaaccaaaaaatagattatacggaagatttaatttttatttttgccacaaatacagtgaattaaaattatataaacttttacagaaattatatcacttaatctaaaatgagatggttttaagtataagaactatttttttaaactataaagaccaattg

SEQ ID NO: 2358 - DNA, 1200 bp, Glycine max
  Soy_ogl_6411 Gm19:38144801..38146000 Cluster 9
tctcaagcaccacaactatgtgattttttatttgctattaaatttttattattttaattttaaaaatagaaaataacaaatattttaatattaaaataaaatacattatacttaatgtgataaaaaagaataaagagataagaagaaaatcgatggaaaaagagatgaaagaaaaaatgagtaaatgtttatatttgttgtgtaaaataataataaaatttaagatgataattttatttatcagaaatctttattttaattatacacatttataaattatacaaaattatatgtaaattaataaaattttatgtaaattataaaatacatgtaaatttatcatatgtaagttgtaaactaatgaaaataagtaaattgtactaattaaccattcatgggtttctaaccgtgatcttatcttgcttgtgtagtccctcttgtaaaatagcatatttttaatatgttttatgcattattatttgatagataaaatgttttgcaaccaaaaaaacttcatgtaaccaaaaagatagataaagtgtttgtaaaatttattaaataaggtgtaaaatacattaaatataaattgatgctcacattatctaatggaatttatagtacattattcaataataaagaatatatgttaaaaaagatatatcaaagagttttgcttcaattaagatgggtctaattaactgccgcgttatttttcttgtactttcttttagtatggtcttgtttcaaaaagtttaaaatataaccgtttggaaaaaaaaagtacagggcttttttatacgatttttttgaggctagggctttttttatatatatactaaaggacacgcattattgatacaaagttttcttataaagttgatttttccatatatttggaaaatttatattatctgatgcatatgataaaatgtatagtgctaggaaattgacaaagaataattttaagccatctaagccaattaattggataaagctaattgacaccaatcgtaggacgaaaagtcgaaaagcattcactcgttgcctcctatatatccggctgtcttacatctacatctactctattcagggtagtgacaagcaaagtttcacacacttataataatatttagttggaggtaaaatatacttttgttgactcaaaatattagtttttattttattttataaaatttcata

SEQ ID NO: 2359 - DNA, 1054 bp, Glycine max
  Soy_ogl_5939 Gm18:5333747..5334800 Cluster 9
taatcaataacataagacatgtttaaaagaatatattaaataatgtattagcaactttctcttttgtcttttcttatttgtaaatattggattaatctacccttaattagaatatatagtactatcatgatttcataatgttgtaaagattaataataatatataatcatgtattttttctgttgaaataatggggttaaagccccaaaagacagactttactaatcaccattaagggaaatacaaccagcagcatcagctgaaactaaagaggatatataatcatgtatagagttacattttgtttgatgattaattttatagaaaaatacatcttcggagaatataaatcttcattaattaattatttgtgtgttcttatcttaaatgtataaacaacctttttttttctctctttctacaaaagtttctgcataagaaaatcaatattactttcatttcttttaagtgttgtttaattggcataaaaataaaaacaaaatagaattaatgctatcacttttgttaaaattgttatttattttttcttataccctttatttatcttattaagtaattttttatttattattcttcatatctgtctcatataaaggatataattgatgaaataataattattatctttcttcttcacttttctaataaacatgtatatataggttgattaatcaaattaaataaggtttaaattacaatgtatttattaaaggggtcattttgaaacaatttatcaaactgaggctatttttatcacatcatcagaaaaattgccacgttgaaggacaatctccgccatgtttatataagaaaagcaggttgccacgtatatatttatacaagaaagaaataggttagcactcgcatggcatgtcacgaatctaggtggagacttctaaatcccctgtgggctagcgatttttactatcaactgagacttggtgtgttggggaaattataagtttttattttttaataatttggcacattatttccaccagaggtgtgcagatttatcagaaaaatctgagtt

SEQ ID NO: 2360 - DNA, 1171 bp, Glycine max
  Soy_ogl_2277 Gm07:8132530..8133700 Cluster 9
tagtttagtgtgccagagtaaccagtaatttaattagaaagataaagtagcaaactgcaataccattatcatggttgatttagtaagtgaaaaatagaaagagaatagaaatgaatatttaatacttttactgattgcttatttttattttttttatcagtacttattaatttgttaacttttattagaagagattcaaatttatgattttttttttatttttttaatcatcagatcaattttacaacttcttttattaatttcttataattgcactaaagaagcatgcataattttttttatttcacatttgtttaattatttttacttaattatagaaattttacggaattccgttttcttatcaatgtagagtggggcaaattcatctcacctacatatctacatctatatggactcatttacacccggctatgattaatcaatctcactagtttatgattttcaacgcaacaatgtttctttctaaaagtaaaatatacttatagctagccaaaaaaatcataagattaacctttaagtatagccaaaaaaatcattgaattaaatatattcttgatttacatacacattattgatacttattattactttttatatctctcctttcgaatcatatatactaaatactatctatcatatttatactctttctttttactaagtatcaaataagatcattggagtgtccacctatgattttatttcccatgaagtgattatatgtgggtattcttatacatcaaacattgtctaatttataacacttactattaattttctctatctttgtttccctatcatattagggtttgatcatggtttaattaataggaaggcgatggaagcaatgattgactctttggaagagacgtggaaagcaaatatattattgaagatgagccacagtcactcgcgcgtgttgcattttggtgggtgaatgtgttgcacacatgacacatgcactttgtccgcgtatttgagttagatatgttgacacttccatcaaatcttccttcaatattcgcaactcagggaggcttatttggtattttaaactcttcctctgcaccccatcttcccaattaagctatgttcctctctttagcaacaatccaattggtctatcaattgaatatatattttgtct

SEQ ID NO: 2361 - DNA, 1247 bp, Glycine max
  Soy_ogl_4237 Gm13:23817201..23818447 Cluster 9
tcttatataaaaactagagaaaagtggatcttttttctttgagaaaaaaatagagccctaagatttgatttaccaattctttctctacacgtaaataaaatctcgtgagtgagcaaccataaagtttgaaaatgaattagccaaataaataaaaaatatatcaaaagacgtaattcaactgcattaattgaacatgtgaattactataaacattttacacagtctctaattccaacgaataaaagaaaaatctagaacaatgaacaagatttattttctcgttgtattttatttttctttagtggagacaaattctaaccacttttatgttgtgttttgggcttgtttggtcaagcttttatgaaattatttctagaaaaaaaattaaaatgaatttttcattaactaattattaaataatatttttttcctcttttaaataaattatatgagataatttttacaaattaattaatgactagcaaatgaaaaacttattttaatttatgtaaaagtatctctcattatttttcttttagaagtgtttataaagaaacttacccaacttcttgccattaattcttctcacatgttggttggatagtataaattatttttcatttttttgtgttttttagtttgattttttttaaaaccgtgctttttcacggtcccacagcaagttttttaagtaagccaccgagtaatgttttcatcgtataatttgacaacttgattaattcttttaattctcaccatgaagtcttttatctttttcctccatatcaaccttttttttttattaacttgattattttttttcaatactggattaaccttttaataggtatgatgataaccttctctctcatggatttcaagtacgggtgtttctcgtgcagtttaatttaattttttagataaaaagtcatttaaattaaacataaaataaagatataattttttaaaaataatattaaattcaaatcaaacaaaatcaatcttctacgattatgttagacttagttttgtgattttttttaatctattatcataattcaaatctatcaactaaacttatataattattatatatgctatataattttaaaaatgaattttatttttattaaattttgtttaacatattttaattaaaaattattatctttacttgtatttaatattaatataaaataatattactgattctttttgttacataatattaatttgtgtaagacttg

SEQ ID NO: 2362 - DNA, 1500 bp, Glycine max
  Soy_ogl_5984 Gm18:7583501..7585000 Cluster 9
aaaaaaacaatgtttgttgacatcctttgataactttaaccttccgctaactatctttattgtgagaaaaagataacaatatttttttaaaacacttttattattggctaaaatttattaaaaattataaaatttactgaatttcacttctcataatttaataagtctttctttgattttataatttttaataaattttaatcaacagaatgtgttaaataatagtatcttgttattatgtccattcctgtcaatattatattgtgaaggtttttaaccgttatgctattgtgttaaaattattaccatgttaatttaatactgacggaatgatcaaatttaatttagaagataaagaactaaaccaaatattttaaaagataaaagactaaagtgaatttaaataaaaatataaataagtaaaaagtgcaatttatcctatcatacattgatagaaatattaaaaaagtgaatagttttatatttttcaagattaaattataaaatctatataaagtaaaaataataattaacttaccatttttggaataaattacagattatatggaggatagatctcagagaacataatcccaattggacaagcttaattaaagtgagattaaatcaaaggaaaagaaaagtaaatactgagagctcacgagatcagacttaaggctcaaaggatgtgttcgttactaattaattggatcaatctttgctaaaagaaaaaagtaaagtaataaagggagatttgtaattcccaatcgggcaagtgaaaataaagcgactcaaagcgtgtaacacaggacgtaagtcagatcggaaaattgcgtaattaagggttttttgttgatgacaagaaagcatacgagagtaaagaggggtatcttacattgacatgttgcaagttactgttttaggtgctttgcttattttaattagtttgcaaatcatgatgattcgccgctttttaaatccttaatcacggtttggtgttttttttctttctttgtaggataatatctcatttactacttattatacaaaagacaagtgacgtttgcttcattaaatgatgttgtatgcccaagaattatattctttggcatatgatatctataaatattatttcggagtatatttcaaaatgtctttggttatatgtcactttattatttttaagatttttttaaaatttcatataatttaaataaaaatataaattgaatatattagaggataatttttcatattttccataggaatatcacattttcatttcacttttatgggaataaaagtacaaaaaaaaaacacaataaaaaagaaagttataacatttttaggaattcacaatacctgaaaataattttcaaaaacttataacagatataagaatgcttttttttaaagacaaacgtaagaatgttacatttccaagaataaacttttaattcataaaacaaatgcactctaataaatataatataatatttt

SEQ ID NO: 2363 - DNA, 1455 bp, Glycine max
  Soy_ogl_1926 Gm06:13655346..13656800 Cluster 9
gtgagtgtaaggtgctttgtttgctttctttttcaatatatttttttctttgggaccatgagttgctaattaagacccttcaagtgcatcataaacttgatgttattatcataaatggattttggatgtctactatatatagcgaattcacatcataaatattggccatggttatggcctatatatgagaagtcaagaatgctagctagctgctgacattattattcttataaataaaagatgatcatcattcatcaggtaaccctcgatcttcttgtgtataactaataaccacatattggcgtattgctaaagtagtaaagtgaagctaattttgttacaaaaatgatatacacttctataataaaatatacaattaacagagaaaaaaaacaaatttaaatttgaatataataaataataaggtgaatgagggagataaacatgaataatttatcgtacaaattattatctatgtatcacttctcattttattataaaaggaaatagccggagggtgggcatatatatatatacatacatgatacatgcacgagaaatgcaatatgtattgtgtatatatatgggtgaatgaatatgacacggggaatggtttctttcaagtgaccttctacattaacaaaagtatatgtcttaatgtgtacgagaaatgcaaataaatgatctcattataaaattttacttctaatatattgataaataatttataaatatctctcatagcttaagctttttgagcctttaagtttgtcttaactctaataagcactgatttgtaaaaaaaaaaaaaaaaaactccagtaagcacttgacatcccaactcactcaagcttctttttttttttaaactggaactcattgaaactttcatgtataaaaaaagtataaaaattatacttttaagctaatggtataaaaagattatttttaataagttaatagtataaaaattatggcacacaatgtatatgaaaattaaacacttaaaaatacattatgaaatgctattaacattctcctatatataaatattttaagtaaaatttattcatttattaattttaaataaatacaaattttggtggacgtaaaattttagacttagttacacttttaatcttcccaccttaatgtttttgtgattttggtcgtcttgtcttaattttaagctcacatttagttctcataatttaatttttaaatttttcaaattaagtttcttgactaaaatttcattgtataattaatagaaatataattgaggaatgaaaaaaataaaagaaatataattgaggtacaatgtatcattgatttatataaattagtaaaatagaaatttaaaaaatatttaaataaacataataaataattaaagtataaaaaatgtaatgaaagttagtttttcatttaaatatttgatatgtttttatttta

SEQ ID NO: 2364 - DNA, 1200 bp, Glycine max
  Soy_ogl_4133 Gm12:37775801..37777000 Cluster 9
tatgatggctttaaagatatatagcttgtacgtacctgagtatctttgatagtaccccggggtccattttgtgccatttgttcttctatggactatgttatcttttgacatcacgggaatggattattatcagttaccttagcattatagcttttgcatatcaaacattatctatgctctggtgattattacgtgcatggaatattgtctgtgtatgagtgagttgtcgtaagttaggaccaccatttgtggtaaatgatctctggccttgccagggtgatgagtggtgggcgtggaagatttttataaagtcactttaactgtttgtttgttttgcatttttactcactgctagtttgtttttgcagaaaggacggagcagctgttgaatatataaacctgtttgaataaaaaaaaaacgtgatttttacatttttttattgtataagatcataaaaaattaatatcgtaaataaattttctatattgttaattttggtgaaattttttaatatactaatttttaagtatcttatatcactttaatataaagggaagaaaatagtacatgcgttataaacgaattttactctgttggccaattaaaaattatagtatataatacttttattgatttttataataattattttaaaaaatatctctaacaattttttttttttataaatattttctttttcccttaaatggactttgatccattacatacgaatattttaacgaatgaaaattatgaagatgaactaattaataattaaatgaacaaacctgtaaagatcctcaaatttaaataatataataataaaatatatttttaattcctacaaacatgctttacttgttgttgctttgtttgatagagaagaaattgaaaggaaggagatgaaagttattttgtttattaggaagaaaagaatagagtagaaaaatttaaaaatttataggactcacaataataatttttacttatttccatccatctctctattttactttaactaaatattttttatttctcacatatttatgttcatctatactttttatttaatttcatttattatatatatttctctctctacttgacagcatcaaaataagtaataattatgatttttataaagtttgaaacaaattataatagtttctcctaaatttaggacttattacactcacact

SEQ ID NO: 2365 - DNA, 1200 bp, Glycine max
  Soy_ogl_4711 Gm14:6359601..6360800 Cluster 9
agttgcttcagaatcggtccccaatacaagtatggagattctcatcaagcttgaggtaattgaagtaagtaacatcccatccaattacactttctatgctgtctatatgaaagacagaaccaggctaccattttcttatatattttacattagggcctacaattttctactgtgtaaagatatgtattatttataattatgattatgatgtgtttggagagggggaaaaagtaggatttaatattttttccttgatttttttttaatttatatttttagttcttaaatatcttttttagtgttttataataatttgtggaaaacttatataacatatgtgatagtaacattttataatattggaatggatattctatgtttattatcttagaattgatttaaaacataactttttatatcagttgtattaagaattggtgcagaagatatttttatattaattatttgttaactgatctagaatgtagatgttatagtaatttttgaaatcttattttaaatttattaatatataaataatttatctataaaataatttctagatcaaatttgtatataagtgatgtagaatgctgacattttttccttttaatttttcaaattgttgacaagattttctagattgtttttttgtacaactaagatggaaagtgttttgatattgattcttagtatagttggtatggaaaatctattaaggttttttattcaagtagtatgcccatatttttattctcgctctaatattcaaatcatcgttctctcatttaaaaaatgtctaaaaaaaagagaatcaaatcaatgtaccgcctactcttccttctatatcaacatgactttggcttacatttattatgacattatcaataaaaaaaacttttaataaaaataacagcatttgtatattagaaactgttttaaaaaaatattattaattcaatatttaccactgttaatctttaaaaatacatgttcttactcgtatttgtcattaaaaaagaattctattattactaagatctctacaatatttattaatagttaataaacatttcattaacttttatttatttttaaaatcactatttaaattctcctacttcatcttcatacaaatcttcctattaccttttatggtaaattttatattttcaagacaataaatatatttacttttca

SEQ ID NO: 2366 - DNA, 1079 bp, Glycine max
  Soy_ogl_4723 Gm14:6658122..6659200 Cluster 9
ctaagatataaatcatgtttttcaattaaaaaatacatttattataaagatagatcatggtctttaaaaataaatcatgttccttaattacaagaaaaatatcattctttttatgtttcttttctcaaatttctctattgtcgttgttatatttttgtaagagatctttaaataagattttaactttgtgatgtttatgattatgttttataaaacattttaaatgggattttaatttaattactatagtatttttaatcaatatttttttatcatttttttaataattaattaaagtgtaggtaatgggtatttagatatccaacaaagaaaaacatagatattgaagttattattgattatttaatcatatacacgagtaagaatttttttttaatgcggatataattataatttcctaactagaccttattcatttttattctattagtttaagaatattaattaaggaaagtaggaaaaaattagttgaatttttaattcaaaatcataacatttattgtattaataatatgagaaaaataagtctatgcatgaaaatataaaaaagattatatttttgagaaatatgttaataagtttattatctaatcataacattatattattatctaatcatagtgatattaatacatttatttttttgagaaatatgttaataagtttattaaatatttataataacttataagttatttctaatataaaactttttattccaatagtatatgagaactaagctctaataatgttaaatattatatcttcctaaaaaaatgtttattaattctttaatatttatttatctcacatatttatagttcaatatatcatatattgcagtaaaataaaagcatggtataattcctaaaagaaatcaattactctttctttcttaaaacttaaaacaaaatgtttatgtcttggcttcattatcaatcggttggcatcggttggtggcggatttggaagtggcgtaataacatgtcattaggagtattgatgatttcctcttagtgccctctctctattcatggtcttggtgttgctcaccagat

SEQ ID NO: 2367 - DNA, 1255 bp, Glycine max
  Soy_ogl_5573 Gm17:7805846..7807100 Cluster 9
taaaatacttgaaaatatactctctctctttttttactaatatatgatattaaacattatttattgtttttggtacttagaataattaattaataaattacatatcaaaattaacaaatgatcattccactaataagaaataggccaaataggattaagaaatagaccaaatgacctatttagtatttttttaattaattaatttatttttaaaatattattttaaatttttatctttttaaattagtcaaagatgatcattttatttatctaaagttaatgttattgataaactgaagttattgatgattaaaaactgttacaaaattgaaaaaaaaaaaaaaactttttcatcttcctccttctcccttctcctttctcctctttctctagttactagattccaaaattaaaatcactttgagggtacttctcatatctggataaaaagaagttcacacacccaacaatctcaacccaattatcacattccatttccttttgcaaaccttttttcttcgtctgatttctcactctatcaacatttttccactctccttcttcctctgcatagatatttgagagctaaacatgatattcagaaataactttttccaatactaagtagccatgatttctgcaggccccaaaatagatcccaataagatttctattgcatcaccaccctcacccccggacaaactcataggcttcgaccaccctcccaaccgcaacaatttaaaccaactacttgaagaccaaaccggaatcggatggatttgagatttcaggttatgatttgggggttcttgattttctatatgggttgtgatttgttgtgtgtttacagaatagaaatgtttagagagaaaattgttttttctagtagttttcaatcataagtaattttatattattaactgcggttaaatttatgttgatataaggattattttgaattttttaattaacataaattattaaaatgaattctttaaagataagatactaaactgaataaaaaaataaaaaataaaagatcaaataaattatttaacattaaaaaatacaattaatattttgacactaatattattatgtaactccttaatatattaattatctttctaattaattacttatcatttactacacaacagtaaagcctttcattaaggatactttatgtaaaaaaaattaattattcaccaattatttaaatgacaacttaaattttttcaaatgtcatctaaag

SEQ ID NO: 2368 - DNA, 1455 bp, Glycine max
  Soy_ogl_6257 Gm18:58772301..58773755 Cluster 9
gttttaaaaattttccaagcatgagtacgacaaatattatgtttacacattaggttaagtggaatagtttctataatagacttagtaggacgtaatggcggagcttgaccgattattttgaggaaggtaagtgataaaaaatattcatatacacaaaattgaaagtaacataattatatgattcgaaaaaaatataggaaagtaatgaaaaatatcaacacacattaaacaaatcaactagaaaattatatttgtcttataataattattgtacaaggataaataataagtctcaaaataattattattttagctttaaactataatattaattatttcttcactaatatttcttataatattaatgtttaattatttctttcatcctttaatttatttttaggctcaatttgatgatcttattattaaaatgttcaattaagtcttttattttcttaaaaacaaataggttcaacttagtctcattttttgttcatttaatctgaatatatttttaaaataagactaaatttggttataaatggatgaaattgaatcaattttaaaaaataattgacttaattgaaacttttaaacatcaatgatctaattgaaccattttgaaaaattacaagacaccttttaatggtaagaagacctgattcaacttaaaaaaattaattagagaatctaattagaatattaattaaacctaacattaatgatgaataaaaaaactaattaaaaataaactaatgatgacaatgttaatattataaaattattattttctttcatttatctattaaaatttgtttggataatcttctttagaataagtaattttggaaaaaaaaagtaaactttttcataagctaatttttaaaaactatcatttctattttttttaatttatggcataagataattttaacttctgaaaattcttatatcattttttttccaaaaagtatttttaaagaaacttaatcatttaaaaaaatgttacttttgtacaaatatgacatatgtccactctcactttttacaactcaagcaagtagtaagaaatttgtgttcactttcttttttcttatcaaaatctcggtttactatttaagttaatcacatattaaaaatactatattaattttgggggtgtcaaatatccatgcatgtatgtaatggacaaaaaatttggggaagggggtcatggctcccccgccctcaagatactccgccattggtagggcgttaatacatattttacatgtaattgagtcctaaattcaaattttggttcaaaatattttttttactgcttcaatattattttctaaaaataaaccttggtgatgatttcctatcttaaattttttcatcatccaatcgcaatcccgattgtcacacaacacattgtgttatttattcttattaatgcatagcattattaaa

SEQ ID NO: 2369 - DNA, 1400 bp, Glycine max
  Soy_ogl_1966 Gm06:15630401..15631800 Cluster 9
aattatatttcttttggatctctttaggctcaacttataaaaaatgaactgcatattaaaactattcagggtttgactactgataaaaaaaaatattaacacttaacgttattcgttaaaaatttagttattcatttgcacgttagtcgtatttaattatttaaaaattaaattttttacatgacttattttatcatcattttaacaaaagtaaacaaaataacttaagagttcgatggtgatgttctaaatgtataaagtaattttataatgttatataatataaaattactgttgatatgaacttttaaaatattttttgtaaaaataaatataattatcataaataataatatgtgattaaataataatgtaaaattattttattaatagattaccattaatctcattaattaaagaatttctcctctcataagggtgagaatatgttaaaccccttgatgtgtgtttatgacctaacctagctagattcaagtcaggtcaggttttttcaaaaataaaataagtttacgcttttataaaagtgttttacaaattttggaacaagtatgcatgtctagtacatgttaattgcttaaaaaaaacacatgctaattgtcgctgattattgtatatagaagtacgatatattctattttctaaagtctaagccgtgtgtgttctatcattactccacatcattctttcatgatttgcgaattccgtttcatactgtataattttttaaaataaaaaattggtcttgtaattcagtctttttatatagtgaaaattctataataatattattaattataagaatcaaaatctaatattactataatgtaatatcgacacctcgtcaagttcgagattcaattacaaagtttgaattcttctgaaacctgagctggtaagaacacctcgtgcttgtttacaataattgacaattagtttgattagcttggacgaccaagaatttttcatgcattgtacgatcacttgtcaaaactcaacaagaacataatagaagaacgtttaacatcttttttaggtggaaagtatgttccgtgagtattcggtgggatttgctaaaacagacaaattattagctgatatacgttgaaattactcgggtaaaggttgactaatcttttatttttatttttttagttatgtgtaaattttgggatgctaaatctaagatattgaaaaattctaaaaactatgattaaagacttataaagagggaaaatataaacataaacaattgagatagattaattcatttctcaaattttatagtcctaattgatgctatggataatatctatccatttatcaacatctcattgttttgaaagaaaaacaataatttatagtatacgtatctaatctca

SEQ ID NO: 2370 - DNA, 1700 bp, Glycine max
  Soy_ogl_2396 Gm07:36474901..36476600 Cluster 9
gacagtaacactgtctaagttacagtgaacttaattcactgtaattaaataaaatttacaatgaattttagctattacaatgaattaaaactacactgtaaaaatgaaaattcttgtgatgcatcttatttcgtcatgggagccatgctatcaaattcaatttgcggcctttttatttgcaatgattgctttaatgaatgatatctaatgtcaaaaagtatgttttagcattttctaaataactagctaattaatgatttgaggatagtacttaatagatacttaatattgttaattaaattcttttagtgacttatacaaacagtattaagtatttttacattttaataataaatatttcatttttagtttttaagtaccggctgaaagtagccaagattaatttagatgaaagtctttcaaaaattgtgtttattatattttatttatcaaccaaagtcaatgatcatatcatatatcgacagcagatagtaatcaacaaaacgtaatttccaaaacggtatgaaacaacgaagatgatggactgataggactattaaaaacggtatgaaacaacattaaacatgatgaactaataggagtattaaagtatgacaaatgttagttactatgtttggaacattggtcaagaaattttaaaaaatatatatttattaaaatacataaaattacattgttataattttctcacgtgtttttatattttttacaacaaatattttcttattttaattctttaattaataatctaacgttattgaattagtaataccttttaaagtagtattaaccaattcgaatataaacgcttaatattaggcatggcttgctgccacgtagggtcacaattttatgctttgtataatcaacaaccgagtagtgtgattgtctaagaatcatgtctttctgccacaataattatgaggtattgatgcattattgtttagtttagataaattagtaaataaatatttacgggaaacaataatgtaaagtaaattaaatttgtttatagagtaaaatttatttttgtcttaaaattttattacccggagaggtagaaatattataaaaaaaattaatctttctactaagtacttataggtagaaagattaaattttctataaaaaaatctaaatcgaacctacctatatgacgtacaaaaaaaacctacctatacatgttgatagtttttactttttataaaagattaaaattagttattgcctatgcaaagattcattcacaaaaaataattgcacatttcataaaatgatatatttaattatttaataaatgacttgtaattaaataattatatgtatttttaaataattatcacatttcatgtttcaatttatttcaaataatttatcatctttaaaattagaataatacttacacccctaaaaaacaataaattaggaacttataaattgaaatgctatatgatgtggcttttaaaaaaaatatatacgatagtaaaataatttttttaccaaacatttttaaacaaactgttaaactagtttttttaagaattaaatgatctagaaattaagtagtttgccctgctaaaatacttttaagttgtcttgttataatttcaaattcaatcgttccttttttataattgtatacaaattttataatttatattttaaaatatgatttaaat

SEQ ID NO: 2371 - DNA, 1150 bp, Glycine max
  Soy_ogl_4997 Gm15:11431101..11432250 Cluster 9
caatttaaggttaattatgtcattatcatccataataatatatttttgtcaaacttataaattatttttagtatgttaaagaaaagtaattatctcacaacttataaactctctgatttgagtcacaaagacattttacaggatatataaaataagccccaatttgaattaagtaaacacataataaaacatgttaggacatgttcgagttttcattcattatgttatgaatatgtttttagactgatctaactaatcaatactaaaaaaaaaaatactcttttgatccttttgaaaacgttattttgaactacacaaacagatatccaaacatatactcaatatactttgttgtatagtcaagtatttttcatagagtttaagtctaaggaatatgtttaaaagtaattaattaattatctaacaattatcttgagttttttttccatctttgtctatatatgttttttaatgaaagatataattttatttgctttcattttctttgtttgtatcttcctcccataatgggttgtttttttgttgggattttttttttagttttggtgagttggaatttgtagtggcagggattcgatcgtgcaaacataattgagcagggtggtgcacgatgaagttttgccacattggacgaccgtgacggctatagattagattagaaactttaataatacttcttgtaaagctgctactagtaaaaaaaacaaaacacattttaacaataatcttgtaatcttgtagtagaattactttttactcaacagaaacgaaaatcgaaaaaaaagaagcaaaatgtgtagtaatataattgatgtgataaaaaatataaaatgaaaataatattataaatatatgttatatgataatatagctaagaaaaatgttgtaacagactttccattataaagccgtctacaatcaataattcaacggttgaaatgttctcgagactcttataatcataggcgattctattttgaaagatgttcaaattgtactactacctcgtctcttcttttttttatacgttgtttaaggttgttttataaaaattaagaaatataatacttttgattataacaaaataattgcggagtttctttttcattttttttctttttatttcata

SEQ ID NO: 2372 - DNA, 1521 bp, Glycine max
  Soy_ogl_5671 Gm17:13265901..13267421 Cluster 9
gatgatatctttagttcttaactttcatatattgtttctttgtatttgcaaagttttgtatctgaacctaagtttcatatcctcacttccataagttatttcttcttaagaaacttatgatattgtgaaagcttaaagaaacttggagttaaacaatactttggttagtaatctcatgttaagattatgttacgttattttaagatttgaagagacttagaaaaatacttgttgcaaattgtgtttttaggggaaatttgacatagctcttaattgaagaataaaccggtataaatccctttctatcatgttttcatattgaaaactttaaacttgtgtttatcttatataattttattttaagaacagtttttcatatagttcacatacacgcacattacaagaaaaatactaattaccgactgtcatttcatctgcttgcttccaaagaaaatatatttgtatggtgtgaaagcaactccaaaaaaatattgatggaatcatcaatatacattattattgtctattgtcattggtttaagacatgctcagtttgtcccgattgattgatgttgtagcattgaaaacaaaatttatattaactaatgttttcggtcttcaatgagatattaaaaaatctatttcaattttgttatctaacaaatattgttgttttaaagaattaataatatatatgtattgaaattaagaaaaaaataatgatattttagtaaaaatgtcccatattaaatgttatcatgtaatatatcttttcttaatctatctgaaaaaaccttaaatatcggttagtttgaaatagagggagcattcaaatcatgagttgcttagcaacttgtcaagataaatgagggtggtcttgggcaccataacgaaagagagttacttagtcgcttacacacttgaaacgcattcattcttggggttaaaaaaacctccacttatgcacttttgacaccatcctagggaaacatatatcgactccttcttataaagatattccatgaatatgtttatatataatttgtacaaatatcatcattatatgccataaattcattatcgtattatcaaacatgtggtagtatatcaacaagcgtgaaattttcattttttttaaatgtatcttttacacaaattaagaataagctacttaattgaaagtgttttgcatgaaaatggggagagatcatgaatctaggttagatttattatcattttatttagttaagaaaaataaacaaaatcattatggaatgaaattcatttcaagtaagaaaataaaataggaataaatttatagaaattaaaagaaaaactatttgagtttaagtatttaaaattagtataagacaatatattaaagcttaaaaactaacttagacagatttgattgtttaaatatcgaaaatatgttattactaacaaaacaaaattgctaaaattgaataattatgaaataaggctgtaagattcaaggagatgaatttagatgaccaaaag

SEQ ID NO: 2373 - DNA, 1357 bp, Glycine max
  Soy_ogl_6729 Gm20:33637944..33639300 Cluster 9
cacatctactaatcatattaacctgtcgtgtttgatttttacaaaaacactagagaaactagtttccattatgtataaagccgagactttgtgcctagctgtcttttcatgtttttttaataaaagatagtagatagtttcaaagcgtgtgaaagtaattataagaataaaataataattttataaatgtaattataaaaataaaataagtagaaaaatatatatactaagatactgttattccttttatatataattatagatatatacatcttattaacgatatttgagaggtggcatgtgggacaatatgtttaaatgcatgttacatctaagtgatattgaattcaagattatttcttttaaaaaaataaaatttttttactgcaaaaaactttatgaatactaaaaccagtaaaaaaaagtagaggatcaaaagattcaaaaccaaacttagctatagtcagatgaatttaacctattttatccaaaaataatgatttttttaattaattttttttgtagaaattttgaaaataagctttttttatttacctaaaaataagcgttttcaagaatttggctcttaaaattagcaccatgcattcatttggtctttattctttaatattataaatatataaaattagtcctttaattttatgcatattctgttaaatactttagtccattgaatttgacatcgttgattcacttgatttttattttattcacaaaaattaaagataaatactaaaaaaatttataacaactcacattatattttatcaattgaactagactctttaatttttacttatttgaaaattagacaaactagacttttttattttttaaattaaactaaaactaataagttaaaaataaaatcagttctattttagatatatacacaaattagagatgtgactgaattgtgccaatcaatcatgaacatgtctaattcaatcaaattcaacccaataacattttttatgaggttgagttaaatttttcttaatatacccacttaaaattaaattggacaacattttcatgaatttcaaatccaactcaagttgattattgtgttaaatatataacaaaaaaataataattatctaattatttttatatgttgtatgtgagaaattgtgaataataaaaaagtaaaaaaaaaaacgaaaaaaaagtaaactcttactctcattctcttgcaagtcacaacaacttattttggctttgaagattgagtccatataataattatgagctataaaacaaatttaatgattgtattgaatactaagtatgagttttaaaacaatgaggctacgaatactagcaactagcttat

SEQ ID NO: 2374 - DNA, 1404 bp, Glycine max
  Soy_ogl_3039 Gm09:7458597..7460000 Cluster 9
aaccattctttaacttaatatcaattgggttagtttagttatgattgtctactcaaaattcaaaaacatagaacacaacctcatttgatgttatttaattagattgaacttctaaacgcccaaacccaactcaatcaacccaattatatggcaaaaaaatactataaatatgagaaacgtattagcattcgaagtataggtatatttatagttctcgtttttttagtattaatatcgattgatggtatacactcatatcacttaatatgtgatccaatgaaccaatctgaaacaattcaattatttggtttgctcaataagaattgtttacccaaaagcatggaatccaactcaactcgatgtgcctttcaaaaaaacaaaaaaactcatctcgatgttaattaattagtttgaatttctacacatccaaacgtatttgtattcttaggatatataacacaacccttcctttgcttgaccagaggaaaaatgagagagaaaaaaattaaattgaaaaacaagtaatattttttttcttctaaatctttcatgaactaaattaaaaatatgtttcattatttaatttttacaatccaaataataatacctagaaaagtgtacaagagtctagtttagatagttgaatataatgttaaattattacaaatttcctaatatatcattaattcctgcatataaaaaaactaccttaaagagtgtacgaaatagggatcataacgattgtcctttgccttgcttctctacacgcgtcaatgggtaatatacattttgtgccgacctagtgacatttttagttaaaattaaaaattgaatcataaagcaaatataaaattataatttaaaattaattaattgacacgtgtaagaatatttttacaagagaatatgtgcgtctaagttgtaatagtactgttagcttgggacatagttgaagataaattcgaggaaatttttcggtgcatggcaactcatgctagctactattgagatggtagtgagactgtttggaaggcaatcaacttgtttcgttttgattctctgttgctgaaaatctaagcgtttttagaagacacgcttatgtaataaaaaagaaatagctgaatattgatatcttaggaaaaagaattaacatataagtctttgttttatggaatcaattcttcacactatacatataatttaatgtcaatatgactcaaactaaataattttgctaaactttaaaattagaggacgtataatattaatgataaaccaagaagtcaactaagaagtgcatattgcataagttggtgaatgctttgagtgctaaatttccttgaaagcgactataaaaaattgcttagcaataatattaacgttatcgatagattaacaacagtt

SEQ ID NO: 2375 - DNA, 1400 bp, Glycine max
  Soy_ogl_5649 Gm17:12198801..12200200 Cluster 9
acccaacattttaagtgttttcccatgaaaagtggttgacaaattcaacttctgaagtgtgaaattgtcacatgggtttttatcaagggttaccagctgcaggtacgacgttacgactcttctaccttccagaatcaggtgcaaattaagttatgtgaagtttcaatgaagaaggtttgcatgtcacataagagcttattcatatagtccatctgcaaaaaatactactaaaatgtaacctaataaaaatcataagtcaagtctatgaacgcaaattaataaattctgcttaaactcttcaaaacagtctcattcatatctttgaggcatcaagcaatttaattttgaagaaataaatgcacaagaacaacgaaggaaatgaacgtacgtttcaaagaaattatataatgaagaaattgtataattgtataagagagaagaaaaatcttgctttacatgctagtgatgaaattgggttagaatgtcactaaaattacatgtacttatttttaagagaaaaaaattgcatctacttaaatcttcatttcacgcccatttaatgtttgaattatgtttggaaaaaatgaaaaaataaaaaaataaaactcaatgcacgataggatgaatagggtttacataaattatatagaataaacaatgatagatatttacaatatcacccctacaccatttgacaagtgtgcctacgcttggttgagagctctgctccacttcgttctaacatttactcattcatagaatatgagtcatccacagtgaattaatgagaaatcggtgtacaattttaataaatttaatagaaatccatatatgagaaaaaaattggtcgaattttgatttatgaagcgttaattagatggttcattaaatttagaaataatagaagataaattattattcattcatttaattattaagatttttttttcctgaatcgcatatcacatcgatctaaacctattaagtcacagattaaactgtatattacatgattatcacttacctaaaaaaattttacgcacgaaagaaatcaaatacaaaattctttcattaaataaattattcttttatttacaaacataaaggatcttacataaattctatgaattatgtacatcatttatttgattcaagtattttacttttaacaaattaaatagattaaattgaatttttcataattgaaattatagataaacaaacttctttgttgaatctaatcctaaagttacttgtgattgttgtaagttatagagaatcatttctctcttatgtgtgatgtaatgcctattttcatgggcacctttccaatggctaaaatcatgtattatatgattatatctttatcataaatagactctccatcaaagtatcattca

SEQ ID NO: 2376 - DNA, 1022 bp, Glycine max
  Soy_ogl_6857 Gm20:39144501..39145522 Cluster 9
tttaatttttgaaaataatcaatttattttattaaaaaagaaagaaaaggaaagtgcccaaaatttgctgcatgaaacccatttgtgatttggtgagtcatgttaatcaacacagccacttgcccatgtctcgtgcaacaaaaagtaataaaacttgctctgtactcgaatccgtacaatttgatttttcttttctattttttatttttcctctttttccctgtactattattgcagacccacaaacaaaagtccttggggccgaaaggaaatggacctaataaattaaataattcattttgggaaacagactacttttctagcgtcctgactcgtcttggtgctgctttgttggaatttcatgatcattggtcagtattctatttcaaaaatttgtacatgcatgaaaattaatatgaatttaaaaattatctatttattaataaaaatataaaactgtgagagcctaaaaatttctattttaaaaaatttgataattaagttaattagtaaaatattgcttgaatgattattataaggatattattatacttaatattgattataacaataaaataatttaaaataattttaattggacatctaataaaaaagattgtaaaaaatattgatttaatttggtacgtaagacatgtgctatgaaataaataaaaaatatacatgagtgtacgagaatgataattcatatagaagaaatacaaagtcaattttataatatagaattgaataatatatataaggaataaattaaattcttctaaaattaacttaatttaaaataaataaaaaatatgctttaatttttttagtttaatttaaatgtatcatgattttaatttataaaaaaaaaaaaaaggaaaactgagttaaggcatcacaataggggcaagcatccaaactatattggtacctccgtccctacatgtcccatgcatcacatcttgaatactattgataaggaaaatatgaacaaacatggccaaaccaaatccaaagaagcc

SEQ ID NO: 2377 - DNA, 1068 bp, Glycine max
  Soy_ogl_689 Gm02:46138033..46139100 Cluster 9
cttttccaaaaaaaaaataatcaatcaaatataatggatcggagtaatatttagatgacttttgatcttaactattctagggtaatatttttttaagactttgcttagacgtcatatatttattctaattgcacacgtgattcatttttttccttcttttttaaagtagtaaatttttcagttttaattatcaaatgttcatattaatttttcattgatcaaattacaggaaaaacccgagattttgtgtgataacataaatattcctactattttaaccattactttttattttagcaggggatgctagtgtaatattggaagtgtcagtataatattttcaaacgaggtgttaatgctttcaaacatactgttttaatcattactttcgacctctacagggagcgttagtgtaacgcttttaaacatataaaaatgtgttaatgttttcaaatttaaaggaaaattagtgtagataaataaaaaagatagagttatctgtaatttcacgattcataaaaaaataataaaaatattgttgtaatttgttttttttcattagaatcttttacaatgaaaatagacatttattacggtattttttttgtcctatatcaaaattattccatttcattaaatgacactgatatttaactctaaaaagttgtatataatagacgataatagtcctcatcttaaattttcaagtattttgaaaaatatcatgataaaatgagaaaaataatttgcttgataaaatttatgaaatgataatagtggtatactggaatgataaaatatgcaattatattaacttaacttgtgactctaaaatatttattgagctctaaattgatgatatttatgtatcctaaaatgaatcagtggggtcaggctagtggtggggtttgggggtagtatgcacaaaatcttaagtttaaaccttagtgctatacacaaaaaataaatgaatttcggggattaaaagaatattttaaatgtttgagagataaaaattaaaacaaagaattgtacaaggactaaaactaaaattgaatcattttacat

SEQ ID NO: 2378 - DNA, 1381 bp, Glycine max
  Soy_ogl_2690 Gm08:14730520..14731900 Cluster 9
ttaaaattattatgcttgatctatattgagaggttttaagataaaaagaattacttctggagagggagtcaagccaataaatagaatgacctgtaaaaactctatcatgaactatctaacatgcacatcaaaatcaagatcaacaattatattatatgaccatgaaggagaaatatgaacaatacttatgagtcaagccagtaaaataaatagaatggtatgtaaaaattctttatcgaacgtgcacatcaacatcaagatcaacaattatataaccatgaaaaagaaataatagaatgatcagtaaaaattctttatccatgaactatctaacgtgcacatgatcaacaattacgaaaccacaataacaacacttccagcacctccttaccatgaactatctcacgcggatttccctaccatggctctccttatacctatgttcacctatagcccacccattaatcttttttataaatattaattattaattttttgttaacatgaaaaattaaactcacatataattttttattcatttttttttcttacttaatcaatcttatattttttatgatgataaattttttatgtacagcactgtattaagcagccatcaactataactaaaagtgactgcctcaactactaccttggtcattaacccaaattgactatcatgcaggcccgatgattccaaaactccaagttcatttttattgagagaaatgtccacacttaataatactttaaaataagattgcatgtctctaaactaggatacatgtgagaagtgagaactaatatctctcttaaatacaccatcgccaccagatgttaaatttgaaatttttaaagttctaataattttctactgatgctagtttatttatttattttcaatttaatcattgtatgtaacgttttcataaataaataaaaaaagtgtacaggatttcacgtaatttaaaaaataattaatattctatcttactaatttattttaatgtataatatattattgaaaacataaataaatttctctgtttaaattatatatttataattatatgaataatttaacttttgatatgtgatcacgaaaataatgttacgattcaagagttgaattgataaaacttaaaggtgtcatttaaaaaaaaagtaactgatatattaaaaggggtcttattaacttcgagaacactggttatgagcacaaaaagatcataataatataattttttcatctaataaaatattgttatgtaaaattctattattattgttttaaggacattcgttaatatttacctattaaaatacaggtcgttagaaaacttaagactatttaatttagaaacacaaagattttgtaaag

SEQ ID NO: 2379 - DNA, 1738 bp, Glycine max
  Soy_ogl_2755 Gm08:18302601..18304338 Cluster 9
acatattttatgtgtgtaaatacatggaacacattactaagaaaatgactaatattgtagtaatattagtcacttgacataatctacatttatttgttttgagtgtttgttcataatcacttagcttcagtgtcttaaaatcaatttaaaaaaaaaattatacattaattgtattaatatataaatatattgatttgtgttattaaccgaggttgaatgataacaataattgagaacaacaaacaacacaagtacaagaacaacaatgatgacaatattgtttaacaatttgagggttttcggtaaaaaaaaaatacgagggattctagacatattgataggtataagaaaagattctaaattggttaacgaccaattaaaaaaatctagcaattttttttcaaagaaaacattaatactgtaatttagttgctaaaagttgatataaaattctttcttaatattacaaaaatgtcattactttacatactttacatattacgttgattgtttaggaatcaatgtaaattattgatgtaatttttttttagtattagtaaatttacacaattaagaaattagttaggatagaataagagtttaattaattatttgattataaattttaaagtagttatataaacttttcttgattattattgttgttgaaatagaattgagaagtagcagtgtgttttaaggaatgacgcgcgtattaatataatttttgtgataagattacaagtttcatgcatgctaaaatgtagattgagaattaagattagaagtttcttaaataagatataggtttaaattttgttaacgaaaaaaagttaattgagaaagaaaattttactaaaagtgattaatcagatttttttaaaaattattattatcaaagttactttataccattaacaagattatcctctaaaaaaaacttagtaattcaccactaaaattttaattgttatccagcttaaattgctaacgtgggagcaaggatgtcaaaaggatcgatcttcccaacacaaccaggcaattataaaattgttttatttgagttgggtaaagtccgcttgaagttttgggtaaaaatttcaattcaacctaacccgtagttgttatgaattaagtttaaatgacctaccatttttttttataaaaaagtataaaaaaaactcataaattgacttatcaaatacataaatatatgttcctaaaaaaaatcttaacatatataatgtcaccgtcataaaagtattatcttatgaaattatatcagtacaaattctgtttaaaaagctatcatgcgttaaataaatataggatagaataacagaatagcatgaaatctataatactttataaaatattgttccaataaaacaatatttaattaaatattctataaaattctaacaaaaaaaaaaacagcccgctgattaatccaaccttaagacatcccttgactcattaaatctacaagttatgccaattgaatggttaaatgagtcgaatccccaaaattaatccactttgacatgctgcttaaaagccgaggccctttggtggaagctgatgatgatgttgatttgttgttcgtgattcaaatctatcattttttatatttatttagtgattttttttttaaaatatagtgataattttttactattactatactaatttaactattttaaattttaaaacactaatagatactaacaaaaaataa

SEQ ID NO: 2380 - DNA, 1496 bp, Glycine max
  Soy_ogl_4971 Gm15:10234707..10236202 Cluster 9
tcaattggtttaacatgacaaagtatacattttaattcaaataataaaaaattaatgggaaatctatacgactttaatttttattgaaatgtaaaaagaaatctcgaataataattttattgatgcatctattttgacaaggtaagtatgaactgtttataacaaacttgttaagttgtggtactgaactgtttggagctggtgtttatgttaaaagatgttttgctgctttagattgaatcgaataattaactgataataggtttctgaaaatagttatagatatacttgctaaaaagaaactgagaacactagtaaacactaataaaggggagttttgtttaattagttgaataggacaatttttttgtaaactcctgatattagtttttgattcctacatataaagaaaagaagatagtaaacagttataacattttacatcaaattaagtttactttgtctagcaaagaagaagaaaaaataagtgtttaatttgctaagcacttctaaattttcatttatgcttgaaacaatccattcaattattttttccaaaagcgaaacattttcttctagtagtcccatcccaccttatcatttttgcaggcatgcacctttttcagctttatctcgacatgcgttttatattctaaaataaataaataaaagtatatgataagattctatagtacttattttggctgtaatctgttctcaaattgacaacatttttttttgtagccacttgtttagtatttactgtttgttgaccctagctagtattattgtatatattgttccatcctctttttgtgagtgtggtctatcatcacctgtttgatattgtcggaatattaaacaactgatatagtttgtggcgaacggtgtgcttgtaaaaagatattctaacatcacttcagtaacagataaaaggtaagtagtatatatagagagcaaacttatatatttgtctccccttatttacatatggtatttgtaggacttaacagcaatcatgctatttttgacatatcatttttcattatgaataagaatcgaagatagatacaatgtgtttcttatatataatgaaaaatgctatgcaacattctttttaacttactatttattattagctaaaatttaacataaatcacaaattttgactagttgtttttgcttattaagtctctcatgattttcaatgtattctaaaactaacaataaagtgtgtgttaggggtaatttattagaattattgttaatttttaaaaaaacatgtgattgcaagaactatcttttagtcatttatcgaaactaattcctttgtgggacttgatgaaacaaaaccaaaatttaaactcttaattacttgcttgaaagacttgagtccttcatcattataggttaaaaagtgttgaataaaactagtaaaagaataactttgaggggatcacaaattatccacccaagttagtttgtgtggaagaagg

SEQ ID NO: 2381 - DNA, 1076 bp, Glycine max
  Soy_ogl_5032 Gm15:13049492..13050567 Cluster 9
caattttctattacagcaataacatattgtaataagagtttaatcttaatacattgttcagactttttatacttatcaattagaaatcaatttaaaaataaaattcaaagtagttattagacaaataaatagttttcaattacgtgacattcatgtttgaatgataacgtacaaaaaaatttacactgttaaagtattttaattatatttgtctaatattttttactactactattatatccaacggatacatatataaaatcatgcaacggagaaaaatagatacataaaggcaattgttaggccatataaaatctttttctttctactcatagctgtcatgcatatatatgttagaatctgttacttcattactctcatgacatattcggctgtaataattaatggaagtagatagttcaggagtagtagtataattgtgatcctttaaatatatgatggccatctttatataacattacatttttcacatatattaacacataataataattatataaatatataaataactgtcccgtgaatctaatattttattttaaaaaaactcacgggtcccagaactagtatcttgcaagactgtgttagaaaaaatatgcatccgggagagattttatttttaccagtaaactttagttttgatagaatactacttttgttagtagaaattcgttttattttttttttgctttcttaatcattcaacctatcttatatatttcttagcggttagcatagattccattcactctacattacaattatgcatgacaattcttcccgtaactcggggattcctacggagattgtcccatttgggaccatgcggttggggaaaaatttccggagagcacagggatagggatgaaaacccccctaactaattctaatttggggacaggaacggggattatgcttcccgtcccgcaggatctccgtatccctgcgtatataaaattttacttatatattctcataacttataatatgtataacataaatataaagattaatataatattttactagtaaaacaaatataaaataaagttatc

SEQ ID NO: 2382 - DNA, 1549 bp, Glycine max
  Soy_ogl_4293 Gm13:27076289..27077837 Cluster 9
tttgaccttgatatttgacattatggtttggtgaatgccaatataatattttgatttggttcaatggtttggtgaatgccaatataaaattatagattaagtaattatgacgtaggaaaattaatgttgtttaggtgatttaagatgcatattttgagcaaatatttttttatattagacaattcacagttagttttaaaaatgagtgaaattttacatttaaatatttttattttatctttcttgttaaatgcggattgagctggaaattcgcaggctatgcgaggtgggggtagactcgctaaaaatgagcccgtttggaatgcaagcttaatcggttgaggactttgcgaagagacttatctgcatgctgtaactctatgtatatatatggatgcatgtgttttattttttttaagaatttcatttttataatttttaaatttgatttaaattaagaaaatattcataatccacatgtacttgtcagtttgatgagaaatcaccttttaataaattaatattataatcaaaattttgaaacactgatatgatgaaattttaaataaaataatctctctaattcgaccataaaaaatttatagtataaacacacatcaatgtctaagaatgtaaaaaaccacttcagtttcgaaaatcataaaagtagtcatatacattaatttttttagtgactaatatcatcttttgatagtttttacattattggaaactaatgtatttcacttgtaatattgtaatcccatgtctcattgcttatgagagattctacgtccttcctgaatgattttgatgttgttaattcttttaaccaattaaattatatgttatattctcattaattattttttaaaatatttttttaaattagttcttgattattatttttttttaaaaattaaaattgtattttttaaattaaaaatatgatcaaagataacttttgaagtttgaattctaaaatctttttaattacttttaacattctttttaaaaatcttttgggatttagggtttaaatttttttgtattgtttcttaagcacatgttttataaaaagtattgaaaattactaacaagattttagagtttagacttttaaagttattattaatcatatttttataaattttttaaaaaataataatcaaggactaattaaaaaaaccaaaaaataattaataagaaaataacaattaacaatgtcaaaatcctccaaattattaaaaacgtacatggtagaaactctcattgctgaaaaaaaaaattctttgaactaagtaaatacattaaaacaaaaacaaactaatatagtatgaacagtctgtttcattgaagagttgcaaaaatttctcttacctcgagcatagtaataatttccattacttaataattgattgttttaatctaaacctgtctattttcatttaagatcaatataaatgtcattctctatctattatataagaggactagtggcattctattaatgccggtccactactgtatgtcactgcgaccagatggt

SEQ ID NO: 2383 - DNA, 1073 bp, Glycine max
  Soy_ogl_683 Gm02:45881901..45882973 Cluster 9
acaataaattactaattatagttgtgttctcagtatcaaatccataaatgacccataacataccaatcaaagcgaaacttcatgcacctctatattttacttcttgcaccccattgtattaagaatgagacttttcatacagcaatgggtgcaggaagcaaaatgtggtagtgtaggaagcaacaatggacccatcaacatctaaacaaaaatgacccaaaaaaacaatagagcactgtacactactaatataactagatagtatacatgccatgcatgcataactttggagggataaatttttagaattattaaaatttcttatattgttgaaaaaaattaaaaataattcaagtgttcataatatagaacttatttattaataaaaataatataagataattgaatgtgattgcagcaaatgctcataatatagtacctcgatattttttttacattttctattttatttttctatatagcgttaatctcaagatattttatttaaataactttgtcacatattcacaaaataatataaatgattcaatcaaaatatagatatattttaaaataaatacatatttgaaattattaaatattaaattgatattgattaaatcaatcaaatataattatgtagaatcaattaagcattttaaatttggaataaaaaaaggtgggacatccttttattaaagcatgatatttttattgacaatccttatcaattttattttatataatatatgatacgatttctttccttcttccaaacttattattttcgttttttccctctccacaggccaccacgaaaaaaatttgcaaaacacattgaagaatcaatatttaaatttgttttaaaaaatattttaatttataatataaagattggcatatcatttagtatgatttttaaaataaaaacagtcataccagggagtaacatgtggcatgagatccaattacaaaaatcttattttatataccaattgaaaaagaaaatctcctcaattgttttgattgacgactaacatgtgtattttgctgattatcaatattattaatta

SEQ ID NO: 2384 - DNA, 1300 bp, Glycine max
  Soy_ogl_5758 Gm17:38389601..38390900 Cluster 9
ttgttcattttaaatttgctttttaacactttcataaaatactaaaatcccacataaaatatcaatttattatattagagactaaaaaataatttttcaaaatttagggattaaaaaatattttttaatttcaggaactaaataaagtaaatttcctaaattcaggaactaaaaaaatattttaattttaattttttttcttcaaaaaaaaaagtctttgttttttttagggcgattccgctctattttattgtcacattccgtatcatcaatagtttatttatcatggttctgtggattctatggatttataaaaagaacaatacaatttatataaccattttatatggttgtgtgactaaatgaaggttctaatgggtttgatcagccatccaaatcagaaatagaattacaacataatagactggttcaaattgattaaaaaaataagaattcgatattcagataaattgttatatttttttttcactttaataaccaaagtttcaatctatataatgcgataaataatttaataaattttaccatataatcgtaaaattttattttttacaggaaaatcgtaaaacgttaagcagcatgtttcgtgtcttttcttttttgctagttatattaagatctacaggaaaagtgaagtataagtcgtagctagcttcacgaaaaaaaaaagtccattgaaaatagtaatttttcattcttttgaggataaatgaatcttaagagttatgaattttaaggaaaaaaaaatatggtactgtattaaagttattattttgacggaaaaaatcacatatactcataaaattaagtgaatgaggtgcaattcttgcttctcattttattttcagttttattgtaattttaattttattataaaataatacatttttttgtttaaatatttgtgcagttatttacaaacttagacaatctgaatccttattttgatagctccgatttgatgttgtttggggaaataatgagataagtacgtatggtgcctggagtaggtgatcttgtataggaagagaataatgagataactctcagcaaaaaaagaaaaaaaaagtaattagataagggtcataataaattattagttatatactcccaaataaaattattagttgctttcggaagaagaattgtctagatgtatatcattttgttgtgtatttcattaaattatatttatacatctttttgtttgtttgagatatgcatatgtattttatatatgagagaaaatcttgtttgtgtttgataaaaatcttatatg

SEQ ID NO: 2385 - DNA, 1134 bp, Glycine max
  Soy_ogl_2127 Gm07:2221601..2222734 Cluster 9
gcaatgtttttttttatatttaaataagaaaactattaaatcaatattaattacagcctggaccaacggctttagtgaaaatgaaaatgtcaacgtactctataataggagaatatttcaagaagaatgaatgtaaacttgtctaaatggtttgtttgatattgggaagaaagtgaaacaaaaaaaaaagagagatgattttgcaggttatttaataaataaataaaatgaaagaaagaataaggatattttggtgttttatcataacaacactttctcctctatattccgtccacttttagatgaattctgaaaattacatatctcacgtattttcaatattttattatcctttcttctattctttattgttaccaaacaaaggaaggaaactactcctttatttaggaaaatgctctatattttacttcaattacaaatttttcttaagtcttttaaatttctagacgcaaccttataaatgctttaaatatttctaactatattttatgatattttcttacttataattttatatttttttaccaataccaaccaaaatataacaattgtatgttaatttttctcttattatttaaaaacataatttctctcttattatttaattttttattatatgttaattttagattaattttgtttgatatattacagtcatgctgcatctcgtgatttttaaaacttttcatatctctattatgtcatttacttattttgtattcctcccacgttatatttaaactaagtcaaattttagttacttttatccttgactcaaacatttctaaatctacatgttgtggatatttaagcagtttttttgcacaaaaatgagtttaacatgcatgcatggatctttccctaaagaggaaaaagtataaaaattccttaatattcttttttttattgtataattcgttccaaatgaactttaaaatacaagtattattccgacatatcttcttagtaagggttaaggtcatgtttgaaacgacaatttttttaaactattcataagagaaaaatggttaaaaaaataaaataaactattttttattagttaaaataaatttatacacttcaacttatataaatttcctctcatctagcctt

SEQ ID NO: 2386 - DNA, 1683 bp, Glycine max
  Soy_ogl_3118 Gm09:35854401..35856083 Cluster 9
gtgatatccagcaggaccaagaaacggtgtgctagagaggaagcataggccttcgtttatatcttttaattttatttttggatttgtaaagtgctggtatgttatgacatcgggactcaattattattgttttgtgtcttcaattttgaacttaaaactagtggttttatttcataattcgatgatattttaaggacttgtaaggtactttaaaaaaggacttgtaagacaattaagtgtgggtggatatataccttttttttatatatataatttatcatcattgacgatcgataccttttatttgttattatagtatttaatgaagtttgagtttattatgaggatatatgtgatgcctttgtactgcatggttattaaagttttaaattcatattttttttatatataagaattaaacatgatataaggaattacaatactcacgtattcaatcaacttagacttttttattaaacttatcatttattccgcaacaaaaaattatatcctatttctgtaatattttatttaataacttggtttgggtaaaggatgttacacgtttttcattgttcactctaattactctctagatcacacaccctataaaacctaagatatccctcttagaactctctcaagggcaaaccaccttcggaaacaacacagaaaacctaaagctttgagtctctttggaatcgtgaggtagtaaataattttgtattaatccaagactcttctttatagatttacttcattatttttttattaaccaaaacataagtgattgtctccgtaaaaagtaagataaaaaccaaaacaaccgatacaatctgaatcataaaaagtaaattaaattaattcaaatgtgatattttgtataccaattatcgaaagcaaagcaatttttttatgagcaaatgaaatactaatatttttacctcagataagatccaaaagttaatcaatcacaaacacccctacgagtgatcattgaggaagattaatttgagcattgttttgtctatttattcaatgcattaaataaatgagagcttaaaaaaacacgttggttgacgttaggagtcagagattgagggaagagagagaaatgataactctcttgttaagatttaagagggtaaagtctaaggatattttaaatggccaaaatttaagttagtcattttgaatattttatcgtatattaaattattttttatttttaagaaattttggaaatgtgttgtttatataagatattaatgtcaaaatttaaagaacccacaatatcaattagatttgttcaaaaaaaattatcttaagaaactcattaaatatctttcattatagatgacccaagagagtaagagcaagtgagcaacaagtcaaggaacacacgtgacaaatgctttgggtgaagagactggaataaattttgttagcaacgtaaaagaaattttaaataaattgtgtgttcacttaaaacaataaccaacatgtagagaaatgcaacgcaataaaaatatttttattaaattaatttaaatttaatattgatgtaactatttaaatttgtaacactactcgagcatattagtattatttttagttttagacccttgacatttataaattatgatcgatcgaataaatttgcttaaagaaaatatttcaata

SEQ ID NO: 2387 - DNA, 1000 bp, Glycine max
  Soy_ogl_5410 Gm16:32184001..32185000 Cluster 9
acttaatgtgaaggaagaaaaactcttcttgcgcaatatgcaagacaagggcttaaaacctcgaacgcattgtaggtgaccattagactacgggttccccagttgagctgattagtcggttagcattagcatggtattagtgtttacttttagtagtttatacacataatattaaggatggtgcataactttttcacaacaaattttactatttacgttagaaagagaaactgaaagtctgaaagagacgagaaaaaaaatataaaatataggagatataattgaggaatagaaaaatacattaactaataagtttaatgaatatgcattggtttaaaatgatattcaattataaattattgtttgaattattttaagatatataattcttttaaaagttaataaatttattatacataatagattgtaattaaatggttgtgtaaattatttttatattatgaatgtataattctttttcccttaattaattataatcgtaaaaacaggttgtatatatatgaagcattatatatcgatcctacttaaagtcaaatagctcatgaagacattgtaaattagccatccaatatttgttcactgtcacaaaaatctaatttcgctttttcaaattttatttttttgctaaagaatctgtttcttgttatttcatgagtgccatttttaccaaactttttctggtctcaaaatggtcattatttaacttattttagtggaatatacgtcgatgctgatgtcactttctctggtataatttactcagggtaaataccagtatatgaattaaatctataggaaaaattcaaagaatgtaactcaattcattgaatatattatatgaattattataaataaaactttaatattatcagtaacattatcattcttacgaataataaaaatacagactcaaagcttatttctaaattttatgttttaatataaaatataaataaaagaatgctacccaatcccaata

SEQ ID NO: 2388 - DNA, 1200 bp, Glycine max
  Soy_ogl_2308 Gm07:9533501..9534700 Cluster 9
ttctctagacacaactaatgtttttatctgtttgttatctttcgttatctgtctgaagcataaaaaaatagagtaaatgaatgtgtatagtgttatcaatctatgtttgcaatattaatgattaaatgtcccaagtaattaatgtgttatgaggttattaaaataattaacagtgattaattatactttaaaacaattaatttaccgggtggactactgagtaaatgtttttcaacggaaaaattataactttatttaaggtttaattatatttttagtttctagaatttacccctaatgaaaataaatcattttaatccctcaaatttaaaaaatacgtttaaagtttttaaagtcagacaacattaatggaaatgatacaacatggtgacttagcacttaccagttgacagatgttaaatactaacaattcaatgtgattagccactttatatcaccgttcgtcatgtgatctatttctttcttcctcaattcccttcgcttacatacatttagggtgtacgtttatcaaaacttgaagaaaaaaaaacatataacttatttaaaataaaacatttgattaaataaattttgttaataaatcaatacaagcagttttattatgttattatttgaatactcattttgattttatatacttttaaatcctcttttatttgtgtgattatatttacttcaacaccttaattttagtttttttaaggcatacatttttcttttataattagtactactctttattttttttcaacatacatttttaacccaatcttatactgcgatattttttctcttaaagttttagacaaaattattttttcctatgtttttctttttaagttctaccgttaattaatatttaatagttatctaagttatcaaatgcacacaatgtttctagcactcggacaacgttttcttaaaggaagtactatctgagtatggaagcactgtttgagttatgacttacactgtttgaattatgagttatcactcaacttgttcataagatagcagaagcattatcaacactacgtgagaccccttcaatcttgtgctatgcaggatctcttgtatagttgtattgctattgctactaaacaatattgcttccatgattcactatatatattagcatctcgtagattattttggcttcggagtctgataccaattgga

SEQ ID NO: 2389 - DNA, 1167 bp, Glycine max
  Soy_ogl_2617 Gm08:11887440..11888606 Cluster 9
gcatctcctttgaagagggaaaaaaactcttccgctaaacttgatcgactagagttagatcatacataaagtgaatggagaagtcattaggaatccaataagtactcaacaatttcatagccaacaaaactttaaaaaaaggtaaaatttatgttgaaaaatcctcacttccctcccagaatcaaaagttcccaatgaatgaatggtgcctcattgcatacacatacaacaggatatgtgaacaataatttaattaaattgctttttagcatgatggtttgtgttggacgaagaggtagggtttgcactccctaataatacttccagaaattaatttcctaaagatttaagtaattttcgaaatgcttactcattttccacttcagccagaaaaggttatcatgagaaaaaatatatatataaaaaggggcatgcacttagtaataagggaaagtggatatagaaatttaaaaaaaattacaaatccaatcgaatccatcctataaattttgattggattagatcatatatatttgattaaatttgatccaattggacatgtgaacaccgtattgataattaatgtgttattattatattttaaaaaatatatattttactttttaagtgatctagaattttatgaaatattctcttattttgcacttgagtgttaataatgacaattatggaaggaattataaaatggtggcctatgaattttaacactttctcctatgtatttttaccaattaaacaagagaaagattttagtttaacatattctcattcatgttttgtgggaagtaggaattcagagtttttgattcaacaatcacgggcctcctaagtaaaccaaacacgcacacaatcatacttatttcactcattcctattttttttcatttcttaatcactcaatccaaacatagggtaagaaaaaattcaagtgacacaaacaacaaattttaatattttttttaaagaaaaattaaatgtatttttagttcttataaatagaacaatatattattagtgttttaaaaataaattgtgatcttttagattatcatttatgaaaatgcgtcatatatagttcttatttttctcgtatacctacacacacaaaatctccttctagttccttatttatgtaaataaagatca

SEQ ID NO: 2390 - DNA, 1300 bp, Glycine max
  Soy_ogl_4797 Gm14:46939201..469170 Cluster 9
ttaaattcaaatctcattatcatcattattaaaaaaaagttgcctcctctcaagcaattaggcagctaatgaattggctttcttagggatcctttttttagtgactactaagcgttagggatgtaaattgtgtaactataatttggttaatgcagaaaatttaatttggatatgatcaaatgcaagcataaaatattaagaatcctctaatacatcattagatggatgttcacgcggtcaaatttagatcaaatgctatctattttctatagatgcggatttgccaaatcttagaatatgttttgattagtcgttattgttaatccatttggcacatatcttgtgtttcatgccaatggaacatgataagtaaaaatagcatttgagatccgttttgcgacttgtcaatttctttcaaaattataataattatttttctttcttatatacctacaggacattcctaacttaccgattgaaatcacctgtctcacatattgcatctcactctatatctcaccattaaaaacatgacacatcaattaaaaaaaatacacattagatttagtatcctcagctgtgggatatacttaggcacatttgatttaatttttcacctatttttccattttttttcaactaattttatgagggattctgccaaaaatggaagacgttagttcctgtatttttatattatcagaagtaatgattgtagcatattgcacatatattatattaaggttattcaatcctctggttagagaaaaaaatatgtgctcaattgcgttgtgttgaattttttattttgttgtccaattgtataatcagtggctaaaacatgtattccagccctttgctgtggtggtttgacggagggagtaggctaaggaaaaaggagacggatgttgttggagagtgaaagaagtgatgaaaagataataaattcaacgtgtattttttaattgacaaggtatgtttttattcatgagacgtaaaatgagacatttgtgagaaaggaaatttcagtcccctaactaacagcgaactgagactaattaaatttacacaattatatgtctattattatttggccaagacataattaaattattaatttgcccccaataataggttagaaatcgtgccaatgagttaggatttccttgtttgatattaagaaaaaagtttcttcactataccgatagttctaatataaaaattatgaaagattaaatttgatatgggttttaattatattcaatgatttaaaacaataatttaattaaaataaattcac

SEQ ID NO: 2391 - DNA, 1800 bp, Glycine max
  Soy_ogl_6665 Gm20:1045701..1047500 Cluster 9
tattttgtttattaaattctatgagacactgcttagtaagaaaaaaaatgtaaaatggtgaatttaattttatcctagcaatgaatatatatatggaaatctattgaagccatgctttttatctatgatatttcaaagtggtaatttgaaagagatcgaaacactgacaatgctgaaaaggccaaatgaaaagtgaggctcatgtatatgtcttaactcttaattattgcacgtcttaatttcatatataaggagataatcattcatttatttttaccgcagctttaattaataattttccttgaatgtaatggatttgatttgagtacctcttatattcagttgatataattaatcgtataatgtatgcaacaaaaaaaaaagtataaataaatgtttgtttataaaaaaaattgcaatccaattacccgcattaactaaattagtggaaaaatggatttgagtgtttctgaggtatgttgcaaatctttttcttatatgctcaactttccctggctcttttggagaagatgtacacaattatatgacaaagacattgatagtgcaaaataaataaactgaatatgtggcctctagggtcttcttccattctctcaatttttggtagtaaaataaattacttttgcagctaagtggcctcgaggctcttccatttctttcaaattatgttagccaccttttgtttcgcattgggcaatttgcacgcggttatcagataatctatcattcatatcttatactaccaggtggttttgatggggtgtacgtgagagaaacaaaatttgatgatatatataatttagatagttcaaattaaatttaattaaaatatcttcattatttataaatcattatatgagcattgtgtgtgtaaattaaatgatttgaatctataaactattcgagattaattcattggacattggttcaacttcgtttgattagttaaataatcaattttaaatatataggtaggtttgctgattcaaattaattaagactaaacttatgaacaactcaaaaatatatgtattacttaaattacaacttgtttttttttttttttgctgcattacaactctatttattacatatactttaaaatatatctgaacaatcgaaaaaaaaaactgatattaattatttttaatttttcaattacttgttaaatttactttttatgcaattttaatcctgtttattcaaaagttagttgggtactatataattttcatatctttaaattgaatgattcaaaatcatgttctaaaattaaaaacaactattatttaagaaggatttttttaacccacttaaaaagcataaaggataaaattaaatattctaaaagataaggaccaaactgaatataataaaaaccataaaaaaaaaactaaaactgtattttaaaaggttttagtcccatttaatttctttgattttatttatctctaactgtttatatgttagcatgtgttaggacctagtaggtttcatgtaatacaactctcctgatgtatgaggaatgcaagttgatagaccgatcctgaccttttatgggtctatgaaaaaaaaaataagggacgtcccttaatatacaaatattttaaaaagattcagtgaactatcgtattgtgtcaattgcccgagacattgactctaacgaataacccatggctaactacagtgcgatgttagtttttttttttttttttatgtaattttctcaaggttcttatccttaacaataggtttttaagggtgaattccccagtgttt

SEQ ID NO: 2392 - DNA, 1593 bp, Glycine max
  Soy_ogl_3870 Gm11:17424801..17426393 Cluster 9
aaatttctagttagttttacgaaacatggcttaaacaataaacaaaaatttaattaagtattagaaagtaataaaagttgtaattttaaatattcttttaagtaacattaaaagaagtttaatctaatgagatcaaattatttattaagtatctatatttttattaaataaacttatacattgatgaaataaactataaattaattaaaataaattgttgaccacactcgtaagcaatgaaattatattctcctttcattgttagtattgaacatcaccatctccgtcggtcacaatgtccgtctccgccggcacatgacagtgctagactgccggtggatgtaattaacaacaatgctagattggtgcaattaacaatgacttctgtgtaaccaaaggaactgatcagtgacaactaattgcatatacatatggaaaatggtgtatggacacatgtcctattatacaactaggtagaaatagaaacattgataataagaaaaaaaaaatacaaatatgataaataatgtaactagataagaagggggaaacgagaaaaaataattaaaaatgttaattaggtgtatagtttctatatcattattttatacatatatcataggataaaatcattaaaatatttgtaataatcacttcaaaaattgtgtttagtttttattaattgattggtagtgtaatttgttttataataatcatgtagaaaaaaaattagttttaaattattttattttctacttctgtgattcatattttctttttttagattaaatgtttttttttctcctaaaactatcatttacaaataaataaaaactgtaaattccaatttgatttaaagcaaacttagtatagggttcaactcagaaaaataaaagtaaaattaaaaaaaaaatcaattcaatccaaatcattttctattaaattaaattgactttatttattcacagagaaactgtgaataggatttaaattttaaattgaattgcattaagaaaatcaaagtgattggatcaatttttttcttctttcaaaccatccaaattaatctacaaacacacctgtcaaaattagtagcttggatttgaattaatttgcatgtttttatcttttaaaaaaggatttttacgtttttcatataaccttggattgatatatttagtaatttttattaataatcactttaaaaatcatatttatcttgatttggtggatactttttttttagaataagggtgtacaaaaattaaactttttattaaacatgattttgataagaatcttttccacaagtatatattcataacattttttttctatcttgaaaagacatttttaacactttatttcatttttatttttaaccaatatcttatatcttatgattaagatttgactttgggcctacaattgttggatgtacaatttcagcctgcaaggctactacaatacaacatacaattaatactaattaataagggtaattaattgatacgaagcttcaaccccaaaacagtaaaacacactcactttccgttctttttgtactccccacgtgtcctccatcgccgtccc

SEQ ID NO: 2393 - DNA, 1400 bp, Glycine max
  Soy_ogl_4393 Gm13:31832001..31833400 Cluster 9
cctcttggtcttcgatttgtgttgtgtcttgtccttggaaaccaacgtcacacattttaaggttttttctttatttaattactaagacaatgtttgtttacatttatttttcattaacttaaattgaattgggacaatttatttgagaaaatattcaatcaatagaaattttgtcaaaaatattctcagttttcaactatttttatgataaactatcctataatctaccaataatacattatattatttattaacttctttttatgattgatgtttctttttaatacaaatattaatttagttattttaattatataaaaaatagcttaaaaattacaaagaactatattttgaaacaaaatatatttcttttattttttatagaaaaactactactctaaaaaatatattttgtaaaaaaactacaaacactgttgttttgaaattgagggagtatataattttttatatattcgaatctttttatattaattagattctcttttattaatatttttttctactttctcattactaaatataataggaaaaatatttaatgattcattaatattataaaatatttttactttgataaaactcgtgtagctacgaaatggatactattcctgtttgatagaaaaaataaataattttttttgaaatttaaattgaaaggaaaaaaataatttcttttttgaaatcaatttttttattttctttcaattttttcaactgaaaaaagaaaaatatatcatatatagtgttttctttctttcaatttttttcttttcactctcactccatccaaatggatcttaaagtaaaaaaaaaagaaaaaaataaattgtattatattattttttttaataataattttgggtgaataaatgcaagaaagaggaaaataaaagaaaaataaaaagaggaaaatactcgtaacaaataaaaaaaaagtaaatatatttgttaccggtcactttaaacatggagcctgtggctctgccttccacaacgtgtgatgagacctgcttagcatagtcacttaaaacactgacaaaccaatctgcagcccaatctttgtttttgtcgggacagttcaatgttctcattaatcatcatagacttcattcttcacctgtaaatcttatttctaaaatttaatcgatgcacaaattaaatattaaatatacactataatcgttatataattgcattttttttaaaggaaaattgaatttttaatctgtgacacttaaaggtgtgaccagccacacgggcacatccattaaatatagcaaaactctcataatgtcttagcctaatgtgagtaatatatatatatattctctttttttttggtacataagatatttaaaaaaaattaaatagttctaaga

SEQ ID NO: 2394 - DNA, 1700 bp, Glycine max
  Soy_ogl_2312 Gm07:9727801..9729500 Cluster 9
gacaaccgcgttacatgggcatatgtgtgtataaaacatatgcttgtagttttctgctaaagagaataggttttgttagtgcactgtcaccacatagctgtgagtgtatccattttgatagtgaaggacagagcctatatcaatccaaaatatgtagtgtttgagcaaatataataaggataaaataatatgattttttttttgctccaccacattctttccaaattgatgggaagaaaaatgactataaataatggagtagaatggatctcattccattctttttaaatgtgttcctcttaatctataagatttaaacatagaatgacttacatttccacttctatctcatttcattccatctcctaccatcaatccaaacaaagctttttagtgacaaggtttttggagagccactaaaatgtgttctagatatcacatttaggtctatgttctcaaacttggtaagatgatcataatgtagttttataaaaatcagctcttaatttgtacaatttgaaaaccataaaacaaacattaaaatatgtagatcactagtaatctgaaaataccggttactactgtgtactaatgattccatttctccatctataagtttttggtagggtttttgacatgatgaccttataatagcatagcctttcgtttcatgtattttagtaaaaataatgataaagtgtgttttagagaggaagttgtagtaaacaaccactgttaaagccagatattagtagttagaaatgttatagatttttctgaaatgcaatcaccagactaataaataataaatgttaattttgtaataattactgtataaaatattagacaattgtctaattagttgatggctaatctaaaatttttagactcataatgtatctaaattaaactatattcttatagtatttccttcattagaagattcaaatcttatcacaaactaattatgtctaatgaataatagtacttattgtgaacgcaaaaaaagaaccgaaagaaaacagtagcaagcatgtcagtttaatttacatctaagcatttcggtttgaataatactagtactatttttacaacaatttatttacaatgatttttaaataaagagagagataagagggaaagacaaaaaatataataagataaataacatgatatataggaagataaagaaaaaaaaagaagtgtataattattattataacattattatttcgattttattaatatataacaatgagtagaaccccccacccacacacacagaagtcccttttaaacaatgaaataaatacaaatagataatcttgcacacgggaaaaatctatctctttacgttgaattaaagatattaaagttgattttggaagattatcaattttcagtaataaagtttattagtaagattaagtttcttatatataaataagcgcacctgttatatttgttttaacatcttgatatagatattcttatattagagagatttttgattttttctagctgtgaaatatgccccatttatcattgtatcattttgagtttaatataatttatattttttcaaaaaaaaaatacaaaaaaaatatccttttttgggtacaatgaaaagaaaagaaaagaaagaggcgagatcaaaaaacaaaaatagcccactaaatagtaaaaaaaggactaaagat

SEQ ID NO: 2395 - DNA, 1228 bp, Glycine max
  Soy_ogl_1179 Gm04:2217049..2218276 Cluster 9
aataattaaaataatggataaaatatgtgtaaattttttattcttaaaaaacttatctaaatatttttcgttgatcaaataaattttatttattttcaaaatttatgattctaaagactttctcctatcaaatatcccctaaaactaaaagttaatttgtttattttacccttttctaatccatcttacagattatttatatttccttttcactatttatttgaaatattttactatttccactcttagtttaaatggccccctctctctctcattatctacccttttctaatccatcttacacattatttatatttccttttcactatttatttgaaatattttactatttccactcttagtttaaatggccctctctctctctctcattatctatataccagtgtccggtttgaacccggtgtaaaaaacagttaaagacagggaaagggtgagattggaaaaaaaagggttttctgtccagattgacaccgaagagtcgaagactatgattttaattcctgccgtaatcatcacgaaagattgtatggtcaaaaaggtacaattggaaataattagcaccaaaacacatcaataatgtttttaattccttttagattatgggcttagtacactccaacttaattgcaagatttttgtgtggaggcgctatctaatcagatgcacattccacttgtaaattcacagtgttttctttttccttaatacgaaattttaaatacataaataaaaataatgactaattattttttcacatatatttttaacagaaaattaaacacatcataagagcaagtttagtacacgtttttttacccattagttttcaaggtttttcaaaaaggttcaatactcataacattttttatataaaattacttatatctttaattttttttaaatgacttatatttttatgttatgtttaacaaaattagctcaaaaattagttagaagttaaaaagttagctagtagctgaaagctgaaaaataaagtgataaaaaaaaatcatgatttatttaaaaatgattactagaaaattagataaatatattgagaataaaaatgaaagaaaatttcaaaatttaaaagttacattttaaaacttatcacttcaagtagtgtttcaaaaaataatagaagatattaagaaactactaaaaaatatttgtttaacaaacaatcaaataaatttttcaaaaatta

SEQ ID NO: 2396 - DNA, 1978 bp, Glycine max
  Soy_ogl_2519 Gm08:5239219..5241196 Cluster 9
tgttgtatatcaactcgtagtaagttactacttattaagatagagataatttataaagcatcatataaagggtgtaaaaattttataatgatagtggtccgaaagtattattattcacggcaaattaatccaagtttgcgatagctgagaattaagcgcaagctcagcaacattaataatatttttgcaaattgagtgagattagtttctatgcagctgatattttaggaaatggcgaggataattaaggctgtctctaattaaaatgatctcgtttccccaaagattagaactatcttttctctcatgtaacaaaaaaaaaaaaaaaaaacattagagctattaattgcttcaagataaattcaactttttacacaaatcctcgtatgattaaaggttgagttagtgtgtgacttcccagcagccaccggcaagctagcttgtcaaacatgcataaaagaaactattaatgcatttcacttattcattatttttcatttccactaactcgtgcaatgtatgggacatttatattacatctgcaaataaaagtaatattataagtttccttttaaattgtattttataatatatttatttgaataattattattaagaaaatgagtaagaacgaaaagaatgtctcaaaattatcaaaagccttcgtaattaaaatttgcataaaaaaagatataaaataatgagcataaatttatacctaaacctaatgcttgtaataataactaacttggtttagtatcacatcgctttctgattttcttgaaagaattaagtggtaaaaaaaggaaatccttacatataactatataagactttccaccccccacaagtatgctttaggaccattttttcatccctctatttgcaaaagattgattttcaaaggaaccgacattattttaaaaaacttattgggaataaaatggttgcattgaattaagtaaaacttttcactttacagacaaataaataattcaaatagaaaatgggatacaaaccataatcttacctcaattattaagtaagacgtatgagagtacataagagagtgtttgatacaggaaatatttagttttttttttagaattttatgttggaaatatttgttttaaatgttttatttgtcttttgaaaaaataacattattagaaaataatgtttcttgaaacaaaattgggtccatttttataaaaatattcccttgatagatgtgagaaccaaactttttcaaattaaaaaataaattttattacaattaaaatgtcatgttatataaagatatcttataaaaaaaaacggttcaagacctctttactgtacgtttgaatatgtaatgtcatgatataactttgccttcttccctccttcgcttgtttggtacaatgtacagtgtcaggatatatattagtcttaataatattcaataattttttgtcatgattcataaatcatggcatctctcaactcatcaagttaaattagtagattaatctcattattattgatgtaaaataatttcacatataaaacaaatcaaatataaatcatcctcttacatataataatgagatcatatatcaatatatgatcctatgaatcaaacttaataatttgaaagtagtacatgtacaagaattattatattataaattttttttccttaattaatcaaaggattagatgacattcattccttgaatcccggcccaatccctaaggattagatattgacgacatcaaattcttttattcccattgttttctgatgatactaatgtacggtgtgtatatcatttataagtttctagagatagcttttataatagaatttaggatttataatccgcttaatttttaaaaaaattatttttaattcttaattttttttatctgtttttggtcttttaactttttgtttttcttgacttttagtcattcttacttttagacctttaaa

SEQ ID NO: 2397 - DNA, 1217 bp, Glycine max
  Soy_ogl_3290 Gm10:840284..841500 Cluster 9
gtttttgaaacttaaacggttgttgaaccggatactagttcaaagtttaatgatctaattggagattctggttaaattgatagtaattaaatttatatttttcaatgttatatattttaagtaataaaaatatataaaactatgagaaataaatatctaaaaattataaagggttataatgaataaattatatatttcataggataaaaatgacaaaataatttacagtaatgtgaaatcattaagtacgtgtttttatttatctaaaaagagttttacgttattataaaaataaaaaaatgaaagaaaatattgatataagtcttttatttttttaccaattttgaaccaatttaacttagtatttattgattgtcaccgaatttgaaatatttgattatttggagttaacgactcaatcaccaaaacaattttcaattggacttattgaagcaatcatgtgtttttaaaacaatattatttattggtatcatctttattcagataaaaaaatattattatttatttcttccatttcaaattaactaaagtctaagaatttttttaagaattaaagaaaacattaaatatcttaattaattaaacatttttactacattattcttttttctttcaatatctgtaaataatagttaaatatagttatttaatactcataattcatatcaatcaaatttatcggggggaaatttatgatattattgtgagtttttttttctttgtgcataataatagcagtgaagcttgaatctatgtcgtcatataatttaaattatccaaacgctctagtctaaatcgatcttatcatcttagtaggtttttatgcgagcgatccagtgttatgttacccttaaaaaaataattttaaatctctttgtataattcttttatttatcaggagtaagtattaaatgtgttttatattttataaccattaaataatttagtttttcatttaatttttttataaagtggttggaaattttgtaatatgtataaaacatatatgatatcgaatatgtataaaaaaaaacatatatgatatcaaattatcgatagtgttgtgatatccaagaaacatggtacaaaccaaccgtattcaaatatattttgtaatagaagaaaaaattatttacagaagtatatatccacaatgtctctcattgcttgttttcatgatccaattgaagctaccg

SEQ ID NO: 2398 - DNA, 1539 bp, Glycine max
  Soy_ogl_3908 Gm11:35681701..35683239 Cluster 9
acataggaaataaatagttgtgcggactcattagctaatttcagactttttttaaaaaaactgtgcgaatctataaaattcttctctaagaattggatttccaacgtgatcttgaatgatgttttattattctagtatttaagatgctctaataggttatcttttttgtgggacataggttcttctttttgctccaactataggtttactcatctgtaacatgggtttggtgttgtccccccatggtgtttgtcttttttcctttttgagcaataaattctggcggggaggttttagaggataggctgaaattgagtgccaacataggcttattactataatttattatatcaagatttttttttcttttgtcgaaatcctttttgaatttttttaaaccttctattaaccttcaaaattgtaaaaacctattttcgaaaatatttttttttatcaatatgactgtatttttcatgtaagattctgtcaacaaatatgattttaaagtttgaggcatatatagaatccataattccattataagtttttatttattcaaacaagtaattatattttcatagaaaattgtttatatgataacgaacacacttattattttggtaataatactaattttcattatagtagttcaaaacaattataaagtgtttgtaagaaaatgagattgaaaaagattaagttccgaaaagaaaagaagattgaataagagtaataaggattaagagaaaagtgcaataaaaaagttaaaggaaaagaaatttgattataagtgacatgaataccttagaatcgataaccataagtgtttgtggtgtgagtgatatttacaataatagtgattcaatctaaagagtaataactatatatgaaattcctaatttatagacttctaattttatgttttgacacgtgtacagacagtttataaactttctttctttttctaaaggtgtcacttgctttcaaaataactgctacaactacttttttgaattttgaaattccggataagagtctcccaaatgtatatgtagaatatatcaccgaaaccaaagtctgtcgaatgaaactttctcgtagaaacacttagaaaattttcaactctcttcctttttgacaaactataatcgaaaccatattttgtcaaaattgacgttttagacaacttttagattatttttcgaccaactataatcatgatcttttataatcgaaactatatgctttatcaaatttttatgatccaattttttcctcactccctttatatataaacgcctatgactatgactctggtgacattaaagtaaaaagggaagaaattgacaaaatgttaagatgaatttgattcatttaaacttccaacctatatttcaataattacacttgttttttttttcttgacaaaaaaaactgaaaacttaaaaattagttagaagctgaaagttgataatttgaaactgaaaaactaatttattaaattaaaattattcgataaaattagttgttgaagtagta

SEQ ID NO: 2399 - DNA, 1302 bp, Glycine max
  Soy_ogl_6517 Gm19:42589..42520000 Cluster 9
gcattgaagtcgtggtcattattttatgcacttgcctaccatttttctatatgccgtgtggtttaggcatattatatgggcagaaaaatctgaacctcttagtctctgacccacgatagtacacaaaggtacgtttcaagttgccaagcttagaaatcaagatgttctttgtatattaaagattgaagtctcaagacttaagaggattgcgttctaggaaaactaaagcaataataataagctttgtattttacactgtccttttggattaaagtgaactgaacgtttttccatattccctttaaccacaattgactatcatattaccatcacttttaccaaaatgattgtttaatgactgaattaatatagatgttaataattctttgtccaatggcacatacctaatgatctattcgatcaagaattttagttcaattgattgtaaaaaaaagcgtgagactatgagttattgtaatttgtaaacttttaatatttatctttaattttcagggataaaaaaagaggttcactactcatgcaagaattagatagtttttacataaaattctagattcattttttttattctcattgtaaaaaataaatataactatttttatattttaaggcttaaaagatatacatgaatctagatataaaacttggcaatcgcacgttaaaattaaatatcctttggaacatattttaataaaattttatcgtttaatatttgttgcagtagaagtgttaatatatgtaataattactttaaagaatatatttcgaaaattttgtttcctttaataaacttacaactcaaattaactaagattcaatataatttttatgaatttaattagaatataatcataaattgtacactatgataagattgttattattttgtatagttattttaaaatttatatttaaaatattttctatataattaaagtgtatacaaattaaactcaatttttaatactaaaagtttaaagaggacaatcatgctaatattttccattagattgttatatttattatttatatactcactttctcttttattttgttttcactatattttcttcttatctttatctctctcatctttttctttccttcaccacaattcacccaaaaataagttggatgttggcgttgtactcacaaaagtaaagtgtactcacataggtaaagtactatgtgaccaaaataattattgatctagattgttaatttttataatgacgattgaagtacctcggtcacttagcatgcaagtaaacaacacttctc

SEQ ID NO: 2400 - DNA, 1303 bp, Glycine max
  Soy_ogl_6906 Gm20:41016401..41017703 Cluster 9
tggaattgagtttttagattttgtaaaactgctgccaattggattttttttgttatttgaagtttttataagataactctacggacttaattataaaatttttacaaaatcaagaactgaataacattttttaaaaatttggagacataatataaaaatttaaatagtttaaagacctactgattaattaaaccaatgtttgttttaaaattaattttttactactttgattttaaaaaataatgtaattattataatattttattcattttattcgatatataaatatacactggttttttcttctattttcttcccctaaaaatcaagttttcagaaaaagggcatgttgaggggcggagggaattggaaaaaaagatgatgaatggatgcatttggtaaaaattcggggtgtcaacaacaatagtcgtatttgaatcatccttccgtaggttttaagttcttaagttgggtcttcttaaactctaatcagatctttttctactttgaatttgagtttattggtgtttatctcctttttatgcaaaaaatctcctttatttttctagttgttgccttaattattatgcattctaacccaattagtctattgctctccttaactcttctttatactcatgaaggttttcttctttctttgtaatcctagtttctgtcttttaatatttttgaactacaaaaaataatggttaaaatatatatttttttcttttatttttttaatccataatttttttcttcttattaaaacaatggagacctttagttaccaagttttcaaaaatccagaaattgaatcctaccatccaatttaatgtttcgaccgtcgattttttaatgttgacttccaggaacaatttatcgtgacatgtgattattagtttttttttttccgatggtcatgattttattagtttattttttggtgatcatgattttttaataaaaaatagaaaataaatataaattatatatttttacaacaattatttattgaattgaatcatgccgtcattaataaataaaatattatatataattattatattgatatgtcacttaagaaattataaacattaataacttatagtgtgtctgtgtctgtcttcttttaaaggtaatgcaaaagtaattcttttcttgttttgtaatttttgtatccagaaatgtattttttccattcaacatgattctaacgcgtttcgaaacatgttattagtggtcgacatactaatttagattaaataatcaaatatcctatttttttgaaaatagggactag

SEQ ID NO: 2401 - DNA, 1500 bp, Glycine max
  Soy_ogl_1061 Gm03:43039001..430170 Cluster 9
ttctatttttatacgtcaggcattgtcatgacaactttaaaaaagaaaacaaaattattaaaaacaatatacatgctgtacttattttattaaaaaacaatgttaatttggaataaataattacaaaacttcatctatatttgttttttaatatctgagcttataataattatacaaataagtaagaatttcgttctaatgacatacatcacaccatgaatatatttaatagtgttgttagaaatttgattattattcagtattgagaccaacatagctaatcgcatcaactaataatcaacctcttcagaggccataataagtagttgggttggtgtatcaatgttatgttatggcatcaatgcattggacatgtttaaccaatcattagtgtttcaacaaacatagctgcaagggtggggtctggctacccatcaactttaatttgttcataattttgggtagttttgttgcgattgtggggcaaggcaaggcacacagctcgatcgatcaataatgattccaagaaatgaaatggagagagtgagccctgcagtgcagtgccggtgcaaagtttggggtccatggatcgtgcaagtgcttttgtttccactgcatcaatgagatcactttttctgggaccaaaggatctttaatctttcctttcattatgccatttattctgactaattattcaatatattctttttaatcttgccatttcattccatacaccttcctcatttaaccttcttcgaatattacatttacaaattataatctttccactcattaaataaaagagtaatgatatttgaatattttatcaatatttttattttctatttctttctttcttcgtatcatattatatttataattttttctatctcactagatattaaatagcatttgagatgctcaaatatatttttactaaatgaaaatacaatgtttcatttcatgcatcacttcgagaaacctttaatgtgacgtagataacctgactcaacaccaacattaatagcatttagttaaatcaatgacaaatggaaataatattttgaattctattttttaaaatgaaaatacttattgatttagcgttggctgaaaatatttttcactaaattaattagttcctaaaaaattaatttgtcataaaattatataaaaaaaatcttgtgtgtcattactattaatctttcctacggaaaagtggtgatattttatgtctttgagaattaagagattactcatattaatgatattttttatagaaaatgctatattataatctttcaatctttaaacaaattatttaattaccaaaattttcaaaatataaatattgtaacagttgtatttttgagaaaggtgttactcaattttttttaatttatataaaatcttataaaagaagatgttaatgaaatacctataatgttcatgtttagtatcttgacacatggcacattttttggttttttttatcttttt

SEQ ID NO: 2402 - DNA, 1400 bp, Glycine max
  Soy_ogl_5571 Gm17:7716401..7717800 Cluster 9
gaaggtgttcagtgtaaggaaagatttgatcctaaatttgaacctagaacaaaatgcccaagtgtctctgccagtttggttgattcgatgttatacgacaatagttgaccataacaaaatgttatgcgtcgatgcactttacgcaaccacttaattaaaattattgtccattgagtactccatcttagagatctaaagttgaaattctattgggaccaactccaactgaaatagaacttgttagaagagaatattatctcaatttgcaattttcaaccccaagttattaagatgtaactaaaatactcttttcaaaatgttagtataaactagtaaattattgtgagtttactaccataatgtccacacatctacttttttttttaaaggagtattttagtgatttaactatgattttcttaaaatatattttattaaaatgcttctgcacacattaataatatgaaattagagttattttttgaaaggaaaacaatattcccattaataattactaaaatttaatttaatatataaatactctttttaaaataaaccggtgatttattatttttttataaattcacaatatatttatttaaatttaattagaatgcactaatgatttatgaataaaaaattaatatactaatcatttatataatgtttacactattaattaatcataaatcgttatgtatcataaaaataattacttcaaaagtcatttttaggataatttctaattggtaaacaggttgacattttttatattgacagtataaaaagcttaaactattttagtaacattcataaaaatagtttattcaattttttatggtacctggttattataaaatatatagttactcgtagccaagttatcaggttcaaaattacctctatttttttctttctatttcctttattactaagattttgataaaataaataaaacggaaatggtatatatcaaatggagagtaacaactatttttttcaaagcttaataaccaaagaaaggaagtaaaaaagaaataaaataatattttctcaatgatcagtttcaaatatttgttcctaggatttttatccatggtaattattgctctatatttgtatgggttgagtgtgaacatccttttcttgagttgatgtgtcaatgaaattgataatttatttgttcattattaacaaatattaaccgtaagtttattttaaaaaattgttaatgaaaataatttaaatccataatcttatttttctccctctagttattaagtcaattttaatttttttttctctaattatttggtaaattttataactttttttctctttattaaatcaattttataagttgacgaccacaatccatgctatggacaccgagttggtgg

SEQ ID NO: 2403 - DNA, 1160 bp, Glycine max
  Soy_ogl_2157 Gm07:3264901..3266060 Cluster 9
aaaaatatattattattatttatttatacatatataatagttactttttaaaagttgtactcaaaatgatttgtaattagttaaaaaaaaagaaagaggaaagggaagcatggttcacatagtaaaaggaaagatgaaagtgaatttgtgttcaatttcttattgtaaaattctcttgaaccaaaaaattaatttttaatctaatgagttaagatatatgtttgatcccttatccaaaataaaaaaaaaagataatataataaaatgaacaaatcctattaaatatctatataaaataattttatacttgatggagtatttggataaattctttatttcttatctataattttggtataattatttatttaatctagagtgaaataatatataaaatgagattaggttttataaaaataatatatcagtattttttttagaggaaataaatttatgacatttcattgatgacgttgttcacaatacaaaccgaaatataatgaaattcagaagggaaagggtaaaatcttaaagccctaatcaagctataagcaacaaaattaatttgtctctttaacaattcaccctagagtttgaaatataaaacttttctattctacatttatttataatcacatgaaaatctgacaaccctttagaatagatattgaaagtgtcaacaacttttttgcaatccgtctcgaagagaacatttgaaaagccaacatctttaatccacaatataaacagatggagagctcgtgcagttcgtgcttcggcttctatatattagtattaatattaagtataactaaattataaaataaaaaatatatacatagtattaaggtatattttaaaataaatagagaaatgttactaccactctctatgattgtttaaattttctttgggacatataagttaaaatttattaggaattgccgattttattggattatactaatgttattgtcattataatacatatttattgtgaacgttttaaaattatgataataaacaaaaaattaccataattaaaaaaaaattctatagaatttaataactgattgtcataatatataaaattaaattttcgtaatttaagatttaatgatttaattcagaatattgtaatgaccttaatttttgtattt

SEQ ID NO: 2404 - DNA, 1220 bp, Glycine max
  Soy_ogl_3315 Gm10:2102781..2104000 Cluster 9
cagttaaattttataatacatttcttgtaaactttttaaaaggttgtattatctctaaatatctttattcattagtttagttttaacttcttaatactgtaaaattatttacattattattcaaacattacaattaagaaaacttaagagatgtcaacaaatatataactcaattatttgtaccaaaaaatatatataactccattaatattaaaaaataagacgacaaactctgatagtctgatcatttaaatcgatattattatactataacttaaacttttaataaaatcatttaattaattcaaaaattattttttactataaattcaaatctaatcattgacttaattaacagaaattatataaaacgtaacaaaatattaataataagttctagaccatacatattgctattttttttccttagttgaatgttaatattttattttaaaatatcacctggcgtggggtactacgtctggtagacagtgaagcagatgccttgagtcgcattttgaattcaaaattatatagaagaggaaaacatttttttatgttagttattagtttatttatttttgttagtaaaaaatttaaactcatgacatgttttttatttaccaccaaatcaatcttagagatatttattttgacagaattttgcatacatttttcacctttgaaagtataattatattatttaaatattacttttgacactatttttataatattatttcttttctaccacattaaattagtattataattataaagcaatgaaatgaataaataaaaaaagttgtctgtctcaactctcaatccctctctcttgtcttgtgtgtgtactaattttaattttttgtgaattgtcataagttgtagttaagctttaaattataagtatgaacttctatcccacgcccttgtactattatttattttactcaaattaaaaataattattctcaagtttgtcgagtaagtattatttattttttcaactagaaaaatatttatttccaaaagtactttatgggatagaagttgatttaaaaaaggaagtgaggaagtatgacaccgtaactattgattagattgaaaaggaaagagtaaactaaagcatgaaataaataaaacatatggattattatacagtttgacccaatgcagcctcaaaattattcagttttgggcctcgtttattagtatagtag

SEQ ID NO: 2405 - DNA, 1232 bp, Glycine max
  Soy_ogl_4698 Gm14:5915083..5916314 Cluster 9
cataaacagtgtaaacaaacactaaaaaacaaaaaagctattcatttttattaaaatattttttttcaagaaataaatttaaataaattagcccattatttattttattaacgaaatgtgttttttatatataaaaataaaaaacaaaccctaagaatcatacaagtaattaataaaaattaataaactctatatctaagtgtgatgacacttaacgtattagaaatgagaaatcatattttttgagaattatattttcttggaaattatgtttttatagtgttataaatattttatttatgtctaaatgtttttagaaatgagaaatacaattgtaaaaaaaaaaaaaaacttccctcattcaggggaatcttggatttctaacaccccatgtaaaaacttaatataaaaaaaaaaaaaaacatttttgggaaggttggattcctaagaataatttttacaattgtcattttgatacgaaacataaaaacttaacatttttaatctgagattcttaaataacttaaaagaacctccctaccaaatacttcatttgtttaatgcacaaggagagttacatgatcatgagccatgtaattaatagaaaaaaaaatgtatttttagcttttatatttttcatatggttaaaggatttaagctctttatacttttatatccatgattttggtccccaatttttttaaattatcttagcatctcttttttaagaatttatcatatttttaaagttaaaaaaactaaattcacattttttttaaagattaaattcatcaatataaaagtataacaagcctaatataatcacatttaacctaaaatgcgtaaactaaaaataaaattttcataatataatattattcccaaatactatttgtgcaaactcttccaccagtgacgattctaggaaaccataaaggggggctgatttaaatatctaacaaataaatataatttttaataaataataattcttataaaattaattattagttttacacgtaaaaattaaaatttatttttattttaaattatacaagatagaaacacatgtatttactttttctttggtcggctaacaaaaatagtatatatttataaaagaaacacgtgtatttataaatttactaaattttaatttgaagttttaaaaaaaaattgatcttacaagcaaaataacaatcaagcacataataatctcacaatccaaaaag

SEQ ID NO: 2406 - DNA, 1300 bp, Glycine max
  Soy_ogl_5245 Gm16:2027101..2028400 Cluster 9
atttcgattaataattataaaaaaaaacttgtcttatttcgaatttctttctttcttttcaaaatttataaaaaggttctgaaaatataagataaataatgaaatgacaaatgtacacgttatttccatcatttcattcacaaatccttaattaaaaaaataagaagcacaatacatgtgatatttttggtatagttattaacgaaaacataaaatatattaattttacaaccaaaggcgccgtgcccttacttattttgaacaacatattttctgtattttttataaccactaattacaagtaaataaacaaaatttatttaaaaatggaaaaatataaacaggcatttttatgttacaaattaatactccaaatattaaagtggaaatactttttaaagatatatatttcatatattgttaatgtttttaaactacatcaacaatgaatatactggttcatcattcattagttgaagtttaatttaataattagagttgcagtgacggtaattaaatatgtttttaatgtattaaatagtaaactgatgtaaaattatgagaaaaataagttaattaagaaaacttttagattcggaaatggttatattacatgttctataatattaaagaaaaataataataaatagccattaatatgtatatttcatatattcatagttgcttattttaattcacattatttttcaaaaatattataatttttttttaaaagtccatgttaaacttttttctgtcttatttcttaactatttttggccaattttacttcaccaattttcttgctaggtttttttggacgggtacattaattctcgatcgattcaatcaattgaaccacttttcaaaagtatgttgctaatatagattatttatgttttttattaatacatcaaatattagtacaatgaataatttttttagtgtagactttcaaaaattatactaatcgtttaagtaatgacgactatactaattacaaagataatcaaagcattggacaatttatatatttgtctataatgtcaactttttttcgtataaagctctgaagcaacaatcctattaggctgcaatttctctgaaagtttatgtcttatttaattcgaaatttgtggtatattctattcccccgtcgtattcttcgggaactgttaattagatgagagaacgacagaatgggatggatgggaaactttcacctccttttaattaacacaaaactttcacttacagaataggatttgggatttacctagcgtgtagttgctaattggta

SEQ ID NO: 2407 - DNA, 1283 bp, Glycine max
  Soy_ogl_6568 Gm19:44670618..44671900 Cluster 9
gtatacatttatactcaattctaacaattatatctatactttccttctaacaaatcattaatatatatatttttattcaattttaattccttaccagcgagatctttaaaatgcaatgaaatatttttttgtaattgaggtgcgtttaaatttataaattctaagaattattattatattaatttataattatcaattaaacttgctattaatataagctctatttaaagtactatagacattattcatgaattttgcaaatctttaatatattattatttataacacatttagatgcaattctaagaattatagtactgtctttttaacaagtaatatagcttaatcatggaaaaaaatactatatattcagccccaataacatagtaaaaaaaagaagaaaataaactaaatcaaattcttttaaaaaaagttaaagaaagaacatacaaaatctcaccaaagtgaatgagattccctaccttagacaatggccccgtgattaaaaaaaattgtgacaaatgtgtggataaaaataaatttaaatgttcattgattttgttagaatttaaactaaataatttgtgtggaatcaatttgtagataaaacataatgattaaatactaatttaacaataaatcataaaatttatgaaaaaaattatcttgaagttatacgacataacctaattattgtacctttttacatttagaaattaaattaattttgtttatcttttaggaacgaaagtgtatttgtttatttaggaattataattctaatttactcttttttatggttaaagtaaaatcatttatttattatataaaaaaatttggataccatcaagtattcatgaatgttcatgtattcacgcatatacatatatatattcaaaatcatgtattgagtagtattccctgagagatggagcatgtatccaagaaacgagagtgaatcttctccattaataaaaaaaatgcataattttaattaataagtaataacaattggattaaaattaatagttacagtagatttaataaaactaattgttttacttcacttattgtttaattcatattaaacttattactcttgttgcttcattttgcaacttctttctcgttacttactctaacttccgagttaaaaaaaggcacacatgatttattggcttctctatctcccacctcatggaagttttgctttttttttttttttcaccattcatatcattgaactagtgacagtctaaacacaaagataaaagaaggttgag

SEQ ID NO: 2408 - DNA, 1300 bp, Glycine max
  Soy_ogl_703 Gm02:47025701..47027000 Cluster 9
aagaaatattttaccaagattattcatctataaaagtcagtaaattttttttgcatttgtaacatgataaaacaaatatctaaataacaatattgataacgtgtttataatattttgttatttttctttgtgatatcatttatttaatttcacatatttttttcttcttttctctcttataattattaaaaatattgtaagaacttattatataaaagtaaattattatgaaaatatattcttttttttgtgaatatgaaaatatattctaatataggtacaaacttgcaatagttccatcctagtattgttagtttattttaatctagccttatattagtcaatatttgagagccgtttattaaagataatggccaaaatgaagaacatgtaaccttatattagtcaatatttgagttattttttaaatattaacaaaaatgagtccaaaataattaataagtttcttttttgtgtgtctatttaaagatttgaacttaaaatctggtgcaaattaaattatttaaactctcatcactagctaggctgattcacgtgggttaatgaataagatgttacttatacataaatttacaataacatgtaattttaaaagcatattcttcatttgagtcactttacaaaaatcatatattaataggataaaatgttaataatttgttttatttttttatagattaatattttttttattatctatgatatgatacgcaattaatactaccaatgatgaatactgttttcagtaataattacgtgaaattacagtaaaacaaattgcaaaataaaaagtatatgcatatttaaatatttattgtagaatataaaattaaaaaagttacaagtgaaaattagtttatacataaattaatttgtaaaaaaaaatcatattatcatcttaacttattgtgaaggtctatatttactcattttccataaaagtaaatatatttattgattttttaaaaattatatatttattgagctattaacaatttaatacatactcattgattacaaaaattggctacttgctgatgtccctcttgcatattaattatccgaaatccattttcgtctagtgaaaatctttagtggagagaagttataggataggaattcaataaatattaattaatgcctacatgcattatgaatttagtccacccaccatttatcttccgatcaatgctgtcttccattcttcactgattgattgccaactttagtgtgaaagactacaaaacaaagccattattcgaacttgtgagttctatta

SEQ ID NO: 2409 - DNA, 1220 bp, Glycine max
  Soy_ogl_6285 Gm18:59813781..59815000 Cluster 9
taagatgttgattttgagtaagaaacataattaaaagaaaaaagactctattaaaggaaatcaattagttatctgataaatataatgataaatattttacattaatatcgtaaaaacacaaaagaaaaaaaaatattgagcttaggaaacaccatttgtaaagttctatttgaaaaatttaaacatttacatgcaagataccttaagaattaaattattgagtcttttatatatatttgggtaatatttaatttgagaatttagtttatacatattttttgtgtaatttttttacataaatttcaaataagaattaaatttgtctttgtgtcattttgtttattaatataatgtgatgacaaaatgaatttctattgaatgtctatgtaaaaataaatttcactaatacataatggatataaattaaactctcaatttaaaatttttataatattgttgagaaactgatttaatatatatagaatctgtacatataaaagatcataaatattttctaacatgattttctaacaaatatttaattgcttgattttaagtttgaatttcttgtttgttttacagaaagtttctatttcaaaatcacttgcatacacaaattaccatgacgtatgttgctgcaaggaatttttttgcagggattattgattagaaattttgcctaattcctcatatgattttatgcatgtagatgatttttttttattaaaagcattcataatcactccgttcgagatttagttatatttaaaaaaattatttcaattctctccaaaagtataatttgtgaaaattaaattcaacatatattgacaattcaactacacttattggatatatgttaatgatttatgtgtagtagcctagatgaaaaaagttgcgtaagataaaaagttttgatgaaatgaattaatgattgcgaggaatattgtgaaatatgtgagaaaatttatgagcgaatattcagagtttaatatatctagattgtggtcttgttatgaagttttgtgtgaaaaaggctaacaacaagtggcaattggcaagccacaaggggtgatgttacaggtgcaataaacctatgtgtggcaaagatggcaatgaaaacatggttcaataatcattaattagatattaattagagatgggaatgggaataatattagagtactagttagcagaaaaatgctaacaaattatctttg

SEQ ID NO: 2410 - DNA, 1227 bp, Glycine max
  Soy_ogl_1661 Gm05:32519174..32520400 Cluster 9
tgaagtaattggatatatattggttgcctatattttttttaacatcaataacctaacatagcatgtgaattaaatttcattctattaacaaataatgtagatttaggttaatgagacttccaaattcgccttacacgcctatattatttttaaaatggatattgtatttaatttcgtattcacaattttatcattaaagtctattattcgttattacttttaaaaggtgggagaagagggaaatgagtatgaattgtattgtatgattattaattttgagactttgatcattggtagttggtactcattaattttgagtcattaataaattaatacattaatattcattcaattaagtaaaattaaagcattataattaagaaaacataacaaaacctttaagatggaagattaattaatgaagacgtgactaaattccaagagtagatgaaggagctgaaatgttacactagtgacaatatgcaaaactgacgaggtattaaaaagtacttgaatttgtgagagattgaaaagtaaaaaaaaattaaaaaaaaatacattggtatattaatctcttccatttgaaatcttattgttaggataattctaattgaaacttggattttctaatgttattttgctgaatttagattaaaagcaaagttgaattagtgataacttagctagatgaacaccattgggagaaataagttaaagtaattaaataatgtaacaaggaaagttaaataaataaattatttatatcttaagcaaaataaaattcttgtgttgattgctaataaaaaaaaatatgaaaaggtcaaatccaaggtccaaaaggtactaataaatattgatagaagaataatactttagtaaaaaaatgacattattttaattattaatagcaaaatgaagattaagatgaacatttaattataaataaactttcaagccaattcatggtaacaattctgacaaataaaaaatgtaaatgtaaaattatttttaataaattacaaatgatgattgtaccgagcacgacaaagatggatgatatcatttcatttcattctcattcccattcgttaggaagccatgataacaacttgaatcctctctgttagggaccttcatgttttttgtttctatcttcacccccacgcttaacacatctgttatatttcccatttaaacaccaactaaatggccttatccttgatgaaa

SEQ ID NO: 2411 - DNA, 1100 bp, Glycine max
  Soy_ogl_944 Gm03:38021701..38022800 Cluster 9
acgacacaaacagcaacccaaacaaaccaactcaacagcgacccaaaagttttccacccacgaaatcctcttcaccctagtccaatcagtaaccaacagcaccctcactcatctataattcgacagaaatagtaacactacatacattctatcttaattatatttataaagtccatacatattatgttacttttaattataaataaaaatatgttatgtacaccgttttttatattattattttaagtaattccaaatggataatgatattattattattagggttaattaagttttaagttcataaactatttcacattctaatttttagttccttaaaatttatttgataatttttaattctttgttgatttttttttatcatttttggtctctccaatgtttttttgtctatttttagtcttttatttatttttattgttcaaaatatataaaaagatgagagactaaaaatggacaaaataataattaatcttgagcaataaaataaagaagagattaaaaatattgatagaaaattaataaagaactaaaggttgttaaaaaaacttttgaaaaattaaaaatttgaatctgaaaaagtttaggactaaaaagttaattgacctttattatttttattattaaactttttatttataaaaataaaatgactaggtaatttatgtagttgatgataatttatgacactcgataggtgtcacgcttaattgtccttcacgtatttaataatgtttttaatatttttttttatatttcatcacaattttatgtttttaagtttcaataatattcctatatcattcataatttttcttagtacatatttaaagtcatgttgtattgttacaatatatttttttagcaatatattgatatttatatgatttttaatctatccaaaaattattccaaaccacctccaaaagttatttcgtgcatcacacgagtccccactagtatatactaaccaacgatcatgcatgaatttgattttgtaatatattttatatttaaattttatttttgaaattataaaattatattaatgcatgcattttatttaaaattgattagat

SEQ ID NO: 2412 - DNA, 1148 bp, Glycine max
  Soy_ogl_22 Gm01:1370633..1371780 Cluster 9
aaatatccttcttgtggaaagttaatgactaattttatgaagtattaagattcatttaaggaattaaccttttttaatatattttttttcatgagtgaaaaccaaaaatcaaactcatgaacatatatttcatgaaaaaggaataaagttatctataaactatatcacataatattgattacaaacttaattttagttaaaattgatttcaaagtaatataatttaggtttaaattagaagtaaaacttaatataaatttttttatataatacaaaaattaatcaaaatattatttcaactcataatctattttgatccaaaaccaattttaaaattttttatgtgaaatcaaatatataaaaattaattcttaattcagaatcaattctctaacctatataaaatcaaacaaacactatgttcaccatctgattccggaagatgagtgacacatatgatagtaatttagattattttcatgatgatctaactaatgcgcttgatgataaaccgatgttagtttcagttgtgaacactgagagcagtggtgagatggtgagactgtcacatcattcattgctagaaaggtcgagaggttgtttatttgttatctgtgttgattcattcatagcatctatgatttgaaatttgactttgcaaaataaatgaatggatgcaaagatgttggatctattattatttttatcttatccacagcttcagatttcattccttcggattttgtacatttcacctcaccaccatttcaagtgtccctactgtcctcatcttccacgtgtagtgctgggaatatttcatcattatttttcgataataaaacaaacaagacccccttcattaaattacattatttaaataaaatcatcatgcttgcttacttttttttgttagattataatttatttatttattattattattttgttaaattcttcttttgttccctataataattggtaaatctcttatccattacaatttttcttcttctcatagatatttggaatataagtttcgataaagtcttacactataatggagatcatataatcaggttttaatctataaagtctaaacaaatcggattcctcacgatatttagttctgtttttctagatatttcttc

SEQ ID NO: 2413 - DNA, 1086 bp, Glycine max
  Soy_ogl_404 Gm02:5573215..5574300 Cluster 9
aatttacaggagatttttctaacatgcagtgcagatcctaattaacatactttataatcatgagagtttcaattagttaagttacaattaaccgtctcttgggaatgtggaggtgaaaaatcacctttgccttgaaggcaacattttaaaaaacggatcagatgagccgaaaccagtcaagtgacccgtatgggaacattaaaaaaccaaagcatctcaaaatcaataggaatcgattaaactggtataaaattggccaaaaataatgttgaaccagtataaaaaataagggttgaaccaatttttaaattttattatttaatctaaaataattttaagataaataaacatacattctaaatatttcacataagtatcaattattttttcaatcattattagtttttatcttatcaacatataatttaatcatttatattaatttataatttttttaaatcctaatttttaattatatattattttatttcttaaaaaattatataatattaaaaaatataaaattagttcaaccatggttcaattatgattaaattattgaatcttgaactaataacttttcgggtccaattttaaaaacattgctcgaaacaatatataataacttctacctattatatataagataatttatgattaaataataattttttacataaattaaataacaataatatatattatcaatgtatttaaatcaagttctttttaatttataaaaatttcccggtaattaataccaaataactcatgactcgtgagattccttagtatgggccgtgacgatgagccaactacttaacgcaaaagataatcaagtttttttttttcttttgaatttgatattcaagtagtacatcgcgtttggtatatacagtacgtctgcgatacttaaatgtgatatgtaaaaattaatatgatatacaagatgtctgaacgtataagattttcaaatttaatatgatatcttaaatgtctaggcatatttaatatgattaattgttttcatctaaaaaaaattctttttggaatttttaaatatcatatctcaaatttcaatatata

SEQ ID NO: 2414 - DNA, 1208 bp, Glycine max
  Soy_ogl_726 Gm02:47859301..47860508 Cluster 9
tgaacaaaaatttctacaatttggtcatgtttagaaaaaaaatcaataagcacttataaaaaaaaataaaaataaaaatattctttataagttaaaaaaatgaacttatgcataaattttgtgtgaattctcttttttaacttcttaaagttgtatggacagttactgaatatttgcatgaatattatgctaaatatgatgtaactgttatcttaaaaaaaactttctcaaaaactgattctaacttgtgtataagctaattttagtttatgagagaatttttaatttatgttaggtttaaatatatttttaagtatctgataaattttaagttttgtttttgaatttaattaatagtgtaaaacagttataattagataactgtgtataaattttttttacattattaatgtataacccttcttctccttgtttttacttcttcaaaagtaaatatattttatgggagaatcttacatatgtttgtaactatgtaatatttactttttttaataattcaaattttttttaattaaatgttataaaaatactaaaaaagtaaaccgtaaatgagttttatatttccatcaatgatatttttattttttaatattagttataatattaataaaataaaattataatgatgaaaatatagaattcatttaatatttaattttttcactaattcaaaacatttatttttcaaagcatttaatttaaaaataaatattgctattatcttagataacgtaataacatatttataagactggataaataaaattgtttcactaattaagacattttttcaatctatgtggaaaaaaacttttaatgtttatcaatatagaatatagagagtaataaattaaaatgcttagaaaaagtcaatataaaatgtcataaaatattatgcattggattggaggaggatcggagttggttcaacaattgggaaggtagggacttgaacttttctattttttttctgaattgtgttgtccctctaagggtgttagctttttcctggaaattgttgcgagaaaggataccaactcaagatgccttattgtgtaggggagttgttattgaagatgcacaacacttctcatccatcttccatacaacttacaagtgtggaatgctatatatattgacacaacaacataactctttacagcaacactttctgcaacatcaattat

SEQ ID NO: 2415 - DNA, 1108 bp, Glycine max
  Soy_ogl_1215 Gm04:4163801..4164908 Cluster 9
gttaattttatacaattttataataattaaataaaatatgtatatataatatatatatgagaagtgtcaaggatggaggcaggatataattactaaaagagtgattaatattatttcaaactttaaaaacaataaatatatagaaacaattttatttaaatccgataattaaaaaaatggaggtagtaagtagtagtaactaatatgtttcgataaaatatttaaatttcgcttattttgtaataattttgtgaaaaaaagtcattcttaatttaactatttctacttaggcttgcatgtgggtgacgcaatctgatgcttaggcttggcacgtcggtgacgcactgacgagattgtagcgtgttgtttgtttaacattatgacttcattgtctgactatgattatacagtgaataattttgaggagaaacgtgtttgtttccctattttttatatagatataaatataaaatttacaaatataaaatttagtttcaaacaattaaaaagtcagtttccctcccactaacgacctgttcataaataatccctaatctgtcatttataagaatttttttaatgttttttaaaagttacaagaactataattcttattaatataaatgttatgattttgtattaacatcataacacagtatgcaaaaattaattttaataatacaaaagattaacacaatatcaatcatcatatttttagtgtaatatatttcattattaatataaacacacgataaatatttttactttaattttaattaaaatgtattcttataggagttgtttaaaaaatagtaaatattttttatatatttttattaaaaaaataaaaattctcatcagttgtttaaatttaattttgtgaccgttaagggtggaagttgtatcactaccatttttgtttgaaattgaaaataaaataagagaagaaaaagtaaagttaaagacaaagaacacgatagaaaaagcaggatcctacgacacaaagacctatgattaatgtcccagcgcgcggacggaatattcttccttgcttatatgttaattatgttaaaaaataatacattaatacgacaaaaaaacttttttt

SEQ ID NO: 2416 - DNA, 1216 bp, Glycine max
  Soy_ogl_1443 Gm04:46606685..46607900 Cluster 9
ttattaaacctaatatatatattaccacatgtgagccaaattgattaatgagttgtaagcagttttgactaattgtagattacaaatctcaattgtccaatagttaattaattaatagatcagttcaagtctataattgaactaccatatacggcaccgccgaaagtgtcttccccaaaaaaatgtggatatgattaattgcagacataaaactgcaaaagtgcttattttaattgtaggattggagctcgaggcatcactttgcatgtaagtttagtcatctaaacgcagattttaatataaaatttatagttaaagattaatttagcaaaaaaataaaaattattcttaatatcttgttttctatatcgactatctcatctcaaacattaatctcgttttcatgtcatttttttcattataaaaagttatattccctcaaaaaaatttataaaaagttatacaaatatgtattataatttataaatacaatttctaatcatacattacttcaagtgtttgttaaaagaaattccttttagtgtcttgttaaaatttaaatttgatatactattaatgtaaaaaattaaattattaattaattagtattttatagataactctcgaagcaattgttacaatttttaaaaaaaatatatataatgatttataactaaacaatataattttttacagcatatgttaattaaattcattctgctctatttatttagaaataaaaaatgttatttaaaattaacacggaccagtactgctgttacttggagacatttatgaatagtctgacatgaaatttctcgtatgtcatcgaatttacgtcaacacatgacgttgctatgactaatgttagcgtacgaccaagtccacttggtgacctccatagacattaactatgcaaaataaatatcacgcaccaaaacagcatcttttcccccgagtttagctaccagcaatttcgaaaggactaataatacatcagacactcatttatgatttattttagaataattcttaactctcttgttatattctcctacaaatcttcctatattatttttatggtaaattttaaatgtgttgttttatagttataataataaatatttttacttttcattcaatatttatcgtaaaagataataagagaatataatataaaaatttatcattactcataacttatttttacttatct

SEQ ID NO: 2417 - DNA, 1655 bp, Glycine max
  Soy_ogl_2524 Gm08:5711708..5713362 Cluster 9
aactaaattaaatcggatgttctcataaaattaatattattaatttaatcatttcattataggtgtgataatgaggttatctttttatgtataaatcgtgaaattaatatagtaaaattgttattgctattttatgatttacagaggagttagaggttaaatttctaagattgaaattaaaaatcattgtcattttttataattgggagagtaattaaattcttgtgaattttttaagatttttgccaatcatgtatttaaaaactattttagttttggaatatttttaaaaccctcctttggttttgaacataatcctaactcaaagttgttatattttgtatccacacacttttctttttgttttatccaacttggttttcttgatcactttatttatttcaaatttatattaaaataataaattatttttcacacatataaatatattttggtggactatatttgagtgacgtttctttaaaaagtggattaagtaagtgccacggcttctttttttaaaaaaaaaaatatagtcaagtgaatttttttacagaaagataatttttcttaaagaaacccaacctaatttttttatatatagtaacccaacctaaatcatatgttagagtcaatattttcatcacttaaatacgagtaaaaataagacaagtgtaaggatatagtcaaatccattaattaataatgttaatttccattcatataaataatgatcaatagagatatattatcaattttggggtatacgagagtatagatgaatctaaaccgaagtactccctccggtcaattataagaaaaataaatgatttcacacttattaagaaattaattaatttccataaaaaataattaattatattaaattgtgttaatctcaaaataaaaataatttttttctcaaaatttttttgattaaaatttgatatccaacataaaaaagtttttatcttattaaataaatattttaaagataattttattaaataagataaatttagctaacttttccttatagcaaacaagtgattttttagttgccttgctttgaagaaaaagcactacagccccttatgtgtacttgtttatgttgaggtcctatgagtcttccccatacgtgggtggttgttgtggcaaaacgttataatagttccaattaagccaagaatatgcaatggaggtagtgaaagatctttgtgctagggcaattctagaccatgacattggagatcctaacctgcattgcacccttatagcaaccaagtctatccatcactcttttattacatgccttaattaaccaattctaactaccccggtagagattataggttcattcactttgggttgcctacctgcccaaaagcaataataaatcaaaatcgaaccaatccaacttcatactatttatttgatttacatttttagacatttaaatttgacctaatccaaccacaccactaatcgattttgtctatcgccaattcccttctatttaacatttcctttcagcaaataaattcaaaactaataatttcttttaatataattacatatgaatatatgtgcgtgtgtctttggtcctaaaatattgaaggctataattctttcatgagaaatatttatgatactct

SEQ ID NO: 2418 - DNA, 1354 bp, Glycine max
  Soy_ogl_3753 Gm11:5563980..5565333 Cluster 9
gacgttaaatgagaagaatttttataaaagttaaatatataagttaatgtttgtttacttactttcgtattttctttttctataaatagattgatctaaatgaaatttaagaggattattagtaatgattgtcaattattgaaaattataaaattatgagtagaacactaaaattcattaaaaaaaattcaaaatttatgatttttaatcaatttcaattactagtagaaagtaggttaaaaaaatgtattaaaacatgtattactaacattttttttttatcgttagcacgattgtgtgaaattacctaacaaataacaattcgatagtaatgtaaaaatatgaatttttagaattttttttattagtaattttgttggatcgtgaaatttataaaataaaacttgagttagattatttgaaagattaatgttaatgatattattattattgttattatatgagcaagaaagttaaaaataagaaattattaaatagcattaactttaattcagtgtgtatgtttatgtttgagtttgttaaagggattgaaaccgtgatgatttaaagtgcacttactataacaagacattaggagtgtcttgagggacaatggtcaatcaaatctttccattaagttagtaattattttgattttaaattttcacatgtatcattaggatcatcttatttaaggtattgttgatttttatgtttgatgtctcatcataattttatccttaaaagtgtctcaatgtgttaaaagaaaagaatatttataaattttgtttgatcttaactcctaaataatttatgtgaaactttatgaaataactaaataagtcccaactagtcaaagataagggacaagaatggtgacttagagttcattataaacaccaacattttaacctcaaatcctcaaatataattaggatcaaatcttcaagtattattcacttctttgatattcgaagaattatcataatcttatttttaaaaggcatatcaataagggagaaaaatatttttgaagtctcattgttattgattcctaagtgattaatgtgggactttgtggcataccaaaacagtaatcatgaaagttaatggatgctctacatcaaatactatcatttttaatgaaattaagtattatttatattttatgcaatatatatttttgtatacgaaatccttattattattctgttctatgccctcctgcctgcaagacaatccataccctttaaaagaaaaacaaccaaactgagaatatatatatggcagatagaagaacatccacgcaacacgaaagtctgcagaggatatccaccaacgagagcataaaata

SEQ ID NO: 2419 - DNA, 1302 bp, Glycine max
  Soy_ogl_4159 Gm12:38744399..38745700 Cluster 9
ctttgttgttttctaaacttttcttaagtgattaaatataagaaaatgttaataagtctcttaaatattaattaagaaattttaaaaaattattagaaagtgtaaaattatatttttttgtatttttatatgatatagataatatatttttttctttttaattttttaatcaatataataaagacactaattagtcatccctttaaatatatctaattaatatgaatattacgtaaaattatattttctttaataaggtgatacttttttgttattatttataagacttaattatctattttattaaaattaagaaaaataattaagttaattgataacaataatttattttaaatttataattttttttaaaactatcattcttataaatattcttttctctttttcaattaatcgtcaatatatcctctcttttagttacgagtattttaattttaaaaaataaatgcaaagaatattttagattgaatcatataaaaagaaaaatatcatttaaacttaggtcttataaataaaaatgattgaagtaggaaaaaaaaaatcaaacatagtgtttataacacagtgtttgcggtagatatgcataaggttgtgtgctattgtaattcaaacggcaatgcaaacatgttggcagcgtcatggataatcaaatacccattataaaaaaattacattggatccttatctaatatttttaatgaataatattacataaaactatattataaagtataaaccagcccactatcgtctcaaaatggtgaaatgtgtatgaaatggtattatattgaagctactatttactttggtgttaatgtgatggtaaaaaaacgagtaagctattaaggggatccaagaacttactataaaaatagttttgaaattaaaaaaaaaaaaaaaagaaatggcagttaggaaataagaaggggaagggaagagaggaataggtgcaaagaagaaggaagaaggtgcaacgcacgtgaccacactctaatcatactcgccactgctttcctttcacgacacgcgccgcgccttcctattactgctatttttctatcattctttcatgttaatgcatatgctcttcattttccatccaacacactaagaacataaatttttgaattaaaatagaatgtggaatttatataatttttttctatttatcttttcttctcttcaaccaaacacaattggcgagatattattctaatttaattaaatatctcaaattttgtgaaaaataattgtggcttctactaaaatataatcctcatt

SEQ ID NO: 2420 - DNA, 1230 bp, Glycine max
  Soy_ogl_628 Gm02:43418701..43419930 Cluster 9
ccgtgttaaaaacataaaattaatttaatatttatttttaaactaattaaaatatttcattaatcgatacttgttaagaacactcgcaaaattattagttagttatacttatctcctttatttttataattattgttaagaagactagtgtgcatataaatgtttataatgatctctttttattttatttgtgttttagaagaaatgttttatatgtcatttaaaaataaaatagtatcaatagcaaaaaaaatattaattattatgtttcaattaattctatcttatatttacctgttttcattattttacatacttcttagaaagcaaaaataaacaatggatttttttatatcctacataaaaaatcattactgtctctcgatctaatgaatctgagaccaattccgcttgcaatgaatgctgattaagagaattttacacataaagataatcaaatataagttttttattaaataaattgttaacgcacatatacatgctgaaatcttataccattacatcaaccatataattacgtttaataccatattattttggctcaaccaaatagacacgacaattttgcgaatcaaacaatttgcaaagtctctcttgatgcagattgacaagagggtagacccatgaacttaaaaacagtttttttaatctcattttacatatatcaaatggtttaataactattttttttaaaaaaatcattcaattagtaactaattattaactttcaaattttagtttcttaactaacttttaagttttcaattaatttttttagctttgagctaacatatgcactatttttttaggaaaaaaaatcatttagagtttaagggtttcgagtttaattattaatgttagagttaagggtttttacttctttaaaaaatcatgtaagaaagtcattaatgttagggttttaatttcttaattcaaaacataaattaagaatgattatttaattataacttattcagttccattatatttccatcatatgcttcttccataaaatccttttgaatgcatttatatctttttgaaaaaaaaactttaacaatataatttaaaggaaaatacgtaaataataacttttgccttaattataatcttaagatattttgcggataactatcttatccgacttataggatagtcatgggagacccacgactatggattttactaaaaatatcttaaatttcccat

SEQ ID NO: 2421 - DNA, 1295 bp, Glycine max
  Soy_ogl_708 Gm02:47089015..47090309 Cluster 9
gacagagtagttctagatcactacgctccttaaaagttgatcaaattatcctgcactcacgtttagtactaaataaaccgttaagttgtattgatattttttaaattgaaaagtaaaagaattaaagaaaagaatagataaaagtgtgcataatttattaatgtaaaataataaagttataatcaaataaaattttataagaatgagatgcgcataattatttaaaataataaaaaacatttcttttagagaagtaagatccagatttttttttaaatttaacatataaagatctattataaatgattaagaatataaacaatttaaatgtatggaaaatttaacatggaaatgaaaattttaaaagtaatttaataatttataaaacatgtaaacaaataatttacggtggggaaacctatctttaaaaaaaagtacagtcaagttcccttattttaaataataaggactttgttacattaaataagtatggattgtgtacgattataatgaattacaataaataaaaatacaactaataaataaataaattatcaggaagcgtgaactattagactcagtttagtattaggcagtgtttagacaatttacataaggtcctaactcctaaatcagaactttattgtcgctattgtaatttatttatttattaggaaaccattagaatacacattattttatagtttgaagaatatagaactggccttctgtaaaaaaagaaacagatagtagttaactatatggacggcgcgttagcatttagaacacatcagcttaattaattatgcagttaaccagtcgttagttgttttgcttgcttgtttaagaatatttttttaagcagttttttttttatcgtcaataaagaaaatcggttttttgaagcagcttgtttaagaatataaagaagccttctccgataaatgattattttatcaaataaatctcaaaactatataaaggattaagtcatcagcttgtacatttttaggtgtgagttttttttattagactacaaacttcagatatttgattaagtaagaataatctcgccctacttagtctatgttatattttttttgttgagtaaagttaatctatgttgttaatttagagtaattatagtattactttaaagacactaatacaaagtaatcttttacacatgtattgaggtttggccgtattttgtttagaagattaaaaaaaggcatatctcacataaataggttaacttcagataaaaaatttaaaaatcaggctacaacatcttt

SEQ ID NO: 2422 - DNA, 1300 bp, Glycine max
  Soy_ogl_2670 Gm08:14009101..14010400 Cluster 9
tcttataaagtgttgcaagatgccccgcatacaaaggtattttcttaattatagagatatcttttaacaatgtaaaatttatttggtaatacaacttttgatttaatctaaagtttagttggagtatggaatatcttaaaataaagatataaaaggggtgccctattttattttatttttaaaaaagtttaaacaaatagggagtctttctctttctactaaatagttgtgaacttgtgatggcactactgtccttgtgattgaatcctcttgcagatttatttgttggcttttttatttctccacccattcccgtgctacattttgaactacataaagagtgcacttatataccggaatattttttttatcataattgtcataagacaacttcataaagaattgggttcgaatatatatgatattacataaaaaaaagtattgcatgtatatatatacacacgtagattatctttaggaattatttgatcacgtggttgaatccttgcgtacctaaataaatttctcgtccacacacacacacaaatttaactccttagtaattatcctagtctatacacatacatgtatctgtgacactaataataattaaatatgtattacaagagagtttaaaacaattcgttaaatatggtgtctgaatcttataattttttttatatttatttttttcttacgaataaaaaaatatgtattgtataaataaaaattaaatatactacatgacaaatgattaataatgccataagatatttaatgttaattaattatgtattaaaaatagttaaatgcgtccggtgaatattggatagaaaatttcagctagatgttgataatttttcttaggttagattgtaacttttatcttgatgtagatttttaattcataattttgaccttttctattttggtgtttctattttagaaaattaacaatggtttaatctttaattttacatatatttaattttttattttttatattttaattaattaaattatttttatggtattttaagagaatatgttagatgtagaattcaattatattaaaataaagaaaaaacatatataaaattaaggtggaaccaaaattgtggtttttttaaaaataaaaggatcaaaataaaaaaaaagactaaaatcacaaattaaaaattattggaacagaaattacaacttaatctttttcttatcttatatctactgtatacctaccatgcatggttcggctgcctaccactaattttggccgaaatacttatttttcacatacctg

SEQ ID NO: 2423 - DNA, 1468 bp, Glycine max
  Soy_ogl_2864 Gm08:43125233..43126700 Cluster 9
tgtataaaaaattaattaaatattgtactaattttaacttaatgactagcacataaatcttaatttagttccaacaaagtaacacatttttttatagttccattgtttgaagtaggtgaggcatctataagtaatattaataattcattcattcaccttggctactaggatagcaagacaaatagagtatttatgcatggatatatagataactaataaatatgggaatgaatattttttaagatgagacgagtattataatatttattcagattttatctattgttatccatgagggatgatgtttgggaaggtgatttgattaaaataattttaaaaaaatgtataagtaaactattggggtgaacatagcaactgtatggacatttgctattgacactcatgattactaactacacccctcccttctctttatatttttttattgtctaatatactcttttattcattaaaacatagttacatggattactctgtaaaacaacatacatctatttcataaagtaatttctgaaattgtattaatctatttcataaagtaatttctgaaattgtattaataattctagaaactacatttcaaaacaatatataagcatcacgtatgttacttttttagattttattttcatcctgtattttttattatttaaatcctaattttgaacctccgtattcattaattgtaaaccttgttgtgacatcgcattttccataaaaaaaaagtgttgtgaaaatgtgcattttcttcatgtggtattgtgttttaacatatgtccatagctgagttcatctattatatatagtgtacatgatacttcattttttttacaaagcttgttgacacaccatcaagtgtcttctcatgtttggttcatcgaaaattttaaatataggttatctgtctttcaatatttagcctctcaatatgtagcgtcaaaataaatgtgtcaaacattagcgattaacaactattgcaactccttaagggaacattctatatttcatattttgtttattactcctataaccatatattttaattttaaaaattaatttcaagaagtacctatattttgttaaaacataggtctggaacaacaaatatcaattccaaaaagtaatttcaagaaatatattttaacaaaatacatataattttgttaaactactttgatatatgttgtttcaaaaaatagtttttggaactgtatattttattaaaatattgttccaaaaattactttttataattgatatatgttgttgcgaaaagtaatttccaaaagtatattttaacaaataaaaagtataattggcaataaaaattatagagaagggaagagttgtacaaaaattggggatgcaaatagcattgacattaactatgtttgttcacaagtttgtgactcaagttttgcaaaatttaccagttaatcattaagaa

SEQ ID NO: 2424 - DNA, 1379 bp, Glycine max
  Soy_ogl_3026 Gm09:5893422..5894800 Cluster 9
ttttcttatttttaaaataattatcttaaatgaaaagttttttttaaaaaatagtaatatttaatttatcaatacatggtgtctttctagtactcctcatataaataagtagttatttacctgtgttgacttacggattgctagattttttctaatattatttaatcattattttgaattttttttttcttcttataatgacttggtcactttctttcttctttttttttgttgactgaacttggtcactttctatcaagtgaagtttttttttttttttttactatgatcaagtgaagttagtttttttttttttttggtcattgtagagtaaagaaacagcaaaagcaaaaactacaatctcaaacaggcagaagcatggcatccgctaagagaagctgctgcaatctgcaaaagcaaaaatgatcaaatattgaagttagttaatacaaagtatttgtgatactgtttcaactttcaatgactcaaaaagtaatatgtgtgtgtgtaaaaagcattaaagcatttctagctttgatatgtttttggagaaatataataattgaactggtgaacaaatcataaaaaaagataatagatacaatgtaacaattgaattaatttttatttaaacaattgactaaattaattcgtaattactttaactatttgataatttttaattatatccttctaaactattttttaatggttattgaacttgtatttgtttttgattgatttttccgtctagctgtcattatgaaaaattaaccaaaaaacctaattgactttttcatgaaacaagtaataaaaaaattattgtcaaagtagaatggttttaaaactattttacatgacatgagaaaactattttgccacctaaaataacagaaaactttattttaaatgaaattgtgtgctcactttttgtcatgtgacaagagaagtcatcctgattgcgtgttttctattgtttttgttttacatttttatatcagtttaacaagacaaaagtgaacacaaaactccattcaaatatcatttcctatatcctaggtagtatatgtttgcactaagtattcttacctttccttatctgtagagccaatattctcaccagtgtaggttttgaacccaagattcccaaccttattcttcaaccaatattctcacctttgcatatctactcaacccaaatattctttgagaagtctttctaggatcactctacaacaatcttactacaaacttacatagtgtcatgcaattaattttttgtaatgacgggaaaactcaattaaaaataaatataagttgaaggaaaactcaattaaaataaatataagttgaaggaaaaactcaattaaaataaatat

SEQ ID NO: 2425 - DNA, 1299 bp, Glycine max
  Soy_ogl_425 Gm02:6848601..6849899 Cluster 9
agaaaactatatattgagggaaagattaattaactcaatgtcttgggcattttttatatataaaaaaagaaaatagtaaatctaacgaactaaaatgtatatattaatgtttccacaagatgaacttgatccgctagtatcgcatgatggagttccaagtacataaaatcagctagaacgtgacaaattccgtacaaagttatagttaaaattaaaattaaaaatcaacttggtagtggtacttacagacacacacaaaaaaattgattccataaactctctttcggcataaaataactcaattttttgatgctttaaaaaaaatgagtgtaatgtagagttttaattaaggtaataatcaaagaactaaaagtactttttgttataatttttactgtaaattttaccaaaattttcaacaaatttattatttattatttttctaatgaacgttttttttaagaaagcttgtcaggaacaaaaaaatattgaattgaataagccctgatgtattactgtctgtctccacaagtcgggattagagcttgaaaattgttagaaatgagatgaatacaactttgtttttttttttagaggcgtgcctacgtctgtctgtcattacaaatctctctgtcattactttcttcaggaaaatgtatctgtctcttttttcttatatataaaaattaaagataataataaaagaaaaattctagcaacccattttgtttaattgtttgttcttcaaaaatttatggccagtcaaaagcaggacaaacttctcggattcaaagaacgtttatatattacaacattattcttttgatacatttcataacacttgaatactattatatgggtcatcatgttgcagatgtaaataagcttttattgtttcttgagaaatttgattaatcactttttagtgaagtattttttttaaccacaatttttatctataaaatataaactctcagatattttatttaacaattttgaatccaactttacttaaacaatgacgtgttgattatatttttttattattaattaaatttattaaaaatcattaaatcttatgagtctagctttaaaaatttcagtcttacggtaaaaaaatcttttattttatttttgaaaggccatctaactttttatttcatgagtcttacacatgattttgtagattttaataaattttattaataaataatgtgttagaaaaaatattaaataacagtatattgtttgcacttctcttaaaaaacagtatccttggtttcaatttatgtaaaagga

SEQ ID NO: 2426 - DNA, 1133 bp, Glycine max
  Soy_ogl_2291 Gm07:8459515..8460647 Cluster 9
attttagaaaagaaaaagtaaagtgacgctgtcaaagagatagggtgacgtcatggctattgcgtctttgcaaatatgctattcttacatatcttcatgtggaagactcccaagtcccaatcgcactccaacgtctagaatttataccatccttcttccaatggctagatattcaatattttaatagtgtctactttttcagattttcttttaatagtgtacattgttccatattttcaatgtgattttaaaaaattaatagttataattatcatattttaaatatttttttttcaatgaattttcaaaacatattataaatattttatagaaaatattctattaaaaggggcaatattcattttagtgatttgtaataaaagagtgtaaaattaaattttttaggaatctctatctcaaaagaaatgttttattaaatactttaataaacttaaaagacaggtattaaataattttatactttcaatataataaaaatgatttgttaatgtacatattttttagtcagagtaaattaacaagtactcatacctaaaaattgttttaaaatacataaatgatataaattgttaatatactctaactaagaaactaatttgcaaccttttttttgtacccaaaaaattttccaaccctttttttaatgcaaaataaaacgtttagttaatatatggtgaaaaaaatatttatttgttttaatttaaattaaaatggtaaaaattttaattcatttcaaaatttaaatttacacatttgtaataaataagttgaattactttaaattattaccctattgtatcaattattacaatttcaatattgcaatatttctctccaaatgagttaaatgcctttcaatatcaccctattgcatcaattgttgctttattgtattggccaaactttgactaagaacaggaagaaaaattaatcaaatgtacttgatcaattttgaatattttaatatcttttatggtaataatattaaatttcttataaatattattattttgtaatagttaaatgctgagctactagttagaatcattagaagaaaatgtataacgaagatgaagattaactctttaaataatttgatctctcttcttttg

SEQ ID NO: 2427 - DNA, 1109 bp, Glycine max
  Soy_ogl_4912 Gm15:8341319..8342427 Cluster 9
cttcaaaaaattggcttaaatatttttttcttgtaatttagtatttttttacttttagttctagtaattttttttagttgttatgacattttggttaatatttttttttaaccgttaaaaatatttattttccttttttcacaaattatttggaagagctaaaaatatttttttttataaggatgaaaagcaaaaagcgctaaatcgacagaatcaaaattttatttaaaccaaaaaatttgacaactcctgcaggaacgcaacacttctccattttatgttactggtgctatgttctccttaacgggaaaacgtcttctatacttgattaataagatatctcccttcttcctttatacaaaatataaagaaaaaaaaacttaaatacaattttggtttttttattttatttaatttataattttagtcttttattttaaaatagaaatatttattgtcttatttaaaaaaaattgtaaacaaattcataatcatgattttgaaaagtacaagtgttttgaaattgagataaaaattattttagctccattttagttaaatatatttttgaaaattatatttaaaaataaaaatttaaaattcgccatcataccaaacgagcccttaataatcatatgcaagtgttcataacttgttatagtaattaaatttgaattcatggatactcactttgacgtaacttgtcttatactagtaaaattcgcttatcgatattgggtttgaatttgaatttttcttgttttgtagaagtcgggtagtatttttttaaactattttatagttattgcatgtataaatattttattataaaaaattaaatttaataattaaataataaaaattgaaatgatataattaattataaataatttagatcttaatttattttcgcttaatagttcttaaatttcttattttgtgaatgagtcaattcatcacataattgaatgaggtgcttttttttgggtgatatccatcggttggaagctcaagactaatttaagtattaatatccatttgaaagggtaagttctcccaggtccaaatagatgtttttttcattcttttcatatacatatacttgccat

SEQ ID NO: 2428 - DNA, 1205 bp, Glycine max
  Soy_ogl_6254 Gm18:58705396..58706600 Cluster 9
gtttaaaaaatgttaattcaggatcgtataaagataaaacaactaaaacttaaactttagacctatcaacaaaaaattatttgttattaattttttaaattaaaaaagatgatacatgttgactaaaatattccatgtatcattcttttcctttaggtcttactttttattacgtctatcatgtgatcattattatagttttaattatatccttatttttacgtaatgtttaagtattttacatgcttattataattgtaattatatccttatttttacttaacttttaaatattttacatacttattctaaatgagattgaaataacatttcttaatccgtctgtgctatcttttaaaaaaaacagatataagaaatagatgtaataatattgattgttcaaaaaatataaaaaaaaataattcgttcatgctatttaagtgaagaaagtattactcataaaaaaagtgaagagaatgccaatcaatgccttaagaaggttagttaagggattgaaaaattagatattttgccatgaaaatataatatttgttgttattaatgcactcccaccattgtttctaattaataaaaaaacttttatttaataattatctcaaatttttttggaatgtcggcttgttgacaaaaacggagactaaaagaagcaaaatcgttaaaacacttatcactaatttttaaataattaaatatattcaatgtcgcttaacgagtattctctgattaaaattaaaattgatatgtacaaaattaaatcattgactttgatctaactctgggttgttttgatccaagatatttttttatataataattccaaggtattgtagcaataatattgttttccaacatagttaggatgtcataaaataaagggactaagttcctttatatactaagttgcattgccaatgaaaacttttctctactcactgcatccaaaacatataaaatgcattcagacactaagttcctttagccagaactaaaggtaaaagtgttaggagaaaaggtcggattatgaaatatagcataaatagattaatagaaaaaatgttcttatattataaataaatatttttactatccattaagatttttgtcaagttaatttttattctacacaaaacagataaaatacatcttttaatatcttcctttaaaataagatttggagttgaatt

SEQ ID NO: 2429 - DNA, 1273 bp, Glycine max
  Soy_ogl_6413 Gm19:38234314..38235586 Cluster 9
aaataataaatatattaagaagcattaaattaaagatcatatatattaaggaataaaataaaaataaaaaacaaatgttaatgactgaattacaagaattttggtgcacaacgaagatcataaatttaaattaaagatattgtagaaactatctaaattcttcaccattcaaccgatcctaataggtagagaaacaagctttgctaacaagttatactcgaagattatttaagttaattaattatatttttttaacgaaaagtaagaaaagaaacaatttcaaccattgacttagaatcgataagtttagttagaaaaaacctcagtaattaaattaatttgatttataatatgaaatgtttttgttaaaaaagttaattagtattataatttatacacatacggaatttaagtgtatatatcataaggtttttttttagtagtttcaaataaaattaaaatttaaaactttatcgtactaattcatgaaaaaattacaattaaaattccgcataaattgttaaaataaaaatataatcataaatgaaaaaataacaccaaaattagtcataatatttaatctaggttaagtaatttataccttggttggtggcttaataaagttagagccagagctagaaggacccacacgaggggtgggttggtgagataacgaaatcttggaagttggaacaggatgaatggaaggcaaacggggcaaagtgaacactacagataaatgaacgcgctttacaaaagcttatgaatattgcattattagagaaatagtatactcccggggtccatttcagattatatcatgtttaagattttgttataaatattaaagaaaataattaatttattgaattttaaaaaatattagataatttttattatattatttatttctttaattaatgattcatttattctttctgcatactattctcattaagtattgattaaagataatcttaaaaaatacttaatacaacattaattttataagaaaacatatattttagaatattttttttctaaaacagtcatataatttgaaataaagagtataagaaatatattttcagttaggtgaaaaaaactacaagaaagaaaagactcaaaagggcattgtacgtaacaattatcatcagaggatgtccctggaaatattaaaaataactaggttaatttaaatatgttttaaattcatgcgtatatggttctatctgattttattcattgcaatttttatttaagattccctatg

SEQ ID NO: 2430 - DNA, 1108 bp, Glycine max
  Soy_ogl_6900 Gm20:40742601..40743708 Cluster 9
acttactctaatcgggttttgaaggatctttatggattccattggttttatcttaattcttaacattataaagacgaattataaggtgtagtatttttccattgacaaaaaaaaagttgtagtatttttcttcccctcatttttgctgccgccgtagtactagtctttcacaattggtgagtttggtatattaattggttctagttgggtacaagtatttatttttatattaaaaaccgtcaactaaaatataaccgacacccagtcaatgagaaatttaaaagaaatatttttttttcatgtcaatgacgttttatgtacatgtggatatgtatttactagaacggttaatctacatgtaatttaattatattaaggttttatacagtgatttaacaagtgttactacttaaattaaatttatcatttctagtgagtttcattttaaagagtaaagaaagaaattgtagttattaattaaaaattatgtttaaaattaaacaattatatatttttttcatattcagccaatgatatattttttactttatttttaatttagagtaatcaaatgcacgtaatttaattatcttaatcatatatatgaatttttaaactcatttagtggtatggtatattacttactatatattatattatacaaatatttttatttttaagagcatcaaagttaagactctaatgaaaattcatataattgatttagtcatcaatgatattgaatattgcaattcagtctttaagctgcacatcttataggaagttaagttaagaatattacagtaacaaataaaaatcgatttgcaaaatttaatttaaatttatccgtgtaatgtattagtctcttagttattagtaatgcattgttatgcatatttttcacaaataagatcactaaatgtttattctaagatattaaatattcctatttttgtaatattatttttcaaccttataataacaatttcgaagtaaacttattatttagaaaaagatatacttttcgattcttttttaacgcatcattgagtcatatgcgatagggatgttgaaaattgaatcaatcggtttgtataccgtgaaaccg

SEQ ID NO: 2431 - DNA, 1360 bp, Glycine max
  Soy_ogl_1405 Gm04:44843841..44845200 Cluster 9
aaataaataagtctaaataattattaaaaaaatgttaatggttggctggcccaatttattacaaatcagttcacgttggccaatcaaatttgcaactgaaatagcgagctcaatttaagattttagctttaatttttagaacttaaccaaattatatatcggactatatgggggattatatgggctagccaattttcacaccctaaaaatagaaaacttgaagcacatttattgtttaaaaaaaatagaaaaagtattcgtaaaattgtattggtgtgagttcgagttatagacatgtaaaatatatttatcgttaaaaaattgagagaaaattttattatttataataatcttatctaattcaaataaaattatctttaataaaatatgcatgtattttataaaacaaaattgtattggtgtttaatattttttctttgtgtaattgaaaaaatatattttagttatcaagaagatgtgaagactaattcttaaacaagcacaattttattgacaaaactaataaaagatgcaagatgtattgaaataataataacaacaaaaaatcgtattaaagttattttagttttaaacttttcattagctgtattgtgtagatattatattgtattgatactaaaattgaacggatctgaaattaaattattcatgaacatgtacgtagtgtgtatgcatcatgtgataagaatagaactgtgttgttttgttagcttgcattggtaacttgaatttgtgctgctttgctcctcgtttgttgggttcttccggttctacgcttccgctgacacaaacatgacagcttctactactcttgaggctgagcaatgccctgttgatctcaactttcaacttccttttacttctcttattgtaacgttttctatggaacacatggttcattatcacatgttttaaaccatttcacccaactcattttattttatgctatacaaaacaaatcacctttgtattatgctttgtaaggatcaattagtacatggttgcattaaagtttttacaattttcattttgtaagttgaagtttttttttagagattgcaagtattttttattagtaataattatgtttgagttaaatacaactattatggacaaataatgtatgtctaaaactcaaactcaagagtacgtattaaacagaaataattgtcacttgattcaccatctcaaagtatgtttggattgatattccttttcatgcggcatgagttccaagacagatcatatcgaatggctgaacggagaagcaattaatgagtgatgcattgactaacttaagtttggggctccatcatctaattcccaacacatgcactca

SEQ ID NO: 2432 - DNA, 1330 bp, Glycine max
  Soy_ogl_2615 Gm08:11745671..11747000 Cluster 9
atccttataataatttattcattttgttttaatccttttgaaaaatattttgttagggattagtaacaaattatctataaattttagagacaaaaatgaaaaaataaacatattaaaaagacaaataaaataataagaattaaaaacaattttattttattttattagagacttagtgtcaaaaaaaatattaggaacttaaaacaaaatttgttaattttttaggaaacccaaaacatatttaaaccatttaattaatatgatcgcatccaacaattattttgatgacaagagaaaaagcctccttcctaaccaaacatcttatcatttttctttagttgaatgcgtaggtagctacaataacgtcttatattgtaatcttttaggatttaattttataaaagctatttctttttccaatatatcataaccatattgctcaaactctatcaatcttaataaaaatctgtattcatacaatttcttaggtaagcaaaatacacaataaagaaaaacaaataaataaaaaaagagaagtatgtaataggatattttttatatataaatatgaaggaaaaagtaagaataaaaaatgagaggcatgtaataagatagatttttttggcacatatgtgataagatagttgatacaatgaagataaatagaaataaaaaatattgtacaagtaatatatataacttaacttaattaccaataaaatctaaagaagaagaaaatccaagattctaccacatgtgcattcacgttttacttcactaattaagcaaattaatgtcattttttaaaatatatttatgattatataggcatgagtatgttaataaataatagcaaatttaatgatataatcatggatttttcacgatgatgatcttttcatattttaatctggttcaagacacttaaataatctggttcaaaattttagaccctcgatcttcatcctttaggaaactcataatcctttctctaatttctaaaattacgaatctgggcacctcccttcccgttaattacattcatacaatattataattggtagaaatgcttgggcttgtagtgaagtttatgctatccttatttttacgaacagggaagaaaactggcgtcactttaataatctcccttttacattttcccttccttatatggcttttggtgttcttaattacatataagcacgtcttccttcaaaagttcacggaggcgatctctcttacaagtttgaaactatggtggataattgttagtttctggattttggtgcaattgtaaagtgggaaacatgtaaggaattagtagtatctc

SEQ ID NO: 2433 - DNA, 1235 bp, Glycine max
  Soy_ogl_6660 Gm20:862766..864000 Cluster 9
tcttcattgtgcataaggtaagataagtttatatcaagttaatttgtgaaaactcttttatattagtttctttaaaattaaccttttacttatctataaggtaattttaatttatgtagaagtttattttgttttttttcctatgaatatttttaaagaagtttatctaaacatattttaatgaagattatattatttaagaataaaaaagttgctatccaattttggctcagctacacgctatcataattaaattaagttgctttgaagacttcaaaaaccattcaaatgttttattacacctctacaggggtataatatgcggagaatagtattataatataaacattcaaataatcaaatcacatggcgaataaaaaaaacaaatgtgtgtaagttatatataaattaggttggtcttaccctagaagaaaaaatttcttgaaagattctttcagacaagccaattgatagctatctatcttatctatgttatggtatgaataagaaagcaaatataatataagatattattatacacacaatactataagtatgagacaaggaaataccaccaaaaatttggcaaaaaggccaattgccaactgccacccaccaatacatgttcaaaaatattaatttccgtgcctaaattgcagatatcttatcttggcttgtcccaaaatctatgtgaaatttgattttgtttagcgtgcttctctctgtttaattcaatgacaatctttgccatggaacattcaccaacagttcagaatttattgtccaagggttgatctatatatcttgaacggttttcattaattaattagattagatgacgttcaactttttccttaacgacaaagagtaccttgttttttttttttaaaaaaaatgatctgaggtttgtgttaaaatcatatgagtggttaagattttgtttggataagtttttatttgtaaggaaaaaaaattaaaattaatttatgtataaaataatttatagatctaagaaagctaattttaacttatgagttaattttaatacatgagatttttttttataaatacttataactttttttttttatctaaatacgacctaataattgtttttgaaacaaattgtaaaacacttgtgttttctgtaagctggaagtttttgtcttgcaagctggaagttttgacttatgtaacatctactagtcagcaaggatatcttttatttgactatc

SEQ ID NO: 2434 - DNA, 1181 bp, Glycine max
  Soy_ogl_5843 Gm17:41495801..41496981 Cluster 9
agatatgctattggaaccttgtatgagttgcatcttcttatatgctatttgatatgttattatatattaagatgcaggattgtacctcgagtgggtgggtgattatgaggttggggaaggtgtaatattaaccaattctagttacgtaccttcttgtaatttgttctcatggcatggcacaacttgtgcttatattaatgaaaatgtttatttctccgagaaaaaaaaaacaaaaaggttttgtttttcttttgttttgaagtctttgtttttttaagcacgtattctattatgttacaacaatgattaaatttcttattagtctaagattttttattaatgtaattgagatagtatttagtaaaatagaaaaaaaaaactaatgtattagattaatttataaaaattataaagatcctttaatttagtttatgataattaatattaaatatagattgttttatctttattgctataaatttagaaattaagataattaacatttaataattttaaagactaaactaatattttcataactctaggaaaaaaagaattaatattcataacttcataaactaaattaacgtgttactctacataaataaggtattataatttttgggtttgtaggaatcacagataattttaagagtttacgataactcattcatctttcttcactcaactgagttttataacctgaaaaaaaaagataaggtattataaccactacaaaaataaacatactttccatattaactctagtattggataatatttgacatacatatcaacaaaaaaaataaaatcagagggaatctgcataacaaaaatcagagggaactttgtaaattgagtttatcttattattttatctaaactatatctcattttatcgattcaatattcaaacttaattcttttcaaaaatattattctcccacgattaagatttgatctatgcaagtcttaattgccgatccgcttgcacacacagaaaggccaattctgtcgccgaagtcaaaactaagagatcgatgataagttttccatctttttgaatcgatcttttttatggcaagatttgccaaattagtttcatccctttcccttcatcactcaggagtatagggatgttgaaatctaaatcaataaaaaaaataattaaaaattaaact

SEQ ID NO: 2435 - DNA, 1300 bp, Glycine max
  Soy_ogl_5863 Gm18:1325001..1326300 Cluster 9
ttatataagcatgtctaacatataacaaataatgtgactccatttttgaaaattacgactctttttctaaaacatataacataagcacgtctcaaacatgtagactcttcctcaagcataagaacgatctcatacatgaaaaatgagactcattttttcaaaaatatttttaaaatctcataggccttcccaccatggtctggattacaattacaacaaaaaagttcgccagttataaaattaattttctttaatgacttaattctcttactatcgtcacttttgatctcctcaattattttcccgcaaattccatcttttattattttaacagtataacttttgtttatctcgttaacttgacaatcaatatttaatacaaatcctaatgacaatgcagtaaaattttatgttattaattaacatggatgcatgacttgaaagtgcaataaagtgttacatgagcattttcattaaatattagatttcaaattaatacatgaaccaaaattgaaaaactaaaattatgagagttttttttacaaacaaaaaaaattgtgagagttgaaacttaaaaaaaaaaaaaaggaattatagaacagcaaattgaaaaaataataataacattgacgaaaagtccaattaagtctttcttaatttaatgtatgtctattggtgtcttttaaaataaaaataattaatatacatgtttaaaaagatttacaataattatgtcagttttcaaaaagactttaaaaggttaaatttttttataaaatatgaaaatttataatttccaaaaatttaaattaaaattacttaattttatatgaattcatagtaattccaaactaagaaccatatattaatatcttgaagatatgaaaattcatttaatgcgttagtttatttcaataaatattttttcatacgtgtaactacttatcacattttaggattaaaagttatttaatgatcatatgattgcctaaagaagtcataagactctatctttgaattttaacatttgattcaatagtcatgattcattctcacatctgcatttatctctctcactcacaaaaatagatattttcatttttataaaacttgtttttctatgctaaaatgtcatccacgaataccacttttttcctccgttcttgatattgatcagggaaatcctacatacccaactttgtaatctccattccagctgttttcataataaaaaaaaactgtatgctaaataagtggccaataggcataaagtctcgttgttttcacaagtagtaggaat

SEQ ID NO: 2436 - DNA, 1148 bp, Glycine max
  Soy_ogl_1932 Gm06:13905853..13907000 Cluster 9
cattggtagacattggtacgcacatatgatgtcctttttatctttctgctttatctaggttttttcaaaaatttgagtgtttcaatttcatttacaagattttatttaaaatcttgcttaagatccacttgatgtaatacactcagactaataacttgttgatatttcttggtcatcacttagcaaaattaaatagttattagtgtcaatttttcattattattgtcaacttttgaccaactctaattaacgttacttttttttcttgttgtgattaagcatgaatgtttagttaccattgaattcatagtatggtcattataaacatgtagtggcataatagcattagttgtctactagagattaaaaattttaaaaattgattttatgagaagttaattaaattgacccagagggaaaaaatcaattgattgagtagatactaaataagagaactttatattttgaaacatacataccttaaaatggtgttacactcaaattcattattaattcactcaagatattggatcagtaagtcactatttgaattgcatgaacttgtatataaaaattcttaaaaatttgtgacctacaaaattcatacttttaacaaattatgaaaaattcataatatacttttagaaattccaaaaaaaaaaaaaacaagacactactttattcaaaaaaatcatttggttatcgattcagttaaaccaactcattagttcacttaaaaagctaattgtgttattttgattcgataaaaaatttgatctaatgacgaattattagattggttatatttatatcattaatttccagttggatagatttgagtgactggtctcacttgatttttatgacattgttgtaaagtagttttactttaatatttaaataccattagtaatttgtatttatttataaaccataactctcaaaatattataagaattatagttagttagatgcatagttgtaaaaattggttaagatcaaacacttaaactgtgaataagtggtgtaatcactctaagtcacttattaaattaaatgtttcattgacctgatcgaatcggctttggagttaaaccgatgaaccaatatttatttattatattaaaaaaatttaataaaaatacaac

SEQ ID NO: 2437 - DNA, 1372 bp, Glycine max
  Soy_ogl_3836 Gm11:10813229..10814600 Cluster 9
ttgacaaaatagtattgcaatttatttaaatttaaatacctgggaggaggacttattaaaggtgttttgtctaattttttaataaaaattaatcattaattaaaggtgtattgcaattaatcataaaaaaaacaatgattgatgatgtagaattcaacttctatgatagtggaaggataatattttaagtttaatttttctgtggtatcaatgtaaaaaaaatcaaactgttaatcaacaaaaaatatgataaataaaactattttatgataattatttttaaaactaaaaaacttataatttataacaatttctaattaaataataatataaacttctttattcaacctatttacttttatgtttttgtcagtaatatgcataagtacattttttacccaagaaaaacggtactattgcatatatataaaaaaaatgtataagaacaattaacaccgtacatatagatataattgtaatacatcattctttctctcttatactactttggtgttcacttgtaccaaacacatcacacatgctttgttgaatacgtacagaagggtcgcaatttttagttatttatttatgtctacatgaagtggacagaaataattaatatgtattgcccctgtcaagcaaatagttatgtcatgtgaaggttttatgatcgagaggcggaataagtttattcttattcaatccaaaattttgttaacataatcttatttgaatttcaactcaatctaattaagacttcataatatatgaaataaaaccaaatcaatgcaatatgttagcgtattaaacactatgtatatctgaattataaaattaaaggcatttaaaataattataatcaagatatattttattttataatatatatttcaagatagaaaatatcatattatatcaaatattattaattaagtcaaaatcactttattttattattaatatataatttttcaaaactatatatatacacatcatattaaaaatattcggattagattgagatcataagataacctaaaatataaaccggacttgtttctaaaattagacctaattttaaagctcaaactcatcaaatttaaccttgagattgaagcaagttattaagatgcgacaaattatgatttttttttactgcatcatgaacatccctaatgtcaaatgaaaaaaaaaatggaaaaatgactttcataaataggaatttgctgaatgttaataatttaattaatgtcaacttaaatatacaattcaggttaatttagacatctcaatcagatttaattattcaaaatatattctatcaaattttaaatcaaatgaatatttaaccgatcgccaataatattgttct

SEQ ID NO: 2438 - DNA, 1400 bp, Glycine max
  Soy_ogl_268 Gm01:51464101..51465500 Cluster 9
cacttctatttttgctcacccttttttaccctctttttcccgtgctccttgacaacgccaccatgatagggttttgacgtgaatttttttaggactaaagtatggtggtgccttcttaatgaaatgtatgaacatgattatcgattttgctttaatggactttagggtttaaaatcaccacaattttttttaaaatcattaatcgttaattcaaattttgggagtttaaaatctgaaaaaaaaagtatattaataactgttagtaaatatattgctaatcgcgccaacagttttttttagtgccaattatgagaatcaaaataagttatttccaaaataatgggactataaaacaacttttaaattcaagactaaataaatcgtttgaaatttgaggggctaaaaaaacttggccacatttaatgggaaataatatatttaataacactaactgtcatattaaaattcatgtgacaatccctaatgtatcctctattaactatgtcaacaattttattaatatcactagtggttaaggaccaaccatactttttttaaaaattataaggaattaaaaaaaattgggaaccaaaaaaaaattattccaaattttcataattaaaaatataattaagctattagaaaaaattatatccaatagcccatatcgatgatgcaccaatgcactacccaaagaggtaattcaccctagaattaatctaaactagaatgagcataaagatgaaaatttaataaataaaaaatatacctattgaggtgaaattttttatcattgtgcaccacaagaaaaatgcaaattagcatcacgatgatagtttctagaaataattaatgctaagagaatttagtaatatagtattattatgattgtgatattatgtttaattttatatttatatgtttattttatttatttgatggtcaacttatgggtcatcaattttttattttttttattaaaaaagatggatcatctcaatttaattcataattcatcaaagttgagttgagttaagagttcaacctaaattgaaaacgggttaaatccaataattttttttcttaggtacaagtcatattaggttgatctatttgacatctgaaatgaaaagaaaagaagaaagagaatgaagataaaattttgaaataatatgattttttagagttgataatatgacttatttgtctcaattaccgttttgattttagtttcaagttcaatgcaaatttaagaaactatgttagcctaatcgacattaataattaaaatttaaaagtaattactttcataaattatcatttagcgttactttcataataaaatgcttaaaaaaattagtgtcaaaaaagaaaataaacttaacccaaaatatggtgtt

SEQ ID NO: 2439 - DNA, 1501 bp, Glycine max
  Soy_ogl_6650 Gm20:186201..187701 Cluster 9
cagctgattgtaaccaatattaaatatagattgaatcattcataacttatctcgataaatcttatttaaaatattgatatccattcaatggttctaattcattggtgcgtgaatacaaagaatctattttccaaactagtatcatgttctcctaaaaaaaaaaaaaactagtatcatgtatggcatgatagctaccttatgatgtcacaaattaaaaaaatgacaactatcttacaaattataccaacagcgattttttattgattaaaattattttatactatatgatcactaaatccaactaaaattcaatttttcttattaagaaaatatatgggcccaagaattttattttcagcaggagtctcctctaccaactgtatggtctaatcttcttcggcatactcaagacaagggttaggagcccttaccactctcaccaacttgaatcggtgaaatctgattttaaactacttgacatatatgatactaattacatgaaccgatttattttattatatatctagattgtaatccatatgtgatacaaatttgtttatatatacatactaaacataactttaattagtaagatgcatatattttgtcttgaaaaaggattaattgcatttttttaatttaaaaatgcactgatctcctacaataagatgaaatgttttataatttatttcattttaagtcattttttacagtatttcattttaagtccgaataaacctcttctatccaaacttattatggatgatttgatatttaaaaatcttccttatttaaaggaatgaaggcaacaagagttaaattctaaactaaacaatgaattaattgatcgtctcaaaaacttaacttataagtcacataaataatttacacatacatgttttattttattttaaatctttggactcatagagaaaataaatattattttagaaataatatgcacatatgtgtgtgtttgaataatctacaggtgttttattttatttttaaatctttcaactcaaagagaaaaaaagtacatgcccacagtgtaatttttttttaataatagtgaaattgtttattttaaaatatattataaagtataaaatatgccttaatttaagtttggtgcttcttttattttacaacttaattatacataatgttatgatttgtatattgtgttaaaaagtgacccaatcttatcctacatattttggttcttgatcagattggatttcggataaaaaaataaaatgattaaaattttgggtcagagataaacctgacccatgctcacccaagatatcaatataaaaaaattgaggaatgttaggatcacaatctcaaacatacttcatctattttataatttttaaaaaccgttctccacaaaaacaccacatgcaataccttgcttttttttttttttcctctctctcatactctcatgctgaagttaaaaaaaacttgttaaccttacaaaccggcttgttta

SEQ ID NO: 2440 - DNA, 1227 bp, Glycine max
  Soy_ogl_731 Gm02:48275101..48276327 Cluster 9
attaattttgcaatgatttttttttactaaaaattatttttggttgtgagtagaatgtgataaatagtaaaaaaagaaagtgtaaatttcatgtgtatttaatatttttatattttattttaatttaaatatttttattcttttaagaatgagtttgattatgtgaaaaataaaaatatttaaattaaaaaaagtaactatgtaagacctatactattttttaaaaattttatagttaatagcaaattttttcaatcaaccaaacacctctcaattttggtgcttagtgaaaaagtgagcgtgcgaagaaggaggcaacgcagctttcagtctcacagcagacaacgtaaggtttagtggttctgcgctacgtaggaacaattgaagaagaccaatagaaaagagaaacgcgtcaacttctccaaatgaaaagttgaatctagcaacactaaaaagatgaatgcaagtcaagaaactaccatgtgtcgcagttcaacactgccacgattcactatgccagttcaattttacttgtttcaaaaggataaaataaaataaagaataagagggaaaaaaactatatattaatagcataaaatactttttttatgcgtaaaataatttaaattatcatttgattataactttataataaatttatttatttttagaaatgagtttggttaattaatgttcttaaaatattagttaataaattaaaaattaaaatatttattgttaaacttgttggaaaaaacaaaaaaattatggataatattattttacgtattttaataagaaaaatcttcttttaatttttaaattttattagataaattttaattagtgtccttaaaacatgggttaaagaattaatttttttattttagttttttaatcaatatattaagaatacctaaaaagttatatcaactcctaaagaaaaagtaatatttttataggtaaatattaattattaatattgtttctttttattaataggagattcaaacttgtaatttcttttctcttcttttatcaccaccaattttatatgtaaagaaaaaaataatatatgatgaatgaaaaaactagatgaacgaaaatatatgaaaaataaatttgtttaatttaagtaaaaatgaaatcaaaacatcaaattgtgataatgtttcactaataaaattaatgattttaatactaatataatatttttattttagatag

SEQ ID NO: 2441 - DNA, 1400 bp, Glycine max
  Soy_ogl_770 Gm03:476501..477900 Cluster 9
aaattattttttttataaaggtaaaacaataattttttttcatggtataaaattgatttttaagtgttactcaaacacaatcttagcatatttgaaaacacgtcttaaatccacacacaaaactgcgtcaaaatagcaaaataacgcacaagttacatttacatgcttctatatgaacgtgaagtgaattttattcaaatgctcactataatgaatttctttggttttgattttgatttttgtaaccaacttgaattaaactaattttaattggtttacttaagtttagattattgggttatgataaaaaaaaagattttttaagcttttatctctaattattgtttattttatataatttttaattatgctagatattctgttatatttcatattttttaatgatcaaatttttttctatagttatcactttatatatctgataattttttttactcaaaatatgataaaagaaaattacttactcaatacatccaaattaagacacttggtaacattagataagattataagaagatcaaatataaagaagaaaattaaccaaagacaaaaatagaagaaaaatggaagtatcaaagtctaaaatgtattaaaaaagaattgatttggcaatccagttagtataggttgatttttgctagtgtggtgttaatggtgtgataacatgctcacataatatataataatgatataatcttttgttgatatagtacatcataatgtcaacacgacatcattgtcaacaattttttgtaagataattgataatagagattaaaaatgaaaaaaaagggaactatttcggaatatgcatttcaaaacctttttctctcctacccatttgtttgcctaaactccggtgatctagcttcggcttatgccattaccttcttctacggatccttattctttttgtgacttctttatttgaatgactcctttccctaccggtgatgatgttgataataaatattttctttcacagttccaccccgggactaaaattgaagaaaaaatttacaaagataaaaattagaaaaatactcacttataaaaccattttcatatttaagcctactttccatttaggaatagtgcaaggaaatggtcaaagagagaagtattagtatgaatcttaattatttattcaattaaatacactaaattattaacaactaacacatttccattttatattaaataatttatcttatgtgacaatcataatactaattaatacaatcatttctactagaatttgtcacaatgtcctgtgtgaaaaagtttataatgagccgaggcaaattgttcaaaatactaacttgaattttgtgcctagcggccaattctgtaaattattgccaattggattataccaa

SEQ ID NO: 2442 - DNA, 1249 bp, Glycine max
  Soy_ogl_891 Gm03:36095838..36097086 Cluster 9
cgttacttaattagacgtctggtttatacatattcttttatcacttaagatgtagaaatgacataatttttttgtgtgcgtttacaatttttgagaaatattagtgactgcaaattactttatatcaatatcatcagtattaaaaaaaaattaaaaaaaaaatcatctcgcagtaagcagttaattctgagtgtaccattttagacatatgcaaatggttgaattagaacgtggataggcaagacaaagtcgataaaaatatggtatgagaaattgtattcgtataattaatttgtatacttttataaaataaagaagaagatgagagaacaaggaaaaatgatataggactataagtacaagtattctacgagaaaatgttctcaatattaaaaagatcttttttttactcaaatattaaaaagattttttcacgtgaaactcattaaacataaaaacatgggagacttattttaagcttttgaaaacttgtactattagagtgaaaattaaaattgctaaaattcttaaaattgatttgaaataagcacaataaaatctatcaagaaggagttaaacaactctaatggtatgtataattggagatactcaaaataagcgagtcacttcagttttttttttttataaaaaaaagatcgtaagtatattttatagagataattttgcttgttataaaaaaattactatagacgataaaaaaaaaatcttcaattttttttatttcctccaaatatttaacttaactatatattttgcatgattcatattttagattattattagttaaattaaaacaaccctacatccatactcattactagttgcttaagacttctacaaattttctatattataaataaatttgatttatcattaatttatattgttagtttctaaaatttattgtaatggttttattaatttttttaatcttttctgacactttaaaataaaattatggtcataataataagtaataattttgtcttttgtatttttttaaaatttttgtatctaagttattctcgtatttattttaatgattatatcctttaaaattatattgatttctttttcaactattttttaaagccatatctacacattacttgggccacgcttgattcaattttttatttgaaaattactttaaagttctaaagacctctaaaaatgaaagtagaagctattttgccatttttatttcttgtaccttaaaagaaagcat

SEQ ID NO: 2443 - DNA, 1190 bp, Glycine max
  Soy_ogl_954 Gm03:38982211..38983400 Cluster 9
tcacaaaatatcaaacatgttaatttttttagctgatctaatttgtaaaatcaactgcctatttttcgattatagtaacagtagatatggtgatagcagtgatgtttggatttgcaggaccctttacaagtaccaatcttttaatcccataataataataaaatcaaatataatatgaaaaatttataaaatgtttgtaacataatggtcaaatgaccatgttcaaattattacaagaaaagtttttgcttaggtactcaatagtactcattcgctcattcgtcattggagtttttttttttttttttgaaaagtaatgttggagatgttaacataattaaccactcctataatatctttagtcaaatatcatatttatttaatattcttttttattatttctctattacattatttttcctcaatctttttatctttttctctctctatatttcctagttaaaaaaatggttatataatttcggtaatgaaaaatatattcttaattagttaataacacaagcttttaatatatatagatagtactttatacgttatttatgattctaactttcgtatgttattattacaactaaaaaaggtaaagaagtatattaatttcttcatactcgtgtttcaagttaaagtattcatatattttcagcaaatcatttaaagcatctttaataagattgcttagatgagttgtttaaagtaacaatattgtttaacctttttttatcattgagccagaggacatgcggtacttaataaatttataatataaatagaatatttttcaagtacggtagaacttgtaaaattaagttaactacttacttcaacaaccttaacatacattaaagtgaatttatgtaaatatttatatctatatgaaaatgtaaggtctcacaaaattatagtaaataattcatctaaataactatgtattatagatattctaaatgtaattaaatataaacactcattcctaaatggtactctttccttctaattataaagttattttaattaatttatgtctcttaaaaaataattaatttaattaatcacatcaaatttatcaattatttatgttattaattgttttttattaatgtttaaaaagaaaataattaaataatgtcatgttaaaaaaataattaatacatctaaaaattttaaaaaaa

SEQ ID NO: 2444 - DNA, 1255 bp, Glycine max
  Soy_ogl_4092 Gm12:35456546..35457800 Cluster 9
tcaagaaaccaaattttctacctttagtggagtctatgataacatgaaactattatctgatttagaaataaattaaaaaaacacattaaatgaacttttgagaaattaatatatttaattattaagtcaaatatattttgggtctctttcaaaatttctcaatttggttttagtcttatgattttttatcctatttttatttttctaatttagaaatatttcactcttgtgtggtctttagagtatagtttttcctgtttataaccttcatttctcattaatgttaaacctattttgaacaccaaacatgaaatatttccaagttagaggaaagaaatgtaaaacaagaaaaacatttagcactaaaaacgaatcaaatttataaaattttacaagaattaaaaacatattttacacttaattattttaagggattgataggttttgaatggacaatgcaacatattatggcacactgtattaggaactgctgctaataaacttttttttcttatttttgagaactgtttataaggaaataaaacaatttttatacataatattttttttataatactatttatttttaaaaaattaaatagaaaatagaaaatattgatactgtcagatatttttacaattatataattacatattaccatatgataagtttattaattcttacaataaatatcttaaatgttataccaaatgtagtttataattagttcacagtgtaaaattttcctttgacaatatatatttattaaacttaaaatatataaacaaaaaatgagatgttgtctttattattgatataaatttaaataataatatatctttgagtttgtggattaagggtctgtttgttaaaggattttttttttaaaaaaaaacacatattttaataaaataagtaatattttttgtgtttgtctaaaactatttttttgttttaaaaaaagttatattttttagaagcaactcctacctcattcttaaaaaaactttttataaatatttttaaaatttaaacaaattaatcctaattggcatggagttgttattgtaacttaattagttaccttaaattaaagttttaggtatacaaaattgttatgttatatctatacaagaggtgcactttatcccaagataggaccatttggtggaagtgaaagtagttagatgtcaaataagaaatttgatatatctccttggttacacaaaaaaaatattcaaacgtaaccaaaat

SEQ ID NO: 2445 - DNA, 1233 bp, Glycine max
  Soy_ogl_5402 Gm16:31917501..31918733 Cluster 9
aaaaatagaaggaaattaagaaaacgtatagttataatcagggtaattaaaaaatattaacaatgtgtttttattatattttttctgcattttttcataattttaataaaaaatatttgttaattttctaatcaatgcttttaaaaaaacttgtcagaaactaaaacttgtcagaaactatcatttctaaattgttttattcaaaacaaaaataaataaataaataataaatttataaaattaaccttatatcataattaatttatttctaaattttataattcatcatctctaattattaaaatgatgaaattctgtaaagaaatttttcttcctttttacatgtaaatcctactaaaaatttcacataaatcatgtaacatattcatattattattaaaacaatctctaaattttttatgcagaatttctttattttaataataagagaaaaatgaaaattttattgaagttatattaaaaagttaaaataattattatattgaaaaagttatttttttcttttcatgacaattatgatgaaaggaacgattattgaatttaataaaccgtcattactgtctccacaaacctcgggattagagcgccaaaattctttgaaattacacttttgttttgttttagaggcgtgcctacgtgagtctctttcattacaaatctctttgtcattactttcttcagaaaagtatctgtcttttttttctaagaaaaaaaaagaattatttttaattaaaaaaaatctagcaacacattctatttgttcttaaaaaatttagggccaatcaaagacaagacaaacttctgggattcaaaaaacgtttatatgagaacattattctcttaataactttttaacacttcatatattattttatgggtcaccatattctaagtgtaacaatttgttttctaccgacagacaaatgttagtttattaaattttgttaaaaatattataggtgtaaattaattaacttttattatgattaatttctattaaaaaatttaattaataatcacttttacatatgatattttgtagaccttaataaatttttatcaataataaattttattttaatcattttttatttttgaaagctctaacttttttatattaaataatagtagtaatgtattgctcgcacgtctcttttttaaaaaacatgtttttatttttatataaaagacaattatcattcaaagtaatct

SEQ ID NO: 2446 - DNA, 1300 bp, Glycine max
  Soy_ogl_6760 Gm20:34867601..34868900 Cluster 9
tattggtcttatcaatatttcttgtttttattttattttattgaatgtaatgtgttttgcattttttctctctctctctcaaagtcgtgcgcaagtaattggtccggttaaagttggaaagtaaatggtcctgtttaagttggaacttggaagtcctcactgttagcttataggtaagagtttataagtttaattatgtttttaatctttaaaatttgaaattttgagatgaatttaattttggtcttttaaatttaaaaaagattgttttagtaactcaatttttttttaaaatataattttagtctctccaattaattgtttattatggactaaaaatagctttcaaaaaattattttaatctctcaaatttagtgtttatggactaaaaatatattatttttaaatttgagggactaaattaatcttttttaaatttagaggaacaaaataaaattcactttaaatttaggggttacaaacataattcataacaaatactagaattttataatgggtaatttttctgatcaaagtaaaaaaaaaagtatctcattaattatatctttttatgcactatttgaagtaatatttgagatatcctctggcggctaaaatttataaccaatactttgttaattagatttattgaaattatacgaactaaaataaattttctttccgcttaggaaattccaaatttcaagaagtaaaagcataaagattaaataagcttttagttgagacaattatatctctacactcactaatttatgttagtcttctatatttttatcatattttctcttgtattttgaatgaaataatataaggtgatcattgtaacaaaaaaaaggttttagtcccggttaaattttagattttgtgttttaatttctctatttttttattgctcattattagggcttgggaggcactaaagatgaacaataaaaaaaggtaaaaactcaatctcacaaggataacaaataagagattaaaatggacaatttttttttaaaagacaaaaactcaaaattaaaaatttgatggagattaaaaacttatttaatccaaaaacataattaaactcatatgcataagataagattaaaacgggttaatgttttgagcgaaaggcgccatttattcgagtttcaagaggttaggagagcgatttcttgaagaagctgtcaaaggatctgcggaatgcaatataataataataacaaattaaaggggcaaaatgaaagggattgtgtgaagggaaagaaaacaaccccttgccaaaccccatgt

SEQ ID NO: 2447 - DNA, 1151 bp, Glycine max
  Soy_ogl_6898 Gm20:40739450..40740600 Cluster 9
ctatccttagttaatgtttaataagaatattacataaaaagaataaaagagtcattaattatagaaataaaagatatattaaaaaaatatttaatgttttcttataattaaacaaattaattacatagttatgaaaaaatttaaatgttatataatctgaaacggatggagtcattattaatataagtatttaggtttaaattctattacaagactaattgcttctatggtttaaattaactattattgagttcaatttttatgattttgaataatcgatctgtctcttgtaaaaaaatacttgtgcaacatttatataacaaaattgtgtgaagtgagaaatttaagttatatttgcctctatttaaaaacacagtaagattattctatatttgaatttaaattaacaaaagaatatttttcttattttatatatttatttatttatctcaaatttatttttcccctgtttttttctttcttgccatcacacccttcatgtctttgagaagcaacaagaaataatttatccattattaagacttgttgtttttatagtagatatggtttgaggatgctactccaaacacactaaaataatctcttattttacgtcaaattaaattattttctctttttttatcatttaaaatgatattctctacttataaatcgtaatatatatttggaaataagtagacagcgcaaatgttcacctcaagagaaaaatgcataaacaaagacagatagctccagacaagacatgatttttttaagaattaatatcttatagcatgtttggatctgtttctcatctcatctacgttgctcttcaaacatgtatcaaattaatataagaaaatgacgcaaaggtaactttaaattgcttctatttgatccatgtgtagagacaaatgatgtgttatcaaacacacattaactctttctattgctaattgagtttaaatttttaaaagatggcatcctcttgtatttctttatatctttatgtttaattgtgaaaatatataatttatttttaaaaacaatttcaatttaacttactcaaaatatttttattagcttaaaaatatgaccttatatactatatttaattaaatcccacagtttgtaattatattataaaattt

SEQ ID NO: 2448 - DNA, 1500 bp, Glycine max
  Soy_ogl_4368 Gm13:30653001..30654500 Cluster 9
gaagctaatagtaatacatgttgtgcctcacaaattttttaaaccagattactctagatacaacgttcaaaatagtaccaaaaaaacaaaattattctgaagtagaagggtgctattactagaagtttatgtcacaaaaggactaaagctcttctttgcattgcccctattccatcagttgaagcactccaattaatgtgaatatctttcttccataaataggcacacatcaacaacatggaaaaaagaagagtaatgaagcaaaggagaattttctgcatatttgagctttttttgagacatcatcttcatcgagtattagagattagttaatcaagaagttacagttattttctgttaagataaaataatgataataaatagtcttgtactcgacacatttgatgaataatattcatttttcctctcaactcatattatggtataattttctctggctttaaccaccattgaagcttcttttctggttccattggccgaggctggaatcatacttcaggattagtctcaaaatccttcttgcccgttctttctacaacttggcaaaaattcaggtttgtttcccagcccttgaattgtcccaattatcactcatagagccttgcaatgaaacttgttggaaatctcacctcaaccagtaaaacagccaaattactaaattagtatatacttcctccgttttcttttttaagaaataaatggatttcacatatattaaacaaattaatttactttattaaattgtgtcatttttaattaaaaaatatattttttctaaactacctttatcataggaatttgatattaaacacaaattccctatgaagaatattttaaatataattttattaaataagacaaaaatagttaagttttgcttatatttgagaacaaaaaatttgagttttttttcttataaaaaaagaacgaaggtagtacacatggaggataattagaatcctgccgaattgtaaaaatagccttgtatccaacatatttgatgaataatattcatttttcctctaaactcattatgactctagtttaataatattttcttataaattaaaataaaattatgtaattaaatgttatagaaaaattttcatctaactctttgaaaagttaagctacataagttgattttaatttagaagagaaactcagttcatttatttatttttattagaaattcttatagaaaaaattattcaaataggacctatttactacaagtgaaaataaattacaagaaaagtaattaaatgatttttatatattttggaaaaataataatttcatataaaaaagtaaataaaacattttcttgccttcttctttaactcctcattgtccattcgttcacagaaggtttgtaatgatgcaatttttagtaaccgcacaaaaaattaatgtatctcttcctctcctttataaatgtgagaggcaagaaaaatcgacatcataacaatatttcta

SEQ ID NO: 2449 - DNA, 1300 bp, Glycine max
  Soy_ogl_1941 Gm06:14183701..14185000 Cluster 9
aatataaaacaaatttgaaggatgataactgataagtcacacgcaagacggcaactgatttatgtattaattctatccatttataataggatttaatagttaatgtttatcattttatcttaagtagttggataaaaaacatagttaacccaagtaaaagatgagatagtattaggatgaatgactttttgatggataacttgctgaaaaattttcatattacacgtacaaaaaaaaggtaaaatataccaaaaactccaagtaaaaaatgtgtttaacaaatataaagtaaaaacttttaattaatataaaaaataagaattataaatccaaaccatacttcatatacaaatgactaacatttaaatataattagtgattacattatcaatttaaaaaattataaatttttttaatcttcacgattcaaataaaatttaataatctatatttgtattacattatatatataaagagatagagagagagaggttaattaccaagccgatctcaccctttccctcattaagtcggtcttatattgacttatatcaagaaaattacctaatggttaaattgttccattaaactaacttattttcaaatccaaagaatgtgaaaagtgaccaatcacctcgcaataagttaagggaagaaaattaccttagcaagataagagatcacgttaagcattttgcatatataacttaccgtttctcatacacttttgacacatcttaatgctatagacttaggcatctttctaggtgaccttgataggtgagatctccatgttctcacacatacatatactaagaaccgttattattttacgaatgtgataattattaatttaagagtatctctgatgatgttattggcttaacaagttgtttattttaacaaatcgttcttatttttttagtattggagaagatcaatgtatcatgtttgattgattaaaatttagctttgattgcttctataaacaacaatggtttatgattaaatttttttttgtcatatttaaaggtcatataagagtcatttgatgattacttaaaattatatcattgaaacaaaatatatataaaataaagaatttaaaataaatataatgtaacaaaaaaatattaataagaaccaattaacataaaataaattatttaaacgataaccattagagatgctcttaagtcaaatatctatatgcatgggtattcaaatttatgaattagttcatgattataagttcacttaacatgttaattgcatttttttttaattttgaccattgaaa

SEQ ID NO: 2450 - DNA, 1200 bp, Glycine max
  Soy_ogl_465 Gm02:9987501..9988700 Cluster 9
aaatgattgaataaaaatacgttagttaatatagttaaccaagatattcaataaactcattagttattaccacattttatctactatgatctaaaacaacaacaaaaaatacaattttttaaaacaaaaggatgttgaaatgtaaatttatgaatatacatcaaaataaaattttataattttcataaatagtgacaaaattttctataataattaaagtcactaaactattttatgttaattgagtgtaaacacaggatttttagaagaagagaaaaagtattcttaggaaaataaataataaatacattatatatagatagagaaattttatcattaaaaatatcaattttaagaattttttattttgaattaagaaaattatgtttaccaaaagccatttttatatattatttattattttcaacataaaaatttaattcaatgttaaaaattcaatatttatttaaggaaaaaatatgttatctgtatataaatttggttttagctctgatacttttattttaactctataaaaaacagtgatttttgttttctcttacaatgaaaatcgtttgtgataaaagaaaaaaattattatttttaaaaattaaaaaatcaaattgattaaagttaaagtatgaaaatacaatttttttattaaaagtataaagaataaaaataaattttacacttgattgaataaccataaattcgttttttttattttcatcttctttcttcccttttattactttctaaaaccaaacagaaagttaaacaagcataactttaagaaataaaataaaagcaaatggtgcatataaaaatattaaaacagcatcgagcccgttaactttttaagactgatatgaatcttttaaaattccaaacaaaaaattgataagttttagattaagtttcttatttttattattattaaagatctgaataaattaaatgatgattgatgacacatattttttgttaaacatttattatagaatttcaaaataaatacttagtcattattagtatttaattagagattaataaataacttggtttaagaatataaataatttcatctaaatcttttctataaaacatcttttgtttggttggaaaatagtataggcctaaatgccaaagtgatagaaacgtttggatccgcagaatgaggtgacattgacctggcga

SEQ ID NO: 2451 - DNA, 1202 bp, Glycine max
  Soy_ogl_2318 Gm07:10050817..10052018 Cluster 9
tatcacgtcgataatttccaaacgtaaacccagtcaattttcaccttaccacgactcttctgaacataattatatatagtcacaagaaagagaaaatataaataattaatttacttcatttttaatattataattaaaaattataaataagaattgagataaatttagatttttgttttacttaaataaattttaaatagaaacaatacaagtgtattttaagaatatattaggtatgacagttttatagtttgaatattacttgagctaataatcttgttattttaatcaaatactatacaattctacgtactttagagtatctgcgttcaaatgagtctcatctatgtagaaaaaacaagaaaaaagaaaatgtgtcccatctcatagtgcgtattatatttttaacatttcaaattaaccaaacaaattaatagcattattttaggtgcctagagttttaaatatgttaaacaataattaagttttagttttgcgaagtgaactgatttcagaattatatgtcaacatgtatcaacaagcagaacaccatatagtattatccaagatatttcttataacttataagtaaataaattgcatcatttgcacgtgactagtaaccatgaaaaagaaagtattatactataatatttgctttcaacggcagtaaaaacaacatcattccaaaaagaagatggagtaagaaaaaagataggttaagcgaaatagatatattttatggatttgttaggattgattttaaatattttataaataaaaatgaaagtgaaattaatttttagaaaaaatttaaaatttattctaaatatgatgtagtaatgattttcttaaaaaaataagtttatctaaattattttttagtgcatgttggtatattttatatatcataaattatcattaagtattaaaacttaatacgttttcatttaaaagatataaattctatgctaacaatcaatttgtggataattaaatttataagacaaaaaaaggtacaaatgcccataagaaaattgttcagagagagttaatgttattaatttgtttggttaattttttgtaagtatgttaatatgagcttgacttcttaagagtttgttaagagagacaaattccgatggctttctgttacgagaatcctttaccttcagcaaaataaaaataaaataaaaggaact

SEQ ID NO: 2452 - DNA, 1500 bp, Glycine max
  Soy_ogl_3357 Gm10:3856501..3858000 Cluster 9
ataattcattttataaatataggtcgagtattaactttctgataaagtgataataaaagtaatgagctagtacattgatttgactttttttttttaatcttggatgcaaatatgatttaatagttataaaagtgatattcacttttggttgctacaagttttttcttcattttacttcctgtaattataagttttttttttaaagtaaaattttgatttttttttttcatttttaatatgtcattgatccagtaaaattggagtcagatgaaacaaaattttatattagagccttaattatagagagggatctttaccaatataaataccacactaaaccaaccaaaaacattatggtttggttttttaaattttttggataaaacccaacctaatcaaatctattattttttgggttgtgtattaagttttggtgttgaaccctaatcaatccattaatataacattttttttcttttaatttattatttgtatatgtttttttaaaaaagcgaaaatacacattatacacgactacacaagtctcgagtgagtatactggccacaacaattacataagccttaatgtctcgctttagaacaaatcaaaatgtgtaatttttctttttgtaactattagacttttcacagagttgcatatgaattttttagtgtatcgcataactatttaaaaaaataagttaaaatgcatacacaatgtatataactatttgaaagttacatcaaaataccatttgaaaatgttaaggaaaaataatttttcaaaaattatgaaataatttttatttttgtgtacttatttttccaatccaaaggttcagtttgaatttgataaaaaaatatacataagtctaactcaattcaaattattttatttaggtctttggtgaaattcaatacaactttacccatgaacactctattgatggatgaaaaaaatgtaattatgagacaaacacattaaaagtaaccccttaaatttctcaataaaggataattattgaaaaaatgatagatacttttttattatttccaccgttagtatatgtagcagattttgtggtattgctggtaccactacttagtatattttttcggaaaaaatttatacaaataacatggtaagaaaatattaaattactagtttatttaactataactcaaatacataattttttatttatttgcatatgacatattcgtttatagtaaagcaattatttgagatttttccggatccattattaactatttttattatataagattaactattttttaatttttatacaacgaaagtaacggggtttaaatttaagattccatatataattattcaatttttttactattaaactaatcccagtaaatctaatttttatttgattattaagttttttccggcttttgactctctcttttttatgtgtaagtattttttatttttttttacaaggggaagtgtaagtattgaagtaa

SEQ ID NO: 2453 - DNA, 1500 bp, Glycine max
  Soy_ogl_3463 Gm10:40077401..40078900 Cluster 9
tatcagtgttttgatgattgattgatgaaactaatatgtattagtagtacttttattacttagtagtgcggctcatgaaatccaaccccggttcttttatttgtgctgcggagaaggacattgttccgcttatgaaaagcccatgcatgtcaaaatgaaaaaaaaatctagtatccgggtttttctctccctaaagcagagatattctcaactcgggatgattctatttgaactagtaagattattatgagtaataatttttttaaaatacttataattatatattcaaaacttgaatacgaaaattcttattattttaattaagtctcttaataagtgatttattacaagatggttaagtcaattaataatacacgaatgttaaatacattcacttgtaaatatatatattaactcatatgcacaacgattttctcatttttaatataattggacccacctctttcaatatttttaggttatttgattcctgagaattacgtatgtgaattttctcttttgtgatgggctaatggctacttcataacattaaatcctaggtaaaggccgaaaattattcctacctaacttacttgtatcacattactagattagcgtttatctttcatcaaacttatttctcaaacgtgaaactagtggtagatgttgatatataaaaaagaagaagttattattagttgtgaatgtctttaattatttcttttgcaaattaacattagttactagtaattttagacctttctagattttagatcaagtattttgttcgagttcacaattattatgcactaagctctagctagacaccactcacaccacaaattgaagattagttggtcatatatcaagtctagttttttgtcaattacgtaactcctcctaatatagctcattaaattaataacattcttctatatatagacttacgcataataaaaataaacaaaacacaaataaatttatcatatttaagtctaaaactttgatacttctcttattttttaattttttttctttttttaaatattttgttcgacatgttaacatgcaaactaagatgagaaaatttgttattccttccattttttatgagactcaaattataagtttgacttatttttttataagacttaatctaaaatgtcttatagattaattatttttttttcatatatatattcttaattatgaataattttccaagttcaataaatagtaagtcaaagacattaatatctaaagcttttttaagagtataactttgttttgtataaaaatatttgggaaatcttaatttcatcattcagatgcaaatattaaaagactgaatatattaacgatgagagagattaaaagaactaaaactaaataaaaaaaaaatatggcaaatgtactctcttataaaaaaaaaaaagaaggaaaagttattttattagaatgtatgaaaatttgttctcctatattctttctatctcatta

SEQ ID NO: 2454 - DNA, 1339 bp, Glycine max
  Soy_ogl_5931 Gm18:5049362..5050700 Cluster 9
cttttatgattgctttttgataatttggatgtttaatttgtgatgatttttattaaaagaactaaaaaataatttaacgaattaaaaatattaatttgatgaactaaaagagattagactctcaaatttaaaaaattaaacacatatttaaatttatttgtgactaaacgtgattaaaattgtagtcacatttatttgtaatttccaaatataaaaaatgataaaatcataattaagtctgcaatttaaaaccttatacttgaaatttaaaaccttacactattttttatttatattattctttacctaattttaaaataattaaaaattgctcgacaaactgatttgccctcaactcattgcaaaactaatttttggcaagccaaaacataaacatgttgatggattgaataccctaaaccctaatccaacttgcttgaaaagattggttaagttaaacgatcaattagttaattaatatcaagcccagtctaccacccgttcatctaatcctcaatttgagcaagaaggaatgaaccaatagcaaacggcaaggacaacggggtgtggtggtctcctagcatcgtgtcgatcatcttagttgattatgagaggaagaccactttacttctaagtgatggcaaatacttgacttaaaggtaaagtcttgccatagatataaatttaatctagtagtgattgtgaataaaagtttaagagtgaataattaacattttctcactaatatttttaataaaaactaacaaattaatatttacttataaaaagacaaaatcttcttactataggggcttagtgttaatagtgttaatataatattgtttaaaatattccattacttaattttcttaaatcatatattatttgtttaatagtgagtaattattgtgttttattttcaatatatagttaaattatatatattatcacctatttaatcacaattaaataagaaataaaaagttaccgatttaatgatgaatccaatttaaaagacacatagaattattatatatttgatgaaatagatattgtcaacataaccctatttggaggtggaaataaagttaggaagttttttcatccacggcaacattttttgttatttctttatttctctttagtttatgtagggtctgcttatcttgaagttagacaaaaaataatcttgataaatttgattttgaactgttaaacgtaattcagatatgtatttaaattaattaatttcagtaataaattcaacatatttttattaaaaatgtaaaaagtaatttcccaatgtcaaaactatatgaataaaaagtaattcattcct

SEQ ID NO: 2455 - DNA, 1300 bp, Glycine max
  Soy_ogl_2236 Gm07:6548401..6549700 Cluster 9
tataattagcttttttatagtccgcaaaaaaatagctttttttctcattgattatgaagatttatacttactagttaaatatatatccaatccctccttgtatttgttgggtacagatttataccataattaagttctataagtttatttttagtaaagagcaccaagttataaatagaaaaattaaaaattaacaacaaatgacgaaattcttagaaaagataagaagaaaataatacttgcaattttgaaagaaatagataccctagataacatattttatgaaagataactttgtattactatcctacaaaatagcagtttttttttttactaactccagcgatttttctttcatacattaaagagattttagattgaaattatgttatgttatttctgtgacttaaatatatttttaaagttcttgtagtttacacgatctttacattttagttattttaaaaaatagtctgtggtatattaactttttacgtaagcctatgatatttgtttagttgactttaacgttgctctgtttgccaaatgatgacgcgttacttaatttttttagtttggactatgaagtatatacattgctttttattttggtctctctaatatactttcttttttttcctttcaaaaaaaatactttctttttcattttagttttttagcctcctcaacaagtatcatagctaagcaatgacaaggattaacacaaaaagaaaaatgaatattaaagggaccatttaaaagataaatttagaaggaggtaaatcaataggtgggaattttataaggactacaagcacattcaaacttatctcttttaaaaaaatttatcttcatttagtactcaattttaataatttagggatgacaaataatctcaaatcgatgggtaccattccaaatccacctcaaaatatttgcttcgatatcctatgtaagtacgaatatctttagaagaagacccaaagaaatgtcataagttactcttttatgaacgaattaagcaattacatcctttgcaaaattatcaccttttcttttagtacagaaattgtacattttgttctgcccaaatacaactataatttattcttgtccacgttgatatttgatctcaatttttgagtactcttttgatccattgccagccaatagtactgcgtatgaaagtataaagcaattaatgttgttttgtctactcagactggaccaaaaaaaatgctgtaattttacgttcatattcaataccaagttaggtaaaaagctttcattttaattaaaa

SEQ ID NO: 2456 - DNA, 1112 bp, Glycine max
  Soy_ogl_539 Gm02:14165961..14167072 Cluster 9
aagaaggactttatttgtgtgttctctctttaaggatttctagtttgattatcttgtttggtttgtggccaagtcctccttgaagaagaaataaaacgtcaaacaattgatttaaatatatccataatgttgatacataactattagtctgggatgcactttttgaaacagtattatgtttttaacattccaacaaaaacacaattttattgttaatattccgaaaactattttgcttttgtgttctagaaaatattttttgaaatgttaaaaataaattgagtttcgaaaaatactttccaaacaatgttttgtgttttgaaaagtactttttgtactactaaaaaaaaatccagaaaatttcaagcaaaacactgagaccattaaaaaatcttatataaagggaaaattattcaatagtgaagcattgaagcggagaaagtatataatagataccgattcttttagctggaccactttaagagggactctgctgcaacaaatttagacaaatttaagatatatatatatatagagatattaatgatgtcataatttgtgataattttatactctcgtaaatgtttttttaatttaatttatttaaagtaatttgtgataatttaaaactataaggatatataaaaagtcataacaattctccatttatgtttttatttttttctttaaaattggtggaatatgtaaaaaacgtccaccaaatcatataagtaaaatattttgacagtttaaaatttgcaaaaattattttttaaatgaattaaaaaaataaattttcataattaaaaatcaccataaagtattaaagaacaaagagagactaaaaatacttctttgaaaatttgagggattaataaaaataatttttttgaaggattaaaaattaattatctaaatttaaaagactaaaaatatatttaagttaaaataaaataaggaagaaaagtagagggaacttaaaggtactgcattggaatttggaggaggaaaaaaaggaacactggagcaagagaggtataaaaggagacaagaacattagattgaagggaggaaggagttcaatgaaaagagggagtatgtgttgttgctat

SEQ ID NO: 2457 - DNA, 1188 bp, Glycine max
  Soy_ogl_6458 Gm19:39552299..39553486 Cluster 9
tatcaaggactaaaaaaattttgttttgtcagataacaaaaatgaaaaaaaattaaagaataaacataaaatttaaatatttattagaaattacaaacatatattataaaaaaatcatattagagttgtattattttcaaacaggtgcttacaattaactcatattatctttgttcttggtggaacattattctaggaacaaacatcaattgatcaacaagagcattgacttgattgtaacaatcatattattcacaggggtgaagcccgtttatatttaatataaaaattaacggaattaaataaatgacataaaatcaaaattttagtgactaaatgtaataaaattatttttggaagacgaaaagcgaatatatgaatgaccaaaatcacatataatagaagtgtttgtgatgaggtttagtccaatttttagttaaaaatttatttaaatcaaacataaaattatatacaatttaatttaaatgtaatcttgacagaactctaatcgatcgatttgtgtgatttgatttggatcaattttataatttttaatactttgaattttatcctaatataatctttaaaaatgtttaaatttaactaagaaagaaactggcacaatgtaaaatctagtaattaattaagttataatcaaaacttgaaattggcatttacataataataagaaacagaagaacaaaacattacatacatgataataattatattattaatctcttatacaaaaaaattatttgtctaagatacctactattcagtacctactattcgtcaaataagttgaagccttgaatagccaaccccacaatgattcattcataatatgtttacttgcgtatagtgctagcaaataagattgataaaatcatagtgtgtttaaacatgtgagaataaatacatatatcttatccataacaaattacaactatgaaataatttgtttaattcactgtacatttcattacttcagctttcttttattaaaaaaattaaattataaaagaataacaatactaaagcgcagcgcatacttgagtatggtatatgtggttcaatttgatttgaatgatgccagagacataaataggataccaaattaaatcgaattaaaccgattaatttgagcacaaaattatttaaacaaattaaaaagacatcagtttg

SEQ ID NO: 2458 - DNA, 1200 bp, Glycine max
  Soy_ogl_3158 Gm09:37669101..37670300 Cluster 9
tgacatttcaccatcttagcaggggtttaatcctcataaaaagttatgtgcatgtatgtttgataaattgtttttatagttgatttgaacatgattttcatctatattgatgttgagtccataatcctatcaatggtcttgtacgtgtcttatacccaaatgtcatccataaattttattaattgttttagatattcacaactatccatgaatatttcttacaatataaaattttaaaaaactattatttttggttcttattataatattcaatttgaaatatcttttgtattaattgttctttcacaaaaatatttttattaaagttggttttagaattttctgatggcaaaaaaaatataattcattaatgtttattaattttgttcatatggtaattttataaagaaaaaagatctttaagttaaaacaaattgaatgttttcaattgaataaaacaaaattcttaattttgataaattaattaattggatcttataacaaagaagaaagaaagtaaaggaagatgatggaacaaaaagacatatttatataaataataagtaattttgaaacttgtaataattatactaaacatttatacagaaaataaattagagcagcttatttcattatatagttaggtacttttaggtaactacaagctacaaatattcgtagacaccagcatcttactacatgcctccacctcaacatgagatgatccattctctttgacaatagatgcatatgcattgtcatctaacacgtcatttcttaatctcctatgtatattctatcattccttttttttttttttttaagtttacattcttttattaccaattgttttgtcccaataattaaaatatgcacaaatttttatattatcttgtatctagattgatgactcactttttataagtaatgaaaaaagaagatcgaaatatattagtgaaagactttcttaaaataaagatggattacacagttgattaaatataatacgtagcatgtattatatagttagaatttgagactctcctaaaaaattttcatttgagatccataacaaaagattcaagctcatccttgtgaataacttgatgcattatctctccactttgagagaaatatgacaggaaaaaataatccacaatctaacaagagaaagatagatacaattttttcactcataag

SEQ ID NO: 2459 - DNA, 1042 bp, Glycine max
  Soy_ogl_6454 Gm19:39415759..39416800 Cluster 9
ttttctcatgtatacaaaggatcttgagagaaggagccatgacccttgtttcccacctaaatccattcctgctaatgatgttgatgatctattgacgtatcacattgagagagggggccatgattcctattttccacctaaatccattcatgctaatgatgttaatgatctagtgacttattacattaagaatttttatagaatagttgtgtgtattatttttttgtaattatattttaaatttctcatcaactagttaaccattttaaaaagagaaaaatttacaaatagtgcttacaaaaaaattacacataattactttgaaatattcttttttgttggtccacataatattctgtgatgacatgaaaagtcaatgaaatattaatatcattgatacattatgagttcatcagttaacattacttgacaacaaactaaaacatcaacaaaaattaatctttaaaggactaaaaccaaaaaaataaaactttaaagtgctaaaatgaaaaaaaaaaacctattttatagacaccaaaaattatttaaaccctaaaaaaatattatataacaatattttaatttttttagaaaaaaggtaaattatataattatgaatgatacacttgactattagtcaagggagacatattgtgtcatcacccataataaatcttataattaaatgaaaaccaatttcaaataaactaatagaacatatggtgcaaaatcttagttgtttgctcggagatagcttttaataataaagagtgaatcaataaataaaatttgtgcaacctatcctaaatcataaactctttgatggaataaatgtattatcggtccatgtacttttagttaaaaaaaaaattagttcctgtattttcaagtcaatgaaatcagctatttaacttttaaaacattggatttttattgagcatgtgatcaactaaagcgtaattatttcagcttataaactaaagattttatatttgaatcttatggatgtaatcacattaaatactttcacaaaaaaaattat

SEQ ID NO: 2460 - DNA, 1174 bp, Glycine max
  Soy_ogl_3851 Gm11:16607616..162789 Cluster 9
cctaaaagttgagcattttttgtattatgataagcgattctaagttaatgttaattctcatattacccttgaagtaattgtcatctccctatccattacattctatttagttgtgaaaagagaaatagagtgaatgaaaatataagagagataaatagataatataaaagataaaaaaaatttaaaataaaataaaatgttagtacgtttgatttaagaaaaatacgtgaaaataaaaaaaattataaaaatattgatatatctttattaatatgtgtatctttttacttaatgtagatcaactttattagtaaaaataaataaaagaatgatgttaacaaaaatttacattcctcacctttatcgaagaccggaattttaaacgttagacccacctttacccaaattaaatccatcactagctattcacaaaaaaaaaaaaattaaaattcatcactagctgattaactctactaaaccatcttaaaaaaatccatcgtcactcgtcacccaaaatcattgctgacaaactcaacgttactcttcaaacaaaaatatatatcttttttattaatttatcatataaaagtgttttttttacaatgcaaacagaatatattaaaataactttttagttaccatatccaagttaacatcaaattgattttattacaatccatttttaaatcatttagacatataattaattattaaaatagacaagggctttcaaattttagattatcttgtttaatcgtttttaacatttttaatgatatttggtatggttctaatggattgcaaaagggtgtcaatacagtttggatgcttttctccatggaccatcgctcatttatataaaaaaaaatcattgaaataactttttccgtatgtaattaatccaaacatacatcaattgatttgtataatatattaaacatgtattttctaattatgttttgataagtttgagatggactaagataatgtgtatcggatgcattactaatattgtgttcaggtgctgagttggttaagattgaattcttgatgagcgttgactttaacgtgttatctataaattaatcaaaatttaagatcttttgagtttgataacactttgaaataattgacatgtcataaattggattggtagtataataagaagtgggac

SEQ ID NO: 2461 - DNA, 1241 bp, Glycine max
  Soy_ogl_776 Gm03:733060..734300 Cluster 9
gaaaaaagaagaaaaaatagagatacacaataaatcatctccaaatcatagcaaatatgaaaggatttttaaaataatgagacccacataatttatactttatttttagtttttctttcaagtgaaaaagttatataatatctctcatttctctcgctactaaacctaggattatttacagataggataggggctagttttaacaaacctcttatctggttaaaatagtttgggttgaattgaatttgtattatttatttatcaaaattgagcctaagcaactcaatcaatattgggttgatttggattgaatctgtaggaaaaaaattaaagatgttttcataaattaaaaagaaagaaaaattcttatcattttaatataaattttgaatagttatttatatatgcatttagatttttctttctttcaagtagttatgctataaacacactcaagctcgtgtaattattgtgagtagtatgctttactggtgtgtaatcgtgtttaatgtgtgtgctttttttatatataaaacttatccaaataataaataaaatttaaaatatgttacattaatagattgagttggatttggattacggtttcaacacaccaaaaccctatatccaacccaaaaaacaacaaattcgatttgattgagtcggattttaccaaacaatttaaaaaatcaaaccaaagtatttgaattaattaagttgtgtacgtgttcgggtttgtagggatctgtacctatgtctatagggaaaaaaagtatttatatttatgaacactgtacctaaatcactcaggataaataaagtaatagcttttcaattctcggtagaaagcttttttttcatatataatataggtattttttataatttcttgtttacttatttatttttactttctcttttttcacatctctagagttaaacattttttgatcaaccaagaaaaatattattgaattgggtatcctaacctttttacatcatttggaaaacaaaaaggattaccacacgttcccttcatacattgaagtaacagttaccaattataatccatgcttccaaattgatgttgatgaatctgattataaaaattggaaaaagggctctaccaaaagaagttaacaagtttttcagaaaaaattacttatcgacaaagatgataagtacacaataacatgattttatttttttttttgtgaaaaaataaagaattaaaagccctc

SEQ ID NO: 2462 - DNA, 1294 bp, Glycine max
  Soy_ogl_2699 Gm08:15219201..15220494 Cluster 9
taatataaagcaggaggtaagaatttgatcgatcctccttcactaacaaaatttaagaccgatctgttgaaactgtgaaaaaattgggttggcagctatatgtgctaattcagtgctaatcaaatctttgtcttggaatgcttattatgcagaactaacgcacaaacgccaaaaaaataaccaaagacacaacaacatttgtaatttgtagtaatggtagtgcactaatgcatgctcgttttctctctctctctacctgaaccaaaaacataataaaaataaataaataatactacatttaattttaatggatgtatatttaaggggtccataactccatatgagatacgtcatgtctcgactgaaccattagaattccaacacgcatttgattgtagtatttttttaaaaacataaagagcttttctttctttaaaaaaatattaaagattattaataattaatttgttatttttttaattgaaaggattgaattcttgactatttattgaattttaaggggtacatatatgggccttttttataatctttttcactattttgtcttttatttgttattatttttatttattatcatctaatttctttaaatatcattttttcatgaaacatacaaatatttaacaaacaaaacaaatggatcgtcatgataaatattatatataaacaattaaaatataatgaaaaaatatttaaaaaataccaaataaaaaattgtgatatttaaatattaaaataatatttatagccttttcattatattttctcttcaattataataatcaccgcacggaatggttgaattgaaaatgtagtacattgcattgagcaatgcatggcccatagactatagtaaaagagacttaaaccaacgacaacaaactgatataaatttgaacattacataatacatagatatcaaatataattaacaaaaaattaattgcttacattttacattatttattatataataattttgataaatttaaaataatatatatatataagagtttaattcaattgattaaatagagtgtgtagtgtttaagtgttataaattccctaatggatgagtacttactcaattagttatatgagtgttgtagatccccttgtaggttggtactctccttaatttctatagaaaacaaattaaaaggtgataaaaacatagatagatatataaatactataataatcacacaaaatattataatattacaaaaaaagttatatatatttcaaaactaatgatcttataaacacgtag

SEQ ID NO: 2463 - DNA, 1341 bp, Glycine max
  Soy_ogl_2865 Gm08:43132701..43134041 Cluster 9
tgctcccttaagaacataatcgttcaaaaagcaatttccataagtgatgaataatgggtcagataagcttttataattttgattatttctttaaaagaggataagcaaggaaacgcgatcacactctcgtacaattttctcgtttttgcttctaccttgaaaacttcagtcattggaaagtagataccacttactccaaagaagaaatggaggttttatccaacgagaaagtagataccacttactccaaagaagaaatggaattctcttttgtgcttaattattactggtggacaaattaaaataaatacctatttttgaatattagaaagagctaaataagtgtttttatgactatttgatcaaattaggatgacgttcagtctaaagtatcacccaaagaataaaaaaaaaaaaagaattataaaattgatttgattgttgtaggaagaagaaatttccccactaacaaactacttgtatcaattaatattgaccgaattaaaaataaaaaaacactatgaatattatgcaaattatactccaattttattccatgttttcatgataatgttatgtgattattttattattaggaatatataggtcattcaactaaacatttattgatacttatcatacaagtatttatatatagattgtttctacaatagaagagaaaataagattaaatagttttcgcataagttgtaagctattttttacaagttatatcatgaatttattattaaaataaattgaaaacaatttatgaacctatcataacttatttcttataagttctctcaaagaattatataaatacttacattaaacaaaattaaataaactgtaaataatttctttaaaaagcaccaatgataccataccaaatcatagtttatttctatttggatgaatagatcaattgacatgtttgagtaccataaattaaattttttttcttataaattaaaatttatagagaaattaaataactttttctttgtctctgatatgtatacaaatataagcattacacagcaacaagtttgagtccctttgatgattttctaagagattaatgttttaaaaaacaatttaaaatatagaattggtgatgagactgataacagttattgatatagtagtgacactaattttaaattattttttaaacattataattccaatttcaaactttattggctttctcggttaggtcaaatgcagaatgaaagcaaagaaaatatatactaggtctggttgaatctattcttgtttatttattttcaaaaaatattttgcaaagcaaaatataaccaaaaacttatttgaaat

SEQ ID NO: 2464 - DNA, 1242 bp, Glycine max
  Soy_ogl_3494 Gm10:41158559..41159800 Cluster 9
tataattattatttctggtaaacccaagatatattctgaccatggagcaattgattaatttttaaaaatattgaaatatatttaagaaaatgattgctcttgacagatgtttttctatgcatacagccttacaagttacaaatcaatctcctgaccacatattttaagaaactaagtaatatctatcaactatatcacactatattagttttataaattattttaaactgaaaaaatatataaattaaattcaaaacaaaacatatgtttaaattttttaacgagtttcaatcatacagctgggtcacctgggtggactcaattcccgttgccacaactcgtggaacactaatacaaggattcggttggatgaaattccaagattccccactacatacctttattatatatttaagtcgtattatttcaagaatgaaatgattttaatctattattttttttaaacgaattacatatattattttaatgtttcaaaaattaactatacattctttattttattataattttaagcattttatctaacttaattatacatcttcacatcattttgaacattttatattttttatactttttaagttttacattaattttaaaaaaatgcataacacatgaaatgcttaataatatattataaattaatgtttttgtggacctgtaataccaacaatttctattttgaattgcagaatttgtggactagtaataccaattttctattttgaatggcagattctcttggatgaaatttaaaccatcaaaagtgtttcatttacatcatgggttcgaagaaaaacaggggaacgataaataaagtcaacaggaaaaaaaatctgcatgcccaaagtctactgcttcatgacttttttttccaaaagtaccactttgaattaaaagatataacaaaatctttctagattttttcgagaaaatttaagaatttaatttttatatatagttagtgttaaaaactttacattgttttaaaagaagttataaatggcccttaagtaatgttttttatagcattatttatagaaggacccttaagtatatataactgtatgtatgagttgttgtaaatttttaagtatttatgtttgatttttatagttaaaaaatatattataaacatattatctaacatactatttgaatatcctcttgtcatagaaattacgaattttcatgtttacttcttacttccatcgttctatt

SEQ ID NO: 2465 - DNA, 1222 bp, Glycine max
  Soy_ogl_174 Gm01:46779501..46780722 Cluster 9
tcatttaatcattttatcgtaatcttttaataaaatctttttatttataaacattgatgattaaatatcgtcaatataattaatatttattttattatatacgatagaattaaaaataaacattttaaaataaaataggatataatataagtattgaaaaataatatagttcaatttcactaattaaagaaaataaaacatttgatcttttttttattttgttcccaaacttgataaatgtccatgaaaattttgtatcatgtttttttatagacagattatacatcaaacatgttttaaaccaaatcataaaaatgaacgttgtcgttgttgggagacgcaaaatgtaagaaatttaatttaataacgaaaacaaatttgtataacgagaaagttttaatcatgatccaaactttcttaattttttttccttaaatgttgaatcatggatgagataaggtaagtatttatataagtatcaatctaatagaaaaaaaaatgttggtgggtgattaagagagaaaaaaaattcaagttctatccctacaaataaaaattaacaaattaataattaagatttattaataaaaaaattgtcaatctaacattgagtataaatcatctgttatttaacttgccataagtcctgagtttaagatctaaattaattcttaaaaatgtttattaaatgagaaaaagtacttcaaatttttttttttttaaatgagtttatatattttttgatgtcatgtttctcagttaatttctttacaacttcacactacaatcaaactcattcaattgctaatggcttgtttggtttgatggaaaagagaatgaaaaaaaaatatgacaatttttaattcgtccattatttggagctttaaatgagaataagtaaacaaagaaaaaaaaacaaaaacaaaattgagtcccacataaaaaaaaaaactttcctttcaatttgggagaaaagagaacataaaaaatgtaaaaatatttaggataaaattacccttatttatatattacatctcttttttatttgagacatttatgttattttaattttttttcttctctttcactttctcaattgtcaaacaacttaaaatatcttacctttttttttctttccttttttttcctacacctaacacaccataaaaaatttatacatgatgcaagaaatattaacttatttcatgaaaaatatattaat

SEQ ID NO: 2466 - DNA, 1000 bp, Glycine max
  Soy_ogl_4782 Gm14:45857801..45858800 Cluster 9
agtattattaatgtattcttgttacaaatataggtttaggtttttatatattagttttgtttttatttataagacccaacttttaatgatataattcctaaagcatcattcatttaactttaactgtaactgttttttctttcaagatttttttttcatgataagtaggatattttaaaaataaccttatattttactttgaaattagtaaaattaaataatttcaaataacttttttaaataatataaatttattttttactgtgctaaaaggaaatacgaaacaacttcacacaaaaaatacgaaaacccaggtatttatcttctattggatgaaaataataaattttaaaagataaaagaatcagacgacggaaatcagggtaactgcagtttcgtgtctatatttttgtaccaaaaagtaattttcttattttttttatataagatgtaattcatattgttttatacattaattatttttagattaaaagtatttctatttagataaaagagtgattatattagcatgcattaaaaagagaaaaatattaatgataatgatatttttttaaaaatatattaatttaggataaatttattgttattaattacattaattatgtttttaattttgataaattagataattggattgtacaaataaaaacaaagatagtatttattatttatttactaatctaagaaaaacaatgataactattaatattgaatcgaaccaaaattaaggtgtgaaattgagacatttgatgcagaaatcaccaagaaaattttgaggcatagatgaagccaatgtgcacaaaagaacaaaagtgcaaaagaatcaagggctagtcctatgatatgacaccttttacaacttcccacagatacttctcaacaatatttgttttttaaaacaaaataaaatgattaataaggtatagttttgtattttgcacaagagacttgtaaatctaatattgatatttctttatgt

SEQ ID NO: 2467 - DNA, 1211 bp, Glycine max
  Soy_ogl_3127 Gm09:36483201..36484411 Cluster 9
atagcagatgtgttcaatgaaaaagtatacttttatataagaaaaaataaaataaatcgtagctctacaatcatacataagtactaactaagaagtattaactattgagaccacactttaatttttagttattttacaaaatctagaatgtagattccactgttgtacaaactctagaatctagatgctatacaaggcacggtctaaaatttttattttttttaattctctggtttaataaaaaaatattcttgcttaatttaaaattcgagcaaaacataaataaaatctgaaagaaaattatttttaacaagaatctaaaatttgacttgacttatacatttcacaactagtttgaataaattttatttaaatggctaaaaataatatttttaatgtgtttttatttttattttaaaaaaaacatattatgttcaaaagtataaaaatatttccattttataaaaaattatataaacataaaagtttagctaaataaagtataaattaaatttttgtaatgaattataatttcaaaagtataattaagtcttttttcctcattttggttgattttctcttttagctcctaaaaaaacattgactgatttagtttctcataattttttttcacatttttagattctgcaattgatttggacgttgagtgattggcattcccgtgactcatcacatagatgacttagtttattagaatcgacatagtattatttaaaaaaaaaaaatttggcgatttgacaatgaccaaaaaggtaaattatgaaattggactctctttttatcatgacttatatatttattcactcataaagtttgatccatcttagttcttataaaaaattatttgtgtttttagtctctcacatcaacttaataattaataaattattacttttacatgatttatattattatttgacacttattatttagtcaggattgaaattgtaggacttgcgtgctctaaattttgaactcaaattaaatgtgagcttttttaactcagtttgatgaaacatatgtcataatcgagctcatgttgagctagcctagttaggttcaatgaggttgcctgttattttttctaattttgttatgaataaaactaaaataacttttcatattaagaataattgcattattgtttgtcttttcattctttttctaaatgtaataataaataacataat

SEQ ID NO: 2468 - DNA, 1204 bp, Glycine max
  Soy_ogl_4430 Gm13:33484601..33485804 Cluster 9
agcgttaaagtcacccatcgatcaagaatccttcatttccttgcgtcacatccgtaggctgagagatctctatatatagtttgaccccataaatgcacaccacgtattactacaccacatttccctttcccttctcttgatgacgtatatttattaacccttcaagttttttcctttttttaagttaccacgtattagacttcgtttgtagcactaattaacaaataaaaagtaataataataataataatgggcattgaggaaacatttggtttacaaatacttcatctcattcaatatttaacaaaatatttttaataaagtaaaccattcaataaaagagtttttgacctacctattttttttcacgattctagttttcaaactttagaaaataattttcttctatttttagtttatttgacttcaacaaaacaacctctattatcttatattcatcccctctttttatatatgagtctagcattggtttaaatagatacctgagtgttattaatattttgatatcatatttaatttttacatataaaaaatattctattttttcttataattttcagagaaagacaaataaacacaaaaacacttttactaaaatatcaatgtttttcctcttaatttcgataaatatattatttattataagacaaaattaaaacaattatttaaatatctcaataaaaaatgagagcattagagatttttttttccaaagaataaatagtaataattttgagacagagggaataatatttttttaaaaaaatatcgaaaaatgtacagctgcatttaatatgactatgtaatctaatattttgcttaaaaatttgtctacaaagtttttgaaatattttatggaaaataaaagtttaatttaatatctatgaaatattaaaaatatttactagtaatatttttatcaaacagatacaaagattttgtaaaaataaaaactacttgatatttaccgttaagttgagacattattaaagaattataaaaaaaagttatttcaaaatcaaaagagtgtaaaaattacgaacaatgcattttacgtatagtaattttttattgttcattaaattttcttaaaacactgattaacatttgatttactcttctccaatgaattagcttaagaaatataataataaataaaaatatcgggtgatttgatatcacg

SEQ ID NO: 2469 - DNA, 1200 bp, Glycine max
  Soy_ogl_4966 Gm15:10104001..10105200 Cluster 9
aatttaacaagaaatagaccattaaaataggtgagcgagtcacctgacccgttcaaattaataaaaaaatgcaacaaaaaaaaaaacgatttacatcgggtcaataaaaaaatgcttaatataacatcgatcattttcttcttttttttcttaaaaaagtaagaaaaaacctaaattatttgccatgttcttttttgttccaaatataaacttgttattattaatcaatgtttatgtatattgttaaaacttcaacttaagtattacaacatattttatttgaacgtttatatgtactctagatgctaattagaacctatagactacgttatgtttttaacttttagtattataaggttataatatgatgttttataaatattattttatatattatttgattgttatcggtattttattaaaaccaatttgatactggttgaatcattgaattttaaattattgttttgactggtttaatgataagtgtaatttcgaaaacatttgtagttttttactaataaaaaatttagtgtcaagaagtacggtacttatttcatttataattaatttgcatgatgttatattattcaacatttactatttgtttaaaattcattaaactttattgttaattttgtatggcgttatcaaatttaaatagtgaaattttttctcatattttaataattattttaatgaacattttatttaaaattgaaccttccatatcttatgtggattagtctaatccaacgtcaataagacgttaattacattctcagtaaaattttagaaacaagattgaagttgtctcatatatatatatatattatgtaactacttatcgacaactccctttttttattattaatccatactctcatttttttatacaaaaaaaaacataaaacaaacatttacttaaaaatgttaaaagttgttaaagagatgtagtgaaaaaaaccaatccaaatacaaccgacaattagttttttaaatatagaagtttcctatttataattaatgtgtcaactatttttttttttaatggaaagaagcagccaaagccgccatgtatcaacttataatttagagttgttttctcttgtcctttcgatacctcatctgttgtttaccacaacatataatagttagacttttataattatatggtcactaggatatacatatagtcac

SEQ ID NO: 2470 - DNA, 1199 bp, Glycine max
  Soy_ogl_4189 Gm13:21701202..21702400 Cluster 9
aatgaaaacatttaaatgaaaggtagaaattaacatatgtaacaatattagtaaattaggcacaagactataatatttttcaatattttgcgtaaaataatatttttcaaaaatcatgttagtaaatacggtacaagtgtacaagagaaaaacaagctttttctatttttaaatgaaatactaagataaaaaaatatataatatacttaattgtcttcttattttatattttctaaataactttatggtaatagtttaatacttcattataaattaattagcttatatttttgttctcaaccatttaaaaaaaagtacttttaaaatttattatattaaataaaaatatttgttgttgaatattatttttctctttttcataattttgcattaggacttaaaacaagattaaataaatattctcagtaaagttttaaaattaattttaaaagcatttttcaaaaagatagttgtaattgcagttttttaaaattcattcaaaatacttatcaaaataatcagaaatatattcagatttcattttaaaaaaacaaaacactaaattttttcgaaagcatttttaaaaaaataatttttattaaaaaaattaaaacaaaggaagggggcattatatcttttttttattacactccaatgacaattataccttaccaattaaagaaaatcaaaattttcaaatcacttttacaaaatcatatgtaaacgcatgttaattttcttaaaattagttctttggcataattaaaataagacttaaatatatttttaatatttaaatttagataattattttttcagtccttcaaaaaaaatgtttttattagttctcaatttttttaaaagtgacttttttcattagttaacgtttcaaaaatttaagagactgataaaaacatgttttattttgaaggattaaaaaaaataattatcaaaatttaaagaactaaaaacatatttaatctttaaaacaaacaccctacatcaattttattgactcgatgcaatttacactttttgatttgttttcacatgttacatgttgagcccatttttacaactctattcctatgcatttaacgaggtgatttgtttctgttcagcgtaactaccaaagagtaggacaaaggcttgggggtccaggagtaaatagaaacttgaaagtaaatcatcaaacttca

SEQ ID NO: 2471 - DNA, 1200 bp, Glycine max
  Soy_ogl_5408 Gm16:32162701..32163900 Cluster 9
ttttttctattaaatgtgatggtaaatattgttgagtattaagtatcactaaaagcaatatctatgcttgaacgacacgaattggattgtattgatgttatactgaatgctttctcattgacttttgggaaatgcactaattattgtcacgtgtttgcctgcgatgttagttcagctgggatatcttgtgtatattccttatgaaactatcaaatagggttcaccagaataaagacattttaaaatgcacatgtttttttttaatgcaaatgttatatagtccacatatatatctactttgcattgcattctatctaatttatggcattactattatataaaacagtcttattaatacatgtccgttagtgaatataatggaaaaaatcaatatattgaggaagggagacttctgttaagggttgaataaataaatatattaacgtaggtgttatcttttattaacgacaatctaaaatactattaattaaagataaaattatttaacaatatatttaatttttattaataaaacatttgaattcattgagaaaatttcatccttttatatcaacttatttatatctactacgaaaaaaattcaacatttaatatggaaaatataaaatcttttatatagaactttttataaaataaaatttaaaagtttaatttatttatataaaaagctgtatttgattgattggatgatttcttaaatttaaaatatatttattaagcctttattagtagtttagaaaatactgttactaaaggatttttataaaaattgtaaaaaataaaataaattagtttcataaatatacttgaataataaataaaattaaaaaagattattttggcttcttgaatatatatatacaaaaatattttgttgttaaatgattttgtaaaaaatagaaaataaatttttataaaaagtaaacttagtatttatttaaattaacttacccatttttagtatttttgaattaaaaatttataaaatataataacttagtttatacatctaattatggaaataaaatttaatattcctaaaatagtggcccatgctttacatattttttgaaaaaaaggagtgagaatgaaaaagaatatgaagttaaaaaagaactcgaagcattgtctagttggcatacgttgtgatgactgtttttatatagttatagattatat

SEQ ID NO: 2472 - DNA, 1200 bp, Glycine max
  Soy_ogl_3251 Gm09:40980201..40981400 Cluster 9
ttgaactaacccaaccttcatataagacggctaaaatggtttggaccaactcaaaaaccctttaggtgaaacatacgtcccaaaggcttgtcttccatgcaagtgaaaaccatgttcaataaatttagggagataaatgatgtgatcataattaaaatggttaggtttgaatatcattttcagaaattgaaggttgacttacagttcacagacatatctagtagctaggaataaacatggaacaagggtttgattttgaattcagaatcgttgagacttgagggaaataataattaaagattaaataaaaaaatatttattttttggattatacttttagaaataagagcacaaagaaaacatgggactttttttttttttgtaaaggcatagaaagtaagtttgatgcaattgatgtaagtgttgggattaggcttcattcaatttcaactagaattcctaatgtacttaaatattggtttattaggcaattaaacctatattcttaatggagaactccttctttagattaaagtaaaaaaaataatactagtaaacattaggattggaaatccctaatgatagtaagaatccaataactatccttaccctaaaagattataggattcttgtcttaaagcacacatatagagcaaaatttcattaaagattaaaaaaccgtcacaacataaggttgataaagttttatgaaataataagcccaaacacacagggatatggaaattaaactttattaataatcgacctaaatcaattcataaataataaatttcattataattcacttaactttggcaaaaagagatttagttagacatagatgatagataggataaacaaaaacaaaaaataattccataagtcacaaactctaagatatatccaaaaatgcaaaccgtgatgactggatttttttttcttgttacaaaatatccctataaaattttcttcacctcttttatatgggtttgagacggccacttattatataggagggagatgccaagcatcttcaaccagtatatatatatatatatattatattttcttgactgatagttagttaatatataacaaacgtagtatttttttaaagtatgcatggtaatacatatagcccactagtcaacggtttagaaatgagaatcccctctatttagaaatctaataccgcgtgga

SEQ ID NO: 2473 - DNA, 1200 bp, Glycine max
  Soy_ogl_328 Gm02:2602801..2604000 Cluster 9
tggacgagatctatatcagatttctggctggctgttagcattccttattccaaggtacagcttgagtttttttatgaaattcacttttctttttttttttttctaaaaaaagttgggtaacgtcataaagataaaggaggtgatggtctcccacatttagtaagcccatggcgcctcaattatgggtgaagcttgtttaattaatatttaggtccaatttagattaaaaatcataattatttataagagaaaaaattaagaagataaattaatgtctccaaattaaaattaacttgtgcattttcaagttttagaaaagttaatttttttataaaagtaattttaacttagtaaaaagctcaatcatcttatatttttattttttttttcctcctataaatatttatatatttttttatccaaacaagactttaaaccattaaatatatgatgaaattatatgaatatttatgttatgtcttaaaactagctagcataacatcagtcgtccttgttcaagaaccatttttaactcttgctcatactaaaagataaaaacttagcttcatcattaagaaaagcttcccttccaaattcaccctttccaaaagggttaaatatatcttatgatcatattttaattttgatatatgtataaaagtttttctttggtttttcatatctttctaaaatttaaaattgatatttttcgttcttattattataggacataggatgtcggttaattactcatgtgttcgatagaaagtcatgtaaccattctaatgcatttgtggtggcatgttaacatgtagttcctaaaattctttttgaggcccaagatatcattttatctaacgaaaaataaatgctagaattaaaaaaaaaaaatattttaatttttgaaagaaaagaaatcaaacaacttcacttataatttatatgttccacggttcatgagaagaataagaaagaaagaaggtcatgcaacgtgaattttaagtccagttcatttgacatctacagttaggctgctaattaccaatccaaaggtgaaatctcttaaaaaaaaaggggggggccaaatttgaagtgacaacaatacaacattgtcatcccttgagacatgcatatgtagttggacgacgaagttggattcttaaagattcattgtacactggaattgaaaaaaaaaattac

SEQ ID NO: 2474 - DNA, 1435 bp, Glycine max
  Soy_ogl_5968 Gm18:6648566..6650000 Cluster 9
aaaaaaaaggtcaaataaaactttatttaaattgattattaagtggtttatatatgtccaaaaatgacttaaccacttaaatatgtttttatcactcaaatttatatcatgttttttagtctcttgatttttttctagtccttttaattttgaaaaatatttttttaatctcttgtgtagtaaaaaatcgtcaagaattgcatactgaaatcgctaaaattagttaagagggactaaaaaggatcgatgtgtatagaaattgagggaaaaaaataaatttacatataagaaacaaaaaaaaaatctaaatttaagagagaaaaaacatataatcctgacaaaaactatgaagttcaaaatttgtttgacatgtgaatacgactatcatgttttgtatatacgagtgagagagtattatttttgtgtgcactagtagtttgagaattacttttgtcagtttgtgtgcaagagagtctcaaataaaacctttttagttagggataataagaggaacattgattttatctatttagatattgaaaatcaaattttgaggattaataatgatcattttttttctaaatgaatgaaaaggttttttttcttctaactatctgaatactatttgtaagaataatgatgatcattattacatgtatgagactcaatttaattgaaacaataatattaatagttatcttcattctcaaatctgtattaataatgtcattttaggtgagttatttttatagttacattttttggaaggacaaaattgtagtgctgaaaggggtaagatggtaacttggtcatgaacagtgtgtatttcccggcttttttttctcatttgagcgacgaattactctgatgggacccatccaaaattgcaaacatttcattccaattttgacttttgagccttcctgactgccaaaattcatggaagtgcgtgcatttcctccctttctcttctttctaacacgattacattgattctaacattttttattgaagcaattaataaaattaattaacttatttgagttaattgtcgatttgtttgattaatttttttgcaacaattatttgcataaattattgacaaaataatttgggattcggctcctctaaattaaattgccacatcaaatttgtatttttaacaaaataaaaatattcaattaaattataaaatataattaaaaacaaattattcctgtttccacgtagtaatcttcacttccgcagaagaaaaaacctaatccaaatattgttgctgcattgttattctcacacttggtgtggcttttcgtaaaaattcttaatccgcatgttgatcgtgatttctcgctcactatttctcatatcaattgccttttttctgatttgttctgataaaatgggtatgttaacagcaaatcatgtgtaaatttac

SEQ ID NO: 2475 - DNA, 1268 bp, Glycine max
  Soy_ogl_540 Gm02:14167733..14169000 Cluster 9
atattgctaatggattgtttggtttagttagaaaacaaatgataggaggaaaaaaaaaaaccatttcattgatattttcgaaaaccacaacttgttgcttttcataaaggtggcactctcagacaacatgattgtaaaggaaccaaatagggtttagcgaaaaatgttagtgcgatgcacgtgcttcactgattctgaatttattcaatataaataaatataaaaaaaatactccatatagtttaactgcctaagtaattacatatatcctatgtcattatatttattatattgaataatctatgtttccagtaaaaaaatatcatattgaaaatattactcgaacaggggatgcaattacatatatatatacttgattcttccttcttctcttcaattgcaattttgcaaggaacaatttaaaaaatttatgaatgatgaatgcgtgaccctttcttatgaatttgaaatagaaataaaaatttataagttgtcattcacgtgtttacgtggatttatgcatatattattaatttataatttataacgaaaggaatgcagtaagtatttttttttcataacaaaagaaaatagcattacttaaagtggtaaaaagaaaaataagacacacaataaataatcttcacataaaaatttctaaaagcattctaaatattaaaatattccgttagctcatgccctacgagagtgtcgcaaagctagcctatattaggtcaccgacggtgcactaaaataaactagcaataaggtccttataatgtaagtaaaaacaaataaataaatcaaacaaacagcaacatattattctaaaatagtaaataaaacataatctaaaatacttcaaaaaggagactaatcttgataatttattaattcctctaaattcaaacaattatttttccacttgatacactttcatgatgccacatcttgcttgaaaattgagtaagaaacaaataaatattcaatttccatgccaatgttttaacgtgcaggcacgtgccttagtcacctggaaattttcttcttgttataaatgttgaatattaattttttttaaaataaattttctcaactgcgaaaaaaaatcatataattaatacattattattatttttttaaaaaatatagtaattaagattcagattctaattgtgtgtataaaaaagttaccacgagagataaaatttatttcaatatattttacaattcaaaagacagacgtttgtgggaaaaaatatccaagt

SEQ ID NO: 2476 - DNA, 1220 bp, Glycine max
  Soy_ogl_2719 Gm08:15920601..15921820 Cluster 9
tcatctctaattaattcaaatttattgaaaattataaaataataaatatgacatgaaaccttcaattttttattttattttcaagtaataaaaaatgatgtgtttgaaagtgtattcttagccttttgctgtatttcttctataatgataaccttgcgaaaacattgactaattaacatgtttagttttaataaaagtacacataatatcttaacaatataatttgcatggattatttataataaatcataaacaggtaaaaaaaatttaacatgtttttatatatttaaaatatctttttatatttaaataatcttatgcaatacacagatattacatatagtatcaagctaaagggttaatttgtttaaattatttgttaaaaaaaacatttttccaacaaaatgaacagttttatgcctttttgacaagtttgtttaaactatttaaaaaaacagttttatgcttttttaaataagtaaattctatctattttttaaaataactatttttttttaaaatgctttttctataagcattttttaaaattttaaacaaatggatccaaaatccactttatagtttctataatttgcaactgtgtaattttaatttcaaacagttttttacttttgactttttttatggaacaatcttggttagaggtcaacacaactatctaatgactccatcaatacatgttttaaaatttaaaagcacaaacatttttagtataaactcaagtgaaactctaaaagggttgacattgtccaactcggatgtaccaagtttgatgttcatcacttctaaatgcatgaattttttcaagataagagttacaagaagatgaaaaatattgtatgaaaagttgtttcgaactttcgattcttcatgacaattattataactcctaagttggcttcattcattttttacaattatgtacccgatgggtattacggtaatgtgtaatactatctcaataacccgatactgtgataaaatcaccctgctacacaaatatacagttggccttaaccctattgcctaagagtgtaaaaatatgttaatatttacttggtttgataaatttaaaaattctatgtacaaaaaaaaatgatatatactccatcttatttttcccatgaactaatatgcatcatttgtcaattcaaattcaactcatttaaaatgtaactaataaaattcaaataacaacc

SEQ ID NO: 2477 - DNA, 1213 bp, Glycine max
  Soy_ogl_5369 Gm16:29577288..29578500 Cluster 9
gcagctgcatctctctttgaaccgcttgaaccaaacacacgtttaatgaaggttaatttaggagaaaaagttattttctaaatcagattgacataattaaatgatgtttaactatctttttttaataaatgtaaaaataattttattttatttttgcttatacttagaaattgaaaggagtaagaaatttacactaaatattgacatgagtcttgctaatcagtgtttaagtgtactgattaagggatcaatatatttttttatattaaaattcctactagattacataaaatatcttagtgaaagtatattaataatattttcaatttcttaatcaggccattgattagcatttgtttaattattactctctttagtccaaataatactcccttcatttctttaagtttcagaatttttaaatctttttgtttatgtgatctgtgatttgcaaagtttaagatcatattaattacttctttattaattatatccttacttgttttttaatatttaattatttgacaagtgcatttattgtggaataaaaataaaaggaggtaaaacagaaaatcccatgactattttactaaaattaagaaatttattattttcctcagtttttacgtaacaaacttaaaccacatataaaaaggaatgaagggagtaatcttttaagattatacacattgattaagaaacattcaattaatacacatttatacaaaagtacctttagttttcaactactcttgttattaattgtccactgtccaccaaccaatgacaaatacatttttatcctccaccaacttatttctatgacaaatatctctttccaatacaaatatttatttatcttcttaattacatttagggatactgtttgaaaaaatagctcaaaaaatctaattaaaaatatcattattttgaaaaaaaaataaaacgtaaaaaaaaattattacattgaaaaaaaagaaaaaggtaaaaagattattattttgaaatggatggagtattagtaatgatagatgaaagttgactcgtaccaaattgaagggttaaattacaatgactaaaaattgaagtttatacttaaagagaaaaacttttttatgcataaattaaagaacaaaatttagaccaaattctttatagctcatgaattatgatgatgttttataatgaaaatgtattatgcatattacttttt

SEQ ID NO: 2478 - DNA, 1100 bp, Glycine max
  Soy_ogl_2583 Gm08:9794301..9795400 Cluster 9
gctagtaataattaggaaaagattaactataatcccgtaacaaaatctttgcctgctaaatgttgagatatatatggtaggatttgactttagatcatcatgttcattgcaaacactatactaagtaaactatttgacgcactcgaacgaaattgaaagcctagctagttaattaacatcctaatccttggggctaaaatactaaactatgttcatttgtttcgtggttgatttaaacaagttaatttacttttctgtttggattttccagcattacattactaaagtttgattacgagaaataaattatggcctttaaaaacaggaggttattaagttattaaaggtgggatagttataaaaaaaaattaaaatatatttataatgtagtttttcactatactccatagttttggagaagcatcccctttattatttctatgttaaagtgcattggaattcccactatgtgtagttttcaatatataggaatctaacatattcttaattattgattgctatatgcattataagatttttttttttaactcactatgcattaaaagattattagctcttgtaatcttataatgtaatatctatttaaaagtcatatattagatatttctaattgattgataatggaatatattataacaaccatgcatccaataaccattttgttcagtcacgtattgattgtggttgcatttgaaaaaatagagcccacacaccctttgcttcaatattttagtgttttagactctattttattaaacgcacgatatttttaatttttttcttcatctatctatggagagtgtgggtgctgttgaaatttatcaaaaaatttaactcaattgattgaataatatgtgtgagtattataaatcattttatattgtatttaatttttaaagataaaaaatatatattaaaattaatctctacaaaactatcttaattatgaatgaacaattaaagaaaattataataattttattatatgtatgcaatattaaaacttgatatttttttttaaattataaacatgcattcaatttctcttccatttcattcccgcaccattttttcccata

SEQ ID NO: 2479 - DNA, 1246 bp, Glycine max
  Soy_ogl_3366 Gm10:4736555..4737800 Cluster 9
cagacacattttaataattatatagtattatatattcatatttattgttttagattttttttttaatttattctttttatatataaaaaataaacttgaaaatgaaaaataaatagactttgcacgaattgcacgaaaaaaaaaatacttgtaatcttttaaaacgagcaacaactcattgacggaaatcaaggatagttatatcttaaaatttgatcaatcaaaacaattcgatcctctgtttttgtattgctacttttcgtaaactttagcattttccttcaagtaaagaacatgtaaaagatagaactgcaatgaggcaacatttattcatataaatagagaccatatattgtgtaaatgaaagtctagctagaaaggaaactgtatttgttaaaaaaaggaaaatgtaaaatgtttataatataatatttatatttatctgtccatttctatatatgaaatttgtttgccgaaatgcttgaaatagaattcttataataatatcaagggagtttagtcgaattcaactcctacggataaaaaataaagcatttaatgtcttaaaaaaattaaattattcttatacaaagaaaatacaagaattaataagaagatatattctaggaggatttagaattagtcttaaaaaattacattggtttgataaatttaaaagcaaattaattatctgagtttagtgaaaaaaactgtaaaaagtgatgggctctataatgccataaaatttaaaaatggaatcaaatactatacaactttatatatcaacctaaaagaaaaaagataatcacaaacctgaagccataaaagtactcaaagatcatcggatttaatttaattgattgagtacgatgtaggttataaatctcttcatattatatttaatttctacaaataaaaaaagtattcaaagatcacaaaaactactggattaataacatatatatgtaccaagtaaaattaattaataaaagggtacggatggtcattggtataccggtttgcacaatgacaagaaattccaatttatcatcaataacgactgaccttgttaaccttctatgattctatgctcctgttcacatacattctaccgaggtaattaaaagaccaaggtgctttatccttaatcgatttcactactcaaaagaaagaaggtcaaggattcaaagggtgcatagtaatgtctcctaaacaaacttattaaactcggtaccgtcactgatcc

SEQ ID NO: 2480 - DNA, 1263 bp, Glycine max
  Soy_ogl_621 Gm02:43074138..43075400 Cluster 9
ttttaaaagtcatgttaataattatttttagttatttaattgtgtaaaaaatgacactaataacatatgtctattaaacctttttaacatcccatcatcaaagaagaataaaggaattttgctaaaaacctggaagataaaaagctccagagcttttcagattcggatatattttccactctactctaatctttctatgattctcttggaaaaaaggagtatatattaacggtctaaaaagttttacatacttatataattataattttattatatatgataagtttattaatttttaaaataatctaaacaaaaatttataattaaaaaataatgtcaattaaattatgttagtgcataaacatttggttctcttaccttgaaataaattcatttatggttaatatcatttttttaaggcaaaagatattttattgatatcctcacctaattagtttagcacaagtggtgcccaactaagccaaaatttatgatggttatcattaatatgatttctccctttcatttccaacacaacattataaagacataatagaatactagtacttttaatttagaggatgtttttgagtgtcacattgaacgaaatgaagtttaatgtggtatttaaataagctagtaattgatccagtttaaaattttgttagcctgggctaacctatgatgcggggtctgattaacttggaattggaaaattaaaaaatataaaataaaataaaattatacattaccttttttaaaatgtatttcacttttaacttaaccaatatttcgtatgatgaacttatatactaaaagtttttttcttgtctctacaattatgataattttgttaataacttatttatttaacgaaagaaaggtgaagtgacaatctcagataatatttaattattagttttgtgatatgatgtcatcatctgatttatttttttaaaaaaaaattttttagatccatgaaataagtattatttatcaatcttaaattgaactttagagatcaaacataataattttaaattttggaggattaaaatttatatttcatatgttaaatattcgtgtagtgaatttacggctagagatagtacattcttgggataaaagaacatcctttacagggattaaaaccaaaatttcctcattttataaggattaaaatcaataattttaaatattagtgagataaaaaaacaaagaaaaaaattatagggaccaaaattaaaacatgtccattttttt

SEQ ID NO: 2481 - DNA, 1600 bp, Glycine max
  Soy_ogl_937 Gm03:37707001..37708600 Cluster 10
tatgtagaatttctttttttcgtttgagttggcaggtgtttattctactgaagttgacgccgccaaagcccatgatttagtgtcggtgaagattgggggcttaaaagcattaacgaattttcctgtatgtcatcgtagatagatttatgaatgttattgcaaaatcattttgtggcggattttgatttaattattattaattacttgaattccatttcataaacataccattattcgtaggtgagacgcaatttggacgaaatgcaatggatgagcacaacggaatttatattctgctgttagatggtaagatgtgaattgtgtgtatatgtgtgttttttttttagagggtgtgtatatgtgttatatgtgcaccatgtgtttacatgtttattaaaatggtgtgtatgtgtgtttacatgtatatcttacaccaaatgcgaagttgcattaagttacattattaatcatgtgttagttgcatataatacttaacaaaatatgagtgatgtgtaacatgtacttggtaaataaaattgatcaacatgacttatttggtgagttatatattaaagaaaaagttctataaaatttaaattatatataatttatataacttcaatttaaaactttttttgacagtatttcttatttttcaaatcacctatgtaaaatcggttcttatcaaagtaagattttaaattgttcttgtgatgtttaacattataggaaattaataaccattttttaaaaatgttcaaccattggtaggatgttcgtaattaagaatttaagataaagaaagtcattgattccataaaaacttgacaaaatttcaggacgggaaaggactatagtgacggtgagtgtgactccccttaccgtggcgtctacaggtttgcattttccctttctttctctctttcattagtttattttattatgcttctctctctctcattcctatcagatcaatcagggtcccaataagcaagaaatgggaagcgaggctgggtcgtgagggatcactaaacatgcactcgggaacttattgtgagttcatattctaacccttccaattcatttctaatttatgcctccacactgtgaatagtagttaagcatcaacgtgtatgtttttttatctgataaatattaattattagaatgtcaattttattaacataagagattaaatttgtgattttttttccttaaatcatccaatctattttatattttcacatcaacatgtatgtataatgtatctcaagtgtatgttagttacttagttattaatgtacataatcaatagacaatgtttgcacattgcagtaaatatatcatatttgtctaagtttataatgtaagacatatatatgtttgtctacttcaacaacaacaactacaaccagtttctgtctcagggttctaaccgtcctgtgcttgctcatggtacccaaaatcttaatttggataattgagtcagtttccctgattgtccatctggttttggagaaaatttgctaggggggaacttggaattggaaccttcgagaaatattaatgtacaacctctagcacaagtcacggtgaatga

SEQ ID NO: 2482 - DNA, 1700 bp, Glycine max
  Soy_ogl_1844 Gm06:8078001..8079700 Cluster 10
aatcagttattattttaatatattttaatttttattaattgtatatgtaaatgctgtactcacctcttaattatctcatgctgctaaggagaaagttgacaacgaaataaaaacacagtttagtttagttgggcatcgtttttttgtgtggatattttgcggatagagatgtaggtaataaaggaaacacgcgtcccatatggagcagtaaatgcgaggagataaacaagacaatgttgtgaggcctatgtctatgttaatctttctaactcgagaagaaaacagtgagaagtgagaaaattgctatagtgactcttaattatccttattgagaggagaattttaatttttatctttttaggggatatcttttctttttattaataaagcgaataagttctgcattctaaaattcccgcctattttgcatgtcattgtcccgctaattttgcatgtatatgttcacgtacattaagtctttatttaacgtgggaagatattgtcagattttttttcacattaattactatactctttgaatcatccacctacctattatcaaaagaatttttccccattaataacgaaactgtttcaattctccaataataacggtgcacgcgctttgcactttaatgctggttatgatatcaaaatttaaagtcttaataaacgtgctaaaccaaccaaaactggtacattatccctctgtatggaataccgggatgtccaattaatcttttaatgtcgggagtttacaaattataatcacagtcgtaagactcattaaatcccaccattaatattttattattgggagtttacaaatgataaacacaaatgaaaagctcattagctcccacaattatataaagaaccaacttcctttttatatcacattcatcttgcctttggttaaaagacaaataaattcatacgtagttccttgctcattacaatggcgaattgaatcgggttacacaatagaacaattaatcccagccaatggatcaaatatagtgggtaagcttttgacattcaaattaaagaagaatggttctgtgtcccgaaaaaaaactgtagaattgttcttaaactattgatttgcctttataaagatgagtttcgttgtgttgcgaaaagatgtactatgtagtcttttttcttattattgatatagattcttttttcttcaatattcttattcattatcgtatttttactattttttttcttcttcctttgaaacatttgtcatcctaacttaatttacacaataaaaaatgtactgttgtaggttaattgcaacaaaggataaaacaagcaaaacaattttgacagtggaaaagcttcaaaggagagagttgttgcatcagtttttttaagcttcttattctggcacaaatgtactgttttatgtcaagcttcttattttatcactctatttttatgaaattatctgcaagtgatgtttctgcatcagttttgttatgaaatactatgttatctttgtttttttttttatgtgatcttttgaaaatacaaatatcatctaagcttactaatatatgttttctgctttgaatgcaaacaacgtttgcattccctattttgtcaaatagctttaccctcaaaattaaacaacgatgtttcattttgtcgatgagaaggatagaaaatgtcaaaatggtcttacaatt

SEQ ID NO: 2483 - DNA, 1407 bp, Glycine max
  Soy_ogl_3187 Gm09:39093601..39095007 Cluster 10
tcaagaaataaaacttaaaagtccttggtagaatcatacacaccttattaaatagaacatcttggggttcttcatataatacaaccagctatatataaactacttatactactgtgctactatatatgaacaaagtagtgcgacacagtggccgcattagcctcttcatcgtccctgctatttttcttcgactccacgacaacaattggcattcccatacgtacgtcaacggtcctggttgcctttggcgacgagatagcatcaaaataataggtaactaaactaggtttggtggtcttctcagtagagcatggttgggatgttcatatgggaaaactataaatacacatattccagcttaatctttgcactctcaccgcaagggaagcgtttttcttccgcacataatttaattatgtagcatataattctccgtcatatttttcaaaccacttttctctcgctagtgccgttgctttaatttggcttaatgattcttgattctttttccccttgtaactcattagtattgattggattcatttaagtggccttaagtacaggaaacttgccgataataagcacctgagagttgagttttttcattttgtgggggatgttttgggctttggaagttacgtaaatgctgactgaaggaaaaaaaaaatactatcaagtacagtaaaatgaagaaatcctaaagtttgacattattttgaattattggtggaatgaaatgaaacttaattgattgagtctatcatccatcccatttcacgtattacaattacttctttctttagtttatatgattaagaacggtttttacatgtgttatccttctcattctcttccaacgatgaactcaggtttttaactttaagaaccagaaatgctcttactactaatgttaatttatttaaattatgaatggattacagaattatctttgcactgagtgcaaggttaatcgttactcacccacaacttaatttaattacatagcatctaattctctatatatcaaattttccaaaccacttttctctatcttcatgttctcgtgtcattgctttttgtcgtttgattcttggttcttccatatttaaatggccttaagtacatgaaactatcctatgatataagcatctgcaaatttgatattaattatatatttgtcaacctattgaaattcacttcagatataatttttagaattatatataaaaatatatatattcaacaatcttatcacgtgtaattcatgattaaagtatgatataaaaatgtttacactctcagtacattctaattaaattattctttttatatgtaggatgagtgtttttttaattaacaatgtaaaacttgtgatagaaaacattaaacatttaattgctaaaaaac

SEQ ID NO: 2484 - DNA, 1368 bp, Glycine max
  Soy_ogl_216 Gm01:48955633..48957000 Cluster 10
tctaaactttatagagctgcgtcaactcattagattataatacaaaaaaaagcacatcctatcaaaggaataagccattaaaaaatatcatatttttaaataaataaaaaacgataatgatggtggagaaaaggcaaatttgcatatacttgaagtcaagtaaaaaaatatcaaacaataactgcacacaaaaaaccgagaagcaaatgttaagagtttcattctatgtacgtatattagttagatgtgttgttaagacttccatgtgtacaagctataattaatatacataaatgtcagaataattaactctgacaagatgactcacatgaaagaagacataacaacaaatctaatacaaaattaacttgttattttacagtagcattaaagtaagttatacaaagatgtgtattatgtatatatagtttaattaatcataaaatatcaccatgcatgagtcaattaaattaattttttttaattcaaacttgaggatcttataataaattttatattttattttgattttcaatttaatgttttattaaaagataacgttattcctaatctcgtagctttagtgagtcccctcactcactattacctctcgccaccaaccatagtccacgatgacaaaaaattgttaaactgcaaaattgtctttcatggatttgctgcgcccacaaccctatcttccttcaccatttgccgcaatgaaacaccagcgcccaaaccccaaccatggcaccctcatcgctttctatctgctccgcaacatcatggagaatgtggtagatgacgatggtgttaaggcagcggagtttctgcttaaggagcgccgaaagggatgagggtgaacaaaggggggtgttagggttcggtggcaaggcaacaatgagtgagaggacccacgaaggctacgatatttatatgactgaaattataatattgtttccctcactatatataatgtttagagaagaaaaagttagaaagaaaatacaaaaacaggcaaaattttcatgttaccttttgcatggcatgggttaattaccatctagttcttgagtcaattatgtgacaatcatttcatattgttgcattgtaataagattgttcgtctgtttagtgactatgttatcaaaattacacaatgtgttcttggttttttggttgtattattgtcatgaatttcattaggttgtaattaatgtgtgaatttttaaatttttttatagtaacatacactaattattttttaaattttgtaaaattgtacaaattcttcttatttttttaacatcccctgcactaatcctccttattttttaaaatatacacaaacatgacgagtgccactgtagg

SEQ ID NO: 2485 - DNA, 1100 bp, Glycine max
  Soy_ogl_1106 Gm03:45867001..45868100 Cluster 10
atgtcattcataagggacaaggctggtactagacctgctggctgcgtgtgtgtttcgtcattcttggggctacaacaaaatctaaatccttgaaattaaatttgtttccgtcccatatacgtagccggatattgacaatttttttctctcgttgttgtctttagcaacataagtagattagtgaattcatcaaaccactcatcaaattcggtcttcgatcaactttacctatacgcgctgagacttgactttaatcaactaagtcggtcactttgattatcttaccgaatcccttttttcgagatgcggagaatggatttgatatattgttagtttaagaataacgcatattacattactcatactaagttttgattatttttcaaataagtataattatattatgcataacaaaaaataacttcttaatgaagccatggttttagcattagaactggccaacatgcataagacgtctatatctatatacgtaaacctaactggttgcgccttaccaatataattaagatataatgattataataagtaattaatcttaattattaaatctcaaaaaaataaatgataaaaaatgaaaaataagtctaaaagtgttacttttcgactaagtgaatccatcttcttaatttatattgcatgtccactctatatatacatactccatgctcttaattttcttcatacacgataaattattacattttacaatgtaatgtcactatcaggaacgttgcaagcgggtgccgaccggaggtctgggcagctggtccacggtggtttaggcgctgttggtttggcagtttcccgcaacaatgagatgttgaagaagcgaaaagaagaagaaaattgacctgttagtaattagatgatagtgtgattttatttataaatatatattattgatcttatttgtataataaaaaaataatggtcagataatgctataagatattagaaaaataatgactgtatgacgttactttttttttttttggttttaaaaaaactctctatttaagcaaaaaaataaaaattgtacatgtgtaaatattctcttcattattgcgggtttgacttct

SEQ ID NO: 2486 - DNA, 1110 bp, Glycine max
  Soy_ogl_2622 Gm08:11926891..11928000 Cluster 10
ctgcaatatctcatgaaatataatctttatctataatcttaaaagataaatgattcaaaacggtaaagaaacacggctacttgaatgatgaaaaagaaacatgacatatcgtaaccccatagctacgcgcaataataaaggcatagacgactttgtgctgcaaagcaaaaaagcaatagagattacagagagaataaaaactgaaacggtccgcagcagcaccatgaactgaagggaatggatcagagccagaggctttgggcaatccccaaatgcccggcatgtaagcttgtcaaccttttcattatgtctaaatttatgagattttaaaaaatttgaccctgaactttttatttcgcgaacaccctattttttttttaaaaaaaatgtgctaatccagcttaaagatataggcacataatttttttcctttttgaaggaacggttatcttcaacataaatttttccttttgattatgtctaaatttataagattttttaaaaaattgaccgtgaactttttattttgctaacacttttttttttttaatgtgctaatccaacttaaagatataggcacatagttttttcctttttgaaggaacggttatattcaacaaaaatagtaatcaataccataaatagaacgttgcaacttgcaagttccagcgttaaaattcttgtattgaacgttgcaagctccaacgttaaattcgctaaaaatctacgttagtatttataaaaagaatagggtggggtagttttggaaaacaaatgaagtaagtggggatagttttggaaaaatagtttaaatgattaattgaaaaagaacaatatttcttaattgattgggtaaaaaaaatgaatgacaggtgggtctcccaataatcgtgtgagaaaaatattgtatatacacaattaaatgattaaacgtagaggattaaaccaaaatgttaatgagtaggaaatcaaaaaacgcctatatatagacaattgaatgattttaaaaaacgtctctcccaccaattaaaaaattaataaaaaatttctgtttcctttttaatgcatatgattttcgtttaccttctcattatccctgtcactataaat

SEQ ID NO: 2487 - DNA, 1200 bp, Glycine max
  Soy_ogl_5281 Gm16:4051701..4052900 Cluster 10
accttttccttgaagtcgagatccttgccaattcgaaggagatctaagttctggtcaagatggaagacataaactcgacttccagtgctgcagcatcaatgatgacagcgtaagaggtagtaatggcttttggtttagggaatattatcttttgatgagttagtattttgttccaaagatattgcgatcgaggaagagattgcaggcattagcaagagtagaaaaatgcttagagttgaagactccattcttaaatggctctgaactcacatgttgagcaagtccgatccctagctcatatacatagttgaagaatgtaagggtgcttcactttttcttttccttttttttttttacttagggttagcaccaatatcactgtttttggcccgacagggtgccggcaacgatcataatctcttgttttattgtgttataatttcatgagaaagattatcatattaattgatctctttaccaaaaaaagaatattaattgacttttacatgcgttcactgaagggcaacgtgacacacgattgtaacatttttttttatatatttttataatttattattgaaacaataggctatatacactaacttcttaaattgttgaaaacattaacacactaacactttccatatttatcctaaaagcattacacactgtaaaccataagaaagtgtgggaaaaaagaagaagaggatcgtgcatacgaagaaacttaattagagaagaattagtgtaatttggtcttaatataattttgtcatttagtcttacatttatctattacctattttattatttacttatttgtcttcttttctttattcgttctcataagtattattttaagctaaacatttttttatattgaaagctaaacataatttcaatacatgttgaaatcaatattcattataaattttacattaagcaagtgtttggtatgtgaaattagctgcgtgtaaaataaaccaagaatagttttttatccaatatagaaacaagtaaacaaagataaaaataaatagaaaatgtgatggcaataaaataaaaattattaagagtaaaaaaaatcactttttcaatatttatgcgttgatttatggcacattggattcccctacaatcactttctttcttttttggacaaccccaaaaatcacttacttttcaatatttttgcacttg

SEQ ID NO: 2488 - DNA, 1200 bp, Glycine max
  Soy_ogl_4431 Gm13:33565401..33566600 Cluster 10
ttattttttgttctctctctatttatcaatttagtcactaattttattacacatttttctcatttctttctttctatctaaacgttgttgtacaatgtacagaaacaatttctctttttggattacaagacagccatgatggtctgtacacaaagtacaggaggtacatgctatgcatgatgtgtgagttcatagtaatatgtgactctaacaaatccattcatttttatctttttagcataaacattgtgcacagggatgataaagaaaagaaatagaattattcgggcacccttggcttggacaaaagcgtgccttttacatatcaggggggaatagtaactagtcagtgttgccgagagcctaggaaggaaaaggacaaaaaacaaggaggcaaaaaagtaatttgagttgcagacatgaagatttccaagcaaaaacagtgagaggcactaacaaaataaaactaaccaacaacattgattgattcagtcggaataaacatttatattttaaaaaaacatgaatttgattttgctatgaaaacttattaattgataatttataagtatttttataaatatttttttaatcatgagatgtgactcaattacaatgaatcctaaggatttagttcaactaaaatttttatataaaaaaaaaaagtgaatctgaaatggagggagtgagatctttgtctgcacattgtttagggtgcattgctgtcagtttttgatgagtacagttggcttgagttgatgctttggtccccccaaggcctaagctttatctctctatctgtttgcagaattacagggttcccttctctttaacgtgcgcgttgggtttctttcatgcttgccaaattggaatctcttgtccgccggtgatgggtcccgaccgattagtgggtgtgggtagggaggacccacttccacctccatctctaactctctaaagttgattctgcatcttctcttgtcactcaaaaatttaacaatgccatgttataggaaaaccacaaaaaatagattaatagacctaatcaatcttgttacaactatattttgattttctcttccatgacacagtattatcatattcttttaagagtaaatagtacgtatactaaaagtgtaaaggatctatataatgctattaattaattactttcaaatctcataaaatcttgaataactc

SEQ ID NO: 2489 - DNA, 1029 bp, Glycine max
  Soy_ogl_5855 Gm18:1054072..1055100 Cluster 10
ttttctgcatgtatacatttcttatactcttgaaattgaaatagtagtattagttaaaaaatttaaaaaatatattaaaaacattattaattcagtttatttacagtatatttttaatacattctctgattccctcatctcacgtacatcgattaataagatccttcaccaaattcaatgcttaaactaaaaaggcaaaggtgattaaagagaacgtcccttaaaagaagtgccagatgattggatcccgaattaacgtgtctgacgggagccgcagttttctagtgtttggtaacgcacattttacattcgcgatttttttgggttttagtaataaaaaaaacttaattatataatttaatcctttaattttaactaaaaattcaattgaattttttaattaataaaaaattcaataaaatgatttaattatttaaaatatttcattctagtcccttaattatttacaagtttaattagattttttaattatttaaaatactaccatcatattttttatataataaaatataatttttttgattaaattttttaataattgagagatctaaatgaatattttaaaagtaattaaaggatctgattaaattttttaattctaattttgaggattgaagatggtttttttatcaaccattgaaatggagctggccacgtagtttcttctttcttgcaaaagcaagttgtctttcttttcttattttatttgcttaatttaaaaaaaaaaggaactgaaaaacgaaagaaataaaattttattgtgggctttggcatcggctcactgggaaagcccgctatcttctgatatccgttacaggaatgcacatggcgcggtgctaactttcgcgatcgtgcataaaataagtgatgcagatgttatattgtatatcttgaaccgattcatcatacacgtatacggagatgggaccccttcacaacgtccaaatattcccttgtggttttataccacataaaattatttttgttattttagtccccaaaacatta

SEQ ID NO: 2490 - DNA, 1315 bp, Glycine max
  Soy_ogl_72 Gm01:3084186..3085500 Cluster 10
taccatttagttcattaaatatgcaatatgagtggaaacaaattgagtcgtgctgggcactacaagtttgatttattatttataacactattatgcgtgaacctggcttagtttttagctttatcgattttattttgttatattttgtttatgcactgattgtcatcagaggatacgaaacttgattatgcgtgagccagacttaattttgtttatgttcctggaaggtcactttagcgtatctttggtgcttagtttctgaacatcacatcctaaatgtataaaaaaaccaaatatgctgaaagtctgtttggggcgcaaaacaatatgcttgactggtggattttgggtgtttgggtctatttgcaaggcacgaaacgatatgaagctctagtactatttttatgggtcaaaaattgatttgtggttcgtatgaaaaaaaaacgtttcaagtgttttacaaacaggccttctatgcttgaatttagttctgtattatcatagattataaaaaactaaaatgtaattttggtccttttaatctactcaatttgtaaatttggacttcttattataaaattgagatatttagttcctctaaaatagaaaattttggttcctttaaacttaattgggtgatttgtagtttttgttttgcgtagacttgaaaaaaaaattaccaaagccatgtgggtattgtgaacagaaccctaatgcctaaaccttcttcccctactctttcccgtccaaatccatcccgacctccacatgtagaggattcacttgtcggaatccacagggcaagagtttgccaccattgttgtggtcgactggaaaatcgttgtaacaggctgaatcctctacatttgcgggttcgatagtttgactgttcatgctgttaccgtgcaattagattgattattttcttctttgttgattttgggtttggttttgagattgattgttaaattgagtttaattccgttcaacttgagtcccaataatttgggctgaaaatacaaagttgtttcaatttgttacagtcagatgaagctctcccaaaacttcaattggggcgcatgataacagatcagtttgtgcagaataattgtattgggcaggaattattttcgatgcttaagcatgttgtaggggttaatagataagagattggggtataattgttggaattcaatgcatagtgggattggggtgggtttgtttgctgtgtgtattgttttcggagttgtaaagttgtgccttcaatcaaatgtatatgtggagttggctccttgtcatggattttactgtttcg

SEQ ID NO: 2491 - DNA, 1200 bp, Glycine max
  Soy_ogl_5799 Gm17:39743701..39744900 Cluster 10
tttagtttgatttaattcaattttcataaataatataaatcaaatcacacaacacttaattttttatttaattctaattaattttaaatcaaaattacaccaaaccgccaacaccccactttcccatatacatttttttaacagaattaaagtcaaacattattagcaggtacaatctcagttacttgggcccaaacaatacttacccacgtgaaagccgggagaactgagaatatataattagttagcttatccgaaacgtgatttacctttttcatacatacgagtaacttaagtatattccaacttctgctcagcagcacacgagggtgagatggcatgcatgttactaatttctaaagaaacgagtaaacattttaaattagagttggtaagatgggtcaccgtcatgattgattactaaagtccataccataggagttgattttacttgttaatacacaatataaaacagtaacctgcattttctattttgggtgccataataaaggagtagggacaaagtagtaaaattgcaacttgtcaaaagtaaggagtgccaacagcaaagaaggatgcgcaaaaaagaaagaaatatagattaaggtacaatacgggctgcatctaatgaattgctttctacacttttttgacaattcagaatcaggaatgtaaaaaggcaattaccaacgataccctatcatgattcatgcatgtggtgcgtgctatatatacgtttttttgggtctgcaaaattaactcatccctatgaattgttataaaatctttggacattagtcttggatttcatagataaaaaaacggaatatgcatgtatgcattcataacaatctcttgtttttagtggggtaagatggctgacatttgccgaatttgtaatcaactaaatttctttctattcttatatagccatcctcaacccagcgaggacccaatgaattcctgagaatccaataatcttgaccttctgttgttgtcactttgcttagctttgtgcgatgactactcgtctatagcttgctaaattatttgaccaccatatctgaagcctttatccatcatcatttgcagcatgcatatattcaaaaagacaaaaagaagaaaacaagtgaagatgggaagaaggacttgaatccaaacccataaaaaactcaaaatatatagtcaagaaaatatgta

SEQ ID NO: 2492 - DNA, 1600 bp, Glycine max
  Soy_ogl_5336 Gm16:7297901..7299500 Cluster 10
ggggtgcaggaagtaatatctcccaatttagatctaggactctaggcctaaagttcatgcattaaactaaaaaaaaacgtgatcagaaaatcaaaataaaacctcttcagctttagcttgattttctttattgattgcttacgtaaaaattagattaatgtaaatgaaccatatgtatgttgatgaatttcccaggaagcgatcgatcgaagagcctctcccttgtaacactccttatatgatccaataaataacacaacatgcattaaggttgtgccattttcctcccttgacgtaagttataataacactcttgaatgaataaataaataaataaaactctactattgagtcaagtttggatcgcaaaacacttttcctaggaaaattacttaatgcatttcattttttgtttgatgcacccctattggaaaaaataaagtacttggatggacttttttaccctttattaattctagtatgaggttcccaatgccaccacactgacacctcattctattctcctttcttaatctcgccaccatcctccataataaccctagcacggctgcacccagtctctcttcaatttgtttcgcgcacgcacctcaaaggccattggagtgtcacctaagttgatagtagagggccaccgtctccacaacctccccgtcgaagcaaccatggtaagtggttgtttggttagctatcaatgtttgtcatttatgatgttacaaattaagcattttgaaatgcaaatacatcatagattgatcaattcataatatatttttttgtattacagattgcacaatctaaatacaaaagaaatgcattacaaattaagcaatccgtaactatattgtagaggtgaacgagtaaagtcatacaaaaatctagggtgcagggagcttgtgcatatggtggagggaggtggcgacaattgcgtgtgcagatctaattggtgcggaggtgactacgacacacagttgatggtgtcgtagttgggtggcatgtgtggatctagggaaggaggtggcggcgcaatagggagggaagaggcggtgagtagtggtagtcgtgggtggtgagggttcatggaagagatggtgaaagaaaggaagctcaacttttgcttggaagaaatggtaaaatgggagaattagaaaatttggtatgcaccaagcaaaaaaaaagggatatgttaagtaatttttctcttccagtatgtggacaattctttaatacacctcattttttgcttggtgcatcccataattttcaaatatacccgttttaccctttttcttcctctttcccatcgcctccggtaattgtaccgatcaccattgctcacctcagaaccattgcaagccaagattatacgatccttccacaaccactccaccctagatccatgcccacaactgtgcgcaaccactcatcttgacttcactacaaaccaaaccacctctttctctatatatatatatattatggattgaacaatttgtaatacaaattaatcaatatgtcatattttttttatattatgaattgctcaatttataatacatatattttccagattgatcaatct

SEQ ID NO: 2493 - DNA, 1100 bp, Glycine max
  Soy_ogl_3157 Gm09:37667901..37669000 Cluster 10
ggaggcttttattaaatagactaacaactctagataatttatatataattttaaatatattataaaaacggggaagtagaataaattattgaaaaatagtaaaagttagtagtgaaaaaaattaactaaaaagttatctaaccaaaaaattaactaaaggctatgattgtttcaacctaaaaaaattttagacaattatagctaacggtaaatatattaaaaaaacaaacttgtaataaaaaaaaaaaaatcacttttgttgatgttctgttatcccagagaacaaaacacaagagacaaccacaaggtggggcctcatgaaggagatgaacagggtggtactactttgtcgacaagtccacttgagaaggtggaagcctttagagtggcgtctcccataaaagaacaaaagtttacctgaaagtaggttttttattgacgccacccaaatcttatgtatcaaaatcactcataggtaaatttttttgaaacccacccaaagtggtattttgtttaaaaaattccactatttttggtgaaaaagcagcacagtactagagagattgagagttgtgatatcaacacctggggtccatggcctcttgcgcttgtgaggagcaaccaggtgcccaaaaccaaaggcacgttgcaattcaaaattaacttcattggcctcatcccatccccaccagcaggtaaatgtatcatcacccaccgatttcagatctagcgttagatttgggagatgctgtaagtaaatactactagaagaatgaaaaagactgaataaaaaaagagagataatgaaatcagatggactaataatgaatcatttagggtgtattttggtttaaagaatggaaatagaatatttttttaaattaaagtaaaatataaaagttgtgtggattccaccaaaaaatatataatttatctttaaatatataaataggtttagcatatgaattaaagtttgtcaattttagtaaaatgaaatttatttaaataatactaataaaacataataaatattgctaattaatgaaaaatgaattttcaaaaaacaacccatatgaactaaaacttagcacattggactc

SEQ ID NO: 2494 - DNA, 2067 bp, Glycine max
  Soy_ogl_44 Gm01:2056801..2058867 Cluster 10
ttgtttttactcataagtcagcattccgtagtcaaaacaacaatgacttagggagaggtaatattcattttaactcttaaataagtaattcttaattaaaacaatactgattgggggataattatttcgaaggttatactgactttccttatttagtctgagttgaaacactcagatgacttgggcgagtgaagactgtcctaagaataccaagttcaacagctagaaccggtacctacacctaacatgaaatttctgaaatagaagtaacacatgaacttaagcacatctaatcatgtgatcacctcacacgtaatacttaacaaacccaatgactttttccgccaagtgcacctacgtatatgacccctctcaggtacaaacagtgtaacttgactcatttctcattttctcaaacattttctgacttgatcgtcaaaattatatatagttgtcaccactgcaatcttcaactgtggagcacggtgaaccaccatgcgagtcaccagaatcctccttctcgtggataacttaatgacatgttactaggtcaatgaaaattgataccatgaatgtaaaaaactgacaaattaaaaaaacaatttgatctaaacactataaggagccaaaataaatctttttaaactcaaagaatcaaattaaaccctaaaatataaataattaaaaaactaaaattataatttagcctgacttatataagaaagtcttcttaattcttggcaagaatgtatagcagtactagtatgataaaaaagctgccagttcaagtgaccgaccgaacgaacacacacatgcgaagcagttcatagaacatcattcgccaatcgagggaagccttcgcacgcgtgtgtcgagctcagaccaagggcgagcaaaatcgtgccattgtttgcgcgacccgtaaatggttgggtcacaaactgggacatccccacgcgctactatacttggaaatatacataattgtttttaggtcccttaaaaccgttcaaaaatactcgatttggctacagttttgtacaatttgtagtggttaaagtgaccaggtaaagtgtaaatggtcataaagcttggtctttgtctccaaatatatccatctttcaatgtatagatttgttgaacccacgtgaacagtgaaaacggtttcattcaccaataagattcgatcttgcccgattttttaagatggcacatcgattaaagtaacgtatactacgggatcgtttagcgcaagttgagtgctcttattaaggaatttagccaagtgtcaatgatcagctatgtgtacggaatccaattagcaagatagtagactttacctccaggttcaaaaattattttattgtttaattattccagctttggaaaatgctgcttttactggtcatcgtgccaatttgtaagtactttttttttttgtgtgtgaagaaattagcggcatgtaatcagtgaagcacatgtaacttaatcatttataagtatacttcttctgaccctcatcgtatttgtgacactctggattgattcgatcggtggaatagaaagaatataagaaaaaaattaatatgaaaattttgaattaaaataaaatttaagaatataagtttcatctcattttattattttattgtctatgttttttttttcgttttctttcaactcaaatgaatcaatctttaggaaaagacatcactttttctcgtaagttgcatatgaatgtatgtatgtcccttctcctgtcgaattatgattctcatatatgagccatatctatcatcaatttacgtgcagtgtgttcatcaacatgattctcaaaagtagccattagtagaagtgaaccacgaagatgaaggcatctgtgcttcatttcaaaacctagctagctagcatgcctgctgaatgttgtttgttaatggttcacttgttctccgcctttcattacaatccaaaagcaaaagacgtgcgcatcatactatgtcatcctcattacaatccaaaagcaaaagacgtgcgcatcatactatgtcatccacaactaaataaatt

SEQ ID NO: 2495 - DNA, 1800 bp, Glycine max
  Soy_ogl_301 Gm01:53036801..53038600 Cluster 10
tgtgtaaggctttttagcataattaacggtgggtattatggaacacacgttttatataattccaattccaattccacggtacgagaaagaaagagccccccgcacgtgcaaagcaataggagctgaatcatcgattaacgatatagcccaacaaattaaatgattcattaaaccgttaatcacatgataaccagctcaggtgatcacatggccacgtctttaatcaaaatgctaaaagcttgcatacaacaatatgataaaccaagttgggtattgaaggtggtcgcacatgcacctgcacgtgtggagaatcacacaatctaatctaggacagctaagggacctcgcaatgttgggggcaaagactgtgcacgctggttaagaaagtgggaggaagcttgagggaaaagcctcttgtgttgattcatattaccattataagaaaacacaaggtataatgataatcatcattacagggaaagtcaagtttgaccgtggaccagatcaagcaaaaaaaaaacaattggtgttgtttgaatatttttctaataaaaatattcaataaattaagttttttatataggtttagattaacttatataaaagttatattataaaaaaaaattcatttaaatttttcaaaaactaattttaattagtttatacataatttattagagaaacttaattttttcttaaaaatacttcttttaaaacacgtgcgatagacattctacacgtgtgcttcgctgtccgtcggcactagttggacatggaaatttgcgagacaagtaggatccatgtgggttaactcacaactcgaggtgagaaggacatggacagcaatcacagcattgcctttgcaaccatgcaaacagtttaactttgtttcaatattcaattaaacaattaaatataataaggccttttgttttttgtctatcattaagataattttgatgagaaaatataactatgtctataacagttgttttaagtaaaatagtaattttttaaaagttaccagaaaatttctaagttgttttcattttcctacttttaaatttctctttttcatattattgtacttcacatcttttcttattcttgttctctaaaaaatagtttttgaagattaatttataaaataatttttacaaactaaaaaaataaagaaaccctcaattgtcctaaacgtctaccatttaatgtgaaagtgcatccaaaattaacttaaagttagcttgtgtaaaaaaggttaaagtactaataaaacgagtaggacataatttcaaaataatgtagcattcaacaaaacatggatggcgtttagaaatattatacataatttattcaaacttataaaaatatttctggagttttatatttttttaaataaatctcagtaaaatccatatgatagaaacatattgaataaagaattatctagattgattactcgaatgtttaataatacaactttaactcaataatattaatatcatttatttcaagtatttttttacattcaaatagatttaattaaattgtatatcttaatatcaatattgtattcttagtattttttatttttttcatttaaataggtaaacttttaagtatatcaattgactcaagtgcaatactttttgaacttattaccaatcttatagtaaattttttctgtcaaaaaaaaaaactaacacatattagtgaatggaactaacaaagttttttgccttaattaaaaacacatttttcttgatttaatatgattttaacatttatggtttttttttt

SEQ ID NO: 2496 - DNA, 1200 bp, Glycine max
  Soy_ogl_2146 Gm07:3135901..3137100 Cluster 10
attacttctcagttctttatttttattattttaagatatttatattttcgtattttttcttctattcttctttttttttatctttaatttacatttccaacactttactcctttttcattaattacaattcattgtaattttaattacttgcttcaacctactctcgtcattcgttttcgttgcattttttttacattcttgcaaagtctatttctttagaacaatacattacttccaaatttattttattgcaaatttacacttcaagaacatgaaacttttgtggtaatttctaatgacaaagtctacggtctaatggtttgcttattacaataccatcaatggtcacatgttcgagacagtcttcacagatcacaaccaaaaaccaactttggtaaattctaaagctacaattctttaaatttcgaattgcctttaatttattgttcattttacagtctttccaaattaacggtttttcatttgaatatcacattatcatgcaatctaattatctctagatattgcattcaaatttacttcttccgtaccgaattatacatatacctatggtggatggctataggacaataccagttctactagtttttttttataagtaaaacatctcagtggaactttgcatgtctcgtaaatttaatttgaaaacttttgcttttaacttagttttacgttttgtctctttattatggttaatacataattctgatcctctaataatttttcactctaaatgaattttttttatttattacagtcaaattatttcattagttttttctatttgaaactctcaacgttattatcttttatccccagaatctccgtgaatttgaaatcattaaactagtttttttatactattttatccttaaaatttaccaattaaaacatcacattttaagcacaaaaaaatttaaaaattattatcatcaaattccatcaagatttcgacttctaaacctttttaataatttgatgtaaattttaaacaatttcagaaatagaatgtcgaacccatctgctgatgctctaccacaaatttttcagcccggactcttttagaaatcaaaacccaaacttgggttcataaaatttcttggtggtccagcccagttcaataaaccttgagacatttacccgactgttatgagttttgttttttcggccacatagat

SEQ ID NO: 2497 - DNA, 2000 bp, Glycine max
  Soy_ogl_3763 Gm11:5996201..5998200 Cluster 10
tcacgaccacgaatccagaaatgcaccaaaacccattacatcatcatcattcaaaagggtaaaccggagattcaggggcatgtgatcgagcgttgacactaaatagtaaatagagactcctcaaaatggagccgtagatgctcgatatagggtggtgcccttcttcttttgctcactggatgcggcttcacacaactgcaatcacatagtaatagtatagggataatcccctaaaatcaattaatcaccaccttccacatatcaaagcatatttgtatatagttactgttactaagaggatgaacaactactgttatcgttgcgggataacaacaacacaagttattttatgtttatactgttttttctagatatttccttactccttttcaaaaatacaaatattctcttattatagtttttgttattttacctctcttcctaatattattcatcttcatctagttgcattcttctctcttttctcgccttcttttttttttcagagatcacatgtatcttttaggggcacatgcttgagcagaggagaaacattatggacagtaaattctctcaaagaagctacatattcgataactaaattcaaaattactagttaaactaaaataatattatgttaattgcttcacatgatatgatatccttttacttttctgcttaatatataggaatgtaatttctctaatcataattaaactatacctgttgttgctgtcttttgagccttgcattctcttcctttaagtgctccacttcaagctccagttcattcgtgtaagcctgaagaatcgaaaaaggggagacgtgttaaacattgtttttttataaaataaaaaaataacgaaaatgatataaactgcataacgtaatctatacgttccactcagcaacagtgatgttttttttttattaataatttttttgttttccacgggtaatattgtttggagactatcttgctcacacacacgtcgaacattaaagatgactagtccttcgactataacaatgtggtttgttatgttgttactatggctgtgcaaattaattcggtataaaaatcgaattcatctgactttaaattattttaatcggtttaattttatatttaaataattaaattggtttgaaaatcaatttaaaacaaaactgattcaaaaaattaattctaaatcaaattaatttttaatccattataaattagttctaagaattgaatgaatttcaaattaattttcaaactatttgtttaaataaaaaaatgtgtaagaaaaaataaaatattaattttttgttgaattaattaaatttaaatcggtagttgtaatgatagaaataatataataatataggagggtgaaaagaattaggaagtagcgagatatataatattcctgttttctagcacgagatcgtgcggcggactcgcgattcttgatcatgcgcttatttcttctgtcggcagcaggaggttgagcagaagttttgttggagggtggagggtgttgggaggagggctgagattggaaatggaagtgagggagagagaaaccagtttctgaagaagcagaggaaagtatgatgtttggtgagtctatggtggtcaagtcttgaaacacgtttatgtctttccacacctcttccatggaggccaagaaagaaggggggcactcaacttgtgttcttacactatgctttcttgcttgcttaatattttccagtcctctctgcactttgtgtgagtggtcatatcggactctccacacgtgacacgcgcgggactctcaattaaaccctaagctcactctcctcccatcctccttaaattatacgctaatatttttttatttttaaataaatgctaactttcattctaaaaataaataaatattaactactattcttagatcattcgttgaaaaattaaaaatacaagtatttttattaggatatgaaaaattagaatgttcatttttttt

SEQ ID NO: 2498 - DNA, 1276 bp, Glycine max
  Soy_ogl_7001 Gm20:45115425..45116700 Cluster 10
aattattttaaaatataaaatattaatggacaccaacatttctaatgaaaaattaaaaaaatgacaaaaaaacataaaaaatttaaataaaacttttaaaatataacagatcaaaactaaaaatttaaaaattagcaaaatactaatgtttctaattgaagaaaatgattaaaaggatatattttaaaaacatatagaattacaataaaatttttaaaacttaatatatctaaatgagatagttacgaattataatggaaaaaaatatattaaaccttgagaaaatgttcacacattagtcttttggaatttgtcgtgagaatcaattgtaatgattttttttttcgtgcacggtattacaaaggataaggcttaataaagtttggtgaatattgtcaacaaaaaatgctggcaacgaattttaatattcttcttttaacacatcttactattgcttgaagtttattaagacttgtgaaattataagtgagaactattataattaaggagtatgtactcatatatttttgggaacttaaatatttcttaattaataataaatagtgcattagaacatgtcattatcgttcatttaatattaattaataaaatgttggtttgattaggtatggcatgtctgaattttattttgatgaagttccattatgtattaatcggtgttgatttcttcttctagcatgctttatgtgtataggggaacattagctttagaatcatacgtagtcacacatagaattacacttgaaaataaaaaataaaaaaactctcgcagctcaaaagataagaattatttcttatttatatattctaatttaactttattttagacgatgtggaatttaaatattttccgacatcaacgtccgcaggttacttttttgtgcaccaaattaacatattgttgaagtcctcgagtagtttttcttctacaatcacaatacactaaccataattagaaagggtatttccgtagaaaataaaacaggaggtttccacatcgaacaaattaagcaacttcatggaaagaaaaatataaccaattgaaaaaacaaaattttcatccttatcgattgcaataaataagataacgaatcataacaagaactataatgtagctagccagccactaggccaacgaatgctttcttgagaaactttcatgggaagccttacatattggatgttccataatattaaagacatgcttagctgggtgagttaccattagtgtcattgctggccactagttgcctac

SEQ ID NO: 2499 - DNA, 1810 bp, Glycine max
  Soy_ogl_5960 Gm18:6226201..6228010 Cluster 10
aaccttgcacttacacattccactctctccctattctcactatctcatcactaaaatctaatgaaagcaaacgtttctttgcaatgccaatgctcatttaactctctctttctctttcctccttcgttcttcttccgaattcttgttcttgttgttttctctttgttctcttctctactctcacaccaccctaagcaccacattcttgttcttattatttttaatcatttttcccttttttttttctgaaggtttgaacatttcctttaatttatgattatcttgtcaaaagaaacatgcatcacacttcagaagttttcaaatatgaggctagtcttcagctggatcccgatgctttttcaagtggtggtataacattatttatttcctttttttatgttgtttattctctatggttcaagctttggttgctcttgtgggtggaatgatattctgtgcatcttatatgccattttttggttaagtttttgtcttatttttattcatatatagtgctttggtacaagagattattgtggggtgttatcaaattgattggaagattgtcatggtaagttatgttgtgggctcttggaggaactaaattggattataagaaattttaagaactaaaaacaagatttcaagagaataaaatatattttttcttaaaaaaaatcagactttacttttaattggatcataaaatgcatataagaatttcactatttaatttcttgaactcgtgatttgtgtagataaatatgattttgctattgatcataattgagaagttaaggcccccagttcggggtagtttacagtttttagttttgaaatatttgaaaatcaaacctagttttagttttgaaagcctttgattttgaaatttcaactttgatttgagaccttgttacaaaatagaaaaagaactcaaaatcaaagtggttcaacaggtgcagaacaatgcggttccaatcccatacagtgctaaggctaggcgcgttgcatcttcaatctcacacatacctttgagaactttctttgaaactccatgattgccacccacttcgccgttgtttgggtatgtgaaggggtggcacaatggtggtttttgtgagcgaatatggtgaggagagtactaaaatattttaaaaaaactcgtattcttatctatatataaaacaggtcattcattaatacctaattttaacaaaataaatacatttttaaaccatctagggcttaaaaatgaattattttttgataattttaaaggaataaaaaatagtttcataaaaatcacattttaaaaattagaaaatagaataagagatatattaaataaagaatttccaaaaacgaataaacaaaattatattaatgaccaaaattaaaaactcaaaaccctcaagtaatcactaatcacacccgccaaaaaaaatgtcaaaaacatgtatgcattatcacctgcaatatggaacacaacatgcagaaccttataacgaaatagaaactcttaaaacattttacctctaactccatcattcacctcatagctaaaatttcattaaatttatcttatttccatgcagtcccattgaccttccataccttctgtagttaactttaaaactaaattttgttgtaaggaccacaaaaacaaacccagctcctccaaagctacaaactttccctagtttccatttataaacggccaaatccaagtgccagggattatacaaaactgtttctgcaattctcttaattttcccgttagtcttttctgattttgccaaatcattgttca

SEQ ID NO: 2500 - DNA, 1091 bp, Glycine max
  Soy_ogl_205 Gm01:48534101..48535191 Cluster 10
ggtaaacgtagcttactaattaaggcgcattcttaatataaagtgctaccagctgtccggtgattttcttcgttcagtattgaagtaatcttgggtaaataactcttatttgctgtcattggcggatctggtttctgttgttcaaactgttccttataaatcacaaagttttaaaattgaatcacaacattaaatattaacacaaaaaaacaactaaaaaaaaaacaacaaagaaaccaatttcatcacaggtcatgccaaaactcacctaactcacctagtgctttggttcagatcaagtgtgagataattaagaaagaaaaaaaatgatatatgtattttcttgaaaccaaatggatttatttttgcatgatttgctggacaacaaccagggaggaattttcccacttcttacaaaccacatagaataagaatagatgaacacgttataatttcctcccttccagattataccacacacttaagattttgacacaagtattaaagaatataattaatttgttaaatttcataaaaaatattataaacaaatttttaatatatcttttatttctttaattaattactctcttttttaattatacactactttcaagtaattaaggtagtgcttgaaaaaaatatttaatacaagattttgtaaagtaatattttttttgaataattttattttataaaacatcatataatctacaaatggagagagtattatttctatcttttcttcttcttttttctttgtgtctataagctaatagataaccatccattcattattttccaactacatatcacatgttgtcaacaaacttcgttgatgcgactccgatttagtaatgaaagtattgttctatttcatagtcatcttgaaatttagacatatatggttggccagaaacaattaatggaaggtacgtaaggttgacctgttttttcctcgttgctaactagtgttgctggaaagaaactgtgggctgaaagtctaccaccttgtcttgaattgaatatcattgacaaataatgttaggaaaaagatggacgtacacctcgttttctagggtgtatgtatt

SEQ ID NO: 2501 - DNA, 1325 bp, Glycine max
  Soy_ogl_5316 Gm16:5361776..5363100 Cluster 10
gcttaagaatttgataaattcctcttacatgtacagaaaattatacaattatgtcaatattatatattttttttgacaaggtattcacagagagactaatcccttgaggatgttagaaaaaaaagaagattaattaatttttaggaagtagaatatcagttaaaaaaaatttctctcccccacatatattgttctattcacataacctgagtctaaaaattaaattgatatgcttaaaagatttaaactatttgtcatttgtcacttgtgttacactttctaaattatatgccaataatgttaataaataaagtacgttagatattttattatgatcattatataattttaattgcataaaatacatttgcaaattaagcagtaaataaccagtaataataatgaccatatcataacatacctcatatatattatgggcggagtatattccacactataacttcaaaagaatctcatacatgtgaatataagatcttctacaagaaaatcatcctcatgtcacaataaagcaactctgatcgataagcaagctaattaatcttgtaaaataaattatagacttaattttacttttaatgtctttggtaataattcaattttaattgtatcaattggatctctatacatcacaaatgtgccaatttagtcttctaggtttcaattgacaacttgagctccagtattataactatgcaattttagtctttcaagtatatatattaacaagaataatattgatctattaaattgtataattgcaatacccaggagacataattagttcaataaaacttgaatgactaaaattacataattaagatacatgagaaatttaattagcataatataaatttgatggactaaaattgtataattgcaatatctgtgagattaaaagtgcaattaaacttaaattgtaataatatatgtttttctcatctaacaaaatatcaaattttatctaaagataaattaaaacaaaaaaaaatagtactaactattgaatgaagataagaatgagggttgcatggttagcacggtggggcgtaatgctggtgtgaggtagaaactacaatggcatagtggacagcctactcaaacatcacagagagggctagagacaatggcaataaaagagagacaaagaaaggacatgagagactaacctgatgcagtggtggcaagacatgcaggatgcaacagaaacaaaggtgtggtatatggggtgcacaaacgaagaagggaaacagaaaattgaagggcaaaagtgaaaaagggagagacaagtggctcactaatgttta

SEQ ID NO: 2502 - DNA, 1200 bp, Glycine max
  Soy_ogl_3826 Gm11:10435501..10436700 Cluster 10
tatttcaagattgtcatcaagaaagagttggatgactcagatgaggatgacaacaacctccaagaccagctactttggcaaacaattgtctttaaagcaatgacaaactcaagagacttacttgtaaggatcattcttttattataattttaatgtttatttcaaaagatctttttaaatgacaatcaaaagacagattaaaaaaaagttatgacatttattttcaacaatttaaatctcctacaattaaacaatcagttacatcttttattaatgcgaatgaaaatgagaattaagaggaggacaataacaattatagatttataattgttgataaaaaagaagattgacagagaaaacaattgaatcaacatattctccccaatatttactaatgttgttgaagtgtcaattattttgttcgtcttctttacttctattaatctttctttttatttctgggtttgctttatctttgctccatgaggatgttcttattatattcttgagagatttacatgagacatcacatgtaaactttttaaatgagtgattaattcgtgatttttaacttaataataatatcttttaccacaattcatgcctagtttaaacatgcaaatacactaaataatgctcccttgcaagttattccacagcacgtgataatgggatgatttggaatactaccatagcccatcactgccaaattggacaatagtgggatgacttcataagatattattgtattaaattttttaaaaaactataaggttaattttatgaaaatccctgattctaaagcaataagggttgtaattatggaaatttggaatttgagctattcattaactcacatatctgtcttttaaacattcttcgtttctttattttatacattttaatttgaaatacatagttatttgaagtctaaattgttaacacaatgacaatgacaaggtttttatatccagatccaaccaatttaacaacgcaaaacagactcacactaaatttccatttttagtcaatcacatatatagtccatggccacttttaaaatcaccggcgtaataaataaataaaaatgacaataaatgacagtaataattgtaaatgtgcttaattttttttcttactcaataaatttaaggtatattatatgtcatttagattttttgacatactaataaaatctca

SEQ ID NO: 2503 - DNA, 1639 bp, Glycine max
  Soy_ogl_1139 Gm04:542162..543800 Cluster 10
ctttcattggaatttgatattaagtatgaaaaagttatccttattaaataaaatctattttaaagataatctcattaaataagccatagacaattgaaatttatttatatttaagataaaaaataaaaataaaaaatattagttatattcaaagtcgaaaggagtccaaaactaaaattggagtttcaaataatggttattgtacctttcgggccatggaccaaccacgcccagccttggttctttaccatgaggagcccatataactgcctaagctaaacccttccaaagatcacaggttatggtcaaagcatatatcaaactgattatcacggaaacgagttgatcacaaagacaagtataaaattacacacttaaatgctctaggtaaaccgtctctaacgctaattgaggaaacctaaacccaaaccgttaccatttatttagtatttaaaaaatacagttaaatgtgagaataaatattgtatgtgtaaaagatttttacattgttattcaattatcaaatttaataaattttaccattattaatttttaattaattaataaattatactacgattagttgataatgtattttttttaataaaaaagtgcataaaaattaatctttaaaagtaaccagccacaacatagtttgtttgtctgcgcattagtgaaaatgggcgcgcattattgtttacgttaatcgatcaaattgaatgtggaaatgcgatgatatttgtgtttttgaagccaatttaaactcacacaaagacaagtatataagaggttggtgatcttaattcaaggtttggagtataattataacagcaaaaaaaaaacaacatcccaactagatataaatgagaatcctaccacacaaacaaactagacattgaagacgttaaattctacgaacaaaatatacgattttgataacctttcaaaaaaccacttgcttcacttcgtccacgatagaacaagcaaaacaacaaaaattcatcattttttacgaaatttcttcatattaattttaaggttcgaatttatctccatctagccaccaccttggccaaggaaaagttatcccacagaccttggacacatccagcaaactaaaattatcaagattttcttcaacatcattactattatcgactaaaatcagtggaagcacgtgactttttaaagtgggttttaattttattcattaatttttaaattattatctaattgctcaaattaataattcatatgtatcattttaagatgtgttcacacacatgtatgtgtgtgtatatcatcacttgattgtcgaccgttctctttatcaaattatgacataattgtaagtttgtaatgatcagagtgacaattatggtgtttgactgaacaagtaatcctcatattgtcattacgagattaagggagacgagtataataagtctagcagtaatttaaagcattgcattggcactaaaaggaaggtctaatctttcttatctcttagtcttaattgaaagagttgtttcaataatcagaaagtcacatatatatcacttaataatcaagactaaagtcatttataaacatattttactctcaatttatcaaatcgttttttactgaagacaaacct

SEQ ID NO: 2504 - DNA, 1251 bp, Glycine max
  Soy_ogl_4960 Gm15:93150..9678800 Cluster 10
caactattaatcaatgttactttcaattaatataatgacacaaaatatagaatgttgttgttcctcaagatcactgttcttattgacgtgactccgtaatcagaaaaaactcaagtttattctttctttcttccatatcactaattttgatcatgtgacagaatgatactaaaaattcaatttttatatattatttaaaagtcaacaccatcgaatctgaatgatgtaatttgcttctctcaccaaaaataaaattatgtaatttgcttgttagcttttgttgggtcgacaattttgcccatataggagggaactttactacattgtgacacttcacttagcatggggttttaaattcacttccaaaagttaggttaattgtgccataagcaatctgagatgcttgggctttggacagtatattgaatgcccggtttaaaagagaggaaaaatgaaggatattttttttcatttcaattttttaaaaataaaaagaataaaataatagattaggataatattttttacttacttttttgtataaatattatgttttttttaaatcgcgtctttctttttaccttcaaaacctcactaaaaaatcagacttatattctttgcggtgtgttttgcattattggtcaactgctactgctagcggtggaattagaaaagcactttaaggaagaaaaaaaaaaggatttcccgtcatatctatgttggagtgttgtctgttgttcgtaacataagcttgtttctttattctgctagttctttgtccctcgaataactgtttaaatatgaaggtggattgcaaaatgcaaactcattgcatttgtattggaacatcagagctaactagtaattttttgacaaatcctatgcacgtacaggatcaaataatgaggttcaatctattatttaagttaaacactaatggaatgaattcagttctatatatgttcacatgcttggtcctcttaaatgtgcaaaagaaataccaaatttgttggttccaaacttaattattttgggggaacttaattagaatattaaatcaaaaaagaagaatttgggagaggcaagggaataagaaaatgggacaatagtttgaattaagtttttccctaaattaaaattaatttatgcatatcaactctaaaaatgttaaataaaagaactttttaaaccgttggagtatataaattagttttaaattataaaaaaaacctattttttatcctttaattt

SEQ ID NO: 2505 - DNA, 1300 bp, Glycine max
  Soy_ogl_1727 Gm05:38202901..38204200 Cluster 10
aaattcctaaaactaaacataaaattttgaaacacagcgcgacaaattcacggaaccttaatttagatatccttcctagctagcttgcgaagcacatgtgaaagtcaattcatgaaagcttttgtgttgtaaatatacaacttggttatctttattctttctgttgtgtgtgacatgcatgcatgcatgctaccacttataacactttttgtttgttttactctctgaaaatgctttgagagagattcaagaaagcatagaagctccattgatttgccgtcgtgtcatgatccatgtaacacgagccaggtgccctcattacgtgtcagcagcgatgtgatgttggtttcgtgctgtgtgtgagcataagcccatacttttcggttgtttgtctttcatgtgagatgatcgatcctggttgaaggtgatggaatcgatcaaaaggtcatcttctcttctcgatcataaaagagttcacattacaaccaaatgaacaaaaaaggtaattaaaacaactcgcgctcgatcgttataaaggaattaagccccgatcgatcggcttgtgttttaatttatcttatcaagacgtacgtgtggttacagtgacacacatatagaagtcagctacatttgaatgttcaaggaattcgctgaaatttcatcattgacacacgtacaatctttcctgagcttatcttccaattacttgttgtggcgccctcgatcactggcattaaggtgcatataatttataattaattaactaattaggttctagcttcaagataaaattaaaactgaatcatgcgctcacagctgcctcctacccttccatatcaggcaaccaacaatctgacctattatcaaagtataagcgatactcaacacgaaacgttgttacagttacagcgcatacaaattgtaactgctcctgctagaaagaaaacatttcgaaattctctctagcttcaaaggcacccaaggccacaattaaattctagtgaaatccatatgttaattagacccatacaaatagtgtatagcatggtcagagaagaaagggaaaacaaatgtttggtttatctctggcattattttggttcttttaattaacaaacagacccatacaattaaatataatcaattagtttttttttaattagcgtgaatatttgttcttcttcttatataagagatcgaaatagtagatgataaccaattaaatggctggccatgtacccaacatctcacgcctcctttgtcatgggattcatgatacaataatgaacaatatttgtcg

SEQ ID NO: 2506 - DNA, 1481 bp, Glycine max
  Soy_ogl_5537 Gm17:5675801..5677281 Cluster 10
gtaattgataaggtcataaaattgtaagcgtaaagacaaggaaatcatggtatagtagaatcaattggttagttggagacaagttgttatttgtctataagaagagacacactaacacttaaaaaggttattttgtattttcttttatagatgtaagttctctctctgaatgaaacttgcaggtgggaattcattgtattccattttttttttattttgtgaatcgataatggatgtcaatatgtgtatgtggagcctggatacgtatatctcttagtataggattagaatatgaaatcataataaaatggatattggcattggcttttaattggtaaaaaaaaaaaaaaccaataataagaattgacactgtgtgtcacgtattactttcttttgcacccaataaaaaagaaaataatccctgtcaattcttattattggtttttttctttttacccattaaaagcaaatgccaatatccattttattatgatttcatattctaatcctatatttagatccattatcgattcacaaaataaaaaaaaaagtggaatataatgaattcccaccaacaaggttcattcaaagaaattatttatatccagatgttttctaaagtagtaagtagttaatttaatagggagggaaatgcaacagcggattggttagccaataaaggatccttttgtttcttacagcagccatcctttgggtcttcgatcaagatattcttctaactgatgctcaaggcatcgtgttcctcagtagtagcgagtttgtctttatttttcttttgtataaaaaaatagttaatctagtaaatgtcttaaagcatttttattaaaataataataaaattaaaatgaaaaatatatttttagaatttaaacatcataactactatttaatgtttctaatgtgtaccatgcaaaatcgtttctaaaaatgtagtaacaagtcactctcacaataatgtctttagttagttatgcagctggaggatattcttttaaaagtcgtcataatcagttcgttaaattctgaatgtgtaattcattttttgaagttgtaaaaaatgaaatagtattctataaaaacaacattaaatagtagagtttttttatttaatttgtacctgttgttataaataagaacattaataaagaggatataaaacacagcgaccaaacacgtttctgttcaggcacgtggcagttaaactaggacagaacaacaaccacgtcgatgttcgatgggcagacatgacccataactgccctctaacttcattattagacggttccaaagtgtctccaaactctggcgtgtctggttgggagagaaacacaagcaagagcataaaaatgaacccatgaagcaagggccagggttctccattcccacacaacttgctttcttttcctttccattcctcttcttttggtcaatgtatgcatgatcccatcacacacgtgagg

SEQ ID NO: 2507 - DNA, 1325 bp, Glycine max
  Soy_ogl_2152 Gm07:3231801..3233125 Cluster 10
tagattcagtttcgtggtcagcgaggttggtggacacgtggtcttcactgacggcttatattactactgcattgccttcaactcaattcaatgagtcttctacatcgttccacgtgcgtgcgattgcaatgcccactactcacctccgcactctaacttccgtaactagctagctgccagctcagaattttaatttcccattcttactagtccaaatacaaaattagacgttttatgagaaaataaaacattaggagttcttcgtcaaattaaaaactctctcctcattcgtttcacttatatatagatttcaccatcagtgtacttttttcccacatatatacgtactttagactaggtccttagtttggtacacaattgaaaagaagtagtaattaactgcaatgcgtataattaacaagtaatgattcaaattgttttattgttttagtattattgaaaatattattaattatgtgtctcttgcttgccttaattacaaaaacgtgcaaggcatacacaagggtgtgtgagacggtggacattgcacttggcactcacgctacgcatgctcttattattattagtcgaagaagatggtgactgttgtgttgaatgttccaccactcttgaatttgtgcaagtgtaaactagttcccagtaagagacaaatttagtaattgacaaatcatgttcctatttgatttttcaaggttacttcttctttagtaacagcctgtttcattttttctcattctattgccagactggtcccagtgtttatcgagcagaaagaaaatttgtattatgcaagtttatttctaaaatgcagaagtaatcatgcatgtatgattaatgtttttggtgattatttattattacattttagtaaattaaatttatgatcatgtgtatagtttagagtttaaaggataataccagaattttgaaattatcatgatatctctctcattctaattgacaccaattcagttatattcattttcattattttttaagcaattcattttcatcattaaagtatatatgtaactatgtattatatatacttttcatctatttataaacttattaaattatttttctaaacatacacgctatatcaaattagtcatttaattttactttttgttattaaattattccttaacataacattaattaaatgagtctttaagaaatataactagttatatatattaattgttattggatgatctgtcatgcaaaaatacattatctatctgtctatttctatgtacagttctgaattcagttcttttactatgatttttacatgaaac

SEQ ID NO: 2508 - DNA, 1700 bp, Glycine max
  Soy_ogl_5419 Gm16:36509101..36510800 Cluster 10
gtctattattcgtttagaaatatatgttttcccttaagcgcattttttacacatcaaaaatcatttaagaaaacatcaatttttcataattgtgcaaatatgtagagttgtccatattcattattgtagttaatttggaacctgcctaatgaaatataggacttgatacttaaattttgtgcatgcatgagttaaatgtgagccttttatctagtttgattatgccctaatctatgcttaatccataaaaaaactaatacaagtcaagcttgacttgggtctcattttagaagctggaatcaaatgtggattttttagtttgactcactataacttccaagtacacaagttgaacttccccgatgaattatttgccttaaattttaaattttgatcacaaattaaattttattttttctcatgtttaatcatgatccaatatgagtttaactcacaaaagccactaaaatattttatattctattttattatactcttgctctggatccttttatcacaacttcatgtaaagagccctacatgttttttttttatcttttttaagaaaattgtaagattgacattaaacttttaaaaccagaaataaaaaatcctcaaattagaaactaaaaactagttttatttaaaaaataaataaaactaataatcagcccaaataaagtgtaaatgtgatattagttcttaaacatatatgtatgtatattatttttttctttaagttatgatatgcatattgtatatgcacttatatacatttgtatcacagaatattatgactcatcagtcatcactatttcactagtgtatagctttaaaaaaaatacacatgacacaactgacaagcttttttgtctttggcaaacaatacacgtgacatgtaacatgcatatgcaagttacttagataataagcattatatatagtggctcatttttgttccggttctcactttgccactcctctcctttcgaaaggaaaagctatatttcacacatttcagttttgtaaacaatgttaatttcaaatgaataatgatatattaattactctttattttaaatatttcatcaatttttttgatctctttttctatcacatcatagattttattatatatacttatatttttttcttttttttttcctcggttgatttttagatgttagataacacttaaatatcagtcaaacatttttcatttcaaacacatacttccttcaaagatcaaatgaatgacacatcatggtgatgtccataaatcaaagtcaataaatgatggggagtgagtgaatgataaatatgtaaaagtgtcaatttatactttgtttgatctgtacaaatttgaatatcgtcgtaattctataaggaaaatgacgtgaaagaagaaaatcatataaattgatggacacaaggctttgagaataatcttcatgttggctgtcgttagcattggaaagtgtatgatatgcatactcttgctcagagtaagaccacaaattagactaattaattagtaaaacaagctgtttgatctctgtctgtctaattcgttacttttgatatgttataagttttatattagttcactaactcccccaaatttatggattgcgaccctttttcttaatttttagcccaaattcctaaagttcctaaacgttggaatttatatttaattt

SEQ ID NO: 2509 - DNA, 1571 bp, Glycine max
  Soy_ogl_5492 Gm17:3658301..3659871 Cluster 10
ttccaatgaaatgagtttttagctgaacaaaaagaaaacacacacacacacaccaaaagtacaattatgccaatttttaatcgttattgctctaatatcaagagattagctagacttcctaggctatatacatgacatggaagacaaatttgcctatgcttttttgagtggggctaattaatgtgttgttatgtagtactagtagaaggtgatgataaaaaatggtactacttactactctatggttttgtttttctgttctggatttgagggatcgagttcttattgagaaagagggtttggtgaaaggtgtgtgcgtgtggctagtggtaggtgagagcgtgcctttgttattttccttttattgttttgtggctgatactccataccattaatcaccgacgtttccattacctctaacgttaaccgatgcgctgtcttcactccttattggttgcccttttctcgttgcaattttattttatttttcatttgtggctgcttttgtgatgtagtgcgtggatcttccatgtgcactgaggattttattttttatttttttataattcgaacgtgacactaatcaaatgattcggtaccaagagaatctaacttgtttaatttatcaatgtgtaactgttataaattttttaaataatatcttcaatttctgtggaaggaaaaaaataaaatgattctgtggatggcagtgttccatcaatggatatataactcctgaaatgaaactaattatgctccactcaaatgaattttgctcaacttcactgttctgtttaagatcaatgtgtttgggtttcctctgaaactttctaatgtgtggatggctaaatttcataggaaaatgtgaggcatttctttacaggttacaaattatacagtcttttttatgagaaattctcaatttctttcttgttaaaagttttttttttatctcaacctttattacagaaatagcaaaagctaacaaaacttccaacaggtacaggagtgtcatttcaaagaacactataagaaagaatgtagctactttggagcacgagatttttccttcagaagacaagaaaggaaggataaaaaaggcatatgcgtaaaatattatagcaaattcggaaggatgtagatttttagcgactagagaccataagaattgatattgacttaaaataagaaaacaagtgtgaatgtgtgattgtcatgtaatgttagagataattggtggagagtgaaatgcacttatagtacttgcaataatgcggaatttatatttttacccgaatgaaagattttatttctctcttgagaagatatttaagagcatacaattcattgttttttacactctatttgagacttaattatgacttttactattttttttaatgttaaatattaaatgagttgctcaattgaatatgaaaaaaaatatttttttattatttaaaacggattaagttacaagtaacaccatgccattcttgtaaaaaaaaaagtaacaccatatcatatgctttaatgctaaattttgttaccaaataaagctggtattattt

SEQ ID NO: 2510 - DNA, 1250 bp, Glycine max
  Soy_ogl_5778 Gm17:39377401..39378650 Cluster 10
gtaagcaactctaccaactccaacgggggagtagaaatctcagtcagactatcacccaagtttggatccaattttgctagaaaattcacacacatgtttccttcccttaatgtatgaaccaactgaaccctcaagttttcctttagaaaatccttgataccttcaacaatgaaagcataacggtgggaatcttgacgcggttgtttgataatggtgaaagcatgagtagaatctgacacacacaaaatgtcatcaaaattcatatcccaagcaatcttaagcccattaagaaaatgtggacatgaacatccgcgttcagagtcacttggttacccttggtcatgatacaagatacccacttcgagggagaagagctagccatcctagtctctgtgttgtcatcaaaagccgacgtaatagactcgtacatagccaaaattctcgccaaagtctgttgatgttcacaagcaacctgcttgaagacattgtggattgacgataacaaatatttgtttgaataagaaaatagtaattacacatgttagaatatatgatttgatgaagttaaattccaactaatgtttttttcttgatttagactccgtttattttattgtgcatgacaagtatttttgaaaattctaaaattaaaatttcttttcttaattttttttatctttatgtaaattattatttagatttagttactataatttttcaatatgcatagtctaaaaattatattattaattatcaaattatcacccaactcctttgaaaaatatatttttcaatatccatagtctaaaaattatgttattaattatcaaattatcacccaagtcctatgaaaaagatattcttactcatcattttgttcctcgatcgtgcgatttaatttggtacattcattaccttttgcattttgactaatggactattggttaatattacgagtgttaattctccatcatttcattggttatcgagggaaacgcgtttggtttgtttccaattcattccataatatcgaccttctaccatccacgtatattaggcaacctggcgaaattaaataattatgtccatagtcttcggctgacaatgaagtggtaaaaggtctcaatggttctatatttgtttcgcgaagtctgcatggagtgaattaatttaatacgtatgtccataactatacttaataattatcttaaaaaactatacaataattacttacttaacacgtccataat

SEQ ID NO: 2511 - DNA, 1711 bp, Glycine max
  Soy_ogl_6930 Gm20:42328390..42330100 Cluster 10
ttcctcccgcttggggatgggtgagattgaacacagatggctaggccaaaggtggaaggagtgcggcagattgtagtggcctcagagctggtccaaaatgtaccacaactaaagcttaaactttatgttcatcaacaataaaaaaaaaaaaaacttttcttattagttttgttgtgaaactgaggaactcaaatctatggatttttttttcacttacattctacttaatcttctttacaaatatgacatttcatctcttatttgtactctttacaccactataacatgttatatgagacttattgtttaaccttcatgcatggattcactcatcactgctggaggtaagcattgaaagattttcaccaatgaattgtaattaatgagttaagtgaatttgatattatatttttattcaaaattttgaaaatcaaatttatgagtaattgtaattaatgagttaagtgaatttgatattatatttttattcaaaattttgagaatcaaatttatgagtttttgttacgtatatagtgttaaatttttatatttttattaaatgtaagacttcatcttacatttaaattccaacaaatttttataaaaaattaaaagataacgtacattaacaaatccaacaattttttataaaaaattaaaagataacgtacattaacaaaaaggttcaatatatagctttatcatttaccataaaaagagtcattctatcggtcttgaaaaatcaaaacaaaagagaaaaatgcgtaagatcccaagagctctgtgctcctttcttctaagagtgacaacatctcataaaacaaacccatgagcaaattttttccattccaaaagaacatgtatgggaaaggatatgccactataaatgtcagcatatgttgaaactgttaaaccaactgaatcatactctatctaaaagggaacaactccatggtgatctttcatggttctcttgatttgatttattatttcaggttttactactcttttgaattttgattcattatggaggatttcttgtgattttacatgtaactcacttgatgaaattcttccttttaatattttcatgttaattggctaaaacaaccatatgcataccagaggcgaaaaccaagagacaatatatgatggaggtaactttccccagctaacttttcatattcgggaagcatgaagtttacttcaagttcagtattccccttcccatcaattccagagagacctttatatgagaatatctgaccaacatgatacctttgtgcctttttataagttaaaacaaaaagtattacacagcagaaaatgttactagaataaggcactatacgataagaaactagcaagtgtaaggaataaaaaatgctaattaagcataagagaaactattcctacccttcgagctgccatattagggtccagccttcccagacagatacacaaaggaaacaaagaccgatattcatcttctttccatgacaacgaagccgtcaatagcctacatattcaaatgagtatctcattgccatctcaaaattgatatttatactgaactgcaatcagagaaaataaggcaatggcagaatgaaaacaatgacttcaaatccctagaaattaccaaattcagccttatctgaagaaaaagatgccatttgaattaaggtaaaaagaaaatgtatcacaaggtcta

SEQ ID NO: 2512 - DNA, 1569 bp, Glycine max
  Soy_ogl_3805 Gm11:8975901..8977469 Cluster 10
ggggaccaaaagttataacttctgcgaaaccaacgaaaaaaaatgaaaactcaccaattccaaatatcttttttttatcacctttggaaaataaagtcctcaccgcttctagtccttgtcattctgtctgcagaatttcacattttctccgtttcacgttcccctgaatactactagtatttataattttaaaaaatatacacaattttaagttttttaaattttaacattttgcatgctgcgcatatatatataaccgtacaaattttgctcataattttaaaccctcaattactgtaactttcaaagggaatagttatataaatatgtccatatatacctatacttaaaattttgattttaagtacagaatagcatgctattaacgctaaggatatctaataattaatacaggtatactcaacaatctctcgtcaatttaaagacatctgtgatttttactttttagaaactccaaatttaacgtttgccttgcatctgtctgtccttttttcttaattatttttcacttatcattattactatttattattttggtgtgatacatatagttaagaaagtgtttaacgtattaattccttatttttttggggtatccgggtatggatggaaagaagatagagaatataaaaagaaagggagagaaaaagaagaaaaattgatagaagtgaaataaaaaaatttataaataactattaatactatgtcgaataaactatattttacattagtaacaaaatgtgttagaaacttgaaagaatatactaattagaacttaggagtgtgcgttggcgctggcgcgaatggtggcagtgtaatgtggagaacaaagagtaacattaattattgatttgttacgtgttttaactattgttcatcattaatattttaatatgtggattatatagataagaattttttttaaataaaaatttataataatccaatactataatcagcgaacaacaatagttaataattaaaaatattatattttaattatgaaaaaaaatgttatattttactcctccaatctctattataagaaaaaaaaatagttttacgcttatttagaaactaattaattttattaaattgtgttaatgtcaaactaaaaatatttatttaaaccattatttattcaaactaaaaatatttatttaaaccattatttatgtaaaatatagtttctaacacatttcattcgaccttttgacggatcttttgataataccacaaacagaggttgagagctcccactcacgttgtcacacatctttttattctgtatgcttttgctcacttttctgtttctgttattatagtggttcttcctaatactactcttacttacattcacaactttttgcaacctaatgctaactattttagatggactttaattaaaaaaaaattcatcatctcatgttaaactcagatgcagctatatctataacatggtttgcaattctcatcgtatgacttgtataactagcacaatttagaagtaattaaacatggtgtaattataatcgatcctacgacatt

SEQ ID NO: 2513 - DNA, 1409 bp, Glycine max
  Soy_ogl_3601 Gm10:47142201..47143609 Cluster 10
ttaattttactttaggaatgcagtaagaaaaattattttaggaatgaacgtcatttcataaaattttgctaaatatagataaaagatacacataaactatgaattgttgttttaaattgacgtacgttagagagactttgaacgtgcaatcagacatttaataaatcatagaaataagttactagcgatagttaataattttgagaaaaaataattaaattaaaaaagaaaatgaaaatagacatttgttgataacttttacgttaagtgtagtatatgtagtaaaacatttgtttataaattttatggatttttttttcttttcaaaacggagcaagcaaattactgcggtatcttccgagtctaccacgaaaagcgacgacactgtcaccgtgactcgaactggtggtgggtcctaccaccaccgcaatctaccgtcggcacctgcgcaagttctggggaccaccattcaaaggtggggcagcgcatcattcaatatttgcccctctgccctattattattgggccattggcactctttcaataattttcaggaaaaagctttcgtatttttttaatattgatatttgttagtacttattagagtttagtcctattaattgattccgttatcgataatagtaaaacagaacatcacactgcctaatgtttactaacaggatttcttttggtacaaacgtttcatagtttttgggacaacactaaaagatagtataaataaataaaataactcacatgactgaattaacgtttgggttatgttatgttacatcttggaatgaataatggagatgaggacacgtgtaaatgagatcatgtgggtggagggacccaataccccttcggtaacgttgttgtctgcactccaaacacagttctcagtttcacaaggcagggaaataaaacaccacttgagacacgggtcctactaatttgggcctctgcaaccttttttttcttcatatgctgcctggccagatgttacttatttttgtattgtactattgtgtgaggctgggtgctatacaaatctcaagtatactatagattttgatttgatatagtaatcatttttaaattatgattatggtaatgggaaaagaaaagtgaaacgagaattatgtacagcaagattgaaagataataattcgagacatataatatcttgaacgtttgatacgataaaagaaaaaaataattttttttataaaaatatcctaaaaacaaaaaataagtaatttaaattataaattactttaataattgtcgattgcacatttatatattttattttaggggacactggttcacttataaaagttatttaagtattgtgctaatttaaacttgtaattttttttatgagtttaatatctatgtactaaaag

SEQ ID NO: 2514 - DNA, 1150 bp, Glycine max
  Soy_ogl_49 Gm01:2317501..2318650 Cluster 10
tcaaggtatgtagtagtacgtgctaattagacatatagctacatgtagcagtgaggatgcatgtgaatgtgatagggtggactatatgcattggagggccttgtgcctacacatggtttcttaatttgtctgggcatcatcatccacccatttgtcctttctagaaagttcattttggctaactaattctcgatccgttgaacaggaaaatgatgtagttccgctccaattttgggaagatatgatagaaaagaagagataaaatgaataaggtaaaaaagagatgaaaaagaaagtggaaagataaaactactctatataaattgtagaaagcatttagaatcacatggaagggtgtgtttgatctccgaatgacacgtttcaatttgagtataggatgaattaaatatgatttttctattgaccatgatatttgatattgtgttagtgacatgattccaagttttttttgacaaaataattcataagttttagattctagtttaagtttaattgaaatttgttattggattttgcatcaaacactaacacgagtcatgctattttttgttcatatacatccttagttggacttaagtatattttggtaattatccacccaaaagtcaattttgatttcaagaattttcaaacaacattttgtgttaaaataatttttttaatatttattatctagacaaaaattaagttatcacaaatttatgttttcttagaattaattcttcaaaatcacgttgattcaaaattaattatacgaacacacaaattattagttaatgtgatttagataaatatttacattgtgtttgaaaatgctttgaaagaccgatttgtcatgaaaaaaaagtcacgtcatttttgaagcaattagttcttgcttttgtcttttttatttattattggatgtgaaacattacatcctaaaatcatatccaaaacacgtttcgtgtgtttggtttcacgttagattagatatataaaaatccaaatatgtcgaatcactcatgttatgattttttacatcttaagtcttcccatttctttatctggtttatattcttcatgcagcattcaaacggaacgactctataaaattatgccgcttcctaaatcacgttaaaatattaat

SEQ ID NO: 2515 - DNA, 1658 bp, Glycine max
  Soy_ogl_34 Gm01:1755243..1756900 Cluster 10
ggatccattgaaagcaacgaaaagaaagttgccccattatatagatttattgcacaaagttgtttatataacatcactgatcatccttccaatcctatgtagccatggattaatatatccattcaacaatgcaacaataaaaaaaaaaggttttaataaaagttaaccttaggggaatttctatgttacaaataaatactaaatcgaaacatattaaaaaaaattaaataaaatataaaacacagaaaacaatacattttcaattccccttagtgtgacatgcttgccaattgtagaaattgcgattcacgtacattatttgccaccgccaccacacttccaaatgtttcaccaaacaaaaacatctacctacattatttattaaaatatagttaatcaatgaaccaattccaccaacaagagttcaacttcataatcaacccttttagactctaaaggtttgacgccatgcatttgaaccaaaattttcaagttacataaagtataaaccaaagcacactaagtcctaataacatacgattgcgaacacatggaaagcatattacaatggagcataacttgcctaacaaactgagactacgatgtgcagcagaacaatcgatgcagaggaagaggcccaagttgggttctttgcattacaatcgaaacacatctgaaacaaaatacatgtagggttgtgaacctgaaacatgatattcttatcgttgaaggcatcaaaggccatgggaacgtgacaatcgaatgaaaaaaaatgggaatgaaaatgggtatttagaagggttgttaattatggaatgagttaattaggggttgagactttctcaggcaagggggtgtttgctcagtgtggtggcaacgccacaccatttctcttctcgagcaaaaataaccactaatcttttgttgttacttcttcccttttcttttttattcaaaacaaattgtatgtcctttcacgttttcttttagtgagaaaacggcgtggaacgtataagggaaggcctgagaaaaatgtgcatttgttaatgttatggttgagtttggttttctcagtgactcaatggattggttgatttgtgagattactgaaaatttgactaacttatttcaatgtcaaacactttcctttttaatcttaaaccttaatataatatttttatatatagtatttattgttgtatttagtgatatagtatttatagaacctcacaacttttagttcaactagtgagattattttatcaaatcaagtttcaatgtttttcacctactcattcgtatgtgtgtagtccaccaaaatcgtgaaatgttatttttatcgatgacggatctaaagggggacagatagttgtatttgttgtcatagtaatgattaaggtgataattagtctagaattgtggataactagttgtgtgtttgttggtattgtagatcaatcttgattattatcatttaaaataaaaaaatttaaattttatgttaaaataataaatattttttaaaatgattatttattagaaattagatatttaaagaattataaaggaaaaaatatgcgctcatttaatagatttttttatccatccctgattttcatataaatagatgaaaataagagtattttttgtttttatat

SEQ ID NO: 2516 - DNA, 1348 bp, Glycine max
  Soy_ogl_360 Gm02:3788507..3789854 Cluster 10
tacttttaaatggaaaatcattttaataaattaattatctaattgttctaaatgtatatcgttttgtccgtttacactatcaaggaaattagtttttcacttacaccaacattatacaaatttacttcccatctacgtctacgcatgagtaaaaagcccaccatccaacactcacatggcacacgtcaatgaaatattgatagaatggactcttagtctttatggcggtcttgggtgacagggtcaactatgctgaacaatgttttcttgtgttttttgtcaatagacatattccacccattctccttatatatccacatatgcattatgtaattcatcaagatttttttaatgtaccattcttccccacaacaatgatcaatattagatcaaaactcctaccgttgctatggaaaatcacagggtttgggtcaagcatagtaaggttcagcgctgttttgccctcagcccctgtttcagatacttgttcatagaatggagcccgctgaagatcgttgcgtacagcgtcgtaagctcacttttatctatctccatgctcttcgttaaaagatgcagcttgggacgatatgagacgagtttgttactgagagcacaggtgggttttgatgatgaaaaaaagtaaacgactgacgaaagtaaaataatataaaaacaaaaatcttgaatacgatcaaatcaaataattagaaaattaagacttagttaaattgttaagagattttttaataagcatattttagtatttgattaatttaaatcaaatctttaagtctctttttgttaaaattattttttaagttttgagatcaaggtaatcaattactagaaaatataatttatttttaaaatttaaaattgcacaaaaaatatattttgaagagttatattttttggaaatgactcgtaacagattatacttattttacttataaatatttgttattttaacacttttataacatgagaaatttctgaaaaaaatttggtagcaatcatttttaattatcaaatttttgataaaaaacttgatcaaatacacttattattgataaatcttatagtattttaatttgtaacatttcttctaaatcagataataaatttttatattatttatctagatttttgaaaagtatgagatatttcttgtaagaacaagagtatgatatctcttgattttttaaagattcaaacacaagggatgatgaatccgaagatgtaagagtgttatattattccaaagaatttcaaaaataatactcttaagataggttatttaaaaactggacgtataaaaagtttttcatgattgaacatcgagtttata

SEQ ID NO: 2517 - DNA, 1400 bp, Glycine max
  Soy_ogl_1073 Gm03:43737301..43738700 Cluster 10
tttttcctaacagagattacggctttggattttgtgaaaaacactactaattccaaatagtatttcaaagtaccagcaaatggctttttcattgaacctctggcatattgttgaggtacagttgtgcagacttaaatttgaggggaaccacctttattttcttattttgattatatagcatgcacgaacatggtgttatatatgcttgggaattccacatgcacgtgtcacgttaaagttttggttttgttaattgttagtattcatttatgaccgctcccacattcttttctcaatttgtgggttactcggatgatggatggatatggtttccatcgctttcaacccaacaattaacaaaagcatgaatgaatgactactccactcacgagataaatattcgtggtcttatggtcaacgcgggtaacattaacttttccctatctacccggcctccattttgaatcttctaagtttttccttatatgtatgtgtgtgtttttgtagtaaaggttcttatgtaattatgttaagacaaatgttaattttttaaaaattaaccaatactctaaaaatactgattaacaagactcttatgttaaataaagtaacttgataattaatttggactattatattttaaaagcatagattcagtatatcatgtaaatccaaatttatgactttttttgttttgtaatgaaattaaactcatcataattaattaatgaagtgagtaactttatcaatatttaaaccaactacttgtcacataatttatgtcactaagtgtatctgtgaattactaacatggaacataatagttgatgtataaatgatatggttgaaatctttgagtatattgtaagagatttgattcttaatcttatatatagtgaagactttattgaaaaaaaaaaatcacttcatgtgttaaaaaaataaaaatgtctctaattattagttgagaatatccctaatgtaaaaaaatttaatcctttatattttataataccatttttaattccttatagtgatgaagttatacatacaatttaaaaaacaaaaaagattccttttagtctatatacttaaaaataacatcttttattttttatacataccatttttaatcccttataattcttattataaagattaaaatcgtgtatatagggagttaaatagattaattttttttgtaagaattaaaatatgatgtttttaagtataaagagtaaaagggaaaaaaattgtaaatacaaagatgaaatgaataattaagctttttgttcatttgttaattgaatagtttaaataaaattattttgaaattgtttataattattaagcatgagtaatgtattatttaatgacttgaaatttaaattaatggtgat

SEQ ID NO: 2518 - DNA, 1500 bp, Glycine max
  Soy_ogl_1157 Gm04:1123501..1125000 Cluster 10
ggttgttgtaactgtcacagaaacacccaccataatgtcctccatcatttggtggctaattttaatgcaatcaaaagtcaaccgaaaagtgtgtttggttttgtaggctaagctagcactaaaatagcactcaagaattttcatgcatgggattgactttgcctcaatcatgggttgtgttgtggcctttcatttagcagagaggtcttttacaatcagcaaattgtggcctctgctcttctcttgttgtggaaatgccgtgtgtgcaaaaccactacaagaatcccataaaatactacataaaacaacacactgaacaatgaggtcaatattaagatatgtattcatggttatgttgtggatatgtattcataaccaaacaaataaaaaaagttatctatctactagcatttcatttcctatcaaagaaataattccctctaaatcattataattagatgtacatcagtacatggtcacactgtttatttagaataaagggcaatttcaagtcttatatagtattatttatttttgacagatgttgaaacttaaaagagcaattgtgtccgaattcaaaagcgtagaataaataacctcaaacgacactgagtgcagttcgtcaagaatatatatatatatatatgttcactttatttttacaatttcttataagttgtcctaggactttactttttttagcttatattttgaaagaaaaatttaaatataaaagaaactccaaatcataagcttggcccaaaaaaacagtagagtagactttaatttttcggtcctcggagaacttgaatcctcaaaattcaattcataccaaccaatcatatttaaatgattttgatgttcacattttttttagtgagatctcttctcttgagttttgatgaaatttttcctctcaaaacacttaaatataagacttcaggaaccactaaaaccaataacttattaataaattaaataaattttaaattaaaatcaataatcatgttatatattttgttagataaaatattaacaatgagatattaaacatcataattgttatcttttacaaatataactacaacaacaataaaatctattatattttaatttaaataatttatataataataactgatattgattttattttgttccatttcatatatcttctcattaagtttaataccttcattcttcaaacttattaaaaacatttccttttcttaaaatcttatatttgtttattctttcatttagatttcttgtattcaataattaatgtatgaaaaaaatcattaaatgatatttttttcaattgataaattactcgtcaaggtgctggtaaaataactaatataatttatattattaatttaaatacacatataatgtaaaaacaatttactatgaccaagcataattaattacatataataaaattgtaacattttataatattattttctacattatttctaattatttttaattaat

SEQ ID NO: 2519 - DNA, 1300 bp, Glycine max
  Soy_ogl_4937 Gm15:9139601..9140900 Cluster 10
ttacatttggctttttttatcttccaaaaatttaagttttgaaatgtatttttaaattccagaaactaatttcgaaatgtagaaaagaaaaaacggaaaatgcaaatagaattccccctaaacaattcatcttatctattgggtaattttgggacatgtttaaagtgtcgaatagctaaaagagcagggcccatgtgacgaatttaagtgggccatgtgttgggctgtgggaggaataattggagcaagattaaaagtgaactatgaaccagcccttttacctaacaaatgcaagggaccatcctattgtgccttccacaattatcagtttagcataaaggatactcttgctatttcaatgcagctgcaacctccattgacattgacatctctacaaaattaccagtaactctcgtgtcatcataatattattgagcagtatttattaattttactaatgattaattttaactaaaaaatctaattgactatctttaatgaaatttttccttctaactattatttttcattcccaatactcataatcagaattttattgaaggagaccaaggttccttaaaccaactacttacttgttgatactcaaccttagcttaatcatagattaattaatataaaaaatcttcaaagttttatgtttttttctatgcactaacactaatagctagtagagtaaagctatttcttatttgtttgcatgttctggaataaagctggttcctttatgtgaattcgggtagtcccatctaatagtttttcttagccatttgtgcaattgtgaatagttgagttctttcactacaacacttgtattagtagcactatattgagtaaataataaaacgaaaaatcacattatctatgattttattcaattttatttaaatttatagaatgtcactgtaaataatatctcttctgttcaatgacaggtggtgactcccatgagtgtttctgccttaaatgccattttttttaaagtaaaaaggtagtgagaaccatatgtgtctcttaaattcttaacaatgttccacataagaagtgtcacggtcctcacggagaagttgacctcctgttttgttttacctctttttgcaacatggaaaatgactgaattaggtaatatttgaataatttttcaacaagtatttataaggaaaaaaaagataaaataaaataaatttgttttaaattaaaatcaatccatatactttaatttctttaaaaataatctcattcatcttctacagaaatttagatatacaatttgatttttaat

SEQ ID NO: 2520 - DNA, 1200 bp, Glycine max
  Soy_ogl_5825 Gm17:40647201..40648400 Cluster 10
ttctcatatgtaaatatatcaaaacctacacggcatgaatcatgtatattaccttaacaccttgttttcacatgctggtctgatttttcattataatttgtgaaatattaattcattttagtgaaggagactactttattcattatctgagaattatgttgaatatggtgttgaaatcattgtcgtattttctagtaagaaaaatgatctagaaagaaattgaaaaataattaaatgttacttaaagctctgcttacattctttttgtagtttggttatactagattttgtcgtgtacattaacttttatttagattttgcatttatgtaatgtaatttgttatgttttttcttcagactttgataataaaaaaaatattcatttgttatatgtttgtcatacttgtgatgtttgtaaaataaaacatttaataaaatatttaaatcggaaaaaagacattcataaaaggaattcaaatttaaattattataataaaaacataattttaccataataatttagatattaatgtgatttcatgtaaattatttcatctcgtgaattaagtaaaaatttctacttgcttctatataaaaaaaaaaaaaaaaaaacaaacaaacgcattcatcactatgtgctatattttacaggcatggataacctaatactcgtccctattccgttaataaacatgtagggaaaatatgtttaaattatgtgggtacccatttaacaatttatctttatttcattatagattttatcgattaatatttgtgggtgcatgtatttttgccatccttagtgatgagcttcctccactattatcggaaagtgtcccaagtcatcccattttttcaactgaggaaaatcagagttagtctgcagcgaggagctggtgcttgtgaagatgactccttttactcgcaaagcctttaatttaatattccatgaaagaatagaaacttatttaaatgtcataattgataaataaaaaaaatgaaaataagggcaatctctttctcaaaaaaaaaaaaacacatgttaggtagtgtttcctccatcgtatatatccacaagctccacacttgatgaccattctacaagttaaattccttttaggtgccatcaagaattggatcaagagccttgcatgggttaacatttgaacattcatgatcataaagaatgccattttc

SEQ ID NO: 2521 - DNA, 1200 bp, Glycine max
  Soy_ogl_2154 Gm07:3236001..3237200 Cluster 10
aaggagatgaagcttcatttgaacttactattgttcatattgctcttaaattggcttgacactaggtggattgtaaattaattagatgcttaatttggatgtcatttatataagaaatgcccaccctttttacatctatccaaaatactcagtaaaattagatctattttacaaatggaatgtgaagtttgtaaaatgatacgtgttttattgcagaactataagttgtatgttctggatgtgagtcttatgatttttgtgagggttgattacctcttgtaccctttatcctctttataaatgcattctctttgctgataaaaaaaattgtatttccagatcgatccgacttataaattcgagttcactcattgcaggttgatgaaaatataaaaggaacatcggtttaaattagacacacctacatggtcgattttcttagtactttgtaatttcttcacttttctttattttcattcgcccactgtgcaaagaaatgcacgtatacattaagaacatttttgtgctctatattgattccattgtgatgcctatacattgacatctttattaagtgatttaaagaaaattatatgcaaatatcgctatatgaaatagaacttcgctcaactagccgtatctaaaatcatacctccataaaagaattatatttgaaaatacaaattaacatatttaaaatcaaattatcaccacaatatatatttaaattcaagattttgtttaagaaaatcaaattcaacatcatttccgacgaacgattattgatatctaaatgtgttttacttttagcttcatgaattgagttgagtataatatgctgatagaaaaaagttgagggtacaaaatactaaacttgcaatttataggagtatagttgtgattttatttttgagcaaatagttacttaggacgaccacttttcaaaaaagaaaagtaaggcacttacccgaatgatgcgtgcaccgtgcacaagacccatgcatgcctttttcattatctcttgcttcccaaccaagcgagacgtaaaggctacgtagaaccaaaccaacccttcttccttcatttctcacacaatattttaactaacgcttcaacgcacgacaatggcaactgttttgatgtcaagctacaagaaccaatattggtttaaagtggcatgccttgctatatatatgctac

SEQ ID NO: 2522 - DNA, 1500 bp, Glycine max
  Soy_ogl_3580 Gm10:46487301..462200 Cluster 10
ttaaagaaaacagaagcagcaacgttaattaattacatgcactgtgttggacatttaagattctcctagaaagtgttgtttttggtagtttgcgttaagtgtcatcctccaacgtggtgagcgattacaatggactctggatgacaagtacccaattataaaacgatgtcgttttcgataatatattgttgtagaggcggtgtgcagtgaccatttaacatgtattgacaggagcagcggtgacattggcaccgaacggtgcgtagcgttgggaccgaagacaacgtggtgcgttcattgtgctggctacaaggtgtcttatctcatctataaagttcaattgaattatagccctacgatttggattaaccgtattttctgaagcgatataagaaagacatatacatataggtcacaatataacaaagcattttatttttcttggataaaaagaaaaatatccagcttttgtcaaacacaaccgattggcgaaaattcaagacagagatattccaatatatacattgtttttcttaaaagaaaaaagttatgttctttaaatacgaaaattccaaatccaccttcatggttttggtagatgggtaggttacgggtctaagcaaatggctaattacagcttgagcagacaagacgcgctttatttgctttcattagcttttcaactttgagtttgaaatgcaagctaggttgcacaccattggctttattcttggaaaattggaatattgaaccctcgatttccttacaaatttcccgttgcaagccgtgaatgagttggaagcgccgggtgtttaagtcttcaccagtggcatcaaacaatagttagattagatgtgtaacagaaggtatgaaacaaatcaccagtaacttggacttttttaacattttctttataagatatagtcaataaatttgatcaaaattccattattaattatacaaataaaacaacacgtgtatatactcattaattgatactttatttcttcatatagttagtttctcaactttttatttacgaggatatcttattttcagcaaaaacattaaatgtaaaattatagtattgtaagggtttatttaaataaataaaaaaactaacatattcactagacaaaaaatatttaaattctaaatatgtaatagaccaatatattgtttttaatataaaataaacatttaggaataaaggcataagttattttaaaggttttacctgatctaaaaacttacttacataatttggtcaatttgaaggttttataatggtgatatcatgatttttagtttctctaaattttaattttactataagactaatccttggtgtcatctttaaaccaccatatcatgtcatcacttattactataattccaaaaaaataaaattttaagaccatattaacatattacccttcatcaagtcacatttaacttaaataagtctgacttgtttaaaaattttaagaccaaagatca

SEQ ID NO: 2523 - DNA, 1445 bp, Glycine max
  Soy_ogl_4432 Gm13:33630184..33631628 Cluster 10
ttgaaatataggtacaatgtatctgtcctataaaaaaaaggtacaatgtattttcaattctttgatttttcgaccaaaattggtcttatatcttaatttctgtatttttaaaaacaataattatgcttcttatatttttataattgacaaatttcatctctcagccatgtatcataaattcatgagttctatataaaaaaaaaatcactaattataaaaagcacaaaaaccaaaatcatcatggtgcaagaagttctaaaacacattttataccttaatatttataattttgacgtgtaatacacaaaagttaatctaggagcatactaagagtgaatatatagataagaaggtgaaaaaagtaaacacgcgcgactagtgtgagttgagttggatgggtaagggattgcaaatgctggtgttaggaattttagagaaacagaagtgggaccgatgtggtgacacataaagtaaaaaaaatagtcaaaaagggtttaatatttggcattgactaacagaggccgaagaaaaaccatcctcattccctgtcacgctttatgcctccttgtgccttgtttggctacgttagattttgcagcatcctattcatatgaagtataaacaatctcatattcctttcctaacaataaccgcattatccttttagccatgcattggaattcaacatttgcacctcacacattttataattctgaattgtttattgtttagaaccacttctaatgtgtttggataatacaaaattgacaagtttgtattctcaataaatatggcagtgcaaattgtcaatctagatatgaaataataaaggagtatcatgcctaacatttaaaaaatacagggaatgcatatgtaatatgtataaaatacaagggatgagtaagtaattgtagagatgagggtgctttgagaaaaaaaaaaaaaaaatctcacgaataaagtgttagtcatgtgaccagaccaagttaacgtcgtttgaagcacaaggaggaccgctataacgggaatgcaaaaaatagagttttttgtaggttgaaaaataagaggaaatccttgtgtaatgagtaaaacaaaagtgatgtttttgtaatttgctctaaattttaccttaaaaatcatggtgctataatgaaaaagtaaaaataattatttattgttttacttttatcataaaaaataattgattatttttactgtaaaactaatccaaacatactacagtggctaaaacttcctgcacctccataaatttttagcagcacccattacattccagaaaatccaatctggaatgtaaattacattctgaattgggctttccatattgtttgaggtgctagtaacaatttatggaagtgcaagaaacaatagtgctatttagcgcaataaaggcccagtaatataattcgatccaacccaataac

SEQ ID NO: 2524 - DNA, 1700 bp, Glycine max
  Soy_ogl_1752 Gm06:797301..799000 Cluster 10
taaaagttactcaatagttatcaactcgataacttctaaacacctcatactatatttgcttgaacgttgaaatcctattataaatactttctccatgcgctgaaaaagtgatcaaccaaagaaagagacccaacacaaaaaagggagtaacatagcaaagactattgcggagcatcccagacaaaataattatggtaagaacatatataattatattaaatatataaaaatattaatcaataagtgcaaccaatatacaagtgcccataactaatagaaaaaaaataaataaggaaaaactatagcaacacttctctcaaagaataatatcctatatcttccaaatgaaaatgaaaccttaaaatagaacactaacaacaaggtccacaatctccttgttatcaaaatatatataatatcttaaaatgtcaatgaaatcttagttgacatgggagatttaacaactgatttaagaaatattaaaaagatataagtatagttaatattttaaaagatataaaacgattaaattatgttcgtctttcctccagagcgaaaatcatcaattattatatctacgatgaattttttagcaaatttttaaagtgagtaatatatatatatatatgagtaataaaaatgtgtgtgtgcaagggaatccagcaagccaacctgtgggcatattttgtgcattgggtcgtggatacgtcgccgtcgctgcacaatctccaaattgcaagaagacaagaggagggcactctactacagtactactcttattctttgatttctgttttactttacatgacaggaactaatgatcactgttcaatatggactatcttcttcaaattatttatttatttttaggcttaaataaatatttgatatttcaatttttttcattttcatttctatattttttattttagttattataaaatatgtttattttttttatctttaaaatacgttagataatattttttttctgtctaaagtattatctaaaatattttaaggataaaaacaaacatattttataataactaaaatgaaaaaaattacaataatgaaaatgaattacaataaataaaaatgtatttataagtagagccatgggattcaggttttgaaatataaggacaagaaaatccaactctttcaatctgagccttgcaaagcccaaacacaaaatacaagaaactattattgatccgtatcctttttgctattagcccctgcaaatctttaaaaagacccccttatcccttgtgtaaatccttcccttttttcttcccccttcctctttcatatgcccccgaccctccatcacctttctcttctttgcatccacaaccacttccttcaccttctccaacccagtgacccatcaccaccgccctgtgcgaccccagcaccggttgtgcacaatgctagatttgcatgcaatcccctctagcacaatccaaccaccactcttactccctctacactgtcccagccacctttgcaccactaccccaatgcacacttccacccacccacctcctgtgcactatgccaccaagctgcacaccaccgctgttaaaataacacaaaagtagatttcattgaaatagtacaatagaatcatatttttattgttatttttttaatactccctaaagaacagcaaaaatacaattccgttgtatact

SEQ ID NO: 2525 - DNA, 1124 bp, Glycine max
  Soy_ogl_4439 Gm13:33861101..33862224 Cluster 10
aatcataaactataggattaggtgccatcgatccaccttttttctctcctatgctagtaatttttgcggaatgccatcaatccatacccatgctagtattaatcgctaacatgccacaattttgtcgatcacatttgtcgtcatgtttttattcttttttctggagcttacgaagtccgatactttgaaattaataacattagaaaaacacaagtttctttatcaataaaaaaagaagcaaattacactatttatctttattccttgacaaaatctagtagtgatttaataggtggaagagaaggaatatttaagtcaaaattaaacaagggtgggtttatgttgggagagaatgtcgcttggggaacgaaggagatggcagaaaaatatcttcttggttgggtgagttaatgaaggaggggtaggttgatgcaaggattaggtccattgaaaatagattgggtggtgtccaactcaccccatcataaacaagtgttatcactcgtcatactataaattaatctataaacttttcttttacgaagatatacacactttaatatatcatttgccttaaacacaaattatctacacatgttagattagtgatatttgtgagaggacgtaggatggacttattgatgcaacaggtaaatgaattctctagtcaattgttgaattaggtaataaactttgttatttctctaaatctaaaactaaaaatgtagtccatatattattatatcaagtatgcgtattattgaatgaaaaacttgtgtgtgacgtgtgatgcacacattccaaactaatttttctagttcggatttaagcaactttcttaagatttgacggtgcttttttttttcactggctttaattttcttcttagtctaaaaataaataaatctcattttgttcgtttttgaagtcttgagaagaagtaaattgtattctcaaaaataaaaaagagaagaagtaaattggaatttagataacaggcaaatgtacatgtggcgatgcaaaagcaaatgcgaataaaaatggccaggtaaattaatgggctgggcttctcgtagatatgtaaagacgggtacatatgagacagttacttcctgcaccctttt

SEQ ID NO: 2526 - DNA, 1180 bp, Glycine max
  Soy_ogl_1094 Gm03:45259038..45260217 Cluster 10
acatataaaagttaaaatttttccttcctctcgttctcttttgaatattttgttccatccaagcacgtgcaaagtaagaggtaggaagggagtggtagttgtacgaaggatttgaagaggaagcgggcaggtgagtgagtggggcacagttcacaacagaaaaattcgcccgtgcttcccgcgggacgctgtcgttctgtcttccaacgttgaaattgggccacactgtcactagccaatggcttggtctctgtcacttgtctgatctgtctgccacgtctacggatacatacatacacactgcaccacatcaatcatgaaactttttttgagtccatattaacacttttctcaaaaaaaaaaaaaaatagattatgtatagaaaatgattgtttgaattaaagttggtaaaaaatttaaaatatttacatttattatctttttgatttttaaatcattttcaattctaatataaattttgattggttaacttttttaaacttttcttacataacttttagttattatataatgacttatctatgtcataaacaaaatctaataaaataattgtgtgactttttttataaaatatattttaattctttgttaattagtttgacgccatcagttaatatgaacaaaggaagaattaataacacaacttacaaaagaattatacttaattatccaattagattttttatgatgcgattacatcatcaattaaagcgattacacaaatgtaaagactaaaatcgcgagggagaaaaattttatttacgtacttttatccgtcaaaatttaaactagggataaaaaaaagaaaattcaattttttttaacctagtgtatagaaattcattattatgcattgaaatttgtaaaaccaaactttaatccaaacatatcttatattattatttaattacaaattagtaagcaaaatataaatatattaatttttataataattatcagagaggaacaagagacaaactaggatcaattagactatttttttattaccccatccaaaatcttgatcggatcatttgtttgaatccaaactcgaagtgtataagacgaaactaaatcaacactacttttaatataaaatatgatataatatataactaaattataaaataaaaaaagaatattttaataattttgggtc

SEQ ID NO: 2527 - DNA, 1200 bp, Glycine max
  Soy_ogl_5010 Gm15:12341301..12342500 Cluster 10
ttaaaaaaaaattcataaaaggaagatcccgcacaaatgagatgtccaaacttagaccaataggttcttcaatgccacattattttagcatgagattttctaggttgctgcttctaaaataccccccttcaccgatcatccctcgcaatagctctaacacctaattgaaaataaatctccaaattctttttaagagtattactctttcatttaaatggttttaaacataaaaaaaataaaaattcttcatttaaattggtcccataatgttagtaaaatatgtaaacttttttttttggagagaaaaaatatgtaaacttattcaccaaattgttggatatttaatgtatgattgaatttgaatccggagaatttggaagtatttttatttttaaaacaataaattcttttttcttcattttgtgtattagaattcataaaaatattttttgtacttcaatccaaatataccctttgtatcctctgggttagtatcccaactgaccaatctaatgatccatcctattttagtttcttcgtcattttagcttaaggttggaggattatgtgttttttggataagatttatcattgacctatttgcacttaatcaatctaaatgaatttgttataaaatttaatcccacacaataacacctcagaaggttagcaggcgaggggggtctacttgttatactaaaaactaactccaaatccttaatattggtcggcgaaaaagaataaaaacctaatgtgactagagagatgggcagattacgcacttaaatgttttgcctaggtcattttaaatcttaaaagaaacctatatcgaaacaccctttttaatatttgaaaacatatgcatactcatataactttattattttacatactacttaaaaaagaaagtaatattttgacgatcaaattggtgagtttaaatatttcctagtgacatttttaataaaattaacaaattaataattgttggtaagaaaaaattcccttctctaatccaaggactaaggactgttgagagtgagtagaggagctaatcgaggttcctaaacgagttgtgaacactgcatattactgattgttcaacacttcaactgcttcgattccaagaaaaaaagaagttctactatttcgtttgttgctggtcattaatttcacaaaaacatccaaaagcaaaagaca

SEQ ID NO: 2528 - DNA, 1235 bp, Glycine max
  Soy_ogl_5230 Gm16:1409700..1410934 Cluster 10
gtaaaacaataatgtagtactataaacatttagtcgatttgtgatcaagcgaaataaatagtatatataacccgtgtgaacaaggtttatttcagaatttctattttaaacaatggtatgatagaaggatcatcacgtttaaaaaaaaaaaacagatagaaggaccagaaagggaggattaaataactatttgacttgtgtttatggaatatgatatttctttatttgcgggatgtaaaatattgcgtatgacaaccaaagcaacgaaaatgatgcaactgttctgattaattagataaaatatactactcgcgatatatcaatcgatattttaaagatttaaatatgttttaagttcatacaaatatatccctatctagttttaatctttgaaaattgaaagtagggtaagaaagggagaaaaaaaatagtaggcaatttttttaaaaaatgaaggaaatgaaaaaaaacatggaaacacatattatattatttcaaccatacctttcaactcataataataatattttaacttttttatcaggtcatatgtcattttttagacaagaggaaacatatattaaagaagaaagaaaaaacataccaacaaaacaagggaactaagcccagtctgcccagacccataaaagaaaaaacaagacaaccaaaatagcaaggaagaccaattgtattgctgaaggaatcctccaaacaagaaggaagagcataaaaaccaaaagaactttggtgttgccattaaaatcaaagacattgtctatgaaactgtcacacaccacaagaaaagcaccaacaatttgcaaaacagagattgaggagcaactccgtagcacataatttgaagatccttgtgaacaacctcagaaaaaaagattcagggaccttccttctcactaaaatcttcacagccgtgaggggttaatatcaacaaacttggccccaacagattctggttgaacttcgtactaagtttgacatcatctgttaaagtactcattaaaaaaaatgatatttttttttctttttaaacaactatactgttttcttataaacattatttttcttttatgctcttcatcattaaaatacttcttttttttaaaaaaaaaatagactttatttagttcatttgttaatatcttttctcttttataatacattattgttataattaatgtctatcagataaatttacacttgctaattttaattgagac

SEQ ID NO: 2529 - DNA, 1569 bp, Glycine max
  Soy_ogl_5524 Gm17:5393032..5394600 Cluster 10
ctgggtgtgtacacgatgtcatcagtttacaaatgtcttcaagtttcgatgcatgatggggttgatgcataggcttttcgttggaaaaaaatatggaataagattgttccattgtaggtagttatgtttgtgttaaagattttgcaagataggatccctttgaaacaaaatatttatagtagaggtctactagaaggggatgacgtgatgtgttgggtagggtaccaaaaagtttaagaatctactcagcatttgtttgtggagcaaagtattttctcacgtttgacaagattgtatgaagtggtttggttttagcactgctttgcataatgagttattggtcacttttatcaaatcatggctcttgcaagaggctcatcggttgatttagaaggttactcagtcctcttggggggatgtgactgtcggtgaagagttctgttgttgggaggggtgtgggtgttgtttctgtgaatctgttccggtgttgttgctgggtggaggtttgtgtttgtggctggccagaatctcatttaagtatgaatgtgggtgtgaggtgttggacttttggtgcttatgcatgtattggtgatggggctatattttcgagtgattctcattcgctcatttctgttagaggctttgggaggtgtaatttatgtccctggctcttgcgtctcagaattaggggtctggtgggtatgcagatgtacttttcgtgtgtgtctgcgtattgggtgtatggtacatgctgttttcatgtgcttttatttttgcttcagactttgtgattcaacctgtttttttttttttggattttgttcccttggatcctataggatatatatatcttgtgcttctttaaagatttctttttaataaaatttgtttggccgttagaaaaacaccaaattaataatatattaatatctttggatttttttttgtgataatatcttcagttattttttttactgctatcttcagttattataaatacacaatgattacgcataattatgcaatataaattaattttgttatgtgaaattttcatatttaattaccttattttttatagacattaaataggcaaaaccttattacaatttgaaaatatttatgaagagatagattaaaaaaaaagtcgcattatatgattattatgtaaaaatttatcacaagaggatttaattctcttactcagttaaatttatgtggttttgacaaggcagcgaggatcttatttcttatttaataaatcttattctttatatagtaaatttacttaacaataaaaaagtgtaataagtacaggttattaattaacatttacgaagctggctctatgatcgtttgtcaagtttttagtggctgaaatgataaggtccatttcatgaatggtgaaatgattttttcattgttaagattctagcttgttgattgaaccgagtaaattattgtaaatttaatattattttttattttcaatataaaaaaaatgatttctccattatataaatctgatctctcgtcattgtaaaaaatatattcttaccgttatttatc

SEQ ID NO: 2530 - DNA, 1287 bp, Glycine max
  Soy_ogl_6563 Gm19:44533414..44534700 Cluster 10
ctctctctccaatttatcccgttcctttcggtcttttcaattttgcaccccacatccaattgcaactccaacgtgagtttttgagtctttccaatataatttgtttttgagtttcatgctttcgaggaagagggggattctcatggtcatcctctaatgggagatcttaatcgcagcatcttgttgcttgttctgaacgaataaatagagaggaagaaagaggtgaatgagacgagattgacagaagagaaaaatgtttttttttttaaaaaaattaatgatgtctaaatttttaattagatgtgtttaaatatgatgtattaggtaatatcaaagaattactccttcatccctctctcctttacagtttctctttgttcaagcctacactacaaggtcagcctccgtttgcattcttacctattaaaaaaacttatacggtgaatctatagagagaggaagattagaatttttcctgtaaaaataaattttgagtgttaataatatgctatgcctgattttgaaatataatcattatggaaccttgaatctagaagattcaagtcttcaagagacaagaccaattaatctctagtatgacccactagcaggatgatgtcaaatgaaaggaaaattattgtggcaaaaaacattacaataatttcatatgatccaaaggcctataatttcagaacgatatcgactttttgttagaaatatatttatcctcaatttttctttaatctcatttttttattatatcacttttttttgtgaatctttattatatcgcttattaataaaatctttattttacttttcccttcttcccttttcatcccaatacatgtcaaaataaaattttagtataatgagttaaacagacacgagcatactaacatcacaagtaaaattttattcagatttattacgtaaaagtcttggattcatatttcttacaagtattaggtttttgtacatgcatgaaaagatacaattgaaaaagagatcttacgtggtcaagcaattgattgtaagtaactaaaaaaaattaaatgaaaccctaggtggttgcccacttcaaccacctcagggccaccaccgatcaccataagctccgtggtcaagcaattgattattgcactgctagcacggtttaattagcaagccaggagctgaaatctcatgtagctatacgtcattccagattaaaacaattttgtcatgttttaattaccgaaaatgatagtctcataaaagtagtattgcatcgttgatttttgagtt

SEQ ID NO: 2531 - DNA, 1305 bp, Glycine max
  Soy_ogl_3360 Gm10:4164623..4165927 Cluster 10
cgaattttatcgtaagagtttaggaagaaagacttgttattaattattattatttttattttttgtcatgattaaatgtctggagttatataataatctagatgcaaatctcatgaaataaacctcttataaagtaatcacattttgtataaatatatctaaaatgttggatccataaagaattatatttaaatatgtgtgtataattactcttataattactaattttatatattaaaaatattactttttaaacatgtgaatttaaactaataaaattttcagagtaattttttatacatagatataaggaatactctattgactttgaaaaatcatacatcattactctattaatgctagctagtatatataattacattcattcacttttagttatttataaaataaaataaatcatatttataaatagttaatcatattttctacgtttatatttttccttagcacattgatttagtttaattacggtatcaaattaaacaggttgtcacatcatattcatatctctgcgttggcttcgtgtagatacatagcatgtgatcgtgaagtagtccataacacccgttcacttgaatcgttccaatattcccattttccaccgtggaagatgagcaaaacggccttcttcaccggcgtcttagccctcctcctcctccttctcgagaactccgtctccattgccggccagactcacctttccctctccgtgggttacttcgccttctgcctctatctatgccttgtcagtgttgtcaccaaacgcaaccttcatgagaatattcacctcttgtttaggcatgaggaagaagaagtaaccgagatcgttgtgaaaggaataacaacggagttgagctttgaaacaattccactgctgcagggacagtttgtttttgttcgccgcgtaaatctcaagttaccaaatcactactccactcagctaatacttgtctagaacaacttcaagtctgttgctagcagctgtttctgtttttcttttcttaaatctcttcaagacacgtacccctttatttctattatttgcccttcatgcaatcatgcttaaccttttgttcccgcaaagctagtagctagtaatgtactcgattaactgtgcggagtaggaaatgtttgatatccattggcttctattatatatttgcccttcatgaaataatgaatattttttaaaaattatttattataattaagttagacatttaacaattacagaagaagagataaaattccatttaataaacttttgtacctgcttataagttg

SEQ ID NO: 2532 - DNA, 1500 bp, Glycine max
  Soy_ogl_1439 Gm04:46534601..46536100 Cluster 10
atgttacccatgtcattaaaatctactctcctgcttttgattatattgagtagtaatatttgttgagtgccaagtagtatatagttgttgtaagttgtaactttaggcagctattgctgtatttcaagaaaaagtcacagacaaatccataacccggtagaatccaagtaacgtggctttttgcctcaaaaattgctgtttcaacatgctttaggtagggtggacagcttgtctcaagtggtcgaattgggtagggtaaaatggcgtcaagccttcagcattcagttcagattctaggtcaatgaattttagatctgtcacggtgtcaccactcaccaaacccttctttttcaaacacatatttatagtttttaaatgtgcatttcaaaatatatttttttcaaaactcaataacccagattttaattaacttcaatttgactagattggttgagtttgagttaaacactaaaaatttgcaaaaagaaaaaagaaagaaaactaacccaagatgatctcatcaattatttagtttggacagaatttttctccaaattaacccatggctatcatccctatgctttagactacgttttcctatttttacattatgttttacgttttatcatggtaattacgagttaaacctggcttaaaaatcattatattatattcgattagaacattgtaatcttttcaatttgaataaaaaatattcaatattcttcgaccttagatttgttcatttccacacgtagctgtgtcaacaatatacttcttggttgcactccactccgcttagcacaacataaatgtatggtgtctcagtctctcagaaattgttagaattgaaacattctgtgcacaatgatgagtcatctcatctccacgtgttattacatagtaccttgtaagtcgggacacgggattcttccatttgcattgttccaaaaatgtgcagtgatcaaatcaaaagcttttcaagtaagctattgagaaacaacccaatttagaaaggattggattcaagggccttgtttggttttgatgtgatagtagaagaattttacccgaccaatccacctatcttgttagcatagtttggtaaggtaatgcttaaacgcagagtttgaccccaccacgttttggcatattggattttgtctacatataagatagagggaagagggatttaatcagtcataaagccaaaaagagacattttacaatccaaattaatctactaatggtgctactaaatgaagatgcataaaattttactgtcattgaaactagaaagtcacaaacaatccatgtggggactacctttcttgtacgggtgtttacacgcaagatgcaagctatctctcatattcccacgtttcattcatcccaattatatgccatgaaaatcgggttggaaatgcgttgcttaagctctaacgtagaaagccaatgtttaataagttaagcctcattttaagaaatcacaatatatct

SEQ ID NO: 2533 - DNA, 1581 bp, Glycine max
  Soy_ogl_6545 Gm19:43968201..43969781 Cluster 10
aaaaattccctctactatcaatttaataaacaacaaattaaatcttgagaggtgatggcattccaaattggcaaatactttgactcgacttggataaatagaatcctcaatattaatttaacctgagcatgaccaaaaagcttaaaaaattattttctgattgaaaatcaatttgatatttcataatgcaaggtgtctactgcccgccaatacaaagaatttgtttccctagaaaacgaatttaaatatgtagaaaatgtgataggaaaaaggaaaaaaaaatggaattttacaatcacacaagtgcttgaattgacattcaaaagataacgaaaagcatttaatttttacacaagacatacagctttttaagcattcacttgcataaaatcttgaatataagttagaaatcatatcctctttaaagaaaaaagttagaaatcatatatacaattgaataacaattttttttatccttctcattttagtttgaaccattacttttaaaaggttaggaaacaagactctttcactttcaatccttatttatttcttcatttcataacatttgaatctaaatcttcatttaagcaaatgacccctcctaaaacccactgcatgttctgcatcatgcgagcattggctcatcaactaaaatttcacaagtttcctccatataacaaacgaagctagcacaagtgcccacaacaaaatgataataatctatgctaaatgtcttaagcattcctctatatccagaccttcgacaaatgatctgctccagctccatgatcgaaatttgatagcttccagcagctcttccagatcgcatgaactgtttgaaaaaatatcgttctttagcttccaaatagaccaaatcacagtaacccaagccacccaccatgccatttgtttcttccttcctttgatcatcccaaagtgttgccaaaagtgtgctatggtatttgcccataatgtcaccccaccattgatagcaccttgctcatacatataaaaataacatatttcatttagtttctatatgctcactataactagttatttcgatttttttactagtgagaaaacctgcagccaaagaataaatgttctgcagattccacactagatttgcatagaacacattttaaatccgtgccattcagaatgatgtttcttttttccaaattgtccactgtttgaatccagttatgcaccaatctctacgcaaaacctttgatcttcgatggcaccaacaacttccacaagaaataaaaaatttcgcttcttccacactcccaacctcactcaactcactgtagacttctctaaccacatatactccttagatttccactcccatccatcttgtgtattatgatttggccgaaattcccctatggtttcccacaatttgttgaccaaatgatgccctcctccatgataagttccacctccaaccctccccacaccaagtgcccacctccgatatcgtagcttgtttttgaaccgagtttaagaaaaggcaattgaattttgctgataatttctactcaccaacccacaaagcattccaaaagc

SEQ ID NO: 2534 - DNA, 1253 bp, Glycine max
  Soy_ogl_4980 Gm15:10918887..10920139 Cluster 10
attattttatatagctctttgtctcgttttgttggaacaacttcagcccaggaattcattttaccgacattatttgcatgtttgattttatttcttttgttctgattttttttttttttttgtcacaaaagaaaggaacctcgttggctttacatcaatttggttgagcaagagattcggtcaaaattttgacgtgtccaatatcatcgtggaattgtcagtcatttctatactttttaaaagcgttctgattggtatttgtcttatatacaataaaatactttactaaatactaagcaaataaatatatccaaaacttgaaaaatacctagaaacataattttgaagaaaagttcattttcaaaataataccgaagatagacaaataaactttggattaattaagtaataaaattgaaatgaacgttatcaagtactaataatgtaacacacgaatccaccgtgtcattcagcaaaccatttagttctactaagctggtgtactatgtacacgttacaggcagtacaaaaaaaatgtacactttaaaggaatatataaattatacttaattaaaaaaacctttaaagaaaatgcataaaatcataaactttttttgtgtgataaaaacggcttgatactgcatgtgaatgttacaacgatctgaactaagttgacacatcggaaccatcaaccaaaagcagcacaactagagtattattaataaaaaggaagcagaataacaaaagagcatggaggacaaagccaaacccatcagagaatcaaaagcaaaacaaaacgacctagacctctaattaggtaaagtttgcctatcattttttataacaaataaaaaaagaagcttcatatgtggaatcaaatcccacctattcacagaagtactgtgagtgtgagtgactaaaatatttgcacatgtattcccttcacgaaaaatgtgtccaacgaggaagctaatgcctttggtaagcttgatacaactcttccacttgtttctgatacgccaaggggccatcaatgcatatttaaaagcttgaaccaccaaaaccgaaccacactctagccacaactttctccaaccctttaagtgagcaatctcaataggcaagatggctgccattagttcagcaaagaaagcaatttgaccaccaaggaaattagcattgtgatctgaaatttctttccactcccagaatcacatatggaccaatagacgtaagtgatggtagccactctc

SEQ ID NO: 2535 - DNA, 1500 bp, Glycine max
  Soy_ogl_3925 Gm11:36755101..36756600 Cluster 10
caattttatgcatattggtcaaactcaacacgttgaaacttatggggttatctgtacaccaatgaatcatgctctaacatggtggtgtagatagtaagaccttaaagcatccattcagaatacaagtataaatgtatattacaataatatagttgtgttatattttaatattttaataattatttggttaaataaataaataattaaaagagaaattgaaagatataaaattatagattacaccaaacacacttgtatgcacatgtacacaggcatatgtacatattagaacaacttattatataacattgatatataattttgtggcctaaaaatctaaaaaaataatgtaaaattgatgatcaaacgttattttaattattttttaaaatttatcttaggcctcctatgctctaactttaatctgagattaaactaaacttttatgcaagaaattatctgaaagcaatccttggaaatgcctacaaaacatccggtgacatatgtcacaaaggatttcatcaagaccatgaggggattacgtgggcgttaaaccaaaactagtatgtgtatccgcggatttagtcgaaatatgatggtggttggacaaagctatatccaattacatcaattgagctctccacattcagggtcatgtccaaaccttgtaaacttcccgtaataatatcttaggtccacggtactttattcatagtttaaataaataatataaaatgagtgtggactttagttgatttactttaattgatttcaacaattataattgattaatttattgtaattattttatggtacaacctattaaatagtccctatctctattcatatttaatttatttatgttatctgaactcatcatcaagtgagtgagacgtgagattattagtaacctgagttgtttatttgattgttcttttattgatattaatcaattattggggtgggtgattaaatgaaatatgacctattatgttatttgttggtaagcttggaggctaggctaaagtggatgtttggaataggtgggagtgctttaaattttgtccgcaatgaagatatattagggtaaagccaatttgcaagatgaatgataaagaaaaacatccaggactgcaggagtgggggaccacgaaatcattagaaatgtagtccctgctagctcccagactttgttaatctgtcagcaacagtattcacgctttgatgcatgtgacgaaaggcaacttcccatgggtgcttgaggagaatccttacctcatataagacatccttgtgagcatgcatgtccattgcaaaacttgtttagagtgtcactaatattaaacacatctaaacaatcaatctcacactccaccagagtatatatatccccaatctcaacacttctagaggtcaccctttaaagccaaaaactttgcacaaagagggtcactagggccataaaatttcgagaaaccaaataaccattctccttgagtc

SEQ ID NO: 2536 - DNA, 1034 bp, Glycine max
  Soy_ogl_2403 Gm07:37767304..37768337 Cluster 10
aatgaagagatccattttacttctttcaccattttttcgttaacaccgtcaatattttaaattataaaataattaacttaatatgaagtagctggtgtgttgtaattgtgacgtcattattttcttatacttgatgtgctttctttctttatagtaggggaaaaaatgtctttcttcccaccacatttatccgaggagatgctctctccaacataagttttgaataaacataacctttattcaatttatgcacgttatcaataaaataccaagttggtttcatcaattaaaatggaacatgaacttgtacccaactagtgtttgtaacattgatgatcataccagtgagatgcagtactgtaccgttgtaccaaaaaaataatagatactactgaagttcatttaagtatctgttttgataataaaaaaaagtgtatatatatatatactgtatttttgttatttgaataacaaatagttgatacgtactatataagaaacataagaaaatcatcaagatgatgatatttaatattatgataaatttaaattttattttaaaagtattcttaaatttaaatattgtaagtgatagtttcatttaatattcatatttataatcctatgataaatgttaataaataaagttaataataaattaaaagtataaaagaaatttaacctttaataaatttaaaaattaatcattcttttttataattagaatcaaaagaaaaatttgatttgttatttatatataaaattggaaggaagtagtattttatttaatataatatttttttaataaaaaaatacataaaagtattctttaaaaaagcaacaagttattctttttttcgtacacattgtccaagactccaagtactactagagcgtggttttcactcgatggaaagagcagtgggtggtagcagtaacgtaccccacatgcacaggtacaacctgcgtagagataatgttggggtggcatgaaaaccacagagaagtgcagcatgggaaacaaaggaagggac

SEQ ID NO: 2537 - DNA, 1410 bp, Glycine max
  Soy_ogl_3903 Gm11:35522401..35523810 Cluster 10
ttggagggcgaccccttggctttggtgaggacatagcagtacttggggggaaaggaactttaagcttagatggccttccacatcctttttttggtgtggcatttggtaaggcttcatatagttgtttttccaaaacaatatctgacctctttctttcatcttgttaaggtggatactcaaaaaggttgagtgtgttggtgcaactcatcacaaatgatctttatgtgctttgatatcgttgatttattttcaccattctcacctagagcttcacttgcttccattatcatctacaacagaacatataaggaacacatgtatctttaatatatgattttttttcaataacgtaacttgtaacatgtcaaaattatagctcggcttaacgagtttgtgagaaatgaaccactttagacaaaccaaagaagaagaaaaaaaagacaacacaatagtccaaagaaaaaaaacttgtggttttgcttgaaattcaaagaagccaagttattcttttttttctcatttaaagatgctacataattacaattagctaagcatatccaacatctaaagaatacaaccacaacaatctacaacagctgctaaattatcatataagaaaacaaaaaaaaaagacttttttcttctaagaggattaaaacttaattaaaaaggtaggcacacaattaaaagagaattcttgttttaaagaggcgtgtgagtgaaaaaggttaaatcaattataaatgcataacaattaactaactatacaattttggagaacgggcaaaaaagtggtaattgagctcacctcggtatgggagaagtgatgaaagttgactaatttctttgattgtcattgttgcagatgatgaagcagcttggatgtgtgctacaccccactatgaaggtttaaaatttccaagaaaaggaagaactttgatgtgaatgacacttgcagttacccttcaggttagatttaaaggcagacaaatgaattaaaattttgcataacaaataaaaaaatatggaaaccattcatcttttctccccttgttcatttttcaaggccgtggatgacttagattcacgaaatggttgatgatcatacgattgagaattcattatgtgggatcactcagattgatgaagtagtaggtgagtgttcaggaatttttataaagtgcccttctttattagtttttcttgcttttttttttcatgaggaaaccaccttaattattacttacgcttttttttctttataaaatttgggcattaaagtatagaatactaccatgacacgaaaacatgtttttatattttttttaaataattattcaaagttttaagggtgctcaaaaagtgttatacccatgatgcctgacatatttagcaaaatcactttcactg

SEQ ID NO: 2538 - DNA, 1200 bp, Glycine max
  Soy_ogl_1539 Gm05:1996401..1997600 Cluster 10
atttattttttattcatatggatcaaaatatatttttatttgtacaaaaaataattataaaaaagttattttattttacaagtaatactaaacttgtagacttgtacttgtttaagtataactaaactttaaaacaagaattcgtttcacatcagttaaaaaatcgaaatttataaaaatacttcactaaaaaatcaaggctctaaaaacttgcagttgtttgaaagaaatatggtgctaaatccataatggattacttatgaaatcgaaattgattgctatctcatctaaatttagttgttgatgtttttcttagtttcaaatgctaaaataaaagcggaataaaatttaagactaaattagtcaattacttaccataacacctggcaatctgtggcatgccctcagttgcacacgtgtcgtcaacataggcatatatacaaatataagtacaataattgtactttttaataaatcttcttggctcataatatttttcttaaacatttttcctaaaaagttcttgagtatttttcctaaatgttttactgtaatatataaaggatttatcctacttgtacatatatgataaaggaatgcatttaatctttatttttattctttagttatcaatttttctctttatcaaggagtaaagtaacttggtagacaaatattttattctcacgatttattttatattgaaagtcaaaattaaaattttagattccttaattcagaaacataaatcagtgtgaagttgtgtcgttgatatctaattatctaatttatatatgttggctacagtacaatttaattttttatctttagccaataaaccagcttctccggtttcaggtgtggggtctctgatgagtcagaagagaagcatactgagacagcagcatatggaaccgagtcactgagacggatcagaatgtcagtccaactgggtcaagggggctatgctgaataatagtggtaatgtcgtgacattattgtttcatttgctaagttatcgtaacattcgtaactcacatggatttaacagtgcccagttattattatggctccaagctaattttgtttagttgagaattgaaaaaagggatgcaggaaacatgatagagtttaacatgccactttgatgtaagatgtttcaattttattaatttgaactgagatatggacaacgattgc

SEQ ID NO: 2539 - DNA, 1085 bp, Glycine max
  Soy_ogl_2899 Gm08:45070201..45071285 Cluster 10
atatggtctatggatcggactctccattttagtctttcaggcaaattcctaaaccacattacactttacaccttatgactaagaagaatagtaatgcaaaagccctaacctcatctttaacgatacacaggaaacccaatggccctcaaaatcagcatacaatgatgaagcttgcattgtccagttagcaatacgggaaaaccacgtgtgggatggctccattctgatacgtagggcaatgaaaacctctttgctacattacatgcaatattatcagggtatactcaagcaatgtggaccttagtaataattcattgtgctgtgagcagtagaagaaaaaaaagaaaaaagacttatactattccttccataatttatcactaaaatggctaccttttattcctctctcttgtatttattgcctttttaggcaaagcaagaaagatttgtgaactaactaatgttaattatttttgagccattgagccacaccttcggtgtggttaataaagttgattttaatgaaattattttttagtcgttactcattaaatatgatgaagatgttatctaaaataatctgaaagatatatgtatattaaaaaaatgcttgaattttttttaagaaaaaaaaaaacaaacagggagttagtgttgactgttgactactccacattttgacattgggtttggcccacccagtattggtggtggtggctctcatgtgttttacaaatttagttacctcaaggtagtcctttagaagttttcttctattgtgatgagaccatctttgccttttgcttgtggtgtgattgctactccaattataaaaagttgagtagcccacgtgagaagtcttttcaatttagtgctccacaactgtacctttgtggttaatgagttattttcagtatataaacaattattatgggcacaggttcaattgaagatgacgataaaacatgcaatcccaagatttgagaggcagaaaagttaatcttgttgaaagaagagaactagaatgaatggaaataatgagtaaaaataggattataaaatataaattaaaggtgcttgttcga

SEQ ID NO: 2540 - DNA, 1150 bp, Glycine max
  Soy_ogl_4470 Gm13:35965301..35966450 Cluster 10
ataagtatcagagcatgttaggtgatgtggtaggtattcacaattataactagaagggtcccagcgaacagaaataacgtgcttcgcaaagtgtggtagcaatgcaattgtgtaatttgtgtttctcatgttataagtcagttaagattaccaagaatttatttgaatttacgaatgattaatgattttgataagatgtttttaatttattttaatagtcttttagctaaaatcaatacatatactataaactgtgaatatatggttttgatagttttttttatctaaatatgttagttgttaatttttgttagtgaaaaaaaatttaaattcattatcttttttttcttttatcattaaatcaatcttattaatttcatgtaatttttaggatgaaattcattttttctcattctcttaaatagatattgttaatgttttttagtatatattttaaaggcatatttcagacattatccctataattagtaataaaaaattaccttttaataatatcaatccgaaatgcatgtgagaatattttaagacaaaatctggcccacgtggtacattttctgtcagactaaatcaatgttacagttcaaggccaaggataaagcaatcaatttatgtggcatggatacctcctaaggaggaacacagggtctatcaagatcaatgtcgacgatagttctctggggaattcatgtgcttctggttttaatttggtggactcttgatcaatgaagttttcaggttcttgcggtatcacgacaaatataaatgttgaattacatgcaattttgcatggtttagtgtttaacgttggcttgggatgttggatacatgagtatttttttgcgaatttgattctttagtggcactccaattactgaaccaacaagatattcatttgcatccttaggcatctattattataaaaggatcaccaacttcaaaagcacatatatagagagggcaattagtgtgtccattggttggtgaggcaaggatcttcaacatctttgatgttgtttttagatatttgtccgactccgatgaatcatcttttgttggttgatgcatgtagcacatcccttggttttttttcttcttctgtagtttaatttcccactaaaaagaatattta

SEQ ID NO: 2541 - DNA, 1235 bp, Glycine max
  Soy_ogl_3991 Gm12:4274766..4276000 Cluster 10
tattaattaattctgtgttactgtcttgttttgttagtatgcaaattaagtttcaacgttttcatgagtctttttttcttgtttagtttatatattgaaatctggtcatgtcattcgtgttatctgacggttttcaaataaattcaattcaatttgattgattcttccgtccatttggtgccggggaaggtgcacgtagagaaattaactaaaccaaatgaatgactacggcaaccgtaatagattactgcaaggtgagaatgaaattggagggaacagaggggaaaagatgaagtttccattagttttaatctgataaaattgttttttatttaatgtaattgagaagtgtgtttaattagtttgaattacgtatttacattaaatgtactttctatttttaaaacaaaataggtatatataaagacatttggggagttgccgttatcattttcgctcaaaccttcaacgcgaattttcaaaaagataggtattcatcttggattttcagttcaagcccagataatgacttatccaagtcttttccagagacttttggttcgcagcagcaattatccaccagaacttttttcttgacttatccaagtcttttgattcgcagcagttaaattcaaagcatgcatagaattagcttaagaactaaaataatggatattattattaaataatctgaagattatttatatagttttattacattaaggattatttagaagagaggataatactttgaagaccaaattaatggtttatccttgtattattcttttaaaattaatatcaacaaaaaaaggaactcaattctctacacaactttttatttatgtgagcataaaattttatactatgaataaataaaataacaccttaaatatgatttctaaaataattatcttgaaaaataataatcttaaataatatgacaatctagttaatactaatattataaaaagcttagctacattaatcaattaaatttttgttatacatagtaggacacgtcaatctcaaagtaagaagtgtcaaccacaacaacaagtaaattgatatacgctgtatgcaagaaaaaaggttatctaacttacttgggttaatcaaccccatgatagataattggttcaattctctacatatttaaagatggtttatataaacaacaaggtcaaacaaattgatacatagttaggtttcttaagaatattatacggggttgg

SEQ ID NO: 2542 - DNA, 1223 bp, Glycine max
  Soy_ogl_4902 Gm15:4132778..4134000 Cluster 10
gatagacttgataattaaaaagttctcgaaattaagttttcatctttgattataaaatagctatcttaaaagaatagtctttttttgtggtacataaaataggatattaagttctgtaaacatacatgcacaaataattttatatcatatcaggaacggcaattattgtggaaataattatgcgatgttatatctccatatgcctcattacctgatacctgcccgtgaaattaaattgccgatgtatgaacgactagggatttctccttgctcattattactaattaggtagggatagcaggtgggtcctgtttgacaaatagtaagttatccattttcatcagtcttccatccatgatatacgacacgttaacatctttaaaactaatccttaattcacgcattaaatatatttttgtcgtggaaattattttattattttagtttttattgttttcctgaagtattctctttttagaagtaataatcatcctgttgaagatactgtgacactgtaaatgcgaacaaatatttgaaccttaatttttcaagttgtagaatactaattccttctgtaattaagttcaaatatatgcataattgttgttaattagttttaatttttaattagatcttatttcttttaagtcttatatatttatttttattcataaaaataaaaaaattataataactcacctattcttacacaatgatcaacttaactaaagctcaaaatcttatgtattacttaaaagaatatattataatatcatgttttgatatgtatttaatacaaacgcaaacctataacttaatactacgtaacactagcatttatgtatctctcttatactaagctgagtaaatatgtgataactaataacagcggaaatgtcgtccttcgaatttcaccattagtggccgtcatgagatgttggccatcttgaccatagatttaccaaatcagacggttgaagcgatgtgtgcctgaatatttcttaacaattttccttgtggaagcatcattccaaagcaccttatcagaatggaacaaatataatgaagtaagacaattggctaccagtgtctagtgccacttgcttccttagtcgtccatttaaatttgtcgcataaatggaacaaatataatgaagggtcgatcgaaggatccgtaccatttgaactgtatattctatctgcgtagaattgcctagctgttc

SEQ ID NO: 2543 - DNA, 1038 bp, Glycine max
  Soy_ogl_247 Gm01:50418563..50419600 Cluster 10
tcttattctcacgctcctttcccttccctcctgaaccacgctctaatcccaatattactctatacctgcatccttggacttgctagtccaattactatattcctgtgaactcccaaaactttcaactttcatattccatcataatattttctctctttaaatacttttctctaaatcattcaattgtataccagtaatgtattctgctgtgtcaaagatcatcaacaatttaactcaataccggtgttgataatgtcctaaaaacttatccattttttggtgaaataaaagacttatccatgttatatgcacaagtgtttcaaaatataacaggttctttttggcaaaaaatcaagtatcggactaggcaagaagatatttcaactatggtaatccaacagagaatggagaagagagtggtttcaaaattaggtcaaattaaaacattttcatagataatgatttgagaaaatatattattcggataattaaaaccctaacttagtgatgtcaggaataaaatgtgaatgttatgaacaactctgttgattcacattttttttttaatgaagatcaagccaaattacattcgtattaaaacatgaacgttctgcacaattccactaactcacaggaagatgaagtcaaaaaaatattaaggattaaaatgcgaacattgtggataactctaccaactcacaattttttaataaataccaaaccaaattacatttgtattaaaaacttgttgtgagcaactctattaatccacaagaaaatcaagccaaaaatcattagaattagaacatgaacattgtggccaacaccactaaccccccaaaatattgttgtggttaattacatttgtattaaaacgtgtcgtgggtgactccactatttcacaagaaggccaagccgaaaacctttgggattaaaacatgaatgttgtggctaattctactaacccacaaaaccaagcaaaaaaaaacattgttgtgtttggctctactaactcacaagtgtgaatgtgtgaccatc

SEQ ID NO: 2544 - DNA, 1203 bp, Glycine max
  Soy_ogl_4477 Gm13:36185001..36186203 Cluster 10
ctttttctagaacttttgttgcgatcccaccaaaatgaattcattatcttttgaatctcatgtgcaaggttgagggaagaagaaagacactcatatagtaagagggaataacctgagccattgatttgataggacttctctaccgaccttagataagtgttttcctgaccaatgttgaattttctttcatattttgtctgttaagtagccaaaaaaatatttcttcttcctccccaacatggatgacattccaagatattttccattgccaagacattctaagattcccaatgctcctgaaatatgattcttgagaggtgcccgagtgttcttgttgaaaaatatttctgatttttgcaagcctatagataggccagatgaggtctaaaaagcactaagaatacttttcaaaagatcaacttttttttatgatgccttgcaaaataaaaaatagtcgtcaacaaaaaataagtatgtaaggagagggatttctctacacactttgataatgtgaagctctcaatccctttgcctcaaaattttctaataatgatgttaatctctccatacatataataaaaagataaagatagggggataatgggttcccttatctaagtcttcttcttggaagagttggtttaactttcttatcatttactagaacatgaaactccattgatctcacactcatcatcatccaatcaacccatctactatgaaaacccatttcatgaagaatagcttataaatatgtccaatcaatcttatcaaaagctttattaaaatcaacctttagagcaaattcaccctcctcacctctcacttaacttttcacgtggtggatggtctcaatggaaacaagtacattatccatgatagagggttcttcaagaaacattggttgttcttttgaaatacaacttggaagaacaattttcaacctgttggcaagcacattggatacaattttatatggcacgatgcatacagaaataggccttaaatctacgcatagaatgagagttgtcaattttggaaatcaaggctatgttggtgttatttaaactttgaggaaaaaatcttgagtcaaccaagtcacattacggtgaaaaatatcatcactgattaaatctaaaatcttatttaaaaagctgaattaaaatcatctggccggaggatttatctgagtgcatttcaaaa

SEQ ID NO: 2545 - DNA, 1000 bp, Glycine max
  Soy_ogl_76 Gm01:3261101..3262100 Cluster 10
agtttggggatacaagagagaggtattgctgagttagaacccaacaatgctaatgatattaataagttgcaaatcaatggatctaattacaacaatgaagatgacgagactaagaaattgcatatgctcccaaaaagaagactaggattggaaggaaaaattaatgattaatattttactttgtttccttcagtttcaacagcaggtagtacaaagagaaaacaacgaaatttcaagcataaggattactatataagttcaatacctgaaaatcaagtgagtgactaaattaagaaattattttctcttgtttcttactactttatatatgtcaaattaatttgagtatctataataaacattgctcgttaacactcttttttctgaatttgaaatacgttatatttatcagattatcccctttgatactccaagtgcatgcttccaacatcaattcaaatcagactgtataagtgttagaagaataagacttgaccaacaatcaagttgacaaatgttctgagtcagtcatgtttgatgagaaggctcatgctcatgtggagaatgacaatccacatcttcaacaagattaggatccattgctgagccgggagcatgttagtgttttgttgaattagaacaaaagataagtgctttggtttagactagagacaagctaaagcgagtcttggactattgtgatgttgaatataacaagctaaaggctcaggttgcaaaaaaacaaagggtgccagaatgcaagactatatcatcacaaactttgaaggactcagagagtacatcttatttacaaagtggccctgaccaataagaagaaaccagaaaaaaaaaaaaaaactttttagccaaacgattattttaattgtcgtgaatttatgcacatgttgattaggtcttagcaatatgctcttcttttactgttttcattattttgtcacctttttacgttgacaatggaccatttggttattttgatgtt

SEQ ID NO: 2546 - DNA, 1000 bp, Glycine max
  Soy_ogl_3334 Gm10:2960201..2961200 Cluster 10
ataagatacgagttataattctctctgctcatggccactcctattcaaatggttattatttactaactaaaacgaagaaacgatttcggaaacagcttctttcttggcaggtaggtgttttgcgtccgagttacttaattttgattcgttcaatataatccaatatccccttctagtttcaatttcaaccttcaaagtgcatgcttagtcaaagtcagatgccaaaggttttcttttaaactaaaaaatagcgacacgtattacataggtcaagacgcagcactggcgtgacctctatatatatgtgtgcatgtgattctgctttctccactacattcacaacatagatcacaatctctcattttctgtttccccatttcaagacagaataacacaacttaatttgtacgtgaaagtacatacaaattaaagaaagtttcaattcgttattacatatatacagacatgtctttctcttacggttacagaaggatcctcttcatggttctgcttatgatgatcatattggcctttttgttggttttgtctcctatatttgaagcaacgtgcaggccattacaggaagaactgttgctgaagcttccaagaggccctcggagaatatcaagtcccgatccaattcatacatgaaatacggacaaacttgcgtacatggacaactaattctaatgctataaactacgtactatatagtttcttacaagtttcaacagttacaaatatctgtataaactttatttttcttttggggtttactagatggaaacagccttagaaaaaaatgcttgatttccctaggtattttcttctagaactaggtatttctttaagtcgtaatacgattctctaaatataaaagcatgtagatccaaattcagaaaacgaccaacaaaatggtgaagatcataattaagcaatttgagataacaaaaacctgagactaagcctccaaggctcccaagatttgttcaaagaacaa

SEQ ID NO: 2547 - DNA, 1000 bp, Glycine max
  Soy_ogl_6432 Gm19:38628801..38629800 Cluster 10
tgtatagaaatgttacaattataatctcaatgaaatgtaatccacccaaaagagagacaaatcatctaatatttataatatctttattcaaactaacaatgagggttgagtttagccgaaaggactagtttctcataacatagggaattaagatttgaattctcacttagagagatatccacatttaaggtttaataacatgattgactccgaaagagaaaatttgtaggaaatcaaaataaacttcatttaagttttttccctcttccaatttacgcataatttcatcaagatacacaaacttgtgccacctgttttcacacacctatgaaattgtttaggacttaaattttctttgttcccataaatatttgcatcatagatgttcatattaagcaacaaagcaattttaaccttcactttggctttattgttctattgtgttttgcaaaagtcaaacccccacttttgtgcagacaaagaaacgaataaccgaaactaaaacacggaagctacgcaaagctaagaatcgtatatgggcccaattattggtattatattgggcctccacattgggttcctgggtccacgctattttgtagtagtaatttatgtagaacaagacaaacaagaaaaggatagaagaaaatatttaaagaatctgagcatcaaagtggaggagtttgtgtgccaaactaaaaaaaaataaaaaaaattaaggattaattttatttttttttataaataatctctaccacgtagcggacgagattaaatacgccacaagtggccaaaatattcttcggaccaatgcaaataaactccataagttacacatttgaaatggattagtagagattcttcaatccctaataaagttctgcaaagcacaatcttttgcatatgaaattgtcagagaatccacccaccgatctgtgacatgtgttaatgtgttttgcctttaggacattatatgagaataagagaatagagtgggaaa

SEQ ID NO: 2548 - DNA, 1000 bp, Glycine max
  Soy_ogl_6815 Gm20:37725101..37726100 Cluster 10
gatgtactgagtacttgttttattagattggaccgcaatcaacgttttttgtccattctagttctaagctgaaacaacgatatacctggcatctataatcaaattggtcatgtcattaggtggagtagtataattggtagggagttgtggtctcaaccccatttattatcaacaccgcatgacaccttggccatgcacgtccgtttgcgccactgctcgttctcaccaccaccctcatcaaacatccctgatctgcatcaatttggacccattgacccagattttcaccatcatcatcagctttattctcaaggaagaagaagagtgaaacaagcaacaaaagcatagttccattttttattgaaaaaaaaaaacaactaaatcaatacctcattgtatattatataacagaattgtgttttcacctcttcagaaaataatgaaaatattattctattgtacaattatataacccaattatatttccgttgttttttttttttacactccctccgtgaataacaaaaatgaaataggattgtgttgtacaactccatgaaaatagtattttcaaaaaggaaaaacaaaagtgtcggccaaatccctaattagtaggatcaaaacataaaaaatagactagtaagttcaacacaattgatagataagtgaattgattaagcatactgggttcgattctcttatggtgtgtatggaacaaaaattgtttgaagagacaaaacggaagtggtatctattcttagaagtttaatttcatgactttcaactataaaatatctttctttttagagaaagaaaaaaaaaagcataaacaaggtgaatttggtgcgaaaaataccctcaatgactattgacaccattcgtaggttcaaacggtttactgatcttggtgctattttgatcctctctctctctgataagaatttttagaactgcactaacaataactatctgcaggtctcagtgactacgcggtggctgt

SEQ ID NO: 2549 - DNA, 1100 bp, Glycine max
  Soy_ogl_6234 Gm18:58005701..58006800 Cluster 10
taaatacaatgtatactttacttgtttattacataaaaaatttattaaaaaataataaaacaaatgttgcatgagataacaaatctgtcactgaatttacgctattaaattaattaacaccggacactaaatcaaatgctaggatcattcgttgaaatagtcatcaattatcagttgttgaggtccaatcactgaaacagtcgttgctattcagtcattgtaatagttgctgttcccagttgctgaaatagccactgctattcagtcactgaaacagtcactaaggacaattagtagaagatcaatcactgaaccatgcgcaatagaagagcgaataaggttatagcgactcaaatgttagtcgctgatctatatagcaactgatttgtcagaaactattcacctattttcttgtagtgccatcatctgtgattgtaactcaaagatgatcatggacatgatttaaacagacaccaatcctcttcatcaccacacaccaacatttcaccttatccagaatttggtgatgcatgattggacagttatgttcatgcacacattgagtgaggaaaattcttgcggggagtggttaattagtcaaatatgggtattttaagaaatgaaagaccaattcattctatcaataattggatctagtgtatcataagaaatttattttttctattgattcttccggattgagtacaaaatattcacattaaaaaataatgattaatttttgttagaaaccttaaatactcataaaataagtcttttttctttcatttcatatttaaattaaaattcaaactctaaattacttatttaaaacagataaacaacaaacagtttcctttcgagttaaaccaatgttgattttttctcacatacctacttcttctcctgtttctttaaaaggaaaaaacctgcagcaaagcaaaccagggtccacgggtcttggaagaggaaaaagaaaaaggtacgaactacggaagaaattaaagggcaattaatagggacaattaattttattttagactaggtcccacgattttttttattgtaggtcccatgatttttattctctcatattaattagg

SEQ ID NO: 2550 - DNA, 1235 bp, Glycine max
  Soy_ogl_2165 Gm07:3659201..3660435 Cluster 10
tgctatttcaaatcattacagggtcaatatatttcgaaagtctagatgtacacgcaatgcgagcacgttcaaactctggcttggtaaattttccatcttcacccaaacaaaaaactcctaataagccaaccacaaaggaattagaaatatgttaataatatattttcaaacacccttttttttcaatattcctactgttttaacaaaacaaagtgttccaaattaattgtacgtcattttacaaaaatgaaagcattaatttttttttcatgaaatatacttagtcggagtagttgttacttggtagtaaattaagaaaaaaaaataattaattagaaagataaaaattatactcgaaagttacatattatttttttcataaaattcaaaaaattattacctgtgtcaaaatcttgaaatttgtataaaatgaaacagaaaaaatatgaaacattctttcttattaaatgcaaatcattaaaatttataagtttcactgataattttatataaattttaataaattataacctgtgtgttaaaaagaatgtattagagtctaacaactcttcaagaatgatttttttttttttaaaaaaaaaaactcttcaagaaattatcgaagttgggaaagaccaactcaacacctttctcagattctctttcatttccataataagagtcaaagcatttgacttagctattcatagctagcactaaaataatgacaaatgaaaatcatgaaacccctaccgaaaaaagaaagaaaaagatcttatttttaaacatttaggagtgtatttattactacagatcttatttgtaaacatttaggagtgtatttattactactatggataaatttggggtaccctacccaactggagctagctttggttacctggcatgtgcggcaatcaaaagagcctctctgactaatttttgttcatatatacactaaatttaaatgctaccaccaatcaatcatgtaaatcatatgttttaaatgttattctaatttaacaatagattttaagttcgaatcccagatacataactctattgaatatttagaaagaaagatttatcacttataataattttatgcagatcaaatataattatttcaagtaaaagataattacagtttagacacacaaaattaaatgctaaacataaacatgctagtcataaaagtatttgatgaatattcatattatttaacatcaagagag

SEQ ID NO: 2551 - DNA, 1700 bp, Glycine max
  Soy_ogl_4829 Gm14:48947301..48949000 Cluster 10
tgggacccgattctatgcctgtgatttgacagaatatggaccgagcaaaagccttcctgtgatgattaattagtgagagatttttttactgcttaattagtgatagatagtcacatgacttcattgactttttgttttcatgtgcatcaattgaaaatggacccaacccaacacattggagcgtaagatgctcccaaattgcgttggattggaatgctcctcccatccagcaatgccttgaaggttaggagcgcaatctaatcttgtttttttggtagtggaaagctgtcaaatctaatactacttctgttattacttcattggttcattgcttgttacaatgttaaatctgttattaatttaaaattaaagcaatggcacacaagttttaaaatatattatatgatttttaatatgtgatatgtcctttttaatcaacatggttttatttattgaattataaagcagatacatttaatcacttcaataaatacttagtttgattctttaagaaaatcatcaactcaatttagtctttaaaaatacttatgatgtctaaaggttcactgtctcatataatactagacacccctcctcgccattcacagtccttttttttttttttgaatttcttatgatacttctattgaattattttagtcactgttaacaaattatgtaacaacaaaattgataacatgataatttgttacattgtcgaaaagtttggtggaataatcatgtacatttttttgttttgttaaatgtgttctttaatcgcttattaacttgccttgacatcaaatactgaagtatctttttatcatgattttttttgtaaaaaatagttgttttgcatttagatacaaattttaaaacatataccaataaacattgctttctcttaaaaccttttttttttccaataaccatatattaataacttctaacataagtggcaattctactttttttaggtaacattttattttatttaaagtttgcaactttgtatagcttagaaatcgggctatttatgtaaaataaaaaattatatagaaaattaaaattccttttctggtctgtagtatagtatgtacaagtaccgggggtggaacacaaaaggctagctaagtgtttgcacatttggaatgctatagttggcatgtgaaccttcaacgaactgtaccttattttccagtacatgacctactcacgaaaggacagattgagctatatagataattccttataatatgcgcatcttcttgtattacttggctcacacaaaccagacatgtgcatttaaaacttcagcacacgcacacaactgtacgggagaaaggataagcagtatcacattttataataaatttttctttttttttcaatgtccgtgaatagtccttattattattcgttactggtgtgtttggttattttgggagaaagaaaagaaatatacgagaaataaagtggaatacgagtgtttagtttaaaataaataaagaagaattaagaaaaagaaaaataaaaaaatcattgttaatttatttttgcaatcacacaggaagtagtatatttattttttgtttttgtagatatgttgagtttcttaggagaaatatacgtgaaaagtatgatttacaatgatattcatccttctttgaggttttcattttctctgtttcatattgatt

SEQ ID NO: 2552 - DNA, 2078 bp, Glycine max
  Soy_ogl_5476 Gm17:3422918..3424995 Cluster 10
ctcttaactaataactaatgatacatataaaataatgttaataaatttgacttaacaaaacaaatgtgtaagtggtatattgtcttgtcaatctatataagacgtgaatatcaatatatctcataagaaactaaaattgtccaccaaaattactatttaacctaaacaatattagaattaatagtcacattaattctcctagtagttatattaattaaatagtgttttaattaattttcatttaattttatgcatatgtattaaatgttttatattaatttaatagtttgtatttccttgattttcattaaatgagatgtatattatttttttagcatgtatttattaaatacataacttttttttataaggaaatatataaggtcggtcttgtaataaagtgaaaaggaagggaagaccaatatggtgggttcgtattccccctgacaaaaagtacatttattgaaaaaaaaaaacataaccttttgtatttataaaatttattgtaatatgttgcaattaaaagacaatatttcacactttaagtttttttttttttttgccgaagcccattcactaggatgattattgatttcccataataagtgattcccttccagcgtggttcataactatcatcatcacaagttagaggcccttagaacaaggaaataaaaaaattacagtgacaattccaagcataatgaaactggattgccttcttctggtgtttgttctgtttacttatatggttgcgaggagaatgaaaggtaaaagcagagtttgggtccccatcaagaacatagactcccaagtgatctttcttgtcgtagagtatgatttgcgaaccggtcagaaactcaatttggagaaggtgatcaaggctgagactcggtttgtaatgggaacctgagtaccggctcatcatctccaccaccaacaatggatcctccttgaacaattatgaagtagtcatgttggttgatggtcttttctcgcaccttatttcctttattgttgtttatatttttttggtgaatggaaggggaaaccaccaagaacgatccattaaaaaccatgaggaaacgtggtagaagataatctgccaaagctacagttgataaaaattgaggaacagtctcagaaattcgtagttgtctatctagggacaaaccaaacttggttaaacaatcagccacttgatttccttctccaagctataggaacttcaatatctcttgacttaaactaaagcatggatggtaagtaggacatccagtagagagctatgtaattgctacttgcgagtctgattctacttgaaattgttggaaaccacgactccaagcaatctgcacaccaattttaatggcccacaattcagccatgacaatagaacaaaatccaatatcagcagaggagagaataacatgacccaaggaatccctgaaaactccttcaattgcagctttctttaggattatggccttatgggtcttttgctggtttttattttaatttggttggaatttcttattaatttttaaaaataaatgcattaattaattaacaagttataatatatatatatattctacttaataaatggagagttatgtagttagttaatataatttttagaaactagtacaacaatattagctgtcattttatatttgagaaactggtataagtcacatatataaattaaaatatatgatccaaaatataatgaaaaactatcatcaatgtacactattttcggggtgaatcgatgaaaaaagagataataaagaaacaaagtagataaaagaaaaatttattatagacgtgataaatgatgtgaatgtgatggaaaatgaagaaaaagactaaaaagtgagttgtgtgaaaaactagatatacattaattgataataacccaaatataattgtgaattcgactcctttttctctaccatatttcttcatgcatgcacatacgtttcagatcttactaaatgaggcaaaataagctttcttttcttttctttggtgaaggtacgaagcagtaacattaattaaagaacataattaag

SEQ ID NO: 2553 - DNA, 1215 bp, Glycine max
  Soy_ogl_1444 Gm04:46713970..46715184 Cluster 10
tcaaagagagcaaattattttcatcttgtgtaagttttctggaaatcccttcacccacactataaattataaacacactgaaagttattttcattctgtgataatttttaatacattttaaatgcgtgtgtcttattcacgtgcatcaataattaaccttcgaatatgtagataaccatatgtaactttttcatagttttcgacgagtatgtttattatctacgaagagtcatttagaatatgtttgttgaacattttaataggattatttttaaatgatctttttactgcgaaaattatttttaaatgaattaatattaaagaatttgttttaaaataatttgtgtttgagaataatcttaaaaaagtgagttgagaaaatttgtattattaaatgataaagtataattatcttttaaaatgtaagcatatatataatttgtatctcatatacctaaaactatatttttacgaaaaaagttttaaaaaaaataatttcttgatcaatatgactctcaatataattttttttttataaaatatcaaattctactaaaaattttgggtgaatttggggtatctttgatcaagagccgttactaatccaccgagtgactgtttttcatttaagaaactaacctatctcaccatatattaataaagaattaatagcatatttaaattaaatgaaaaactataaaaaaaaatccatacataaaataattaacattttgaagtcattttttagtttttaatccatatctatataattaaagagagagaaggggggagagagagaaatatatatactgcaaaatacatacaaatcaatgttatgttaccttatcgttactatatatcaaagcagtctagttggctatgttgatataacttagaaaaaggaaaagagaattggccatgcatgttgatatagcttagaaaagggaaaggagagtgaaagaactgaaaaaatgacctaaacatccatcgggaataaatagggacgttagtccccctctccatgaaacaatataatccgtctgtctgtgttcatcgattaggaatagaggttaagaatacattatagtatctttcttttttaatccttccaattgtcttttaacataactgtgaggctctgaaattgacaacattttggatgcagtgatgctaatgatgtaaaggacttgaggtcaaaacactcataattttctt

SEQ ID NO: 2554 - DNA, 1500 bp, Glycine max
  Soy_ogl_5295 Gm16:4455401..4456900 Cluster 10
tcccttgtcaaccaatttagttgttagctatccactaaccccatttactaatgagtagtccttccgaattttgttcaatttattgttttaataataaataaataaaacactcttatcccttgaaaattcggaaggactacctcatgtctttgaatttctcatggttgactttttggatggagactttacaaattaaggtattaattacgagacttcagctatataccaaacaagtcttaaaggttttggaggattggacatatgtgacagtcaggcctcctttagaagattgaattaagttaccttcatattaatcataagaaaaataatatagtaacaaatttaaaattttatactttctcaaattgacatcacaaacatgtaaatttttcttttaatccttaacctatcaatgttttataaaaccaattcttttcagtctagtatccagtagttttgttagaaatgttagtaaatggattcaaacctgctacatctcaatcctcttctctcttttttactcttttccaatcattggaattttgatgtgacttaatcttaaccttatatttaccttacacgtaatatacattgttcattaaaaattgaactaaaatcttatactaatactagtattaattttagccttatcatcttatcaccaacgtgattattataaggatctataaaaatcgcacccatattgaacttcaagtcattaatattaattggaggtggtttggatacgttagttgttcacgcagtgaagtatttctgcaattgtgggaacatcaagcacaccctatgttctacagcgagaagggctcttcactcttctttagggagatttttaggataaaattgttgctacttgtatagaattttattgattattccaaacaactcgagcatgttccttttttaattagaaaaaggatactgagttttaatatttcattcatttcttaaaaactaaagttgtatgttacgagaactcagatgaaatttcatcggattactcataacctacacaattaattaatactttaaaggactagaggtttaatgatcaaataaaatagatattgaatttatggtatggtattcattttgcaaaatgatgaaaaattaaggtgatttgatggtcttttttttcctccactattttatatatcctttgataaatgataaggctggtagtttcattttcctttagtacgaataacacacacaaagttacaccatcaaaatttaatctgcaatttttttatttttggcgtaaccatattaaatttcttatttaacatttaactaatccttctactatcgtgttagccttttagataaagtaatattttaaattataatttgatgtccaagccaagaataaaatcatattcatgattatttctgaacgtgatagatgtagagaggattccagcaagcagagacggccttccatgagaatcagaatctataatcatctacacaaacacttcg

SEQ ID NO: 2555 - DNA, 1240 bp, Glycine max
  Soy_ogl_5635 Gm17:10485261..10486500 Cluster 10
tttcttaagtatttgaaacaattatttattatcttatcatttccttatttaaaattacattttttttggttatcgtatagatatagactcacaaaagctatttacaaatctataacgtcaaatctattaattaagtttaagcttaatttattgcttgcataattaaatttaaagtcaagcttaaacttattaatttagtaaaaaaaacaagttagttaattggacgtttaaccagttgacttcaaataattaacaaataataattcaactcgtatacgtccacatacaaacttaccttacttccaaattaagttcgataattttcattacgctagttatatataatacgtcccttattttgaggtttaaaaaagttgtttgttttgttttgtacaactttcttgtataaatattaaaaacaactttttccaaattatatccactttattaaaaaataattgaaaaatcttaagaatactttttttttttttgggtggccaatcttagtgtactttgattctattcaaccgaaacaggttaattgctaaatgctaataacatatgtacagccaaaagccaaaagtttttgctattgatgcttgcggtgtttgctgcattgaaaatgataaggcgaacatctccaatattcaactctgtcagagcttcctaactctcttttgatgatcagtcttatctttaatctttatcttattatatcatttttaagaatactttaacgatgaaaccttataaattattttacttttttatacttcttcaaataagttttaaaaattatttttcaattatttttaatagttaagacttaagagcatttgaaataatggtcagaatcctcaacttcttggaaaacttttaaaaaatttatttattatttaaagttaaatacacatttaactgttctattcttatgtgataaattattatatgttataaaaaaataaatacatcttattaatataaataatactaattaatttttttaaattatttttaattatacagttttatacaattacaacatctggattttaattctttttttataggtcttatcattttatgaactttaggaatttttcactcgaatgacataattctttagtaactaaaaatgggcttcaagtcatctaacaaattaatgttcctttaaaatgactctcataactaatgggactgggttggatttagtagaaagagatggtcttttagaatataa

SEQ ID NO: 2556 - DNA, 1800 bp, Glycine max
  Soy_ogl_5842 Gm17:41471801..41473600 Cluster 10
ctctagctaacaactatgcctatgctgcatgctgctgtattacactcatgtggaatataactgccagagttaataagtactacaagaaaatataattttttaattataaaaaagaaaaacatatatatttacgcacgctttttttttctttctaaataagtactaatgtttgttgccttccatttttttcctgaaacaaactcactcaatttcgttgaattaattaaaattgaaaataattttggagtattgataggtccattagcaactgtttttactaaactgtgataatttataaaaagaaagtatggaaaataattattagagtaaatcacactggtttctcttatatttaaaactaattacattaggcattccttattattttacccctccagaaaattctccaaatttttgttattctattacactgacacccctgcaccacgagattcttgattttgttaacttaaagtggtcatgtgccgtgacatgcatgttttaatgaaacatcctgaccaaattgcccttgtctacatttatgttgaaataaataaataaaaactaataaaaaaaagatgaaaataaaattatcaactgttcaccttcatcacatagttattaaactcggtctgccccggccgatcaactaaaattggtggattggacccatttctatcccaggccgggttgctttgtttacgggttgctaactaaaatcctatagaaaaaaaaaaaaggaaatagtaaccaacccaagttcaaacacaagacctaggctccacaactcaccaacaactgaagcaagacacaatagttgttatactctttaacaaatttaatatatatattattttacagatgaatttttcaaaaaggaacttaagaaaacttgaatccaagatcttagagtgctttgaaagttcgttaatcattaaaccaacatgaattttttgaataaaatatataataaattataaattataacatatattattcttaatatcgtcccactttttatagtttatactgtattaaagataataataatattatgtgtttatactataataatattatcaaattatattagttacattattttttaatatatatatatattagatcttactatttctatccgattttgataacattggttggccaccctaaagcccgtttgaaacaaacaccgcaaaacattgaatcctccgccgcaaggcttctcggtgcacacaccaaaccatgttattcttgattgggtggtatgaataaaagttcatatccgtgagtttccttgtgttttttattgtgtcgattccaatctgaaggctattttggacatttcactaaaacttagcaccctccgtttaactgtgttggcttgggggaacaaaagtgatgatgcatttcaacatatatagtcttgagtcaaataagtccaacacatgatatacaaatataatttgctctaattattaattgttttgaaccaaacatatatgtatacgctgtttattttaattatcctgctcaaagaaatcaacggttctcctcgatcgtttagttgtatccgttggatcaccgtccaaagttcacacgtaaactacaaattttaaaggaaactccgttttgttcagaacaaccgaatggttttatacttatattataaaggtttttttatggtatataaaggttattttacttattcagtaaaaaaaaagttattttactttataggttttggaaattttttttacattgggtccttaaaattatatttgttttactttcaaagtc

SEQ ID NO: 2557 - DNA, 1182 bp, Glycine max
  Soy_ogl_3944 Gm11:37293819..37295000 Cluster 10
agaattgcacgtgccattctaaatggctttgtttcatcttccacttgagaatatcacaaaaaaacacttaaccttaagttcatacatgttccatctatccaagcctagaagcaaaacttaaaaaacaatgtgactaagtccaaaattcaagggtcctacttaattaattccctccaaaatataccggaattgtgaaccaaaacacgaatagagtttgaacttttatttgaaagcgggagcatagcgatcatggaatatctagaaaatcgaaaaacaactagtcttaggattatttttttaccaatatcaaactaatcaaagtgattaagagagaatgaatagttttaattaagttaaaatttcatataattgttttatatgagtttttatgtctacttctcttggtaaattttaaataaagagaacctataaaagtcaatgaaaatatatttaaataaaaaaattgatgcatgacctatacttgagaggatcttcactcaagatgtcagttttaagccaacattttaccttggcaaagttcggtgaattgcactaaggttccaaaaggcctgaacaatcagtggcagatgttggtgatatggaaatcggtaatatgtgtgtaagcatgtagtcgtgataagctcaagtatggttgaagtagagtcaataaataaattttaaaaaaaactacatcatgcataaaaactgtaactttagacctaagaatagacatttaatctaacaaaaaatttcatctctatcgcatcgaatatcatagtcaaaaagagagataaagtctaaaggggagaatcttttcatcaataagtgaaatagtaagaaatattacatacacaattagtgcaaacatgtttggattgaagttagaaatattatatacatattccattccaatacaaattcaacaaataaagatcataatcttttgataaaattacttttactcaaaagtactttttcaccttaaatctaaatatgcactgaatccatatatgagaaattatcggcaatttgacgaagtcttgtgtggtaaaatgagtaaatgactcatgggacactaattcttgtaacagtaataataatatataacaagccaaggttcatgaaacattaaagaaaggttttgacgcccactcggaagccaacttgcaattccgtccatcc

SEQ ID NO: 2558 - DNA, 1174 bp, Glycine max
  Soy_ogl_1583 Gm05:3611901..3613074 Cluster 10
attctatgtcatggccctacttgtgctgctatcttaataatatatgaggttccatttgattattgaaaaaaatattttaattacctttttttatttaatcgatgtaagttgatttctttataataaaagttttaatttaattctttaattttcaaaatcatgtcaaattttgttattttcatctaattgatcaaaatatataatcatcaaaatgggttacaatcgacaagccacccgatccatcacaaatttgaatcaggttggattattttttttccatttcatttatgtataaaatatgacccacctgacctgtgctgggctatgttgactagcgaaccaaagacatgttaatgctacaaaaaaaactcactagtcacacagcacaacaattatgattaggcttgaccttttttttcactcttttttcttgattaagttattattcttgctttcttattattaattaggcaattttttttttccttttgagcaacccatcttcgactgacttgacccactttgacagctataggtgttagtgaaatctgacacgtgccacttttactcgttttagccaccaatgccattctaatcaattaaacataaatgataatattgatgtaatttttaaaattaaggaattagcttaaatttttaacaataaaaagaccaaattgaatatataaaataaaaattgagaaaaaaagagtattttagcctatttatattaatagtttaattttcgtaaaaaaaatgcatacatagactaattcaaaacttatttattagagttttatttttgtttaatgaagtgatttaatagtcattatttgcttctatgatttttgaataaaaaatctatcaattatttttttatactttacttgaaagaataaaagttattatatatcatctaaatttttgttattatttttaaataaggttttattttaatgaccgtttttattttaacatatgcagtattactagattgtcgaaataaatatctaattttaattaaaaaaaacctttaagaaactaacgtaccgtttgatttgagtgttttttttttctaaaaataattttcattttcaaatttttaagatttataaagcatatatcaaaaataaaatactctatggtgttttcatttcttcataaaaattaaaaa

SEQ ID NO: 2559 - DNA, 1817 bp, Glycine max
  Soy_ogl_6558 Gm19:44267501..44269317 Cluster 10
aatttttgttgggattctgtcccacattttgtttcagctgcgcagtataacaacatattaagtctcccaaactatagattcacatagtttgttctttatgggtttggtttgctcctcatatcttttgtatttctcttttatcttttttggaatatattttttttagctcaagcgatgttaacataattgggatgacttgtattattggaaggtctattgtccaaggtttatttaaaaaatgaagtttatttgtcaagttttttcaatttatggttagaataaagtatgcatttaaactattcctaattttttattaaacaaaaaagaaataagttttatagtttgtaacatatgcatgtttaaacaaacaagatgaatcaatcatcttactaggatgataaacaaagtgtgttgtttttacatacaattgcatcatcctacaaatatgcttgtatatatgtatatagttgtactcttctttcgaaaataaagataagaagcaatgtcctcatcaacttaaaagtgtatcaaaaaaatctcataggaagtctttaataaagtcaaatgattctaaactacttcattaaaagatgtgataactgcaatataacgtataatagtatacttttctaaacaaaaagagttttgttctatgttgatgatgccaatacaaaaaaaaaaaaaggaaaatgaacattttactttgtcttagtaaaatgactagttagtgaaagacattaaatgtttcatttaatgcaccaacacttgtatttccttgagctaaaacaatgaaatcttaaccatcttataatacagacttccaacttgcctatgaatattagagaattcaagaaaaaataaccttttgctcgacttatctgtgatctatgacattattttttcacatgttttacttgcaaattcttcaagtgtaaaaaataaaacacttgaattacatttgtacattcatcttgtcaatgacaaatagtcattgaactttattctttaccttttcttagcaaaaatagtaataaaacaaataagtttgattcaaagaatacttggttgtgagttgaagaggcttgttggtaaataatacttagaatgttgtttggagaaacaagtcaaataatactccaaccgagtctataaagagatttgaattaaataatacttataatagtgttgactagtagtgaaatatggacctatctacaaataggttaggtgctaattatgagtttttaatgaaaagtcttttatgaaaaaacttgttcttcttataacccataaaaattcaaattaaaaaaagttaaagagcaatgtgttttgattgtttaaaaaatgtagcaaaaagatccttaattttgacacaattttaaatgggagcaaatttcttaagctttttaaaaaagagtgtgtaattccctatgaaattgtaaattaaaggagctaaaaatgacacctagtaccgtgacataaggtgcttcatggccatgtgaggttacccaatttacttgattgggggcaccaacgccctaagactcttcccttgaagtatcccgatgccaaataatcttgacaaaccaacactttggtggtgcttcaaacaatgcatttggtctatttttttaagtcattttaatctctacactttccttctttattgcctaaacccaagtactcaacatcaaaattaagaaaatgagtaaaattctaactaaattttgcgcaattaaatttaatgacttattttttagtgacagcataaaatttatttcattggtctcaaactaacttaacatttggaataagta

SEQ ID NO: 2560 - DNA, 1200 bp, Glycine max
  Soy_ogl_6559 Gm19:44282901..44284100 Cluster 10
cttgaatttcgatcatagcatcaccttcgacggagcatgtgagataattccatgtaatatgtattttttctgagattttaaagaagatttaagccatttattgcaaatttagacgtagattgatcattaaaaaaaaatgtacgtgtcaaagtagaagaaaccatctagtttacttttccaaaatttagctagttagaattctacttttatatctctctttttcttaggtttctatgttgggtaataaataagggaagagagtaagtgtaaaataaccaagaaaagagaccaaaatgcagtgtttcaaacacaaacagagcgttgactgcctaggatgagttctaagaagaccgagactacccaatttttcaagcagaggctatataggtgcccaagtaatgcgtgcctaacgacaacctcaaatttctaatcttaatgcttattcttatatattcagtttcacataaggaattaaggtggtgaattatggatgaaggtttaattgttgaatgaattagaaaacccgatagacatagcgagaaattaaactaaaaactcaaattagaaattacaaattctaggtgaaatataatgaaccctaatcttaatgttttctcccattgcattaaaccaatttcttgcattctaacgtattaaaatattaaacccaaaagtaaatctttctgttttctataaattttaattcttatttttcttcaaaccaatcagtcataaattatcctttttgtttccaattaaaattacgcttggtaaattctagatcatactttgatccctaagaaccagagacggagccatagtagatacaaaggggagcaattatcaaattgtttattccttttttattattattattcaactagtaatgatagttataattttttatatttttaacaaatataaatataaatttaaaatatttaaaattatatgaaaaggagatgaaaattaaaattgtaaaaataaattttcccaactatagtgggcggaaaaaagaaaaagaagaaagattagattacacaaataaaggacaatacaaaaaattcaaagctctatagtagtagaataatgatgaaatgggtgattaaaatataatactaaagttggtactaaaatatagaaaattcaagatgttaagactcttttttgaaacaaaatgctcaacatggtaaggggatc

SEQ ID NO: 2561 - DNA, 1450 bp, Glycine max
  Soy_ogl_4560 Gm13:38845251..38846700 Cluster 10
aaagttaaataagagattttttatctttattattttaaaattttacataaattactttatgaatataattcagaatttcgacaataatttaatataaccttaggacaaatttatatatagaattggttaaaaaaagtaaatcaaatttcaaatgcctaagcaaagttttagagatttgagtaaatttgcttaattttttgaaacatcgattcttattgaacggatatcaactcaactaaaaaaatgtgctcatcatatatttcaatacaggagtatgtaaaagagttattgcatcgtaaacaaaaaagttttgagccataaaattattacttgaagtaaaaaataaataaatattattacctgagccataatagtcaataagttattctcttaatataattttattatattattttgttctaatacttatttgcgccaaaagacatcacttattatacctatataatagtgggagatttattacctacatgtaaagtgaatgattttataaaacattcatcttttataaatttgatataaaaaaatgtaagaggggcatgccgccttacttcacaaggtagctccacttcaacttagagcattgggttaaaaaattaaaagaaaaaaatatttattataaaaatcataagagaggataaagaagtcatatacaacataattttacgtattccaataaaaaaaattcatttttattcctcaagggtgttcacctgcttaacctaaaatatatgcaaacttaaaggattgagacataacttttagtgagtaatctaagactcattatggtaggcaaactcttcttccataaaaccatttctcaactctcatgattttacctctcactaaaacttgatcctatttgtactcattcttacaactattgtttgcaccgaactcaaacctcaaacttgactgtgtctagcgtgcaaaattaaaactaaaatttatttcacatcatgtggaagtctattttttcctatttttagttttttttcttttattatttcctttcccagtttgtcccttattccaaacctaaactcacaatttctgccatcacaaagaatagtctctttcactattcatcttcaacttcgaccaagtcatctgccaacacttgcctcttccaacaatttcctgcgcagtgctttgtgaccagacaatttttggcgcctactattttactgctttttttgttcttcctcttttcccaaaattgtgttcttccctcctcttcgaccacaaacatcgacccacaaaaaaatgcatatgggtatgttgaaacccagataaaaaaattgcatatggatatgttgaaattgacataaaaaaatttgcgagcttgttccattaacaacacacatttctcaatacttaagcaccaacaatttcatatttaaaaaagagaagcaaaactcatatatagaat

SEQ ID NO: 2562 - DNA, 1200 bp, Glycine max
  Soy_ogl_2283 Gm07:8177728..8178927 Cluster 10
gcctagttgctatttttttaccattcatccattgttatttatagatattaaacgtacaataatttgaatagataaaagagaagaaaggtatatgaaaaaaaaaaactataagaacaatgcatagttaaaggaattacaatgattaacccttaatatgaaaaatggcatcaacagctattgaatatttgaaaatggataaaatggtgaaattttgaggaaagggaaagatgcgacgagcgccgacgatccaggcgggcaagacgtgacacgtagggcccaattaggatgtggctttctccatcagctcttgtgttttgcgggacccactccctcagccgcatcaatgctaatacggacgcgtaacatggaaatgtcagtggttgcaagctaaacttagaattagaactctgaagccttcttcttcttcaaacacataaatgcaaaagaagaaagaaatgactattctgtgcatctttgatttgaaattggaaatgatgtacacatctgaaaactaaataaatacccacttaataacaatattttgataggagagtctaactgcggttaccactaagcttttgtactttggacatttgacatagatatggtggcctatttcatagatatatggacccggttgggatgtttttatcttcattttattttcacactaccaaatatagaagtagattctatcttataatgataataatgtttcaaaaaggaaaatattttttaaataattcaaaaacaatttaaataattattttattaaaataaactaatagattgttctttttaaaactctgagagcatattacattttaagagatgcaacaaactatatatagagagagaaataggaggtaaaaggaataataaataataaatactacagattagttaactttgataaatttaaattttattagttgttagattacttgatttatcataatttttaattttattacaacattaatgactaaagagggagttacttttcaaaatataattttcagctaatgagtatgtaattcttttgttataattaggatgcaaaaatgttatattttattttttatatataggatcagtataatataatatcatcaaaattggtccgattatcatatcaatgaagacattgatttaagagttaatggttcaatcggacttgaatcaaaatcaaatcaattt

SEQ ID NO: 2563 - DNA, 1400 bp, Glycine max
  Soy_ogl_4145 Gm12:38163401..38164800 Cluster 10
aacactttgagtacagctattatgccagaaaccaacattagtgtcgtgtgtacagcttatcctccatccctgtgtcaaaacataataaaatcataaaatagacatcatagtaagggcgaagaagagaaattatcaaactcaagaaataaaatcaattttctttgtcgtgaaagcaacccagagttgcttcaccttagaattgattcttggggccgaatcgattagaagaaatgaaaccaaacatgtgctaaacttattgaaatcacgttgaggtaacaattacgtgcgtctaatgagaagcgtaaaaccaaacacacacttagtttgtgagaataaatatgtcttaaaaagatccaacaatatgcggctaattgaccgaaagtggatacatagtaaaagttgggtttctctgtttggtagaaaaggaaattcacaatcaaggaaatttagagtagatgcaaccaaaattgaatctaaggagatacactagtcttttattacataatgaattaatgatcaaatttttgttgaaaaaaaatattcatatttagtattggacaataaaattgtcttttagaaagaatgcatgtgaggaaaaagaaaaaaatagaagtgaacttaacatttaaattctgcaagtggattttgaaaggcttttcttgtcctttgacagttttactattagtttgtggaattgtaagagttattattaatcactgtattatttatttttggtacaaattagcccaagtgaagtagtgaacggaagaacacttcattccaaatttccaagtccacatgaatggtttggattcttattaactaaatcatctcccaccaacaatatatcttttatattatattttaatacatgggaagagtgcagcaattatttaagttgtggaaacttctggtttactgaattatttaattttattttggcatttcattacaaatttttgtaggtttattattagttcattacattcaacggagaaatttgttagatgattaaggacagctctcactatcggattgttactggattacgtaatctagtcctataaactttattctcaagatgtcaaattcttgatataaaagagtgtaatggatatctcatatatacaagaagagaaataatccttacctaataggttacttttgtaggattaagttaggataaaattcaaattctaacattaacatatcaaatttaatcatcttgccggtcaataacaagtgtcataaatatgcatatctttttttcatatgttgagttaattgatttcaggaatagtattaaattaacctaaattattcttttagtctctttttttattcaatttattttatttggttgttttattattaaaaaatttaatttaatctcttacttt

SEQ ID NO: 2564 - DNA, 1272 bp, Glycine max
  Soy_ogl_1145 Gm04:674529..675800 Cluster 10
gttagatgttaaaagtagcattttaaccaaattatcacataatgaaacaataattgtgctacttccaaaaatcgaagggagaataatattaacttaaatttaatagttaaaagactaaacaatttttcacaataaaataaataatcaatatattttaaccttattttaattaaaagtttgaatggtttcgtttttttttaataaatcgatcaattaataaggttttgggattaatttataaggattaatttataagcatcccttttttttaggtcatttacaagcattcttaatatagagtcttgttgggtggaggaaatttttttctttagaaaatattgtcatggacagatggtcttgtcaaaattggggcgatgacgaaaggtggtttcgagcttttgcctcaacctccgacaaatatgcatatataatgtgtgtttgaatttaagttcaaaatatgataatgcgtttctatgtaaatctaacagaaagtaaaaagtgatgacctttatgtaaacatatatttacaatcttttactcaagcacacacatagtttggttgtcttagccaagaagttcttattttttgtttctttttcatactgtacaaaacaaaactatttaacattagaaagcgtacaaatatcatttgaaaaataaaacaacaggaaattaaatgcattgacaaatgacagcatcactttttttaatgagctcctttcgtgctcgtcggcaaacacgttaatttgtatcattagaatgacgttaaataaatgaataagtattttcatcatcatggatatatgtttgattggattagaatataattaattttgcctctaaaatcaagtttgagcagatataatgaattcaaatttttgtactaagttgaaaagttacgttatattttattattaacttacttttagaagagatcattttttacaaactttagttcatttatatttaaatttttgcaatcgctcacctaaagtcacactttgtcgttggccatcgtcatgtcacgattatacaattttgttcgctatttctttatttccacaatgtggttggaacgctctcatgtcatttgcgtttgaacatttcgccgttttgctaacaaacgtaacatcagtagccaaaaagcctacggaacatctttttgtacttccaccggcaattcattttgggcaacgcgcaaattaccaagtcacccaaatgcaacacatttcgcccaaacaaaagttccactttgtaggagaaataaagtaa

SEQ ID NO: 2565 - DNA, 1175 bp, Glycine max
  Soy_ogl_3252 Gm09:41054263..41055437 Cluster 10
tatcaacaatttttttaacttacaaatattcattttcttttcaatatttcatattcttttttctacatctacatacacaaaatgctaagcaacctataaaaataattgcttgtatataatttttgggtgtataatgaccacacaaaaaaaaattaaaacctcttattaaatgtaatcaattccattttcatttgttttattcatattaacaaatcataacagatatttattgactattttatgtagatactagataaaattaaggagaattttaaataaaataaaattgatgcagaaaaatcaaatttaattaattttgacaaataaaaggactaaattaaattggaaaaaatgaaagattaaaattgtacctagagacataaatagactataaggataaaaactaaaataaaacggcttttaatgttaagtttttgactgaactttataatttaattgggatattttggataagaataattttaattggattttgacatgatttaacttagaacatttttttataaaaaataaatatttaaaaatgtaaatttcaattttaatttttcacgtgcggtgtactctcttttgtgagttcattcttattaatcattgcattatttttcatatggcacatcccaatagaaaatcacgtttatcttgtaccacataatcattcattcatgttagataatatctaacgtatgatatttttttttgaaagaatctagcatatgataatcaatattttttttcatatacaactcaactcataattcaaaaagaaaactttaaaattttaaagaaaatcaaaataatcaaaatttaacttagatcatacttcttttaaatgcaaatatgtgtcaataccatttttcttacgtcaatatatgtcaatacctattaagtaaaataataaaatgcataattaaaaaatagataaattttaaaaatgttaaaatttcctcagaggcaaaagaaggggaaaaaaaaccttagatacaatgagaaggatggattgatagcacgatttttgaagaaagaagaacaactttaaaattagtacaaaagcatggatttatccataaaattattttgtcttcaacatttcacctttatcaaacactggaaagcaaagccaaaaaaagttataatgggacatgaaaggtgtgctc

SEQ ID NO: 2566 - DNA, 1205 bp, Glycine max
  Soy_ogl_1243 Gm04:5742679..5743883 Cluster 10
atttttaagtaaaatacatttcataataattctaaaaaattgaaatgaataagtacacatatataatttattgaaagcatattaaaggtgttaagtagaagagggtggtgtatacacaccacctggatatatggattaaggctcgcgaatggcccatttaaaggtgaatgcaagtttttgagaattgttattctcaactctaattttgccttcctcgccccatgtgcttaaaaaattatttccaaaatatcacttataataggaaaatgttttcgttgtatagtttccttgtgaaaaaggagaaaaaaaaaaatacacatatttatatagaatcatatttttgttttgtaaaaggagatgaaaaaaatacgtaacattatgtaagtattcaacttgttaaaaaataaagtggacaaaaatgaaattaagtcaaaataaaaagattttgacatggccacggtttcaatccattcaaaaatttctgccgtttgtatgcaaattgaaaattgctactatattaaagagaggagtgatagatatacttagataggtttaaaattaaatctcgttgccatcacgttacttgcaaaaatatgtaacactccaaataattcagcctttcccattagaaaaaatcgagtcatcaaaagcaacgtatcccttgcaagcacacatgataatgcctttgccgtattaacttcgtttacttaagtccattttttattcgtacccttcggatacatccgataagtccatttttcattcccttaggaggttaataattttattaacttagtatttactatttaccaagttcttattcaacaacaaaaagagttcataagtttgaatatgagatttattaaaataatataaataattatttaatatttttttgagcaagttgttttatctattaaaattaaacttattgaaataaattaaatatatatacgaagtttaacaatcacttttatatgcaaaaataaattattttaaatgtctaaaatctattaatgacaatatacagcaagggtttagttttggagagtaaagttatatattgagaatattaaataattttatattataatccaattataaactttcatgtatgataattttgttaacttttataaaattattttaaaagttatattaattgtgatttatgatggaatgataatgttaaattattttacatt

SEQ ID NO: 2567 - DNA, 1400 bp, Glycine max
  Soy_ogl_5539 Gm17:5704501..5705900 Cluster 10
tattgatattttgtaagattgtacgaatttttagtttgtttcattgtttgcaataaatttatttataaaagtgtttgtgtaataattaaaggagtagtgtgatgttaatgtgtaaggggtggtagtgtattgttttttaaataactaggaaagttagtgaaagtgaaaaaaaagagttctctatgaagaatcaaaataagaaaaaaaaagagagagagagagaattttgtataatctcataaaatattaaggatctaagtataattttctaatattaataatttagatgacaaaacaaaaaggaattaatctattaacttagcagagaaggagacgagcaatgctattcagtacaagcactctttagatgacaaaacaatcattttctttaaaataaattataactaaaaattgaaaaaaaaaaaatatatataaagcttttttatatgaaatgaaatgattaaatctaagtcttataataaaatatggataatgaaaatttaatatcatataattacttaaaaaatcatgtgagttttttaaaaaatcaagtaattattttatattaaatttaaatctttcatttatgattataagattcaaattttattctcttagtctcttataagatatttattctcataagtcatatatatatatgacaatttggacaaaaataagagtaccttgtgcaatgggatggccagctaggaagaactattgttcatcccaacgaaccggtttttaagattaaaagaacaattttttattgcaatggtgcacacttgcaaatgaaagcaatcgaggaaaggataaaaatgagtagatctgggaaggtgttgggtgataaggattggaaaaaggaaaggtgtatgcagtgagtcgaacaattttatttaaaaaaaaaaatattttaacaaaatggaaagtaatttcaataaaaaggcattattcaactgtaatgtatttttttaaaattttaatttgttaatttgcaaataaatgaattatacttcaagaagatatatatttgtcatatttattatttcaaaattaaaatacaaatgaattatcatttaaagtaaaattataaataagtgggatagcaggtggatccaatttaatttcatttttagagtaaaaaattaatagaattgagatccacaagaaataacttaaaaaaaaatcaattattgtggatgatctaaacactttggtacttaaaatacgaaaaccaattcgaaccgaatactataaactgaccaggccttgactaatatgcatcagaattttgatgatggattcccatggcagctcataaatctattggttggaggattatccatctccaccagattgcacatgttattttcctgaagaatacattcaagtttttaatt

SEQ ID NO: 2568 - DNA, 1258 bp, Glycine max
  Soy_ogl_5622 Gm17:9866085..9867342 Cluster 10
aaagtatttgttgagtgaagtcaactaactcttaaatacatttatatatgtagttcaagcaataatcaatattttttgtttctattaaaagtttaaaactattatttgatttcttataacaaggaaaaatcacattatgactagattttaaacttgaattgagtttgaagtttgaagtttgaaaggtataggttggtaaaccaaccgtttgaccttttgggggtattgagaatctaaagcttcaaagaaagatattagtattttactgcatcattctagagtctagatgtttccatttccacccaacaaaagagctatcattttcactatacttggaaagccgtcaacgtactaaagtattcaagtctaattttctacaatgctaaaaccatattcgtccgttaatatgatacgtagtagttttttatttgagaatcatacgtagtaaccatacattataaaataactataaatttctattctgtaggaattaaataacaaattaaagctctcccgttttatctctaattgtaaattgaatatacaatgactaaaaaaaatgaagaatttaaagaataagtcagagtttaaggtaagataagaacaaattctaataagtttcttttttatatattctttaacctaattgccaagcctttattggcctttttattttatgaaacattaaaatttaaagacgtcagctattccttaatatatgtattttttattaacgagaaaaatgaatcatgttaaaccaagcttataactctcgtcttcaattcccatcatatttaatgatcattacgtagcttcacagctttaatctgacgaactataaactcaaaatcctattgatgaagctaacttttaggccaataagaattccgtttaagttcagcctgaagaacagtagccgtcccaaccgcaaataaaagcacctgtgtaatttaaatattctataagaaagtcacatatacataaaaggagtatgcttgacaaaaaaaatttcagttaatttttatttttttattaattgaaaagtttatttaattttttaataaaattttttagatgccacttaaagtaatatttttaaaaggttaatttttatttttttatatttattatttgttgttcttgaatatttattagattttctttttaatattttcgtaaaatttgttatctttattttttttacattaagatttttcattttatgtttttattatacatgatattgatagtgatctac

SEQ ID NO: 2569 - DNA, 1283 bp, Glycine max
  Soy_ogl_63 Gm20:34585101..34586383 Cluster 10
cgattagctaacaatttattaatgtgaaaaatgtttagctaagagataaggcaattctattcaaggataatcatatttattgacttaaaatcatcaccaatatgaaaaatagtatctaagttatattgtatgacattatagataaatagtttgttagaacttcatttgatcattggctaatcttggatggctatgtatcatgtaaaattttgtttacttcacttctaaacgatcaatgctcaagtcaactcggtttatatgtttataagtttgtctaacatctaaaatggatgtgacaaggaactgaagggaggttttgttgctataattaaatggaagagttttctctccatctttggtcttgctgaccaatcccaggaatggaaagtgttcctatgtgctttcgaaaattgacactaaattgacatggtagaagactttgagcatattgtgtaagattatgcattgccgttttggtgaaaaactatagttgtggttaatgtgccaaatgatctaatcgagtcacttttggcatgagaaagatagattagtcaataatcttgggtcctaatatttttatactctaggaaagctcctcataaaatgtgtattttgacactaaataaaataatattactttaatttatagtgtcaagatgaattcaaaatttcatagaaacttatttataattaataataactagtaatggtaattttcatgaaatatttaattattttttctaaaaaaatggtacgagtttacaacgtctatttcacaacacaatccaagttttttagttgaattaaccactaaaactaacatataaattcatagaaaattcattcaattaaccttaatggtttagattactgttttaattgtaattatgatcaattaagttaagcaaaaattactgaaagtcaagatgttacataatgcttgttatttaatctaataaatgttttgtgatatgttatgttgttgtttgactcgatgactaggttgacctgaggcatgtaaattcaaaagtaataaaatgagatatgtaaaaaagaattaagctacatttgaattacagtttcattccttttaaaagtaaattttgagtaaaatatacgaaaaaaatatctttcttcaaaagtatatttaacattcaaaaatacagtgaaaacaattattacaagatacacttagccttttaaaatagatcttgatccttagagtttcatggccaacatgagcatagattattctaaaaaaccccataggttatagtattata

SEQ ID NO: 2570 - DNA, 1769 bp, Glycine max
  Soy_ogl_1753 Gm06:900401..902169 Cluster 10
aaacatgccaaacttacaattgctgagcagtaccactggagctgcagcgtgatatatctggtcccatgttagctatctgagagaaggtgaagctgaacaaaactcacaagaagaaataataaaataaatttcttctataagttaaaaataacttatacataacttaaaataagttttttaaaaagttaaaaacaattatcttctctaaaaagctgtttttaacttatatataagctatttttagcttagagaaccaatttatttaattttatttcttttttttaaatactttttgaaaaatttattcgggtccttaaaaattaaaagcgtgaccagtctacttttgttcataaaagattcaatgtacaaatgcatgtatgagaagatactgacgtacacacatttaatggcatgacagtgacaacttgcaacatcgagtctcacatgtttttacttttttaagagcttttgatcattttacccaagtccggtgcacatttaaatttcttaattgaactagtgttttggacaaacacactcgagcaattttttcaatccttttaactgatgcctatataactcttttatatagggataagatgcacttgtacgtattgtaacgactaatcgcacaaaaaggaataaccgaggaatatatttatcttataagttataacacattcatctccctgttagattacaattattccaaataactagagaaattttgccaaatactagctaattccttaattaacaaatggcagttctcatatctcaagctccttcaaattcgtcattcatgtaggtttctgcatattgttcaccaacaactctgatatttaattttggtgctcccagaatttcatacatgaaagaaggaagcccatatatagcttgaaaacgtaactagagaaaaataagatgtgaatggataaagaggggcaatatcacatgatggttttggaacaatcactaagaacaaagacacaaaagccttagacaataccatttaatttgcttgaaaaagacagaattttcaattcggcgaagtaagctagggagcgactattgagaagattatggactacagacaaatgtgactcggaagggagagaccatgagatctcaatcagtgtttagagtatccatatatgatgcacttaattcacaaagcatatgggtttgttcctgtttcttacaggcactaaactacctcatgtcattgtattctcaagttgttttatgtgcaacaatttagtatttatttgtgttcccctccaaatcccttgtaaacctactaaagataattgttgtctatatataccagaccctcttttctctcccctaatacacacacatcaattatcaattctgtttgatcattatctactttattagcaagtagcaatataaattgtccagtgtggattaaataaatgtcaagtagcagaaatatatttttgttttttaatattctagtgttcgaaaggggggaaaagtggcctagatgtgccaggcagcacccataagaaaatcaaaataaaacaaaaacataaacaaacaaacaggtcaagagagatgcaacgccatcaagattcatatatactgcaaactggtcaactatcataatcgaatagaaatttttcttaagcatatttctctctcttgaaatcattctttgttagatcaagagagatgcaacgccatcaagatttcttaattttcccacgctaagttcgttgttagatcacacagctcccctcccc

SEQ ID NO: 2571 - DNA, 1400 bp, Glycine max
  Soy_ogl_3947 Gm11:37409801..37411200 Cluster 10
tattattcattttaactttttgtaacaataaaaaatgtaatgagaaaaactaaaatagatgatattatatgacaatctatcaaattaattagaaattaaagtaaaagacattatttttaagaatcaaagttcgaggtttatttgtccttttttacctgtaatttgttcaataaagacaatgaatatctcgagaagcttttgtaagcctaagaagaagacaaaaagcactccagttcatacttcatagttcatacatcctccagtgttcagtgtcaatgcccatgaaattcagtgatactaatgttgatatatgcatagaaatatattgagattcataaaagatgataagacagggttaagtctatagtattttgatattatgtttgtaaacagtttttataatttactttttttcttttatcttgttgacatatcacttttttgtttcacatctaacttcttgttttctcttttcttcttgcaacaaatttttaaaatatcttttacaactaattgcatttatttctttttaccacaacactaattaattttatatttttctcttctcttccatctctattatttataagaaaattgcataattttttccatctctattatttaaaagaaaattgtataaaattaatatatagtataatttatcttcttacatcccctactctatccaatgttgcaatctctgaactctgaagaaatgagggacagctaacaaacgggacaatattggtttgaagtgacctgagaaggcaattggaaatactttttataatctatcgttggaagattcaaacaagaccaaggtgcaaggttttctttgttgcattccacgtacgtagctaaaaagagaacgtgcaattgtatcattggtccgtgattataggtgtaacttgaagtatgactagccattcttttaccttactagttcctttagttattagttaatttattttctaaagaattgagattttttagttaaaatttgggaatgtttttcctttatttccgctttttattttattttccctaattaaatttagtcatctttaattatgaaatatgaatttgtaaaattattttttgcaataatctacatatttgttatttaatttatgtcatgttatattttatgttaacatatctataccttcaatttttagagattatcgtattccatacccgaatcgttgcagcacaggcttcgacctttctcatgcgagtccaaatggatagatttcatgagaaaagcagcggttcagttaactacatatgaatcagttttttgtgcatcattatagagaaagtaatgtaaaaggaattgcatataacttgttgaataatggagatatttgaccaagcaattaggcgtccatgccaaacct

SEQ ID NO: 2572 - DNA, 1069 bp, Glycine max
  Soy_ogl_6746 Gm20:34520548..34521616 Cluster 10
atactattataaatatggtcaatttctatgttaaagttaagcacacatttgttatacaatgttgttctagtaaaatcgctaattatttaagtgtcaaaacatgaattacaagtacttattggagaataaacactgattgtctgtttaccactaatgagtaaaatatttcgatgaaagttattttaaaatttgttcgagtaatccttccacatttcaaacaatacagatgccaagattcataatttttattttaattaaatgaaatgtttatttttttatttgtttacaaagtagtgaaacaaaaaatgacatttcaatacttagagtgactataaaattgtaaaatcaataagaaaaattaattaaaaaagcaacatttatctcgtttcaaacaatattcatatttcaaaattcactcattttataggaaaaaaaataatgatttcaaattttacagaaataaaaaataaagaaaattgtttatcaaaacaaaaaatcgcttctggacaaaaaaaaatatatttaaacttaagattttcttatatttgtaattctacaaagtacaaactgtcatttcttcttttcttgtattattttttttcttcttatttcaccctctccaatggccgtttcaaccaaggctgccagctcatttaggtttcgattttgtaggagtgacaatactgggacagacttgtagaggtctcttgcaagttgcaatgatttttttgggcctgacaaaaatataattttgacccaaaaaaacgaggtaaacacaattcctatcgataaaaaggtaactactttctgcacatttcatattactttctgtacctaatttgaaatgtaaaattagatactgaaaagtctttccagaaagtaaatatttacattctgaaaaagcctttccaaaatgtaattttacattctgaattaggtgtttcggaattaaaaaggtgcaagaaacagcattggaggtgcaggatgtagctgtctgataaaacttcatgcttacttttagctagtttagaaattggctgttgcaacccatgcaaaaattgttaatcgg

SEQ ID NO: 2573 - DNA, 1400 bp, Glycine max
  Soy_ogl_2279 Gm07:8150901..8152300 Cluster 10
ccaaattttttagagatttatatatatatatataacaagttactacttggagtccaaataattagcatttagcacagtacatgagatcatatttaattatttattttttttcacttatttatctttgcatatatacacgcattttcaaaaaaaaattataaaaataaaataaagaaaacaacaaaaattgtcccatttaattgtaaaaaaataatccaaatcaacatacaattttttggctcacaaattaagcattcaggcaaggcctccctagttagaaaactaactctctcgcttgctggacgcattacatcagcccatgttacaggttggcaacgtacatttatttttagttcttcaaaaaaattaaaataaatactttcttagaaataaactagatcatacctaacgagctttagaaatgtaagttgggcagattagtctcatcccttaggttttgtgaatttctgcatttccatactatatatgtttgagtatggttttgtcattcttgtgctatgatatatttaaaaatgttttgatatacctaaaatatttttaatttgaatcaacgttctttaaatatgcctcatttgctaagaatttataagtatcacgaacttcaaatgtaaaataataaattataagtgtcacaattcacaagctagctagaacctggaatatagggagtgggcattatgactaattaaaacaatacaatacttttttgccaggttatgggttcctaggcttaatcttgtcctgacttctgaacacattctaatcttactcgggtattttgacggtttaaattaagcatttaaaaagagggtgcgagggaaatcaaatgaatagattattccaaaaaaaaattaatgatttttctgtctttaactgtttgtaaatcctttatttctgaaacactgcatgtaaatattttcttttaacatttaaatttcaaaatggcatgttactttatattgtcaaattgaacttgcatattcttgtaacctagaaaaattgccacccttccccgttacactcgctagtgaggctcagtttttggatccgagggaatgttgaaagatgtactggaaatggccaaagatcctgattgatcttataaacgttggaaagactagacattgcataagtaaatgatgtttgctcctatgttagaaaagagactgtcacaaattttagcatagaagtagaaatcccatccctttgtaagaataagctgcttaattttgttattgtgtcctgtttgcactggtcaaataatctttctctgctctcaggaaattgctgtgcgtgctcaaagtcacacaaactggaagtaaacaactagctaggaaaactagctttattgataaactattcaaatataataacaggtt

SEQ ID NO: 2574 - DNA, 1494 bp, Glycine max
  Soy_ogl_3940 Gm11:37148501..37149994 Cluster 10
atatatataaaaaaaaacaaaactttagatgagttagattccaaatactcactaaagttaaaatgagtttcaatgctcaaataatgtttttaagttatgtttggttgggatgagcaagatataataaatgaaaatataagagatataatttgaaaaagattaaataaaatagaaacaaagtagaacgttggattatttggtttatatatgagaaatagaatagaaataatattattaaagtagattgttttgagtgaattgtgaagagagagaacttaaataagttttataaagacttttgtatctttgtagctattcgacgagtgagcttatacaaatgattaaattaaatacactataatcgattatacagttgcatttaactgattatagccgtgcaataatcgattttagaaggaaccaacaagattaaaaaaggcatgttaaaaaagataagggtaggaggaaccaatcagccagggggcgatgcgatactactgcagtgttggttcgagctcaagaatggtgttgtcatgtttacagtcattcttggaggtttttgcgtttgaaagtctgggttgatcatggagacataaagatggggtgaattagtctttttgttgttaacgttcattatctccatggaaataactaacatgggtctcactaattcaaaattaattctcttctgcatctgttaaaagttaaaacaaaccgacacatgttattcttgttcgcacatacttgtttcggttgtcaaaattaaaacagtgttaaagtacttgcaaataatttatatcaatagcaggatttaaatacacatcctttactaaacatgggcctaaataacaatactagctaagtgaactaacatttgttggcatatgaaaatatttttcatccatatgaaagttagtctatagtcaatataattacacttgttgcaattggcccactatgttcgatcggttgactaactgcatgaaacgcacgtctattttggggtaaactgaaactgaaaggtccattttttaggctaacacacgacatcataaacatgagtttttcgtagcttgaagacatgcggggacttgtatcttttgcatcacatgatttgggaactcaaacatcattgtgctacatatatgatatatgtcgattgtttcacaacccttgtttaataaaccataataacaaaaggataattgtgtagtttttttttttactgaactgtgaagtgtaggcaattgagtatatagataaatccttttaaaaaaagaagtatagagataaattgtaaggaattaacagagtagagtaaaataaaatctcacattgtcttaaaaataatctcatataacaagttacatgtttaagcctccacttacacaattagagtgagaaaaatataaatcatatactccaaaaattagaaatattaacttaaaaaaaaacctctatcataaattgagatacattaaaaaaaattgtttt

SEQ ID NO: 2575 - DNA, 1533 bp, Glycine max
  Soy_ogl_1758 Gm06:1281401..1282933 Cluster 10
gagaaggttcttactgaatatttcatttattagacatttttagtcaaattttaacgtcaaatatttaaattgcttcaaggtgacacgtccaatcttctatgacgcataaacccaaaatcataggactatttgtttcaggatttacttttatattttcaggaatgttgatgtaagtatcattttcgtaagacttaattttgacggttagataggttataagagaattggatgaaatatgtatttgatattttttttaccctgtgtttcattatcactaaataacaaaagttagatattatattatatatttaaaactcagtaaataataaacaaatattatataaattatatttaaataatagaattgtttttgtgacaaaattatgtataaccttttaaaatgaatttcaatatgatttttgaattttatattttttaaaattatgtgatcacagggttaaattagcaattaaaaaaaagacatgaatgatgtcaaatgcaatacgtgaactttcatgtgatggtgaccctactagtagtgagattcaacatactccctcactgaaaaccaagttctagctctaaggcctctagctctacgactacgaccaacaatatcaaatttaaaatttacgtgtaaatatatcaacacacaaacggggaaaagtagaaggggcgagatttacaatgttagataaaacaaaataaaaaaagttatagtcagttaaataaaataattgattacaaaatgtaatgccttactcttaagatagttaaattatccgaatgattcctacaacattaccagctcaatcaattataaagttattaagtttaccatgcatgccaatattttattggatgacactgctttaaacagtgtttacatttgtcctcaatttataaactatttgctcttatatcatgtagctcaattattagttataattaattattgtttaattaatttattttttggaatgaaattatttaaaatctagaaactataaaaaaaagcaagtacaaacatttttttctctttggattgctcaattttttattacatataaaaatttatttttttttggtgtaaaagccttggtcctaaatagtgtacctcctcaaatatacaattgaaactgaccagaacaatcggtggatcccatttaacactcatgatatatatttgttcttctcttttccaccaattcatgcatttacagggaaattggcaacatagtagtctccgagctttttcttttcgtcaattagtcttcgagttaaattacataacagcattatttattcaaaagagaacctgaggaattgtctttaaaacatttgttagaaaaataatcagaaatttatgtaaatgttttttgagacatcctcataaaaaataataatataatttatcgtaattcttaacaaaatttgttatttatcttgaattaatatctttaaaatatacttacctccttattcagacgttttatcgaagatctaaatggacttaaaaagtgacttactggg

SEQ ID NO: 2576 - DNA, 1315 bp, Glycine max
  Soy_ogl_5785 Gm17:39555886..39557200 Cluster 10
gaaaaggagcaatagctggagtcagcaacgacgccggcggaggtctgcgtggagaatatgtcggtgggatctgagaaagaggccttcagacagaggagcgccgatttatccgaatcgggtgaaacggaatcgttccgcaacgtgaagaggaagaacacgaggaagagaaaggtttaatctcagttaaatgcgcagacacaaacacactccaccccgtcgacgtggttaccatgttctcctgtagctgagggtttggtgaagttaaaggtttaatcacagtacatcttttttaattttaatttttaatagtcaacgagttaactttgaacatcagttgattgatttggttagagggacaaaaaccaactgattccctaaaataaaataattaaatgtcttaattttaaaataaaaagattaaaattatagattaataaaataacaagaattaaaattacagtttagctttcatgaattacatggaggatgagttttttatttatttaaataatcatcaatttttttaaaaatagttatcatattaagtgaaaaaagaaaaacacgaagtacagttgaggttaaagcatgaagcaaattgatgcagattggagcagaccaatctgtcatactaattatttctcagctggcccaggctggcctttgtggtctaacttagttataattaacctttgggcctacggtacggagctttaaattgatagaggaaaggaaatcaaatacaagagtcacgtaaaattctaatttactataaggtttatcatattgtttgcttctaagtcaagatttagcatattttgttgtgtctgtcttattagcgtatttaatgttggacttgtgtcaacatgcaacagccgtacttgttctattctagtgaactgccagtgttcttcgctcttgggcttccagttttagcccaatatgacctttgcttccaggatttcaatgttatgcataactggacaacaaaaaaacaattgagtattttttttttaatcaatatatgaacaatgcgtgtttgacgacgggtgtctaatatattttattaaacaataattatgttaaaattaaatattaaattattttcatattttaatataataatttttttaatttatgaaattatgaactcaatatatgaatgagaatattctgtaaaagaaaagctacatgacaatatttgaaagagcgcgtcaattggtaaagacattgatttatggttcattagtttaatcctaatgtctctatataaagtagcaaaataacataaaatctgtgttaagtaaaattttgaaaa

SEQ ID NO: 2577 - DNA, 1539 bp, Glycine max
  Soy_ogl_5844 Gm17:41497501..41499039 Cluster 10
aaattaaactgactcacaaacactcctgaggagtccctgccttgtggagctgtcgtcgacacgtattagggagcaatgttgaaagcccaaaatctgctaccttaaccaaataattggtgcttttcccatgatgtcggaagcgtggagataagccaatgcagtagcagtcgtctctaatcattttctatttatttttaaagaatataagtaactagctaattatatttattttagtataaaattttaattttataaataatatattttgaatatatataatgcacggatatttagtttgcataaaacaatgacacacatgcatgtaaaccctagctaggacagatagtcagtgtaatttttatatttagtttgaatataatgcattattgacacaattaggatttttttattatattttttccttttttaacttctcttatctatttttaatttctttgatcattcttctctcgctctcaacatctatacagctttcaagccagtccatattcagaaaaagcatagagagacacaattaggattgtgagaaacaaaaggaaaaaaaaccaggacagaacatgatgaagcacggttgttcatcaaagttgcacactaaagaagagaaagaagtcgctaaaatgcttctggagtttcagcattcagaacctcccttgttgaattggggtcgcaagaggaaaagatctgcagttcaagattgtttttctccatctcttgtttttctgcaaaaccattcgcgtcacacaagaacggttatgaagaaggtgctgctgaaaacggagaacgcttccagccctgatacacctctctccttccatcccgatgaaaaccctaatctctccataaaacaacagtctcccaaaaaggtatcttcttttttctcaccttttgtcatgccttctcatttatttttacaaatgttaattattatttattaattctttttaacagagaaatcaaattcactatattttttctttattttcttcttttatcaccaaatctttggatctttctttttcttgaaatatttctacatcacaggagttggactcaattcaataaaaccttcatcttattttatttcttctaaattattatttttttaactgcaaaaaaaaaaaaacaatttgatacaatcagcaaatttaaccacaatctgtgatcaaacctgccaacaaatatcagaataaaaaacacagtgctcaagcgcacacagaacacctctccctacgaaaacacccagagctatgaatacatttgaaatctccctccctctataaaccgctactgacggaaaaataggtcaaattattgtataaaaaaatagttcaaattactcactgcccttaagaggtgtaaatttcttttaacaattcttgtgttattgttactaagtatttatgaattttattgattgatctttgtaaacaaacaaaaaaaaaactttgatgagtgagtcttctttttcaaatatatattgtttttacatataatacttagtttaaaaccttaaactta

SEQ ID NO: 2578 - DNA, 1209 bp, Glycine max
  Soy_ogl_5436 Gm17:1060392..1061600 Cluster 10
ttcatattgggcttaaaatttccatttccactaaactgggctcattattctttgatttcggtaacaaccgagctctaactttagtctaagtgttccaaaattacaaacaattagttcatactctctctcggatctaaagtttcatctctcaatcatctgtgtgtgtatttttttaatacttttttacttagtacctaacattgatttactatgtctttaaaagtaatcttaaaaacatgcaacattctaaaaattgaaaatcatggattgctaatttttaatgctattttcaaagagtaaaacgtactgtacattgtatcgtaaaaagtataagttatttgattttttggtaattttctcctcttttttttactttgtattgggcaagatttttaaagagatggataaataaaaatggtacaaatatcaatagtgagctaatggtgagacagtttatttaaattttttaaaaaaaaattatggaataaatgttttttaaaataaacatttttaaagaaacagataaaatataaatcattttccactgctaagttattgattgataacaacacatgtcgacgtaaccagtgtactattgccacgatttagtcatccataaatctataataacatgatgtcgtcagacaaacgaaatgtcttttttaaatggcttgatattatcggtaaattacgcatcatggcttagtgtaaaatggcgtcactgtcacttacgttattcaagttaccaatactcctgacatattgattggctgttgtaaatttcatttactgacgattttttgtcattgaaaatgcatgatatattgaaatagatttttagcaattacatggttgtcagaaaccctcccttagtattagtaactataatacttttcttgttttcttgtagtagaatgttcttccaccagcagaaagactgaggccatgaatgcgaattaggtgatgagttcatgacatcataaacgagaacgactcaacgagtagaataatagagtaatcaaatgaagtcataaaaaacactaatttgatagatgtttagaaattacaataaaataaaaatatgtactaaaagatcaaaccaaacaaaaaataaataaaataggaaaatgctagttttgtttttaaaacaatacaactatttatagttgagctgtatttcttttaaatgataaaatcattatgcaacaa

SEQ ID NO: 2579 - DNA, 1500 bp, Glycine max
  Soy_ogl_5831 Gm17:41164301..41165800 Cluster 10
ttgatgattaccacattggacggtggatatatttctcattgacattaatcgttgctttcatcacttccacaactccagcaaattcatggttttccaatcctatttatttgtcttttaataagtatcgccggtatatcattatgagagtgatagatggatagaagagtctgaccttattaacgcgtaacgtaacacacgttacttgacgcgttatgggaagacctgccaacattttaaaggggaaaaaagtaaaatgcaatggttttttcaatgctatgatacattttaaacaaacttttaatgtgtttaaataattcagaatttgtcattttatgtgggttgacatatacatgcatatatataaatgccaataaaagattgtaagctctgagttaccattaactccttccttcctaaaattgagaagatgtaaaaaatacattgtatcaataatgacaggttgtcaccgcctcccattacgttaatttgatttacaagggaagaagagtatgttctagataaaacttattggtataagagtaacacctagacatgtgaattgacaatacaatacatccattcaactatatatgggcccttaaacaaattctcaatgttattatgtcctttcatgtgggaaatctggtaaattccgatattgacctgttccgagcctcattaattgtttgttcaaaatttcaaataactgtccaagagcttagctgccataatattatttcatgtgctaacttttttgtgttattagcaagagaagtagagggaagttttgtctaagaagacttttccaaataacatgaatttgtattgtaatgtcatggagcatgactctacagtcacatatcctacagtatagttcgtgcatggttgatttgctgcaggaaataatgcagcacacatttcaatataaattcaatggataaaagcaaggatactaatttgttaataaaattatttttgttttaatcgtaattttacaacaaattttcaaccatcgttccttctcaccgaatttctaaaagtaaatgctgcaatagtgtagtagtaaagcaagtcaagtaacagaaagatgggggatgaaagaaagtttggaattggtcaatttgtaaggaagaaacagcctcatgctcagctacctaagctagctgtcatttgtagaaagcgagaggcacaaacacaaaacaaaaaaccgttcaaaatcaatatccaaataaatttttaaaaaggggtgtgtgcttattagaagcaacggaggtagcagtgcaacccccttacttaattaagtagcagtaatttaacagtacgtgagtgctgtccacgggactcaaaatcaaatgagaaaaaccctttacaaactacaaatgattcactagcacgtgaaccgccccaaaatgtaattaatttatgacaacaaataattggcttcaataatattactggaccaggtagccagaaaggacacgatctcatggctgccttgca

SEQ ID NO: 2580 - DNA, 1200 bp, Glycine max
  Soy_ogl_4919 Gm15:8482901..8484100 Cluster 10
atttgctagtcaataggtgctgtggctaattttggctgccctcagactttttttgtattttaattgtccaagcttttttatttattattgaaaagatggatactaattcattctaaagtatctaactaagacgtccatctctaaaaatagatatttttttcatatatttgaaaattgaatccctaattgggttttttttacccatatacttagggatataattatgtgtctagtgtctactatattatactacaagaatttgtcgcggtaggactaaggttgcaagaaattgaagataatgtgagaaattttataataatttatatattttatttaataaataaattagattcttttcatatattatgtgaaatatttgatagtttaatatttttttgggaaggtaaataataaaaacactcaaacttacaactcatacttagatttaaaagtagggaaaaaaattactagctcttttttatatatttttttttatgtttcaggtttctattttttttttcccaagaggaatgcaatggtgagactctttctaacattcccttgtacacactctctaccattgggtcacgtcacccttttttgttttttattctctgtcgcatggtaactggctctacctgtttatatctattttgactttataatttaatttatttattttttgaaccaccgtgctgcaattttgatcgggcttgccctaacacttcaggtcaagatccacgaccccggtaagaaaacctgcatctggcaccttcaacaccgccaaggaagccacgcacacctactacaccgccgcgaaggccaagaccaatttcccgacaccctcagaattcatccttaacaacaacattaacacgcttagtcccaaccagagcagcaccctccactcttccatatccttatttaatgagtctttttaatgagtacatttaaaatattagttaagaaattaaaaaaatatttattatataaattataagagaacttaaaaaaaattatgtaatttttcatttctcaataaaaatatttttagtttaaatttcttaacattagtgacataaatatcaaacatcaaagtattaaataaaaatattttagttcaaatataataatttttaattttattaaatatttcttaaatgtatgtttgacaaccttaaatataaaaaaatatgggaa

SEQ ID NO: 2581 - DNA, 1312 bp, Glycine max
  Soy_ogl_5286 Gm16:4278489..4279800 Cluster 10
ttacaaacactcttagcccacctaaattagagtactgatcctctataatagattagagcattatttggagtaataaaatttttattgaccagttttaattttaaatcatatacctaattgcatcagattcattctctataatatccatcaatgcatcattttaataataattttttttataaaaaatgaatttgatgtaattaggtgtatggtttaagactaaaattcaccaataaaaattctacttctttaatatactgtagagggtctgcactccctaaattattggcctcacgtgctagcttcattgagataggtgtgaggaggaagtatagtttcggatcgactagatcatataacataaatagagcttacaaaatttaaacaagccctttttttatggttaagcaatccttatctacaagtcagtttgtgggattgagatatgataaataaaaaataaaacctattataataaaaatagaaagcaaaaaagatacaaggtttttgttagtataggtaacaataaaatgaaaactttttttagtgcaataggctatattaacattaatattttctttgttaaggtgtcacattattttagcgattttttatttagttttaaacttatgatccaaaactttggttagcgcaaaccatgcaataatgtagttcgacctttgtgtatgtcatccttgtgctggtttggctttttatttctcaaataataaaattattttgctataaaaaatctaaaatgtgagtatctgctctattttgttcaatatatatatatcaacatcgtattcacgagtaacctactggtgggagtaaaattttcatgatatttagggggcaaaacagaggcccgtaaaacttataaatttttttgtgcccacgaaaaccatgcatgcaaaactgaatttccatcgtcatatccatttcttttatgaaccatcgtcatctattttaaagcatcttctagctactttaaaactttgcaagctgatgagtttttgaatgaaatgcatgaaccatatgtacaataatattggatttggtcccatgcaagtctgttgttacttgtacccgtggtgcagcaaaaatcatcgtcatgtgccacatgacgtcttgaatagaacgcacagccaatggccaacggaaaaatatcctctcttgttattggaagagtccaatagaagagtgatagacacatgaaatttgtgggtctcattgtggatcggaccaatattcaaccaatatcataatatcaaggtatctaatcaattaattaaattggtacatatatgtt

SEQ ID NO: 2582 - DNA, 1203 bp, Glycine max
  Soy_ogl_5858 Gm18:1070498..1071700 Cluster 10
taaagtcaaacataatgcgcgataaatatgttgtttaattaacatacatgttataaagaattatataactgggtgtttggaattggattcaaagagggagaaaatgcatgagaagtcaatccttaaatctcaataaaatctcatcttaaaatcttgtccaaaagcaaaataattaaatagaaggaaatattctactaaaaagtatccaactaaacttttctgcaaaagataattatagacaaaatcagtattgttaaaaaaaaatatcctacttagaaagacttgggagtgatgtatctaggacaagtagattgtaacgttttaagagagaagggcattttattgggttgataagttcattcattgtgctgcattaataagatgattaaaattacaaaggtgagtgaagaagcataattaagacaaggttgacttgcaagttgcaagttgcaagctgcaagctaaaagagttatgctgtgtttggtttgacgggatggaggaagtagtagtgggtttaaatttcattcattaataaaaacaaataaattaataattaatattaattttttttaaaatattatatttagttttttatttataaaaattgaatataatattagaaagtttataataatttatacaatatatttgactaactaaattatacattttaactgttatctttggtttaaaagaaaaaaatatttaaattaaaataaaatataaaatttataattttacataaaattaacattatttttttcctattgttttttttgctctcctcagccaaacacagcattaagagttagggcaggagggagggtgatggattcactgttgatggaattggttggtgggaagtagacgcatgagagagagagcatccaagagtcacgtcgagacattacatgagagcgacgtgaaagcgaaacgcaagaagtgaaagcgcaaatagcttttgaaattttaaccaaaccatagttttccataatctcgtggggactcctaaataattaattaaaatgtgtctcatatatattctttttaagtaaatattatataatttcatcgtatataataatttatgattaaaatacagtggtaatttttacattattaatgaattttaattaaaaaaaaatctatattcttcctcctgctactttttgtttttcttggtgagagcaggtccttttcct

SEQ ID NO: 2583 - DNA, 1200 bp, Glycine max
  Soy_ogl_5274 Gm16:3587901..3589100 Cluster 10
atataaatgagacatctaaatttgattttaccctaaaaatttgtgactccctcccagctttttatactgagattacgaggcttttaattccaccaacccctgcatgtacacgacaaaacaaaaggcacgttacacacctaccgaaggctaaagtcgtcattttagcactaagcgtagggcaatatgggtattccattataggatgccaattaaataattattagcaacatttaaaaaacaataatcttaaaacacatcgtgcaaactagttcgaaccgtggggcccaccaccaattccccaccaacttccattaccattaccaaccccccctctaccccacccactgatttcccaaatactcctacattaacataagtaaatttattacaccatgtttaaatatatttttattagaaattacatataaatttcctttgataaaacataaattaatttctatacttcacacataagttatttagtcataaaaagtatgttaaaattagtaaattagtaaataaaaacagataaattttaacaacactttctattacactctccgcaattaattgaaatttatagaaaatgataatgttagtggatttcattttccatttaataaatctttcttttcttttatttttaattttttctattaaattttaataaaaacaaaatgtatgttaaaaagaatatgttagatagtgtagtattagcattcctcaaacaagtgttgcattattctccataattttgttgctgagattcggaggtgtcgtttatgtggcgcgtgacggtcgtggatgaacgtgttgttgttggatgcagatcttctacagtttaaatatatatgtggcacggtgttctgtttgtatctaacactctaacagtccacaggttctaaaatagtgtttgcaaaaaaaaaaaaaggcttaattacaattttctcccttatatattataattgtataattttaattttttaggtttgaattatataattgagtcctttaaattttgcaaacttataattttagtcctcaaagtgtaatttttattctaaaaaaataatttcaatggcctaattataaaatataagaaaaaatcatacagttataatacttgaccacattatttggagattaaaattgaacatttccaatatctaaaagacttgattgatactctttttggactag

SEQ ID NO: 2584 - DNA, 1300 bp, Glycine max
  Soy_ogl_6802 Gm20:36925301..36926600 Cluster 10
aaaagatggaaaataaaaataaaagaggagtaataagtttatataaaaattatgatgtgacaagaaaaaaaaaacgtatcacagaggtgtttgttaaaagagtatccaaatatcattttattttatttaagatgacggtaaattaagtgtaatatatttatatttatgttttaaagaaataagagtgtgtgttttattataataaaaaataatataatatttgtatctctcaaatatagtaggataaaagatattatagtaataacattttttaacagaactttacaaaaaaaaatgttatgaagtatcgtatagtgaaatattttggagaggaaggtatatcttctaacataactgaagtgaagggtgtaatatttgcatcacacgaaataaaaaaactgtaattaagtaaaataataataattatattattagtacattctaaaagtatttacataaattattgaatttcaaaaacctatagtatactaatagcaagtaatctgatacaagattcatatacctctctaccttttttcatgtgcaactcatttaatttgtattttttcaaaaaatatgtttctcttcctccttcatgtatatgagaaaattttgatgaaaaattcaatcaaactacaatacatggaagtacacaaggaagaaactagaagtgcagcactggaagataaccattaagcaatagcagaggccagagggtgagatatcccctacctaactaacggccaagcaactacctaattaacggccaagcactggagtgcaggccttactatggaccattgggggcccactttcaagaaactatataaagcaagtatgcatgaacgctggtttcccaaaccaatactcactcacacaatcattatgaagattaagtttcatgtcaggccgggagcgaaagttttctctctgaaagtattacgctctgaaaaaattcgcgatgtcaaagagaaggtgcaaaactctcagcgcattcccattttccgccaaattttcctttacgatgacaaacttctccaagacgaatggaccgtttcgcaatgctatctctacgatggcgcgttcgttctcctccaagtcagccccgaaaatcctccgtcgccggtgtttccgccgtgggatccctccttgcagctgattccgccgcaaggctttaactatcctcttgcgataccagggtatccctcgtcatcggaggtgatccccatgccacaaccggcgtcacagacactaccgcggctgccaacctttcggcctcatccttcaccgtcgcatatgg

SEQ ID NO: 2585 - DNA, 1300 bp, Glycine max
  Soy_ogl_1944 Gm06:14435701..14437000 Cluster 10
atcgaaaaatttaaataaaataaataaataaatcttatgatattttagtcaaggttatccacttctccatatatttttaaggaggatgtcaaaatctggtaccataaaattgagttattacaacttataaaaaaaaaaatatagtactaaaaaaatacttgatgaattattttgtaaaataaattttgtgattttttaacagcatgtataaataccacacatccaaccatccatcttaccaaaacccttgtaattttcctaccctctcattccttaattctctgtcgttagactttactttttcccattacatgcgttttctcttttcattgaaggttgtatagatgtcgtgtaatacttcatcatctatttctttcaatcccatacacctttctcatacttagttaaaagacctttttttttctttttctttaatcaacttctttagacaaattcattgtatacatcaacaaaaagacaattcaaaaatacataaaatctttgaatattttaccctcttctatgcttgatcaaatacaaagacaatcatccgaaaattagacttctgtcagcatatttaaaaaatcaaactatttatcaactctgttagatcttattagtatgattaatttgctagagctataaataacatcaataagttgaatatgtatttgaaatggaaaggataagtacaaaaaaaaaatgaaaaggataaataacaaagtcgtcatattgcctttaaaaattaaaaaaaaatattaattaagtaaaaaaatcaattacccttattttttgtttactcttttttattaaagatatttatctcattttatatagatattttttctcatcttaatataactttaaatttaaataaattttgactcaatcctgaaattaacttagtatactaaatatttttaaaatcagttcaaagatgtactcgaaattaaaatgtccttttaatactctaccagagaaactaaaatgccaaaatagggtgagcactgtgtcaacgtaagccgtaatgctatgaaagcgagcaataatttgttaaggaccaagaggagtgagacagtttatacttcatattcattgggcacgtcgttgaagtggagccaacattctccgcatacaagtggctttcaattttaaaccacttgcttgctcgccttttacttcttttttttttttcgaaacataaaaataatgaaataaaaatgaaatgagactaaagttttcaaataaagatgataaaaatgtaaattttatcttattttactgttatttatttttgttt

SEQ ID NO: 2586 - DNA, 1692 bp, Glycine max
  Soy_ogl_3321 Gm10:2448809..2450500 Cluster 10
gattactttgggggtagtagctccttccttgtatgaaggcaatgtcatatctctttacatcatttaaaataaataaattactttttgttgtacaaactaaaatactaagttgaaacttataagcaagagaaaattggatgggttattgtagcaaatgaaccttaaggtgcttgccattggcagctcttgattgctatttaaacctccctaggtgttggtatcaatatttattttgacaaaaatgtctcctcataaagaaaacatgtatttgggtgaattatacaatgaatttaagttttcgatcactttatataagaatttctatatataatagaaataggtttttatatactgcgtactattatattttggcattctattatacaacaaaaatttatctccattgtatatgtttaccctactatataatgaaaatgagtatcatcagttatgtatataatgcacatataatatatattacaaaataaatataaatattaaaatataatttaataatgtatacttctgtgtgcctcccttttcctaggaaacagtagtatgaagaaatgagtgtcttgcttgctgttgctggttatgagacacgtacgttaacactcgtccaagtgcgctgcattctccatgcaatcctatattcctttcaataataatacacaaacaatggcttattttatatatcacacggttaacaccttttaactttttatattttttttatcacaccataaatcatataatatttatatttttcaaataattattttttgataatattttattttatacatccaactaataatttttaattctctatttctctttcaatcgtatcatattatatcatttattatattaatattttttttctcgagttattatcggttggtgttaagtaccaaaaataacttttttcatgttattctttttcttttatctctatatacttataacataatgggtatcctatgaaacatttttaacattcccttttctttccgatcatttaaataacacatctacagtgcatgcatgccctcttacatgtcaaagaaagaaagagcgaacacgccatggcgatgatgagagccaaagctttctttagctatcttcctcttcgccttgggcacaaaagaaaccgaggtagaagagctcaaaacgtgtaaaaaccagtgctaacagcaacagcaatatactaagagcgacttgcggatatgcatgcaatgctgtgacatgtattctcgtatgaagaaattaagagcctgagatggagggaaaaggtaatcctcatcagtagtaggtgttagcaaatcatagtccaatatactagggaaaagagtacaccaggagattctcaaaggggctcaggtcgatcaaaggaaggatagtggatttttttggggggtaattttggaaaaataaaataaaataaaacgggagtgtattaagaaatagggagaatggtatagcaaatgccgaatgttagttcgtcttccctcatgggactagccggcccttctcaccttattgggcctatcaacagtgggattttcttcttacatcatcagtcatttttcttctacatccaacatattttcttataattttaacattgtcattcataaggccaatctgtatacggattggtatagaacctacagattattaaaaatatgt

SEQ ID NO: 2587 - DNA, 2078 bp, Glycine max
  Soy_ogl_4863 Gm15:2137023..2139100 Cluster 10
actcaaaaacctaaaatataaatagcgatgaaaattctatttcaccctgtatatatgatcgaatgcataagtagtttatggattcttagaatataatatttctggtacaaaaattatataagaatttgtttgtgcaagccaactgcttctgatttatataattgatagaaatattaacaacacactttttaatattttattattatcatattctctctaatttgttaaaaaattgaaaatttaaattgtataatttttaacaaactagaaaaaatatatttaaaaaagatgtgttagagaatatagttgtgattatctggataattgaatataatataataacgtgtttgtttctataaaataaaataataaataaaggagggaacgtgcagcacgaggtagaatttaataatataaatatgcttggtagacgcagtgcaagagacacgaatctcacgagtctgggcagcaatatgaaaataatataatgtgacatgatgggtccttttcggaacagaaaatggcgcccattcataacccgacacgctttaagtttattattattagttgctgaccaatcaaaccaattcaatattcactatgatttttattcttcctaccttcatagcttggactcactcattcattaacgtataaagattctgaattattaatgtatggatagggtagctgtatggtcattagttaattcttttcatgtccaaagaaatcacgcctcgtaatatcgtatggacggacgactgtgccagttactcattggttttcattttttgcttttacgtgactctcatgataaatctaatcaattgacatgaactatttcaatttaatgtcttagattcgaatttggattttttttataaaaaaataactccaactacaactgtaagactggtatctacttaaaattggataatatgtagtagccatgattttcatgcacgcgaaactaaatgatccttggacgtagacttgtgagcgagaatataggttaggattgggacatatggccacccatttctcactattgcgtggcgtcaatgatgggcagaagaaataagattattaaaggatgagtttgtattcacctttaatttgtttgcttagttgaagcttttaagtgaattctttataagtgtagaatatatatatatatatatcaaagtactccttcaaaaagttggttctaattttataaaaaataaactttattgtttttcaaattcaagtttccaactttaaagaccacgtgtattttttatgtgtaaacaatattattacaatataatatatgttttttttttttatatttactcaagtgtcgtaggtacctcttttttctacggctcttactaacaacaactatcccaataacaataattggctgatctacaagattgttcatgtccagtttattgctgcccattataatataagataatagaaatcctttaaaaaaaatataatagaaatattttagtacactatttaatatatgtttctcaatttaaaaagaaatagataaattgtgtaccacacccaccaacaaaagaatctactctctccattctaaaataacttttgtacatcaagaaaaaataataaatagatgaaaaaaataacaattttatatcaacattattttatttctaaatactatagtttattattaatatacaaaaaatataaataaaaagaataattaatgttatattaaaaaattaaaataataattattttaatttagacattttttacacgacaattataggaggatataatggttttttagtagatgtctaaattaaagttaggagaaattaaaagtatttttactttaaaaagtaatacatttttctttgtttatttgatgcattgaaattcacaaaaacattttcaaattctaatccaaatataatcttattctctatttttatttatcttgacctgcagaatggtttcaccttattttctgaaataaactaccagttgttgtttagaaagcataaaaatagtttttaaaataaaatgtgaacaccatgtgatcagatatttag

SEQ ID NO: 2588 - DNA, 1478 bp, Glycine max
  Soy_ogl_6798 Gm20:36903801..36905278 Cluster 10
ctaatcaaggaaacggatcggaggggggaatctatatatgtttgacatgctgatcccaaagtcacataaaatagaccctgtataattataaccatcatgggtggttgagaattgaaatgattgaaaaataatagcaacaatggagaaaagataatcaaaattcttatttgattggaaacttggatgtgctatagcccataggattgtgtgttctgtgtgatattcggtaatgatatggtgccataggtagtgtaggtggccatccccattcccttccccttatcaaaaacacattggctaatcaaaccataaaagggtttattcggaggctctacgtacacacgtacttctatccccagtttggccccgccaaattagatattcaaatttcaaagtttgtttctgagattacaaaaaattgaagttatttgatgcatatgcccaattaattaagtaaatgcagtacatgtctgctctatatgctatattcaacgtggtagtattacatttcaaaatattctgaaactctttaatacacatttatttgtaatatatttattaattctgaaagacgagtgtaatgagtatgaaaacctgtttacatagaagttgacatagaaacttgatatgcagttagtttatttaatctatcctaagtctaatataggttgcatagtaaactctcctttttaccatttcagcaatttcaccaaacttatatttaccttctcttctgaaaaaaaaaatcaattttctattgtaaaaactacataaaatgcggtctgtaacaaattgtgaccggtcagattctgtgttgggtgaaccatcatcttcaccacattgcaaatactgaatagcatgacagctaagggaaacagacgaggttgtgtggcatcgatctagagctatccaacatcctattaattataccaacttcttcgtacttcggattcagtgaaaggaacaaataggagtgtcctacctgtggctcccactcacattcacatcatcaatctagatatcgtcttatcttaatttgctcacttgccctatctcctccataaaaaaccgatgctgatgctaaactccacgtctccaccatcgtttcccctcttcctttcaccactcttctatctcaatctttgcccttctccttactctgatgatatcccttcaattttttttttcaaaactatatataagtgttagttttttcatataaaaaataaagacttgattaagtttttaatttctaaaatttgagataaatttatggtaaaaaatattgtgacataacactgtcaacatttaatacgtctgaacttctaaactcatgtcattgcttcattaacgttgtctgattctagaaattaaaaatgtattttttaaaatttgagaaacttaaatgattttttttttcaatttagaagttcaaaaatgaatttatcttaaatttcagggattaaaaacataatagt

SEQ ID NO: 2589 - DNA, 1400 bp, Glycine max
  Soy_ogl_984 Gm03:39821001..39822400 Cluster 10
aattaaaaactaatatattatgaatgtttaaatagtcttaggttcattaaaaaatgagactcatacattatccaactttagtttcttttatgatgagttatataaaaaaaatgtttgataaatagttataatgctatccaacattcacctaacccaagaggaaaaaaatataaatataataagatttctaaataataataagaaagatagaaataaatgataaatatttatgaaataataaagtatttatgtatcatttttcttatgtaaaatagttgttttttaatgattatatattttttttgaaatagttgttttttaatgattatataatttttttgtaagataatcctactttgagtaaaattattatatgtgataaaacttttttttctagtaaatacatacctatacctaaattcgagatccgttattcgacatcaatagtaatgaaactttaaaattttctgtataacgggtctaacgtaacatataaatggtataattgggaaacattgattgtatccttctccattaatatgtaatttttttttatcaatactgatgtgaaataatacaattttcatcaagtatatatagaaactttctgtatagatatacatataaatactttttaatatttaccatatatatttataattttctctctcttatctcttatttctgtgagtgtcaaataacataacagtatcggttaataatttttttcatcagcatattcaaatttatactcacctattctctttttctatccagaacttgtaggctgtagcttctgtgtaataataataaaaaaattcaaactcttcattttcccttctttttttatttttccgattataatcacgccgcccgccattttttttaacatagttcataatcatatgttacgaagatttggagttaggatctatccgattaaaaaactctgataggcttatcatatataagaagtaatgttatttttttgacagcagaaaaaagtaatgttattagacatataaaaagagaattaaaagtgacaacaaaacgatcaatggtctttatgtgtgcattgtctcacttgttagtcttttataccgattaaggctgtgagtaacattaaaatcgcttgttttgttttgatttttttttattgggtgaactattattttaatcgcgaaaaatatactgtgctattatgttagttattgaaattcagaaaatttaaaataagtttatataaatacagtcagtgaataacattcgtccaaactctaagaaaaaaaaacttaagtgatcaaaataataatgagtgattaagtttatttgtttttatttatttattttagagacaaatataacaacacattacactcttataggcaaaagacgttttt

SEQ ID NO: 2590 - DNA, 1015 bp, Glycine max
  Soy_ogl_1608 Gm05:9048186..9049200 Cluster 10
ttctaacctgaggatccctaagacgaagaccaaaaccagtagaattggtctcctttaaaaatgcagcatcaacattgcattttaatcttccatgcactagaggaatcaatctattttgtataacatcttccactgaaatatctcttgatttgtaggcttcctttgctcgatcccagtcttgaaaaaaggagtctccccgccttatgactaattcataatcacacaaacttccttcccaaactgcatcatttcttcgttgccaaatgttccacaacgtcactgcaaaacgtcatcgctgatgtgaattaagggattgcatgatagagaaaaaagatcactgaaattttctacctgcatgattaagtcctctatctgttgcttcataccaaccacatgccaacactccaacgtcttagggcaagatacatgtgaaacacattatccatattagaatcacatagagaacaaaccgatgggcactcactctacatgtcaatcatgaagcttgtctctagtaggaatacaacctctacaaactctccagcacaatagtttaacacgcggtggaatattaagcgcccaaatccgagaccaatcttcaggtaaatcacaatcaacttgatggacgagttcattcatgagtaagttgtaggcactttaaacaatataacctccatccctgctaggctgctacccctccaaatatgtttgtcctcttcatcaaaatacaagaactagattttgactataacttcaacatccctcggcccaaataagttgtgaattatacttaaattccatgtcccagtagcaatgtctacaatatttgcaacgaccaacttctctgccccttgcacaataggagtctcaatgtaagggtttccttcgaaccttaaccaaggatcagaccacatgttgacttccttaccactacccaacctccaccgaagtccctctttcaacaccacttgcgaggacaacaaacttcaccaaacaaatgaagggttatgcccta

SEQ ID NO: 2591 - DNA, 1117 bp, Glycine max
  Soy_ogl_4865 Gm15:2150084..2151200 Cluster 10
gtttgtgtacaaggaagcaaatcataaaaataggaaggaacgttagcaaaaaaaaaaaaaaataggaaggaaaaaatatgcttgtgtacaatttcaagaacttaggcaactctttcttttaatataatttgcacaaatattaagataagcttaatgccattctagaagaatatataccactatttatgaatctctttactcttttttattaaatgcacaaataagagaatgttcattcaaacttctttttaatctctatgatttaaaaaaaactctacccgaaccccatcagaataaatattttgaaaaagaaaaaaatacacattgttagtatgtataatgataaaaatacaaaattaaagtgaattgtcatgttagcaccttgtaatatttattagtcacgtaagcataatctctatcggcgtatgaatataaagagcaaaataatttttttccaaattataggactaaaaaactaattttaaatttaatagattaaaaatatattcaaattttaaaaaatcaacatttaattaaaataatgaaaagtatattagattcaactataaaaaagattcaaccataaaagtatgtttaacagtcatgaccaaattcaaaagagtatttgattacacgttgttggaaaaggtgggacacataacaaaagtaagaaaaaaatattatatgaataaattaatctttttttcttttgaaagtatttatgagtaacataataaacaattacaataaaacatttaagtaatccaaatttttttaaaaaagtaactgtttaaaagatactaaatttttttattacaataaattttgtctatagacacaacaataacgtgtttctatcaagagtattttgaggggggaaaaaaagttgagaggtgaacctaacaatatattattaataataacagtccctgaattcagaagtgattttgaaagtcctaaatccatggtgtggtagtgatatgatcgcctccatgagaccatgacaattcttttccagtgatattaaggcgagggatgagaatcgttgacgtgcgtatatcttatatgagttgattgtaactctagccaattattttatttctctatcctctgaagg

SEQ ID NO: 2592 - DNA, 1000 bp, Glycine max
  Soy_ogl_6541 Gm19:43856301..43857300 Cluster 10
acaatgctaaaccattaatatatgtgtggatatggcctcaaactcgtaggcatgtacaaagcataattcaggcattgaattaatttgaaaactacaagacaacaacggtggatgcaagccggaccccggagaaagacgagaggcaacgtcgtttcatgtttattgatccgtctcaatatcttatccccttgttcttatgtttaataataataataatgtgttgttttttgtaattgtattattggatgggatgggtattgagaatagagtagaaggggaaggggagtgacaaaagaatcttagacgcgtcagaatgttgtgtcccgttgacgccacccaaacccaaacccaaatctttgtccctaccctatttccaccgttggaagatgattgatagacggtcaaatattatttaacatttagagaaaaaaataaagatataataaaatttataatatgaaaaaaagagataaaaaaaaatgagaaatgttgatgaaatatttaaaataacagttaatttatatctcaatatttcctattattttatactttcaaatacacacgacacattaagaataccacttgtgtataaaaaaatgtcgattggataattaatgagtaaattttttaagtgtttgaattgagataataaattatgtgcatacggttaattttttcattggagtgaattttatgggtaaatatgaattgaaatttctttcacctgtgataaatatacattcttacaatccaaacatttataaataagtaattaaaaacattaaggagtattgaatattctttaacaagactaattaggatgattttaataaacttcaccaccttgcaacaaaatgcaaaaatagcgtctaaagagtagtgttggtcaaacttatgcaaaagatatatctttaatattaatttgttaattttattaaaaatatcaatgagaagaatttgaacctaccaaatcgatattaataagattttttatgtttaa

SEQ ID NO: 2593 - DNA, 1800 bp, Glycine max
  Soy_ogl_1222 Gm04:4435301..4437100 Cluster 10
tgccattattacacttatgcaataagcttgcttgatttttttgtttcttgttaaaagagtcaaatatccattaatgtatatgaacgaatcgctcgtgggtgttgatttcctaacacgttggttgtacttgacataaatgcaaagtgaatcataaataatactccctcccgtataatttcaagaaatcaggatatactaagattctagttgttcataattttcacttgtttaaacttttgtgtattggaatttacacatttaataaattaatagtcgtagttgactaaggtggtacatgattctctaaagaaggtcttcaagatatttatactctctctttgcacgattcgattctctttaaataagcactcttttggtagaagatacttatgcccaataacttaaagctaccagcatatccatcccgtcgaacaaagttttttttttattccttcagtctcgtgttgaagccatggtcatgagtctatttgtttttgtgtagtgaacttgaggcctatatattgggctacattgagtggtaaactttagcttgtaattttttgtcagatcaggaggatccccaacgaatactcaagtcttaattgacggcaaaactgaaaaaacaaaataatattacaaaacaaatggaaagtccaaaaagtgaatgacttgtaccaaaaaaaaacatacattcaagaattaaaaagcgggtatatatctttaaatttttggagattaaattatacaaaaatatatccaagaataaaattaaaaataaataatttgtaactttccgaaactacatattattatatattattattgaatagtcttaaactaattaatcatcacttttgtcgtggatttcgagaattcttttggactgatatggctaaatggcaaaggaagaaaagaaaaaaagtagcaaaatgggagatattaaaatagctgcctatgattctataaagattgaccaatcatagcatgaactaataggctaggtgcatatatgatatatcgatgtttatcatacacgagtacgacaaattgcaaaacaaaagacacgcatttaatatgccatatacttagcaaaatataggttgagacgttgagtttcaatcgaaacatacatcaataaatcgaagctgacgtgactgagatcttttaagaatctgaagcatgcctcagtattacatcagaagtcaataatctgtgaacgtagtaaatgaaatactaacttggttcgaatcagcaggacctataactgccgcattaagcgtggataagaagaacacgcgcaccgatctaaagtattctaatgacgataaaaaactaatgaaaatgcgaaatcacatacagattaaatgtcggcactatactttactatacttaaataatctgaatggctcacattgatgtcttctaaatttaccactaaataaatagaataagagtgattttattgatttcaaacaccttttaatgttggatccatctagcccacacttctccagtcctccgtccactttttcagcggtgggagttgttctgatacttcaagaaatggcatacgaaacattaattaatttgttgggttcttatttattactacaatattcataaatcattatatgagttcacgacttcaggtaataataagtgttttgatttttgaaactcacctcaaatgatagataagaaaaaaagataaaatattgaaacaattccacactacaaattaaagtgctatataggacaggcgcacaacctttcctttgaaaccaaaatgattttgtctct

SEQ ID NO: 2594 - DNA, 1446 bp, Glycine max
  Soy_ogl_1487 Gm04:48340301..48341746 Cluster 10
tatattattctattgatttatttgaaattttaaggttttttttatagaaaagtttaggttaattggcttatctatatacttctcccttgaatcacacttttccttgttatagtggttcattttcttttagtatcaatgatagaagaagttgaatggtagatgtataaatggcctcccttccccatagaaggaaatgatatgtcatatataataataaaaaattaactaaatcaatctaattttctcataatagagacgattaagaagactgtataagtaaatatataacctaaaaaaaagtagacaagtccaaccaatcttgcttgcacaatggaaagaaccatgatttatctctccaacaaatcaaattagccaaaaggtgtaggttcatgaacctattctaaagtttcaatcaattcacgtcaatgtccacaccaaaaaaataacaacataatgtagagtagttttcttaaaataaaaaggtcacactaaaattttaaatgagattactatttaaaaagttaagaatttaatttatatgcattatcaataagtcaatataaaaaaattacattatcaatcaatcaaaatcaataaaaaagttgtcgttgatataactactaaaataattattataagagattaaaatttaataaatttattgtgcatagtaattaaataacaataaaaaaatcttttgcgggactgttgtggatggttagcaaacactagacaatatatgaaatattatgacatgcaaaaaaagtaaaatactataatgttttatcatgcgaacctcctctctcaatccaaaacagtgattctacaatctttctttttatgttaatacatgtttggcttcgccttaaattctctacaattgcgttgaaatacaatttagcgtgattttaaatagatttttgcatattttacatattaaaaagtagatttttttcgtatttgattttatgttggagaaataattctgtatttaaaattaagtttaagttgaaacatcttctaaataacttttttaatttccagcttgttttataataaaaacattaaaataaaagtcatatcacttcaaaataggtgttttccttataatgttggtgtactttccttttgaagccactaagacaaagtaatcaatgattaaagattgggatttcccaatggtaatgggataagctattatattcttggtggaaggtttcattatgtagaagtttgagagaagcaatattaatgggtacttagatgatgtcacggtgtgaggcttctatttgtgaaagtttggacaaaaatcatttaattcatatcgtcacccatttgtgtttatgagacacgcatgaatgagaatatggttggaacctagggcagtggtggccctcagggcaatctaggtgtgccaccgcctggggttccctattttaggggtac

SEQ ID NO: 2595 - DNA, 1042 bp, Glycine max
  Soy_ogl_6752 Gm20:34691759..34692800 Cluster 10
tggcagtgtttatggtagatccaaatattcaatggcaatagcaacattggctgatgcggcacgaattcagtggcatggtgatgatggcaagtagtgacatcagcaattaaagatgaagatggaagaaggtggtggtagtaaatggctgcaataacaattgctatacagcaaaagaatgtacgtaaataattttttttaatagaatacatgtattcttttcattatataattatgcaagagtgataattattatgggcgatatattttttctttaaaacaattatatataagttgatttacaagtttaggagaagaatataatgagtacttagaatttaattaggattgatttatgaaaaataggtgtctaaattagaattatttgtcaagagtgaaatttgaatttacattttggcttggctggtaaaagtaaaaaagacactacaaattttgaatttaactcatttagtttattatatgacttaattgtattttaatgtttaatttctatttaaataattttttatattataaattcaatatatttaacaaattcatgtttgaagaataaagtgaaatagtgccacaagacctatggttcagcatctttcttttcacttgatccatctcgctttaattagagtcataatatatctcttctgatcttctactgcctgcggtacaagtcaacacatagttcaataattgtcatcttaatgttggttgacaagtgaagcatatatatgtcgaaatagttggacttatattttgcataagatcacagcttgtgggatttgtttcatattttaatcaattttgtttgctcacaaaaatgagtttaaataatcaaacatttaatgagtcaacaacttagaatgaaacacacataatttaactccttacaactgttaaaaaaaaaaaaaaagcatgatccaacgtggtaatgttcagcaaggtgggatgtactatgtacctcatgctttttatcccctaagattttgggagcaatggatccaaaaatttgagtcattttggagtcata

SEQ ID NO: 2596 - DNA, 1500 bp, Glycine max
  Soy_ogl_2974 Gm09:3872901..3874400 Cluster 10
tccttaagctaattaattacactgctatgaagaatattataaaaaaaaatcagatttaatagtactatttatataaataaatacaaaatattcacgtgtgaatatttgatatttcattatactctcaaaattgaagataaaaaacgacagtgcgatttttatataattcaaatatcaatatagaaggaaatatcaaaataatttttattttatctttattattcttaaataattctttcttcacacccattcttcctcaataatgtgtccatgggtttaaatacgtcttttaaatttgaataattaaaaaattgtttttattagttcctaaaatttttaaaaaattacttttagtctctctcattttttgaattaatggtgtcataatttgtgtcaattttacactctcataacttttcttttcaaatttagtttttttaaaatgatttgtgatagtttaaaaccatcaaaatatgtataaaaatcacaataatttcacatttatatttttatttttcttctttaaatttgctagaatatgcaacaaacgatcaccaaaatcataccagtaaaatatttggcggtttaaaattgacagaaattgttttaaaaaaaataagttttggtggttaaaaaacactacataatgaacaaagaaaaactataaataattttccaaaaatttgagagattaaaaaaaattaactactcaaataagctggaaaacatttatgatctctaaagacaaaaaaaaaaaaaatgtgtccaccaacaaggattatgtgtcctttttttattttggaatgagtaactaattcttttcagttttcacgttcatcactctttaatttatattgttacgtgtcagcccactagttttggtaacattctttccttgaagccaaaaaatgtcattgagaggctatattacaatttagtggccgaactacggacaagaagcgcatctggtgtagtggtatcatagtaccctcccacggtactgaccggggttcgattccccggatgcgcaactttttaacttttttatgatgatttttttaagagagtttccaaacatgaactttttgatgatgatttttttaagagagttttcaaacatgatactattataggggaaagaaaaagaattacccgaaggcaatattgaggtaatatagtcagagacggatgcagaagttggtcagagagtgataaattaataataaatattaactaaaatttaaactacaatagactaacaatttaaatgtaatgtatcttttattcaagtcgtgtatgtcctaccttcatatcaatttcttctatcttaggaactttgaatgactgtttgggaacatgagattgaggagtttcaactttgttaggtcccggatctgtctctacttataaatatgcatgaagagtagatttttctatagggctctctacaatcaataaaaaaaaaacttaaagcaaatctaaattaaacatcatatacat

SEQ ID NO: 2597 - DNA, 1179 bp, Glycine max
  Soy_ogl_4987 Gm15:11217701..11218879 Cluster 10
ccacattgaacaagatcagtgtgccaagaatgagtgactgggtttataagatcacaaaccttaaaatcctcaaaaccttgctagagtgatgcactttgaattatataataacaacagactaatatgcagagcaatataatatgtagagtaattttgagaaattttttagatcataattaattaatttatttgactgctgaatgaaaagtaaaattcaatatgattttatgaacctttaaagtaatttattaaatagtattttatcagattcttcattaattgaaatatagcaacagactactatgcagagcaaaattttctttttttgattaggagcagagcaatataatagcagtagaattagtctatccataaacatgttagtatcatggtaataataaacaacattttttttttcaaatgtagcacaactagtatcatcattatattaaaagagaaacttatttcaaaaaatatttaaggaaatggaaaagtgaaatgcaatatatgcaaacaatagatcatctcttcaaattgtcagaatatttgtaagggaatgatatatttattttcatggctcaagtgatgcaatttgttttttgagtaattgaaattcaatgttgaattatatattccttgaactttatgtttcctggaaacttcttataaattaaactacaatataaagaatgcaaacaccttttaagaagtagagcatactttctttacttttatcttcctccaacccgcaaatgaattccaaatgtgtttcacaattcacaaatgtgtaatgaagaagccaaagtgttgaaatctattctgttgctgactgcagataatttgcagcagaatttttagtgttaaaattaaatttcgttggtaaaactggatttcccgggaagaagtattttaatagaaaaagtttaatgactgacagcatgacaccgtcagtggttatatttttccaaccattcaatgaggatttcttttgtacaaattagttagctatccctgcatatttgtctttatgtatttttgaaacaacttattatttgcttaaaatcaataataaaacatattccctgaaattaaatatattttgatcgtaatcaaataataagaaaatttatttatattttaaattttttaaaaattaatataaaattaaatttaaacaac

SEQ ID NO: 2598 - DNA, 1655 bp, Glycine max
  Soy_ogl_2626 Gm08:12042646..12044300 Cluster 10
ccaaaatacatcataaataaaatacattaccttgaatttttttagaagtgcatactactttatattataataaaggattaaaaatataaaaaatgacgttgaattttttcgggaaataattttcagcgctgcatactattttattataaataatatttattaattgtacataattttgaatttttgtgattgtttttaatgtaattgaaaatacaaaaattaccttagacttttggggaaaataattttcaacttgtatactactttatattttaaaggataaagattgtttaatttttattttaatcaaaattttattaatgtaaactttttttttaattttcatgtaatatgttattatattcacatgagaaataatatttaacataataatgttgattatctcaatataaaaaattaatctttagcctaataagtcatatgccatcatctttgatatatgacaaaaaaaaaaaaaactaaataaaaagaaaggtattttagaatacctcaataagggatttgagaagaaggctatatatggttcctgcaactgctagtttcgaaccaagaacttgatggttgacattcgaactgcaagccaacaagtcactcggggataccaacatctctatattcaacggattttatttattgccaaaaactggcagcatattgaaatggtttcatgctcatgagtatcaggaatcatcatctttctcacaatccttgtgtgttgaataaccatcctcagtggttctattgtcattcaaggtatgcaagcccctattaatttttttggttacttgttgctctctctctaaaccccattttctttttcctctttctttctgattttcagtataaagtttgttttgttcccttggaaacatttgaatggttttggacatggagaagaggtatagtagaacatctaaatttcagcatataattcatgttgtgaaagatacatggatctttttttttttccagttactataactcacgcgattatgtgttttgattctatactcgtggtctggagatgagtggaggggagagggggaaagggaaagagaaattgagtgaaagtggtaaagggaaatagtgtgtcaatgagggaggtgggagaagagtagtggatgatgaaggatgaacgatagtgaaaggaagaaaatctggtatgccgaatctttctcccatttttccgacgaatttgggatcaaggagttctggagaatatttgggaggtacggaagagtgaaggaggtgttcattgcagcaagaagaaaccaatggggtaggaggtatggctttgtttgttttgcggggggtaatgaatccaaaatcgcttgaaaaagaattgaacaatattcgcattggtaatcaaaagatacatccaaacccgcccaaatatagaaaaagacagatttttaaattggagattcttatcagagccatcaactacaaagtgatcaattttgtagaagaaatcaaagacaaccagactgtgatctcttaggaccgggtcagcaaaaaataagtaaaaccaatcagaatgctccccctatcccttataggagtacaaattctcagtaaggaaagcaaaaagataaagttagaagaaagtttgggtagcgaaagagggcaataat

SEQ ID NO: 2599 - DNA, 1162 bp, Glycine max
  Soy_ogl_4390 Gm13:31589075..31590236 Cluster 10
ctagctgtgaaaaaaataatttattttactaaatatttttaattcaataaattaaattaataactttcatttttaactgttaactttaattttttattttttaaacttccaactacgttttaaaatttcaatcaaattaattattaaatcctactccctttattcttttttaaaaaaaatatattgcttctattaatttatctatcatttgaaaaattcaatatcatattaattattttacatatgtatttattatgaagtgaaaaaggaaaataagtaaaatagaaactctataatttttaaaagacaactaaaaagatacagagagaatattatgaaacaagtcacttatgatgatagctaaaattggcgatggcctcaaaaacttttgtacaacagtttgacaacaattttagaatcacccgtcgtgatttaatgttccaacggcataatcaactcccaacactcaacttccagctatatgccaatgtcattgccagccaaagtagtttgggtgggttttacgaaaatattttgacttttataatacacggattatttgtccttattttcggaacactgcacatttttaactacacttgaacaagtatagtaatttaataattttaatgtatgtcaattcatttaacaacacccccaaacaccagcacttgaatttcagtgactttgtaatgaatgataatttaaaatcacgcatctattgtttaaactaacgactcgtgaactatggtcctcacaccggccccgattccaaatttgattgtttgtgcaaggtcaagtttaacttttgtaactagaaaaatagtgaatgcttgcactatcactatgtaaagacttttatgtttgtaattcaattatagattattacgataagtttgttgttttctctaataaatatcttaaaaattatattaataataatttttaattaattgtcagtgttaaaattttcacatcaaccatacataaatattaggttaaattattgtttaaggtatctctttttatttatttattcaatttatttcctctattttttagaaggttcaatttaatgctatattttttcccctaaaatgttcaatgttgtacttctgcccaaattaacaccaacgatgttaatgaaatccgacgaaaggac

SEQ ID NO: 2600 - DNA, 1426 bp, Glycine max
  Soy_ogl_4956 Gm15:9523956..9525381 Cluster 10
gatggataaaaaaatcatttgcattttttcctaaaatcttcttatatataattgattaagaaaacaagttattgcaggctggtgtgaatatggcaggaagtgacgaaggcatgcaagacttggagaacaacgttagtagcactattactactcattctacatcaaatgaaagcactactactaatcaagaaaaaggaaaagagattgacactacaactgctaatccagaaaacaacattggagtattttcaggtgtgattgatacggaagaagttagaggaatgatggtgtctgatccatttattaaacaaactgttgagtcctttttgaaatattcagagccagagaacaaagaagacagtcaaaatgatgccaaccaaggatcaacaattgcacctgctaagcataccaaaacaccataaggaaagaagatgtagtcacaacttcctgaaaatttaattcatagtcttggattaggagttttttttctctctctagtgtttttaatataaatagtccattagcatgtatacttagtgaggtccatcaacatgtgttctagttataaatatagtaatgtttttatttatttatttttaggttaataggaaagatatatgaggaagacacaggtaagtttgttgtatttggttaaaatatgtgtatggaacctttttttagtatgcatgttctttgattttatttttatttttatgtttttgaggaatcaataacatttcttctacctgaacattgaacatataaaaaaaaattatttttaacatgaacattgaacatacaaagaaatagaaaaaacatattaattactttatacatattgtataaaaacttttacaccatcatttatttgcagtctattgtttttggtaactttgatttttataataattattttaaatattatatcaattacaaattatgatttacactaaactcaaaggaaaaactaaaaaacatagaatctttctaaaataaattatgtcaaatgttcctgttataattgggaattaataaatttaggttaaatggtaaaaacggaatcaacatccaaatagtgaaaatctcactaacaaaattaattcagcatggaactagttataattaaaagcagaggagatcagattacatcagtcacaactttacgaaaattatgtcaattttcacctattgatttaatcttaatcaatccctgttttacggatcagaaattagcacgtgatcatcaatccctgtgcaaatcatctcctctattacccacaaaaaaagtttgcgatcatcaatccctgtttttcttaaaaacttgattgcatattaaacacctccctttattgctctcaagattccaatcttgcataattttatttttcgttctttatgattcagatacctcccactctcatttttc

SEQ ID NO: 2601 - DNA, 1300 bp, Glycine max
  Soy_ogl_6567 Gm19:44633201..44634500 Cluster 10
tgaaacaaaggtaaaacctttaatgataattgacgtgaggatatgaacgattgtattcttttaataataatatactaatttattaacctttaatatattatcaatttataattataaatataactttaatgacaataaaaataaagatgtaaagaaatgagaattggtattcacataatatgcaaacgaaagaagatttatatataatatagatataaattatagttaaaccaacaatgtattcattcttatagtcttattttttttatacaataattatattaaaatttgaactcatcatctcatatatattaggaatactctaatttttcaccactaaatcgatattaatagtgtttttttacagtatagttttatccgatggggcgataagaaaatgttgaattctgtactataatcctttctggaaaattaacaatgcaaacctattttctatactaaaaaaatgtcatataaattaaaaacatcattatcagttgacaactactcaactagtaacgatgaaaacaaatggcatgcgtaatgacggagaaacgcacgctgcaacaatgtacgtcagaagggatcacactgggtataactacctactctcattgattaaattataattataattagtatataaattactatatataggcgtcgttcaacttgacggtttgttctagcagtgattcttttattgtatttttcatcacaagtaccatcgacttattgttttttttaagctgacttattgctgatatctaatattgcagtcgattttttttttttcgttcacattggttcatagtagtcgtaaaaataattcaatttatatataatttgggacattataaaatgtttaatatatgaactagtaccaagtgcaattttaaataaggagttgttactaacaccgagaatcgggctaatatactttcttttggtagtgagacgtgacacatattgcaacaagtcttgaatgagcgtctcgggtgggcatttttcacttcaacaccatcacaggctcagccacatataataaagttatgtctattttttcagttgagagactctcaacgcccgtttataaaataaaactaaaacaaatattgtttactttttaattaggtttaactgtaaagtgaattttacttcaattttgttttgaatctcagtttgaaatagaaataaataaaaggaggaacacttttgatattcagtttacaagttcattaaaatttaagtttgaaactctagttcatcttacagaatatatataatttgtcaaaaggaa

SEQ ID NO: 2602 - DNA, 1163 bp, Glycine max
  Soy_ogl_4640 Gm14:4092751..4093913 Cluster 10
aagagagagaggatactaacaacactccttccttttttttgtgtgaataacaacactccttccaatacacaatctaatactaaaaactaaataaaagatgagacatacgaaaaattataattttcaataattaaatcagtaataaagtgtattaaaaaaatatgttcgggactacctcttcaagacttaggaaatatactctcaattaattaatttaaagggcatgtttgaaattatataattaaacagggtaagtaattaacaattacttttatttgagtccagcaaagctttctgtgtgacttataattgagtttaaaaggagtacactgtcagcatttgtctctctttctctctccatatatatagagatatgtttataattttactttattattgtttaaaaaaactagttcataaaaacccattttataataacaataatatattattattattgcataaacctatttttttttaaagtatgctcaactttttataaaataataaaaattatttactaattaatcttgtttaggattgccaattgtgaaaagtttaatgtaaaaataatttacctatagtaaaaaatttaattactcggcttttataaaagaataaacataatacataagccacgactttattgaaaatttcaagacattttttaattaagttattctaaaaaaaattgaaattatgctgtgcagaaattaatttcaagaggattctcaatggagagtttgaaaaaacaaccttggaagaaaatatattgtaacgtgtacgtaaaattaattgatttgcgttttctctattttgtctgcccacaccacatcatctacccatcggtggtaattaatttcggcattttatgattaaataaaagacataaatatgatttttgtttctataaaatgaataaatttttatttatgttttttatttttttattattttcatctaaaatttgaaattattatttttagtttttgtaaacaatatttccttagttttatgtatgcaaagtattaaaatcgctaatcttggtccttaacattcattttaagatatataaataaaatttattttagatttattttcaaattcagtgtaatatgttgaatgtggttgcatagacactaacatatcccacccaaaatggt

SEQ ID NO: 2603 - DNA, 1240 bp, Glycine max
  Soy_ogl_1488 Gm04:48365761..48367000 Cluster 10
gcagagaaaaaaaaaatagataaacatattaaataaggaaaaactgcttattttataaaaaaaatatgtttttaaaaaaataatcttaaacaaacagaccattgtaaactttctgtagtgaaatttaactgacaattgttaaacataccttcttaatttgttaaatatacccattctttatttataatttttttccttctaaactacccctttccggaatctagtttctagaagtctatcaattccgtaaattaaattccaaaggcataattggaaaacactatcttgttcttcctacagaatctaatccttataaactcatgcacagagaagactcttaagaaagctgtcctcgcacccttaagagaagcccctgttacatggaagtacctcgcaattcgttgattagttacatcaatggatatctaacttgtttatctaaaattaattatatacttggaagttttttattttttatctataaaaatacttttctaaatatttcctctctgaatttcccctctagctctctctattttttttttctctatctctgttatctaaatttgtttgtctctagacttaattttctttcactttaactctataaattataggcttaatttgtatttttttactccaaactttttttttttaattttacaccaacaaattaatttgacgtatgttacctctaaatttttaaaaaacttatgaattttaccttgttttgcgacacgagatgttaaaatatttatatttttatccccaattttttcctttttcacaatttttattcctaatttttcttttttgacaaattttacatccaaattttatgctgccatgttagctcaacaaatgaaagtaaattttgcaattttttaagagttagaagtaaaatacctcaacttaatttattgagaataaaattcataaaaataataataataataaatacaattagtccttcctactatatccacgatatttttacattcggagccgcaatgaccattagacatatcaccaggaaaagaaggattgaaggaacatatatgtgaaacatttgaaaagaattgggcagtacaactttcgacacatctaaagtggaatgatcaatgtgatagagaagaaaaaaagaacaaactctcaaatgtacaaacgacatctgaagaagggactcaaatacttttttaatcatttataatccaattgagttaggagaaatcggtggatg

SEQ ID NO: 2604 - DNA, 1500 bp, Glycine max
  Soy_ogl_1745 Gm06:560401..561900 Cluster 10
cataaatagtgaaaattatgttgtcagtaagtcaaaaatagtctttaatataacttttaagtaattagaaaatgtgatgataaataggatgcatatcattttatgtatctaatactagtttatgtgttaatgtttttttatttgacatcaccttaattaaaatcttatgcgtttatattgaatataaaaaaaatgatgatattaaacgtgtattttttaagtcaatccaaactcccacaaagacacatgcataaaaggttggtgatcttaattcaagtttaggaccacaattacaaggagccaaaacaaaataacatcccaaaccagatagaaattagaatcctatcacactaaacacaaagtatacgcatgttaaattccacggttgaacaagtaataaaaaagtatattttcaacttaactacttaagaaagttacactttatgcgtttaatgaaataatgatcattacttcaattataatattttttattttaacaaaaataaacagttctctcgaaactcataaataatgataattaagaacgtaataacgaaaaaatgattggaaatagtttgattttagataagaaatcgaaattgagatttgatggagattaaatatttagaaaataaatacagtaaatgaaattaaacgaaaaggaaatacaattaaaatttggtgaatacatacattccgatgttggaatcaatactctttgtcaagataattcaaaaaaatatcttggaattaatactcataaatgtctgtgacatgagttgtgtttacaggatttgagtgtaaataattcaacacatgaaaaaaaaaaatctttgattgttgatataattgtttctttatgcaagtattttttaattcacccttgtcaagatacttttacttgaaaagtatctttatagcacttctaataattctaaaaaaaaagttctttgttaaagaaatgtttcaaatgagaacacatctcttctaaaaaaaatgagaacacaaaatgagaataattaattgagccattggatcataattaaaaaaacatttaatgaatgagattaaaacctgttttaaaagtttcacgtgtctgctgcttccttccccaattctttttccacaactcacaattttaatcacaacattggataatgtagcatttgaaaaaacatggatctctcgtccaaatcgttctttcactgctccaagcttggcctttggcactttcaatatccatgttgatagagcaaatgttccgaaacttttcatgatttgaaaggcgaatagggtcaattaatttcatgtcggtgcaacaaacagtcataaactcttcagcgtccatgtcaattgcaagattggaaagaatagggtcaattgcaaaaactaaaatgaatgagggatgaaggtgaattgcaagactgtgtacatgttcggaaaagaaaccaaatccgtggaagcacgtgactttttaatatgggttttaatctcattcat

SEQ ID NO: 2605 - DNA, 1000 bp, Glycine max
  Soy_ogl_1904 Gm06:11548301..11549300 Cluster 10
ggttttgtactgtgtattgattatcaatgaaaaataaatatctcaatagccatttatcttggcatattatggtaatcttcgtatttcactgttttgaaaattagatcaaatggatcggttagaccaaaaaactatttgaactagccgttgtctggttcaaataaaccactgaagtgggttatagataaaccaactacagaaccaaaaaatcagacacaaaatgtgaaaaaattgatgaaaacaaatcaagaaccgacagaaaactggtatacatctggtcaataaaaaaatgcttaatacgtacagtgttattttgattttttttttcttgaaaaaaagctacggtatttatcatctctttttaattttagagataaatttgttgttgttaacggatattattgtgtattattgaaatttacgcctaagtattataatatatatttgatttgaactttttatatatgcgtactttaaatgtgtttctttttactgctactttaaatgttaagaatctacaaagttatatgttttagtttttataatttcataaaattctgatatatatttctttaatactatttaatgtgtattatataattattgatattattttttcaacaccggttcaattatagttaagtcgttaaatcttgaacaatgtcttgattggttaaaaaaaacattagttttttcttttaaaaaaaagcttgagctgaatttaattattaaccgagtgtttagagtaagtttttatatattttagtaagaagggtagcttaattaaggagcaagataatgttgataagatgttctttttaatgctgataactacaagtctacaagagtagactcaaggctttgtacttatgtgaaagtggtgaatgctgatcacacagctctctggtctggacctcatttgtacgttctccaagttgcacatctgtcaataagaactttcttgttaatcttccttcacaagtaaatggaaaaatatctt

SEQ ID NO: 2606 - DNA, 1154 bp, Glycine max
  Soy_ogl_5629 Gm17:10328601..10329754 Cluster 10
tcatgaactctttttgatttaaattatatgtattttttattggagtcgattttatttaaatcagacaagatgactaaataagtatttaacgtatttttatacttataacttgaacaaattcgtgatcgatcacgatttattaaactaaaacaacttgcattagtttattcatgtacttcacgattatgtattaactcttagattgtggtctttaagaataaaaaactattgtatttttatataatatatcaaatactttttactaaaacctttttatttttattctcttaattaatatacctacttgactataaaataaaaaaattcacataataattttttccttattcattaattgttagtatttgcttgccctacttatggtaaaatctagcagctctctgcaagtattagtattttccaagcaaataaataaacctaatgtgagaagagtcatttacaactgagcagttagctcccatgtaaaagaggatccacgtgcacgatatgataccaaaatgagcaaagtggatttggtaaattcgaacatgggctccattagaatgaaactatttcatggatgtgcccaaaatcaacttggcccaagtctcctcataattgtcctgtccattccaatgtcttcttttattcttagccatccaatattttctgggtttatcaaacagcttgcagaaaaaatttgaagattgacgcagtgtaagattatgttatatttatatataggtcaatgatttacggaaaaaaattatgtttaatttctattatgtgtgtaaaaaaatttggaccaacaataattatgtatgacaagtaagattaattttttatccaataagttgagaggcatttatcatctctgacctacaaagaaaattcttgtaatgctaattaaatacacataattactttttttattaacaaaagttaattattagtttattagcaaaaaattcaaactcactacctaattctcctttccttcacttcttatcatcaagaaaaccttatatctcccatatatcattaccttaattaaaatatctcatttttttattacaagtaagacatatttattaaagaataatgattaaattgtaattttggtttcctctaattcttagtccgaattttgtttc

SEQ ID NO: 2607 - DNA, 1153 bp, Glycine max
  Soy_ogl_1584 Gm05:3649233..3650385 Cluster 10
gcctcctcaaaaaaaaaaacaagttaagttcaattataaacacgggtttgcagttgttgatgttcatatttgaacgcttttgatctgaaatgtgactagatgcagctgaactccaaaaattgtgtctgatcatgtgaaaaggctgaaagcggtgaaacaattgtcacttgaccctgaaaatagaaacctcggaacctgatatatatggatagtcactgatatatagtagaacggagtccaaagtaacacacacaaagacagagttagcaatcaaaaattaattggttaaatttaattcataagttaaatgggctgaacttaatttaaaaattaaacttgtgaaataaaaaggatcaacttgatataattcaactccaaccaactccatctatttatacgtgtgtcatggtttttttgtctatctttctagattggttaagataataactaaccaatctaaaaaaatatatttttgtatcagcttgagctttaaccaacatagaaagtgatatttttatgtcagtttcaactatgtaaaaagtttgattacattagttaaaattgtaaataatgtaaaacgatcgacgatgcataatgtatgttttgcactaatgattaagtccgttaattgatcattgacgtgataacactgactacttatatgggactttgatgctaacatagcattgtcatggatcgataatgtgacactaattaacgtgataacatgtcattacattactggataaaatgtacactattgtaaaaatatgaagtcaaaatgtgtagtattataaaaatattggaacaaaatgcaaaaaatataataaataatacaatgttgatatttattgtctttgaagcttcctaaattattttaaccaacaaacattataatctcacatactaaaccatgcatgtcattaatcgcaatatgtctaatggtagtttaatattggcaaatgaagaacttacgttatttgttgtgtaattggacttgcatttcgtcaaatagtaatttgatattgacaatgatatatatggtttggtctgtgagcggagccagccttgggctatgttagaacggaggggtgaccgctcaaggctttaaggctaaaggagtacaagaaaaaaagtctatataattgtgtag

SEQ ID NO: 2608 - DNA, 1000 bp, Glycine max
  Soy_ogl_3320 Gm10:2403901..2404900 Cluster 10
tgtcattacatttctctaatattcctatgatatttgatccaaaaattgccccatctgtgatgatacatttggggggaaaagcgattgtgtggaatgtcatgaggagggataacaatggaattagttcaagatgaatacactttgtatttttttatgaatcatattccagtctttgcaacgcccaaaagtgcacacacattgagacatcctcccataacccttaaactatacactttatattcgaaaaactcctttgtattatcagatcaaaggcaagaatgacaagaaccattttatcccgagagaaaaccaatcaatgaagagccccattaaccaatgacccgaatccgaatttatcgccaagatcaacatatgaaacattaatatcatttatgccccacgaattagttttaaaggagaaaatctagaatttatcattctcaagcttgtgcaatatccaataagaattagcaggtagtcatttgttgatgctgacatacccaaaaccatatagaaattgagaggctattgcgtattcaaagtatggtaatccttgatagacacttggtggattccatataatgagatcacgctttctcatggggggtgggggtaatggagatgcattgcactagaccttttttaagtggcgcctcaatatcaatggattcaacataaaagtcatctgatctgagaagaagtcagtgggaggctctgaagcatggttactcctaaaatcatgtcatatactcgtactcgatacgtacaagtatcgggtatgtatcaatttttttttaaaaaaaatggacttctctttttgggtactttttgagtacgaatcgggcccatagccaagtccaataacttaaaatattatcctttttataaagaaagagtaagagtaataaagagggtgagagtcaaatgtgaaatattaatggagttgaatgacatccagttaaaggaattgaaattcttaaaagttgttactttttttctt

SEQ ID NO: 2609 - DNA, 1300 bp, Glycine max
  Soy_ogl_1144 Gm04:669401..670700 Cluster 10
tttacgtgcctcaaagctgaataggtaaaagatataactcaaagtttttacgaaaaaatcatgtaataaacatgaacgaaataagtaaactgattaatttgcaaactcgtaaaccctcaaacctattcgatttgtaggtttcacaaatcaactcatgtatgctcgtgattaaatagattgtgactttcaaacttgtgctagctcctatgttatgcaagttacaacctacacacccacctctaaaggtgaagcgaaattaagtttgatctgtctactgttgaatctctggctattctcggtaggatgagaaattctttgtcccattgaatgacacccgcaagtttaattcttatatcatcagtatattacctaagttatattgttaatataaagtataacattaaattacctaatttaattattatgacaaaggttatccttgccaatttttatatattggtagacatagtaacaagacaaatcaagagagatctgtccatatctttgcaaaatgtgagacacgttcaagtttaaaaatgcacgtttaaatattttaaacttatccttgtctctgtcatgtttcatcagtgtcacattttttttaccattttaatctacttaaatattttaaataaattatatttaagttattaattatattttaattctaacaatatataaaaaatactatactagataacaaaaaaacttataaaaaaatgtgagaattactgtaaataatattacttgttatataccgttgtgtgtacccaacccgtttttacaaatctcaaaataccgaactcgtcttaagtcaaaggggggttttcctatcagtctacaaattcaaatttactttttatatctatatactaggattactcaaccttttttccgagctttgtcaaatattgtttaaaatttatttaaaatgtgctgacagtgtaaatcacccaatcataaatttgttatgtttggtaaaaccaatcatttttgtgataatcagtttaaaactaatatttataattataatgtatcaaaactaaattcatagttttttttttgtatgaaaaacagttaaggaaaagatgggtaccaggattttttttctttccatttataagaaagatacatattttagtgctacaaagcaaggatcagttacccatattgaaaagatagatatttatcatttaagacgacatgtggtaggtggactactgaagtatctttagaaaaccatgataccaaatggcttcagaaataatcttcttcgtcaaatccccccagaaagatcact

SEQ ID NO: 2610 - DNA, 1134 bp, Glycine max
  Soy_ogl_306 Gm02:1097401..1098534 Cluster 10
cttaacataaaataatatccatccatttggggagactatgattgatcctccagatgaatgattttattggaataaaatggtcgtgggtattagcttatagcttatcatggtaaggcatgcattaatcctaatttttagtgagattcacccgctcagaatattccctaggtctaaaaaacattatgatgactcttcgacactgttgagatcccactagacaaccccaacttatatccctattcttatgaaactaaacaagtatgctcatccaatcatcaccttataataatttttagttacaacatattaaacctatcaataaatatctcagaatttaggcccgtcatacgacctttaacaactaggaatctcaatcacaaactccattgtacatatttacatatatcacaacaactcatcaatacattctcattatacaataataaacatttgaaaaacacttagaatatcaaaatgagaaggtggtgttagaaaaaatttgcccaatgaatcctaggtttgctcgacaaaattgaggctgtaaacacaccaattctcaagggtaaatccgcccagctaaattgaagttcacccaataaatttgaaatatctatggggtaaattcgcttggcaaaactgaagttcacccaacacatccaaattttagcccaacgaatttatgattaaaaaaatgcttactctttgttgcaattattcccaacggacacaatttcgaccagtgaatttgtgacaaaaagcacttaactttctgttgcaaatctgctcaacgatttccatattcactcagtgttatttgtaaaaccagtatgcaaacaggttcctctccttcccaaagtttcaaagttttaaaaactttggaaaccaagtcatctctcaaataatcccaaatggatttcatcattttcaacacacaaacaaccacaaaacattagtaagaaattttggcgaattttatctcaaacaaattaatttaacgtatttattttcaacttttaacaaacttaaaggattttatcccttataattttacttccaacataattataatttttaccccaatttttatattttttttgataaattttatccctaacttttttttggtaaatttta

SEQ ID NO: 2611 - DNA, 1000 bp, Glycine max
  Soy_ogl_6556 Gm19:44240001..44241000 Cluster 10
ctagtcttttcagtcatattttgttcatttatatttcatacctaaaatatagaatgagaaaataagttattactaaatatgtaaaataattttatagtaatattattttttatgaatctaacagtatgacactaattacattgctctatgctacacaaggaactagatgacctgaaaatgatatgacagaaggtatcagtgcttcttttttctgattgcatgatgaatggatgctagattttcaattcaacataacaaccggaagaaataaaaaaggaaaagaagaatcaagctgtcaccggtgttagttcaccttatatttcccttgtttaaattttgtcgagcgcatataataaccaatggaattgatccaacattcatacattatccatttgtctatattttaataagcaaaattccattatatcataaaatagagataatgcagaaataaaaaaaaaaatgtaacattaagtagtactctgctatcatccacacggacccctattaaacacagaataaatcattcatatcctgaaactaatcaaatcaagaagtaatcattctctagatcaattatctcaatccctccattaggtttctgcattttggtaagtttgctttgcataaacttcaagccaaattgtttcgcaagaatcttcacaattatagtctacttccattgttcatatgctttctttcttctcccagctagtcactgccaatttaggacaagacaagaagtgtttttagcagcttttctactgaaaaaaaaaattatatttcctgtacataagctctcaaaagcatttctgtcttatatccaaacaggcctagaatcttcgcctgatccttcacatgattatatcagtggactcaatgggttgttgctcaagaatttcatcttcctcataagtctaaggcaactcattagactcgtaatggaactccatatactctcaaaacatagttacattaggatcaattattcactgattga

SEQ ID NO: 2612 - DNA, 1100 bp, Glycine max
  Soy_ogl_1221 Gm04:4434101..4435200 Cluster 10
catagttagaaacaaaaataaaaacttaacacttacagtataattttactatttgaataattcatatatatttgttatactttattttctaatctttagataatttttttcattttttatcatctctaataattttttaagttttttatttgaaaatatcttcagagattttagttttttattattattattctgcttgccgactatgattgttctatctatatatgcatcctgattgtcaagaaaaggcgaggtgttggagatttttgacaaaagagcacccgattatgcgattatgaaggcacacatcacctcatgatagtaagtttaattacaaaatctaatcaaagggaataaatgattattttttagtaaaccatcaatttagtcttaaaagtattgttctgtgatttttctctcttaaatactccataaagtaataaaactttatatcagtaatattttgagtattgaatattcgaatacctgaaagactgtttagtttctaaattgatatattctattaacctttaatgatcaatttgaaagattttttaatatttggaagactatttagcatgacttctaataattaaaagattacttatatatgaataaaaaaaaaggattacttatataatttatttattttaaggactatttaagaggcaagtcaatactttgggaataaaattgattatttgttcaattttctattgttctgtacttctaataactagttttgaacccaaaatttaaccccaaatgtttgactatatatatgcaggtgtcaatgataaaaaaaaatgatattgaatgaagttttgagactatatttcctataatagccattcacaaatacaattggtgtgaaacaagggtaggaagcatgtccatcccggctagggttgagttttgtttaccattgttacttcttcattatgatagtaactattgggagaatcccgaagagttcaacccagttagatttactaaagggcttcaaaacattgccttcctagaggcaaagtttgccctggctatgattcttcagcatttttctttccagctctcaccctcttatgctcttgctccaagta

SEQ ID NO: 2613 - DNA, 1362 bp, Glycine max
  Soy_ogl_2687 Gm08:14614039..14615400 Cluster 10
tctaaattgaattttaattaatatttttttaaagaaaatctcaaatgggtaaatataatcttgtattacaatatagttatttattatgaatttaaaatataatttatatattgataaccttgtattataatataatttatatggttacatataattttttatataaatgagaataattttctcagctgtgaaaagctactctcccttttccctcattgtgaaagtatttatcagtcttttttcttggcagttttagctctttgttacccccactctgattttttagaagaataactcttggtgatctattcaaacaaaactctcaatgaggacctttggaatcattgtttttctctttcgttgttccgactatagataactctctaatctctaaatctacaaagatcatattattatctttatcttttctcttacccgaggataactctccaatttcttctgtttcaaaactcggagattccaaacggtgggataacaaacttttgtgataatggtttatcattatctttcacttgccgtggggataatatataaatgagtattcctctatttaaggtcttttcttaatttctttttttaaaaagcattttaattttcaaaaactaattaaaaatcctatttgtttggttatttttgtaaaactgttttctaattttaatttttaaaactaaaaaataaaaataattttgagatattttccttttttaatttctcatttctcttttaaagggaggtgaaaatagcattttcctaacaattactaaaatattaaactttttaagcctatgtttgattaaaatagtgagaaaaggatttagtctctaaaattatactacattcgttctaaaataagtgtaatatttgagaaaaaatgtcccaaaataaatataaaatttatttttttaatataatattaattattttttccattaatatctctaataaatattattttaattttttaatataattggaatattacctattgctctttttcagtcatactccttattggtcatttaggttttcgacagtcatagtttagttccctggaagccacaaaatagatggatcaatggcataactaaaattagttcctttagattcaaagctacccacatttataggaaagaaaccattgtccaaatttacttgttaactttgcgatttctaattgcaactcttttaggtgggacgcagccacctctttttgttctcattactatgcccgagaatttaatgggttgcctcagtgtatgttttgttgacacgggtcttgtctttgtctctccatgatgttttgttcatctttctctttattcaatcaaatttggcttgact

SEQ ID NO: 2614 - DNA, 1000 bp, Glycine max
  Soy_ogl_6684 Gm20:1754801..1755800 Cluster 11
gttgcaaaggtcatgacaatttgagcaagaccgtaagaactaagaaaggtgaggaacacatcatggtgttttcaatgagtgtaggcgggattgacagtagttgcatctccttcatcaatggtggcaatgggacaaggagtgctgtgagtgatgtacccatagagatcatgaacttgtaggagatatgagtgatttgagtgtgcctaatatggtgattggcatgggaagggtggatgcggtgggtagttccaaaagtaaggaagccatgagtagagagagggttgtgaagttataggctaatttaatacaatatagaagacaaataaattagaattttattgaatttcattatatgtgtataatatatatatatattacaaagaaataacaagactctaattatataacttaaattacactgaagtagagagatatggaaggctttatcattattcgaacattataaattaatcaattttagaacaatccataaattttattacactgcttaagaaaaagaaattttattgcaccagacaattattatttttcatgggttcttcctactatattaattattctttcagaaggttctttttttttattattattgtaaactataaccttttttttttaagggaaacaagattatgcaatttcattccaaatcaaagaccaaatacaagaggaaatgtgatggaaaacataactgcaagcattaaattttaatgcttttgtaagagaataaacaacataattacgtcttacaaaagtcaccctaactagagtttgagaaactataaaaaatatgtctacattttgctaaaataacatggagatgatcagatatgccagtagaagaacatacggtcactttcaaaactgtcgacaaaactgtcgacaattatcttacggtcactttcaaaaatcaatcacagtttggtagacgagatctgatgtccattgaagaacatactataaacttaaagatcaagtaatt

SEQ ID NO: 2615 - DNA, 1428 bp, Glycine max
  Soy_ogl_6366 Gm19:8190601..8192028 Cluster 11
gaaaatggcctgtgcccctcctcagcttgctctttgtgtcacagccaaactattgatggtgaattaacggaaatatatattttcacttaccccaagaggaaattagagaccaagtttctataggatcacaggaccaatttagttgtgcgaatagaatctttataatatgcttatgtagtccaatctattggaaaatgatgggtggatactcaaatggtagttgattcttacatttcatttggaactaaagaaaatcagagggagggtacacatgtgtgaaagaaaacaaggaatttttttgttaaactcactcaaatatttttttttctttcaatttagagataaatatactaagacaaaacttaaataggtataaagataaaaactctccttatttattatacatgtttttttttttggaatatttgtgtcattttatatatctctctcacttttcactttttattcaatcaaagaaccatctcattttgatactatttttctttctttaactttctttccttcctaaatcaaagtattagagagataaaaagagaaaaatataaatataacaaatgatatgataaaaagattaagataaagaaaaatgacaacggtcagtacaatatttgaacaatgaatgttgatgtattattactgcaatctattctagtattctttacctccttggaagaggaagaaggttcaaggacctagctagtcttgttggaaaatgattcggcatgacactaaagaccaaagggaacaggaattcgaaatgacttgggaaggcaaaaggaagttcataaattgtaaaaagaaacaagtgataaatgtaatgataagaagtggatagattatgatagttataaatctatctatatagtatatacataatataataatgttttctaaaagaaatgttgatacgtgagatttaatttttagagtcgtaaacaattaatttattgttaattttaacattaaataaaaaaatgatttacatgtgtgtttcttattaagatctattattatatttataattaaaattttataattaatgattgtcaatttaaatcactaaccgttagactaattcttttgtttggtaatcaggatttgaaacacttatgtcaatcattgatctaattagactaattcaattcaacacaaataattggtttatagatcgtttgagatatatattatttataaatcaatggtccattatttaataaattaattattgtacccttataattagtatgactatagaataaaaaattattaaatttatttaatcaatctatttcaattctcattaaaaaaatctataatatatatttaattatctatatctatctatactatatacatgcaagaatgttttaaaatggaaattggcgttaacaattatttattgaatcc

SEQ ID NO: 2616 - DNA, 1154 bp, Glycine max
  Soy_ogl_508 Gm02:12004501..12005654 Cluster 11
tgaatattttgctaactagtactcatgacacaaacagtctgctgaactacgtcagtgtagagtttttagttgatcttttgtgaaagggttggatatatattatataattgtttgatataaaacttacgctatatgcattattttttggtacgtgacaccatatatattgtgttatggtatttacttttcactaaaaaaatggtttagttgacaactatcgagtttatatcttatatgaatagtttgaatcttattaattattgtatgatttataagttttgttagaattactttaactttgagatcaattatgactttgacgagtctttgagatttaatccaactaatttttttcataaaatgtggaaaaagtttgagagatgggtttcgagacatatagtcttagccaaagcaattgttatcattatttagagattgatgtaagtttttatctcttaggtggattgacctagccaaaatgaggagaaaatttaatcccctagaatctacgctgagattaaaggagtagaatcaagactagcactaataatttgattaacatgctaattaggtggcttaactagtgaggatggggcttttgtcctcacagactaattgttatcttgaaaaatactaattagatcaagctattaacaaaatacttcacccaagttcaagttcaagaacattcacaatcctccaagtctagaatcataggtgtggagacttgatcaagtgagactattgggtcaagtcactaacaaagtacttaacccaagttcataatgatccacaaactttcaagacttaagtcatagttgttaattttaaccggacatgaaaaataacattaagattgttcatacttaataatttatataaaaacttgttttttctccatcaaataacattaggattgtttatatttgagaatggaaaataaaataacctagcgagaaagcaatatattcacccctcatcatataaatgttattttcttaatgatcaacaacgttaaaaatttcaaattataccaaacatgaagaacaatatattcccaagttgtctttttattttagtgttgacaaaactttaggaataaaaacaataaataagttgtactacattaagtattaacccacattaaatttttt

SEQ ID NO: 2617 - DNA, 1556 bp, Glycine max
  Soy_ogl_2058 Gm06:42674001..42675556 Cluster 11
atcttaaaagttgggataaaatgcatcaaattaatttgttatggataaaatttgttaaaaattaaaaaattagagataaaaagtacaattaagccttttaattaaaatatgaattcagaaattaaggttttcgattttaaattattgtctattaaggaattttattctattttacaatatatttagtacaaaataattatttcagttttatacaagatttataaataatcgtatataggattgatccaatgattggagatggattaaatgagaatgaaagagtgagagttaacaagtttgaatcccccaattaactttttaacttaaaaaaaaaaactaacaatgccaatatatagttggttcaaatattaagtcactttcattacaaataaaccatatatttaattgtgttgattttttttatttataagaatgaaatacaataaaaaaaattattaacattcatctatcatgatccatttgattttaagtttacttttgattatttaacttggtaattacatcagtgtatttgaatttccaagtgcctctcaaggtcatctcgtattctcaaaagctctaccataagtacactaataaattgactatagtaatgcgaccatgtttacatttcaggtaaacttctaatgaacaacccaaacccaaagactacttaacttcgtccataaggtatatggtgttggaatttagtaagtaatttctggtcacgtaactaagagagaggacgtgtacatattgctaaaagagtcaaaagataatataagctggtattatatcatagtatatccaagaagcttcgcttactgactgatcttattcctttccatactcggtgagataattaagcgtgtggttgagtgtttgataaaaacatattttgaataaaattaattttatgtttaaattttgttatcataaaagaaaacataaattatgtacgagagaatggaaatacgatgcttcgaagtatctcatccagactgaaagaacccgagagtgtacgaggaaaataaaatgaatgtccccggaaatactgttgaaatttacttccggaattcaagtcataattttttaattattaataatattttttagctttattacttcttctacccgaaaagctagtaaagctagtatgctcacttaaacagaatgaaaataaataaacaacaataaataagttaaaatttgaaaacgaactcctttccttttctaagcaaggaaagtgatagaatgaaaaaactcttctaatactacttgataaagtgccaatgatattctagaattgtgagtataaactcaccaagaaaattactgtattaacccaaaccgcaaataattttaaagtactaaactaattctttggagtaagaaaattttccctaatgttgtccatcaaacaataaaagtaatgtaaaaggcataaaatggaactccttgtaacaagaatttactatcctaaaccaacctactcagatgttgagttaaaagaaagagaaaaaataagacttaaaatatattttttgtctctacaa

SEQ ID NO: 2618 - DNA, 1036 bp, Glycine max
  Soy_ogl_3844 Gm11:11084201..11085236 Cluster 11
taaatatttttaatatttaatgaaaatattaattaaactaaaaagtaaaatgtagaaaatattaattaaactaacgttttacaataattacacattcttttcaattaaatgagttaaaaaatcctctttgtatttaatattataaatttttgcatagtggagtaaacttttcatatacttttataatatgtattctcttttaaaataatttttacttaatattttatttttaattttaaaatacataaaaaataatataaatggatatgattattttaaagaaaaatattgcaaaaagaccccaaaaaaactcaattttacagtagtattagtttgatagtaccaactaccaacagtcacgcgcccagcagaacaacacttgaaaatattaacttggtttggaggaactcgctgctttgatatatggtatcttacaatcttattgatatacttgagtattcagacgggttcatttatattttatattgtatatgaagaggatttgggttattttttcttggttgtgttatgagaaaaaaaatcatgaaaaataaatagtaatttacataaggtttatcatttttttatatttttattgcaacataaaaaaatatagatagatagataacggtattttttttgccaataaccatagataacggtgatatactatagtgataaacgaatctggagataatacaaaacacatgtgcaagagacatatgggaaagacaaatatatagcatattttggattttccccgcgcaagaaataataatgctttatttctttaaaagtaaatgacgtgacatgaatttcagttaaatttcattttaagttatttttctttttaattatgtaaatgttttatgacagaattcttaattaagatggtaagcagtaacattatttgatgtgtcattttttagtttatattatggctaatcacagcatattgaacttttacattggaaccgttcactatcatggcatagtcaacgagatgaaacaacgaccaaactcttgaatgatgtta

SEQ ID NO: 2619 - DNA, 1200 bp, Glycine max
  Soy_ogl_3072 Gm09:28657501..28658700 Cluster 11
attgttgagtagaagctaaacttgcttaaactactagcgaaacatatgattaactttacatttttacgtgataacaaatacttttttattgttatgaaatgattaagtgatgcttcttagtttaacaacatatcttatataagtaatgtcacttaatatgctccaactaattctgctagcgctcttggaaatgtatcttagagttatgcatcacaattaaggtatcacattgtagatgttcttgtcattgtatttggttgtgaggagagaaatgaagtgggtgaaaataaaagtgaggtaattagataaaatataaatatagtggaaataaaacacattgtcagattgtttgctttaaaagaaataggtgagaagagttgaaataaaatattaaagttgtttggtttaagggaaataagtaaaataaataaataaagttgtaaaaatacgtgtacacccatattatatggtgctagctaattgtatataattgattattaaaattatataatctattaaatgtatcaagttaatcaattataaagttcagataattggttttagaacacaaacatgtattgcacgagtttttaattgattaaaattttaattgaccaaataaataattctaatatatttactttagccaaccctgtgaatttgaagagttgattatgccatttgaagaaccagttatttcaagtgtccgatgattgaacatattcaaataatcatttattagatttgaataatcgattaatcgaatgcaatagagttcgagttgcgctcgcaagacgttgaaccaataggaggacacataacaatgacaaccatctagtggcatgatcttcaaaaaccaccaattggaagaaatgcagacctcaatgagcactaataagaggttgaaagttgcaccaagaaagcaactttcgtagccaaatcaatgagtttagcagaggtgaaatctacacacccaccaataacacattttgacgagggaggtaagggtaacaatttggggaaagaggttaaggttcctcaacaacaacaattaaaagaagggaaaaagagtcaaaacaatgtaatcttagttgttgccgtgacttgctaaaaacaatcgtaagacaatgtaaaaatgtgaaacccacaatagcaagtgttaactttctcttgaatcacctcaaccaaatgatttgggtc

SEQ ID NO: 2620 - DNA, 1434 bp, Glycine max
  Soy_ogl_5692 Gm17:15535467..15536900 Cluster 11
atatatttaaacttaaatatatgaaaaatattcatgcattaaatttttgggtccaaacaaattttctagttttgtccctagatttggtggcacgcagattttggtggtggtgattggtgcgtcagtttggttggcttgtggcaagggtgacaccatggtgtggtggagatggtgaaagttttggatgatggtgggaggtgaagaagatgaagacaagggataactattttaacagaacaatgttaagaaaaattaaagaatgattaaggtgaaatttttaaaaatttaaaagacataaaacttttaaaattaatatataaaaatgaaataatactaaggtattataatagacgaaaagtgatatttaacttttatattatcaggcctgatttaacctaatttctttgagatttaagtgcatttttggatttaattattttcattgaccaaaagtaatgtgataaattaaaaaaaatacttttcaaactctaaaaatattgaaacgacaattattttaaaaataaaattaaccaaaccacattacactcccaattggcaattattctattgctgtagccggctaattttattcaataatttgaatgttcatataattgagaaatagagcaaaactctccaagataaactcaagcatgcatgatctaacgattctaacccaactttaagtgtaactttgagaattaagtggatgttaatatggatttagttattttgattaaccaaaagtaattaatctgatcaattaaaaaacactttttaaactctaaaaaaatttaaaagaaagcaaatttttaaaaagataataaatttaaccaaacacacaatacactttaaagtctaaactaaaagacccaaatgacaatgattccattgttgttgactgtagttatctaacccaactttttttatatacgtgtaactttgagaattaagtggatgcttggatttaattattttgtatgattatccaaaagtaatatgataaatttaaaattactttttaaactctcaaaattaaaaaataaaaatattttttataaaaaaaattaaccaaactcacgatatactccaaagtctatactaaaagacccaaataagaatagttcattaatgttgttatcaaactgtcttgatccaaagtcaaggagagttataacagattaattcaaaccatgtatcattcccttctttccttcaccttttatctaccaaactaaccttttatatctcattccatggcgtatatatgtatatatatataaataaaagaaggattatatacttggtattgcaaactacgtacaaatgttggtgtttcatatggagaaggagcagtggttggtattgttgggagcaatagttttgggctgtaatggttgcttccaagaagagaaggttgcgctgctggatttc

SEQ ID NO: 2621 - DNA, 1100 bp, Glycine max
  Soy_ogl_2799 Gm08:34788101..34789200 Cluster 11
aagagatgtgaagagagggaaaaaaaagtaaaaaggaaggataagaatagaattatataatactttattgatattgacccaagacgcaccctttaggaactatgctgttcgcccatgaaaacccatgccactgtgttattttctttactagatatctatgctaaaattattaccttgtgtacatttctctattctaagcacaagctagatgtatatttctctcatccataaatttgagtttggtatttctttaaaagtataaccgaaaattttaataaggaattttttatgaaaaataatataaattaaaactcatccttaaaatcttttgagtttaatttatataaattgacggtataacttttttacgatgacaagtaattgaaaataatcatctaatcatctttattatgcttttaaagataattattataaaaattaatagatttattacatataataatttgttattaaattagagtgtaaaagaccttttcacgagtgtatatgcattatttgcaaatatttatttagaaaattgtaagtaatgacacccaaaaataaaatcttttggaagttttttctaaataattaacatgtaggacatatttgaatataaggtaaaagtgtttttgagagcttttatataaaaaaatatagatttttttagtaaagaaactaaaaaaaaaatcataaaagtagtagtccttctgattatgcaaacatgctctaaatgtgtcagcttatcatgattgtgcaaaattttgattctcccgcaataggaattaggattgctaccactcccatagtcattgaataatagacatttcaagagtccaaaatgaattaatatggggcattattaaactccaacacattaaaacaaaacaaaaaaggttttgctttatcggaaaaaaaaattttatgttttggtggtaagtctctgctttaagggttacgcataaaaaaattgtgggtgggttgagtccatactgttgcacttcacccatgaatcacatgaaagaaatgcaattttctaggacgtgtggtgtggtgacaaaactaaaggtagatcataattggaatctcactgttgtggc

SEQ ID NO: 2622 - DNA, 1314 bp, Glycine max
  Soy_ogl_2803 Gm08:34856801..34858114 Cluster 11
aatttagtccttcttttaataaaaggttgaagttagtttcttactttttaaaaatgttttcatgtgattcttttcattcaattgagactaatgatgcatttgaaacaatacttttgaaaaataaaagactaaattaaatattattttttagaaatgagagactaaattaaatacgaaaagatacgttaaagtgttgttaaaaaaaaaaggaacaaaagtgaatcttttatcaaaaaagattaaataaaataaataacaattgttatttcaattcttcctgtaacaggaaatttttactaattgttgtagtaatggataaaccaattattgtagttttaaacttcccaaaatattggttgtttttacctagcctgcatgtgggacacttgcaatgcaattttgaaaatttcttgcataaacaaagatttgatgtctcaattcccaaggaccgaaaatggcaaaatttaatggtagttgaattttaagtcgttgcttttgtaaggaattttgttataaaacatggaatatgaagttttatttacgataaacaatcttattgaataggataaaactatttaagataacaaagttttttcttgaaatattttacttagttgtataccaaattcaaacatgaaatcattgactaaacaaaaaaatttaactcacagttgattcacattttatgatcaaggaattttgtgattctgacattattttaaataattcatttttaataaaaaatagttgcacataataattttttggataaaaatgtatctaatactaaaaaagtataagaatttttttatccagtaaccgagaagactaatgctccgtaattatatataatttggttcaaaggtagaagaataacattctttttttaagattgggtctaaataaatttctgtatttacatgtttataaatttagtgtcagatgaatctatttgtaaaatataatttttttaatcacaattagaatgataaaataaaaaaagtgtccactttttaaaatgtaaaatttagtaatttgaagtcaaaagaagctctgaaaaatccgccgcgatggggtcaccacttacaaaacacaagttggaggagacgtcttcttatgacacaccaccattgaccaattattaagactgcgttgcgtgcgtgtttcaaaagcgtgtgcacgttgaccctttttagagttcacaactcctgcctacatggtgacaaatgctaaccaatgtttcgaaaaaagttagaaatcaaaaggttttattaaaaatattctattcatatttattaggatatagcttaattg

SEQ ID NO: 2623 - DNA, 1100 bp, Glycine max
  Soy_ogl_5111 Gm15:42804401..42805500 Cluster 11
catagcttcataaaagcctataaaggcttagtgaaataaataatatttgggtagttatcttgggttaagataatgttgttgtaaaacctaaagaggtttagagaatacttggttggtgttataagtagtttgcttaattagtgaaaatccttcaactagaagagattaaacgtagctcttgttatagagtgaacccggatctatccttgaatattttatctccctatcatttttatttctcacacttaacatttgtagacaatctgtttttgaaagtgctttgaacaaaagaaaacctttttgtatgcgaaaaagttttaaaatacacaacacataattaaagcccccattcttgtgcattctcttttttattttaagactacaaattgggccataatgaagatcaaagttagtatctaatggttgctgatcttccatagcaatctagcttgagtcaaaattaatttgaagaaactcttatcattttaatgttgaagactttattttaattcatcaaacttagatcagtaagagatgctacatggcaccatacatctttttaatgatgaagagtttattttaatatatttcaaaggtcttatatttaatttgttttggaaagtacttgcgaaattttaattttttttgtatttactaatatagcacaatcacattatatataacattgtctcatcatgcaataagaaaagtaattaaatagtattgtgcattaagacaatctcattagcaatctaactaataaatctccaagtgtgcccccacaaggaaataaatctaatagtatataaaacttatttcctagctagtcatacctaaaaatagaaaaaggaatgactagaaattagatctcgataagtccaccaccaatatgtcccaaaccaaaaggccacctctcaccatcttgtatggtaagatctacatttagggcgaaaccagacatgaatattaggtggggaggggtaacatactcaaagctagaaatatcttagaagtctcataaacaatataaaaataagaggagaaaaaatatttactaagaattgaatagaaaaagaaaatatttgtttgttagtgagtct

SEQ ID NO: 2624 - DNA, 1233 bp, Glycine max
  Soy_ogl_6005 Gm18:9081901..9083133 Cluster 11
attttggcttaccctttaaccaagaataagccctctagcattacaaatgacaagattgatccagaaaccaaagccctctagcattgtcttcacacgactgataaaagataaaaaaaaaaaaaaaacaatgcaattcctattaaaatatatgaatggtttggtgtggcaatcaaatgttgtggggacataaacatatggggatctgagctaggcattgaaatctcatgttttcatctgagctaagcaattactacagctgacttttcagtgaatgctttctttatatgcatgaaaataaactataaggagaatattcataattacttcctatggatatatgcaggagaggtaccattggagaagtaattaaatggcaacaaaccaagataaatgaacaaaataatcacaaaacaagaaacatctttagaaatacaaaaactggaaaaatataaactgaaataaagtataagatacaattatgcaaaagaagagttcatgtgtattaatggtttaggttgatattcaaacacaaataattgtttatatgattttaaagataaatttgtaacaaggaacaaattaattatatttaatattagactctgtttggtgtaaagaagagaaataaagtataacatagaaataaaaagagaaagtgaaaataggtaaaaaaaaacaaaatgatatgttaatatgtttgattgaagagacataaagaagaaatgaagagagagataagtaaaaattagccagaaataatataataattctcatcaattttaaaattattgactttcattttctcacctaccaaacatccctacattatttctatctcattcatattatttctcttatttttttttcaaacacaaccttataagtatttttctcttagttaaactatgtgctaaatcatataatttacggataaaaaaagcgtatattttttttcctgattattatacttgtttatttctttcctctccgctaacattgtttctacttttagtatactaaaaaaacaagaacaaaaaacgaaccattattttaactttccaataagacaatagcaaaatcacaaataatttaatcaataaattttaatgaattatactgctttatatgtttagtttaatttgtctaataaatgattatgtatttttattacttttttaaaaaacattttttccaaatattatcctttactttatataccaataatagcattac

SEQ ID NO: 2625 - DNA, 1197 bp, Glycine max
  Soy_ogl_6372 Gm19:12165701..12166897 Cluster 11
attttcttctctttccttatcctggtttagtttcatgtttagaaattactagcttaagtttgtattaggcatatttttcaagagatttaagtaatcaaattgttatcttctcgtaaaaggttgaagctccatgtggtagaatgtttgatttagtcatgttttttaaatgaatgatttatatattaagttttgagctttatttgttaggtttggaatcgtaaataaaaaaattcatacaatatttcaaataataaaagagtttctaaatgaaataaaataagacctatatatattagttatgtaacgaagatgtgtcattacaccgaagtcttatattactcttaatttttaaagcatggacataatttcatatatgaactacgtacaattaatgttaaaattatgttgataattttttttcagtaattacatattactgtaacttttttgtatgatgcgtatattttaaaatatttgttgtatataatattgatatttaatttcattattaaataaatcactatatttgcctatttgacaacacaatttaaaattaaataaacaataacataaaataaaaatttataatatgatgcaaaaaaaatggacatatcattaatacttttatataataaatttagaggttaaaggtgagatacagcggcagtataaggaaagacaaccaattaaaatgacctattgtgccacatcaaattttaattaaaaatagttaaaaagaaagaaaaaaacacaaaaaacgcttgcatctcgtctcttcttcgtcgtatgctcacaaattgaaacttcaaagttatctttttacatttttttcccttaacttatctttctacttttgttagcatataaaaaggcctatcttatgtttgttctccaaaaataatcaaacaattgtagttacccagacgatgcttgtgaccattaccacttttttcattaagttatatcatcttctacctcttgattttcttaacaaatttaaaacaaattaaattaaactaaatcgagaaaaataggtttatcgtgaaatcaaaattgaattaatttcatacttgttttaaacaccgcctatctatacagaacttgtctgagattgagaatcattcgcaacaatggtggatttacattatgggtaatgggagcagttgccctcagtaaatgttttactttaatatattg

SEQ ID NO: 2626 - DNA, 1600 bp, Glycine max
  Soy_ogl_4088 Gm12:34320101..34321700 Cluster 11
gacatttagaaaatgaagtcatggtggtggggttgagttcacaggttatgatgaggtataataattattaaaaaggaaaagaaaaatagaaaatccaaaatgctagctggagaggcatgatgccaagaaagcaacgcctagagagagacagtataatgcccaaacgccaactagccgtttgaggatgaaagcgactgctttctcatcctcgtcttgcttcttacttgcttttccaaaccagattctgattgcttgcaacatacgctcttttttttacatgcacgagacattaatatttatacatatacatttttaaatgtgtttattttaattctacttattgaaaaaagcaatataagttttaataatattagttcatttttttaagatgatgtttatttgaatgttaatattgtagtgatatttatatatattatactatataaatagatatatcaaccatcaaagtttttgtaattgatctttgagtcttgagatttactctcttcctctgagttcaattcacttgtacttttagtgaagaaactggcatattataactcttaaatgtaaatattacatagaatattaattttgtttttataaatatgatttgatgtcacgtattcctgtggaataaattactatagttacaatttaaatcaaaagatgaattttaaaaaaatgaaaaccgaggacattcaaagagtttaacattttattgtatcctgttgcacaagccagctatacttgatcaatgctataagcacaatagacactttaacctttataggagacgtttgctacaaagattttttttccatatttgataatcgtcattcttgattctcatgaatcatgagaattatgattttcaagaatgacttaaaattttcagaaaactttaaatttctctcagtatcaaacgcattcttagtctcaatttatgatttggaattgtcgcacatttgatttatttaagaactaaaattgtgtttaaaaatacgtccaaatcacattcaacggagaaattcggctttccagggataaaaaccaaaaaatatgcaaacatacacttgtacgcaaacatacacttggtgttaaaccattcacatttaatctcattgttttcatttgattgacaaattgagtcaaagctaatattccttttcattgctagttaatttttatataataaaaccattcacttactcaacaagcttaagtgagttatcttttagaaaaaaatatttataacattactaaaaaataattaagaaaattcttttaatttatttaaataaaaaatattaataattgatcattttcaagtgcttatgtaatcttatccttgagtatcaaaatattagtctaatcaacttgccgcattcttagaagcataatgatatataaacacaatttattttaaacattcactaatatctttttctttctatcatatcttaatttctatcatgtttatacttgtatttttctctttctatctctaagtgacgatagtatggtgactgtcaaatatttttctttcataaataagttgaaaaaaaaaccctaccatgttttaaaatggtttagtgag

SEQ ID NO: 2627 - DNA, 1782 bp, Glycine max
  Soy_ogl_6691 Gm20:2120919..2122700 Cluster 11
ccttgaaaatgatttaatcagataaaatttaacataaattaacgtaaatataatattatatagactttaaatcatttaagtatgtgatgttaaatatatatttttcattcattcacttaattctgttttgatatttttttacagtatgttaaattaataatctctataaaagtgattataatgaaataatctatcttgtataaaaaataattttattattattactttcatttgagttttgttatgtattttatttgtttgtacaaactcctttacttttaggagacaaatattttgaaaattaacttatggacattgaatcgattttttttttccaataatataagaaattaatatagttcttaatataaaattttcatactccttgaagtttgtacaaaatttatcatggccatacaaaattcatcatgatcatattaaatctaccatgattgtgataaaaaacttaaagttgattttcaatcttgataattttttttcttgtatatggtcaaggacaaaactaggttatacacaataggggttgtcgaatattttctgttgtccaatgagtataaaaatgaaataatagattttatcaattaaaaatatataatcctatgcaggaagcatgccatctattaaacgagcgttctaaaaattgcaacatttttaatttcatcttataagacagtaaaaatatctaacatgtcaaattaccgtaagttcttttcacgagctcaccaacgcatgaatgcgacggtccagtttggctgtgaggattgacgagcgtttgaaaccaataactttataaatctccgacgaatattgctttccaataacatgtctttttaaggccaatttgttaatgcattacatgattttttttccgactttgacttcataaatataattggcgttcacaaccaaaagtgaatttatcacatcatttagcagtctcaaagatgtaaaatcacagaacaagatttcttttttatgttttctctaacaagatggtgttagtttatgtaagacaggttcttaagagggttttatgcggacaagagacaaaaaaaatcatgtatttttggaattattaaaggaactgttaagaagaacatgatcgttgtagattttgtacggttgtgataaagccacagacaagaagccaagattgaaaatcatcatcaattttctgagcagggctgtggtggattttgtactgtgatagattttatatagaccacaagagtatttaaacaaatcacgtgatgttcgtcggaaatctatttgttgaagaagatgaatctttgacttgctccttcaagctaaaggaggtaattgcatatcaagagttgagtttaatagtttttttttctaacaaattatggttctaattacttttttttgtctcttagataaccattttgcttgagtatgaatcctttggttgtgtttaatttttttatatattaatgttgttatttggtatttttaggtagaaatggaatgtttgagagagatgctaaaagttgcagtacatgcatggtgccctgagattcgatccatgagagttggtgttgctgcaagagttaatgaagaaaatgttgacctattgaacttgccaccagtctggtggtcacagatgtcttatagatcgaaatgcatataaaattgtagtgagttctatacgatttttgatgggtggtcatggttctgtcaatgtatataaaattgtcttgttgcatgtagtatgggtaggtaatattctgatatgaataa

SEQ ID NO: 2628 - DNA, 1893 bp, Glycine max
  Soy_ogl_529 Gm02:13647008..13648900 Cluster 11
tcttaaaagttctcttttggcacttggcatatgttttggttacacatatatcatatatgaatgagtgtgatctgtcactgtttcgaagctattttcagtaacttatatatgcatttatccaatatttgatgtggaaattgaagtatatgtgcgtttttaacaactattgatattcaattaattaatcatagaatcgcgattaaaatcaagatggaaggtgaaagaaaaaagcccgatgaagttaataaaaataagcaactatatttataactaaatttaagttaatttaaataagcaattaatttattgatttaattcgattccgattaatgtgtgctacatgtcagttttttttttcctccatacctaattctgtttccatctctccccggcaactagatatttacatgtcagttgttgtattaggcatatgtcacgtatgtaggatcatcaacagtatatgccatctatctctttagcaggtgacctcgaagaaattcattttggggatgtacaatgcatatgaatataataattgacaaaaaaaaattgaaatacagaaacttcttgatattcttggttaatttattttatggaaagtgctattttttttctttctgataacacgatagtgctattttagcacgaaggatgtcacacaaaagaaattaagataacatcactcacttttttgaaacaaatatgatagagtatttgttagaagtgaaccctttaaatgaattaatttattttatcaacatgactatttaggatgaaggacagacgcgcatgaaagaaagatagcgtgcacagtgtcttctcttaaaaaataaatataaaaaaattattttctaaaagatataaacttcttagatagacttgagtaactcaaaggtgttaattattttttaatccgtaagacttaaaagataaatatcaaaatttataacaactcatatctcatacttaaaaggaattaatgctaacttaatgaaaaatattcagaatatatcaatcaatacaaaacaaaaattcaagaccaaatcaccaaaaatatgttttcattgataaatctaaaaaatgaaatactttaaaaatataaatgtttactttattccttggattttgtcactggcaatttcatttatgaaccatgaaaatgatcaatttatcccataaatatataaatgtattaatagtcaagtcttcttcaactgtctctcatgaaaatgatcaaggaaatcacggaaacttagtggttcttccccctctctatgactcatgataaggcttcttcaactccactcctacctgggtaaccgacaacaaccatccattgattgaagatgttccatttttttcttttcttttgtttggtttggttgctgttgtttttctgactcttatgttttcaagtgcataaattggtttggactaatgaggatttgaatttgaaattaatcggttaagaaatttgttgattttaagttaataattttaatttctaaatttgtgattttgtggtttaaaattttaagttgattaagatttggatttaggatgaaatcgaaaaaataaggtttctctagttgaatgcacgtttttaaatttccataattatcgtgaactatttctatcttcaatacataaaccgcatgtgagatttaattcattttattttgaccttgtattttttgtagctaatcccctcataggcttctctgcgttggcattccactttcaagctttctttctcttctttccccctcccatttggactgccatatttgcacacactgagcaaaaattataggaccatgcatggctccgactattagcttttatctgaatattaaagattaaattgttagtggggactacatcaacacttgg

SEQ ID NO: 2629 - DNA, 1700 bp, Glycine max
  Soy_ogl_632 Gm02:43601501..43603200 Cluster 11
atctctaaggttctcacaacattaaaacaaatacatcaaagaggagctgaatcttaatatatatccactaaaagccgcatgaagaaaaatacaacaccttagctctaaaattaaaccaaaattcgtactcaatcgtcctacaaacttaaagtttgctacaaaagcacttggatcaacttgccgaagttgataggtgataaaaatcctaaaaagccttcaaccatgaccatacaaaaaacatgatttttttttttatcaaactttctcactgtcaaatattattttccttcaaatgccatttcattttgctgactctataaaattcagaggatagcataccaccccaccacccatcaatcatttgcttttctcccaaccaaaccatgtgatgttgcaaaaaatgatccaatgctgactgcctaatttaaatccaccatgttgtaccaatgtttccaaatattaggtgaaattggacgtgtaaaaaatagatggttaaatcctctacctcctttttataaaacgcgcacagtaattttttatcttgaatttagatttttctacgttgtagattcatttttgttggaatcctcaaatgcatgctaactgttatttatgtttatatataaggattcatcatcatcttatatgtatgttttatgtacaatggggacaagtataatagttaatacaagtagctaagttgcggcgcatttttttttaattaatttgttagttgatggaaaaaaaaacaaaaaaaaaatatcagggaaagataggaaagaaaggatggagggagatcgatgctgaggaagagaaggaatttcaagaaagaaagaaggttattggggaaagaaagtgagggataggtatttttattttattttaaggtagtgttgtgcatgagacaacttttatcccatggtttaatttaatgagtaacgcagtttatgatttttgtcatatttagctttgtttagttccgtaaacattttttttgcattaaacatatgcacataacatgtttttttttttacggtgaaattttgtcaaaaaatattgccgatcatcaccatttgagcgttgccggccaaattatttctggtaatttttgtcaatagaacttaagcatttccactaataaaatttgtgttgagtgttaagttctatggtaatattttggttttaaaaattgtgaagtcattagcctgagacgaagataaataatttagagtgtatttgttttatcgattgagatgtagagacatggaatttaacacgcatttaccacaaaaacaaagaatgtgatgtttcttggaaataaaagttggtgtaaacatacattgagattgacaatccatacacgcatttaaactaataacatttgatgacaacaaccaaatgtgtttgatataaagttgtcaacctaataattcaattaacagtgaatcaaacatcgatgatgatttttccaaagatcattccacatagaaaaatctcaaagtttgaaagaaagaaagtgaagagatttaactagaaaaaagtaaaggaaagaattgatagagaaaaaaaaagtagaaaacaaattgatagaaatttaagtggccctttcatttgtggtgctacttaatttttaatgatatttaactgtaaggataaaaaaatattaacggaataaaagtttagaaactaaaactaaaaaa

SEQ ID NO: 2630 - DNA, 1200 bp, Glycine max
  Soy_ogl_4386 Gm13:31321601..31322800 Cluster 11
acttttctagatatcttagattaaaaaattatgatttttaggactaaattttagtttactcttccgaaaaatattctcaagaaaaagattccaacttttttaagtggaaaaaaatttttaattatgtattttacttaaatttttaattttcagaaaacatattaagagtatctaaatgtatcttacatatttctaggaattatgatttccaaggaattgacttttcgcatgattcttgaatatgaaaaaacttttttcctactaaatatccaaaaaaaatcagcctttaaaaattacttcatcagtttagtactccatctaataaaataaaattaataaacaaatagtcctccaagcttacaagcatgagacttaatcattttccctacatttctagcaaatgattaatccttaaaaagttaatttgtacaatcttagtcttagataaaatcattagtaattcagattagtccttaaaatgttaaccgtaatttactttcatcgcaaccaatgactaatagataggagtctcttaaacaaatcagaaaagtaagactagacgaagctaaatttaatcacttggtagtatcgcaattacacataagttttaaatttgattaaaagtgaaaaaattgaggtatattttaaatttgaaaaaagataaattctaccttttataaactttttccacccataaaaaatgcaatcataattagcaaagcagaatcttcttaaattatatatataatctgaagtttcaaatttgagtcatgattatataatatataattaattaaatgcttgtggagaggaggaattttgccatttatattgattttttttttgtaatagtcatttataataattttatttaacttgaacataattatgtattgcacatgtgatgcatataaaaatgttaaaatatcagaaacgttttttttattaaaaagtgttattaatgaattcttatcaagatttccaatatactcttaatgtttttaataaaaaaaaaaggactataatggtgaagatagtgcatgaattttagtgaagagggtactatggttgtgcggtgagtctaacgagggcatgattgggtaggatttccctgtacaccaaacttggattgtacgggaaagtaagccaacaaaacagctggcagacaagagaaaaaaggtcacgcagcaaaatgatgca

SEQ ID NO: 2631 - DNA, 1500 bp, Glycine max
  Soy_ogl_4395 Gm13:31866601..31868100 Cluster 11
aggctcgtaagatgaagcatttcatattaaaaatgctcagacaaatgctgaatatgctaactgctaatgctttcaggtattccatgaagatgaaagtttcgatcatcaatgttttgaacttgaaccattatcccaatgtgtgttttaatttggttattcgagttattatgttatccctggttttatatgaacaattaattaatgtgtgaaattttgtaatattgctacatagattaggggactatttttttttattatatgtgtcaagggttacctgtttgttgaatcaagaaggaagaatccagatatctacctgtttattcgagttattagaaccaaagacatttcattctcaaatttgcaccaaaagtgttctgaaagacaaaacttgaatgcactgagccctagctgtaaatatagacaagtaagaataaaatattagacccttcaacgtcttgcagaaggagacctatgatattacgagcaaaacacttgagcactctgatccaatgataataaacttgacctatgatattatgagtcaaatttaatttaactattcaattcaaatcctaattaaatatacagtaatttgtcttaattaaataaaaaatcctaataaaatttgattcgtatatgatttctaaataaatctataaaaccccaattacatttacaaatgaattaaatatataaaaattctaacaagatctttgtaaaatattcacaaaactcttgcacaatttcattaaatactttcttgatcttgtgctcatgtgtaaataactttcatcacattaatacacctgtaaaaaaaaatccataagtttcccatagacattctcaatttagagacaattctattcaaggtgccgttagacattaaattaatataagtacacatcttagtgagaatttgaatcttgattcaatatgttgtagagattaatctcttttattagatttagtctgctggttagttagtacacttgtacaatattgactcaatggctcaaacacctttcaaagaaaattttcagtaaacatatatagaaatccctcgaccataaactcttgggggtaaagggagatccctcctggctcctgactattaatgttcttttcactaaattaaatgcattacgttactcattagattgacttctatactatagcagagaaggatatataattttgctattacattgtgaattgaataatctttattttatcagaaaaaaaacaacacgtgtttgatggtaaagcacacaaatatccccagttgaagaataatttgatggtaaactttgaaaaaactccagtgcaatatttgatatccgaatttacgtcccaaagttaatacagtaatgcgcctagactcgggcaggaaaaaacagaagcatagtggaaccttcacaatacaatcatgagtagaagaaaagagaaaggaatgtggtagaaaaataaggcaatattagaatccaaaaaggaatgcaaaga

SEQ ID NO: 2632 - DNA, 1902 bp, Glycine max
  Soy_ogl_4048 Gm12:15445599..15447500 Cluster 11
gacccaaaatggtcacaaagaataagctgaggttacagtcacaatctaaatttgatgacgaaaacatggctaattccttaatcaaatttgtagattgagcatccaattgcaattgcatctgttttgactgagcatctaattgtaattgcatttcctgtagatgttggagacactattgcaagaggtcatcattttttcaggtttggaaggggccatgagaaccaaaaaacaatgaaagttccaatgatacaaacaacaaaagtgaggggagaataactcctttggagcaagaaagggctccaagagaatagagaatttaggaaaattttgctcaagtattgattttctgtttttattcatcacattttgcatacatatagtctgaagatcataatatttctaatagaatagcaatcacacacgtgtctctgctctaacagaaaatgaaatctaataactattctttgagaggtaattcaattctaatgaaaatgactctaatactttgtcttttacttcaaatttagcatggcacaaagtctttaggcaagactgaagggatcctgtttcgtttgggtccctctttggacctgagattcactttctgtgttgcactctatttaggccggtaggcccattaagtaactcgttcaaactaaacatttgtgtttatatcagagtctcaaatcaaggagaaggtgataagtgccctttgacatcttaattaagggcattcttacaatatcattcatcatccatatactcaaaagtctaaagaaatgttttctctcggctgcttaatgacatacaacaatactagaagtattgtgtgtgcacctaagtacgagtaaaatttatctttattaagaagaacaacaaattggaaaattagaaaattaatgttgctaggagatatatgattgatctagtagtaaaaggagaagaaaatggaaaggaggttataagtttaaattttccactaacaaaaactaatgttactaaccactaacatttatcaataaaaaagaagttaacgttgctagaacctgaaagatggagattgaatcatctccaatagatgatcttggagagagatcttaagtttaagatttgttcttctaagattcagctactaaagacaccctcaagatctacttgttttttttaaaagaaaattattttttactctctctctccctaaatgattaatgtgagaaccaacacatccaagagaataaaggaagatggagaacagatcaacgaacaacaacagacaaacaacagttcaaaacaataacaacaacaaatccataacaatataattttaaaacaaataataaaataaaataaaatacaaaatgcaaggcccatgtggagagacacgacaatcatcgcacgatggccagcgacggtcatggggccagatcagagctcgtgcaagtaacgtccttcattaaaataacaatccatactaaaaagaatataaaatctcaaaattatattaatttgaaaatacttcatgtaaaacaaataaagtcaaataaatgtttttgcataagtaaaaatattattcccagatatgacatataaaaataatcaacactaaaaatataacttagtcagtcacatttggcatattattctgagcaccaataaagttaaaaatgtatctagaggtaattaagtcttgaagcttcctcaattcaacaacatttttctcatgcactaaaaacaacacttttaatgagataataatcacactgaataaaataaacctagagtatttgaaaatagtattattctcatccagcattgtaatgtggaaaatcagtcatggtatccgcaatggatttaaaattatatatatattgataaaaatcatattaaaataatcacaattta

SEQ ID NO: 2633 - DNA, 1586 bp, Glycine max
  Soy_ogl_4057 Gm12:16718601..16720186 Cluster 11
actatgcagatagtatttgctgttttccaaaatttgggtgctagaatttcatggttcaatcacaaattacctttatgctgatgttgttatcacaaattaccaactatgcattataattaatttgtggacatcataccacctatttaacacctaacatctaattaaatattgagatacatggttaaaaaatataaatataataaactatatgatgtgatagaagaagaaacaaaatatagtcaaagtgtttaaaatagaagaatacctaccttttattacaaatttaataaaatatgaagaggtatttatctctcacaaggcgacaaaaaaggtctgaatgtatgctgtaagaggtatttacgtttggtgcctaattatctccgaagaaacatgtcttaaattaattcaaaatcttaggtaaaataagccaagaaattgacacatcaaaaaaccaaaagctggtaatagaattgcaaaaaaaaggaccagtagtgctagtattgaaaatttgatttcagctatgtacaaacaggttattcaaccaagaagcaatgtgcccttcaatccaaaaacttactaaaaatgaatctgaaatccacaaataatgcactaacaacaaatctacacattttgcaagcaaggaaagttcacaagcctaggcatcatgactccaatcaaatgtctcagcaattaacttcaaaccagataagcttagtagcaacagaattaaaattctttgaattcgaagcagaaaccccatcctgtttcgaagtagtctcactctgacctaaaatgtggaatatcttccactcccaaacctgctggagctaccagatacttgttcagctgaattagaactatgttccgtcccatcaacatctctaagaaattcaggctccttagtggtaaccatgaagtccatcaagttgcggctgaaccccaaatcagaatacaccctcaaggcatcctagatatgaaaatagatactactagatatagcagtggcagaacattaaaaaaactgatatattgaataatatcacaataaagcacccatatatatgttcatatcctctactgtcaaatcagacaaagaactcatatgactgtgtctcattccttatgcagtagccataaagccaaatgaaaacaagctaagactaaggcctaatgatttaaaaaaataatacattaaagtacatgcttcctttacttattttgacagtctcatgctatcatatataaacatattatgtataaacataatattttgacagtctcatgcttccttcattttttatttgccattcagctacacgtgttttatttttgtatccttatacaaattaaaggaattgtaattaaaaatgtatgtgcctggtaaaataattgctgcaatggcatgttgaagagttatacagtatcagaggcaaagaagttaacatagacaatcaaaggcttgagaagggagattatagtgaagtcaaacgaatcactgcagcccaggtctaattctaattcttaattatgtcagggagattatagtgaagtcaaaggaatcactgcagcacatgttaaaaattgtc

SEQ ID NO: 2634 - DNA, 1394 bp, Glycine max
  Soy_ogl_1629 Gm05:29348201..29349594 Cluster 11
aacaaatccatatatgttcctccatttatctttcctttttgcaatgaatatgccccaaaccttaccatacttgctgaagattttccaaagattctcttcacaatactcatcggggaacttagaaaagaaaaatgatgtgattctcctacgtagcctagcacttcgtctcatgtaacccacctgcttactctctcacgttctacactcatgtgtatcagtttcgataatcaaaatattgaccctctttgattttgaactcgagcaattatgaacaacattattgtttcattgatgagcaaacgtcccttgaatttggtacaacgtaccagtaattggaaatatgaaagattgtatcctaccccaccttacacagaccatactacacaaatgaaaagatttggttgagataataatttattaatttacatttaaaaggctattacaaagacatttattataaaaaattgaagaattttatcaaatcaagaataaaaaaataacaagatcataatagttagtttattatgtgttgtcttccattaaaaatagaagttgattattatttaattttacttatcatgagataatttcctccgtcgtctttttttatatatatcctgtatattcacataatcacctcacttgagtttttaaaacccctcacttgcagttttgacccgcgttaattgacaatcaatgagatgcatggagagaatttaatgggaggtttgaaattggcggtggatcgagtcaaggtggtagtttgttgtcatctgtcatctttttcatattttctcccttatttttcattgtatatggataagattagaattaatacttttacttacattataaaaatgttttatattttcatttaactacaaattttatttttggaaaatttgttattttattaaaaatattttaggaatcatattaaaaagattttcaattaattgatgatgaaaaacttttatattaccgatacatcattattaaactcataaatttaggatattatgtttatttctaactttgactaaattaatttaaaccgagtatacttatttaaagtttaattatatttttggcccataattattattatcaagatttgattttggtcctttttttttttgcatgaatttaactcccctgttattttaatgttgcaattttgattcatttatcatctggacacctaatgcctaccaaaaaaatggagacctaatatttgatgaaaatattgacatgatcaccgaacatcggaacatgtaagattttttcaacttattttggaggtgttcggtaaaagtgaagttttttttttcgtcctagaattatgatttctagatagaaataaaatttgtttcattagtcataaatattcttag

SEQ ID NO: 2635 - DNA, 1468 bp, Glycine max
  Soy_ogl_2051 Gm06:41356233..41357700 Cluster 11
ataataataataaataattatattaaataatgaagccccacttagagataaatctctgattgttagattgagataaatctaaaaatgagttctctaccacattttgctttttcgtaatatactttcgtccacaccacatactttttgacattttgatttaacttaactacaaattatatttcaccttatagattaagcttgtatgagttgtatccgataatcaaatagaaagacaaagatcgcatcaccaatcgtgctgtaactaacagtcacatgataaaatgcaaatgatcacgtcatgtaagtaaagaagaaataggatcatcccaagtttaactaatttttaggttgttggcatacacatatgttgggatgcataaaactaatcaaagttttaattaagtacaattgtagtagcagtttgttgcgttgcatataacaattgcaagaaattacaaacaattactattaatgccatcacgattatgttcatgacgttgtgtggatcgcaatttaaaactatatttaagataactgtaaagaagaaatttaacgtcgggtaacttatggtatattggatgaagtttcttaagtgaaaattttttttatcgtttttttattgtagcatatctatgtgacaggaagaatttctcaaaaaaaaaaattgtaattcttcaagaaactatttcttagcaataaaaaataatatcaaagtttcttaccattaaagtaaaatggtgtatgaatatctcataagaaatcacaaaaaataatatgaaaatcaaaaaaataatttaagaaatctacttaaaaaattttcattcgaaatgttgtcaatattacaaattattttctttgaaacacaaaattaatgatattcttacataattttttttcgcatcatatataatgatgattatattattcctctaaaaaatgatgattataaacaaatactatcatgattttttataggtcaaaatactatcatgatttgataaattgagagtgggtttaatcattcaattttatttttttttctcaaatgtagttaattttaaaaccatataactttggatagcgtgaaatgccaaacttacggttacctgagaaggatggataacgcagcagcaaagtcaacagaatgacaaggtctcagttacatacatgtgaattgaaagagtcatgcatttttggccgtgttgaaatatcttaattaagtggaggaaattaggcattttttttgcattattaagggaggcttgttataaaggtgatggtgataatataaaaaacagtggaaaaagcaaaaaggttaaaagggtgaaagaatgggaaaaggaaaaggttttgtgagaaaaggtctgtgcatgtgtaattcaaaatagaaaatagaaaggtgactgttgaagacttgagtactttagcaataaaaggatttgtaaagattatcgatcggtatgcaatg

SEQ ID NO: 2636 - DNA, 1700 bp, Glycine max
  Soy_ogl_2792 Gm08:22923801..22925500 Cluster 11
ttatatggacgagtgcttataacttgatctgaaacctttatttagtttaatttaaatattttccacgaaatgaaaaaatagaaatggttcacacgaacaaatcactgctttaattttagttttgtatttgttccattttttttattgatactccttaaattttattggttaaatgtgggttaagtttgatggattgatttgtttagcccattataaaattttattggtttttacaccctctatatttacgattcacgtttgacaccattctttatttattttttaaaatttcctattttaatgcccaaatctacaaatgagcctcactttttaatctctaaacatattgcagagattttcatattttacctaattaatgttgtcaaagccacaaatccacaagtggctcataatatgtattattataatttaatgatccacattattatttactttttttgacagaatattttttacatacttaaatgttaagtttgggttctgaagcgtcatgatgtttggcccaaatagagtattaatggactgagcagcccaacgtactaaaaagaggaaaagtcccaattttttttttctcaatctcgttttgcctagctactttattttattattgatttgcctgactaatctcgtttttctcaatctccttttttccttagttatgtaattgatattttaattatattttaaggtttaatttggtctctcaattattaaaaggcttaatttgattcctcaattttttaaaataaaacaattatactttttcattagatgcactaattatttgatgaaaattaatattttttgtatggtttgttaacacaactaatgtaaaatattacattttttaaaataggttgttagatgtaaaagattcaatatggataaagtttgatggagcataaagacgtcattttatatgcctcggtatggataaagcttgatgaaacttaaaaattttaaaaattgattgacaaacaatcgatatgattgctaattaatgtaaaaaatatcgatcttcatcaaagaattaacggatgcgacgaaaaagataattatttcattttaaataattagagactaaattaaaccttgaaatataattaaaggataaattgaataattaattctaaactgttctcacgttctctctctctctttgcctcacgctcacgctagtctctttaatgatctgattctttctaaaactcacatctctaatcttttcactttcttgatatcaattctatgtgacagggaggggcaaaatttgcccagctttttcacaacgttaaaatgagggagaagaaagtttcttttcttattctaattttaatccaatagtggagactttccctctctcttgatccgttggatatatccttttttaagtgataaataaactcgttaaatcagtaactttaagtgtgtagtattacttattactttttcatttacgtgtttagtgattcttattgacgaaatatcaaacacgttattaatgcttttctttctttgatttttttttctttacatattttgaaaagttggcaaagagagcaagtaaagcattatattttttaatgggacagcaagcaaacaagccatctaattaaaatatactagctcaacaaactgtaaactttgctttgaagaattatgtgcctataaacaacact

SEQ ID NO: 2637 - DNA, 1465 bp, Glycine max
  Soy_ogl_3400 Gm10:7046701..7048165 Cluster 11
gggaaagaaatacaagatgcgcctaatttggatgaatttgaaaagggtcatgggaggggtgtgcgtgagtgactaaaatttgcaggtctgcaaaagaggcgggttaaaggatctgagggtagatttgtaataataatttttaaagataaggtatgggggtgcagaagaaaacaatgggtgtatttagcaattgcctttctttatgatgaaacttagacagatccgttattaatcaaactttaatgagattgagtaaaatttttgtcaaattaatatactagatctaaaattatcatttggcttgaactctttaagatctgcattccttattgaattgataaattatgtaaattattctattgcacctctttctatgtttcattaccaacatgcatccagacaattcagaaaaaaaaaaaaaaaaacatgcattaaacttttaattaacattaaaacattgaatcattcagatggcagatgcactcaaagatctgcaaatcaatacttgcatagccatgttttctttgtcctgtcctatccgtgaaaagtcattaaattgcagtaactgacactgacacgaaattgataatactgattgtattcaaagaaaataatcaaatagaacaaatagcaacttgctataatactcttccttttacaagttgatcttttgctggaatatgattcaagatgaccctccaagcgaatatgttaaccttcaattccatgtacaagttgcataacatttaatacaattatttgattttggattaagctgttttaacggaattccccatcctccctccatcactatccatccccactatcatcattaatcctaatatcatagatagatagctttctccaattacttctcaaatcagattcccactaaataactttcttctcctacactatttctagcaccataaaccaattaaaaatatagtttaaatatttttgcaaaatttgatgttgactttttttttagttaacaatgttaacttatttgcattatttcaacttcagtgttttgtattatttaatctttgttgacttattttgaataagttgacttatcttgatttgtgtaatatgtttgttttatattttatttataaacttattcgactactccctccatttttttaaattgtcggatttttgaagaatttatgttttttttaccggttattgataaaatttaagatcatattaattactcttttattaaatatatcattttttgttttctaatctttaattaaaaagagaaaggggtgaaataagaaactctataactttttttattagaatcaagaaattttattgcattatttcttgatttctagaaaccaaccttaaaagaaagaaaagaaggaacagagatagtattaaatttatttaaaacaaatgaaatttaagcagcaaaattaatccaattaaatacattcatatcaatatt

SEQ ID NO: 2638 - DNA, 1464 bp, Glycine max
  Soy_ogl_4759 Gm14:40889371..40890834 Cluster 11
aaattaccaataaattttatttgtccctttctcagcttatgatattggtggattatgggggttgcatcttccccatcattgctcatgccccctggaatgggattcacttggctgatttcatcatgcctttttttctcttcattgctggaatttctctttccctcgtttataaggtactacctacacccacctattcttgtcaaattaaatttagcaacaagcattcattaaagccttctcttttcttttcctcatcaaacgtcagaaaagacctcaaagaacacaagctacatggaaagctttagctggagcacttaaactctttgctcttggtattcttcttcaagttaataatttcttcttactcgcctaacttctgttcctgtcattcgagtttcatcagttaatgtattcaattcaggtggctattttcatggagtaacttccttcacttttggtgttgacattcaaagaattcgatgcctgggcattttacaggtaacttcatccatattccataacataatctcttgtaatttcttcactactttattacctcataactcatggttcatattactattttgtttatgcatacatattatttgcagaggatatctattggatagattgttgcagctttatgcgagatctggcttccagctccgcggcggaaagaattaggtttcatcaaaagttactaccggcattggtatggttttcatgtcagtactattaaatttgagggctctaatgtgtctatatctgattaccctattaatcaagattgtctctaaaccaaagtcatcctatttgctgccacatgatgtttaaaagtaaaatttaacatctgttgctgccacatgatgtttaaaagtaaaatttaacatctgtagcttgggactttctaaattcaaaagtcccaaaccaaaagatgttagtagaaaattaaatatacttaattagcaggattattccatttcagattgagtgaagtcagcaaaaatatattaatctagtattacatccggtatattcatatttctcttgagtagtcctcctttgctcataactttacaaatatttttatgcaggtttgttgcagtagtattgttggcagtttactctggattactgtatggtctatatgttccagattggcagtttgatgtatcagcttctacctcttcattgcctcctattagtggtggtgatatttacacggtgagagtaggttcagcactcctcattcctcactctgctatcttttatttgtgtcaattttttgttttgcatgctttttaatgttgaaaactttaaggttaaaggaaattgtttctgtttgctactcctaggcacttatggtagttacgataaaatttggtaacccatacatacaacttgctattttgagaaataataatgtttgttccacactctaatttgaggtgtgaagtggatgga

SEQ ID NO: 2639 - DNA, 2052 bp, Glycine max
  Soy_ogl_5109 Gm15:42391349..42393400 Cluster 11
ctagttaaactgtctgtaaactacaaatagaaaataatatttgtcaaattttacaacttgttaggaaaaaggatagaaagatagaaatttgctatcaaacaatacataaaagacttcttaataatcaaatcctaaagatactgagttttggtgcattggacgaacaagagatatcgaatagtgtttttaacattgctcattgattcaaggaagatgaattgaaaaaaaggttaaagatatacttcgtgctctatggtgattgcatgaaatataacatattgtgtagtagctagtcgaaaaatctagtttcacgggtcacaaatctagttgggattatttttaagctaggtcttttcaaattaattatgaggtcagaataatttcctaacatactaaataaatccaaattcataattaatatatagtatttccttactaccaattcacaatataaagcatgcagtttctctgctgcatgcagttttttttcactacttaaacaacaaattgaattcctacatataatattcaggaaaaaaaaaaaagtagacgtgatcagtctagtcctattactttttctgttgtttcactcatatagattaaaataagaagagggcaaataaacccagttactttacagcataaaacgccaaaagataatttacttttgatactaatggtgccccttatggctttgactccattgaatttgaatccgagttcacattattatataatgactggactgcttgagtaggaagaagtgaaaatagctacatgctgagttcaatggacttgaccatgaaactatacatttctgctagttgtttcacaaattgtgttgatgaaagttccatgtccacaaacctatgcttttttagcaactggcagttttgtgatttagaacagttgagatcatcatctagtttttactttctattaggatcaacaaattgaatatcctccatgcaactttcctgtttgaatatatggattcccggtgtacaaattgaggtgtggtttaaacaatgaggaaatgtaacctctacatggtaccactcgtttttgaaaggcacctcgtatggactatttgtgactgtatctcacggagatcagaaagataaatatgattcccatcttgaaatgttttttttatcaaaggaacatttattgccattgatgaacaacatgggacaaaaatatgtgtcatgcatacgtgcaataagaagacaaattaaagaactttgtcgggaacttataacgatcgaaaccataaagaaattgaaggttctcggctttggtgatcgaaccactctatataatccttgctcctggcaaataaaacgatgtgtttcttgcctcatgcagttccagttagtcataaagaactcgtcggtaagtagactcagttttaaggttaacttggaggttgaaattaaaagaagagagatatcctgatttctaatctctctactaacattctaacaaaaattaattgactgataaaataagtgttaagtatactatgtatcattaaggtttaatacgtatatttatatatttttacattttgttctctatacatagaaactagaggtttaagtcctacagatgcacttttaacgatgttaagtgtgtcataggtaaaactataacaaaataagaattggcaatgtaaaataacaatcactagagaatttgtagcaattttacctaagaaagttgagacagacttaatggtaggaaccaaaacgtaattgaaagtacatgtgtaggaactaaaacgtctaattcataggtatactgaccaaaacgtaaaaatggtgcaagtttggtggaatggaatccctctaatttcccaaagatgcttacaaccatgcacgtcaagcatccttaaaaatggaagttttttatgcattcaggaaggattgtgaaattgttgtctgattggtataattcttctaaacatgtattgaaaaaaaaaaaaaaaaactcatacaagttacaatgtgcagcctgaagacattctaccttcgaatatacttttgagcc

SEQ ID NO: 2640 - DNA, 1176 bp, Glycine max
  Soy_ogl_5118 Gm15:43417445..43418620 Cluster 11
tgggctgagctgaatattgtggggatcgtaatttattgtgctaggcctgctacgccagctgctcccacctgtttacattaacttgttcgtcgctagctgttgccagggtttgttgattctcatcttgcgtttcctttgttttctggtttttcttattctgaattttgtattttggaaatacataagcaatattttttactagtaaaccatatatttaattgtactttttttccaaaattctataatattacaaattttgcctcctattttgtttttttatttttattttgcacacacataataaaactactacaaaattaatttaatgccattaactacttctttgaacatatgaaatttacacactggaccctttgcgtaaggagtcaatgaacaaataaatattcaaaaatagaatattgtcctattaaaaacaactaatacaaaagataatagcaaaaaaaaaaaaacctagcaaaataaatcctatggtttaaaatctttttatttaaattattatttttttaatttatattaaacttaaattaaatttatacattatatctaaggcttcaatatttgtttgtatctataaatatcttttttttagtctattttttttcatttttgttcttttcattttttaggcttcaatatttgtttggatttctggttcaaacctatgtttgagtcaacttccgatttcgagaaatattcagatccttttttttatgcaaaatggaatttgtgtaccattaattaaatttaccttaaaattcgtacatcattttttgaacggacattcaaacatatcttaaggagctttaatagaattttgagaatccgatactactaatccatcgcaattaagcttaaaatgtccaaagggaggatttacccaccgaacatcagaattaattaactccttcgaagcaccatggatcaatttcgaattgagctgattgctaataacaatattaatatcattaacagcacgtttaagttacttgggccactatgccaacaggattacaatcttcaaaagcacgtttatttctgctatgccaaagaacatctagcaccactgtaaactatttaatctgcactatttgtccctctattttaaaatatttgaaacagagatatctgattcatttattttagaaaatatataat

SEQ ID NO: 2641 - DNA, 1604 bp, Glycine max
  Soy_ogl_5755 Gm17:38234401..38236004 Cluster 11
gtcaaatccttctatcataacatcatggattcactattctatggcagcaacttcaaagtcgatggccaatggaagcaactatggaatttgcgtgttcaacctaaattcaaacatcttacatggtgcatcattcacggttgtctcccctcaaggcaaaatctgattcggaaaagagttctatgtcaatctacttgttccatctgtgaaaacgaattggagaatgactgatatctttttcggatgctctcaagctataaattcctggtcttattcaggactttggaatgtgatccagcagaaagtacttcatgcagaaggtttacaagagctcctctttgatctgattttatctctttcacatgaaatctgcagcaagttcacctctaccctttggaaaatatgagacaacgatgaaataccagtttcatttgcagtctccctcgctggttggaagctcgaggtactccaatcatccaacctcaaccagcacctgcaacaaatatttgttggacctaaccgtcacaggggcggttaaaatgcaacattgatgctgcattatttaaccaacaacaactctttgggatgggattatgcattagagacaaccaaggaacattcattctcgcaaagacagcttggcacaacaaaaatcctagacaggaggaagcggaagcgtggagtcttcttcatgcactttcatggctcaaggaacaaaattttcacaatatagattttgaatttgattgcaaacttgtggtggatagtgttgctcaacaaagaaaagggtgttcagtttttcatactttgataaataagtgtagggacatattccagttcttttgaaactcgggagtgagttttatacgacggcaagtcaagtcaatcatgttgttcatcttctagcaagagcatcccaatattgtgctaataatcatggttttcatcatataccttcttgtattttttatcctattatgaatgaaagtatctaagttttttttttatgtgaaaaaaaattagatgatcattttgtctaaccaaacataagactgaaaatttttgttttgttaatttctcataattttgagtttattatgcaattttttattctttagttttttagggagaagtgtattcttttttatttattttttagtgtaaaattcacaagttcctaagttttttaggatccatcaaaaagtaagatgttttttatataaaaaaaatgtattaggggtcataaaaatcaaataggaattttggtgtactattcattaaatagaatattagatcatttcaatcaataaaaaaccaatgtatttgttgttttgatattaaatcaattaaaaatacaactcattaatataatttattagtgtaataaattcaacattaaagtattaagtcaattatatagaaaaatctactcattaaatctattattgacttttttaatcaatttatgatatcatattaaacttaaaaacattacacttttagaagtaacaagataagtttctagattcttctaaaaaaaagataagtttctagacataggattatttcttaaaagttttgttagatacttatttattaaatctatt

SEQ ID NO: 2642 - DNA, 1724 bp, Glycine max
  Soy_ogl_6029 Gm18:12121977..12123700 Cluster 11
ccaaaccaacctgacttccctcctttcatttccacagccaatactttattcactgaggtttgaaattaagcttgtcccatttttgcgtcgtatttgtctcagttcatcaacttgagttgaacaaaacgaaaattttgagatatttcattttgtcccatatgcttcattcttacgtaaccttcctttctttaatactagaccaacttgattctccatttttaatctctgcgcccaatatttatggtttggaatgtcttgctttgtcgattgagacattcaataattaacttctcttcctaatattaagatcaattctgccaatattgaaaagtactgtaccactggttgaatggagcacaagaaagaagaaattaatgcttagaattaagcttacatttacgtttaaacaacatatgcgcttaaaatatgtgaattttatttcacttgtaactcttgcaacagaacttaaaagttagaagtgctaacattgagatctacgtacccaatttgatgagggcaatattccaccacagttattcaatctttcttatttgttttatctacatgttgttgattatagatcattaggatcgatttgatgtatgaagacttatattcgatcttcattatcgcctttgtatgaaaaaataaaataaaatagaccattaagatctatccctaaatgtgtccatcacatgactcaaatgatttcaaataattataatatctatactatttgtggtgccatcggctaataaattttctgatgaacttaccttggaattatttggacttataaaagttcaaacagtgaatttgtctctgaataatttaattggaacaattgattcaaaagatgattggaggcatctaatatctggaatcttttgacctatccaatataataataagattttatggaacaattcctcagtatgcatgtctaagagttgtctttcataagctatatgcattacgatacattgggaatccggaactcagcagagctgctctcattataaagggcatcacaaaagaagataatcctaaaaaaaagcaaaggaacatgcagggaatgagaatgatgagcctaaaataaataaagtcactctattttgggataagagttggataaactgtgaacttttgaagaatttgtggttctctactcctgatttgggaatggagtcacaaatactatcaattccttggtcaaatgacttaccaactgtgtatgttaccttaaaaataacccttaacaacttctgtaatacttttagttacatgtgtattttcttgtaatattattatcaatctacttatatattataaattaaagagaagtaccgaaaataaactctgcgacacacactctttagtagggtttaatcatcaataatttgttgaaaaatatcagctccttaaatgaatcataatatcttaaggggttatgccttctatcttggatggaagaagacttgggttgacataaaaaaagaaaagggatgaactctacccaaccaccccaagccaacccattaagatcattagctatgttggtctatggcatgaaatctataaaaagtgcacctaaggaataggttctgaaaatagtgtactaagccaagggaatgcagcatgaatattcacttataaaatttatagtaattacaacattaacaaactgaaaaattggtacttttctaatttaccgtcaagaaatg

SEQ ID NO: 2643 - DNA, 2639 bp, Glycine max
  Soy_ogl_6066 Gm18:18744951..18747589 Cluster 11
gtgttgcgttagggataaaattgctctggcacgaattagccaactctttcatcactctcctaagtctcgtcgtaataatctttgtaattatcttataggatacattataaagactaatatgacaaaaatgtttcatagacgtaaccggttacacctttgaaataagagctacaagagtttcactgatcatcttcacttttagtggctcatcaaaaatatcttttatgagatcgcaaagagaatctcccacaatggtccactggatcggatcttgtaaaaaattgactgtaggcttctgcactgggagctttaaaatttctcatagcaaataaagccttgtgaatttcctccgtagtcacatccaattttaaaagtctccaattggctatcagctaactttggtaatgctacttgaagacaaaaaggataaaaatgggaatcatcaataaaaagattacaaaagtaacccaatactaacctctctacttcatccttctctataactcaatttccattatcatcctgaatagctttttggaagtgttcttccttcttttgatcgcagcactccatgaaactagcaagtgtttcgatcaccaaaagagagacacttcgtccgagacctttggaaccaaagtagatcctcttgtttgagcacctcttgatactctagccaaatctctttctaccgtgcttctagatgatctaataactggcaagtgatgtctcgggaaataaaatcaatgctttaaatgagtttttgcttgagctggaagatgtcccctaaaacatttttattccactttcgcaattcattttagagctcgcgcaccctaacattccaatcgacatttctttaccaatttgtttttcaagaaaggaccaaactccttatatgtcatccaagtagctacaaatttgaaaggcctcctattttcattcacatatggtgtgcttgacattctaatcaacactgtcctatggtcagacttgaaaaatgacaaaagaactagcacacttggaaaatagatacgctaatcaatattaataagggcatgtttgagtctttataattaacaattcacccatctttcaggtaaaagcaggaccctagaaaccagcatcaactagatcacactcttgtatcattctttggaaatcttgtgcacccctccaagaaggattagtagaaactccactaggatcatgagagttgagaatagtgttaaaatcacccactatcgcccaagcctcatttgtcatttctacagtattacacaaagatttttgtttctgatagctgggactaccataaaccactgtgagaaaccgtatatttagcttgctttgtctaccccaccctcaaataaacaagttgctcatcactgttgataatctcaacgtgcatgacagaattatgacctccacaggcaccatatacccctagaaagacctcgagcatcaactataaacttacaatgaaagtccaattcattttgaaaaaatataggctgcgctgctgcttcactatttgcatgagtatctataaggaacataagagaagaatcatattctttacttatatcattaataagtcctccaaaaccatgggaattagttcccctacaatttcacgttaaatattcattaagtttgggagaagaattggctaatgaaagaccagattgctttccttcaagatcacttgcattaggggcattaacctccatcttctactatatttgaggcattgatcctcctatatttgacatagccacctcttgatcccccttcacgttgctaaattcacccaaaatcatatttggttccttctttttcagaaatttttgtttcgtcttttcaataaagcctttatctatcaactcataccacatcatgtcacctgtatttttacgttcctcctcactttctttattctcatacatgttatctttgataaccatgcacccccacttggcccacttacttttggataaggcatatttctattaaagtcattccttgttgcatgcgttgaaacctccttcaaattttgttgcaccttagcatgaccctcccctgtctctgcatggaaattacgcacttcacgagttcttcatcagtcaccctgatcttcggacatttgttatactcattcaaatctttatgcccaccatcaaccttctttatattccacttataatcatgattgtcccttgcatccaatccccatgtcttgttcccttcactactaaaagacatacaatatcttgtctttatatgccacctcatattttcctttatcaataaccatctcctcttcatcaacctctccaccctatctgaatttgacttttttggtactcaaatttggatcatcttccgaaaccacacaactactctcatcctccatctctcagccaaatatttcccttcaattttatttaaaaaatttactatttattgtctactacagagacatttcttttcaagcctcattatatattatttctatgttcattgtttttctctatttttcattttattatttttgaatgatcaataaaagaaaatattgaaatattcataatttacatatggtagacaattacgtttagaatgagatacttccaaaacac

SEQ ID NO: 2644 - DNA, 1411 bp, Glycine max
  Soy_ogl_6704 Gm20:23473221..23474631 Cluster 11
cagcataaatacaagtacataaacataatatatcccgctaaaaaaataagccttctaagttgacttttaaacaactccaataaaaataaaaataaaactcaattctaagtggtggaatttttttattaaaccaggtgatttcgtaaaattatatatattaaactaggtggtttcgaaaattatttttaaagatgggtgattttgactttgattttgatttttgacatgactgatttgcataaaaaagatatgaacattaaaccatagacctaacttgtttgggttagtttccaaaggcaaactctacttagagttgacctagctaacactacaatagtgttggacttctagtgccctatttttttatttcactttgtgtcacccaaaccaaccctatttttaacatttaattttatttttatttaaagttattttaagtgacactaattattctttttggcatacacgcactttcaatccctatcatttcacaattgtgttattttggcccctcaaaattctggtgcacatttggtcctccatgttttcaaaatttaacaattttgaaataaattgatcaagaagaatgattacacaatgaagataatccaacaatgatcatatacatgttttactaacattgcaaacatcaaatagaactaattaaatcaatgtcttgtcttaacaacccacaaggatttgtagaaattgttgagatgtttcttcctgcactctcaatattactacaccagtgcattccgcattgacttttcaggatgcacttggatgcaacaagaaacaatagtgggaatgcaggaagttttagccaaattattgttggtttaccttctccattgaatgcaaaaacctcctctatagctttttccagttaatgagtccttgaacaaatcatcatagaatccattgacctacccttcaatggttgccagtcaacagagaatgaatttcatttagggtagcttataatatgttgtgtgatttacgcaattactcatgcattaattgtttgtattattaatagcatgtataagcaaaatggactcgctttcactagacattacttgttgggtattcaataacgagtctaatgactagagggccatttgtggatcatttgtttctattaaaaaacatacaatatattaaataaacttgcctagtttaacgtctagccacattcaacattgaacttcttccacactagcctctaacaacatcaagtccctcaatgaatatgatagatggagcaaatttcctagctgcattggaaaggtctaattctagccacccctcttccaacaaacaactctgcataagggtaagagatttaaggttggcttaatggttaggaatggaagcttaatggtgaaggaaaaaggaaagaaaaggt

SEQ ID NO: 2645 - DNA, 1200 bp, Glycine max
  Soy_ogl_109 Gm01:4495301..19500 Cluster 11
cttcccaaactattatgacccctactattcatgctgtcgttatccccgttatagtatcggacatcatcagtcttttattctctgaattcactagcatttgtctctaccatgcctaaactgggtctctttgctggttccactcttaaatgtttatttcttttattttagtatatactacatatgtatcttttatatagaaatatataatcttattcaaattagataagattattaaaaaagataatattcttcttcttttaaatatttaaagcatttatatatcaatttgaaatctcggcagttaatccacgtaattgaatcaaagttgtgtgtggttcatgatagttactaaactttcctacacatatttatattgctttcatgtaatttttaataaattataatattttgttcagagaaaatagcattactcttgatcttgaaattgtgacccgaacagccacagattgattctaatgcatcaaatgtcttattattacttaatatttctctcaatctatcttttctatctttctttttctattatattgtatcacctattataaatataattctctcttttctctctaggtgtcaattaacactaaggcctgtccagggatgtttttccttgattttaggaacataactgattgcagggttcctcctgcgagaattccactggcttctgtgtacctctcttgaaggttataaccttcaagtaattatgcagatagatagtaggaaatgataagttttaaactgagaacctgtgttaaagatgtattaattggttaggaatatgatttaagtatttgatataataaaatttgacaattctcttttcttaactaacctttaaaaagaatgatgcacatatggttttatttctaatatagtattacaatctattcgatcctaatattagactacccccaaatatttatagtgattctacgtccaaacttcatagcttctgaatatcatcacatcaaatttcacactccaagaatgtctagttcaggacgggggggggggggggcttttgggaatgagttaaagattggtctcagttcattttttaataacttaacatgtaccaattcccgaaaagttcaacatcaattgtgaccttcttaatttcctcacaatgacccaataataatgtcaattcatttggatctgctagagagaaggtat

SEQ ID NO: 2646 - DNA, 1000 bp, Glycine max
  Soy_ogl_6006 Gm18:9150501..9151500 Cluster 11
agctctagaatgtagtttacaaaattatatatattttgttaaaacatatttcctaaaataactttatgaaacaacacataccgattccagaatataatttccagaataatgtgttaacaaaatacacttagttttggaaactacttttcaaaattaaaatatgttgttctagtagtcataaaaacatgtgaaatatagaactttccttaaggagatgcgatagttgccaattgctaattattggacaaatacttattttgacgctaaatacagataacccatataagaatttttcgatgcacgaaacatgagaagacgcctaatagtgtgtcagcagctttgtaaaaaaataaaatgaagtataatgtacaccatatgatagatgaagtcatccatgggcatatgttgaaacacagtattacatgaacgaaaatgcacattatcacaaaacaattgatggaaaatgtggtattacaacaagatttaaaaagtaatgaataggaatgacgaccgaggttcaaaattatgctttaaaaaaataattaagatagggtgaaaaataggatttaaaaagtaacaaacatgatacttatatgttgttttgaaatgtagtttctagaattgtatatttagttaaaacaatttcataaattactttctgaaattgatgtatgttgttccataaagtaatttccaaaattatgttttgatatacacaaagagaaagaggagtgtacttaataaacgtgggatgtaaatagcaagtgtctgtaaagttgctatttagtcctgataagttacttatgcaccccacttaatttttttaaaacacccccttaatgccttcatctttttctccatttggttctcctaactctgcctcattgcatccccaattcatataataccccaagtctatgaaattgtgccttttagcattctttaaaacatattcttcaaagtatattaaaaaagagttttctagtaaggcaatgtcgac

SEQ ID NO: 2647 - DNA, 1377 bp, Glycine max
  Soy_ogl_4717 Gm14:6441001..6442377 Cluster 11
acagttattagtttgatgcatgtagttgtgctaatcttatttgagaaaaccatttagatgtgtactataattatccaccaactttctatattttatcggtgttattcttattagttcatttgttgtttcagatgcggtttagatgtattgaagatgtgtagaatcatattgcttttgtgcattaatcatgagtctagaaatttaagtaccttgataactagttgcattcatcttgtataactgcagtttggtgttgatagatcccagcctgttcatagtttgttaggattaaacgttaacattgatgtgcgaagattctagcctgttttagtgtgtttgattttcaggttagaatctctgaaccttggtttggagacaaagtcttcaagagacaagcttttgcccaaactatagtagttttcaagaacaacacttggtcacataggacattaggactaaacatttatatgatatagttggcattagttggcattagttgcctattatttttacttttccaaaatggtttaccttaagtgtatagtgggcacgtgctccgtatcaacagtttgttaccttattatgctaagagccatatgtttttatggcatgtttgaagactgaaagtctctatatctaataccaaggcaaggtttggtatttggttaacggtttttacataaacattctgatttatgactcagaactcgcaaaaaaagaagaaagaaacaatggaactaaaatggatagaactaaagtggttcaagttgatttcactaaaatggatagaactaaagagaacaaatcaggatatgaggttgtaacctttgaaattattatacttgtaaaaaaaaatattcacgtctttgaaattaaaattcaaagttttttttctgtcattaaagttcaaagtcaattcgacgacagcctttgttgggcattggattttttttcctctttcatttgggcccatgacattaaatttaattgcattgctttcaactatggcatgagaatcaacacatttatgccaccaaccaacgataacaaacattcacacaaaataacattaatgaaagtaagttacactaaaagaatatagttttaccagaaaaaaaaaggtgttacaaaaataaaaaagctaatatgttatttataaccaaaacacccataagcatattttatattttagaaaattattgcgtgtaccatcaaaaatattaaatgtctgaaatagttccctaaatttaattgcattatttgcttgaactatatgacctgagaatcataccatctattatttatacttcttccatctgatattttcaagaaaattattaattacacaacttataacatataactaattttttggac

SEQ ID NO: 2648 - DNA, 1300 bp, Glycine max
  Soy_ogl_4317 Gm13:28045301..28046600 Cluster 11
cattttaacatcatgcactaaatggaattgtacaaaaacaaaatccaggttatgcaattgtcattaatgatagttaaaccttttgtgcagactccaatatataaattaaactttgttcattctaaacaaaatattatttaacaacttcaataaaaattgaatttatataaatatcatccttacttttcttcgtttgcacctcattttcccgtaaattttgatggaaaaggacattaatataaggacaaaaattgttcggccacgaacggtctaaaataaagccgtttgaacgtatatacagtattatcctgtccaccttacaagaaacacaattagaacacaaattagtttttattgttaacttttttagataaacgttcttattgttattttatttcttcgagtttcgtaaaagaaacatctaaatagatatattttttgtttttttactgaataaatgtattatttattaagaagatttagttggattgattcatcagcgcgtgtaatatagttataatggttaattatttttctttttaaaaaaatcaacaggataaaaaggaaaataagtatatactagcattgaaaagaacagaagaaccaaaatattattttcgataatgtaacaaaaaggatagtgatacgctcctattgattaagtttctgtatgcaaaatcattgagccatgctgcagacatgttctatctttctgggttagtgatgggcacatcttgtgtgctcccccattaataatatattttctttgcttcttaaaaaatgctacttttatttaacaatttatcttttttacaaattaatacatactacaatctagtctattatattgcgtagtttagggttttttttttaatttgtttacacaacttaacattattttatagttttgaactttcattgtttattgttcttattatgggtaaaaaaacaaaaaacttaaacatttattaatggagaggtagaggtaatgattattctttgtcagattttgttaatcattgtcctaaggaaaaaggaaataaaaaaaaattaatgtataaattataaaatagtgtaaaaaaaatcatgaaaaatatggtgtcagccttcttaatttcttaactaatatctttgagacatttattagcatttgttttagttatatatttagtaaacatttattaaatttattggagggaactccaaaataatgcacattaatttactaaatgtattaagacatggatcccgtccgtgaatcctggtgcttagtttgttgtcatttgccactacattttat

SEQ ID NO: 2649 - DNA, 1214 bp, Glycine max
  Soy_ogl_5343 Gm16:7958501..7959714 Cluster 11
aattaaaataataattattttaaaatattttttctactattattatgaaactattatataatagtatgtattttagttttttttagttcatgatgtaacaaccggtacatgcatttgtcttattgttacatttcttatatagtttaactttttatattgatctatactctatagtatatttaaatatttctattttaattgatcttatttagacttgagtaaattttcgtgcctcgctgtctctttatatttttaaaataaaaatacaataaaaaaagggagagatgggcagttatataatagttgatgatatgtgatgataattatagagataaaatagtgagagggtaatggtaatttgattgtataattataagggtaaaataaatataaaaatatgtacaccaaaattttcaattttcattacaaagtatagataatattaagtttgttttctaactactgtcacttaacagagaaaccttgatgcaaggaaaaaataaaataaaataaaaacagaaacagacaaaaaaatatgttaagaaaaaggaaatgtatattttataagaacaaaaaatattaaagtccttctattttctttttatctttagcaaaatgtgttaaagttatgcttataaaaaccaaaacgagacaaactattcaatcaaagttactcttcattttatgtttttataactaatctataaaataaaattatcagatatcaagactcagttataaacattcctatttatccaaaatgtatttatgatgaatcttttttatttaataaatattcctatttattataaatcttcctacatttatcaaacagcctattttattataaatcttactatttttatttaaaaaatcttcctattttactattttgtaaagctataggttcaacaaaatttagattttcctatttttttaattttctttgtctattttccattttttccattatatatctttttaaatatttaacctagtggagttgaccaaccgattgagatccattgaaattaaatgacttaaaacaaatcaaatagaccaaatccgatctcatccaaccatttttaattcgttcaagtgtaaattatcaaatgctttatatctgtgtgtagtgagcaccatgctcatcacacaaaaatgaaatgaagtaacattaaaataaaaattgtgtgctcatcaagtgaaaactaatt

SEQ ID NO: 2650 - DNA, 1172 bp, Glycine max
  Soy_ogl_5730 Gm17:36155929..36157100 Cluster 11
acattttagaaaaaaaaattaaatgtgatcgatgggtaaatttcaatcacattaactaacctttttaattattttttttaaacaaacttttttgattgacccaaatgttattagttaattttgtttatatttgagtatgaggatgtacctttttttgtcatcatcatatttatttaaagtatctattaattttattaaattttgtcaatttttaatcttttatgataaatttgactaactaattgaaacatgtcaagaagaaaagagtaacttaatcttttgtcaaccatgtttatgaatgaatggataattgttttgaaatcgtctgccgtgccccctctctaaggagtatatgattcaacaaaaatcacatagggatagatttgatataatcaaaacctctcataaaatatgtacctgtaactagcggatgaataaagtacattaaatagtccgttttagggattgacaacttatccattcaatgactttgacacgggacgttcattggttttataaaatcacaactaattgaaacgtgttttctttttctatctaatacatcatatagaatgacgtatacagagtagttattatcaatatttttggggtcagattgccttgttgtctgcatttagggtttccggtttcgaagaatcgttattaaaactaataataatagtattaataataaattctatatattacattaaataatatcaaataaatataatataatataatgatttgatgacaaaaagaaaaaactaaaaaaggcatcattttataaacataagtaactaacataatacaacaagagaaaaactagaatacgttatagtgtaaaataattttgtactatcttctaattataaaatattatttataataaattttttgacttttgttaaattatcttaaaaattacaccaaccttaattttatgattggatgacaattagtatatcataattaaactcataacaacatccattaatgctaacaagtttacatttagaaaaaaaaatgaaaaattaatataatttaaacttgtaaaaaatgaatcaagatataaaagttatagattaacataaataattaagttatatgatttataagataaacaataacaataatttataaaataacttgtaattatgtgtaatccttat

SEQ ID NO: 2651 - DNA, 1100 bp, Glycine max
  Soy_ogl_5734 Gm17:36698801..36699900 Cluster 11
ttttttatcacatttatttttgttaaattttatgtgaataaaaaggaatatttttgtataaaatatttttttattgcagattcattattttgttatagacttattatattagttaatcaaattcgttaaattcttcttattcatattaaaatgaataaaaattgataaggagttagttaatgatattggagtatagtatgaatattataactcttttaatatactcatatacaccattttcaaatgagggtcctaactcattttacaatttcagagaaaagggctctctcaaattaatgtcatggtacaaaatttcattaaatggcattccactaagtaggaacacaaggagtcacaagaaaaggcaagtgaaggagccaaaggtgagatgttccttggaagaaaaagcagtcaacaacgatcattgcgcacccaatcatggtgtataatagattgaatctctagttgaaatgctggctgatacaatcatgcgtggtacacccttaaaccctttccccccttaaaccccacatcaaattacaagctcattttgattttagaataggtctattaattatttggtttagttgcttggatcagctacgtcatgcataaatccaaaaggttaaaaagttttgttgaaagtgaatgcaattatagtgtgacgttttccgctgaaaagctaaaatactttcaaggagcatagttcgtagcataaaaattaagaagcttttacttttcttttttaacaaaataaaagggggggaaatggttgagtggaatttgatattttagtttgctccacacaaggacaaggaataaaccatattcaacattgctaactaatatttttaagacatctgttaagaaattaaaagaaaaaattattacttgtgaaaaacataaaaaacgtaaaaaaatatcatggacaaagttattttctatcttccaataaaaatatttttattttaacttaactataaaaaacatttgcttaaacgtaattattccacataaaatttggtctggatttagcacatgacatttctctagtttacactacttctccgtcttcgagtcataaaagtttgattcatgtg

SEQ ID NO: 2652 - DNA, 1400 bp, Glycine max
  Soy_ogl_880 Gm03:34836801..34838200 Cluster 11
tcgatcagaaaaataatctcatcacaatccttttttcatcctgtgtaaccttgatgtatgccaaaaaaaattattgaaaatttaatcctctaattatttttctctgtttttttgttgttgtcatcaattttatattactatttttttatctaattataagattttttgattaattcacatcctataaaaaatttagttaaatttgttaacaatttatatattttgtcaataggtcctggtaattggtgtccttagttcactgattaaagaactaaaattaagagaaaaaatatttagtttgaaaatcatataagagaaaaaaaatatgatgaacaacattatacatatcttaataaaaatctttttactttaagtttcctaacttgttaatatttgtcttttttagaactatagttaaaattattaagattcttcatttttctttctacttatattattttttacctaattaattatatgttagttttcttctctaatccttataagataaaaaatacatttatcttttttagttcatagtatttattgtaaaataaggatatttcgataaaaaaaataattaatttaaaaaataacttgaaaagtatcttataaaaaatatttttttttaaaaaaaaaagtcagatagaggtgtcatcatataatcgtagccatgatcattatcactgctatggaaggtccagaggaggccgaagtggataggggaacaagtttggttgaatctccaagcttagcatgcttgagtcccataagtctgcaagcccaaatttgaatattgtgtgcaaaaaattgaaacatatcttttctaaattgaacataatattttaattacaaatttaaaatgtatctttggccaaaatcaaacaacttcttaaactaaagagataatggatattttttaaataatctttttcttctaaaaagatcaaattcatatctcttactatcaataggagtctttgcctaaagaagaaaaatgcaccacacacaaacaaaaaaagctcaacaagagctcagtatccatgtttagaaaaattagagaaaatagttgtttataaattggatttgtgtctaagttgagaaagagagtcttaaatcttaaatgtgtgtagttattcccaagagagtgattattagcatattgtaaatcaatgatttgaagccttaaaggttatacatgggggagagagatcagggtaacatccatttgatgggttgtccaaagtggtggtataattagctggctacttcggattcactagggagtgtgatccctagggccggtctaggatttagaaaagagtatccatttgatggattgttgcttgtggtaataattagctcgctttctataattcgttgacttggtggccaagttt

SEQ ID NO: 2653 - DNA, 1300 bp, Glycine max
  Soy_ogl_1313 Gm04:38742201..38743500 Cluster 11
gagtcgatgacgctaagcaaaagcagaagcgtgtgggccctttcatgcgtagctgtcaaccgttaaattaggcctaactctgatgtcaccttctgttgcgggacacaccataggtctcaattcaaccgttaggatatgacgatagtgggacccaaaaatcaaaccatatttcttcctatagaatcgcaaatcaccttaatgccctttaattatgctattttgtttttcaaatgttgttattctattgtttagctgccaaatgaaaagagaaaatatttatgcactgaaaatttaaaattatttaagaattataaattattaagtacactaaatttattgatttaattaaataaatgtattacgattaatctcaaataagaaactaattgcttttgcttatgcaaaatgagtttaattttaattattactgtaataattttatatagtttaattatatatgactgtaccgttaaattaattgtgtatcattttttatataaaattattgtaagattttagaaaaatagaataaaataagcaaattcgtcccgcgtatccgaataccaatttaaagtaacatgaatttaattgactaaacctaattcagacaagctggtaaaacggatatatacggaaaaaaagatttaaatatgtttttactcattcaaatttgaataattatttcttttagttttttatttaaaaaaattatttttatttgtctcttaaattttttaaaaccttcttttagtttttttttattcaatgagctcatggtttataatttatgatgatttttaactatcaaaatttattttttaaaaataatttctaactattttaaaccatcagaatattttattcggatgatttaatggcctttttcacacatgcatttacgtgtttagaatggctcacatttatttgcagcatatggatttatctacaagtaacataatatattaagctaaaatatatttatgatctttgatatatatttaacttttatttttaatgtctgataatttttttctttatttttgttttctaatatatgaaaagttttattttttatgcttatcgttaaccggagatatgattgttaactttttaaacataatacgattgtgatagttttaaaaccgttagtatttattttgaattttaaattataatttatggtgatttttatttgtcacaggaaaacaaatccagtatcccccataaccagtagatctagtcggcacaatcccccaatagcaccattctgtgtcaccttctccgcctcagtaccattgtg

SEQ ID NO: 2654 - DNA, 1133 bp, Glycine max
  Soy_ogl_3139 Gm09:36696301..36697433 Cluster 11
cgggatgatcacgacaacaacggagaggaagtgcatgagcagtcacgaggtgaggatggtgccagagaggtcgaggtggtggagggcagcataggcggagaatgcgatggtggggtgggtggcgttgaggttgttgttggaaatgttgagggaggccgcagagggtggtggcggggacgggaccggagaggtcaagagtggtgacgactccggttgtggcgtcacacgtgacggctgttcaattgcatggagtggcgtcgcggtggttccagccggagagttgaagtttggcttggaggaggaagagaccgtctttgtttagagagagaaagggaaagagaagcaaaaataacaatagctgtaaataataaataatgatatgactttaatttaaatacatgttaactgattagacttaacgacgtttgattatatctatcatcatcacgtgaaacataaaagaaagtcaaataaaataaattttagataataaattaaatatgacctattttctagatatgatatacatattttagctcatatacgatcatcacattggaaaggcatgcacttgagttgatttgatactgataggcttgaataatttgtttagtttttttagctgttatacttcctaagtacaaaaaggaaaaaaaattgatcactattgtataatgatgagttggattgttattatgattgtattgattattagaacatctttaatcacgttctttaatggagtttttggattcaacaatttgtgtttatcaaatattattatttttacttgagagttctttatattagaggttggattttaagagtaaaattcaagaatctgaattaggttctactatcattagaacaaaaatgacaaaagtttttgtattctatgtgatatcatgagattgcaaaaaatgattcaaaaataaaaaaatgaattcttttattaaagatgttcttagaaattaaaaaaaaattataaatttattattatcaactaaattaattacctttttaaattttgatgaattagataattgaatcgtataaaaaatgattttttacccaataatagtaaataatgaacaagatgaaataaattaaataacaattacattcttcctggc

SEQ ID NO: 2655 - DNA, 1224 bp, Glycine max
  Soy_ogl_2726 Gm08:16345623..16346846 Cluster 11
tttattctttatttttttataacagtttattactgcaaaaatgtttttatagcagtcgttcttgataaattatgctgtgaccaataccccagttagtcctatacatgtgacccattatcaagaaaagaattgcaattgtggtgtataatatccgttagttatagacctccagttgatctaatccttcaccaaaaaagtcagaaattctgcgtattttgaccagtgttcaaggtgaaaaagctacgattcaagactaaaagcttaacttttagactttcatttggaaaggatgtgaataaaaaggaaaggaaaaatagataacttttagattgtttggcttgaaagaaaaaaaaatattttctcatgtttaatcacatagaaaaaatatgtatataaaattatataaatacctctaataaaaaaaagtgtgtatagaaataagggtaattctctactatatctcacaaaagctgcccgcaacacctttttcatacaaaatgagaaaattgtaaaaatagtggtatctatttacttttttggattgtgttccttcgttttaatcaatcaaacgggacaatggttattttttaaaatcttttccatttccttcctctcagtttctattattccaaaccaacgtttatgcattaataagtactaagtgttattcagaaaaaagtacaatataaatgtctgtttttttttcttcaaaattcccacacttttcaattcaattgagcatgatcaggacggacctgcttcttggaggaaggggataatttttcccactattttttttcttagtataacatgtatgtgtagttatctattatttttataatttaaaatttagttaaaaaaataggttataatatgaatcttgctcggtctcatttatatatgtgagttttgctcccacaactaaaatattttggatctgtccctaaacatgattaagtaaaaggttcaattgttgaacaggttttgaatggaaaaataaatacaacttaaaatttattagtcttatatagagatcaaaatgtaaaacttgtaacagtgacaattatgatgaatagtttagattaaatttatatatatagactttaaattatcatataaaacataataatcttacaatattattatttagttgtaatttttttatcacaatttttattttcatgagaaataagcacttgaaatggttagaataatatagaatac

SEQ ID NO: 2656 - DNA, 1119 bp, Glycine max
  Soy_ogl_2727 Gm08:16379595..16380713 Cluster 11
ttgagtcagagataagcaaagttgaacgaagatgttgaaataagaagcagaattaatgatctcatcaaggcgtgcccaaaacgcatcatgccaaagtgagcgaaatcggttatgaaccgtcggataatcatttacgaatgtatggttgcgattagaagcaaaaaaaaattgttcaacctttcatttagaaaaaattatgcacaacacaaaataaataaatgagagcatgacaaaatttcaacgttattatactgtatattttgaatttatgttattttctatataacttacttgtatatattctttgttttgagttcacataatattttctatctagcttactcgtatatattctctcttttttttctctccaaatttgatagtatataatttcttgacatgtattattgtctcctttttctaatttttttattgactatataaataaggtaatgaaatttttaataaaccaacacaatgacggttataaaccactatattggtaaaaaaaaatacatatgcacacaattcatcttcagcgacgatttttgaggaatttaattttaaaaaatattagcataatactttatactcagcatttattttatacaatattcaaattattgtaatggtttacaaattacaataaccagtattgtcatgagttataacaaccacgcttaacaaatgagagggaaaaaatttacgtagcataaggatgacaggggttgcaaatagaaaaaccccaagccctacgacaacaaggacagaataaaacacgtggaataaaattttaatatcaacatttagttttaaataaataaataaaaaaaaagccaacccggttcacacccaataatcacaaccatacattcgtaaatgatgaaaatcgatttcgctgactttgacacggtgcgttgacagtttcacactttcacttgcacacgccagaactcgcctctcatgaatatactttgtgtccacacttttcttttgctgagggattaatattacccaaagttatttattggagtaagttttataattttaatttgtagttggacactcacttaagtaaattgtatctaagcatcactaagtttatgtttgatagtgtga

SEQ ID NO: 2657 - DNA, 1000 bp, Glycine max
  Soy_ogl_3401 Gm10:7123301..7124300 Cluster 11
aatggcccaaagcagatattgcatcactctatccaaatggtatggttcacttgaatgcgtatgatattttcaaaccaacatttgagtgaatctaaaccaagtcattcctctaaaaatctcaacggtatatccctcggtggcttaaatgccaggttttgactcaagatgtaaatagaaagttttgtttccttatcgtgagctctacctcatttttttctttgtaatttgtaaatttaaaagcatgcatactccgatccattaatttaaacagaactacttatttttaggaaagtttaacggctgttgacagggcctcgatttcaaagtgggctgcaatggtttcaacccaagagaagcttttggtttgggttacacacttcttgaaataaaatgcttgttttaataaaataaaataaatatttttttaatttttaatgtgtttgtataaatcgatgatgcttaaaaaataattttatttatttattttaagaagtaaatcatatctgtttcttaaaaaaatatttatataaaaattttatattttaaaaatatttttttaagtttaaacaaaaccacctttatatgttcattttttcggacttagcaaaacaaaaaaaaaaaaacagaggggtttaggaaataaattcttttttctgcagcagtggggtatgatttcaagttcccttttcatattatgcaattagatgataggactatctcaaatggcttaatattggtatatgagtaaagttatatatatttttacaatttctatattattttataaagatattaaataaaataaatacatatacttaatgtctcacaaatattaaacatatttaattcttgtcctacaaaagaaacaacaagactaataagaaaacattgtaggaagattgaacacacctcgaaataatatatagtactattttaaatattgcaatcaggcagtggtatggccctaaataatttggattactctgtatatgtatgtgcc

SEQ ID NO: 2658 - DNA, 1400 bp, Glycine max
  Soy_ogl_4260 Gm13:25384601..25386000 Cluster 11
ccactctgataaagtcatgctgtgatgaccaccctctgatgagagctgtgttaaaagctctctgtaggtttcttactgctgggataaccatgtccatgattatgattttagtttgagtatcagacaaatacaaattggctgtgtgtaaatgattggagacaaaatttaaagttgccaactcagtctattgtttacccagatgtgaatgaaaagagtaatgtaatggagttaacccaacaggttacaacactagaaagcataagtaattctattctattaaagggctaatcaattttattttatttaaaaaaaaaaaacattactaccaagtacttatcacttttttaggagataaaaaacagttatttagtaacagtataatctaatcataaatcacaatatcataaatttattaatttttataaaattatcttaaaagttatattaattatgactcacgatgaatggatcgataataatataaaactattttgtattgttagtatatcactattaaactcttttaaaaaaggtttgagtctattaatattttgtaaatttagagtacatatatatataaggtttaaaaaaggattgagtctattaatattttgtaaatttaaagtacatatatataagggataaaattctaatgatgaataatacaagaactagcaagttacttatttatttactctttaaattaatcacattcacatactattttaatgttggtattctctgtttatttttcattgtataacattgtagtttcagtataaggaattatgtttcttcattatttcccttactggatcaacttgaatcctctctagctactatcctgctaaattagttcttgcaacagtggttaaaaaagattgaatgtgatcaaaggctgaaatttctgctggacagagaaagcgagaggatctaggttcgtcaccatggtagaagatgcagatggtgatcccataaaattactctaagaagcataagatggtgatgatatatagaaaagtatgagagaaataaattaagagtataatttgatttaattttgacatttttttattcatacgaatagagggcagtattaagaaatttacaataatttacgcactgagtaatatcccttgatttaattttgacattttggtgatgagaaaaacaaaaattacaagataaacgtgacaaaatcaacttttcttaaattatgattatttgattcttttgtaagttcttaaactcactatacgaaaatcaaatattgattcaaaggtgatggtttaaacatatttatttatccaataaaagtgacttcaatgcttttgtctatcatcatcttaaattgactttaaaaactctagatactaacaattaatatttactctcaattt

SEQ ID NO: 2659 - DNA, 1100 bp, Glycine max
  Soy_ogl_5670 Gm17:13242901..13244000 Cluster 11
ttataagctggaacatgaagcttgattaggaaaaatacaatcaaatgaaaaacattttgggatgaatcttaataaaattggaggtgtcaatagcaacgcttgtttaagtagattagattgggctaagtgatagttcccttccaactgccttggattcattgtgggaaagacccaactcataaaatgaatcctaaaattaatatctaaatcagacaaaaggacatggagctagctgcctttgcatctttgctagtggagacagttgtaaaactgaactttgttatagaggaagttaaagaactaggaagattagcatgatgcttcaaagagtacagaacccatgataagccatgataagattattgttagtcgtgagacaccatgagttgacgtgccagaggaccaaatacctactcatggattaaatccaagaggaagagcctattaaatgcattctttcatggatatgacttggatcttgctcatttttaggacattggttaagaaactagctaaaaaaaatatttattataacattcctaaaattaaagagcataaaaaaaaagttatgaacatacaattttgtatattttaataaaaaatttatctttttaattttttaactaatgtctcaagaatattatggttatcatttatctattttttttatggtatacctatattttgattatgttttaaagtaacaatatctcttgaatgtcatgatgatacaagtatatgtcgaggcatagcatagatcatttacagtcagcagtaacacggtttatttgtttttttgtttccgataatatcttcttctttactaggtaagactttaatgtcatgtgttaaagtatagcccctctcaatcgcattccttatatatatattgagataaaatatttaaggaattcaaactttttctaacaactaaaggggattgagtctaacagaatagtagtatgtctgtgtagctgtttgtcgatgcaaactgacgttgacaaaacatttagatccttccttttacgtttaatttgaggtggatcgattgatttatctcagaattcatgcagacaacaagttggcaaaaaagttcaaac

SEQ ID NO: 2660 - DNA, 1334 bp, Glycine max
  Soy_ogl_3117 Gm09:35828467..35829800 Cluster 11
aaaaattaatatataaaaaattttacaaattaatttatatataatacataaattaattttaacttattgaaaaattattaatttgttattcttacttttttttttctaaaaatacttatggaaaaattaagccaaatattctcttaaacatggtatattccttgtcacatgtgattaaatctaatcatgttattttttttatcaataaatattaatcattaatttattaaattttgattggcatattggtttaaaattgttaagtttcaccatggagtcgaacacaaccctttcctactaacctaatgagccaccactcttcttggacatgaactattttttaagaatatttttttatcagagaaattaaattctcttatactttatgagaacatttaataaattggtatgagtcttgcctgtaaggaagcatttgacgcgattttctcccccaacaaccacttgacaataagcaaaacatgtcagcttcttaaaatgaagttttttaaaatgaatgggagaggtctaattcaacttcaaactcaagggatgagagttgcccttcatttatatattttaatttgattatatttttatataatataaaacttgaatattcttcgatacagctttcaaatttttatatatacaccttccctcctcttcctcatctacattctcttttccatgtaagtatccgaaattttgatgcgtgtattggggattgtttttattatatgttaatgattagtggggggtttgttactttttgtgataggctattcgttagggggatatgctagggccaatggtatttacgggacctgactttaaagtcggatggggaaggctctcggaggtggttataaaatataataaatgctaactagtatcgttagggtcctagttaacaaacttaaggtatgtagaaatatttttattgaaagacaaaatattaattcatgattcttcttatattttttttaatgatttttacattatatttttttaattttataattaatattctaaaaatactaattaataagattcatgaaatatttgtgattctctgctttaaattccgagattattgggagagatttatgtttgttcctcttttttatgtagccttgtaaattaaaggtatatcttacacttggtttttttgtaaaataaatattttttttttcttctatagtcattaattactaacttattgatttgggcattgaagtctctgcatatgtccatcacctctccccgaccttgatgaagtaatgacgttagctctccatcaattccaattctttcggtgccatatggacactaag

SEQ ID NO: 2661 - DNA, 1864 bp, Glycine max
  Soy_ogl_4300 Gm13:27281337..27283200 Cluster 11
gcctcccaacatcaacttggagaattgaacccaccatcgcccttcaaagccacgtcacctatagacacaacttccaaacccacttgcacactgtcctcttcgatttccaaaatccacaatacttgtgctctgttggataccgttccttatcttcctcattgaggacaatcaccattctcaaacggcgggtattgacagaccaaaaggcccaaatgacagtaattggcccaaacgtataactacgattggtgatttttgtaaccgttagagaatggatcctttgtaattttcctttccaagaagcttctagattagtacaactgtgtattagttgtattatgaccgttacgttatctgtgtatttaagtccttgtaagctgaaagttagttatatttttatatttgttctttcttcttttggagaccttccctgtctccaatgtcggaatgctctaacatcacacaacataaacaggcgtgaagtttatcacgccttcaggcctaagtcacacatagtatgatttgttgagatttcttgagcttctttctgactttaagattaattctttagagagctatgttcgttctatagcatgaacaataggtatttgtttgtaattatttaacaagttaaatatgaatattgttattaacacccccaccccatttctattcaaatgcttaaattgtaacgtatcaaactaggcaatgtttaaaccttagtgcgtgtttaccatttccttcacctcttttgtttaagatcatacccaccatatatcttgcctctggattcatgctttacatataaatataaatatgaatacatttggaaaagtggggagaaaagggtttagatttttgtgggggtaaaagaaagcaaagagaagaaaaaagggggtttgcttcttttggaagttgataggaggagaggtaagtggagcaaagaatagatattccaaaaacttgagagagggcaagagcatgaccgaccattcacaagtttagtggacaaagggaaagtggtcaccctaacactaaagccaatttgtcgtaattgttttgtacataactccttggcctctttccaacaataaagccccctgtcccaattctttccacgttcacaagttaccctcctataggaggataagagtgaatggcactttagggtcactttcacttatctcccactttatcaagcaataatattcataagcatgcatgacttttcttatcaattatcatctacaaagtcatcttataataataaattacaattattaactcccttcgctattacattgaaagaacggaaaatagcatgcactaattattaatgggatctcgggctagtattttagttaagagtggttggaaggatgcggtggaggttttctcctttcttaattcttaatgttttgcaactacgatggtaggttcaatgacgcgcttaattaaatacacaacaaaaattgtattctaattcaacgtaagacctataaagagtattccgtgggaccctagtggtcaaacatctatattaccaatttattgaggtatggtagctaacaaaagatggttttagagtttagacaaaagcaaggccactacaagggcttgttgttgtgtggttccatcgaactcacacgtagcttttcttcacaaattgcttgtgtgggattttgggtgagggttaaacttctcgaggcttcttatccgtcaatgtgtgaaaaaagatttcgtgccatgtgtacttatacgttttaacttttagttttttttagagctgaacttaactactactttgttctacgtgcttctgggttcagtggttgttaaaatctcgttcaacgaaactccgaaa

SEQ ID NO: 2662 - DNA, 1300 bp, Glycine max
  Soy_ogl_1992 Gm06:16707101..16708400 Cluster 11
agtgtcttatggttgaggccatgagttagtaggtatataagttgttttggatttgagatgtatgattaatatgttatgaggaggaaggttcaatcgaggaaattggtatgggaatgattgaatcattaaatgaaaacatgtggttagtgataagtgccaatttcacctatcatttgatcttacaatttggcattaatttatcttactttttccttgcttttatacttgtttgaccttaaattttcttaataattgatcatttaggattaggaagttatcattaagttagctttttgatagattgtcactatgttttggtcttaattttcaggaaaataagaagaaaaagaagtgaaccttgtaaattaaggatgatgatttacgcttaacaaaggagaaagtcacgctcagtgacaagtttatagagtttttgagagtagttttggtctctgcctattccacatgaatttgctttctctcatgttccttcacatactgtctctgtctctgtgctgtctcattccacacttaacacaatcgtgttcgcgcttagcgtggaacccattgagtctacatattgatttgaagagtcacagttagcacatggttctcctatatgcttatcgtggaaattaaatcactggagctcttgaaatagatgaagacttgtgcttagcgagggaaggagacacgttcagtgagctacttatgacctgacacctatgaagggagataatgtgtacgttttctgacacttcaagtatttcaaggacgattctctgtgaaaagctacgaaaattacctttggagttctcccttggcctctccacccttctaaatcaattctttatggattttcttcattccagtggctaggagtagctagattcaaaatatttgaggttgaatctagtgaaactgactcatatacttcttgtaaaacctaaatgttgttctcatttaaatatactgcttctctgtttctatgtttaattatttatgtcctgagcatccatttacgtgtcttgcatgttagtcgatgcctaattggaaaacatattttcattttagatttgaaagaaagaactcaatagatcttagatctatgaatgaatattgatttgttgagtttatcttcttattagttcttttgcttaatataaaattcctaactaaagctcctaaggaatcagggatttaataagaaaaattgatattaatgcatgtacctaagaaataagaaattgggaattatatgtattttaggatattgaaataagtatgtggttttgggttgaga

SEQ ID NO: 2663 - DNA, 1021 bp, Glycine max
  Soy_ogl_2691 Gm08:14734601..14735621 Cluster 11
atttcataactccataacgctttctatttgcttcaattgcaaacccttttgcagcagctagttgtgatcatatagacatacatatatctagtacaagcgtacgtaaaaaggagagatacagggaaagtagtgcatgggttgaagccagccttgcttatgttggtggttcagatttcatttgcttcggtgcacaaacttgccacaaacgatggaatgagtgtcagaatagttactgcctacggtctcattttcgcaacagcttctacagttcctcttgctcttattttttaaaggtccatacttccatatcccactgcttaattcaagaaattattattcgatccagagcatagtgttaaattatggtcccaacataaaggtatttttgacatttagtaattataatcacgacaatatcaattacattttctcgtaatataaatttttttctgactcactacaatcacaattacagttgcagtttaaaatcatggtccggaatatgacatgctcacttgctcccgatcatttatgtcaatttctacgcgacatgttaacaaaatttaattgaaaattgacataaatcataaatatgtaataattttgtaccatgcaataaaaacttcctatatacattaatttccacactctttactatatatcaaaccatattagtgttgtccgatattactactaatatgaatggttaaaatgcctttttctttattactgtttacatgaaaaacagaccaaagctgacttggagggtgatttataagtcattgtttttggcctatttgggtaagtttacgtgatttaattacccttaatatgatagtttgtttacatagagtttatgtggaaaataattaaaataaataaataaaaatattttaataaaaattgaactcatgattatttatttatatacaaagtaataaattactaagacacttgtttcatttaattaactacattaatattattttcaatgtatcattagtaaagaatttttttcttc

SEQ ID NO: 2664 - DNA, 1629 bp, Glycine max
  Soy_ogl_869 Gm03:33160272..33161900 Cluster 11
atttttatttgtttcacaaccttttccatttttatatttttattaatatttattgaactttttggcctatgcaaatgcacgagactttatatatcatatctagttttttcagaaacaaaaaatatgtatctatttagtatatctatgtcactttgttaggatggcacgccttgggagataaacgacctatgtggtttgaaaagtttttgaataaaggaagcgaacaagttgttcatatcttgagaagtgtcatcatcaagattaataaataatgtctttgacacttacgtcatttgagctacatatacatttacatttcgattaatgtctaattatggttctctcacatgcttatagatttagttcactctttagttagagtgtctctcatgtcacttctgcctgtgacttaggaacccacaaaaatatgatgagtcactatcgacaagttataaagggacttgcacattcacccaacccaaaacaatattatatagtaaatttgccgaaattattcccacttaattaaaccatattgcgacttaattaataaaggaatgagatgagatatggtgtcccacataaagcttgagaatgaagtcgttggataaagatcatcttcctacgtgacttcacttttcaagaagctcttcaagaaaacataatcatcatgttccttacataaaaaaaaaatgttaggatcttttaagttacatgaatagaaaactacagtcaaccctcccaaaagcctagcatgatcatgaactgtccattctctcgaagccataattaaggtgtagagaagttttttctctgccttctccatctctcataaacacacaacttactgagcttatggatcccaagtctttttgttgcaaaaatcatatactcccttgtatacaataaaaatcacaatgaaatggtctatttctacacacttactatagctacgtacacataacttgacttagacatatccactttatacaaacacatacatcgtggcctatatgaacttgtatagctttgcaagttaatcatctttggcttctcatctttttaatgctttttgtaaacccttgttgaaatgactttttttaacacattaactatgaaaggccttctttaaaaacaaacctagctacttttttcaaggaccacacatttcctacatgttgccactcttcactaaagctaattaagccacgttgatctgtcatctagaccaagacaacaactagacctgctttcctaaagtcatgacatgtaattactactcttcaccacgcattcatcaatccatgtctacgtatattattgctggtcaacaagttaggtcataaatgagtaatataacatcatactagtattaaattagagatcggcgaatagcgtggacatatgcattgtctgtgtgtatttataaatagtgcatatgaaattattagaaaattattgtgtgacatgtccagtagatggttggcatcttttgtgtatgtttggtaaagtttatcctaaaaaaaataaaaacctattcttttagtcatgattgtaggaccacttggaggactaaatggtaatgaatagacttcaacttagtttggagcaaagtagatgaacatgttg

SEQ ID NO: 2665 - DNA, 1000 bp, Glycine max
  Soy_ogl_1299 Gm04:36731701..36732700 Cluster 11
gcatgagctattttgagtttatttcaataagttgtctaaaatagttaataaaacaactaataccttatataaaaattgttcaatcctatttttactttaactattaaaataacttaatgaacccgagatctaattctaaaatcaatcttgaatggttcgaatgaatgagaccggacgaatcatgcatgaccccttataaccagtggcggaacttgacaaatttttttggaggtaccaaaatatttaagagtgtaatgcataacaaaatagagaattaagttgtaaattattattgtaaaaaaatttgcaaacatatcaactattttttatacaaagtaaaatttgtatgagaatattaaaaaaatcattaagattttctatatattttccaacgaaattaagaaaataatattttccaaaatcacagaaaattttatagaaaaagttttcaagaaaatcactaaattaaaaaaaattgcatgaaaacccataagaataagtattcattgcatgtattattttcataaaaaaatgactttcaattaaaatgttatgctatattcattcgacgacttaagatagttaataattaaaaaataaataactttcaaggtatttaaaattattataaaaaaatattagaaacaactaaatataaatatgttgaaattttcttctataggtctattatatgtgccctgttgtcagctatgtatgtcttgtgcgtgatagtgttacactctattagaaaataattgaatcagactaagtttcaagctgcttataagtttagaaagttatcctgttttaatctgtaaaaaaaattgcagcggataaaagagagaaagaatgtgcatgcgttcatacaatatagttgcctttcatatcgttctctgttcttctggatatgtcctcgccttccttcgactttcaagatctagaagcttcctttctcctccttctttccatgcgcccaaattcttaataaaaaaaactcaga

SEQ ID NO: 2666 - DNA, 1900 bp, Glycine max
  Soy_ogl_2007 Gm06:18553701..18555600 Cluster 11
gggtttgaaaatagttttcaaccagcaatagacacacctcggttagaacctcactagctgcgttattgtcccaagcgcaaagatgtttagttagtgtgcctgagaactccttttataatagcttgtatcagtttcataaatttacttcagccaatgagtaattttcttactccctcttatgcaatttctctatcctttgaacttttttttctatgtatagtaatctcccttcacagtctggcttttctatgtatggtaatctccaatctcccttcacagtctggcccatactaattagcattgccaaccagtcagccactaaaatattgttgactgtcttgcttctgaacactttatcgtatgctaatgaacaataaaattggacaaattatgtgaaaaatatgctaaaaacattaactttttatacttgactaaacttgtatgagaatacatagataacattaaagttatctgtgaaatttttacatttaaaaaaaaatcatttttacaaaatcatagccaatataaccacttcctacaattgctatcgagactgtaacagtctcaagtttgagggttgtggtcactggtagtcagttttcactggatgcatttgtttggtgaattttcattaatgataccaaataagacttacagaaaaaagcagaaaacaagagggacagtatcaatatagtaccaaactagaacatgtttcaagtgatctaaattttttttaatgcattcctcactattgttagttttggatttagaaataccagttcaccatgtggcagcaactgcaccaaccaatagcaaattgacaaaaggttcaaaaacaacatcatatagatgagcatcaaatataacaagcctaaatttccaataacacacattcgcccttctatgatatgtccaaggtccaaaatgtgaaccatacattaactatggcaaggctctagttatgtcctctctccataatgaagctctctgctgggaagcagtggttatgaatgggaattatggttaagtgtcagagttagggtcatgggcatgaatgaaattgtaatcaaatgcaacatttgaagttatatatctgcagggtcctcttttgaagaccctgttacaaaaattggcacatacaggtttaggtgacaagaacacattatttatttaaggagtagttcagtctgtgcttatcgcacggctcgatgattaaaactaattgcagctctttcaatttatagcataaacatttatttccacttatttactcgatatgggatgtggtcacgaaacaagacagacagacatatccataatgctcgccttctatcgtttgttttcccattgttttccctctccttcctctttcatatattaagaaagcttcacttctgcaacaagttcgtagcatactacaaagggtgaacaggactactaggtttattttttagttcttcacctcattattcagcttctgatttcccttttgttctggttcagttctttttacaattatcttcggtccttcaagatctttactgatagagaaattattgtttttcataagaatctccattttatatgaatttaataaagtaagttatttgacttgtgttctttgtgacatgtagggtattaatttcttgtgattttgaaaggttgaaatgatgactcacgtgtatgttgataaccttgattcataagttaccgagagagatgttgaggatgaattccatgtttttgaacctatagaagtagcaaaacataagcattatttgacgactctgcatgtttagaaagaaaaaaaatattatttacaaatttaaagaacgagaatctggtacatgttacagtgtgtgtgcactaataataataaagtcaagaaaaacccctaaaa

SEQ ID NO: 2667 - DNA, 1442 bp, Glycine max
  Soy_ogl_2363 Gm07:19003901..19005342 Cluster 11
cagagctctttgggcacttaaccgatttttgtagcatttcaagcttgtcctagggatcacagattgatacaaagtggattctcatggtttgtaaagctcttgaattctgccttatatatttcgcaaatagcagttcggacaccaaccctttataattcataatactgcactttctaagctgtgaagaaatgtattcaggaacagatggtgggcaagaccaaatcttgggaatggccagtttcataggaaaattatcatcaagaaaaatagtttgaagcttggggcaatgctcgagcatttcagacacatgccacgtaatagctcccaaacttgagctccaaatgaatcaaatggtgaaagacaattccagggaagcactctcggttaaactgcaaaagttgtaaatgttggtcaatatttttatttgtaatttaaaattttgaaaatacaaatcttttctatccgtactatctgctaatttgttacttcctaatttgttgggatatattaactgagtcaaggttgctccacgttcagaggaatgtaacgttcagagatgtgacagtttttattttctgagattcagaatattctgtattgcacgttgggtattatgcctaaatataataacaaggaaaaagcacataatatttatctaacagtgcagtgagacatactatataggtggtgacattttccaaaaggacaaatactacctacggagtagtctttgtttatctagaaacaaaaacaattaaatcatatacctttttggtagaatgatagatattaaacattacacatagaatgtggcacatgatgtcgtcgggtaatgcactcagcctgtcatccatttccattccggaaatggcgagcaatgactaccttctgttgttgtcggattgatttgttgtcttggaaaaaattattatgatacatgatatacttgatacctataggttataggttataggttatgagaggaatgagaagtatcgatggcatgtatcactactactactcaacccattagggtgacttagtgatggagttgaagtatcattactcgttgtctcgtgtcctcaaaataaaatatagtatatgaataaaaccaggtataattaaatttggttgattctgtaaataaaaaaaatctactaagttaagatgtcatctttacactgtatttttttatggaaagtacttgttaaataaaaaaaattaagggttggcagttttctaaatattaatttagataattaattgtcatgtagggataattgataatattgtgtttatatatgttgttaaatttaccaatggagagtactcatcaattcacatgacatcattttaattatttttttttttttgtgaaatgatatcatttcacttaatatgacatatcatcgatcagttcgatcgatattaatttacacatc

SEQ ID NO: 2668 - DNA, 1693 bp, Glycine max
  Soy_ogl_2773 Gm08:20081408..20083100 Cluster 11
tgaaggcatcatacatatggtattccatatgcatataaaaaaattatcattgtttctaatggatatccaaaaagctgcaatcccatgttggtttcacaattccatggtagcatatgtctcgtaaattgaagacttgctaatcagaaaatagggacaatgaacagttagttattaagaaaatcaaatataagaaattttttggcattcttgacaaatctatgcatgctgaatgcacttccttttttttattgattattcattatattcaagataatataacaattacacagcacatgagtagatgatatatattattaagaaacatttgtactaattatagttaatttcaaacttataatgtgaagctttacctcaaacaatgtttgtgacaaacaaaaacatgcataatagaatgaaggtgcaccacataacaaatctggaggtgatatcaaaacagattttctgtggtttttgctgggtttggggttgaaggtgataacacagtaatctttggtgtgttttggctatttcccgttgaaatattggtattggacttagttcctctaaatctgactttggtcacttgacttcccatcagcacaatagcaaaaagacaattggtaaaggaattacacactaactctgtccacgtgcaatacagccataaacactcttgttctcaatccgttttgtccaattcttgccctctctgcttcaattttgatatgttaaggcaaaaaaaataatgaataaacagggcaagaaaataaatttaataacttgactcattaaaaatgtaatagaaaacatatattgatttcatcaagatttaatccttcaaagagtaacttcagaaaacttgcctaccttttcttagtgtaatggatggatggatggaagaaagagatacaacaacaacagtgcgttagggaagggagtggcttctctctcccacagaatcaaagtgcagatttgacaaatgaaaaacttatctatgacagaaggggagtggcttctctctcccacagaatcaaaacagataatgagtgcagtgttcttcccttccctattgtaattgtaactatctcttcaagtcacttctattcacacgtctatgaagagttatagggtcaccatgttagtcttatatatgatacatgatacatcttcttaataatctgcattcaatttataaatcaaatagataaatcacatagaatttatgttattataaattataaagataataaattttagtgtaagcaactcaacttgatatctctttggaatattcacatattacaaaatttttcctaaatgtaatactaaaacccatacatacaatttaagacaattaaacaattatcaaaattgaatatcaaaaataaaaaacaatgatcaaaactaatcttttatctttatatttttattagtaattgtaatcataataattttatattgtcacaactggcatgaaccattgcagcaaaaatttcatcatttaaattcatgaaatatttattcatggctaaatcacaacgtctctttgcaaataagtataatactaaattaaaaagtttctcttcatttgtacaaattatagtatgaggtgtagtgacattcaaaatcttcaaatgaatactttgttcacattaaataattaaatgtttttaaagaaatgcctaacaatatc

SEQ ID NO: 2669 - DNA, 1876 bp, Glycine max
  Soy_ogl_2793 Gm08:23194401..23196276 Cluster 11
atatagatatgtatgatgcaatgtgcgcatgcatttgcatgtgggtgtcaccacaggattgttctcctcttttcccttcagtttgctcgcctcgcatgctatggccgtcctttcatgtgcccattcacacctaaattatacactctatgtcaacatcactctcacatgcttccaagatcccaccttatattatatttcacaaattaatataataccctacccaaaaagaaagtagtcttagaaatatacattttaataccatctttttaacacatacactatcattaattaaaatttattaaaaaaattataaaatttaatgagtttcacacttatataatgaacttcttttttatttttagttttaatatgagattgtattctataaaaagtttgttaaaaaaatatgttcctataacatttcttttattaggggtcttgacttcttaatagaactttgaggtatatttttatgaattttgattcttgattgactatgatattaattagggatgatcataaatcaaaatcaattttataacccaatcaatccaaacaaacaaaaaaaaatcaaatagacttcaatcattgatttggattcgattgaaaaaatttaaatttgattagtactttgagtttgaattttgattttagcaccagaacttatcgacacacttaatgacataatatattttattttcttttacattttttatattaacctttagagttagggatttagccaagcccatattttttcattattcataatcatacactcagttcacacttcatacttcacaatatcaatttctaaattattaagtttttaattttaataataaatttgatggctctatttaaattaatctgatcatagtcaaattgatttagttcggctgggagatccaaactaggaaaagttttatctgaacttaatcagttaaaattaatcgatacaaataaaataaaaatatcacaaattcaattgaatcgactcattcccccaagactaataatagtcttccttaaaatttctcaccatttatcatggatgtattttgtagtattagttacaattttttttaacatatttcgaatatttttcttcccttgaaaaaagacattttttcataactatttggaagctattttatctgtagcgatacgccaatacctgtcagttcaaacctagtttggcccatgagttctgacaggtccatttcgaccattggtactctttattctcattttagatatctaagctaggcagtgtcaaaagaagttgctgctttctttcttcttccttttttcccactcgaaaatattagattctattgccaacaattcctcacttgatagacacccaattttagcggtagctaagaaattatatgaaggggaaaatattggtagatacctcaatcctatatttctttattttttttttcttctaaaaacctcaatcctatttctcatgatctcatctagtgagagatgtaatgagatatacgagctagagagaaaaacataaatacattgtgtaatactactatgatgtaataaaaagataaaaagagaggtatttgtagcacatataaagatattcgtatatgattgtttttaatgaaacatgtcacagcttctacatgtaattttccttcactctatgcttaaccaaaaataaaaggactaaaattcttgatctctcatctcattttttacatttagtttgatcttcgctttaattctttaattaaagtgtttcttttcttttaaattaaactcgtctttctgataatttattatattaactttgtcaacttggtgacatatgataaattaagatagatgttatgtgagattaaagtttgtc

SEQ ID NO: 2670 - DNA, 1371 bp, Glycine max
  Soy_ogl_3424 Gm10:33834001..33835371 Cluster 11
catcgactctaaaattacaaatccattcattttaggaacataacttctgttcatgattcaataatttattgaacttatgtatcctattggtttgtagcattgctttctcattttccgtactttgtttgactcaagcccgcgtggtgtgccacctccaaatagtgcttgggctaagtgtaacagtgatggctcctaagggggtaaaactttctgcattcccaccaactctggaatttgcattccaaaataaatttttaagaatataatggaaagtacagaaaacaatagtggcagtacagaaaacaacaatccagtaaggtgggttaactgataacactattggagctcaactattttttctttggaaaattttatttatatttttttcttcgtacctttcctttgtttttctttgtatcaatagtttttaaaatataaaatgcattctgaaaactaactttgaacgacaaaatataaatgccgagtgtaaagagtaagaaaaagagggaagtgggaatagaatgggccttttctcttcctctcccaaactctagcaacctgttttaggtgaatatggggctattacttcctgtatctacaattttcatcctgcaccccattgtaatattataactatcaaaatccccgaattgccctctctaaacctcatccttcacctgcggactctgtgaatctctccaacagctacagcatggaagtaggtgaagtcattgaagcctcctttcctttgttggtgaagtttcaagtaagttcatgattttttttgtccaatctaatcaattataccggacactggctgatgcacggtaattggatgcaatggtggagacacgttaataaaaacaaataagtcatttatgcccccaacaaggttttattttttcacttaaacatatttaataaaaaaaacaagtgttgtccccataacacaatttttcaaaaataaatatagaaaattataagaaataaagagagaataaattaatattaattttaacatattatccttctattagttaaaagagaaccaagttcaattttaatctctctaaaagtttttgttcatttttgtctttctaattttaaagtgttatcacttttatttctcaaaatagtttaaataacattttataaatgttctctaaatgctattagatggtgtttttggataacaagtgtgcattttaaaatttaaaaaaaaactaaaaaatggaccaaattttttaaagaaactaaaatcaaatttaaaaaaatttagaaagaacaaaaatatttgtaacccttcataaaagctttaggaaatttgaatttttctatcatgagatatgcattgttgtatttgtaaaaggt

SEQ ID NO: 2671 - DNA, 1300 bp, Glycine max
  Soy_ogl_3842 Gm11:11038801..11040100 Cluster 11
tgctctacgtattcataaccttaactgttttttttttctttggtgtgaatagcccccacatagctttagatggggttaataaataaaaagatagtcaacacacataatagcataaacttctttaacgcgccatagttccatctatgatacattgatacccaatcgatcacgaattccagacactaaagaacgtgaaaccaacatgagaattagctgagaacctctctacaaacttccatagttccatctaataattcggctgtagcattcaagagagaatctatgaacctaccaaaaattagttctttaaacacacgccagagttcatagatgcctgcgcagagacaagaaccctgtataaaatgcatttttttttttgttaaagagtataaaatgcatatttctaaatgctggacatctcacgttaattaacaatatggttattacagcgtatataagtagggtgtagccttcacttttcatgtcaattttggaaattgaattaggtttaaattccaatttgaagttgatcatatcaaagttgattttagtgattattattggccatattccatcagctatcagactactcgcaagtgtcaaattctgtaaaattcactcaagatattcggttctcatcatagtaactgaatgtgtcactgtatcacattaattagtaatatactagtagtaaaaataatgtatacaactgaataacaactcttacctcgcattaactagtttgctagtactattttcatttttttatttgtcttttaaagttgttgggtagaaattaagaaataaaatattttttttattttgataaaatagttgtaaaatttcttttttttttcaccccccaataaatgtatggataaactaattaaagataaaaaaataagtaaaaatatagttaaactatcactattgaatcatcgatgctttcgattttaaactatcactattgaatcatcgatcaacgtacgtatgtatatagtgacaattaatttggtccttatacgtgtaaatgtaataagaaaaatgtgaatatagtctctctttttttctcatagatatctttttctgttgccaatttttttagacgcagtcaaatataaaatattaaaatgtgaacacttcttttaaccgtctttttaactttgactcgctatatgcaaatatagtctagtgggttgttggtaacaaattcaaatgtttactagtagattgaagtagatttgactatatcctactctttggtaatagcgacggatccatatcatcactataatttgtg

SEQ ID NO: 2672 - DNA, 1648 bp, Glycine max
  Soy_ogl_5080 Gm15:22797353..22799000 Cluster 11
aaaaatttatcaatttaagaattataaaaagttattaaatgcatatgtttactaaaacttatacacagggaaaatttgttgatatcgggtgtaagtcataacaaacttgcatcattattaacaattatataaatgataagtaattatcaatttagacactgaacaaagtggtactatcttatcaaattttagacaattcaagcatttgtagatatataatttaatactaaacatttgttcatattttaaataacacatcatatgtcaaagtaaagtaatatgatgaagtattaattagtttttaaattatttaaattttcttcacaatgattttcagttcaataattagattagtgaaatttatcatttgtgttattaaaaaaactaaaaagttaagttagtaagaaaaaataattaaaaattctttcagttctttgattgacttaagtagtgtttggtttttgcattttgttatcatatcaagcctcctaatcttcactctttactgcttccttaacctagtttatgataatgaagaaattattagatgcccccaaagccaaaagtgtactcaagatattaattgcagctatgtttcatgagtaataatatttatacattcatcttatccgatcacacatataataattacttgaatagtttattttactatatccatcatattttctttgtttataatttatgaatttgaggtgttgactttttcatgtcatgatgttaggacgtgaagtaaaatgtaagtgtaaacatcagtttttcttgtttctaataatgactcggtattaagaatttttaatgttcaaataccatgttgaaatgtcatctacctatatccgtacatgtacagttaattgcatttcaactttaatagttggttaattaggaatcgtttagttttcattctctttcttttatgggaagttgagttgttaatcaaagatctttccctatcacctgaaagaaaatggaaataaacatgtaagaataagcgaaagaatatatggagcagaagacagctagctttggcctacttttactaaggggacacaagacaaaggtttttcatcttccatgtgcaaaggtcgtaatattaactgacgttcttatatagtgtcatttttttattcatattcaaatttagatggtattcatgtcgggaggacgccggaggaaggacagtgtgtatcccgaggctcaatggctttgctctgctccccctcagcttgttctaaccattagcttgaggtgtatcatggagctcacatctatttatatgaagtgtttccagacaatgctttacatgtgtcctcaaacattaattggccctcgagtggcacacgtcattgtacgtatgatcctgtcggcttcgtatgtgttatgggtgtgttgatgtgtcagagacgcggtgtaccacctggtttgtcgccggacttggtcatgacttgtcgaccattagagacgagccagtacttgatgagaaggacgttggagatgaattagacatatgtttggcgtaaatgcttaagcatgagttgtcctttggggagagtcaactaggatgatgtaaccctcctagcaccgagtcttatggcataaattcttatgagtgagtcgattatttggggag

SEQ ID NO: 2673 - DNA, 1200 bp, Glycine max
  Soy_ogl_26 Gm17:14922301..14923500 Cluster 11
agcgtgtaagtctgtgtaactacgatggcattgagaaagcgcgtcatcaaagctgtgaaaacatttggtgcgacccacactgacttgcagccgaaacgtttcattatccctacgagcaaagagaggctattggcagctttttcagcgcatttgatgcttaatatataatctgtttttatctctatttttgtttagaaaatgttacatgcatcaatctattatttaatggtgtcacaggaaagaaaaagttgaaagtatgattcatattagggtgaaattaacaagaattgattttaattatagttaattttaagaacataaaaatattttttgtataaaaaaatttattactatttattattatttttctaccttttctcttcttattacatagtgtcagttattattttatatctacaatttttttttttatattttctttctttctctctagacgttaattaattaaattacatttactttctattgatttcccccctaagtttatttggcaattcccttccatatgattaatacacatgttaaggaaggctatccacgttgttgaacagtgcatcggagtatcagattccacatttcttgtgtgtattacgacatcctactagcaaaaagtaatagaaagttttatcaggaattaaaacatggatatatatgaagtagccaaaggaatttggtctagtggaagagtgataggttcataagacttgagagtagtgtatacaagatactttataaagagattttttattcgatttctacaaaagttatacctatagatatggatttatccatgtcgctctaaatgaattgaaaaaaaatactataaatatatagttagctttcatataaaaataaatatatgtagttgattacttgattcagtttatttaaataaatgtatatatatcttactaatttttgagagatttttacaaaaagtattattttttcaaaatcaacacattctaatttttaagcatgtgctaaattataatttccactattcaaacttaaaatgttttttttacgaatttaataaatattattatagataagaaagaacaatgactcgcatgcatataactttagaagttgagactaattaagaaagtgaaagtaggaatattttattgaaaaataaaaaataaataacttttgtactttcaatgtaataaaatg

SEQ ID NO: 2674 - DNA, 1727 bp, Glycine max
  Soy_ogl_6036 Gm18:13271601..13273327 Cluster 11
agatcttttattggagatatagttttaggtttttatttaagtttcattatcttgaattttgcctctattaatttttatcatattatattttatttggagtaagagaaattcttttatcaataaatattaatttattaattttgttagaaatattagtaaaaaaattcaaccaactactccttctttcttctcctttcactcttaagtctttccttcgtaatcacactaccaacctaatttggagtaattaagaatttattttctctcattagccaaaatccgagtcatcacagtacaccaaagtgtggtataggtgggtgggacatgactgtggtttcatatggttagtttcagttattgcaattgcagagaggacaaattaattattaatcctaatcatatgcacttgctcattgctgtctctcttttttcaaaataatctttatagatctaagataataaaaaatctgcttagtattgattgcatctatgtcttttccttccaagtaataaaaaattcatgcacattggactgaagcttctcttatattattacaaaatccactgttgtttcctaaaagattaccaaaataacaaggaaataagattaggctagtggttaagaaggcatgctttgattgttttctatactcttcacaacatttatgggtcagtacttcaagttcaagctaacgtcaataatgatttagggatatttggaagagcttttctaaattttaagtgtttaatttgtcttatcatacaagtatttaaaatgaaaactaaaactatttataaatttttaatacataaactctttttaaatgataaattatgtttttagttatcgaattttttacattttttattatggtctctacactttaagttgaacttaactcgtcttttaactttttttcgacttaatatttatatttttctgtttatttttaatctttaaacgataacatgacacataagtttattattattttattataatttgatttctaacaactcaaaaccaccaaaaattatttcgttatgaaaaaataaacttaattttccaacatcaaatccataaacaacaaataaaacacccaaatccaaattagacgcgaatgtaaaatcaaaatcagtagactcaagtccatatatcaaaatcaaacacaaatttaggaaataaaatagtacagacaagtccagatcaaatgcaaacacaaatttaaaaaaaataataaaaaattgacataaaatcattaattaccccaactctaaccctaattgaattgaagctccatgcaaatccaggacttcgattcaaactcgttgcattctcaattaccgtcaattaaaacttccacagtttttaatcgattgaaatcaaatcataataaaataaccataaatttatgtgtaacgtcattatttaacacagatataagaactaaaatattagatgaaacaaaagttagagaattagtcaaggttaaccaaaaagtgtaggaatcaaaataaaaaaatccaataactaaaaacataatttatccctttttaaatatttttatgagagtaatttatgactttttttataaaatattttaacttagtttcataagttctacgctaaagtttgtcaacttaagctacgtttgtgttgccgttgaaatcttgatagtgtgaattctcatgcactttaacgcaaaagtaacaaagagaggcatgca

SEQ ID NO: 2675 - DNA, 1146 bp, Glycine max
  Soy_ogl_6375 Gm19:15973901..15975046 Cluster 11
gtatgtgccaagctatctacaatctcataaaataattataattgttctttgttcttcttctgtcatgttttgcatgtcatgtttgcttggatttccaccggtcattgttatggttgcagtggagaactatggcttcacgttttgcatagtaggtatgtacaataggaatgcctcaaacttgtaccattatagtgtatatatgtgacaaattttgtataactttttttttcctaatgatctcattactcattatacatgcatgtagcatgttctagccaatgattttatatcccaatagaatatatttactttttaaagtagcgatggtttgttagttattacgataatttttacaaaatttatttggacttatcttattttatttcgtatttaaaatttaatttttttagtacatatatataacaaaaaagtacgtgattgttgtaattttaaaaagactaaaaacaaataaaatttacatatatggggtttagtgttaatatttttgggagttaaaaactaattttaaacctatcatattatataaacactactacttcaaaacaagtgtttaattaaatatctgaaagtaactataatgattaactcataagctctttttcatttatttatataaatataaatttataaaattaattatctatatgatctttccctttaattttcagcttatttttatcaaaataaacttgttcaattatgacatatgctccttgatgataaactcttattaaatatagtgcttaattaactatttatcgaaatatatctttaaaaatatttggactaccttatagatataaagttacttaccatagattcttataataactctggccttatcactgggtcccgtgcatgattatgaaagaaaatatgacagaataaatcaagtctctttgtatttttatttattttatttttcttacaacgatgacaaattgacaatgaagtttgagccaaatacttcatctaaattatctaaacacttattactagctagcactaagctgatcatattgaatttttaaaaaagtgagaacaattaattttttaaactttaatttgagaaagccttctctgttattattttttacttttgctttaaattatgaaagtctcaac

SEQ ID NO: 2676 - DNA, 1100 bp, Glycine max
  Soy_ogl_6695 Gm20:2460201..2461300 Cluster 11
tccatcttcattaaagttcatacaatgtatattattgactatttgaatcaacttatatatatgattgtttcaatttaattatttatcttgggttcaagaattgatatgtatctgtctgtcttaagtatttagagaaagaattttgttgattagagtaatcataccagatttgaatagaattgcccctaaaagaagtagaagatacatataacttatgaaaaaaaaaatgtacttgtatagttgtattcatatctatattaagcaaataattattctactcgacctgtgagtaatttttgctagtactaattagatccattatctgttacaatttctaattatcttcggtggtggtgctaagcacggtcgagatgagcaaacccgcccaaggttcatttgtagagggcaccattttttttatttaggttatataactattaaaaatatataatttaataaattatattaaaaatttatgaagatagaacaattagcagtaattttttagagtaataattaccattaattagttaactaataggtgatatttcaagttcttaaaaaacgaaaataaaaaaaattgaaactcatttaaaatatcacaattcttatgatcttaatgatgaattctatttgaagaattaaaagacattagacatgtttcaacaattgaatcaaaataaaattttatgatattgcattctttgaaaatatttaattgtttttcaaaggcacgtacaacttataaaataatattaattatttttgttattgtggcatttaccaaaaggagtttattaaaatagaaatgattaaaatcctatattgttatctacgctgcctccggactaaaatataagaagaaaaaaatctgtgataaactaaaatataaacaaattttaattaattatctcttatttagtggtaccatctctaaaatatcattaattgaagttttatttctaacaatcttttctttattaatcttatgcaattaaatgtggatactttagcaaatggattgatttcttttttgtctaaatctcaggtgtcattttagtcctatgcaatcaaatgtggatactttaggaaacgaattg

SEQ ID NO: 2677 - DNA, 1651 bp, Glycine max
  Soy_ogl_6700 Gm20:4059301..4060951 Cluster 11
tatttaaaggtaattttaaaaaaatttacagacaatttagtttttttctgaatagaccaatttaatattaataattaaccaactttctaaataaataaaattagttactaatgtcttataactagagacagaggtaatatatattttttttcttttatctcttttattattagatatgtcaattatttttattgttctaaaaataaaaaataatcatttaaaaaaaatcatctgagacaacaccatgttagaataataaagactcttctaacaaaaccaataacggttgacgttttcaagtactcgactgtgaataaaataagatttgtttgaagccaaatatactaaagatgatgtttaaaattctaagtttcattttaaaaaaaaaaatacttttaaaataagttagatgtttaggatcttagctaattttttttaaaaaaataataaattaatagtttagtatcagatgatgacatgtcaagttaatggtcatgcccccctttaacaaaatcaatggtaggaattaaatataaaataaaaaatttcaagaaacaaatacaagaaaaaattattaggaacaaaaagaaaaaattgaaaatattttaaagacaaaataaaaagtaatttaagccaaaactttaatatgacatatggatttaagggtgggaacacacttggctttgagggctctgtctgtccttttggaaggtgtaacctagttagtaagcctatttatccttaaaccaccattacctatgactattaccgaaaaatcatggtgatcaagacgaggttgcacttcatcgtgccatgctttggtacaagagattaccatttatatttacatctcaacaaataacatgacacaatcacctatgaagcaataagtaagacccaaacaccacccactagggtatgtttttatagaattaatcacaatgttgagtcatgcttgatgaaacaaggaaaagttgccttaaagtttttgtttgaaatccgctcccattttagatggaatcgtctatggttcaacatatgcgcaatccaatacataagaaagttgattgcttaaataggcttgacctatttaaaaaatttaaggctagtatagtcagtcctactaggccttcaaacaaggcataataggcctcgaaaattaacctgtaacaggtaaatatttaagttaggctcaatgtttaaaaatttcacactacccctaacagcatgtcagctcgccaataccttgttaacaatccatgtccaatgctacctgtattgccacattagaatcgtagtcaaacatcaacagtcaacattgctatatcataagtcaactaacaatagatggtcaaatagtgataatagaaaattggtaaattgcacaaaactgaaaaatatgatgttaaaatttctataaaaaaaacttgggcaataaaattcatcaaatgttaatatttggaaggtgcaattaaagcaaaagaaaataacgggaaaggcattggacatctatactaatttaccaatttactaattagaaagtaagtaaaggagataaggagaaaagagatgtggaggccgtcagaaattgctttcgacgacaagacatggtggtacatagtggtttgtgatggagctagcggtggaaaag

SEQ ID NO: 2678 - DNA, 1165 bp, Glycine max
  Soy_ogl_867 Gm03:33032136..33033300 Cluster 11
aggcacccctattaataataaaagcattacctgaaattaagaagtataccctatgagagtgagagaaccgtttcacgggataaaagaaatcaagtgtcgtgtgtgcaatgattataagatcttcaattaaaaccaccaagccccacgttgacagtatgcagttaaatcttgaagatattaaaccaataagcaaataaaatgaaaaattacatgagacccacgttagagtttgcagttataattgatttgagataatttatggataattaaaatgataatttagtctaagtaaaagtaaatgtgtacaccaagaatagttaccaagaagtatatttcttttacatattgttatagataatgataatattcacattaagttacataccataatattgtcaatatttattgaaatcctaatttggataatatacaggactcaaactcaaatgaaaaaaaaaaaaaacttatggatagaatcagttcagatattaaatccattgaaccaaaatgccaaaagaatttttaaaaaaataaaggaattttagttctaaatttacttacaaaaactatagcagtactgtgtggagattaagaaagagaattcgtctaaatctgttatcccctccaaatcatattattgatatatcaatgttgacttgttaaattcctttaatcatcgaggatttttttttggaagaaggcaaaattcattgaggagcaaatgaatcgcagatgacaaaagctaaacatgagtggatgtttcaatgattgtagcacacaaggctattctattatgtagatattaaggggtataagtaaggttttaattgagtaggatgcatgtgattcctataactaaaaaaattattatgcaggtgtgtttacaattggaaaatcatcaacgaaaaataattagggattatttgtgttagttttaaaaataattagagcaaactatattgtgtacctatgagttttttttaaaaaaattaagtatagcatcactcttttttctattcctacactaattcatttatgtttgaaaataatacactaaaatcctcttaatgtttgaaaatattaaattgacactctcttatatattacactaattaacacccctacaaggaagactactatgatgttttaaaaaatagaaaatatc

SEQ ID NO: 2679 - DNA, 1200 bp, Glycine max
  Soy_ogl_1621 Gm05:27421701..27422900 Cluster 11
aactattccttgtttttataaatttcttcattttagaataactgaatttataatcactaagtaatgttaagactatttagttgagaattagaatagaataagaaaggaatatgaggaatgaattaaagccaaaaggtttgcgggaaagagtcatgcactcagtaaggatattttattctccttcataggcttattctttcgtcatctcctatcaattaataggtatttcggatatgatccaagtttgttcaatgaacgattaagcaattattatgagacaaaacagttcttttaagagtgagattccaaaatagctttaggaccaaaagaatgaactgttgcatagaaattattcttcataataaccagtcaaaaaactaaaatctaacatttagttatgatatatagaaaatcttttgaaatgctttcgtgattccaaatctatggagtcttgacaaccatctactaagaataacatgataaaaaaaatcatggtgggttcttagaatcgcgctttttatgcaaaaatggttaatttcaattattaatgagcaagaatatctcatcttgtcattttaaatttatctcctttaatgagcaagaatttcaaagatgggtatatataatatgcttctatgttgaatttcaaagatgggtatatataatatgcttctatgttgaccaccaattgttcaaaagaaaagatgaatcttgatatctacgatgatattctaattctaattatataagtatatctatttaatgtaatgagtctcccattcaatataataggaggtttaatttgatatttaagtaatgagattctctcaatcaatagattagacatttaggttgaactttctgcatgtgcttaatgttttatttagagttagattagaaaaattctactcataaacaggaatgcatggattcagaaatcaatcgaaggagtgactgaaattatttttcttgtttgactttaatggttatgtattgaaaattttacgcgttcaattacacattattatttgcatagcttttaaaaagtgtttggtatatagaaaatttttaatgtgcatgaatcatgaattatggaaatcatgtttcttataatgtctaaatttgtttggttgattataaatattgtcatataatttccttgagaatataaaagtaaaataatatatttattatcatctt

SEQ ID NO: 2680 - DNA, 1300 bp, Glycine max
  Soy_ogl_2328 Gm07:10519801..10521100 Cluster 11
ataactactctgatttaagaagtccttggaaattagctgtgaaaatcataaatatttggagttggagtatttagagatctccaaagccaacaactgaaattatttcttaatagagaaactatttcttaactatcaactctcacatgaaatatttgaaaaaggtgtccaattgcacggtgccatttggattgcgcatgagaaagggaagaaggtgctaatgttgttcttttaatctttagtctaattgtggttttgaactaattttcttgagctgttcacatgtaggtgctcatatttttctaaattaatggtataaaaacctttgacagagctcataatcaaatacagatacattttatgttctcatataattaaatataatgactaattaaactcaattctatgaattagatgttttattatatgcatattacatgtttattatattgcaatgttagcttggtaagtagaagcaaacctgatagtgatatagctaaaagaagcgaggaaaaaaaatcatctataagaagttaaatgatagcaccaaatgataagtatatgcaatttataagaagttacatgatttttttagctgatagtttgagaagtgcatccttcttttcaatcgctattaactaatttcatttgtttatgcatatgctgcaatgctttcaagtagaaaaattggagtagcaagtttaaattgtaagttatggccaaaatctattaatctacccaacactactagcatttgttttagaaatttgttgctctactagtttttttgctaaattatctttgatcaactcatgttgcagggaatcgcaaaggtttttaatagttaaaaagttagcagaatcaaccttattgatctttgctggacaggacaagggtaaagttgacaacgaaggcaaccaacgtgtaagggaaaataggcgtgtaagaaatgttttaaggcgaccaatatcttgccacggattacgagattgtatttgaatgatctacatgaatcattctcttattagaattgtatggaaaaacctaattttgttgtcaacgagagcaaaaaccaattgatgtaatagaccgcaaccaaatgccctacggggaacacaaactttggtatgatctacacaatgaccctcgtcctacgattaacaagaaatttcggaagtaaagatgccaaaatcagctatggagaatctgattgataaatctagtttgagcgtaatggagaaatctgataagttcgattagttcacgaataatagtagagactactcacaaaaaaaataattac

SEQ ID NO: 2681 - DNA, 1000 bp, Glycine max
  Soy_ogl_2357 Gm07:17541901..17542900 Cluster 11
gaagacaaggctgtattgatcggtgcctatttttctattgaatgagtctttatttttgacaaaatcaaaggtataaaatgacttgtcgaaataagatttaagggagcatcgttcaccatcctttagtgaatgaggggtgtacaaagtgaagccaaccatggtgaatccaaactggctggggaagggcctgaacgagagtgtattttgtggaaaatttttgggaaatataattaaaggggattgcattagaagaagggggtgcaaatagccattgtcatggctaggctatttatcaagttgtccaatacaatgcgaacatgcaatgagcccaatattccaatctgaaggaacaactatatgcctaatttctaaaacggaaaaaaaaaaaaaattcacagatccttagcaacttttgctcattcccaaactccacttcaaattatcgggtctagtcttttagaagttaaactgaaagaagtaataaagtatttgaaaacgttgtgatgggaacataggcatcagtaattccatacagatctctgcatttttttaaaagaaataaaataaaattatcatattagtcctaattatcaaaaagaaaagcaaaagacctcaaacagaaaaaatattgaactagaattcaaaatctatcaagcttagttagttgaacatgaaatttaaactaattcctattcgaagtgtaaatcacattccaactctcaccacaccaagaaggctatacaaaacgaatatctatgcatctataactagcagatgagataaatgaaagtggaagcagagaacaaaattctcatacaattataagacaagaatgaacacacacgaacatgcttcggactattttccgagattggtaaaatgtgcataacacaagcaaaacacgcatgaaggatgataataactcgtgcaagaacaacatgcaaagactaaaaatcattcgaaagtagaagtctcaagatcaaatatttccatggcacat

SEQ ID NO: 2682 - DNA, 1300 bp, Glycine max
  Soy_ogl_2772 Gm08:20026401..20027700 Cluster 11
aaacaataccttatttaatttagaattggcaaaataggtgcaaattgcataatcaattaggtggataaagatatagttgccaggtaagtctcatgtaacagaacaagtttttggatgacataaacaatggaatttatgatgaaggggcatttacaaacactacggaagagagtcaaacaagtaatgaggtttcgtttctcaccaaatgggtcccttttagtccaatccatggttttccacatttggtatctagttgatattgagccagctaaggattgacgcaatagaagtagatcaagaactttagcattatcaattaacaattatcttcaacaataggaaacgtattttagaaacttaagttaaatactgaaataaattctattgttttctgttaatgcctgtttctcatgtgtttaaataaattttcaagtcattattaattaaaacttctaaggttctaataattctaactcaaattgcacaaaatctcttccagttaaggatgttgctttgtcccaattttatcatacttttacttttttttcatggatccttggtatttaaaagttatgttggaccaaactaatctaagtcgagtcaagtggattttttttacaagaggaaaagcttttccaacccttatttttttctaattaggaacttgagattttatgtaaagaaaatcaaattccttgctattcttgtttctattttaaattattattttttaattattattttttgagatttttttaacatgccataaacaatgacgctttcatgagtaaaaaaaaaaaaacaatgatgttttttcatggttagctccgccattgactgcaatgttgcctggtcaaaaagtgaaaaagaaagttgtaaatttctagcaatcttcttcaagtatgaaaatctattgagatgtcctctataattgcattatatttttgaaaatgatatctcatcttaagtttgatggagaaaaactatcacataacctgtcaaatgacaacaagatgataaattaatttcctttttaaacattcagaaactagttccatacttgatttttttttgtttgtaataataaatgaaaatacaaaagtttgagattaaaaacttcctgcaaacttgtggcttatgttgtacactaaatcactagttgaatgaagtcagtgcgttaacgtttcaatagaaattgaacatatatgagtcccacacgcaatgccattgtagtatattgaagcttaattaggcatgtaatatacatttacttaaccgcaatcactttgtgaagatgaaa

SEQ ID NO: 2683 - DNA, 1070 bp, Glycine max
  Soy_ogl_5721 Gm17:33965246..33966315 Cluster 11
ctcttcattgccaattggaacttgacatatcgttcgttggaagtgagtactcggcggattcaacaatgacatattgtcctatactgttggatgtacatcttcagtgccgatcaagcatataatagaataaaattaaatatgaattatttaattaatttcaaaccaatactatttctccaagaaacagggacttttcttgcttacgagttacgggcgagtgtgcgaatcaccctacaataatagggcagaaataatatatatgtacatttctatgctcctttcactttctctctctttcttaatttctccaatctgtttttaatttttataattatccacctctatgtatacatgtatgaactaccaaggacatagataaatgaagtgagatggttccagattaattaactatgcattttggattcaagtcttaatatttatttacattgaatatttttttaaaaattttattatctatattaatcctacttattcaaatatgattgcgaaaagatattacatgtggtttataaaataatgtgactagccagtatatatagtatcccttaaaaaaagctagtatataatatatgctatatatttagtttgtacgtgtttatgttcagagtacagctaaggctgaagaatttgaggaaatcatgcagatactcgaattagaagattaaaattcaattcagttaaaacaatctgttgccaatactaaaattttgtaaaactggaatgaacttatgtgaaaagacagtcaagataaaattaatgtgataatttataaaatttaattttgataaacactgaatgttttgtaatattaatatttttgttatgcaggaaagaaaaaacaaacagaaaagagaagcctagggccaaaaatgaacgactccctttctcccattcggtcagctaatacaagggcagaaagctgaattttttattaataaaaaagtctattaatatgaatttattaaaacgtgataacaaataatttgaatttcataacaaaagaaagacttaaatatgtttaaggacatacttttaataaataaatgaca

SEQ ID NO: 2684 - DNA, 1017 bp, Glycine max
  Soy_ogl_6094 Gm18:47660301..47661317 Cluster 11
taactagttatgaatgaaaaaaaataagttttttcaaatacccatttttataaaaactaattatagttttataactataactaatttttaaataaagttatttgaaatacccataactataatttgattatagttttatacctatttttatataactaattttttaaatactgtctttaactcttcagtagtgcatcttttaaccaatcataactagttatatttgctctttataattgtaatttttaaaattattttataaacaagtaacgttttaattgttcatgaatataaaatggtaagtaattatttattaaattagtatatagaagtaggcatattattttttaattgttcacttttagactgattacaactataaatattgtcatttatattatagctacatggctagctcactactacgtaaccattgtggttgtctataacaacaaacatcatggcttaaacccttccaaccacacaataataagtggcaaaaactttatggctgcagggactagatatacgaacataactaaacattaaaaatgggttggtgaacattaatcgcattttgcttcatccttcgtataaatttatgtttaaggttttcaccttcacatggaacacaagatggctaaggcaaacacaaggaaagtctatgttgttcttcagggtcgagtaccaggtcatacttttattgattctcttacagacacagtggtttttatatttttgtaaatgataatttactcactaacgtgtttgctggtgaatggaagatatatatttttcatggacagaggctagtaaacaaactttacggttcagttcgaatgcccatcgtggatttaactcttttgaggaagttgaacatgcttggattgatgtcttgacaatggcagagacgagttttacgcgcgttgccatattcatcagcgagaccaaaatgaatcatctagtagtggttgttcagaagatgtgcataacatgggtaagtgcacacatggtcga

SEQ ID NO: 2685 - DNA, 1386 bp, Glycine max
  Soy_ogl_6378 Gm19:28969183..28970568 Cluster 11
gacgcatgacaacatataaaaataagatttaattatatttttggtctttcaagtattatacttatgtgatttttatttcttgggtactaattgtgtcaattaggtcttttatatatcataacttgggtaattttagtcttttaagttttgatttagctaattggatttgtcagatgtcatgagatttaataaacaaacatcattttccattaatatatattaaaatcacaaaattatgaaacatgaaaaattcaattggtacaattaaaaataagaagattaaaattatacagttgcatacccaacaaactaaaaatgtatttaagcctaaaactaatgtgagatctaataatgttgctattaaaaagacaaatcaatataaaaacaaaaagttaatgaattaaattgaataaaaagttcgagaataaaattaaaattgaaccatttggtcaataatcaaacaatgaagagtcagtcgagtaagtcaccaacaagtctagtacttagggtgatccatattaacatattgtccgtcatctataaggtcgatcacattaactgacttatcctcacataataatttttttagcctaaagagtttatgagccacaaatttgtgaaccgaatataacaggattctaacccattcccacacgtgaccaaaacacattacgtaagagagtagttatacacgttatcccttgaaaaaggtgggaatggttacaagaccattcctcaagatacctatcatggacaggggctaacaacctctacttgacataattattatgctttagggttagttgatagggaagaataaaaattgaagacgaatgatttgtcctagttaatgagccagatgtgggtgaatcttaatttaatatgaatttcgggaagacacacttaataaataagcataatttgtcctggttgtgcttaggtcatacttgcttagatttttttaactcttagcatatacactctcacttttcaatatgcatgttttttttactaagaatgagtttctaggatgaacaaagccaactttaaaattgtaacgtgttttatactaaactagaagtaaataaacttatactatctttgatatttggagaataaactcaattttatgatatatttgattacactcaaaaatatgttcatacattaaaattctacctgaaaatacatatatgtaaaaataaaaagtatttacgtaagcgttttttaatcttgaggcttgtgttccgaaacctgctaatctaaactattagccaaaaaaaaaacttgaattatctttttaaacttgaaaagtgtaagataaacatgcatattaccttcataattcacactagttggaaacatgcactgcgtgcttcacttacc

SEQ ID NO: 2686 - DNA, 1182 bp, Glycine max
  Soy_ogl_129 Gm01:40044019..40045200 Cluster 11
aaggaaaagtttgaaagtgataagcaaattaaatttgaaaatgattaaaaatgcatgatatgttcacaatatcattttacaagccgttctttgagatctcacattctatacgcacataatattatatatatacccaaataaaatttttgtactataggaggcagcacttgatttcattttataaaacaattatcattattattgttgtggtaaacaattatatatactatcatatcatagtattttggtacccgtaatcttatattaacatagtatgtcatttaaaaaaacctatcatgtattaatatttaaagtttaataaaaaagcttatgacaaatactttggaccttaagattttttgtttgatactttttgacatgaatatttatgtaatataaaaaacccaagtaaataaatttctataataataatagtaaaaggaaaaatttaggttaatgaaataatcaatctactatgtacatgaaccgctttgagttaaatcaaattaaaaattagtttagttttttaaagctcgagttatattactcaatttggataattttttttataaatatttttaaatcaataaaataaaatgaaatcatatttttagacttaaatgtacattttattatttaacctattatcattttattactttagtgtttttttacgaaaaaaataaagaaatcatagaataaatcagcattgagttaataatgcttaaatgaagtagtcagtaaaaaaaaaaatgattaagaggagaagacttcaactgtccttcaacatactggagttatccatctactccataaaatggattttgcctgcataacttttgtggcaaatatgaactatccatacagaataggaaaaaggtctagcagcatggttgtcagcagcacaaacctaaaaatcggataaaaatctaccaaaatacttaaacaggagaacaaataaaagatctagcagcatgtaggtcagcacattaatcaatttttttctctccactaccattactgttagaaatataatatatacatatataaccatttgtatcttcacctaagagcttaagcatttgggatagttggttgttggcaattacctttcatttcgatgtccagaagctatgcatttaacctttacatagccaccaggatccatacctccacctctgc

SEQ ID NO: 2687 - DNA, 1300 bp, Glycine max
  Soy_ogl_635 Gm02:43702601..43703900 Cluster 11
tgcagacacttaaaattagttaacatctagagataagaagagataaaaaaaaggtaaaaatatatgtaaaaagaaataataggtattgattaagtctatttttttcatctatgatattagtataaaatactaaaatttcatgaaaaatattaaaaaaattagtttcaatacgaggaataacttggttgattaagtgtatatgtgatcacatatggtaaaaaagtcatgcattggaagtgactacactatccacaggttcctccattgactcactctatcaatgtgaagaggataaaggctttcggccactcacttgctttgaagtgatttgttttgtatgtgacaagacatttggagggaatggagcacataaaattaagccaattctttttgggaatgcattagaaaattctcatcaaacttgctcactgattctttaatctttggtggtttcttctttggttgaagtctttttggattattcggtaccatgccatatggggtgtcctttacttctgtcttctgtaacttttatgccttcttttaatttttcttgttacacgaaaggtgcctttattatatttgtggaaaagtgccactcatataaatgatgcgattggtggattattatgcttagggaatagtaaattcaagacacgtatcatgttcgtaacggtttgttgttgaataaagcttttttttggggggaattgttgaataactcggcttcttatgtacacgactttgaattatattcgattcgattccaactaaaatgggagaaacatgcaaattgatgggtttgattttgatatataaacaagctttgctatcaccttaactaggaaaatatattgcttaaaaaaaactaggaaaatatacatatatgatttatataatatataaatgtacaatgggcttactttcagttgtttaattgaaaggatattcaaataaaatagagaatttacatgtgattaaatttaaaatacagacatatatttaactatcagctcaaatatgcctcaaaggattgtttgggggaaaagttatattgagaggactttcttaaaaatgtgaaaataaaaattaaaaaattgttttgtggggttatcagataagtgaaagatgttgattgttatgcatatggagggggaacaaacacacctgtcgtgaaaattatgtcaggtgtcctgtttttttcttggcaatctaccaaagatcatttgtaccgtaaaactctaaaattcgtgccaagagtaagaataagccgtactaagagcaatgtcctttgaacatg

SEQ ID NO: 2688 - DNA, 1014 bp, Glycine max
  Soy_ogl_1302 Gm04:38047401..38048414 Cluster 11
ccgttgagaataaacccaacaacacttgtaagagaagaagcacatttattgataaggggcaaaatggagtggagttagtgcaagaaattaatcaacggtgtaatgtaacttacagtacattttatttgagcttcgacacgcaatgcataaataaagtgtacgtgcactacaaattgtcgtccttaaagtttatttccctctattttctttataaaacacgatcccaaggaataaatcacgcacaatacttaaatacagaagttcacgagtgagagaaggaaaattttcacatttacattattttaaacaaataatttcattaattttttaaaataagagaaataaaatgacagatttttatatgtaatatttttattatttcttatttatttattttaaaaatattttataacaaaaattttaaaaatattatattttcttgtcttttttcacctattcaaacataatcttattaaagaatttcattaagtatatagaaactggaatatgtcaattactttctttaggtgttttgagtttgtctacttgtgacataaatttctttgttgaaaattcaaagtttaatagcaaaaataacttttatgtctcctttttctctattcctagggtttagcaagactttgtcttactagggttttaggaggcgccttaagggtttaaccaacgagaggccttggtccttcttgttttcacaccatcaaggttttgtctgattcatccatctttcaggtgtgttttgttggtctcgtattgattttggtagtgtttgggttctggtccatgtgagtggggtgatggaacaatggagaacgattgagtttcaaggggatgaagagacggtgatccaggttgacgagggagattgttcaaaaaattcagaggatgaaggtgcctagttgatggggcaattgtgaaacaatctcctagtcaccaactaattgcacatcaacataccacccctgcaaaaacacgtatctcctgcatggttgcacc

SEQ ID NO: 2689 - DNA, 1500 bp, Glycine max
  Soy_ogl_2810 Gm08:36032601..36034100 Cluster 11
acctaaaatgaaatactatatttaactctaaaattaatcgtacttatacacgtgcataattaagtacacatgttcaaatgaatgctgggtgaaaatcataatcattactcttaacagaaggtaaatgagtcttctaaaaaatcggaaggtaaaggaatttaataatttttggtccacccgaatcatgtcactctgattatttttcactcacactcacgttcatggacacacccaagcaagctagcacccattctctcactcatcactcagtccaacagtagacttcactcagcagtacaccgatttcatcccaatcttgacattacggataaattacaggtaattgtgattaatgtagctgcaattgtggttgcgatgcgattgcggtaagttacaaaacttttatatctacagaccctaatttaaaatcactcacagtactaaatttcttgacactggtattttcttttggtttttataaaataaaaaaggtcacatatgtttataaaaatatcacttattgataaataaaatctaacatataactctttttttttttaagtataaaattttctatttaaatttatttctcagtctctttgatcgttgggccgatcctggataacacgtacctcctaagtcaccatcacacttgcggagcttctttattcgtatttaatttggtttatgcttctcccttcttaaggtatgtcctgtttactgtatacagctaattcattttttttaaagaaaaatttatttcgattggtgtctgtgcatgttattaagcgtgtgtttgtttactgtgcatgaattttgtttattcttagccttgattaaataatatataagatgaattaggtgttgtcccttccatgctcagaccattaacgatggatattctttatcacatcaagttatgttaagttattaacctttttattcgtttttattactttccgttaatttattcattagtttaattttgatcccctttttagttatatgcatttagatttagtatttacgtatcctttagatggaggaaaagtctaatttaatattttaacttcaaaagcttacatgaatatttttaataaaattaaatacaacgaaaattaaagacaataatatttaaaaatatcaattaaataaaaatatttcaaattgtgcacatgttatactagttcacaaataataatgataatttataagaacgcttaaacatattttttatcctcttaaattaaaaatttatattttttgttcttacaaaaattttaatacattttttattttgcatcagttatatgcataattaatgtaaaaaaaaatattatatttacattgatgatccctaactaatatcatatttttttcttcttaaaatggtcatccttgatgatctatatattattattattctcataattttttataaaattatttttactttatcataattcttatgagtctaaaatatattttttatccttataa

SEQ ID NO: 2690 - DNA, 1200 bp, Glycine max
  Soy_ogl_3074 Gm09:28863401..28864600 Cluster 11
gtttttatatccaggtaattgcacaatgtaagtttttgtcacacatttaatttatagcggcagttggaaactttcctatttattaagcttggtgtgatatcaatgaggttaaggatacatctttgatcgatacacctacgtttcttatgttcttgctcattaaattaagatattttatttgctttgtcagatcacaaatggaatgtaaagaaagtgggggagcaaagcgagatagtaaattgaaacaaggtaccaaatggtgatgttatcttatttcttaatttgaggcagcaggtttagaagagaaatgccagtaaattaatcttcatatttgtcgtataggcttacatacattaattatgacattaaagttttgtagaaaaacgttggcttcaaattatttcatcaataaccattttatgttaatctttaaaaaaattattgctaaaaatttgtttcgtcaaaaaaatttatttgtcatctagtctttcaactattcttttaggtcatcactttatttttttttcataaggatatgaatataatgatattgttaattttttatggactaatttagtaaaattaaatctggtttggaacttggaagattaactatgatactttaattaccaattttttttttgaaaaataatatgatcgcaagtttagagaatcagcttaaaggaatttctcaaggcatttgcttgaaattttttgaaaaataatatgatcgcaagtttagagaatcagcttaaaggaatttctcaaagcatttgcttgaaattatatacatataggagtttgttatgccaaataaattgtaaagctcttttcattttactgcaaaaattaggttaatttacctcctattgtcgtgctagtgatatcaaggaatacgtgtgttgtgctccagatactccatatgatggtttgtttacctcctgttgtcatctcgcataatgttttgaatcttactggttctgtgcttttgttcgaatgttattggtcctatgtttcattttgttctttcgaaggcatgtgggaaatgttcttagtttttatggtgtcaactttatttctcttgagctcctttctctctgtatacatcttagataactatatatgtgaggcctcttgtgatgtgatttgtgacatgtgacatgagaaactcaaaaacatggattgattactattttgtgt

SEQ ID NO: 2691 - DNA, 1424 bp, Glycine max
  Soy_ogl_3408 Gm10:7750101..7751524 Cluster 11
tgatgaaagagattattaaggggtcgataattagccatataataaaaagtttgaaccaaggaattatatatgctaaattcagaaaaccggatatgttgatctatttgtggtaatgagtggctcaatttcttgttaattggttgtcgatcatgaaatggatgtttttgattaggatatatacccatgagttaacataattcaattgaaggcatgcaagtctaattttttacttcttgtagtgcaccatattatatttgatctgtcggcaagccagtgccccacgcaacaccattttcttcctttcttttattcattttttttcctgctaattaataataattcattgtgctgtacatatatagatacacataacggagaaagcaagcatttcaaattgtatttttataattttattaaattctgtaaaaaaaaattagtatcctaaccttgagtaatataattctaatgattattaatataaaattttaaatgactcagatattcataaatatgctatttaacagtatatacttgcatttttttggccgagtaaatacttgcattttaaatactttattaatgtaatgtgatgaaatatttgataattttgtaaatttgatcaattttatgagcattaggtaatttgaatctaagagtcaacttgataaaaattactatctgtaaaacattattaaggtatcaattgatggttggttcaagtcatacatgtttgatcttcttagtaattaaggacttgattttggatcttatgtacgaaaaaaatcactaagaaagctaatccgtattatgaatatttcaactctaatgggactaatttttgtagacacttgtgaccctaaataaatacaaaagttatattttttttaacgaacaatatttatacactagctttctcatcttctactttattttttcaccttattgttattctctctatttattcattttatattatgttatatgcttatcaaatttgtcactttctctttctttcgtctttctccctatttttttttcttcttccacctacatacactcaaaaacaagatgacactaatcactagtatatatagagagagaaagagagagaatagttcgcatttaaaggatgtgaacattatagatgtggatcatatgaatcatacatggatggtcatacattgatacatgagtacttaagaaaggcataatttttcttttaatattgatcatcatagaatatttatcgattcatatttatttttgcactattttaacaaatttgttaggatttggataaaatccattttattttcatttttctaaagattcgaataaatgattttctctcttttgtgtgttaaaacgtaattatattattttttgtgtaataaagagatatctgagtttttttatttaatatc

SEQ ID NO: 2692 - DNA, 1580 bp, Glycine max
  Soy_ogl_3892 Gm11:32573801..32575380 Cluster 11
aggtggcccatgaacccattcaaggctatttataaaaaatgtactatttacctattttgaccgggctcccatcaatgaaagcataggaaaacatataaatatgtaattgaacttgtaattatatatatcacatgtccagcgccttagatgattttgtttctacttgattagaacgttaccttgcttgatttacttgcacccaataagagcattgcttattttctcttacccttaaaaaaataatagaatatatcttaaagttgctataattatcttagagttttggtagtttttgggttataaatagtttaaatgagttttaaacacactaaaagaaaaagagagaaagttagttttctcaataacatttccgaaatccttaaatttcagaccgaaaatttcatattttcaaaatatatttgcaattcactttttaggttataagtcttgttggcctttacatgaaaaagaaaaaaaaaagataaatgtaggaaaactatcggcctcaagtataaggtttagaaaaaaatgataatgtaattaatataaattagtttcattattcattaattagagcgaagacataagatctatagcacagtttatgcacaggaaaaacaaaaaatgaagttgttggcatggttaatattgaacaagttgagaaattgaatgctggttaacaatagcaagtagcaaccacttcaaaatggttacactgaataagctttttgcccaatttgtcttgctgtcaagaatggatcgaatgagtgcactaagagacaaacaaaagcacccaatgaggcaatgacactttctctctttcatgtgcctcgttaatcttatctgcaactgactgcaacctgcataaaatgctaggaattaaaggattatttgaaatagactgtaaacagtgtgtcagcatttgttactggaaagttaagcatttgggttgtcagcactgcaaaaaaatctcacttaaaaattatatttcattttatattatgtaattatagaaaatgagggataaatgaaattaaatttgttggatttatgaaaatacgacctgtgcttgtagttttaaacaacaaccagacatcctattaggaaaactatagtataagatacaacttttttttaatccgtaaaaataaaaaatatgtactaaataatttatattaatttacacattttactccattaactaatttaaacctccttaacatataagatacaaattctagtgttataatattacagtacattttatgatttaacttttcccttttcatatccatcacattaatattcttgtaatttatatttctctttttttcttgtttttctctttattatataaatatttgtacacaaatgatttataaatacattttctccaaagtataatatagtattataacttcctttaattcccacgctaagcatatgagaaaattaaatttattctggaaataatccctgcttttaaaaaaatagtaatatagaaacacttgagagaattctaattaacaaaaatcattaactcaccaatataacgatggtcaagtatttgaaacagaaag

SEQ ID NO: 2693 - DNA, 1661 bp, Glycine max
  Soy_ogl_3897 Gm11:33811540..33813200 Cluster 11
tatatttatttaggtttctcaatttttgaaagttttaaattcttcttatattttttttaaatgcttcaatgtgattctttttgtgcgtccaattgaggttgatggcattaagttgcaaattttgatagaaaaataccacatatatggaagcttttttttttttaagaaaaaaataaacaatcaagttgatacactttttttttgaaagagctaattgaagattttgaaaatagaggaacctaattcaacattctaaataaataaagtgacaaaattaaccattaagcctaaaagggtaaaaaaaaacattttttttttttaaaaaaggtttagacaaatacatcgaaagaataaaaaacttcttattttattaaagaagaaatttttcttaaaataaataaacaagcaggcacgtaatcaattatatggacctccaaattacccttttagtttataaaattgattatatatacagaaattttattggattaaatcgacttcaaaagattattataaatttggttatactaaaaatttaatggattatatggactccaaatagcatgcattttgatggaagtttagaaattagattgtgttgataatctaattaacaattatttatgttactgcataacgaaatatatccgcatgtccacatctaaatatatcaaattaaatccaatcatttcaaacctttgacttcgcagtaaagcaatggtgaggtaagatggtaaagcaacgataacactgcaaatatcatcttcttcctctgagttttgagatgattctcctatgcattgaaatgggggcttaaggattgatgagagaggggaaagaattcatgagttcgaacttcttcccttttttcttctccctaatattttaaccaaaactaataattaacattaacccattaaaaatattttatttaaaaaaacttctccttttccaccgcactaaacgagcttgttagcctaactttccttctctactctcttcctttcctttccagcctatttttcacttaccaaacagactgttaataaagacttacaaatcctaacctacacaggctaaaaaaaagggttggatgggactgcacaagaataagtccatagtcttgggtggtgtttaagttgaacgcgatgactagaggagtctccaaacgtcgtggatgacaaggagaaggtttcaaggtctgacattttgaagaagaatgtgtgtcataacacgtatgagtgataaataaaaacaagttaatccatcggtggaaatgggttatgaaaaacaactataggtagaaataggccgaatggtctagcgtgccttaggcctcacctatcctatttattaaaaaggtcaagcttaggtttttatttattattagatgatatttttttactgttaatatcttcttataaaaggtcctcagatatgactttagttgtgtcaagggttttcatgtaattttaattaagtcgttaaaacttaagagtacttttttgcttaagagatacattcgcttttaaagaagtttctctttatattataacacaacaagaaaaaggataaatggccatcagatttagtgactgaaatttgttcatcgctattagcgatagatttaataaagaattagccgtttgtccccatcatca

SEQ ID NO: 2694 - DNA, 1800 bp, Glycine max
  Soy_ogl_4055 Gm12:16164901..16166700 Cluster 11
caaacacaaagcaacttaaaggcaattgatgtccattctttttcttctatgagttggttgagaaagtaacttttagaaaattaaaacttaacatttttagaaagcacttttcgcaatgtaaaaaatatatcagttttacttttgaaaagttaaattttttacaatacataataaaatttttacacttattatataagaggtatattaataaagttcagaggtgtttttttgttttgttttgttcaaagatgtaaatatataaattgcattatagattgggtctttgaaacggcatatccctccaccagaaagattttttttaaatttcttttaacctttctttttatataatttttccagtggagcaatgccaatggttctaaaaatatattactttcataaaatctggggttataatttttttaaaaaatatttatttttgtttaagtggaggagttaaagctcaaataataaaataaattacacagaatttttttgacaaaaatattttagttttaatcaattatgttttaaataactggaaatagagtaatttctttaatggaataagtaataagaatgaaaaatgttggttaattaggtataaaatttcgaaaggtatgtattataaaatgagggaaataagggagtgtgtgtgcaagagcgaaaataaatatagaaataatctcattttaaaattaagaactcaaatttactgtatatacatatattgcgtctagttgaattgattaaacgagtgtgtgagttgttatatacttttttgatattgtatttcattcttataagtaaaaaaatattataaaaataatatgatttttttaaatctagatcacacttataaaaatataaaccagaactggatatttgaattacatttttttatactttttaatttttataatcttaactcaatatccgtatatattctgaattgacagtattaattaataagtctaaaattgaattccactttgaatatcaaccagaatatattgtattttatatgaatttttctttcagataattggaaaaaatattttgtttttatcaacatagacactaaaattatagcgatattaattgtgcttgccagaatgaacatcattcaagagcgagtcatacacaagacaaatattttatttttaatcttcaaaaacagaaagacaaaaatgtttagacaagataaggaattgaatatctgattgttacaagtggcactatatatattctcatatctaacaagtgcatatcccttaacattaaacttgataagggcatgccatggatgattcacaacacacagcatacgtggggacaaaattttcagacgctaacatgaataatcctttatgaaatgtccacacctctccctcataaatggggacgggtcttaaattgaagagtggatagtaactcaatgaaaacaaaataacagataccatgtttaaataacctttatattgttaaggttttgaacatatcgtagtacttcccaattttttattattttattccaaagaagtgaacaataaatgggtcagatattatacgcaacacataatatatttaatgttttgaattgaagcaaacatggtccagagggcaaaattggaatgctagcatgtgattgcatttaatcaatgaattgaacagtgggttgcaccaccacatgttcctaaccatcatcagtgacactctgtatgacactgtcccatgtttcattccatccatggcttagcttttgtcctcaatgactgtaatttgaattcacattttcag

SEQ ID NO: 2695 - DNA, 1300 bp, Glycine max
  Soy_ogl_5717 Gm17:33695301..33696600 Cluster 11
tatcctcgtattcacgtataccaacctatgtttctaaggtcccggcctagtatagacagagacacagcgtcggtgccgactcttaattgccgtcatagtcaatatttatttaattatttaggtattggctttgtaataacttgactttctgtctgcatataacggtccaatttgataagtgcttccctcttttttaacaatgtcatggttctacaatattctgtctacacattatggaatttgcttttaattaattgttaattattaagtgaaaaatcaggaactaccgactccattgccaactcagaaattcaatggctggatgccaagaacggcaatttattgctagatttattatcatgcatttttgaattaggatttacaatatttttttttagtttctaaaatatttaagatttctattctttttttcttaaactttttttcattagtaaaagtcttcaaccttattttttgttcatatttttagttattattatctatttttttattagatgttgatatggttgtcacatgtgaaaacttatgatgtgacatttatacattagttattaatttaagattcattatcctaaatttttttaaaatttctgtatttgattcttaaactttttattgacaggtcagtgttaaacttatttttcattcatattttagtcattattgtttattttcgccgttaaatcctaaggtgattgtacatgtctctaatcatgtgtctatttatataagtaataaaaggaagataaacccataaaattcttttcatagaagtaaattaataacgaatcagtaaatgaatttgtatgatttcactataaaaaaagattcatcacattcttcttaccacacaatctcatcatttttcgtcaaccattgaaataaaagttgtctgcctggtcatgaattgttgataaaaaccaagcaacttaaagttggtatgctagtcagcacatgaacctccttcacgctagtcaaacttttcatatctaatatgtgagcgagcatttttcccctctttgggtgagcatgaaaccaaaatactttccagctaggccaccaaacaaatacttcttttgattaagtttcaaattgaaatccctaatcatctcaaacaattccttcaaagcagtccagtgatctcgaccattagtcgacttaaccaccatgttttccacaaaagcttctgcatttcatcgtgcatgctatctttaaaatatttttgaagagttatgtttctcttaaagtacttgcataacaatggcaagtcattttggat

SEQ ID NO: 2696 - DNA, 1750 bp, Glycine max
  Soy_ogl_6046 Gm18:15713151..15714900 Cluster 11
tcataatgttttttggatggttcatatggagacaagaaagtgggagtgatgtcgaaatagtgatggatagatatcatagcttggccaactgctagccatcaaaaggaacatgaatcgtatgtcacatgcaccacgtactaaagttatccagcagtgcacttttatgttggtttaatatgtgcaatgtgcgctagatagggaatgttatgatgatgttatcattgtgcgcacacacatataacgtgactttaattatatactacttgcaaaatattttgtatacgaaatcaataagatttgatcatttttaacacataaattaagattaaatcatttcattatatcattctatttagtgatatgatcgataagatgtgagaaagtgtcatcacacatgctatatttggaaagataatggaacccacgtgagttgatattgagttttgttcctctgtttactaagtactaatccaagtgattagcggcaacaaaaattgcatggttgcaaaaaaaaaactgccatgaataaagttatacacaatactgataaaatcatgcacattattaggcattgagtgttgaacatggacatacctttgaaacgtaataagaaagattttgctttagttatgcaagtgttcttatggatgaatgaaatcactatttttcctaagttgattttggtttgattgcaatattttgaaaagaaagtatccaaaacagctggttggcgctggatttgaaatgcaaagcaaattctatggagaattattaaaaaaacaaaaaagaatgtgggtttctctatattccttgcatggaaacttccttccatctacaaaatcaaaaccaaacatatcaatgaattcaatattaatcaaagataatgaaaatggtagaaattgcataactatatatcagtttgagcttgctcttgtccactggtacacatctcaataagcttctaagacttgttcatgtcaagaggaaacttaaaagctgactgtttttttaataaactaaatttttgtttttttatttagtgtttaaaaattcattaccaaatttataattcttccttaacaagcgtttgacaattacaaaatatatattaataataagttcgtaattcatatatttgttctcaacaaagtagagtaaaagtccgtggaggccatctcatacacctttgaaattggacaaagccttcaatgatcgggcatttactcaaacaatcaatgcattgaacgggatgggttctccaccctatcaaatttcaattacctggaatcaatcaaatgattatcttctactttctatgtttatctaaatattttatactgccttagagaacttaatataacatcacaatttcattatactccattaaatgaaatgttgagttaagaatttaattttaataattaaaaaagttgtgaaactaaatagaaacaattaattaaaattatacacaaatcaaatattccactaagctacttgtatacctcctaaactgagttttcaaaattatttttgttatattttaattagtgaagttaattcaagattggtagactctaaaaaaaatggatgcagggaactgggaacttcctaggtaaattggtaaaaaaaaagaatgacaattcatttgaattaaaaagatgttagtattttttataggtaatattaatattgtttcagcgggctttttttcacaaattatgggcttcctaaattctattttttcttaggg

SEQ ID NO: 2697 - DNA, 1210 bp, Glycine max
  Soy_ogl_6098 Gm18:47922901..47924110 Cluster 11
tctcacttctcaggaatcttgtttgattgaacttcaagagaagagaaaattattgtcatgaagaagaatcatttattactttattaatagatttcatttgaagaacaacatggacaaattcaggaggcaatggagggtaaccaagatatactcacactttcaatcaccttatacacattgagagcaagacaagagaataaagacaaagtttgcaattatatattaactatgacttcagcgttcggacccaaaaagcaaaaaacactagtgtcttctttggagtggttcctgttggcagttgcacaatgttttctagccatttcctcttgcttcagaacctcttcatcattcttggcttgaaccattgcccttttctcctctgcttccttgtgaactgaggatatcttgtttttaattctttcaccatattctgttttctttctttctatttgttcctgttctaacaagaggtttgttgcagttgcataacttgcatatagttacagtactgaaagtacttgcgtgtttatttggatctacttcattcactttaatgagatgatagaacatgttctcaaactaattcatagaacatgcttttatcttttgaatggaaagaaaaaagaaaaggggttttctaaaaatgtggattaggtggttatttgttggatggatcaatgaatattgctatgaaatataatgtactaattaaccttgcacaatttatttgcagcacatataatatgcagaatcacagataaaggcacatgctctaacaatgccatatattacaatcataatggcctacagatcacaaaaccacaatatctgactagagacttcatgtaccctcgtgtaccctgtgaaccatacgaattagttgagaattaggaggaaaagattattttgtcattcaacagtaccaataaactactcatttgattggttgtcaattttctagtgagaattgattttgcaatgtgatttgaattttacttttatctcactaatgacaaattattgttttttatccactcgaattctgatatacaaccattcacactattcaactagacctgatctatttttacttagagaaaattagaccctcggaactgggaacgtgcaaaaaataaaaataaaaatttaccactcaaatcttttctctatccccatttgatttagtttttattctcccaactattttcca

SEQ ID NO: 2698 - DNA, 1400 bp, Glycine max
  Soy_ogl_6386 Gm19:33082301..33083700 Cluster 11
ccacacaatgacaacatcgtaatctcacacacgacagagggggaggattgcgcagagttagtgttgatttgacgaagagacttgcaggaaaaggtttcatgcagtggggtagccttggtttaggtggtggtgaagtgcataatttgacttggggtttgacagagactcatcaattcagtgagtgatgtggccttgcatgggacagggttgtcagcattgttgctttcgcgttgaggtggacgacgactaggtgctttactttgtgtgggggaagagcgtcgagaagaacaaggggttctcactatcatggttcctgaacaccacagaggggtcaataaccgattttttcacacaaacatataaaaaataaaaaattatgtacgtaaatatacatatctactattattcacacaaatgtatgtttaggtatgtatttgttgttatttattgtatgtttgtgtaaaaaaatcgtcaataacagtgtcaagaaggaatatacgttgcaccctatctcataataggtattccattatacttatttctgaatcactattctgtgtatatgggtgaaatagatttttcatattctgaaatagttattagaagtgtatagataatatgaaaaacatttgagggtgcaagaagcaattgccctactaaagtttagtgttgccatatttttttcctttttgtgtttcatgggtcgtagtcgttctatagttatactttattgaattttccacacacgtgtcaagaacaaattaaatcatataatcatcttttttctcaatttctttaacgctgcacttgtttataacttatctcatttataaactttttttatttagatcacatgtatttttttagaaagagatagttttattcgagttaagtagaattattatgaataataaaatttatctataagtctatcaccattcttcttttgatttttgatgtaaagtatattttggtctagagattccttctgttatttgtacattttctatcagattgcatttggattatactcttcatcaaccaatcttctatcattcagatctcaaattttttattttattttcttatttggactctaatagttctgtccaaggctgctttgattgttattgatattaagcatcttcctgtacattttttcttgtttacattttttttgtttctttctcatcattcacggtaataagtgaacatactataactgctgaaagagtgaaaaaagttctctcttttaagcctctctctcttttaagcctgatggtatgtttggttgtgcaaaagtaagagagatagagaaaatttttcaaaatttggtatgaatctcacatctttttctctttattttaatttaaatatttactctcaattctcttccattc

SEQ ID NO: 2699 - DNA, 1052 bp, Glycine max
  Soy_ogl_142 Gm01:42292401..42293452 Cluster 11
aaatctccaatggccattccatgcttccaaagtgatgttaaacctttagcacaaatgataaacaggtagggggacagtggaccccctaccttgagcctctccctggattcaccggaccaacatcctctccattaacaagaacaatatatacaaatgatgataggcacatcgacatctattgaatccagcgttgaaagaatcccattctagccatgatagccgtaaggtagcccaagtctaccctttcataagctttgcttatatctattttaagtgtcatctctcctttctttccccatgttttgcatttcaagtaatggactacctccgtagctacaagaatattgtccgagattaagcagttgggatgaatgttatttgctctttagagatgcacttgtgtagaacacctttcaatctgttgacaattgtctttgaaagtattttataagccacgttggaaagggctattgaccttaagtccttaatcgtctttggatcattatactttggtataaggacgatctcaaaataaaatacttaaattatgtatttctagtaatttcatatcaaatttaaaagaataatattagaagaataatcactatatttatgatatatctaaacatatttaaacctttaaatattaattaatgattttaagatccattaaatgagattaatccctcaactcaaaaaaaaaaagtccctttatccttctctaggtagaaatgagaatagttatattgaactaaagcgtctttagcttccctgagaacatttttaaaatttttttattaacttcttatctcttttaatttatcattttcaattaatattcttagttcaaactaaaatgccaatattttttatataattttttaataattaaaaataacattatatcatattataaattatttatcataactcaaaaccctctcaatatatgaatgatattaggtgaatagctatcataaatctaaaactttttaggaagtttttcttcaccataatgtttttagtcatttacttaactttttatcttttta

SEQ ID NO: 2700 - DNA, 1007 bp, Glycine max
  Soy_ogl_1296 Gm04:35847301..35848307 Cluster 11
ccatgtgatatcaaggacaaaagcatagtttttaaaaatgtagggacaaagataaattttgatcaaatatgtagtgatcaaaatcatgattttaaaaaggtaaagactaaagtcattatgaaccaaaaatatattttacaataataataataatgattttttatgaagtaataataatgatttcttgagataattatcaaattactttaatattttacaaatatttagaaccaaatacacatttttaatatgtttttcgtgaggagttcctttcattttcgtagaaaataaagcaaaacacttgtaagtgattttaacatctgaaatgctaaaaatgacatcacatgttctattgaaggaagcgagattttttcacacgatgtgacatgcgaataattagttcttatgcaagatccaacactaagaaatgtttaaagatactggaaaggaatccacactagatgaaacactgagtcgtgagatttttattgggtattcattgtctgagacactataatggcttctaattttaagtcttcccagatacttctagtatgacatgagacatttggccagtgttggaagttgatgactaagtagttgtgcattgtaactaattcttgtaagcttttgagcccagtctagctactatatataaaagccattttacaaagcttcagaaagcattgagagacaacttctcactccgcaacttattttctctctgagatttctctattttcaccgttgagaaagtaaactgttgaagaggatcttcaagaaaatggaatcaacatcatccatcatcatctctgattctttcatatgctatttcaccatgtttagctaaacccgttgtgtatatgtgctagaactgagttgattgccttgtattagcattatcgtaagaataggacctcttgatgcatgacttaattattgtatatttccccttgcttgttgactcctttcctttcacactcttttttttataattattaaatatg

SEQ ID NO: 2701 - DNA, 1000 bp, Glycine max
  Soy_ogl_2839 Gm08:41021901..41022900 Cluster 11
agactaaaggctttttctcgatggtttttggcatgtgtcgtgttgttgtgacttggtagtcatgttgaactaatttgagggaaatgtccatcatgatcacttaaaatcttataaatcttcatggagtccagtcaacatccatatcatggttgttagtcgtaagaacatgcatcatacgattgttagtgtggatgagtgaatacgtaggaatgttaaatttatgtttgaaatgttttattattgttgttgtaccctataatatatacacgttgcttatacgatatattattctaagtgagcttatccttgcatcttggaggctctgccagaggtgatggtgggatgtgactagttggataagtcacattggtatgccttgtattgaggatttattcctcttactattttcttttgagatgcataaaataaccatcttagggagtctgttttgtattcccctcccctattgatgtatatgtagttgatgatcacatagtgatgttggtctttttttcattcatctactcacctttttttagatactatgatattactttcgtttataggttgcagagccatgaggcacttcatttatcatattgtttaggtttacatgttgtgacgtgattcagttaggatatatgatgttgatgtttaaattcgatgagacaaaaaaatatacacattttttaatgaataaactaattaaagggttttaaaaattaaaatcaaattatatccacatcgtattagttgatgatgtcatgtagcgacaattgttgttacaaaacacacttccttttttttcgtagttgtgatagcgacaccatacccacaataattcccctcttcatttttctcataattaaacaataacaacttgtggttttcttaagatctaatcaagaaaatggggagggttcacaagggttttggaacaaaagaagggaaaaaatcatatattttggaagtgaagagacctggaaaaaaatgatattca

SEQ ID NO: 2702 - DNA, 1400 bp, Glycine max
  Soy_ogl_4743 Gm14:27237201..27238600 Cluster 11
tattatgtttttaaaaatgaataatgaatgatcaaaagtcaaaaggtaatatttcatttcattattttcattttgaaaaaagtttaaaaaataaaatattaatttaaatgaaaaaaaacttttctttcttttcatatttttcacttcaacttttaaatatacggggaaactagaaaaagtttctgccaatggatgtgaacaaccacatcatataattctaaccaaatatgctataaattaagaaaataattgctttaaaaattaagaaaataatgaacacttttaatgttttcaagatattaaatttctatatttttttaataaattactaagaaactaatgggagagaatataattattcttatcaacttacaataattcaaccccaaaatgaaatttaaagcatgacattaatattataggtacaacgaattaattgatgattcaactgaaataacttcagcacatttgttatcttttaaattactatgttaataaatttggaatttttttttattaaatacatctagatgttaattgattatactttataaacactttactcgtctgagatttgttttaattatgcataagtaagagtcgagcagttgtgaaattatttattaaaaaatggctttatatatagattgtcggtaaatatatgtcttataaatttggagtttttcttgtttcagactaaagcatcgtctatttcttttaaaattaatgcatatcattgaaaaaaaaatacactgattactaaataaaattgaatagagttagcaaaaagaaaattaatcaaaaggacggttagcaacattaattaatgttgtctggtgattaactgattatggtggggactaaatcaaatgtatgtcttacatttcaagaatatgaaccgccataatggatgacttttatatctaagtcatacactcactttaattttaagacggttgccttcaggtcaaagtatgaatacatcattcatggtcaattgaaacatagtacttttgacatgttggaaggggaagatttctatgcatggcactacttttgctgcatagcgatggagtaatgctgcaattttagtgatttatcaattgcaggaaaccaggactattgacaaaatctgaggaaatcatccctaagattaacaaatgcatcatttttttccgtgccattaatcatgtttcttcaaaataacaaaacaatatacaagatatgttagtaaccaagaaaaaaaaatgtcttaatttgatccaataacatgctaagggtaaaaaaacaaagcagtctctcgtcatgtgtatgaagtgagatgatcgcattatttgtccaacgtacttgaaatgcgcaccatccctttggatcatgcttgaggaagagataagtctttg

SEQ ID NO: 2703 - DNA, 1400 bp, Glycine max
  Soy_ogl_4751 Gm14:31150001..31151400 Cluster 11
acaatttcttcaagctcaagtattcacaaagagttcactcctcattttgttgtttctaaatatatttttggaagagctctattcctttgaaaaaaataacttgtttttttcttggagggtgatttcgaataggatccctactcgggtcaatttgtacgtaagagagatgtattgtctctaattacagagtatagagtatcttttgtgttttacgcttctctttggaagaaatattgtcatcaattattttttatcctacttgatctgaaaccttggaatgttatctatccatggattaattggttataccgggtctcacctaataacatatttgatcatctggtatagataatatcagttatgaaaaggaaaaataaatatatagtctttagataagtacttaattattttaaatgattttctaattttaaatagaaataataatcttttgaaatatcaaacaaaatatacaacacacacaaccatataataaattattggtaaagttctctgtgtaatttaaatgattaaaactgttggaaacgatattcgtgacacatgtaaactcaataattactataaccgccgcaaaatcatttttttgttgagatttacttgccaaaacttagcttgtgtactgccacagtgcgggacctgataatgttctttttagtgtcaattagtaataaatgatagaaaataagtgtaatgaatttacaaaatgatttatcgactataatgcacaatttatataaaattaaaaattaaaacaaataagaaattagtgttagcattaagccgggaaaaaaataagtaggaattaacccatgaaattagttgacatgacaaaacctttcatcatataatataataatataatagtgaaatgtatttttatgtgaaatatttaaggtatcttgtattttttttctattatttaaatattaacaattttatgtaaatgttaataggattttatgtaaaattattatttttcttgtgcattacttaaaataaatgtttcttttatacaactaaaattttctaatagataaatacttcaaactatatatgtactgatatgatcaagaactccttgatcatgttttagattgggaatccctcaagccaatatagggttcaataagtgtcaatcccttgaatacatcttggctccatggaaattatggaatctagctcatcttaatactatattagttctatcatgtaattttagattgcatcaccttaatcaagggttacaaagcatcatatgagatattgaacgttccagataacatatgtctcgtcctacctatttcagaagcggttctatcctacctaaactaactaacctaactaaaatatatatgcttatgaagaactatctaatggggcac

SEQ ID NO: 2704 - DNA, 1300 bp, Glycine max
  Soy_ogl_5105 Gm15:42257901..42259200 Cluster 11
taaataaacatggaaattagctatgaagatcctcaacatttggactgttcagagacctcctaggaaaacacttgaaatgattcttatggataaaaatgtaatgacttaatcaaagattgctttcaaattctgcatattgattctatgatgaacttattctgtttactctgttacttaagtagcgagacaaggtaatagctcaagtgaataataactcggacacagaaaagtggaaagggatactcatacagggttggtcgtacattgtttagaattttgaggtggaggctaacaatggcaaataaaaggcatccaatcataggtacaagttgacttttctcaaaggaacaatggtcaaggaacaatctgtacctgagatacctcaaaatagatatcgtcttacaaagtttcaagctaattgaagtgttgatcctgatgtattaataggtaaagattacatcatgtatagatattgctgaagttgttaataacaagtagtttgggtttttgaacattatgttttattgatacgtaaagagcaaggagatatatcttttaactcctgttggtccagggtacgggtgcactatgaattagttatgacgttttttaagtcttttttttttatagaaaatttaaagaaaagtgaaacaagttggaactttttaatttgggtttgtacttttagtgtgattaacaactttaatggatccccatatagattttttttttcttttcttgcatatgatgttaaacaagttgtttctgacttacattattttaataatggattagatgaatgctatttttttagtacactgaatttgtgtgtatatatatatatagccaatgtgattatttttggaagacttcagcaaaaattacattttccctttttaaatattcttttcctatccttattattttctaacgaagtctctttttggttcataaattgcaatttcgaataggtgcatgtagtatttggttttgcttctctttctctcactcttttgttgtatgcttgtacttccctattttattctagcttagaaagtagcaaaaatgacaatattttcttcccttttcatttttactttgggatcgcagtagctaatgaatttgttttctatcatgcattcaatgaacccagtcgcatttttatcttgactagtgtaaattttttttttttttattaacatatgtgactggtgagtttgatggttcagtccaatgtaaccttgagagtaagccaaggaaagtgcaatttaatttgaaggatgaaggttaaatcatcata

SEQ ID NO: 2705 - DNA, 1350 bp, Glycine max
  Soy_ogl_5702 Gm17:16128832..16130181 Cluster 11
aaagtttatatatgaattgtaaaaataaaatagaaacatagaagataataaaaatatgttttcactaatttttttcataatctttttaaaaaaataaaaaataagataacattagtaattttagaaagacctaaaacatattttatcgtaattaaaataaagtagaaagtaatttttttaaccaaattaaacctcatagccttctctgtttcaagaccaatactataaagcttaacaaaaccaaaatataatacatatatgagtatgacattaattttttttttccaaatatagttgacacagataagcatagcagtcgaaagaaggaaaacatatggttggcaaaattcaaaatgatagtgatgacatgacacgtgaatattttctaataacaaataacgcttattagatatatgtgctctagaattttaaataaacatctacctattatcatgtagttggaatttctgataaagaatgttaacaattccatataggtcttgtccataaaacaatgacatgccgcaaattgcttcttttttttagatttagagttatttcctttcttttcttttttgagggagagattttgagttatttcattgaaaaaactagagaaactatattttggaagaaaaaaaatcaataggatatggtagagagagaaggaaaggagcgaatgctagtctggcaccgaaaccaccagatggtgcttttggtgataagtcgtctagagagaaactcatgggcaagcctgctcaactttcagaatcgagggatctcattaaggagggactgatgactgtgaattatgatggggggaaccgtttgctcaatccctaagtttactctggctactgctttcaataagctttgtctaccatgccaacaatgtttggtagtgaaactcttgggggaaaatgaggggtttctcactatgcgagacaaattgtgatctacatggaaacttgagggtaagaattcagaacttttgattcaaggtcatctaaaagtctctcagcatgaaaccaaacatgcattacattctttactctaaacgtattttaagaaaagtaaaagggtgatccaagcataacttactctaatatagttattgttttacgctttttattttaaaaaataataattagtaaatacatgtttagagggttaactaatcacaataattagtaaatatatgtcacatcgttgggacaatattttaatgatttacgatgtaacttttctctttcattattatacccgatgcttagacagttaattaatcacattaataaaaataaataaaagtacttgtttattgtataaatatttatggacacatcaacc

SEQ ID NO: 2706 - DNA, 1078 bp, Glycine max
  Soy_ogl_6086 Gm18:37796201..37797278 Cluster 11
cacagccttaaagatgttataggaaaaaaaggttaataaggtgatctttcgaaattcaatattcaattagatgccttctataaatacctttataatatatttattgtaaataccttatataaagatcagtatagtctttaaggctatcaatctctacatttattgagatatactacgatgatttttaattatttcgtgatcttaattatttttgcagaaagaggggagttttataagacttgtatgaaagaacatttgggttacaagtatcgatcacagcaaatatatatgtaaatcattagatgtaataatacatttgaaaaagaatcaaactctaggtgaggtcttaatgataagaaaataagatgtgcatctcgcaggttaccactacacaaacccgagtgaaagacccactcataaatgtgtgaaagtgagtgaaatgtatgaaggcaacaaatgctaaactacccaacctgcaaaacaaacaacatgcataataacaaccgatattctagctagcctatggttaagcatataaaacatatttacaaacaccaacacatatgatgaaataaaactgttcacaacaaaaaaaaaaggccggttagataaatagaataaaagttacaaatttacttaactaattatgagtaatacaaataccagtgcaaaaagtaccaagattgtgaagaaggattagtatacttatacatcaattgttcatattataaaacatttgaaagttgtcaaggattgaacataatttctatgggtggaacacaccaagaaaaaaaaattgtgtcatttctctcctcctctctctactttgattatattttatctatgctaatctaataggaaaagagttgagcttatgtcaaagttttttttttcaactatataccaaggcctcttgtaaatttgtttttgtccttcacaaactcttgagacaaagtattgttctgccatttacaaaacctcgtttaatttacaattacaaattgagttttaaagtgttgttttgcccaaattatttatgaaatgttttttaaagtacaattctaccccttttcttaaa

SEQ ID NO: 2707 - DNA, 1000 bp, Glycine max
  Soy_ogl_6707 Gm20:23567201..23568200 Cluster 11
tgattgatacttgaatgaatttttttttaaaaaaataacaactctatgcactaaagttttggatagcaaataactattcaataaacttttatgattaagcaacatcaaaaggtaggagtgctaatctattgtcacaaacttaaaataacgttatttttatttgaaaatacatgcaatatgaattaacaaagaacgtaaactcagaatttttatactacaagaaaaattattcatcaccttctatcaaggaaaatggaacaaaacaaatacaagtcccttgaaactaaacgatgaccttttactcatgtttttttttttttttttaaagaaagaaaactaacactaaactatcatatacaaagaaggcacatagtgcaaaggacacaaccttaccttttgttactattattttagtatttttaacttcaaaaataaaataacaaaactaaaaataaacttaatgaatgaaaaaaaccgtccgtgcctcttgtatcctagagctatcattatttctttatcctataaaagttgaactttctttttatccgccaaaacaacatcttttaatttcctaatcttaaaataaaaaagaaatggtgctttttaacccacggtaggaaggaaagcatgtcgtcacaacgtatgtacgtattttgttcagaaaataacattttggttgcatacatacatgaattcatgaaaccaaaaattaaatgaagaagccaaacataataacaaattaaatgaccgagagaaaagaaaaaaaaaaaggacttgatctaaaacacgtaacagcaaaagaaagttgagggcttggaattgatccagaattgggaataaggtgctatcgaactatgttgcaagtgtgaggctattgattatagcaacataatcaccttttggaacaattgtgaagaaaccgtctttttctccgtgtccttcatcgaattctctcttcttttttttcccctgttgagattgtgagtctccttttgtgtag

SEQ ID NO: 2708 - DNA, 1200 bp, Glycine max
  Soy_ogl_872 Gm03:33490901..33492100 Cluster 11
gctataaatagccaatgaagcacatggagaaataggtagggaccatgagaatgacaaggcaatcatgagggataatataatattccccaaaatcgtgcacatacagtagttcccatgatgaaccgataagacaaatgaggtaggtttcaattgtaaccatcaattaacaaaacgaaactataaggattgcctttttttggtttgcctttttttggttgtgtcacatctttattagtttactacaatagccatgttttatttgaatagcacataagatttaattttattccacacaattacattaatatcatgaaaaattataaacaatttgtattgtttcatctttattatgaaaaattagattttaattatttatttaatttttataattttataaattttatattttagttcttatacttaaaattcatctcttttaattcttataggtacatattatttttaatccttgttaggctctatagttttagatgataaggactaaattagattaaaaatggatatttaaggactaagagagattaaaatggtatatatgtatagaaactaaaatgaatgatttttgaatataggaataaaaagataaagtctgaataattatagttattaaatgaataattaaaccaaaaattaattaaatatttcttatcatgaaactaatccaaacacaccataggaatgtgccgaaaaaataggataaattcggatgcaacacactagaggtaaagtttgtttcctttgttttgtagggtacgttgttacaatctctttttgtatttggttttgggtatctcttatagccatatttatctaatatatttattatacttgtcgataaaaaaattataataaattttaattttgtcagatactttcttaccaatataatattagagtaatgcaatatgaaaaaatgaaattatacactaacaatataaaataatttttattatcattcaatcataaattatcatataaataaattaataaattttatattaattatcttaaaagttataataatagtaacttttaattgattgatatttatatttgaatacataaccatttaatttaagaaatattcttttaaaaaataataatcagaaattcacaatcaatgatagtgctctaagctcttattgaaaagcaatgagtattttttttttatcagtaaaa

SEQ ID NO: 2709 - DNA, 1005 bp, Glycine max
  Soy_ogl_3411 Gm10:8466533..8467537 Cluster 11
caaaggatcaaagtttcgaatatgataaaataagatagcaaaaattgtattagagtgtttatgttatgagtccttgaaaaaagaaagtatcatttgtgtttatgtgttgaagtgtcgattccgttagataacaaaacacgtcaagtgagtaagagaaatgtgaagtcagaaagagtgctaattgagccttttttgtgaaaaatggaagaaaaatgagagtttcacgttaatgttaaaatgtgcataatgtggtgagtctgttacataactttttggtttaattattattttatcctctaatttactttctttaaaatttaattttgtcatcttatttttaaaagattattttaatcatttaatttatttattaattagttccatttaattattttatctttaaaatgttcagttaagtttattatttttttttaaaaatgaatttaatttggtcatatttttcttccataagctccaaacaattttaaaaaattagatcaaatttagttttaaatgagaccagattaaaatcatttaaaaaaataaaggatctaattcactctttcaaaaataaagggatgaaattgaactcaataaataaattaagaaatgaaattaaaacttttaaacataaaatgactaaatttaacctaaaaaaatagtttactcaaatagtaattatacctaacttttttaaagaaagaatgagagaatcaagtgagtcaatatgcgtgaacgtgagattttttagaaagtgagttattttagaaagagaggatgcgtgaggcttgttggggtgtgaatggaaatgggaatgtgcacatgaagagaataaaagattgcttctgcatttaaagtctgcatgaatgagagtagtatttgataaaaagcttttataatttttttgttacatcaattgttactcatttgtaaaattttttcataattttttgaattggatcacagatacaaaataaaaaaatatttttttggtctattaaaaaa

SEQ ID NO: 2710 - DNA, 1204 bp, Glycine max
  Soy_ogl_4252 Gm13:108201..109404 Cluster 11
agtacaaaaatccaattgttcccggcatcatggaagccacgttagcctctaactagaagagcttaagcatagagaaatatggcatatggacgtttgtcaccccaagtcaaccaataacgtggttttgttgcccttttcccaccttgtgttgaaaggacaggccctagagctgggcatttaggtttcagcccgtggaccacttgcaaaacctgtaaccatataatatattttgagtccatctgaattacagactttttaaccttgtgggttaaatcaattttatctacgatgagatttttacaatttaacctaaaaaatatataatattaataaataaggagtgtaaattgagtaaaaaaattatagaatttaagcatttttatatgatttaatggttggtaaatatgatacaatattttgatttagtataaaattaatgaattacagattaagtaaacataatatagaaaaatgtttttttaggtgacttaatatgtaaattatgttattattttaaataaatatttttttattagacaattcatagtttttaaaatgcgttaaaatttacattttaaaatttagttttctgtttttttttttttttgtctaattcctatcaacctgcattgctaattatgtctgctaagtctgaatgaattaagctaaagggtttaggctcacattgaacaggggatatgatttttaagttattttttactcaacacacatcacatttcacatacaaattaattattctcagacattgcaatttaataacatactagaaatttatatttgataatttagcacaccacatatcatatgaatcaatcaagcagaaaatgatgcaatttcattaataatttcataaatgttaaatacaaaaagtctttgattacaataccattttttcccacaaaacattatttttttgtcattacaattttattatatgcaaatgacactttaatttcaaccccttccaatagtactataaaaattaaattaactctaataaagagcaaacataacaactctattggtaaatttcaatatttaaaatttaaccgatcccagggtctttttcttgtgaaataacaggtataaatgaattttttatcataaaaattggaagtttttcccttctattcgctttctaccttttatagatatttttattgatcactaatagtactgatac

SEQ ID NO: 2711 - DNA, 1276 bp, Glycine max
  Soy_ogl_4256 Gm13:24866295..24867570 Cluster 11
tcacccgcatgcatgcttatgtaaaaaaataccacattattagccaaggcatttgatcaagccataaaattattacttggaagttatgaattgtataacttagacatgtttttctcctgttttagattttttttttaatttatagtattctttgtattgcaaatttttttaactataaaaacatgacctgcatatagtgagaaatttattagaaaattgtgggggaggggttcatgcccccctttcttccaacatatataaatatttgatcttatacaactcgccccttacatatatatcctcatgtggataataaatgtaaattaaggagattaatttttatttatttattaaaatgcatgtcaattccacgtgaaatcttcgtgtgttgcctggaaacaagaaagttaatactatcccaaacttgtcactaatgtgctgcaaatgctatgcatgtcaaaacttatcatcccttaaagttgattataaacatttgaaaattaataataggttttataaggaaaaaaaacatttattacatactgttagatcgggaattttggacaaggttaaaaaaacatttattacatacttatcaccccacattttttttttgtaatttgaaattttttaatttgtattatactttgatatatgcacaaaaactaaatatcgaattacaccaatggtctgttagaatttgctttcatgccaatgatcattgtcacaccagaatattctttttctactttttaacattttgaaagaaaatttctcttcaatgattgttggatattattattgtaaaagcaggtgagtaacataatttattttggtttaatagttttttataacataattaacataactttttttaaaaaaaatatgattagcatgtgtcattttttattataaactcacaaagtttattgacttgtgaaaatgacaattaacatttgtaatgttaggtattttaaaaaagaatgtttagtttgtcttatctattatatattttttattatatacttttgatttttttaaaatacataataatagatattttatataaaatgtaatgtttatatgttttataattgccccctagttgtttaattttagctccgtccttgcattccctcataaatcttttttttttgtttcctatccgcagcaactcgcaagttaaagggtggtcatggaaaacaaccaatcagcttgggaagaatcgtattcaatataccttgtaaacaattattcacaataacataaacatcat

SEQ ID NO: 2712 - DNA, 1273 bp, Glycine max
  Soy_ogl_482 Gm02:10785001..10786273 Cluster 11
cacatttcagacaagctagtcccgtgaagaaggagaatatggttgagccctagctcgtgtatgttacattacacatcgatcattgcccaatcatcactgcctattgtatggttatagtgctaatagttagagtcctgatattgaattatagtgtgtttgtattttggttatactattttttcaagtttctacgtaactaagcgtgaaagaaagaaaacgttagattagtgttcatccggcttttaaaggtgtaaaactcaatcacattcttaggttagttacgaattcaattgaaatgattaaattaatttcttttacatcataagtctaattaatctagattgagttaactatatttcattttcaatgattcgatttttgtgttatgtttttttgaaaatgaattgaattaattgttttttcttcagaattttgagaattttttctcgtagatatattctaacaaacaaattaaatgcccattggcattttaaattcatggaatgttactattattttttgtaatagatttatacatgttttataatacagttgtgatttttaatttattttttggataaatattttaaaactatataagttgcaaatttaatgacccgactcaaatcaactaatttttaattagattggtttgtttcaaatttattgaaaatttaatccgttatgaatgttttgattgatttaaaatcttaaaaaagaataattattataaaaggggtaattcagccactccttttttccataaaaagaaaataaaaatagctactcactttttttcagttttatttgcccatcgttttgaagactgtaagttggagcacaaaagcccatgtacaatcgatttttcgcttttctcaagcccaactcaagaaagaagtattcggcccgagaccatttgagtaatggattttaacctcgtgataatgagattaagttacttcaaaagatattagtattactctccattttcattttttattttcttttaatttaaggttctgacaagccactcacttttaagttttaactctataaccattaaattaaaagaaaatagaaattgaggacaagtaacgttttcaaaaaaatatttcaccaggaacatacatgcgttttatgtttataaagttataatatttataaaatattttcacttcaccatgcaccttatattaagctttttcttccgaccctctaaaaaacttactccctgtccccaaaattggaatgaaaatgaggactcatccttttc

SEQ ID NO: 2713 - DNA, 1192 bp, Glycine max
  Soy_ogl_1646 Gm05:31801301..31802492 Cluster 11
agacactactgaaaatgggatcaatttcagaaggaacaacaatggaataaataataaacttcaatttatttttggagagaataactttatgcattgcatgagtctaagaatggtaattcaaaccattcaatggaggagagactagaacagatcatggattttaacagagaagataaaggtctgggtcgaaggattgagggaaggatgttgaattgtagaacctgtttgtgatttggtatcaaggcttgaagaaattgtcattattggctttggaagaagctttaggagaaaggggaagagagaatgcagaactaagtgacttattatataccatattatgacttcatggaatgaaataaatggaaaattgtatttctttgtgaccaaataaaattctacgtacatcaatattctgaaacaataaagaatttgatttaaaaataaagctcacatgaaacaattaaaaatattaagaatttgagttgcaaacactcttcatgggagaagtaaaacagagaataaaaaaaataacatacatgtatcgacttctatatatacattaaatttgaatagttgttcaaggcctttaaaaatttactttttttcaataagctacttgactcttcttactttaagcatttcaggctttcagctacttgagttttcttacaatttaataaacatagacataatatgtagtgattcaaataattaatctcttcctccagtgttatctctttaatttatttatatttaataaagtagaatgaatattcactattaagaataatgaaatttatcattaaattttttttctttcttaaaattaataaagatatttattattaaagacatatattatcgttgttattattagcaagattagtagctttatctctttcatatttttatttaaatttaaagataccgatggaatattcaggaaacttaatggtaaaatcctaggaattgaattttttttttggggtgtgtaatttaattttgtgggtttaatttgtttgggtcttcattagtcgttgaagattctcccttagtattttttacaagcacttgcttgtcttttttttttttttttctaggtcaacaaaaacacttgctagcttgcagtggacttcaattttcttactctatggttcagtgaagatgaacaagtaagctcaagtaactacaa

SEQ ID NO: 2714 - DNA, 1177 bp, Glycine max
  Soy_ogl_4324 Gm13:28439501..28440677 Cluster 11
aaatatgaaaaataatatctcagagttaacacgtcctacaaagaagttgaaaataaaaatataaataaacaaaataaaatactgcaaattaatcaaacattttgaataaattataatcttaaaaaggattcagaatttcatactcccctcaaaagtgctaacaaattctgtaaaattggtgataaattgatgaaatccatcatcccttactcagtaatcattttctccaaaatatgtaaaatacatcaaatagttgtaattaaattgcaaaactcattaattcaaaatttaaaaaacttaaaaagaatattcttcattaagatactatcaatttgaatagtctatcatatatttaagtttgtttttgtgattcaattataacaaaaattaagttgcaacaaaatttagatataaaataaaaaattattattaaattaaaatttaatagtttgaagattttaaaaatattaaatgtgttaaaagaaaatagcatagatttctaattgaatacaaatatgctttgaaatttaaaacacaaagaaaaaaagaagaatagtcttattattatttatcaataaggtctaagttaattggttgaaacatgatctatgtgaattgttgtataatttccttggtatatatgagttgtcgtggtatctgattcatggataaaaaaataataataaccttattttcgtaactatatcaataacttacaaacattgttttagcaaacaaaatatcttacctcatttggctcaaattttatactgaaagcctccaccaattagtgaatttgaaacgatcatttggctccataatacaggcagtgtgtttgtactcatacatgttacacaaaaggaagtaaaccagcaatagttatcaaaacaaaataggaaagaaaaagagaaaatgtggaactttatattttttttggaatgagaataaaaaactttccaaacaattattcaatttatgcgacataaaatttcttataatatcctatctcaggtctcgtcaccctcatatttgttctcgtgcttttcccactcataaaaccacaatcgtgaggaaaggaccaataaacggagcaacagagaatgtaaggtagaaaagaaaagcctctacagtagtatttgacatggatttagtcgcaagaaaaaaataaatagaaaca

SEQ ID NO: 2715 - DNA, 1200 bp, Glycine max
  Soy_ogl_4182 Gm13:21154401..21155600 Cluster 11
tgtgaaattcaaagcaatcctttcaaaacagagacaacagtcaatgtcatgcagccatgcaccatatatgttatgctcagtttgtttgcatgtcaattctcttactttaattcactgtgcagaaccgaaacttgtctcttgagtcttttagcttagtcagctttgccagggccgcattttctcagcactctgtcaagtccgtacgggttctggttgacatttaattaccagctaggattattttaaaatcttgttgttaataatattaaaatataatttgagtcttcactcaaaactatacatatgttttaatatcattttatggctattattatttatttaatacttttgttaaatctttaaaaatttattccttacactcgctaattgtctaataatcaataaaaatattattattaatatcattattaatttttatgaataaaaaaaatgaatgactaatttatggaattgctgaggatttttttgtaattaatgggcaattcttaattgttaattacttttatatacatgtatcttataaaaaaaagtaaataatgttttgataatttaatttacattattttattaattacttttttatatatatttatcttatactaacaatggaaacaatcatttaataatttgtttacaaatatgagtactgtatttaatatggatgtcgcaaatgtttgcatgggttttacgatagcatttcaaattactatgtgtcatgcttagggttatgctgacaaccaaattgaagccaaaatatacaaaatctaggtggtataaatgtatttgactgaaggatatttaactgatgtaggatccttttacaacaagagtcttaattgatatgcagctttgcgcaaagttcaaatttctgacacctaacaattctcttctcattttggacactgaatgtggatccaacctcaaaaaagtcactgaatatggagtaccaatctcaagcttaaacccttactgaataccacatgaaaatcttgaccctgagcctccaaatctcatcatgattttcgaacaattaagcacgtaccctttatgggttcaacttgtctcacacaccaataatttacccgcgacacaatctacccaaggagagtccctacatattactacttgatacactatccgctctagttagtacctattccactcatgtcttaattgact

SEQ ID NO: 2716 - DNA, 1000 bp, Glycine max
  Soy_ogl_2029 Gm06:22578301..22579300 Cluster 11
cacaaagttgcaactcaaacatttttaaagaaaatcaggcatataatacttaaaccagcaaccgcgttgataatttatttttggactttcataaaaacatatttgatgatgcataaggcaaaattaagcatggtaatttgttgatcaaattatgtaggttaagggaactagacattatcatacaatcgcattacttatattcctatatattgggggtaaaaaacctaccccatgataaataattctctttatttttattctacttccaaatttcaaattctagcgagtacccttgttcgttgttcattgttgtcattttcgtttctttttctctatttccaattttccaattttagcaagcacgtcattgttttctgaagtaatgttaattttcttacgtgttttttatgtgcaaatttttcctcttcttgttgcctatgaacctatgcgcggaaaggagagagagcttcaaaagttaaagcctagaagctattgaaagtagggagaatcaaatgaccacgctgtgaagatttaaagaagccgttgggatttgcctttctttaaagtaaataactattattgtttaattaattccatacaaatgttttcaagggtaaattaataaagtaaaggcacttgtcttgtttaaataaacttctcaaaaaataattatagaaagagaaaataaaaatataaaatttaagtttttcataaaagtcaaaaatcaaattgttactaaacttttatacaagtttttcaatttaacttctagaaaactgattttaacttatagaaaatatattatatattgatagagaaataattttatggcttaaatatatttttagattttgtaatttagcatttttattcatccttgtaaaataattttattttttttagtcttttcaaattatgtttgttttgttttaaatttttaatttagatcttaaaaactaaaaacaaaacaaacataatgtgaaaacactaaaaaaaaaaa

SEQ ID NO: 2717 - DNA, 1763 bp, Glycine max
  Soy_ogl_4730 Gm14:7043201..70193 Cluster 11
ataatactttagccataagtaagtactcttattctcccgtatatatttatctgtaaataaattagttttcaagaaataaaataatgaaaattgaattaaagtccctaaacaataaataattatatgaaaatcttgtgatggactgcgacgtttctcattgtgcttctgttcaatcttgtgatgggtttgggtgaataatttaaagtgaaacgtaactgattattgttatttataatcattacaatatctaataatacatgacaataaataattatatgaaaattaaaaaatttatataatacagtgcgttctaatttaattcatatataacttaattaatatatctttaactaaatactaagatgaaaagcagaaaagaaatgcaattttttttcgaggcagaatataatattacagtgggtacaacaagtactcaaacccaaatacaatcatacatcaataaataaataaaaaaaacattagacacgcagagaggatacaatctaaaaggctagaacaccgatttgaaaattaacaatagttcccttggtacaagccattatcaatccaagaccaagatcttacttgataagatctaatatatttactaaatcaacaactgatctcttgaaataaaataattttttgtgtgtgtgaaaagaaaaatacaactacgcatattgttgttcataatgttcaaaatcacgatccatcacgatgatgcacaagtcttcaagatttaacaagctcttcccaaattaatttggggcatcagaattaacaaataatatacctaagaagataatagaccagacaactcaatctcaaacgaggaagaaaacatcatttttatagttagaaaaaagtcgcataatcaatataataaagataattaactaaatataataagcaattattatatttaaatgagatatcaaaattaatttaaaacagaaattatgactaattaaatggtaaaaaagtatgacaaaaattgtcattatattaaaaaacattccaagttaaaaatacaccattattacaaaatataggctagccttttatatatatatatagtagttgtaaacaaacataaattagcctatacatttttttagaatctctaaaaagtaaccactagattattaaacatcataatcatttttttaatctataacaaattggctcataatatgccaaaagttcctaaacttttttcttctaagactggagttatatgttggggataatgagttaattaatgcttcaacaagaagaatcgtagagagtaccatccatgcatagacacgacgccaaatctgttgagatatcggacaagaaaaaaacaaaatgatttacaacctcagtttactggaagcaaaagaacatatacatgctacccctgtagatttatgacgatgatgtttttataagtatctgcaggagaaagagttatcagcattcaatcaattgatttttaacatcttggaaagggaattatgctcattggattcattaggatttgttgcattatatatatttaacttttataagtctgggagtccctaaaatcccaaccccccgttgactcccttcacttgataaaaaaaactaagataagattgaaatttgataatcgagattgtgaattatacttttaagttgtttttttctttaaagaaaaaactatacttctaagttaattagtatcactatgttactgctccatgtttgcaaaaaatggagcttaaaaaaaaaaagac

SEQ ID NO: 2718 - DNA, 1292 bp, Glycine max
  Soy_ogl_2758 Gm08:18865009..18866300 Cluster 11
tctttgcaaaagttgaatttcttgatacgataagactatatattgtttttacattgttttatgttttacatcatgatggtaagcaatgaaggaaaggtttcacgaccaagttagtcaatgcactatgtccttagtgagcaagaagagcaaacaaccttgttagccaagaagcataagatttcaaggccaagtagctcaatgacaagtgttattgatgagaaagaaccaacaaccttggttgccaagaagcataaggtttcatgtccatgtggttctatggctgcaatctttgaggatttgagaccgcatcaagccttgtcaaactccatcagcacccaaacacgatggttaattatttatatcatatattacattagcatgtgttagaatgaacttgctttactatattcaaatttatacttaataataggttttaccaacaagaagaaaatgggtcctaccaaatgtcttaaaactcatggcttaagatatgaagatcgtttgacaagtaggcttaatgctcatggccaacctattggtagttatcgagctaccttgagcaattatttggggacattggctaggaatgcatatttaatccccttaacattcacaagctgtaaaggactaaaagaaaactgggatgacttatggaaaactgtcatagtattacattccactcacctttatcattgattatatttttttaattgatccaaatatttattttaattgatgatgttatgcaggaaaattttgacattgaagagcgtgctaaaagtggattttagaaatcatatgctcaagttggaggagttataaatgtctgattgaagtcaaagtactttttccaaatatgccagttgattgtaatttaaaaaaacaacctcctaatgttccactagagcaatggaaaattcttgttaaattttggaaatccgacatagctaaggcgatttaaatatatcaaattttattatgtgattatttatgttaatgatttgattgtttttgtttttctcatatggtgtttgtattataaataatagtagcaagaagaaaaaaaaagtagagcaaaatatatcactatacacattactggtttaaaaactttagcagaaatacaagatgaagagttaacactaattgcataattaattttgtattggtataatggttttgtttgtttcaaatagtgatttaactaatctttttcttttatataatagacaatgaagaatcctaatggaagagagtcatcttatgtagaaatgtttatgctgacacataag

SEQ ID NO: 2719 - DNA, 1500 bp, Glycine max
  Soy_ogl_1591 Gm05:4664001..4665500 Cluster 11
tatttttaacttgtcattttagtctactcaagtgattttaaattggaacttgattataataaatatttcaaaacttagttaaaataaaaaaatgataataattataattaattactaatataatttttaagaaaaaatttatatactttttgaataatatttaatatttatccatgcatgacacgagccaatatattttagtaattgtaccaaacaaaataaggggagatactaaagcaaatcaaggaaaatcaaacaaatggacttttgtccctacccaatcaaccaaacaaattatcatccaaatattgaaccaaaatcccatttatcttatcataattcctaaaaaactcgtgggtaaatcttttttaaacagtgcatccaaaataatcttaattaagcataaaatcctaataaaatactcttatgaaaaataaaatcttgaaaaaggaaaagatttttcattaagaataaaatctcccatgataaaaaaaagaagatatgaatatccttaataacataattgtaacggtaacaactcaattcaaatgatcctaatctattgtgcacaatttttgcatcgccaaaaggtgaatgccttgaaaattaagctatcgcattgtcttctctgtgttttccaaaggtccctctaaacccttgctgattgtgagacccatctcttacaccattcagaggaaagatttgatcagctactgatggaatacggatattgcacttttgttgctcctcagcctattcaaagaaagcgcaaactttacgtattcgtgatttcccagaaggatgtggtcgttttgccataaggattgatgatcccaagtccaatcaatccaaaatactcctccaatgtgtcaaagcgggttacctaacttagagctcgagaattactaaatataggactattggaataaattccatttttaaaaaagaagattttttttttgggaaaaatgaaaaaaaaatcttcttttttagttgaatgtcaaggagttaaataatttaagataaaataccaaattaaagttgattaattttttttattcctaagaagcgcatattttaccagaatcttcttctataatgacatgaaacaataatatcattgaagtagatacactaattactttagatataagaagtcgagtaaggggattggccaggttgtctgtgatggttcatgtgctcgtttgaagatggctaaaactagaagcaatttcctaaatgaagaattgttcaatttgttacactttcttgacgatatgcttatccacaacataacatgtatgtagattgcaagccatcgaaaatgataccgatgcaacagaagtgggtactaatgttaaagttgatcctgaagagaatgtttcaacaaaaatatgttagaaatgttataaatcattggtgattacaatagcatatggaatttttcctcttttgtcaatgttttccttgactatgtctatcatccgctttaacacttca

SEQ ID NO: 2720 - DNA, 1200 bp, Glycine max
  Soy_ogl_5989 Gm18:7927501..7928700 Cluster 11
cagattctaattgaacttttcttttgttatatatacggaattaatatagtatataagttgtataaacaaggtgtggtccccttcaacgtaggtgcactcttttattaaagtaattccttattttaaaggagccaaaatttaaagtcttgaccatatataacagtcatgaaatgttggtccctgatttggtgctgctgcactgtctgcacatatttacatacaagcttgaatgaagtgtaagagccatatataatatatagaaagagagattaattttcttctgttttcttttttgagataattatatagtatgacagattccaacaaaatgcagtaaaaattatgaatatgtataaacattcagttatgcgaactagctctcaagttgcaattagtatttcaagtaaaaaggttttttttttatttttattttataagcagcaagtatgggaggaagatgtaactgcaaattttgtattagattttccttaattaaatacctgcatggctgcatgttcttttggaggttgggaaagagaaaataggagaaatgtattattcattatttttgaagaaatataataattaaaaaagattgaggatgaaagattatccaatttctctgtcccattcacagactttagacttagtgagtatacatatagtattagttaaaaaagaaatgttagtaatatattttttaatatatttttatcagttaaaattataaaattataagtaaaatttattaagtaaaaagtaaaactcacaattgagatcctcagttcgaatggtaatttgtcatatgaactgattcaaccctgatacaaagcgtaagtgaaactcacataatttctttatttttaataaattttaatcaatatctccacatgatgtaagattctaatatcttagatatacctagatctaattaagcattgagaaaagaaatttaatagagtgcttgttcatgaaattttacccccaaaatcatcataattaaacaagaaaaattcgctacttggaataaacacagaaaaattactcaaattcataaaggaaacctgcattgaatataaatatttatttacaaaaaaatcaactaattttatttaccctaacctagcttttttttggtgtttaccataacctagccaagatttaaaaaacatcaagaaaatcatgaatttaaagaaagaa

SEQ ID NO: 2721 - DNA, 1300 bp, Glycine max
  Soy_ogl_2633 Gm08:12416201..12417500 Cluster 11
gggtgtgtgattggtattaaaagaacatttttatttgtttaattgttttcactttggtaaattctgtaactccctttagaggtgtcttgatttcttttacttccaaggtatgactaactgctgtacttccaatgtttaacaaagtcttatatagtcaattaatcaactgtatatttattttctaaattgctacagtaactaacttggcacaactgtttggttttttttgttatcattaatttaatgtttggtttaattttttttttcttcctcttgtgtgaaagcagtagactacttgatgccatactaaggtcaaaacataatccaggtatactggtgatagatcactcttgtcatcatcaattgacacaactgggaaaggaatatttgacaaccctcacttccttctagctttttattggctaaaataaaaatcttaataacctaggactaagcaaagattcttcatatgtcaacatctgtttttaaaaggtaaaataaaaacttcattcttttagtattcttttcaagacaatcctttaattgtttgacaaatattccttccattttgggtggtttgatgatctgacaaatagaaatgaagttattcaatttctgaaacattttggggttctaatattttgttttctttttaagagattaatttcaaaagccatgccgctctacaaagtggatttaacacaatattataattatgttgatcatgttgacagagagcaatatacaccttgatcagttgtttgtttaatttggagtaggtttcttcaccttaagtatagagccacagaatgtgaagaagcaaaatttctaaacctcatcatcataaaatttgtaccatgaagaaattccaatgcaaaatgaaaataagaaaattggttaagcaatacgcagcaacaaagattatgtataatcaagtttagaagctacaatttggttggctatagagtatgcatcaaatgaatgttatgcataatcatttcatctatccattcaagtttaattttaatcttaaattttcgaagattttgatttagaggagcccttcaccatgatccaactaagacaagcatcatgccaataacatgtattctacatgaacatgcaacagcaaaatggaagagaccaaaaccaagccacacgcatatgtaatttcacttttgaacaaccaaataccccatagaaacacattttatgcaagtcattcgtatcttcaaggaagagattaaaaaagatatcaggagagtatgaaagagacgagtacctctctcacaatggaaga

SEQ ID NO: 2722 - DNA, 1200 bp, Glycine max
  Soy_ogl_532 Gm02:13758201..13759400 Cluster 11
ccctcaaccaagtttctttatgatatactattgtttaaacaataattctgtttggaattgattacagatcgctgtttacatatttcctttacttgaagtaatagagaggggagattaattccttcaaaaaaaaaaagagagggaagattaatttatagtataactttttttacagaaaaagaaaagagagaaatgtgtaataatatcattaattaaacgtgatggagaaaaatagaaagaataatattaccaaagttattgtagaaaactattaaataaatttgactctagaagaaaatgacatatagttaattagttatatatatacattaaaacattggcatctgtacgtagcactaaagcaccaattcttccttctatcaggaaagggtcaaatatggtcgagttgttaaggtttgatgaggtcaaaaggtcagtgtttcttattattattacagatttaacagagcatattgggttggaaattttgtctacaaatccataaatatttcgtgtgtagttacatagtgtaaatgagatgcgcatgcctttcgagtgatgtgttcatgacgactgggtgccgtagcattagataactttaccatgataacatttttttagcattaaaaattaaaatagtataagttaaattacaaaattttgtttttcatgtatctttttctatattactacaacgtcaacgtttaacacacaaatctccattcaacttcaatccttgggatcgagttgggactaagtggcttttttcttcacttatgtaaatcctcgcaataaaattagttcaatttcttcttcttttggttggattaaagagcatgtcatgacttttacaattgaatttgaagagaatccgtatgtaaaactacaaagagttagtgtgtgtttggaaaacaattaaatctaacgtcaacgggttttcagataaaagttataatatgtaattgttttgacattttttctttgaaaagtgtgattttttttgttaatcatgattctaacacgtacgtattcaaacacatccttacatgttgacgtgaaatttacatattaaacatgttgtgaaaatatgtttttaacccaaaaaagtattatgtaaaatataagaagaatatctactatgagaaaaataaataaactacaatgaatgattctcatgatttcgcatctttcacaactcac

SEQ ID NO: 2723 - DNA, 1000 bp, Glycine max
  Soy_ogl_1964 Gm06:15604101..15605100 Cluster 11
agtataaaatctctttatttgtctatagaaaattaggtaacgagttaggtaattcttcatcatcactttatcgtgtttgtctagaaaaccagtttcagattcaatgagtatcctttacatgtaatgtctatgcttgcgacaatgctagttgtgcaatttcatgagtgtttatagagaaccaggtatcgtcttggatgttagataattcttcatcatcactttatcatgtttgtcaaggaaattaattacacgcaatgtttatccatgcgacaatgctggttgggtaacttcaggatcatgtccataaaagttaaccggatatatagttggtattaaggaaatgaacagatgagacaatcagttactgaataggctgagttatcgaatagagctttttttcttttttttttgcacttctaaaataaatatcaaacaaaattttgttgttcagctgttaaacttctgtgagtgtaatttaccattaatatttttttacgctgatttaccattaatataaataccagtataaagtctatttatttgtcttttctcgtatttgttcaattaaaaaataagatatagaaaaaagaaagcaatacaagtagagcatatattactttaataaaagataaatttcgtaatggtactatcatttttaattacaatatctcatataaattatattatatcaatcgtcttaggaggtgagttcagattgcgatttgcattatttacagctttggtgacgaaattgggatttgcgtctttatctgcaaattgcaatataattcttggcgtgctgattatgtgcagccattataagttgacaattaatctttgtaattttgcactttcgtggatcttaactcttaacgcgctttaaacttggattattagaagattatggtgatgttaaaaatagtagtcgaagactcgtagaatattatgggaaggaaaaataaagtagccttgctggataaatggatatcatccgtgtacg

SEQ ID NO: 2724 - DNA, 1400 bp, Glycine max
  Soy_ogl_2701 Gm08:15296401..15297800 Cluster 11
aaataataaaaatttgatggtaaaatttgtaattaaaccaatatactaattattggatatgataaaataattattctataaattgctgtaatcaattacttgtttcgtgcattaagaaaatatgattttctttaaaaaaaaagtatgatttacttatcctatcactgtaggataacacgtgcgcatcatgaagctaatcgtgtggggtttgccttgaggtctcatcaagttaaagagttaaagagttcagtaattctctactcctacagcgtccttgctttgggaatattatattgggggtttcatacccccgtattaatgttaattaggttctagtggtttttgcctccccgtaagcaaaaaaagattttggattatgagccatttattttttattcctaaggatgagaccttgtttcttggatgtatgtatctgtaataagttcttacagaatgtaaaagttgtgaagatcacgtctactttcttgatcggttaataaagaacgaatctagaatttttacatcattttttagcatttacaatatagaaaatcaagttcttacagaacgttaaaaattgtaaactgcctatattaaaaactatttttaatttgcacgtatggttcttgattaatgtatttcactgaagcacaacctggttctgtacttagtgtcatatcggagttgcgatagtggcctacaaagtattttatgtgggcatgaaaatagatagagtcatagagaaatactaatgttggcatgcttcctggacttggttattttgggagagtccttgtcaattaatcttaaatggattgaaaaatgattatgttggcatgttctaccccttgccttgagttatcagtaccctttaatttgtactcaacttggtacgtattaattttttttacacagtactattaaattctatgttgcttataaaattttattttcacatataaagtccaagcagagaaatgtaattttttttaagagaacagacaaatgtaattatatactgtatattactgatagaaaaatactgaatattttttaaagaggaaaccgcgccattaaataggctttagaaaaaaaactcatgttgatgtagtgcattaattttggagtttgaacaactttccatcattccatgcatctccactgacaatactaattaattgatagacaaaggaacacgatatgtattttagtttaatggtgttttgtgttgataccttattacaattctttagacgttttaaccttgttcttatcttttctctcaatttcactgataacaaaaactggtttatttatcaaaataatataaattttaaaaaattgttaaaatgatatattttaaaaaaatattattattttaaggaacttttaaacgcgtg

SEQ ID NO: 2725 - DNA, 1132 bp, Glycine max
  Soy_ogl_2804 Gm08:34858969..34860100 Cluster 11
ttatatagaggaaacaaacatatttaagtcgttaaaatactgcttaactcgcaagactgaaggagatgtgtattcattaaccttaccatatattgaaggtaagaaatatattgttagggagtttaaactaattaaatctatattaatttcaactaaatctgcctgatatatattttattgtatatgaaattatgcataaggctaaggtgcatgaattaaagtaatgtgaaagtagactgttacttccagtttcctaattttgttcaagtaatttcctacagcgagttgtatgtatgatagaaagtagttttttttttctttgacggatgatagaaagtagtttataagtgaaataaagattttaatctgtgataggatggacaacaattgatcgaaaagtagtttataagtgaaattttaatctgccgagtaagcaattgtattaagtttgttcccatgccacttttgaaaagatacactatattaacaatttccttttaacgtaagctaaactcatcattaagtttaattgcggaaaagcatatttgaactaagattccgataatgggaaggaaaaaggtacaagaagttatgcaaattttgagtctagacaagtttattctattacaggtctcacaatacccaactgatcgacttgtttcagaaaactcaaaattcatgaatctgcgaccaaattcatgtcactttttcctccggttatgctataatgtgatgattaatgtcattctctctgactacaatttcagcttaataaattttctttcggtttatcaagggttgcagcacaaaagcatacagaacaaagataaaagaagaaatagattactagtccaaatgatgtttccgttcgttctacgtaatgagaagtgtaaaacactgccagctctacacactcactttgaataataatcacgattcacgagaacttttacgtactttgcatatcctaaatttaaggcatgctagatgagcaaatcatttaatattttagttaattaattactttcaattgttgcattcaagaagcggattcatgaaaagacgatgattgaaactgacagccgaaaatttagaaaaaaaagagatccaaaaaattgagaaatataaatta

SEQ ID NO: 2726 - DNA, 1100 bp, Glycine max
  Soy_ogl_1610 Gm05:15231401..15232500 Cluster 11
aatttgggatgaagtttcaatgacgcataaattctattttgaaacacttgataagagtttgagagacatcgtgcatgagagtttacaataacgctcatttaacctttggaggcaaattcattgtttttttggggactttagacaaattttatcgatcatccctagaggtagctattatgatattgtccatgtgtcatacctatgtgagcattgtcaagtattaactctgactagaaatatgtgtttacaatcaggtttggacattacaagtgctatagaacttagccaattctcaaaatggattttggatatcagtgatggaaaaatatctgaaccaaacgattgttacgcttcaatagatattctaaatgaatttctcatttcatttgattacctaataattgatattgttcgaagtacatatcctaatattattgaacatttaaatgatgaggaatttttgcaatctagagcaattttggaatcaacaattgagactgttggtcaaatcaatgaatatgttctttcgttagtttcaagtatttaatttaattaactttcaaagcaatactattctgcattacattgatattatataatatgcacgatttctagcttttaaattcaccatgggataaaaaagaatatttaagttctgattcaattgacatgtcaaacaccattggtagacaatcatttgaagtcctaacccctgagttcctaaagctaaaggattatacaatggtactagattaattgttgcaaggttaaaccatgtcactgaagcaaagactatgactgcaacgaaaatggcaaatatgatttacattccgcgaatgttattgtctccttcacaatctccatagttttttaaacttataagaagacaattccctattattgtctcacatgtcatgacttttaacaaatcataaggttaatcatttgtaagtgtgggattatatttgcttagactaatgttcagtcatgaacacagttatacgtggcaatttctagagtgctgagtaaatgaggcttgaaaattttaatacatgataaggacaaaaaaccatgtaagactactgtcaatgttatattca

SEQ ID NO: 2727 - DNA, 1054 bp, Glycine max
  Soy_ogl_2332 Gm07:14372347..14373400 Cluster 11
attagtagttctagctagttgaaagttatagaaaattgtaaaaaaaatgagtttcagatttattaaagaattcgattagtaataaatttatatttttttgtaaattttaattattaattaaattatatattaaaatgagtgttaaaaatgtgttaataacatcatctttaaataaatcacaaattattgagttcatgactcgcacaattacaaattacacaggctatatattcacatgtcatgagtggttgatattccaatttccaacctctaataagtgcctcgatcgtgtacaacctctaactgcgagttacgacccgtgaaaatgaatagggttgtgttatgcatacatatgcctccatgtgagaaagaaataacgctaacaagagagccgtcaaacatgtgaaaatgaatagggttgttatcattcctttgagagccttcaaacaatagtccacatgccacctacaagggagagataattatgaaggttggggtctgaatacattacctcataagactagggttttaatgaaagacaaacacattaatatataataaaaacaaaaactagaaagattggaaaataaaaaaagaagggtaaggggtacattgatttgattatccttttctcgtggcatcttggaatcaatgaacgagacattggtaattgcagcaaaaatataaatatgtgctcactactgaaatttgaaaacttaaaatggattttctttatcggttgtaatgaaaatcagtgtgaaaaatgactttgggatcggttcttaacacgaatgatttagaaaatcttgtttgaaattttaaatattggaaaatacatcaacatttaacattaattatacgaataaaaaatttaaaaagtatttttagattgatactttgtacaattgatctgaaaaatgttatcaataatttcaaaagttataaagacgtccacattctatatcaattgtccaactaccaatcttcattcttccaaatactttttacattaattcttaatacaaccaatgtataaattatttttaaaacaatc

SEQ ID NO: 2728 - DNA, 1000 bp, Glycine max
  Soy_ogl_2387 Gm07:35848801..35849800 Cluster 11
taaactgaattggcgtttgccaggtacaggttaaagaatttgggatttaacttatcagacctttaattaaaatacattaacatagtaaaagttttttacaactatgtttttttttttttacagaagcttttttacaactaccagcttatcaagaattgttatctgattaaaatttattaacctttgtaatgattaatctaaaagttaaacatggagtgatttttagctggtgaaaaaaaaaatagactgatagtatatcaaaattaagttcttcaacaaattcttatctgggtgttaacacggggttataagattgaatgtttaaggattttttttccgctaagctaaaggagcagtaaatggatatctttttggcttttggtaattgtttagttttgtaatgaatttaaattttttaaattagaatatttttttggttgagttgaccgatgcccacaacagtgattatgttttgttttttacgtaattactaattaccctaattttttattagtagtcccataatcagcggctaaattattgttaacggaagagtttttaacagctaaaaattaaggtcaatttgtgtaatgctattgtttgcagctgtggctgcagctagcggtgaaccttgcttaacaggggaactgacctgcatgcatgcaattaagtgttgaatgttgatcttatcttatccatacgatcaagagcctctccttaaggactcaaaagtcaaagttggacacaccctcaatgaggccatttttgtgcggtgctgcggatttacttgccaaatcaggatgaggatgaaataatagtgattgtaatttgtaatatcatgatttggacacctccttttatttggtataaccaggaagtgtaatctttctcttatcgggtttatttttgaagtaaaattgatattttttattattactttatatcaaaatcaatgattgaatcttaaaccttaattaaaagacagacccattggacacct

SEQ ID NO: 2729 - DNA, 1100 bp, Glycine max
  Soy_ogl_3070 Gm09:28489701..28490800 Cluster 11
tggctggcatgcaaaaatggggggactaagtataaagagcctcgaccctcatccacgtactccatgggttaattcatgtgttatttttctttcttccattactattatttaattattatcttaacatttcatttttttgctcgaaagaaaagggtaaaattaattgtcattatgttgttatataattttaacagcgatgtttttgttctttttataaattcaaataacatatcaagcaaataacatattaaaaaaatggtttacttttcttcttctgttttttagtgtaaaaaagaaaagatcaaaagaataaaaagtttacaatagtggtcaggtaaagttttaatttccttaagttaacgacttcaagattctaaaacttttcacattacaagtaaagtttaggtcattaatttgtgaccaaaccactgaaagatagagactgtataattatttttctattaattactcttccattttttctgttaaatattatttttacttaacttttgataattttaaattataatatgtttcttgtgatagttagaaagagttattagagtaaatgaaaaaatcaattatatagcagaaaaataaatggatgactaactcataaatcattttataaaaaatattttacattagaattcttcaaaaaagctaaaatagaaaactaatatccaatcattttttttttgaataattgttggagcattctatggggaaaaataagtgatacatgttaaaatgttacatatataaaatttatagaaaaataagtgattgttggagactaggaggaggtctccaagaatgttgtttttggtaatagactaatagtattcacatgcaaccactgattatcagcaattgcattttagaactgtaattattatctgtgggggggaaattagtgggcatacaaagaattttttttggggtagggaggaggggaaaaagaaaatttgttggaaaagttgggacaaaatttgtcaagcaaaaaaattagtaagcataaaaaatatttttgttttcaataatgctcttatgataaaatggaagtgggaacttatgatgggtaagcatgggctttgtga

SEQ ID NO: 2730 - DNA, 1000 bp, Glycine max
  Soy_ogl_595 Gm02:41287301..41288300 Cluster 11
ataaaattatgattttcaaatatgaaaaaacttttatgataccaaatgcccacataaaaactattcctaaaaaacattctttcttgaatttttttcttttaaaaataaatactaaacatgagaaaccaagactccaatttaagattccagggatgtaacaccatctttttctctagatttctttatttgcaattattaaataaaagtatttttttaaaaaaatttagattgctactattattggttgctaatttaaataattgtatttcaaatatatttgactaaactaaaaccaactattattaattagttttgaaaaatattatgaatttaagtaaagtaaaattttgtgtgtatgaaattattgtctggatgaaaataattaattaaaattaaacaaatagtgtgtgatagttaaattagttagaggagtataagaaaaaaaattaattaaatagatgactgttaattttaatttattaagtggtgaggttagtattaaattgtaggctagttatcaatgttgtaaagtccaaacagtaatttttttttcccgaatctgggtaatgatacattctggaaacccagtttgttaaacaacaaaattgtatgagggcagttgtctttcattttggctcagcctgtgtgtcaatctcctctgaagtgcatgaaaattttccttctctcaacctctagtgtaaccgtaacgacgtcattaccagttcatagccggtattgattaattactcagagttactaaaactttatactgtaacggctagagcttcatcggaaaaaggagaacctgagttgcacatatagatttttgttgctgcattaagatgaaaacttatgaatagaatatgaacgcgagaagctgtggccctgtagtacatacgtgtacacgtgaatgtagaagaaggaaacgtgatatatttttcttttcctttcctaatgaagtgtaattggaccgagacttacactaggctgattaataata

SEQ ID NO: 2731 - DNA, 1456 bp, Glycine max
  Soy_ogl_1628 Gm05:29279918..29281373 Cluster 11
tgtctagaagcaaaatccctcggttaaagtggaaataataattcattatgcgtgtttaaggtatgaagggtatttaactaggacgggcccttctgaccctttcatctaaaatttaatgtagatatacaagtataggacaagtaattaagacactccgtaaagaaacattttcagacataactttcttcgcctacgaacagacgaagaaacgcccatcttacattcttctgtcattgtttgtgtcgtcccgcttgtgcaagcacctagcgtgtgcttcaatctaaacatgggcctcttaattacaattgactaatggttcacttgcactagtcaacatgttaaggctaggttttttttttttttttgtcttaagcatttgattcatcgaaagcctctaactaatatagaatttgatcaaaaaataagtaaatttttgaaaaaaaaattactttgattaagaatcaaacttaaatattatttaaataattcaatcttaatttcaacaaattaattatttatgtcaaattacttgatttgactaggttaaaatattattaaaataacaataattaatttcatacccttctatttgtcaaagaacttagaaatagaaacttcattaacatgtaaaaaaaaaaaaagaaactccaaataactgaagagttagagtctgattggatatataaatttcttcaaaatcacttataaaaacaatgaaaaaaacttttcataagtaaaaattaatttatgtaaaatttaattggtagaagttctctcatcaattatatcaaaagtttatttttttaacttatacataagttaatgtatagataattttttttcttttttttctcttataacttataagtatttttggaaaaaattattcaaacatatccttaatcctttctctatcttaattaagtctgtgagcaaatgaggtctaatgtttcaatattgttatatatcattacctgatgtctgtctcattattcccagagtttgttctctaggatgtaaccatccatttctcccaaacgctgaccccccttttccctatcaaaatattaaagctagattttctaactaggatattggaatttgaacatgtgctttttctatttttcgagaatacctttgaaccgtttgtgtcgtctgtgttgtattaattcttaacttttacatgctttatattttctgagtctatgatatactactacaagaaaatatattgtcatgtcctaatactagacagaaatgtaagttcttaaacttgtcttcggtagtgtataattgttgtctaattgatcgaatcatgtaaaattatcttaataattaatcatgatcaatatcatactttaaataacttaaatgttcgtaaattaagatgcaattttataattgacactgtgaacgtaataaagttacttttgtagcgtgaaaaagtcaaagtaac

SEQ ID NO: 2732 - DNA, 1300 bp, Glycine max
  Soy_ogl_2376 Gm07:34312401..34313700 Cluster 11
aacttgtccaataaaaaaatggttagaaaattttaaatcttatttttttctaatcataatattcatctttttaatataatttagtttgcatttaaaattcagaattcaaaccttaaaacttaattaaggtgttgcaaacatcaactatataaagaacaaaataaaatctcaatcgaattctgattactactctatataaacaaagaattgttcggagaatctcattacaaatatttcaggggacttgcaaagatgcgtaacaagtattgcaacaaaccaacgtctttttttattcatgaaaagagaataatgaagttatttatgactccgtttgcaaagatataacaaattagagagatgctgatgaagtttgcagatggaggaagtggttgagacatcaataatgaaaggaatagggaaaagaaaatgggtaaaatggctagggaaaagaaatgtgacaccaactatctccatgaactatagccaataaataaatcatttgatatgaattagaatccatatactaaatatatatcacaatttaaattcatattcaaatgtgtaaaaaatacaattaaaagattttatttatctatcacaatcctatctcccttcacgcaattaaattcttttccctatttttttatgttatttgtgataaagtttatcattaaatgcaagtttaatttatcatttttaaggtattgatacatgagaatttctttctctacttcctcatgtcaaatattaagaggatggaccatagccacgagcaagcaaatattaagtatgtttggaccttaaccatgaacaaacaattcaactttgtaaatcaattaaaaacaccaaattgtacaaaagaggataaataataaaaacatgtcaatggaatataagtatataaaacaaggcattaggtgtattaaacttgcataaagatatcaggacaaaaaaaaaaaaaaaacaaaactatacacacaaagaattgatccaaaaaagaaaacatttattggtgtgtcttaaactttaaactatcaagtccatatattagtaattaagtttatttgattgaacccttaaacaaagaaaaaaggtttatttgattgataaaatttaataaataattttaattctaaaaccatttatatataataaaatcaatataagtatattcgaaatccaaataaataataaaataatgttttagaaaggcatgagattattggaaataatataattagattaagaaaatgatattggaaaatacaaattgttgtgtatattatattattatattagt

SEQ ID NO: 2733 - DNA, 1000 bp, Glycine max
  Soy_ogl_4275 Gm13:26303901..26304900 Cluster 11
agtaattttgttaatttctttattttaaattagaaatatttattcttcttattttttaaaatatacaattataatcaacttattttaaaatataaacattatttactcttttatttttgcaaaatttatgattttaaccctcctgtcaaattaaaaacattaatattaagtatgacatagattaaataaataattcatgttacatcactaaattttaaccatatcaaattaatttcttaccaattgtggcttttgaaaatttataaaaaattaaaattatagattttataaaattgaaggtgtaaatgtctttattttaaataggagaaaaaaattaagaattttaaaaaataagaaaatttaataaatttatttatttaaaaataaaagaacaaaattataaattttaaagtataaagagatgaaaatgacatttaattccatattcttctcccctaatatatgcataaatagacaagaatgaaactaaatgtctaaatgacgtcttggtagtgttgatggacataattttctaaacgaattaataataagtaacgggccttaccttacataatgttttaattttatttatttgaaagaagggagaggaagtcgaacaggctgttaaactgaggcagtgaccccatgaaacagacaatcccacctctccatctctctctatctaacgtactcctatgggaaattatcacatgctcctgcttgcaggctccttagcatggtcccactcccatcaccattcattcatcactctctccctgcctgtctgcgcgtgcttaattttcatttcatttcattttcctcacccgtacaaatccagaaatcctttcttgtgtgactgtgacagcaatataattattgaacccataattttcttttcagcttagtaagaaaaacttacacgagatgcataatttggaatagatgattgatgtcttaagcatgtgacatgcacatgtataaattagtaatgtatgtatgt

SEQ ID NO: 2734 - DNA, 1300 bp, Glycine max
  Soy_ogl_5979 Gm18:7444301..7445600 Cluster 11
caaaaatatctttttagccacgtctgtgcaataaccttatcttccccgtcccttttgatggacggcaagagacagcgaaagtattgaattattaggagtgcttgacaaaaatatgggagacatgcagagttgtggatctaaggttaatttgatagtgagatgttgtaaaaagtacttgatattacggagactatagatatatgcttcctattgtatgacatattttaaaatggtggaaacggatggaatcaagcaaatagaattatagttttgattggttaagctaagatgattggaattaatgtgatctaacaaaatgtatttatctgaaggttatttttatgtttttttttctccttcaaattttgggtatgaaatggagaattcaggacatgtttggcttgagattttattattgttttcaattaaaaatatatcagtttattttaaaatatttgtaaagacaatagtaaaggtatttttttattttaaatttcaatacaaatctttgaaaatagaaaataagatggtattttcacaattaattataaaaataagaaaaaaacattttcttagaataaacaggcttttgttttttactaattaatttccaaattattcctgctactacatatatacttcctggcaaatgcaaattgtactctcatttacatattgtaaaatattcaaacattggtatcataattaattttatttcattttaatcacccgtattatattattcaatataccaacatagcttcatatatatatatactcaccatgggatgttcttaacatcaattatatgaaacaagttccagcttgtttccaccttctcctcctctccactagcacaatttcggccatccttgccactccagttctacagaggatgggcgtctggaataattaaaaagaaatggggaaagcatcaagcatatgttgcacaataatgtaggtgttacaagtcacgtacgcctttagttctctgatagcgagtgatttttgtgtattataaccgtagtacacaacatgcatgatgaattaaaagaaagaaatatgtaattgtattgtatggtaccttgaattattggtacagggaaaataatacataacaaaatatatggacaatattcattttgtaaaacttgtgtatctatattttttcttctttaattatacacaacacttacattagatagacatatgtaatgtaaatcattgatatgtacgtcttctcctaataatttcaactttgtgattattgattcattataagagtctttatgaccaacct

SEQ ID NO: 2735 - DNA, 1546 bp, Glycine max
  Soy_ogl_6013 Gm18:9900955..9902500 Cluster 11
gtttatgaataattacatttgtaatcaaaagactttattagtttttcctttatattaatttcattgcaattatactcacctaaaaaaattagttacaattatttgagaattaaaaaattatttattattaacatttgcaaatgaggcaaacttaccaacgttatacaagagatcggcaacttaattaactttgatgcatgtcaacaaatattatctctttgtgttattattattcttataatctccttttgttctttttttctctcatctttatttattgtcattgttttataggctctgatttctgaagagcttctttctctcagcataatggccattatcataacaaaacattattttttttcttacttcaatttgatatcaaattcttttttaataggtaactattattattttagctataaaaaaactaatattattttaaaagtaataaggtgagtaacataattcattttagttcaaatgttttataacataataaataggatatttttgttaaaatttattattagcatatatatcaatttttattatgaattaatagttattaatgacatgcgaaattcacaattgacattggaaatttttagtctttcataaaaagatgtttagcttatcttttatgtcaatatattctcattatatgctcttgattttaaaaaacacacacacaactataaatatttatgtaaaatttaagatttatatgtttattaagtgaattttaattttttaaattgaccgcttagtcttttaatcctccgaacctacagtatctaagccaaataataatatattttaattttagaaagacaacaagtctattagaaattttacatagattaaatttgaacatttttatatttatgtgacgaaaaatatattttaacctatttaaaataacataaatgaattgagaagcaaactcaacgtacttaaaataatgttttattgaagaattaccaagctttgtcgacctagtagctatagcaaaaatccattggttttacgtttaagaacaagaaatattcgaggaaatgagactaaatggaaatggattgtatcaagcatagtagaataccaaaacataccaaaacatcttctccaatagattttccagcattaacaagacaaacaccttgcaattgttgaaacttcaaaagtgttggatttattggttcgatggattgaaatccggtaattcaacattacattcatttgaacacatcgacaccaattgaagatgagcatagtccattcttgctttccatttactattatcccgatgaaaattggcctacatgaagatccttcaaggagcattggaagcatcctaacatcatcatgaagcatgagaagttatgaacaacaaataattataaaaatttcatgtttcatacattaggagaaaacatcaccttgagaaatgaggacaagaacacaattatgttgaaaatattgatagttgaattagccattccaaaccacacaaatgcaaggtccaatattattgaatttattcagg

SEQ ID NO: 2736 - DNA, 1172 bp, Glycine max
  Soy_ogl_94 Gm01:3819801..3820972 Cluster 11
tacaattttgataaatggaaaaatatgaatagaaaaaccatgtggaaaaaaattatgtatatagtgatttatttaagatgggttgagtcacttgtccgagatgtattgttcacagggagcaaactcaggtacaaattggaatattgttgagttggttgagattagaaagtcttcagatggtaagaagcttttcaatatggatgagactctgaaaatgaattaaggatgaatatcatcgaaagacactttgatgttaaagttggtaaagatttaactagagtgacgatatataataaatgcttacctatatggctacaacagttacattaattgtctttacagaggtttgttataggtttgattttttggttccaaaaccatgccatgattaaaaggagaagtcgcaatatcaaattatttgaattaagtccattttggaaggctattatctttaagtgtgtctcacaaactcagcttgattttaggtttaactgtattttctatacctaattttttaatttttggtgaattttactctaaacttttaaggaatttgtgaattttacttcaatcatttatctattaataagcacaaaaattgagggttaaatttgtcaaataaaaattaagggcaagaagtgcaattatattagaaataaaataatatatgataaaatttgtaagttgatgataaaatacgtcaaattaatttatttgggataaaatttgcaaaaaattattaaattaaggggaaaaatacaattaagcatgattttatcatatgtctttcttaaatttatcttaactagaaacttaaacacccatttttggttgctcaaagattaaaaagttgaagataaaaagtgtaatcaagcctgattttatcacatgcctttcttaaatttattttaactggaaatttaaacactcattttttattgctcataaatatttttctactaggttttttaaactcattttcataaaataaaaatgggctccactaatatagcccagatcacatccaatgtccaatgatcatccaataaagtccaaatccaatatgggccagaagttaccagtctaattgcgaaggttaatggatccgtagcctttcagttggaccttaaaaaccaggcatccagtatgaatttgatatttgaatcctccac

SEQ ID NO: 2737 - DNA, 1600 bp, Glycine max
  Soy_ogl_463 Gm02:9969001..9970600 Cluster 11
aaatatttctaagaatacatgatcaattaaatattttagccattattaggaattgtgtgattcccatcaacaatcatgctttctaacatattgaccaacacacattgctttcttattaataaactccacttataatcttgtatagttttcaataaattttgagtaataataaaaagtatatttcagtcaaaggacacacacttcgagcatcatatattatagtaggaaacttgagcgaatatagacataatgcatacaatgcggcttaaaatgctttcatcacggacataataaaacagtttagttcccttaacactacgagatgacaaattattaatccacatacatcaagaaaaacttgcactcagacagagtggcagcatcatggccttttattatttcttatgcctactcacgttctagatcctaaccctggcaaacttacaaatacaactagcgtagctgttctagctcatgttttatgtaacagtacacgtgatttaaagatactaagctggaattaattacaaacaatttgatcgtgtgcgataaaatagtacctgcaatattagtcatacttttgagtttttgggtacatgagccaccatttttttaattaaggtgcatgtgtcgtaataattatataagtattctggtttggttaggatgcacttcaaaacttgcatgacacaagaaattgattaagcgcttaccttggttttccaaagatgcactttacatcaagttttgaccctccacaagttttggatattaattaaatttttaaaaatattacgaatgaaaaacaatttaattcctcatcaacatatttttaaacattgattcaatttgtaaaattaatttttatttgatattaaaaggaccaaattaatatttactttttaaaatatatttgaagaattaatgaactagcatatgtgtttattaaaaaaaatagtaaagaattcagaggtaattaatcgggagcatcctacattttgtaatcctagagtattgggggacatttctagcttgatgcgagttgttcatcatgtgaaatttttaaaatgaaggataaaatacgtttttatcttttaaaaaattttggaacttagttttaattcttataaaaaatatatttaatttctatacttataaaagaaacatgttttcctaaaatgcaaagactaaaaatatactaaaattttattaaaaaaattgaattaaattttgaaatattttgatcaattaaaaatatattttgtcctaaaataaaatattgctaaaggtacaatgttttctagagtacatgaattcgatgaaagggaaaacaatgtaatgaaaaaagagaggtgaaaaaaaaaaggacataaattttccttttaaaataacctaaagaattggccagtcaattgccttgagaaatcatgtctggtttgggtagaagtactgaaaactgttttttccccaacatgttgtacgaataaataatgaagactagtcctatacttacttgtctttcagtgaactcataattaatttgtccctccctcaactaactactcctgccattcgtaacataactaataaaagttgcaaa

SEQ ID NO: 2738 - DNA, 1065 bp, Glycine max
  Soy_ogl_1644 Gm05:31790336..31791400 Cluster 11
tgtctttacaaaattgaaagcaaatcttacttttggttccctaaacaaattttttagcatttttaattcatttacttattctctattaataattgatgacatgacaattatgtatatgtttggattaaaatttataaatttaattttacaaaagtatccaaagtcatgcttattcaaaagtgtatttttttttacaaaattttactgttaaacatattttgggagaataaacaaatatgattcaaaagctgattttactgtctcatattttaggatcctcccacatcaaaaatccaaatattgataacctaatggcttgtcatgccattaagaagtttaatggaaaaatcacgccaccaactaatttattctatcatgcattcttctcaattagctggattagaccctttagtcaccatcaattggtatgaacaaatgtaatattaaaaacattttaaaaattaataaaaatatatgcacggttacttctgtcaatctccttgatgatgtgtgttattaagttgtcaacaatagttattatctcaccaaataatgttgttacttaataatatagagtaaaaatattaatagaaaaaaaagaattggaaccaaaaatactataaaaatgtttaagtactaaaagttaaattttcaaaaaattcaaggacaaataattaatccttaaatttatgatattactaattaaaatttatcaacttaattatctttattaattttgatgaatcaattatatgtttttttgtaaactagggttagtctagcgtagatttttgtataattttgcacaaagtcataggttttaactttgtcgtcgtcattgtaaaaaattaaagttatttatttcatataataataagagtaataataatgatgatgatttttgtttgatatttttatattgtagaccagaatttggctgatgtctcatcattgagtgatgttagctggttttctcttagctttcttcatggaagtaatttggcaagacttatttcttgaagtgcctattgttgttactcgacaactaacatttagaagaggtag

SEQ ID NO: 2739 - DNA, 1600 bp, Glycine max
  Soy_ogl_3861 Gm11:17232001..17233600 Cluster 11
tttattctaaaattattctcatcctacaaggacatcttccaaggtgagaggtgcatggttggaggcaaggcaaccacagatctaaacaagggtatcatttttacaacggtggtattgatcattgatgtaaaaatttcttattttatatcagttgtattgcaaccaatgtaaaactatctatctataaaactttcaatcaaactaatggatcaagttgatgaaaatggtataattatagtatttttaataattagagaagttgaataaactttttaataattaagagactcaattaaacttttacaaatgatgaaaggaccaattatataattaagcttattataaagactgttgactcttgttatgtgtcgggcgaagagttcttcaagtttgctaatttatttatttatctccatctttcttactctttccttgattataaaaatcattcaacgacattttgttcattcacgtgttggtatttagttgtatgcagacccaatatttttttcaccctttctctttattctctctctttgttgtttcctaatttttaaacacatattcggtcttcaaaagaaaaagaaaaagcatttggtgtgaatccaaagtccacatatgttgtgcattaattgattttaaagttatatgattcatgtttagatgattttattataaaataaattaaaaataaaattcagtataattttttttatccaatacaaaaattacctaaaattatttcaatttataattaattttggactataattaattttagactcttctttaacgtgaaaattttatctaaaatcaatttttgcattcaaaatcaattctccaacataaaatcatatacacacatctatatgcatccatacttataaatttaaaatattttagagttatggatattaaaaaaataaaaaaaaataaaggggtatttacaaaataaaaaaattattgatattacacttaatgttattaaataaaactgaggacgaattaaaataagtaaagaacccacttctttttaccagatcactaaacaaaaatattaatttaatataaaacatcacaaaataagtgtcacataataaaaggacagataagtatagagaaataagagcaggtaacgactgtttcatttttattaataagaagtagaaactcaagtttataatataaaaatcactattataattaaaattgaaatttgttaagaaacttaaaaaaaaaatggctaactttaaaagtcataatctttgaccgactgccttttgtttggatgtctatcaagcttaactaaagcatcttccttacttgtgactgctttatatgattcccttaggatttttaagtttcctagaaaataggaacgaactatatttcaaagtggcaatcattcatttttctttgggatattctgtttgttgttttctctctttttctattttgttgtttgtgtagtctctttacgaactgaaaaacgaattcatgatggtgtaagccacctatgatacctgactctgcatactgcatacattaggtcgaatcatgaacataaatgtgtccaccaaaaaagccatttgcatatccc

SEQ ID NO: 2740 - DNA, 1800 bp, Glycine max
  Soy_ogl_6365 Gm19:8156001..8157800 Cluster 11
atgatttcgagtgttaacttacgtgagggcttcgtgagaaaaaaaacttacgtgaaggtgttgtgtgttcaggaataacgaaaggcacaacgatgcctataaaatacgtgtcccatagatttcacaaaaacatgcaaataagtcaatgcctataaaatgctcctaaatagacaaattaaatcatcaaaaagcatgttagagcctcagaggacacaaactgcattgatccataggagaatacactttattaaaggctaaattccaatttttttctccctaatttttcaaatcaataattttttttctttttcttaatggattattaataaataataatgattaattgagttattaaattaattataaattaaccaaaatggataattattaaaaattgaataaaatattattaatcataatttttcataacatattaaaaagattaatgtttatattttttataattataattaatttaatatctctaataattacaataattaattaataatctattagggagattaaaatcataaatttataaaactaagaagatgaaataatatagttaaagatcaagagattaaaattgtaatttattctttattaaaagtttcacatttcattagatgaaagagataatttttttttcacgaatatattttcgagatagctttttgtttcttatgagatagtagtaactttttttgtatggatattttataagaaaaataattctgattgagatgttattagatactagtattaaattaaatatataatcacatttcttaatgaaaattccaatcttaatttattatgttgtgaatgattagtcctttttattagacctaacctttatgagttcatcatactttattttactatttaattttttcatttaaataacatattataaaggggaaaatttaatatagtcattaattaaaatttcagcaataacattataataaaactacatacttatagataaaataaataataaacttattatttcgaaaattattttttaaaattaataactataactataattcactctttgtagaagagtataatttattaagttgcatccatgtttttaatacaaaatatgctagaatagtaagaacctccagtactaccaccgattaggatatcaataatatattaggagttagaactgtgtataaaaatccactaaaaaaactactgtacgtattaattacaattacaataatttatcaaaatcattgcccatagattaaagaaaaaataattattgcccacagatagagctacttacgcaccagacaaaagacattttacaaaaaaataaaaaatgtaatattttggaattatgcctcggatccctcatcgccaagtgcctacagaagaaactagaaagacccttggacgcttaaaagtcttgcaaaatgatctggctccttcacgcagcctaaaagccccccaaaatccttgtgtaaaagattctcttaaagctcttgaatttttttttcttaattttatatttttaatatctttctcttttgaaacgtaaatttcatatattattctgtacatttgcaaattttcttgaaaaaacgaaagttacatatcataaacaccaaattagtatctcactcaatgatttcttgaaaaatcaaaagtcacataccatgaacacaaaattgttatctcattcggtggatctaaaaacattgtgatctctaacccatgaaataaaatcttatagaaatataagatcagttttgttaccttaaaaataagaccagtttg

SEQ ID NO: 2741 - DNA, 1600 bp, Glycine max
  Soy_ogl_5131 Gm15:46736401..46738000 Cluster 11
tctatattgattctttgttatgattatggacccgtttgttacaattttttttatagcaaaaaacatattttttaagataacacttttctatttcccatgcgtctaatttatctttagttttttttttaaatgaacacttattattttacattagaagtatttttttaatccgtaagaaaccgacccgatatataattaaaccacagatattttgagataaaaatgtatataagattttttgttacatgaggaattaaacgaaagatgtatgtaagatgaaattatttttgatttattgtattttaaaataactatagtctttatacactcatttaaataatattgattatgtaattataaatgatttctttatattaaaatatactttaatattatacgtaagaaatgcactacaataattaatagctaggatgatatcattgcatttctatttattcatatttatcatcatcattattattattgcattttaaagaagtgatcataattgtgaaaatattttacgaaaagaaaataattctggacataaaaaggtccggacgatatgtgagttgtggcaacacttgcatgaaaaaacaatttacattaacagtgcttgaatatattagccctgcatatatcaagaaattaagattatggtatctctttacattatacaattttttttctccttttgtattttggagcatataaatgctcaaggacatttcttccatgagatgtaactatagaaagctaacattatttctcaaatcaagaaaatgaaaaaacttttttatttttccctcctcctgcttgttctcctcattgattctggtaagcactacttaccacaaattcaagatattcacttttaatttttgcataatgatttttctcaagattaactatgtatgtgactagatatataccgtttggtgtaggaaatcaagttcaaattaatgacagtggttcccaaaaattattgttggagtgaaaaattgtgtactcatctttgtgacccaaagaataataattgcgacattcagtgcaaatatcaatatagatcagtcaatgcaactggagattgtgaaaaagatgaaggcgacttgaacatatgtgtttgtcattattgtggatctcaactttcatactcattgaaaaaacgatgtaaatgaatgagtaagacgatgaattgaaaaattatataaataaaatggtagtgtacactagattcatatgacaatcgagcacacacacatagaaagaagaatgataaatttacttactaactttaaaagaattattctctgtctatatataactagctgttgttaacttatatcgcatattctttttaaaagtagtataagttatatataactaaaaatttcttcaaaatacacttaaggcgtaatttactaatttattccttttgaaaataagtggacgcttgttagtaaatggatctctctctataacccttttttacttaacttgtctctttttttaacttagttttaaattaccctcatctctttctccctcttgtataaaagcctctttatggttcatccctaggaaaaaaaaggcaacactt

SEQ ID NO: 2742 - DNA, 1600 bp, Glycine max
  Soy_ogl_498 Gm02:11635801..11637400 Cluster 11
agcatttgaagaaaagatgaacaaatttttttaaattgtttaacattaaagaaattgaaagagtactttttttattaaacctaaaatttagggaagaggaaatgaccttttaatcttaggtagaaaaagcctataattcaaggaacacttataaatgtacttacatttatcttagctttaggagatgagtgaaaattcaatcctacaatccatcaaatacgagacttttcatactttactcatccaattccttcgggttgaaagagttcttatatattaggttcaatttgattaaaataatacactataaaatacttttaaattgtcttccaattagagattcacatgtataataacatgtatatggtatgttgactttatttatattgaaaataatttttaattagttgagagtgttaaagtctttgcatataaaagaagtgttatcaaaatctgttgaagtgaagaataatattaaaattttattattatttgattatcttttcctttttgttgcgaaggtaagggttgaatctacttgacttatttcttgcccattgtttgaatggtaatcttttaaaaaattattttctcttttaaaaaaaaaattcctaaaatttgatcacatttttttgtcttgaacttgatcatgtggtttaatggagtcaaaattgtccaacacaatgaattactctcttttttctatttaagtatcgaatttttttttaaaaataagttgttcttatttattcttttgttttcaaagctttacaaatattcttgctgtcaactatacacttactccccatctatttattatttacaaaggcaatcttatttgtgttgaataatgtgtgggtaattaataaagacaaaaaatggattgcaactttttagttacaagtgtgtttgggatttagaaagagcaaatagtagataaaaatgtagggtacttattgattgtaggtgcgtaggaattaggattgtaggttacttattacaaaattacaaatgaaaaaggatgcaatagaaaacttaataaaatactaaaatttatcttatattattgtattataaaaatgaatctaaaaagatttgaagtattcctgtaatgtttaatatagatttattatatataaggaactagcaatatcctctttaatacactccttttaatacactttattattagttagaaataaaaataaactaaaaaattaagagagtttcattagttcaatagtaagacccacaaaaatttatatattttcaataaatttcatcccgtagagattaagttcaaaagaatgaattaaagagagcatatattattaacatatctcttcatatctcacatatgatttaagacactaaattataaagtattctagtttcataggtattttcttccgcacatgtctaatgttcttcctgttttttatttatttattattttttgtcaaattgtaaagaaagtggatgatgtagagaatcaaagtatcacatatagaataatattttttaaatttgaaatgaattaactttactccaaccatgtgactacctttttttcttctttttgtcgtagtttagaaaaatc

SEQ ID NO: 2743 - DNA, 1862 bp, Glycine max
  Soy_ogl_3858 Gm11:16975039..16976900 Cluster 11
tttgaatttatcagaaaaaaaatatctgtaatttccttctcaaataaatgtttattttttttttctaaatagaggtaaagaatcatagatgacataaaatataataaagtacgtgtagaagtaaaataaagaaaagtatgggctatgagttgagacagctgcaaagactttgatttggtaaaaaccatgattaggagacctcttgaaagtagaaactaaagaaatagcatccacggagtctgccttccagaccaggatgccaccgacaccttcggtatctggaacaaccacttctgtttatgaattatgacttccgagcatatagaattaaatatttcttcaatttttttttttatttttcatataccttttgtttttccaagaggatgttgagaagagatattgttttttcttatatagccaatcagtttccatttaataaggaaaaaggttgagtaacctgatgttataactttcatggttgacaaataattttattcattaagtatgctgattaagctaattttattcattaagtatgctgattaggagttcctataacaaaaaattagtcttttacttttgatcaagaaatactctaaattcactcaaatataagtataagaaaaaaaatattttataaatgtacaaaatgcacttcctgtaatttttaaatgtgttatcatgtaaattttaattaaaaaaatccttttagtttttgaccggtgcctgattggcaagacctttgtgaaaaaaaaaagtaaaaattatgtaaaaggttgtcaagagacaatcaattctttttaaatttatcatttatttatctttattgtaacgtggaactatcttaattgctctcattttgtcaatgagaaaaaaaaaatactatgccactcattaatatttctattttatcaaacgatgaatagagaattcaattttctattttcgtttattcttcttacacagtgacaccaaatgtataatattatgttgctttaattatggcagaactaccaagtttagttaaatgtttattgacaaagtatttttcataatttgattataaattagtatcttaataaaatttatgtactagtgtattaatcattattatttacaacattgaatcagttataaattgtcttggatataatttattaattaattattataaaattaataattttattatatatatatatgattgtttataattgagtgagtgtgctaagaaaattatactctgtatgtattctaattaaattacaattttaaacataaaacactttgcttaaacatataacatatttataaattctattgaaaaaaaatgcttaaatgaaacggtgagtgtggcatcgtgtaattaaaaccaaaaatggtgggcatattatgaaactcggaagcttctgatattacgaagacagaatgttgctgcaactacaccgtcagcatcgtgagtgatacacgtgtgtgtcaacactgtgaaatggcaacacgtggggtaagtaatacaactaggtcgtgacaggctcacaggcacgcatttttatatactctaagtgtggacaatttaattaaaattaaaaactgcattcggtctaatataagataagtttgaattcaataaaaggtctaacaggagtatttatttttattttaatttggaacatattgtaatttttttaatttattaaatattaaagctaaaataattttgttttcaataaacctttttcctaccaatacttactggttcagaaaatattctttgctttaacttgtaggcaggaattctattgtaatgctaatttaacttttacttttaaaaaaaggaagcaaaaaagaaagagaattgg

SEQ ID NO: 2744 - DNA, 1700 bp, Glycine max
  Soy_ogl_3862 Gm11:17237801..17239500 Cluster 11
gcgtgtatatagccaattggttcttcggggggggggggggggaaaaattaaacctaatagtggatgcattagtttactagtcaataacatcatgcaaggttatgattagtctaagggttttgaatgaaatcaataattagtagtacaatcaaaagggtttaatacacttttgaattgccatttttcaaattaagtaaaaggaagtttgacatatatgtttcatggcaaaaggaccttagaaatttatgattttcacaagtacaaagagaacgtatatcttctacaagaatatatactcgagttgaatgggaggtaaaaaaatttgtctttaatattatggattaattattgaaataactttatgtcgatttattcatgcatgcgatggtctttaactttttttattctatgaagtcttgagcctttttagaagcaactatcactacctacaagtttagcacaactaattaatagataagttatatgtattaagcatattgtccctttaaaaaatacattttgtcaagagtttatttttaactatgcacgagggaaactttgttgagaaaaataatacttattttaataatctttacacttcgcaagaaattttttaactgtcagttaaactgccactttgttcacaatagattttcataattttgtctttcttttatgagtttgtcggaacacaaagcatgatctcgtcggcctaagaatgatgtactcaaatgtcatctttataatcttaagcactttattacataatatgagaattatactttattttttttagacaaatattaattttttagtttcttaatttttattagtgagaatatttaaatccatgactattatactcccttccttctacatttttccatgttaaaatttactttttattctaaataaagaaacctcagtgcccgtcacttcatccaataatgatgacaaactttcaaacttgaataagaatataaacaatttatcaaggaatttattataacactttcagagttttagtaaattatataacctcatttgttggtttttaagtctcaaaatcaaatttaataaatgaaaaggagttaagataattttattttcataaataaattctcattatttgatttggtttagttaaaatttaaaataataagtgttttaatagataaaattataaaattaaataaaacttacaataatgaacttaatggtttagttaatcattttgtctccatatccgtgtaaactttttgttttgctccatatacttaaaaggactacatacattttattgcctgtagtttttcatgttttaatccttacgcctctattttgttacagttttataccactaaaaaactaataactaaaactaaaatataaaaaagttgcttgtatatagactaaaacgtagaacttttaaatatagaaactataacatattgtctatttttttttcttcatcatgttattgataaaaaaaaaatatctactgatttcatggattagaaaatatgactccacctttaatgaaattcttctttttttaattatggtttttcatttataaatccaaactccaaaatttatttaaaataatcgagttcaatatttaggtacttagtattctctaacttgttggtacttaatactctctgtctaactatttgcagttgtactcgattttaatt

SEQ ID NO: 2745 - DNA, 1471 bp, Glycine max
  Soy_ogl_6346 Gm19:2497301..2498771 Cluster 11
tacgtggactacctttaaaaaacaaaaacttatgtggagtcaatagattataacataatgcatgtgtagttagaaaggaaggaaataagaaggggaaaaaaaaaggaaaatacaatagggatgagggaattaaactaaaagaaaaacagagaggtgagaactgcataaataaattagacatttattaaatttaaaagtcattttttcagtaattattgtgtcttttaataaaaatatatagatgactattaaattttttattaatcattagattattagcctattaacaggtctaatccgattgtttgaactatgtatctttcaaactatttaggtacaactcctacgaataaataaatattacggttaacctatttaaggttgatataaaagaattgttaacaattataacaagtgtgataaaatcttattttattattggtgaaaatctatattattttgtccattataaattatctttttacatacttatatgtggttcatttgtcccaaaagttatcgttcaggatagatttcatttttacatgctaaataaattttgttgtagttaattagtctgtactctttacccaaattcttaaggtattatagtaccgtacagagatattgctcaatttgtttattttcattcaacgtgagacttgttacacgtacttcttactctaaaaaaagtggtctcttattaattattatttcggtgatgacttattattatttcaagtacaactgagtccccgtgcaagataaattaacatgtccttcctaatctttttgtacccaaaaaattagtttaattcaatcatttttctaccccttttgaattataacaattttctaaggagactactaattaagaaaacgacaacatgaaaatttctttatttctgccctggcctaaaagaacgaaaggtagaaaacaattaagccgtatatcacgatgttaaacatgcaaagatgtgtgaaaattcgacccattaagtaggacctgtgatatgtaatataccacttttggtttccttaaattgtagtcataagagtaattgtcaaacaccaaccaacataatatatatattattatttgttctttgtaatgtaagccctacaaggatatatatcagttgtggtggcaatgccaactcaacttattgggtaggacaatctaaatctcaatggcagggaaagtgtaggtcttctgtagaaaccatgcttttcaatccacctcacctatctatggatatggcccagaaatcccatgagatagaaaggccctatgattgaaataatgggttgtggtaatatataaggcctattctctaataattcattactcattgtttgaaaatccactaaacaaaaatttaacatttcaattattaaatcacccaacacgtggatgaattaatatagaattactcaaaatcaatcagtgtcttgaattcacactttgatg

SEQ ID NO: 2746 - DNA, 1300 bp, Glycine max
  Soy_ogl_6422 Gm19:38459901..38461200 Cluster 11
aaaattaaaaatcatattaaaaaatttataataacttacgtattttattcaacaatttatatattaccgtgacttatcgaacacaatccatgcgttatagaatttgaattatataaaggcgtcgtacgctgagaattgtatcagctccttttctacttttcaccaatctggcaagaagtcaacatagaatcatagatgctgttaaagaaaagtcaacatagaaaatatcactttcgagcaaccaaaggtcagccctatcccctaacccaacattatttggcaatggacaagattccattgttgcactgaaaactcattctcggaattcccagttgaactaagtccttagcaatcacaagtactccgtttaagagggaaagaaaaaaattataaaagaatgaaaataattaaatatctgagtggataagtgttgtattttttaagaatattacaaaaaagccaaagtctcatattgcctaaaataactttgttttatgtatttatatatcatcttgtgtttaaggcttttatagcagttagtaagatgtgaaagtcttgcatatacgaatttggtctttgtgggtctcatagtgtaaattgctcttatcctgtgcgtgtgataatttaccttgcaatctttttatattgtaatatatttaaattctttttgagattatttagaatttaaaattcaaattaagagctcactagaaaagtttttaatgtgccggatttatgggattttcgtgatttatgtttttgttttaattactttaccattttatcattaaacatgttttaattatcgtattaattatattatattatgattttaaatgttaattttttttttctttattttcaacgttgacatgttacccaccactctatatatagagcttccttctaactgttttatgcacccgaaaaatctcttctcttatctcaaatttctttgtttctgggtgtgtgttttttacttgttagttttcttgcctcattttatatgagaagttcctgttgtatgttcaatgcggatcaaactatttttaggcctaaagagaatcttaaagtggggcttttttaaaattaataataatattttttggcagaaaaataataaaaatattttaattaaataattaaattttttactgaaactttatctttctagcttttagggatgcaataaatagagggacttttgggctaattttggtgagaattaatagattttgagagtaacttttggactattttggtaatagttaatatatttagataaagagattttggttaa

SEQ ID NO: 2747 - DNA, 1700 bp, Glycine max
  Soy_ogl_494 Gm02:11581501..11583200 Cluster 11
gtatatgatgtgttctagacataatataattgcaagagataatctactttttgaataattaattttttgttcatttaaaatgataatgctttttatatgaattgtcctccttactttttaatttgtgtatatatatttcaaaaactaagaaagttatagaatatattatggtgtcacataaaatacataagtaaaaactacaatcatacttaatttgatgcaaagtagatcaatatttttagagtgaattacacggatttttttttaggttttcactttgagttgccatgtcattaagttagtctaatgggatagtttcgtgtaaatttgttttggttaacttcgttgttaatagcatactaacttatctgacatcatcaattattatgagtagatgagaaattaaaaatacagtttatccaaaaaaagagttgtcccttcacattccttgatgacatggtatgtaattggtacgtcaattttactgttacatcatcatttgatgttgttacttgataacaaatagctaaagactaaaaaaataaaatattgaaagcatatctaacgcaatttacagaaaacacaaaaggtacaagtaaagaaaagaaagtgaccgatgttatataaattaggtagttttttatagggttacagaacataaggatattgagtgtaatataagtagaaaccttctggagatacatgtaaatacaatatactcatatttttaaatttgactggtgactggcgactgtagtaataataatattttccaaaattttagttgttgaactatgatttttttttttgaaagatgagttgaggaatgataaagagataggacatcccaattatgattagttagatgattattaaatgtagatttttttaatattatataatattataggaaataaactaacgcaaaattataaaaaaaaagtttaggtataaacttgtaaaagaatataaaatgaccattttgtatgatgaaattaaattaataataaagttttaaaaaataactatttataatttaatataatggacctacgaaacttaatattggcctctattatttactataaaaaatattatttgttggaaaaattttcataagtataaaaactaaaaagtacagcatgtacctacaaaaaaagttacagcatgtggttttacactaatttatctaggtttaaatcaatcgatttatttggttaaatggatcaaacaccatatcaatttttcgattgaaccaattaattactttggttagatttgattattttaatatattttttactgcgtgcgtgattattttaacataggtatttatagttgtttaagttgaaaaatagtaacacacactataatgtacatttttcatcacactccttaaaattagatgaaacacaagagtctcatcaataaataatataggttttactctctatatagcatgtttcactatgtattcaattaataagacctaccaacatatatattttttcaacaaataataaaaggatatttgagagagtgcattcctaacattctttgaattgagaaatcatttgaataattatttttcacaaacagaataatcacaagtaatccactgtcacgtgatgttaacgaaaacgtcaataaaatattcatgtgtcacaagggaaatagttacatttttcaataattatata

SEQ ID NO: 2748 - DNA, 1568 bp, Glycine max
  Soy_ogl_2001 Gm06:17174368..17175935 Cluster 11
taaatttattggtaactaagaggttgccattgttaaaaatggagaaccatataaaagaaagaaaaagaatttgaatggcggttagttatgcccatctaattttattctcaactttcaacagtgtatggtcccctaggtctatataaaaatgaacccacactagtcccacgttcaaaactgaagcagaaaataccacttccccaccattgcatgtattgtttaccaatcatcatacatactggtcctgatttcacaatccaatcaaatttctttttcttgtttccatttttctctcatcttttgatgtgatgaatgtgaaagttggaggcgtgtatgacaaaagagggtgacttgataaaaaagctacttttcctccctagaatttagtggacaaatatccattcctgattagtaatagatggataaatatctcacaaaaaagaaaaaaaatgtgtttttttttatttacaataaaactttataaattcaaatatttattattatgattggtaaataagatatattttttccttcattgcatatttttattcctttaacttagacaatatataaattttggtctctaaactattttgaaataaattaagttgtctatttttaaattattttttattcctttaaaaaaatacataaaattaaatctctcaggatcccatttatttaattaatatcttcagaaattaaatttattaaattattttaaactttcttatcctcaaaatttaaaaacaaaacatcaaatttcactaaaatgaaaaaaataagattaattttcctttctttgaatctaatatcacattttattaaattcttcatttttttttattaaatttctccaaattccttatttataaaatttaaaattattctatatttcaaatctattataaatgtccaaatatttaacacgactagttttaactagtattggtaatctactgataattaataggagtatatactattaagagagttgtacaagacgtataattttcaactaccaatatataatttaagagtaatcaagttatagtattctataaattgatagtgtactcattgtactgaactagtcggagttattggtcccaaataccttattgattacttaactataatcaatcttttgccacatttctgctttcaattcctaattaaaacctgtcaattaatttaatatatatcatatcatatttaccatttaaaatctgctttcaattcctaatcaaccttaaagtaataattattaattttattttcttaaattaataatataaaattttaattcttaaaattagtactgatcattaatcatactgttaattaaggtccatcattttgttttttgacaagaggtcaatcaatttgttaaatcaatcgctttgatcttgactttagtatatgttagttagttttattcttcaaaccaaattgattgatgattacgaaatttatgagccaaagtgaatgtgaagttaaaggctatattcattgttttaataatattaaaaataaattgaatttttgtacttttaaatactaaatta

SEQ ID NO: 2749 - DNA, 1500 bp, Glycine max
  Soy_ogl_3060 Gm09:12352701..12354200 Cluster 11
accctgaaattctaaaaattgcattgtgcatatcttttttttaaaaaaatcatatgattttataatttatatataatttaagagaaaaaatgactatacattaatagtgtaacatatttttatattatcattcaattataaatcaatatgtaaattagttgacttgtacaaaattatgtttaaggtcatatcaactatgatttgtgattgaatattattttttttaattattttatattgttagtgcataatcatcaaacttttaatttaattaattattatatattaaatttgagtctttccttcttaagagaaaaaaagacttctttcaaatttcaatctatcacatacctcaacgaggcatgttatttttgtttatattaagtattccacattttgtttttactttttttttttcaaatgttactactcaagtttatataatttgttaaaaccaaaactttctatgtcaatgagtttataatttataactttaaatattcaccgatcatttcattttaataattgattcacataattaaaatttgtaatttacttcttaattttacaaattttattactttaatttattcttatataatgaaataaaaccttcattctttacaataataatatctcccattctactttagaatagtgataattttcttttatatactttttaatttatattttatattttatctaaattgaaaaatatatgcacaataatacacttagaatttaatattgtacttaaaaaaattattcttttattcctcctttacttaatttctatatctgctatttttgttaatcgaagagaaaatttatgataaaattaaatatgacttaacaagtaatgaattatcttaaagtcaactactcaaatgttaactttctcaaatgtttttaaaccatatcaatataaattaataatatatattttaattcagttttacacatgactcttcaacaccacatccacatattctaattttagtataactaactgaaaaacagacacgctgtacattgcgtcttaactattttttttagttagatgtaattataataatgttagaaaagttattaaataataataacttataattgtagatgatttttaaaaatagttaaagaataaataaaaaaataacaaatatatacacaaaatggaataatggccttggagcaattgcatcaatacgcccgagaagcaattgcaagatagaagcaacatgcttcagtagcatcttcggatgcaataggtcaataaaatttgcgtataaaaaaaacttatggtgcgtctctttttgaatcttttctgtttatattttcaatatattaattatttgagaatttctcagtgataaaatgatgaaaaagaaaaggaaatcacgtgacatgagtaagatggagcccaacatgtgggagcgtatggtggttggacaacaccacacacttttggtatggaaaaaccaaggaagggaggggttt

SEQ ID NO: 2750 - DNA, 1400 bp, Glycine max
  Soy_ogl_5164 Gm15:48915801..48917200 Cluster 11
taaggacacgtataacaataagttacatttgttttgtgaagatcattgtgatcgcaaatactaatatatagttgcaagttacttatgtttttatattttttttttgtctagttatgctgcttgcttttatgtgaatatcattctagactcattttggaatccatcctcatttaaaatttgaaattaactgttataaacaagttaaatttcaaaataaatttgtcatttaaaaaaaatattgaaaaattcttttattactaaaatagaaccggtacgatgtaacttactttcaactggataatatttattacttagtttttattttctaattaaaataaagttgagaaaagttatttacttttttattttattttattatggttaccctacaatgtttttccttctatggttgcacgcaatttttttttctttttttcaatggtgtccaaaattgaaatgtctcctttaaatagggtgagcacacttatagtagtaaattatatgtgtttagtgaatatcattatcatctaaatagtaatagttgcaagctacttaagtttttgtattgtttttttttttttttataaatctaggtctaaactaccagattttaagcgaatatgattctagcttctttttttaatttacgtaacataatccttactttttccatagtgtatcttgcagaatgacccaagatcaggcctaggattgatgcccaaattaaattagtttttttttaattcaaggtatttattgaaatgaattgcatctttgaaaattactctttttattttgtatccataaaaaaaaatttcaaattcattatgggatgactgagatgtttatttttcttatgaagagggacaaaagaagtatttttcaaaattaagaaactaaaaaaataaatttaaatttcaataacaaaaataaaagtgaactaaatttaagagacccaaatcacacttaaaccaaaatttatctccttggtccttgtgatcaactatgccaattatatagtcgtacattatgggagatatgatttttgcctcattcaaccagtagctaacttaatatttgttttataattaactatgtgatcaattttcatgtaactagtatatccatgatttgaatatatttactttaatgggttgttatcaattgtttatttattgagagtgtatttggtttagagagaaatagaaaaaaaagaaatagaggattttttttttgaattaaagtagattataagaggtgtgaatcccatgaaataaagtataaaatttctttttgatatattatttctctctttcataccaaacacatattaattaattggagcacattccaaaaatgataaaaaaatattgtggaaagcacactttttgaaatgtaaa

SEQ ID NO: 2751 - DNA, 1300 bp, Glycine max
  Soy_ogl_543 Gm02:14221501..14222800 Cluster 11
tgtaagaatcaataatgtattggatttttataaggattacaactaatattttgaaatattttgagggaccaaaatcatattttactttgatctaccaaataaactcttttttttaaaaaaaataaaggcagttacatacatgtctaacattttggacacactccatgacagcggcagatccagaaaatttgttagtgaaggcaagaaaacaaaatatattatcttttcacacatgaaaaatatgataaacttttatgaaatacacaaatttcatgataaaaaatccaaattacttatataagcttttacaaattacaattgtgtgttttttattgacttggtgtatgtgtttagtattataagagcaaaacggtaaaaattaaaaggataatatagtaagataaataataatttatctttttttatctcttaattataattttttgcattcatctaaaaagaatttgcctatggagtcaaactgtttttttatggggacaattttttttatcaaatatgtataattaagtaaaaagaattatttttttggggcaatttcccccataatgcttaacctgcatccgaccctgctccgtggtttgctcttcgaacgtcatgctactagctgagaataggtctgggaataggtcttctgaaaatattaaaaaagtgaaacataaattaaatataaacattataaaaaaattgcctagtagctagtcactaatgcgatacaggttaaccgaaactaaaaaaataaaaatccataagcttcattactaataaatcataaataaataaaaagaggtgcaacttaattttgatgcatggcgtctgatagaagaatgttctcactacattatttatattttatagctatattcataattaaattattctccattatatgtaccgcaaaataatcaaactaattagaggcaaagttttatgagaatcaaggataacagaagttattttaattactatgcaaagatgatcagaagaaaaggaaaaaaataaaattgatgacaaacacaatatttagagacagaaccttgaagatcgttcattgttcctattttttttgtaaaatagattgattgtgtacccagctcttaaaatttcttaaaactaaaatagaaaattgggagtgaatctgtattccctaacaatattgctatagttgatatatgggagtgtttgcaccagagaatctgtattcctttccttcttgttgagtgtggctctgttgtttttttcccttatgtattcttctggttatgttgtcagcagtgatgtc

SEQ ID NO: 2752 - DNA, 2000 bp, Glycine max
  Soy_ogl_577 Gm02:30111401..30113400 Cluster 11
tgattgattttactaacaagtagttataagtaatgatgaacctaaatttttttaataaaacggtaagaaatttaaatatggatagaaaaaaagcttatttaggaggcaattcacttttgagattttccaaaaaaatacttgtatggtaaaaaaattaaatatattctttattataaattatacttatgaacatgttttgttgcatgtttttttaagacaaattcagtttcataacatgtttgattgcgttaacaaatacgtatgcaaaattaaaataaactcacttttgtaagagaaagatttagattatttttacaaatttagttcataaattaaaatttaactcaaacttaaatttataaattttaattcaaatatgtacttatgcatgaaattctttttattgattttgatcatagttaaaaaattgtaataattatcaaatgaaatttaagactctctcacacacagtacatgtacattgttaatctgtgaatcacacacatattatattatatgtactttgcttttttagcaatactatattattgtgtgaagcgtgaagaaagatttcgtggatgaatcgtccaagatggaggcacgtgagaaggacacatttgaggtgaggaagtagtgatgggtcacgtgagaaagaggtgagtgagtaatgatgaggtttggtgtcagaatatcagaggaatgacgtgaaggagagacaagtcatgctaataaatttatattttaatttttaaaagattttttaaaatttttaatttcattagttaagaaattttaacgtgaacttttttaaaaattaaaatataaaattttaagaaataaaaaaatctatttattaattataaaaactaaaataataaatttagaaatataatgactaatagcatatttaaagtgacgattagataaattaaaattaattatcaaattcattaaatatgaaacaacatataattacttaaaaaaatcataataatattactttgaaaaatgtgaaaggagattcctaactgactcccaaatacattataaataggtaactaaatcaaagaaataaaataacaataataatgggttctgggttcttcccccatagggtactgcatgcttggggttacggccgagcctgtgtactgtactccctctctcttctgctccaattagtaccattagtgtaaccgcgtccactgctcacttttctgcaactaattaatcctgtccttcacttacatctcacctttgactggttttacgcttagtactttggatcaagagtgtaagaaaaaaaaatgaaaatatgtgctatttaaatgaaagtattattgactgatgtaaatgaatattttgattcttgaaggtgtgaactgtgaaccgatcacaggcttagtatatgaaacaactgaaaatttgatttatccgtatgttcaaaaagtttcaaattaaattcagaaattaaaatatagtaaatcattaagtttaaaaataaaattaaaaagttaatttttttatatgtgacaactatataaataatacgtaagtgacagatgatattaatcataattgttacatcatcactaaaaatattatataaatacatcatttgagttaacagaaaaaatatataattaatttatcatattttttataaatttaaaaacaaaattttaatttttttatttttttaaaatttaatgaatttaagaaaaaatagatatttatcaaaaatataatctaataaattattttaaattcgagttacgaacacataattatattaaatatttttaaaaattattcatattagtctttcttaaattgaataagattgttttttggcaaaagatacataagtaccctcatacaaaaaattgatataaaagatacatatatatcccgctaaatgtttttaaagtttgattaatttgcccaaatgtgtattttttttttttgtatagaaaatgtgttagtttaaaataaataag

SEQ ID NO: 2753 - DNA, 2500 bp, Glycine max
  Soy_ogl_2039 Gm06:38989401..38991900 Cluster 11
caagatttcaagaacaatgttgcttgtgtgaagataagggggaatttgatgttaaaaatatcactccttgggtgactcgcattgtaagtaaagcttagaaatatcaattgctcacttttgtgttacttcaaaagaattcatttctcttatatattgctcaacttatagttataagaagttacactagtatatggaagagtactgctatgcctgccagctctactgtggttggcttccatactatgcaaaagaatcgaggctgggatgtcacccatatatattatgggtttacttttcttttttgtcattgcaaacatgcacataatttgaattgatttccttttttttactgaaatgttcatatgcaactatcaatccatgttgtgtctctttaatatatgatactctaaacaaatttttgctctaaactaaaatattactattgatatttgcaccaccttgtaatgtgtatgttcttcatcagtaaaaggatccttgatcgatccacacatttcaacttgtaacatattatagagtatagtgtattattgcacatgggaatacttctagagctttatagaaacttctcataaccacaaattttcgaggaataggacaaacacatttgatttactaataaaaaattaattcaatgacaaaaaaaaatctatttttttagggaataaatttctcttcataaataagagtttaattttcataatattacaagtaattttcgtattaaagttaaaattattttttacattattttctaattcaaaataataccgttatttttatcaaaggatatattatagctaaacatattttatctattttattacttgcaccatgtatttatcatattttatttaatttactaataattataatattaaaaaaataatattcgtgcaacgcatgggtatatatctagttcattttaattgcaaagaaatatcaaattaaccaactaatagtaattgcttctacaagcgtaggcaacaagcctgcagcaaataataatgacttcaaacgaattagcatgtagacaaagactactaatagaattagaccaaaaaatgaggcaaacacattatctttattgttagacaattaatctagtaccaaagtaaaacataacagagactaagaacactttgatacaaaggtataactctctctacaaatttaatacaccgtgtctctcccatttctttgtgtggtaaacttcaatcatccaatttcatcttctgttgccttatatcagagattatctatataaaaacaaactaaatagtgactattgttattttatttatattaatgacaacttattgctctaattttgtacattcctccttatattttcctttaatgtcttcttcaataaccaacctcattcatgttgcatacaactaagttaatcacatagaaacactttcactttattaacttgaaattaaactacaatagaacctcaaaacttagaattttcattagttttcaaaatcttattttctaaatcaatttaaccacattcttccataaaaaatggacaaacatgtttcaaatttatcttcatgaaagaagaggcaaaatcttaaaggcaaagaaaaccttgttgtaaacccaaatttaaatatcaaacggaacccaattttctaataagattttttgccattaatttacataaacagtacaacacaaaacacacatttgtggaatacataaccttgaacacatgtatgcagtgatacatcatatgaagagattgctctcctccaaaacacgtcacaatttatcaccatgagaaaatcaatccaatcatgcagataatgacatatgagtattaaatcagaacaaaatttgaaaggttaatagaaaggccaattagaaggaaaaaaaaactcatgatgggaaagcccagagttttgaagtagggactccgaaaaattcattcctaataaaattcaaacataaaatagatatgcaaaatcaaatatataatatagaatagaaaacaaagttaatacaaggagtaacattaatacctttatagtttccttagaaacaaaagctacagaaaaaagaaaagaaaaagcaccaacatcaatgataaaaagtatccacttctaattgacacaatcaacctcccttccaaaaaaaagctaagttgtatggttttgattctacctgtaatttattcggacaatttatcttgtgattagtgaatattaaaatcccataattacatttcatctagttttatataattcataataacaacatatgcaaattacatattgtctagtgggagaaagaagtaaatgtcatattcaagatcatttgtattaaaaaaatattttaagtatgaatggaactctcttttctgaacaaatatttaaacatgataaacaaaaataaatacccatcagttatatctaaaactttctaacttcctcaatagccacatctctattgttgactaaggaagcct

SEQ ID NO: 2754 - DNA, 1100 bp, Glycine max
  Soy_ogl_2095 Gm06:46362301..46363400 Cluster 11
ttttgttctggattttttatctgttgctgcttatgttagctctgtaattttccctatgggcttaacaaaaaattcttgggctattgtactcataattcaaccaaacaaatttacaattctaaaagcctcatgggtcaaaactgtaacttacccttgaatatattggataaactgcaaaaagaacatacccatgaatattattttcaagatcatgcacgtaacttggtattggtaatattctccccaaagtcgaacctcttcggtgaatctaattctttttttgggaccattttatacttgtaaatagctctttctctctctaaatcaaaggttggaatttgtaaaagcctaataagaaagagaaagatagagagaccttggtgacaacgatagtttccctcatatcacatactaatgaaatcgaatacacttagattctacatgaactatacatttaaatacatctgtagtcgcttttatggccactacgcatgaagcatggcacgacacggcatcgactcacgcatgcagttacgtcttgacgcatgcctatcatcctcacttgtttttttcactcttcttaattggaagtttctttttctttgtatttcccactttatttggttttatttttacttttcttatccaaaacagaagaataaaagataaaaagaattaaaaactaaaatattgagtctgtttctttattaaactttctgaaaagaatgcaaaatcactcaatataactgtaaatttggaaacccatttggtgttgtatcccccaaatagatgataatcactttagatggctgttgcagtggatctcttttgtaaggtacctctggtgccttttattttattatatatatatatataaaggtttactatactttcatactattttaataacttacaccaaattatttggataaaaaatttaactacttcttttgtgacaataaatttatttagggacgagatgataatttaatgtttacattttaaaacttaattatttctctctcccacccacaagtaagtggagaaggaataagggagggagagaaataaatgaattttaaaaatataaatattaactt

SEQ ID NO: 2755 - DNA, 1714 bp, Glycine max
  Soy_ogl_2805 Gm08:34998401..35000114 Cluster 11
atgtcattgggcgaaagctttaaaattcgaagaatgtattcgaaaattttaatggtcgtcacatcagccacaaaaattataataaacgataatttcaaataattttatagttaaaaataataatttgataagatatataacatccaaagtcaaaagcaccaaccacgtttggacttggtctaaaaccaagttcggctcaggctgctaattaaccgccgtgtttggactaaacattaccgtaaacggcctagacgtttcacgtacactgtcatagtgtagattgttttgttgccatcgaaaatagtaataaatctttcttaaaagattttgaacacacacgaacccgaagtaagtatttttttaaacataatttattatatatttaattatcctagatttgtttgattaaaaaacaaaactattatccaagattcttctataatcatgtaatatatgcattaaattattaaaagtaccaaaattgacacttcatgattattcaaaaacgttctttatctcaacatgcaattcaaggtggactccaaatcagttatagataatttgaacagtcttttcaatactattattcatgaatctcctaagaaaacaaacatgtaactcatacgttagcaagaacttcaagatttaatgttcacaaccagtttttcaattatgtttttaattatattcatgttttacttaaagaatgaaaagccataaccttatttcttctaaaaaaattgttcaaaatgttagatgttagattacagtattttttcatacagataatttgattaaaagtatcacataataattacaaaatatctaaaatataactctgagaatgagtgtgcttgcttatgagttatcttctaatttatttgactagctttataaattttaactaaattgagccatttgaatgatttgattatcaaattatatcctcttttgggttaacttaaaacttcttacaaacttgtaaattagaagtattattcattcttttattttcattcttgctttaatctactttatttatcagctattcctcttaattgtttctacgttactaacctttttaagtattttaatatcttttttttagctattttatttttcaataaaatatcaaatatttccaaaaaataataaatgtaaaatgataattacctaaaaaatatttttatccttgacataaaaaaattatacaaattattatataaacacatttttatatcattttatatttatcaactgaataattaaatgtaccaaacacttctataataataaattaagttttttcagataaataataatttaagatataagttctatttttcaactaccaattattataagctttaaacctgatgtgaaaaaattatgagctttaaactatttttgttaaacacaatcttaaattcaaaacttgtgaatggaaaaatatgattggaaaaaaaaatatcactaaagataataactcaaattatttaaaaaatatttatcaaccaaaccagtaattatttcattttaatattatggtaaaaaataaaataaaataataggatttctctccctaatcaaaccagcactcaatagtcaaaattgaacacaacaccaaaaccagcattgattccgctgtgtctgaccaagtcttattcagcctagttggccatccccacgttatcattttcatattcaaaggttg

SEQ ID NO: 2756 - DNA, 1900 bp, Glycine max
  Soy_ogl_3893 Gm11:32575801..32577700 Cluster 11
tagaattatatataattattatgaacaacaaaattttttattttaatgtttagtgcaattacatacttaaaacttaaatttgagatccctaacaaaaataatcacatattagttaaagttattataccttaatcaatgatctcaaattcaaattattaatttataaatacattaaatacttaaagaaattttttagtcatcaatatcagtcctactctcctcaaataaaattatctctaatgtgataattgtgtcctaaaaaaatgtattaatatctaacaacttaacattatactcacctcttaaaaaaagttatactcataatttctgaatatatatttaatttgttaaattggtatataaatattttttttgttaaattcgtttttaaaactcttaatataaaggttagtaggaatgaagaagagtaaattaagtagctttaaatataactttcattatttaaggaatacagattgctatcatatttttcaagaactaatttaattatttattttaattagtcaatataatttttttcttctttttgtagctaaagaaggtggtaatcttcaatactcgatcagcagcagtatgctttatcctctcttttttttatatattcgcaatatacttatatctagaatatggtactttcgatctgaaatgattggcctagttacataaaaaaataccattggcctagacctagtcattaaggagatatattatctgtctaaagtattgaagctgtgacctgatatgagatttttaaatatgcacgaaaaaagtacttaataggtaatgaaaaattattttcctaaaatataaattaatctaatattttattaatttcaatttacgtaaaattctagttgaacaaaaattccccaaaagaaatgacagttataataaaaaaaaacattttttctattatttttttttttgtcgttttatatgtgcaatgccacctaacacgaaagtatatcaagaatagataattgataacataagataagaaagtgaaaggtcacctctaaggaagcaaaccctcacttaatatatttgttccatatctgtgatgttaagataattggcggcagattttgttaaaggaagagaaatgctactaacatgttttaacactttatttttcttacactcttttattaaataaaagttaggtaaatttgatgaaatatgtgaatttaaatcactacatgtctggataattaatatgattgtttaattagtagtcttaaatttaaactctgaatatgtaattacctcaaatatttgaagaaatagctttattattcatattgatttgactttggcctatcaatgatgagtgaaacttaaattaaaatttgtgaggattttttttcatattttaaatcaaaaagttgtatgttagggctttatgttaacatatgtaatattttacttcataaaaactaataataaatactttttattaatatgcttaaaatttgagatgaaacttaaattaaaatttgtgaagatttttttttatattttaaatcaaaaagttgtatgctagggcttatgtcaacatatgtaatattttactttataaaaactaaaaataaatattttttttattaatatgcttaaaatttgagatttaattatcttattttaagccgatataattttatcggattggaacataatgaaagcaaataagaggtcaatcacgttgggtcaatgcacctgttccgtgacgtccaagcaagccaaattcctttttccctttgaagtttaagagtgtctaagccattaacagccactatgttgagttggggggtccaaggccatttgagagaacacaacactacactatgaagaaacatgagccaacaagttagcccaccat

SEQ ID NO: 2757 - DNA, 1276 bp, Glycine max
  Soy_ogl_6701 Gm20:4360018..4361293 Cluster 11
taaacttcgtagttgtagaatggacttaacagtatgtaattcagagttcgattaagaattgtgtgtataaaaacaatttaactaatacatttatccattctgctttatctctaccacacaggtgagactccacaactgttagtgccaatggcaagcccttgacatagttcctcataatttgttggatgacattgttttcaaaaactgaacaattcaagagcctgaccatgacttaattccctcacctagtcactttttaggctgcttgcacattttgagcaattaactcatttatctttgtttcctactttaaaatcctcatggttcaaaaaatctgagagaaatgcttcttgtagttttttttttgccaaatgttagagttgaaatttctctaaaactgattagcaatatggttataaataaccttagcaagcattgatttccctatacccaagattccataaattcctatagaccgcacatcatctagtctaatttatttgggttattttgattcatgtttatttggattgtcagcattaggcgttgatcaaattcgaactctagactctgcttatgatcattctttactcctagaactgaaataaagttatatttggaaaactaaagggatagacaacatacatatcatgtactatgttgcttagtacattttgattcagaattaatgatttccattgtcgtgatctaatccacaagatcatacaacagtttgtatagcttaagtgcttaacacatttgaataaatttattttctatcttttaagtagttgcatgccatagagatacatctttggattccttgcaaaaccagattggcccacctataattgtatatggaaaatttggacaattttcacagttttcacttttttattgaaaatttggacatgttttccttcctttcagcatgttgttacacatctttattctttattccactccttatgctatatatacattctgaaaattaattgcaacattttcatgtttgatgaagcttaattagcagaagagaagagaaaagaattgttatttgttgttagccccaaagtcactaactgcagatcacccaaaagcccagttattgaggtaacaattctcttacaaatactatgttcaatgcaaatatttaacttcaatctgttacaaatattcattgtaaatactatatttatttcaatcccttacaagtttgaaattacttgataaaagttgtgtatggtatgattattttattgtatctcttcattct

SEQ ID NO: 2758 - DNA, 1100 bp, Glycine max
  Soy_ogl_861 Gm03:5370601..5371700 Cluster 11
ttgtacgtgataaatgtacactaatatctatcgtgaataaatgtgagagagatgattggttaacttgctttttaatgtgtgatatttgatggcctcagttcacgtgtgctctatttgttttactgcttggtgttagtacgaattagggttttctgttatttcggtgttgtctctttaaaataatgttattttaaaaattatgttaatatttttaaatattaacacaaactctcaatttgaaggaataaaaccaaaataccttcaaaatgaactccagagaagccaatttcgtattggtaatgccttcagcattgcactgctccccaaaacgtacatggggtcactagatatggcaaaagtgcctcaagtgctcaactataccatgaaataattaaacctcattttttttactactttttttataaaaaaaactcaatgtgaaagtaagttaggtaatattttatcattgatttaaattattctgaactactaattgattgaacgaacgaacaggtgaatgttctaaatctttgatatttatttttttatttctatacatgaaaaattactttaaccttaatatgttataattatgatcaacgtaagtatgagtatctcattttatttctggggtgatttttttaggcttaatgttatgttaaaatgaaattcttttttcttttatctcaataatatattacttatatttctcttatgtttaagaaaactaaatttttaggtgcttgacttaaatttaattataagacaagaaaattacacttctttcaacattttttttttgacaaaacatttctttcaacatatatccacacatagagtttattcacatgtactattaagttgtgtaaatcttatacagagaaaccgcattagactgtctaaaaaaaaacgaattagacaagtaacttgtagatttcgcatgtatcattgtgcatttaaatcggaagttatgaggtcattttgatcttagaaaatgttattttatttatttgctgtttttattttcaaggaagaaatagcaaaaacaatttttttgttttttttctattttctcttgtttttataaatataaaaaacag

SEQ ID NO: 2759 - DNA, 1400 bp, Glycine max
  Soy_ogl_1321 Gm04:39402201..39403600 Cluster 11
ataaaaagtcatattttaaaaataactttctatgttccacacttacctcccgttttgccatacaagcctctaatgctttctctttctttgtatgattatattttttacaatgacaacctcttaattataaataaatttacttcaataaaatataatttaaattactaaatactaattgatactctaagtatattgattaaaaaacttatgattgaaatattttttattaagagatgaaaaattacattatccatacattttttttacactctcatataatttatacaataaatatttttttaatttcttaaccaatatctcaaaaatatttgttaaaaacacacatctaaatttatagttatataaaagtatacatgtaatcatgttcgaaattgctacattcaagtgtccaatgtcagatataacatacacaaaattattattaatattttcattgttttatataatttgggttagatactttgaatatttgaatatatatgggcctttaattttcatattgttgtgatgttgtaacagactataaaatataaaccaactcattatgtgatattatatcatttaattcttttcaataataataataatatccacaaattacaaacaatcatcttaagtaaattaagtaaaaatgatttgatcctatagtttaaaactttttcacatgaattttataaccgagttattttaagtagttcatgtcattaaatatggttcaatttaattttaattgttcaaaaattaatgattttagtgtatatatattaaagattttgaaaataatccgttattattatgatcagtgatggcacaacatatataatatatttatgtataccacaccaacaatcatattaaaattacatgtctagataccacgggagtgtgtggtgatcataggagttattttcaaaagttgcaaaatttatattgaccaaaattaatgattattttttaagactaaaagttaatttcattatatgtatacagcaactgaaaatatatcttactcttaaaaaacactagataatcattcattatcaggccgtatgtttatgattttttcagaaaaaaaaatatatctttgattaaaaaacatgtttaaaaaatgcagtaacaattaatcattttcgaataatttattttaacttttttgctcttatccttttttctatgtatgtatctctaagagaaggaatcttagatgggcaaatttgaacgatgttggaacaataagcttaaacatttatagaatcgtctggggtgaaaggcttcggcgatgagcatgaacattacgtgaattccatcttgttagtaccaggaagaacaagttaattttgtgtgtcttaatttttgtttcatgcattactcgtttttgt

SEQ ID NO: 2760 - DNA, 1227 bp, Glycine max
  Soy_ogl_1899 Gm06:10786874..10788100 Cluster 11
gattttaaatatttatctaaatatacttttttttcagttacctaattttccagtgaggactttttgattacttgttgctccttccattctacttaattttagggggggaaaatatttcaaattagttattttgcaaaaccgatgaagtattatttgttttttccatagagtacattacgtgggagtagctattgtgtagtaaatataatcgtttactgagtttaaatttatttttgtaaaaaaaaaataatttaaatttctattattaagtattaggtgacatttcaaaatataaaattaatgtttaattgaagtgaaattataaacttgataatatgagtatatgtttatatgtttttgaatcataatcattacaaaactaattattaataaaaaaaatacaaaattaactatcaatattcaatgatgttggagcttgtagaaagaagaaaatatttgtaagaatattattatatttaaatcataataactgatgtacatcaacaacggatccgtggcgcaatggtagcgcgtctgactccagatcagaaggttgcgtgttcgattcacgtcgggttcaaccttgggtttttagttaccaattgtggatttttttatttttatttttaagatactcgttcattttttttaaaagtattaataatttaatgtcggtaattcattattcaaaataaactcttcggcttagaatttgtttggatattttactatcaatgggtgtttttatggtattaaacggaattttaaaaaattgaaattctttttgctacaataaaaaaattgaaaataaaagcatttgaccactttatcaaacaaagcaaaaataaaataaaaaccaattgaagcaattgataattttaaaatttaaaattctcaaatatttcattctaaaggttcggcagaatagacccatgtactcgtttacattttgccttcatcataaatattaacgtattataatctttatccagaattgaagctcattcaatcactcaaattaattaagacgtaatgtttaactaaatttcaaattcccaaaaagagttaatgtcaacgatatacaagcatctcttataatcatatctaccgaaaagatgtgtgtagacatttcagttataataacactcctatttagcatattgtggggttcaaatcttacgggggatcattaaaattctttacgacaaacaagacaagcagatacct

SEQ ID NO: 2761 - DNA, 1529 bp, Glycine max
  Soy_ogl_5351 Gm16:26812101..26813629 Cluster 11
tgtataagtgcctataccaaaatggttaaatttacttctaattgagttatctacttctaattctacaaaattaaaaaaaaatggacacaaagcaaagagattttcattgatttgataaatatgataacaaatcaggtagaaacattccggtcacaataacaatcctcattgtttggtttgcaaaaaaacaaagaacccagctaaatattcaaaagctaaatcaattcacgggctttaatattagttttatacatacgcggatgcgagagaaccataaaaataagtaattataagttattttatatatttaaatatttaattaatttactcttctcaagaatagttcttaaccaggttattagagtaacaaatttaacttagatgattaaacataatgaaagttattataaattttctacaatttattttttattcctatagataaaaaaaaataggttatcaaagtaaaagtgcttcatagatttctttgccgcagtttgcttcaaatattcatttttcaatattttctaaagaaaagatacaaaggaaagaaaaatttgaagtatatgtttagtttgtgtactaatcttgctggttcgactatagtttgtgtgtttaatctcatgtgtaatttataatggtgttcttacacctttcatcctttctccaactttctctaaattctcaaatgcctacttaacaaaaattgcccatgtagtctccattactttattttcttaaatgaattgtatcttaaatttatgaaaaattacacttaattaagacgtgtagaaaccaaaacacttaactaaacattttaaccaaattattaaaaaatattatcagaatattcaagttgcaagttgcaagttgcaactttatttactaaaatattatagttcactgttcatgttgggaatgttggttatgggaggcaaacatgtttttattttatgtttgtttttagtaatatatgtgtctttttgttattgaatcgttcaatttacattggacaatgtaatcgttcttgtataattaatcatttaaaatatttaaattcacataatttgtcttcctttattttttcctattaatttagtagcgtaatattaaattaataacagaacgtataattagaaacacattaatttaggccaatgataaaaaaaatattaatatattaaaaaaaattaaatacaaatctaaagtgcattttttggattcttgctaaaaatcctattggagattggacctcccatacacaattttcccaacatgaacagtaaacttgaatattttgataaataaagttgcaacttgaatattctggtaaaatatttttttaaatattttggtaaagaggcataaaggagtgatttcacaaaagaagaaaatgatttattctatattacaaaaccaaagtttaggcttttttcttaaaaaaattaatcctcttgacatatttttttttcttttctataggtgtctctttcgctatagtttaattcatcttgtaagaggatgattgc

SEQ ID NO: 2762 - DNA, 1397 bp, Glycine max
  Soy_ogl_580 Gm02:363204..36749600 Cluster 11
caagaaaattactataagaacattatatgggatattttttttatttactttctttatagcattatttaacaccttttgtggcatttatacatttagtcaaatgtaatcaatgtctctatatttttatattgttgaatttgattctcaaactttgaaaaacatgtggatttaattcatcttaacttaaaaaaaataaatattttttaaagtttgaggatcacattcatttatctgaaagcatagggactttaactacatttgaatgaaattttatggactaaaatcaagtttttaccaaaaataaacgtgatttcataatctaaattaatttgttcaaactaacttccaatagaaaattaaattgatccagttatatctatataaaattattaatatgaaactaatatttaattaattaaatgtgtgatattactactaccagcttcactaaaatatccttttatagattatatatttattcatgaaatttaagttccatattaagtttaattgcctttttttgggaaagatggggtaggtagagtccaaatacatgcaaaactttttttaactttttaaataaataattaataataaaattacacttaaattatttacatatcttaaaattgtgtaatcttactaatgaaaataatataacagataatatatcatattataataaaattatatcctaattgtaaaaaatagatcataattattaaattagagacctaaaataactgccaaaattaccttactatggccacgaacatgaaattgagtaagaattactaattgagggaaacaaaactaccaagaaggaattaagagtatataaataattatatactatcacaaacatgattagaattgtagggctttaatatattgtaaaaagttaacaagggtttaaaaattcattgacttgtgactaattgatgggaagaagaacctaatataaactaagattagattaaagaaatcgaaattcatgtgtgtctcaaaattcaagatgttcaatattatgattaaatattttgaattttattttaatctttttgggtatgtttgatttgatatcataagtgagaataagaaaggttgtcttgtcggaaatattcgatgggatttgtgaatctttaatagcacaatttcaaacgtgcttcgagtgtggtatgagtgggcaagaataacagttgaacgaagacaagttggaatgttgatgtgaggttgcatgatcatcacatgggaaagaaaataatggtcaagttgtggtgatgattcagacaagatattagctgtgtcaaatgtgcgaaagatcacagctaaatattacacatatgatcatcacatgggaaagaaaataatggtcaagttgtggtgatgattcagac

SEQ ID NO: 2763 - DNA, 1300 bp, Glycine max
  Soy_ogl_1619 Gm05:27241901..27243200 Cluster 11
ccttttttgacttttgaattggttgaaaattacatttcaaattgattatagcttttatattacggatcaatctgaaagataaaagaaaaacgttcctttcaagtaacagcctaataatttttagatgaaaatgacatttggaatatcacctctttttattttcctttgagagctacacatggatgttgtatgggagtggaccatggaatttgtgtccctcatttgatgttttctgtagcaaatatcttatgaaaaatgctggtcctattcacgtagaacaccgcaatatttttttttggtttttaagataataagatttgtttagataaaattaataaatatttatagaaaaaaataagaagataaaattaattaattttttaagctaaaattaatttatacacctcaacttttaaagaaaatcacttatttaacttctccgaaaagttgtttagagaaaatcatgtaaagtcttttttttttactttttttaattttcacatttttttaaaatttaaagtattacttcatttaatttttttactgaaatttatttaattttaatacattaaaaatatctcttttcatttattagaagttaatgaagatataaatagtgtagtgaaaagactttggaataattgatttcttgttttagtacaagatgcaattggtttttatttttaaataactgtaatcatggccaaaagcagtgttatatattaacaaaagaaatatatatacaaaccatataatcaatataataacaaacaatacgatgtatcactgatgtatattaactttctatatgctgtgaagttgtcaattagtaggatatatagttcacattattagtataaattcataatgtttatattagaacagtttaatttttattttttttaaaggaaaatgaagttatgacttctcgttctctttttttaagaaggacttctcattctccttcacaagtaaaacatgaatacaattggaaacataattgaaaatttgaccctgagcatgaaattttgaagctttttctaggaatgagttataagatttgtttctctccttacaaaactcactcttaggtttgaaatagaatttaaacaaagattaaatttatcaacgatggatgttgggtaatgctgagctgcaaaacgtctattgattccatctgctactgtcttggagtcaacctcaaaaatgaccgatgaggttaagattttttgccatttgaattgattggaataaagcccatgatttcgctcctgtaattgttggtaaacttgttgtcctt

SEQ ID NO: 2764 - DNA, 1221 bp, Glycine max
  Soy_ogl_1990 Gm06:16610801..16612021 Cluster 11
aaatacatttaaacaaaaaaaaaatgagatgaaatgcaggttttgaccaaaagggataatttcatttgaaatttaccaaatgaaaatattttttaaattaatctttaaacgagaataagtcatagtaatttttaagatttcatatgaaatcataaaaaaataataaagtcgtaaaaaatcttaacaatcttattttttttaattatttatataaagtcataaattttcaaaaaggatattaactaatagctaagtcctctaatgagatacttgtccatcataggactcaccaacttcactactttaaaattgtgattaattttttttaaatgaattttgaatgactttaaaatcgttttagttataatcatatatttcattgtttaattctcttaaaattaaaaatagttatagttaatattttttataatttatgactttaaaattgtttaaataataatttaaattaaaatgattaattctttgatcatccaatcacttttattttttattcttaatcattaattataattaaagtcatttaaaattaatttttaaaaaattaatcacgactttgaaatctaaaaaaatttacaacttttatataaattaattcttaatcgttgaattttttacaactttattataaataaactgaaagcatgaatttttttttataatttcatactaaaagtcataaaaattcttacaacttatctcatttgtaaattaatcaaaaaatattttatgttgataaaatgcaaatcaaattaaatgcctgaagcgggtatcacggaacagtacgaacagtacgttgttggaggtaagaagcggacaaaaatcatgtgatgttgggttcgacacttgccatttgctgcagcctaccaaacacacacgtctccatgaaccagtttgtctcactcttcctctgtctttattcggccaattgattaaatatatgtattttttttttcaaatttactaatggaagattaattttaaattattatttattttaagataaataataataaatgttatcacttttaattaaaagtggtaatatcagttattaattttttataactgaagtcataattttgtaatgattttagtttttttttaaagaatttatgaattctaagtaacagggagttttttcttttttcaccacttctaagtcgtttactttattttagaagttgttatgacttctatttt

SEQ ID NO: 2765 - DNA, 1297 bp, Glycine max
  Soy_ogl_2657 Gm08:13387204..13388500 Cluster 11
tatgaatacgacctttgcatttgagaacgtgatggcttagctagtgccagatatcaggctagctatcacctcgatgttgacgtgccatgtgcaccctgcgcaattcaagggcatgcaatgcactgcaacttaatttaattctacctatatatctctcctacaactagctataatccatattcagattttttttgtcaatgacttatattattagctatagtatttcttttatcggccgatagtaaattgttagcagagaatcgaattgaatctacaatttttttttgcaatttttgttatttatcaaactagtcttataattaaaaaaataataattatcttctcggaaatgtgataaaaaaatgagtgcatcaaaaaatttctcatgttaatgtacagtattaatatttttttgtatttgttaaatacaaatataagttgaaatcttacatcaaatcaaatgaaaaagaagattgaacattatataaatatatataatgttaataaatataaaatttaagatttttaaattaaaatgtacaatatttatccctcaattacagaacattcatcttctaaagcaatcttaccttttcaggtatttaatatagttaaaaatatattttaattcaaatcacgtatcttttcttaactattcttaattaggcataaaattacatatgaccaattaattattatttaaaaaaatgtggaatcttttataaattgttttttatatttgtttcatgttataataaattaattaaatttatttcacttacatattttctttgaattgataccacttgtgttccaattaaatcaatggattttatttgtcgcaaaaaacatgtattcattttttgtggtacaaagatgaaggcatctatacttgcatctttatccatcaatttattactttgcttataaaaaaaaatgtttgcttgcagctgataaaaacatcttaatttgattaataccaaaacactgattttttaaatttttatcatcccttatttattaaacttatagcagtgtgcttttaatttctttctccactttttctcaagaaattacatgtttcatttttgaacttcacttattctattttaaactttaaattcaaatgaaactttttttttcttctaaacgttatttcctttctctttatacacgtcatcttcatacacatattctctattttaatttcgtaaatttcctgaaatttaaaaacccagtacaatgcagcattacagttatcagttaatagtcccacttactgatttgggtggttggg

SEQ ID NO: 2766 - DNA, 1081 bp, Glycine max
  Soy_ogl_3075 Gm09:28870501..28871581 Cluster 11
acccaagagatcccacgtagattagcacctcaaacacaatttatcctaaaccactcaccttgaaactttattgaaaaagggataaaggcaatacaaaaggggcatgagggaacaaaaccaaaacataaaaatagattatgcacaatatcaaacctcctcaaaaattataatgttatctaaattacaatctgtatagattaaaatagtctcaaatatatttgaagaaacgatagaaaggttaatataaattagtatagttgtgatgaaaattaaaaatctataaggagattaagtaatgtttattttatgcttgattatacatccatgtatttctagaagattaaatatttaatggctatatcacttaaaactgtgctcactgggtttgacgtgatttgtggtttgtcagtatttgaactcatatattaatatttgttcactttgtatatattagttggatataagtgcttcctaaattattatcaaattcagcctaattcaaggttgttagtttttaataatttaaataaaattgattatatcagtttttatgccttatttattctttttttacgacaaaagggtggattatatttcatcagtagaaaaaacaaattaaaaatcagtgcatccgattataacttagtcaaggagaatatgagggttaactaagtgggaaactgactttagagccagggacatatgttttgctgtctcacttatggcctaaaaataagtcgcacctcgtataggtttacgtttccttgtctctctatatgtgtgttatttatctgtgcacttgatatttataatcatctatccttttttaatttaattatcttttatatctgtttttaaaataaattttataatgttagtaattaaaaattatttcattataatataaattaatttatatgtttaaaatatttatttattacaaattttaattacatgaaaataaacatttaattattatgggtaatgtaaacagtaaaatactatttaactgataaaattatgccatcatcggtatcactccagaataatatgccaaggattttaatttttaaactcgctt

SEQ ID NO: 2767 - DNA, 1100 bp, Glycine max
  Soy_ogl_3883 Gm11:29579101..29580200 Cluster 11
tctctaacattttcaaataatttcaaatttcctaaacaatttcacaagggaccaatatgaacccttctaaaaaacattaaggataaaaatgagtcttaaaaaaagtgtatttgtcttcgtttcgtcacatttagcaattaatgtcaatacctaatatgaagctatttcatcaaaacattagagagtaaaataaagtttctaaatcataagcgaccaaactgaacaaaaattaaatcataaaagataaaatatatatgtaatttagtctatttttaactaattaattttttcttttaactgtgttttttttctatatgttccaaaaattgataacatcataattaatgagggatttaaaaatattgtatactaaaactaactccacgtaattgtcttgagagacttctaaatgatgtgataaatgagtaggtttcaaacaccattattatatcatcaaataacttggttacttataccaaaatctaaaatcaaatttattaaattttatattgactaaaatcaaaataaaaaattttaaatgaccaaatcaaaatattctataaataaaaatcaaaatcatatttaagctaaaggtaaccaatcaaaaagacattttatatcctattaaatattaaagtgaatgatactttatagtattgtaaaaaaattaaggactccagagaaagttttatatatataattaatgactatgacaaaagatacttgtaatatctgaacgacaaaagattgatcaatttataaaagctacatagcaacaagatctccaaaccctggaaagacaaatccaatcctcgatagacatatatcctaataaactaagcaaaaacattgaacaaaaaagacaaatatacaaaacaaggaggatggaaggagagggcatacaaaccagagagagcattaatcatgaggaagcaggttttgaaaaacgaggtgttacccattctcttggtgcactttttcatcacccagaaggggtatggtgatgggggagcatctatatatatcaccctgctcatcactagccatggacataaggacaagagtacgtactagcatacttgagagtactatatataaga

SEQ ID NO: 2768 - DNA, 1425 bp, Glycine max
  Soy_ogl_4732 Gm14:12903601..12905025 Cluster 11
aattttttgttgaaaatacgaagacaattttttttatccagatatctataaaattttgtggcgttggagttacattcctatatggcgtatgcagtatgctgtgaaagctggtactcatttttatgggtcatggcctacaatgtggcacaactatgggtttgttgcttttgcactttgaagttgcgtcctgatccttttttcttttttatcttttagattgaccattccagaagttaaaatttgtaatcaattacattttgaattggtcattcagaatgctaaaaaagaggtgcaggaaacaacagccacaactttgtagcagtatatatggatcgaacgggctgaagcctagtatgctgatgagacccaaaaacaatgccagtgtgcttgcaggaaaatataatacaataccttttgacaatttctttttgactaaatttaattttatatcattgattttggttctaatatgtttatgcaatagttcttcaattttagaaaagttataattttagtctaatgttttagttttacatatattttatttccttttctttattttaataaaattcaatcttaaatttaacatcttcattttatatatcataaaaaattgaaagttttgatactgttgattttttaaccaataaaaatatcaagtcacttatcttattattaatttgaaaatttttatttttttcaaattaatccttgattaattaaaatattttaaaaaaaaattcaaactgcaactattttgaattataaaaaaaaatctgaacataaattagaaatctgaaccctgatctctttcttccataaaccaagctaaaatctgaatcctaatctccatcacccgatagaaataagtgacctgtttttcaaaatgtctattttaccaaccttggagctatattttttccaattttctttgtcatgttcatttgcctcttgggatgcctttgattcataggccttgtattatgggttatcttgtaatcaaagataaaaaaaggcatatatttttcacaggaatgttgagccactttgccaccttcgtctgtttactccaagagcagtgaatgattagaatgctaaatcaacttttccatttttcacacaggagtggctggtgctgggaattaaattccaaacgaggaagtgagggagaatgacctctgtctacttgggtaggtgcgataaggccagctcaatgaatattggggaaggtgttgagaatgcttctgcgctttggataggaaatacaacagctttataggagttataatcatttatcggtggtataatttttctctttagttttcaatggttaccgattgggggattttccttggttattgaatatttattgctactatatatatttattactactggtgtcaataataacatattgtttgcctt

SEQ ID NO: 2769 - DNA, 1480 bp, Glycine max
  Soy_ogl_5083 Gm15:24033921..24035400 Cluster 11
gttatggaaataagaggctaaactttggtatgcttgagtctacctaggttcaaaattatcaaacttgtgcttgacatgttaattataatagactaattttgagggcttaacttaatttatttgaaggttagtttggtctaaaagtaaggttgaacatgataagtttattgtttttctatcataattactttaaaaattataataataataatttatataaaaatattttatattatggatgtatggttattgaactctaaaattattgtcttatttatatatttattttatttaaattaaaatgtgacatgtgattaaaaagtataattttgttgttgttagtttttttttgttagataaacctaaatatgtttaataattttcagctgaatggacatattaacctgaaatggatttataaagagagacttaaagtatttgttttacttattaatggaaatttaattaagtgtcaataatttacaacaacttatacatattattcaatcaattgaattaaattttcttgacatagtatttactttttttaaaaggataagaaacaaatatcaaaactcaaattataaaataaataatattaaaaattagtatattaatataaaaaatatgtaagctttaatataaaattatgatattttgttgaagaaagattattacaacagagttagcgcattttctattttcttttagaagataaacatagaattaaataagttataattttaaaactaatatatataatttaaccaatgactaaaaatttcataataatcaatcacatattacttaaacaaaatttatataaattaaatagaagatacaatattacaagttgtcgcgggagaaaataaatttagttttttaaagtaatttttgtagttctaatgatagaaaatctttattatatttagagttaggaaggacttcttccgcaataggaatactcttgctaatttcatatttgtttgaattttttgtcatgtgttttggccaagtcctcgaatgattttgttcttgctcttttctctttttaataaatatggtatgctacaaatgattggtagggcttagggtgttagactagctgggatccctttccttattgtgatgcttttttattcctaattttcataaaaaaaaatgtttaaagttttaaaacataattgactcaaattttgttaaagcaaaatttattttttattcaaccaataataaatacgcgcgttatcttcttcaaacaaagaaaatacattctttaattttcttttatcaagaaaaatttataaaaaaaaatagagacacgttaacaattgtcagaaataatggttgtatttggaaggtgtatccatcctaaataggaagaaagatagaaaatgagagaaaaggacttgaaatgttaaaaaaatgtgatcggaaataaagagagaaatagaagaaaaaaatataaaagagaaaacat

SEQ ID NO: 2770 - DNA, 1289 bp, Glycine max
  Soy_ogl_5740 Gm17:37214312..37215600 Cluster 11
ttttttttacattttttattctcaagtatttttttatctttacattgattttgaaactaaatcattcattgcatcaacccaagtatcgcaccatatcaaactagtatatatataattttggctgtcgacaaatttaatttaaattatacttttaaataagcatttcctagaaaaggacatggatttatataattttggtcaaaaaaactgcgcctaccattgcaagttggtggagtccacgtttttttatagggcggttccacctcatgccctcgtagcatgcaagttgctacaagggtagcttattgtataggtatttatgggggaaagcaaacctttaatgattctcctgaccaataaaattgtgtaattctggacttggtagacccacacaaacttacaactttatcgagtttgcatagttaatcttggtattaagttgcacttgcgtcttggaaaattagaaataagttcaatcagcttacgaatcacttatgacgtagtattaccttgatagttgacactttgtttggttgtttagaaataatgggggaaaaaagagtgagaagaaataagtgaaaaaagaagaagatatgttttttagaggagaaatagtaaaaataatgatatgaccttgtgagttccacttacctttcttaatttctttaccaaactatatggaaatgagcgttaatgactcaacatatgatagtagattaattattttaacagcaatcgactgacacagtgaatgttttgaaaaaataatcgatttttaaaaaagaataatcgtctaagcgcttttaaataagcgttttttttaaatatcattcaaataagtttagagtttattaacctattaaataaacgcttttttaaaaagtgcttatttaatttttattgtaatatttagaaactatatattatatatttgttgatctatttaaaaaattaagtttatcaaactaatataagttagagtcgttaacttattcaaatacaagagtttttactcatttaaaatgctttttttttaatatttaaaaactcgtttttataaaaaagcacacacacatatatattattaattaaaaaataagtcaagctgaatccgtaaaacctaacccgtctaaactgggtccttttaaaataaaaattcttcttttgtcatcgattcttttgcgtggaactaagtcacaatatattcttaactattgtgaatgttgaatatatactaaattctctagtcttgaattaaacgttgaatgatgtgtttttttagtttctca

SEQ ID NO: 2771 - DNA, 1481 bp, Glycine max
  Soy_ogl_6060 Gm18:18504695..182175 Cluster 11
cattaacaaacatttgtgaaacaatattttgaacacacacaatttttagtaaacctttttaactaaacaaaagagttgaagtttcattctgagtaagcaacaattttccataaattactaagttttcattatgagcttaaaagaaatatttattctacacataaactttataactaacttttgaataaatttttcttttgaaaaagagctaaaagttcatgaaaacacaatccaatccttcattcttgtgttattttattcactttagaaatgaagcctgccacatgcacacgtattggtttttttcaacctcagtacaaacacccaaatgttgttgatattaacaaaataatttatactgaaatttcatataaaaaattgaatctaatatgtataagattgtagcagttgtaatgattcatgaaccatgaagtgtacaaaatagaaaatctccatgcattcaaaatgtatgaggtactttccaaagaaatttgttgataggaaaactttgatgttgatggatatcctttgtacaaaaggagaaataatggaaaagttctttagaagggtgactatgtcattgataataaatttgttgtcccttataataagtatctacttctaaagtacaatgatcatattaatgtagaatggtgtaaccaggctggatctataaaatagctcttcaaatatgtgagcaaatgtcatgatcaaataattaccactttctacgatagtgcaatcaaacaaaaggagtctcaatgtattgaagagatcaaaatgtattatgattgtaggtatttgtcatcatgtgagacaacatggaaaatttttacttttaacattcaatatagaaaaccttctattgagagatcatccttccatttacctagtgaatatgttgtatttgatgaagatgatcccatagaagaggttgttaataaaacaaagaataacacacctaagtttttggcatgaatagatgcaaaaacatttctcctgaagcaaaaaatattttaggtaatcaatttccctctaaatttgtttgaaaggaatgtgaatgccaattttgttctaaaaaaaaggaaccacaatcaaaagactattgtttattcctataggaagtgaagagttgtattattttagaattttgttgaattactcaaaggtagcacactcatattcttagattagaagcattaataatattatttatcctacatttaaggatgtttgctatgcatcaggactactagatgatgattgtgaatatctgttgaagcaagtcattggaaattaggatgttatttgagaagaactttgttactttactttttcaaattagaggtctagtcccgaattactttggtaaaaaacttggaagtatgtaagtgatgatatgcttcataaacaaggattcattatgcaattcaatggtgaatattataacttcttttgatttatatctttcatattatata

SEQ ID NO: 2772 - DNA, 1800 bp, Glycine max
  Soy_ogl_6114 Gm18:50380201..50382000 Cluster 11
atattttattttttacactaaattacaattttgattcaatatttaattttgcatacatttataaaaaaaatactttatatcattttattaaaaatcaaaaagtagatccaagtaggaatactcgtaaaaatagtggaacaagcaaaattaagtgttgccctaatcaaggcatgagtcatcatattgacttaacttctaacaaaaataacgctaaagttatgatgattggaaataatgcagttacaatctcttaaaacgacaaccaactctctgaaaaatcagtaaaggaagagttaaccatttcagcagtggccttacaatccacttcaaagatgacaaaatcaaattccatagaaacaactcacttcgacgcattaggcagtcccaaagtctctcattacatactttatttcttttatttttttacgtttaaatgattaaattaatttatatgttaccttaaatgaataagttagatctaaatttgtttggatcaaaataatagaaataaaaaatatgcaaattaagtattgaaccaaaattttatatttttttataacaggaggagaactaaaattgcgggagagaaaaaatagaatgagccaagtcattgataaaacattaaaattataatttaacctattttttaatataaaaattgtatttgttaaaagtattcctcaaggaaagtctcacttttgtctagacatgctttgtttcttttgtttgtatatcaacttgtgattaaagtgttcaaagtggcaaggtgggaggattgatcgagtgcttaagttttagtctcatggatctttggtagtgcaaattcgcggatccccacacacatgctcataagatttttacattgtgattaagttaaattctttttttagattattttaatttttaatttttaattcaaagcttatatgaaaacgttaattttaatgtgccccttttttaagtttgaatggcttaaaaaattatgggtctttataaactgtttttaaacttgcaaattattttatcattttatactcctagtttaataattattgacaatttaaggagtgtaactcaattgacgcacaaattaaatttgtgcgaatgaatgaatacatttttaggaatgaagataaaccaagctcggacggaagatttaataacacttaaaccttctcttttctctcaatcaaagttttattttcaaaatttacaaatattttttttttagagttattcacttaaaaaaagtgaagtttctcaattgtaaaattcaagaaaaatacatttgactaacttcataatttactatttttattcaataatttttcttttcaaaaaggatgatagcttgagatagttaagagatgttttttttaactaattgcaagaacgtagtatgtaaaatacacattccaaggatgcaaaaataaatttgaaaatatttaattaagagagtaaatatataccaacaaggcccaacacattagttaatatttagttaagttctttaagcatgttatcaggagttttattcgttgatgagaaatattatttattttagaagactatggataacgaagactgtgttgaagagataaactaattttagtgatctctactctttgaataaaaaaaaaaaataattatggtggtctacaattaattaattaattaatatatatatagaaaaggatataagtatgtcaaatatttatctttttggtttttaatgcacactaaataactcagtagacaaaaatatagatataaaatttctccaaaaaaataatagatata

SEQ ID NO: 2773 - DNA, 1303 bp, Glycine max
  Soy_ogl_6116 Gm18:50772601..50773903 Cluster 11
taaatcttccttctttatatcatttctttctattatcatctacttcaattgaaggactaatattaattatttgttttctccacttcagttgcttaactattgtgcaatttttccttaatttatatgagattttagacattctgtgtgaagttttttagacatttttcttaacatactggaaagtattttcaagaaaataactttattttttcaacattccgaactgttaaaatcaaaacattgtttcagaaaacacattacagaataatgattttgtataaatgttattggtataaaaggtgtatgatagtgaaaaatagaaaaaattaaatgagagtgtactcaggcaaaaagaaaaaaaaagcggagttaatataacaaaattcttctttcttttatacttgtgagttgtgtctagaggcctaatttatgggttttgcatatggagtaacaagccagtccatattatacaactatggttaaatgagtttgtgaatataattcatttctaacatctctatttgttgtctcaaaaaaatctctatttgttaaaaaaatttgaatataccactaatataagagtactattgtgtttgaaataagataatgtagcatataatcaatttttttttttataataacacatttaaaatagaaggagaaagtctgagaagacatcattttcataattttattttatttttgaaagaatgtttcataaattattatataatggaattttaatactacaaattatttttaaaacgctaatttaacttaaaatgaaaataataaaaagcaattatggaagaggcctcctagtcccaacaatgctcgaagatttacttctaaatcttttataacaatatatacatttatatttactctgatcgtgggataaaaggcaatagtttttatttttgagataaggataaaaagaaaaaatagttaacatgtaacatgttggttttatcacatgttttttgttcgatcaattaaggtacgttaaaatggctttgctattcccactcaattatttgctacgtccaccccctatttttctaatttttttaacaaaggtactcttaacaaaagttttcactgtattaggaaatctgactttgccataaccaattaaaacacattttgcatacaaagacggaactagacttacaagttaggaatagccaagaatataaattttgttcatcaaatatataaatattaaattttatataaaatattcataagtttttaaaatgatccgagaacatatataaaaaatatatttatataaacaata

SEQ ID NO: 2774 - DNA, 1800 bp, Glycine max
  Soy_ogl_6133 Gm18:52288101..52289900 Cluster 11
tctattcgatatatgttaatgttcaaggtgagtgagaaatcgtatagcagacgaaaaaaaaccacgttaagagaaactgattttataaaaaaaatccaaacaaaaaaaagaaacaataactgtcaaaaaattaagcgaaaaaaaaaccacgttaagagaaacggatttctcaaggcaccaaataacataaatgacataatgaagaaactgagagagaaaacagttttctgatacgtgatttctcacccttcacggtagtatgtatcaaatagacaaataatttaagacttgtatcattcagttaattatttatttaatttgtattttaggggtcaaaaactcaatattttctcctcatacgttggtttatggtttagtggaagaaagtaattaattatagtggtgtccctattgagttctatgaaatgatgggccagcatatgtcacacaatgtctgattcagcctgggcagagctatgtctacaacttcaccatcaaaggtcaaagaggcacacttctctggcatgcacatatcacttggctaagagccacggtgtatggtggcattgtcattttgcctaaaaaaggcatttcttatccgtttcctaaaccagacaaagaagagataattattctaggtaagttttatattagggaaaaataatcattaagcctctaaagattttagtcctatgttttaaaactgatggttttagtactcagcatttttaaaaggtattggattttgtcgttgatcatatactttattttgactatacccgtcacatttttagaaataccaagaactaaaactatcgtttttaaaatatatggactaaaattagttttaacaaaaaaattaaggtacctaaaaaatattttatccttatattattgattcgatttattttcattagcacttgtacgttatattccgttgtagtattaagtttgatttgtatcagttttaggtgagtagtggaaatcagatgttgagcttccttttttttgctgagatgggtgttaaaaaagtgcacggagtgagggatttcaggtcatttaaaaacttgttgtacaggtaccgcttcagaaaaaataatttttatgttgtattatcaatattaagtaatagtttttaaatgttgtaattattaatgttgatgaactattccaaaaggaaaactattcctctttctccaaagtcatcccagagactgaagtacgtaaaactctagcttaacaggagaaaattataataacaaaattgacatagacgtacgcagattcaagcagttatttacaaaaataatatgaaaaaagtagtttctaaaataatatgaacaaagtagttctcctcagccaagggaacctgataagactctgattaaggaggaagatgattttgccaatgtttcttagggtatacttaatgattcgtgtgagattaaagctaataggaagaaggtgaaagtaagcttaattatgattatctgaatacagttacgctacatggttttattggttttggtttcgggtagactagacacctgagctgcataaaaaaattgtaaaggttgtggaacaactaggtattgatcaagccattccttgtagaatattggagataatgaaagtggaatgtttgacaactaattattgaacttgatgcagtttgctttgtggtctgttaggtaaaaattgtagatgccgtttaatttttactaacttgatgtttcaggtgcatgtggatgcccgttggtcccacctcctcaagttcgttgttttccctataatcaagta

SEQ ID NO: 2775 - DNA, 1300 bp, Glycine max
  Soy_ogl_6392 Gm19:34247501..34248800 Cluster 11
tccatctcatgactcagtgaggtgtacgcagaaacataattgattccaaatgacgtggtgacacaacaacatcatctagggggaggcagtggtactaattggatgaggcaaaagagaattgtttcaaacagaatatttaggaaggtgactgtttggctgcctaaaaaaagaagtaaaacggatttttctatattaaatagttttcagaacaaaattaagtgtatttgatgttattttatgattaaaattagaattgtacttatgtagtatcgatagtattaactttgaattcaccaaaaaaagatagtattaacattgaatattacttttataggtagaaagtattttagttttcatttctgtattttttaaaatactcaaacttcagttcttatactattttttcctaatgggaattacgaatattttaaaaattgtaaggtctaaaactgatgtttaaaaattaagaactaaaactaaattttaaactttttttagagacaaataattatcattagtcctaattttattgtataaattaataaggtgaaattgtaatttgtattaaaaaataaaggctaaattacttcttgtacttattttgttcaatttagtctttatattattaaaaaaattcaatttgatttttagttttcaaaatcaatacaatgttttcatttccatataattaaaattaaaggtggtcaaggattcaaatcaatatgataatccagtgaactccaaccaatcaaaaacataaatgttggattggtttaaattgaaaaagtgcaaatctaatgagtttgaatgagtctcgattttaatagtctaatctagttgattacttactatttttatttttatacttttctaacttttagagtttgggttttttaatttgtcccaattttattattgatcaatgattactatgattgtaatataagatataatttaattttaaacttaaaatgaaataggtttaatattaaactagtagtttttataataaatattaaactagtagttaaaaataatttttgagtaaaatgtataaaattacatagtatcaaaatcacttttctatttttttttcttctttttttcatttttaaataataaatataacgatccaatccgatcatagtcaaattggtttgggtcttgatgcagattaaaactaagtaaaatttgattaaaattgatcagattgactaaaaagaatgtcatgaatctagtctgattggaccaaatctatgtccaccgatgattgaaataatgccattaactttgtgatttt

SEQ ID NO: 2776 - DNA, 1600 bp, Glycine max
  Soy_ogl_6668 Gm20:1212701..1214300 Cluster 11
agtatttacatattgagattatttaaagggttaatcttttatttaaaggactaatctctcttaaaagatatttttctatacaaacaaatttaaaatcgatataaaacaataatgttaatatgatcacatagatttcaaggtttcggcaagactaaagaaggttagaaaaagcagagttatccagcagacagcagaatttgaaggtgttgcggatagagccgtaatggaaaatgaaaatgaaaaagactgcggataaagcgcaagaaaagaatctatagttaggcagaacacgtttgacattttttcttcttcttgattatggtgttaatatgaattagtttctgtcactgattaatttttatcgaaaattttaaatatatataaaataaatattttcttctcagtatgaattatttcatattcatcaatattcgaattctacacaatttaattaaggaacgacatttgaaatttgattataacaaaaaagaataataataaaaataatttagaatgaaattatctgttagttgtcatagcgacaagttctttaattttgtcccagataattttttgcattttcgtcaaacaaagtgcatttattcgatgtttgtttatttaaaaataatttaaaaactatccaggcctatatgttaaaatatgtggagtattaaaaatttgcttcttcctttcaaaaaaataaattgcttctgtttctttttcttttttttttaattttaaaaatcgtcaaaaactgtaagggtatacaaaatttgcttctaaaagaagagaacacaatggctgctgtcaaaggtccacaagcaccacaattcaatctattttgaacccttgcttaaatttttaaaaatcaagttaatagaattaagaaatgtataaaacaacccagttaaagtatctttgttaacttttttacattaactaagatacttaagcatataaaatcactttcatgacatgatagaatagcgtatatatctaccgtgcttagttgagtaattgcaaactagcttttgaatgaaaaaaaaaaaaacctcattggtacaagaaacagacactccataaggagaaattgttctataatttgtaataatgatattttttaattcactttcaactcatctttttgaatttggatattttaaacttttctcatataatagaatatgggtaagtaaaacaacaaaaaaatttccgttaatagaatacaaataaattacacaagtgagatatatgaatttttcttacttatatgatttaatttaatatggtcatttttttactaaatgtgaaacttcttcccttatacttatcactacaataacctctccataaaataagtgaaagtttattattattattagcttaaatcaataggacacatcacttgacctcaacattgttttaaaaaaaaattgataccagggatcctaatacgtgagtgtactgttagaaaaaattttaatataaggaaccctgatacataaattcatcaccaattttactatctcttaatatttattttagttggtatcaaatcatactatgacctccacactgctaagattgatcacctagtggc

SEQ ID NO: 2777 - DNA, 1208 bp, Glycine max
  Soy_ogl_6686 Gm20:1775977..1777184 Cluster 11
tgcaagtctacagtatgtataaaattgatgtaatttgctttaggaatcccccaaatcattctacagtcaattttgaaagttcaattttttaaagtgatatttaattgggagcaggtgcaatctacattatgaaagttaaagctttttaaaataatatttaattgagagcaagtgcaatctgcatttagaaagttaaaggtttttaaaataatattataatagttattattataggcgcgaatgttaaaatatttttgttcttatcatgtagtaccatttagtaaaatagaaaaataataaaatacaacactggaaatatataataataaaataatgttataatacatagaaataactagtacactaccatttttattcttaaaagggtaatgttttttttaatatattgtgacattcatttcttttcttttttactggcgtcacattcatctaaaattaaggaaaccatagatgcctgaaattttcagttgtttcatctaacttccaagtcaccaaattttaacttttaaaaaaaagtcactaaatttaagtactcattattattttttcccttaaatgtatgttaatatatatatatatataaaactttgaattaatgtgcatgacggataacacttttaggtatttatttgaaatttttgtagtttccgaaactaatacaacaatgccatacactttcaagaattaaaatgatactttactatcaggataactaataaaattttatcaaacaaaagtaataacgtaatataataacaaggtaatcaaggacaaatccaagaaaccagtggttgaatttttaaaaataatatttaattgggagaaggtgcaatctacatattgaaagttgaaggtttttaaaataatatgacatttgagccatgagaaaagaaaaaaaagataaaacaatattaagtttaagatgtgaaaaattacgaccattaatttgagcctctatataatattggtgtcttgtatgctcaaacttgacaagctagtgatatagcagctttctgataattaacttttacgactccttgaagggtaagaaacagcatcgtattcgtgatgttgcacctcatcatatccataaggtggaagttcatgaaggcgagggggataaatccggcaatatctgctgttggtataagttaaacttaattaacacaattcacaattatatcttc

SEQ ID NO: 2778 - DNA, 1000 bp, Glycine max
  Soy_ogl_546 Gm02:14241001..14242000 Cluster 11
tagagattgagaaccttgaagatccttagagaaattcatgggaaatgtagtaagagtcgttgtcttccttgagtctaaacttttttttgagggtggatccattttgtagaagagattgtttgtatgcctagctccttaaaatttcttgacaattctagtcaatggggagtgtttgcattagaaaatatttaaggttatgtttgtagcgacaccaacgtcttcattgttctttaggaaaagttaataaagagtaactaacttgcggatcctgatgctatgcaaccggagctttttaaatttctttaactctctctactattacttcattagttcatttatcagttacttcattttctacatgacaaaatttctttaccaagaagtgcagagatggcgtcaaagttatgagaggtgaggtgagagtagattataggatttgttgcccgtattaacccttccaataataaatgtgactgaggtgaagtaggggtaatatagtctaattatttctcttctcatttattttctctcttctttctagagtggcaagaaattttattattatttcttcttaataaacttttttttttttacaaattgacttttatttctatcaaattaaacaatccacctcatttttttctctacttctctcattttcatttctctcttatatttcttttcttctaaaaattaatgtttttgttttaaaaattttggggtgcggacaggaaaggctgaagaggttctaatttgaatttttattgagacttgaagttacacatcagaaaaaaagtcattaactagttgaaaaatctaactttaaaaaatatattagaaggtataatataattttgtgaaacatataaaaacaaaacttttatcacttgaaacgattctttcatttctcaatgattctcctcccctcatatattcatcctcttgtgctaaaaaataattcataacactttatatgaatgatggtagatagttcaataac

SEQ ID NO: 2779 - DNA, 1295 bp, Glycine max
  Soy_ogl_860 Gm03:5324306..5325600 Cluster 11
atatttgttatattttataataattatatttaattatatcttaaaaattatactaacattattttttaattgattgataattataaaaatatttatattaatagtgtatgactattaaaccctaatcttatataatttaacagaattgtttttttatggaagatacatactacctataaaagaaaatatctgttaatctcttttattatttaggttaagtttattgatgtactaagtggctaatttaaggaccatgataggtattttttttataattttaatataataattctttatcttccaaacgttcattatttttataattaaatgactggctacacgtttgccatctaacattcaatgaaaatacaagcaaaataaaataaatacaagtctctgtacaacaagggcaaaaattactatatgatttttctttcttttttatgataaatagtttttgtttatattagataaaaaaaataaaagaacacaaatcgttactctattagcattcttattattttttataagaatttaaatccattgcttatgtaaatttttatatcaaaaagagaaatatatcacactatttattattagttataatttattaaaattctcaaaacatggggtcttactcttatttatgagtttcattcatatttttataaattacaataaactttaattaataataaaatatgcattaaaaataaaagttttaatttttatatattgttattataaagatttttatactaaagcatcctccattggaggctcaggtcaattaatatatatgctcagagtcggtagttactatgtatgataatttacaggagttgttggatgatagtagtatacaaaattctgcaatctaactaaatttaaaaataatttattaggtgcaattcttgccgcaacaagtaaccaattatccttgtggctcaaaacctcaaaatccccaaactccaattaccaattgcagaatgaactaaagtctgctaattattgggcttgaagttgttgtttgtttcttgggctcttatggagttatttgtttcctcttcatcaattgtttcatttttaaaaacgttcaacgaaatcgttaaatgcatgtctacttttcctaagtacacctccatcatgttaattagctcctttattctattttatttgtaacttcataaaatgtatttttaattaatataccctataacttagtaactacaaactacattggaggttctgttgctgttattaaaagaactcatatcagcctagtctaataaaag

SEQ ID NO: 2780 - DNA, 1000 bp, Glycine max
  Soy_ogl_1298 Gm04:36411501..36412500 Cluster 11
atattgaaaaaataaaatagataataaaatgtttttattgttttgacatgtagtattactttacaactattcttttgcatacttgaaaacagagtcatcacattggtgtctccaacttttgaaatccgtggaaaatggaaatttctaagaatatgtttgggtaggtggtttatctgaagtataaattatactgtatttgcatagctttgtgatattttcttattttcacctgagatttttttcgataagtttttattacataggaacttatgttaagtgtttaaaactaaacattactagccacaatttgcctatttttgtttttttaaatttaactatcataaattcttaaaaaataaatgacacgcacaaaaaaaaaaccacgacacacctatcaataattttaaaaattaaaatatacaataaccaaaaaatgattaaaatataaattaagggattaaaattatagatatataatttggtataaactttaacaaataatcaccgttaacatgtgtaaataaaaataattttataaaagtaatatctcattataaaaattccacaaccatacaccattgtaaaaggaaacataaaagaattaccagcgatgtacagaagaaattactagtaacaaaatttcatttaactgaatcgtatttttagaagaaaaaaaagagaaggaaatatataaaaattcataaatttattaaaaataaataattataatttaatttatgtaggaattagtgtttaaattaatttagataaagaaatgaataaaataaaatatttaatttgaaggaaaagaaactgaaataaataataaaaaatacacatactttatattttatgccttgataagattcaaaaatccgtcttttcataaacctctcacatgaactattcctacaagctatattggagagcttataaaataagctaaaaaaaaacatcttatagaccactcgtaaatatgtggacaatgatttatgtagtg

SEQ ID NO: 2781 - DNA, 1116 bp, Glycine max
  Soy_ogl_3086 Gm09:30228408..30229523 Cluster 11
tctataaaatgtaagaggtttttcttttcgcctaccatgctgcatgtttgctttctctctttggactaaagtcagttttttttaaactcctaagatatcaattaatcgcatatctcagtatgtttttgttgtctatgtttacatcaagaacacctgcaaaaaaaagacatttatttaatagataaattaaattaattttagagataaaaatgattgctcaattttaaaaataagaatgattacacaaatttgtttaccaattaaaaattcttctttggtaaattcaaatatgtatatgcacacacaaaataaaaacatgtaagctaaataagatgtagattcacataaagaaaattcatcagaagaaacaaaagtaacaaaaataaatattccttagcgagataaataagattcatattcggataaagaaaactcatcaagaaaagacaaaaattgatgaaattcaatagaagatgttaaaggaaagattatgtaattcttaaagagggaagagtgaccggaagaaaagaggacagttttgataaagaaagattgaaataaagtaaaactgggacgtgcaacaaaaatttaaaaaataaaaaatgcaagtcagtttgtgcaatttagcgtgatgagaacatttataaccaccaaatcaaaaacactaataagaaattaataaaagggagagagaaagaacatgagtcaattacatatggaccacaattgtgcagattttgttttttttttttttatcagttttagttttaagacatagattagatttaaagataacaaattaaatctttataaagacgtaaaatttaaaattaattatttacggttcacaaagcttaaagcttcctttacatataatatatttttttcgttaattatggtattaatacgaagtagttcaacagaaaatagtgattcttcagaaaaaatcttgaaactgaatacaagttaatatcacttgtatcaaccgttattaatataaatataaaaagatagatatgattttataatacatcttattatgttttattttatataaaagaaaaagagggtacttctttttaggttagaaaggaatgatacttaattcgttgttat

SEQ ID NO: 2782 - DNA, 1100 bp, Glycine max
  Soy_ogl_3094 Gm09:31813001..31814100 Cluster 11
tgttaacaaaaaataatgaattggcatgtgttatggattacttggttttggggataataattttgtaacttttaggaaatataagattggttggatgattaaaaaaattatgaattcaattctgaaaaaaaaactaataattaaaatttttccgatgaaaaataaattgtaaattgtaactgcttcataatattaaaatagggtttcttaaaatatctatgactatcccttaagaaaaactgcttcactttataattaagaacgaataactaggaaattacaatttttgtagcagaagacaatctttttagataaagaaaaaaattaatcacataatggaatacaagggtatctctcctcgttacattagtaggagtttatgaaatgctaagacaggcttaaaaggagatgggacaatattgcttatgaaatgatccagatattttttttttattctaactttaatcgataaacaccttttgactttgctaatttctaccatctcatttttgttcagttaaggaaaactaaagcaggttttcgtatctatccatccatattggccaatttgtgtagaatcatataagctaccaaaatttacaataacctctcctggtgtcatctttatatattggaccaaaaattcttatactgtttttccttgttatcaatataactattttttccgacaaaaaaaatatataccaaaaatgtgatttatctaagcatggcaaacatgtatatgtacccaaacaagaataacataatatttttctcgttatatgaacgagtgaagctagaacaattgaaaaaaaaaaattgcagttattatcattatctaaataattaataatacatacaataaactactaaaattttagttgatatctaaaggtagcctcggtctggcggccaattgtggtatctttcgcgaccattggggaaatgctttagtctgcttctcagtctctcttggcactgctctcgcgttagaagcaaagctcattgggatcatcacaactatgaaaattgactcttctaaagtgctggtttccgttgtggatagaatgtgactcgaccttagtaatttaagctttttt

SEQ ID NO: 2783 - DNA, 1281 bp, Glycine max
  Soy_ogl_4257 Gm13:24910301..24911581 Cluster 11
aattataatttggattccaaatttatgtaagttcggaaacgtaagataggggcacagactttttattttgctcagataaaatcaaccaaaaaggcattaattaatggctttaacagaagagcaccagtttgactggatttttttaataacagcaggtttcgtctccaagaaacctccttaccattactgttttatttatttattttaatcaaagacagctgcattccccttcaattactataatgtcttttaaagttttcagacttgaataagaaatacattaaataattttaattttaagaaacgctaatattttttaaaatataattatatttaacaaaataatatagttaggctattcaaaacaaaaaaatatttctcataatatataaatatgaatttttaagttatatatttaactaaacttaaataatgacgtgatgacataagattttattttatttatatgaatgcaaataattaatatttatctaatagaaaaatttgtcttaatatcaataaaattatattgagtcaatatcaatcatatactattagtaaaattaatatgtgacccactaggttagaggatactatcatctcttacctaagaaaaaaaaagttatatgtttaaccgtaaatctgtatactaatttgactttaatttcggagaaaataaacttatcttacatggtcaacattttttttttatcagtaatagtgggctcagcgtagtagagttgatatattactactttcgaagcgaaaatggaatttttaagatatgtttatttattatttattacaaatattatttttaatttaaaaatgaaaattatatttttttgattataataatttaaagaagatgcttttaagaattatgtgttttttttttatttttaacataaaaatatatttaagttgttttgattctgtttaatcatatttttttttacattcacatatatttatttcacatttattctgtataattatgttgaaattagttttataaaatattttttataaaacaaaactacaatcaaacacaccttattttttaaaatatacatatataaaaatataaaagagagagagataagagtagttatatataatatttattatttaatatttaaataatatataaaactatataaaatatgtgtaaaaagaacgtaaggtcaggagaatatgttaatggagtttcattattcttgttatcacaatattaatttgatgttcccaatgatttcacaatttattttgtaaaacttt

SEQ ID NO: 2784 - DNA, 1479 bp, Glycine max
  Soy_ogl_5114 Gm15:432820..43286100 Cluster 11
ccaatttttcaaagaattttttttatttcatttctatctaaaacaaaatgttaaaaaaatatagcactcttatgatttacatatattctatttcttcttttcatatcaaataagaaaaaaggtcctctttattttttctttttaattttttatttctatgattttggaaaaaataaataatattctttacttaatatgtattatgtcaatttcatttatctatccaaaactttattaataaaaatggagagaaaaagaaaaaaaatcttccacacgtagaagacggctaggatgggggcggatgaaatttgatatgcaaataataacatgaaatttaaatattaaccctaaacccacaacggtatgctggtattattattttcacacacaagaacgagtaacttcaaaagctttctaccctcaaataatcacctagcatatgtttggaatggaagaaatggtgtttgcttggatggaagaaaaataagaaaaaaaaatctaaaatttgaattgaaagaaaatgaagaaaaaaattttaatttttttatttaaaaaataatccttttttatctttttttcttcaataaaaaaaattcattagttgtatttttttcactttttctattgccaaacaacaaaagaaaaaagaaaaatttaaaatttgtaatagaattaaaatgaaggtgaaagaaataaattgtttttatttttataagccaatctttttattttattttctctcaattaaaaaaatatatatcaattttcatttttttcttctttgaaccaaacatatcactaaagacggcaatatccaaaccgacaaactcctcaactgtgtagatcagttgtcctttcctctcatgcaacctattaacagtgttgatatttcacgcagtattagtctttgtcattaagaaagaaaatcccatatctcacacacacatgattgtaaagttattttaaaaattatattaccaattctttcaaaaaaattattaacgataattttaaattaattgactatataattttcttatacattgttaatacatacatgctctttaaactctaaaaataaatgaaaagaaagcagtgtttgatagtgtgaaaaaatagaattgaaatttttttttatttaaattaaaggagaaaagaagaagtgtacaattcacacataattttaatttttttctctttttcttttatttttttcacaaccaaaggataaaagaaaaatattgttagcagaataagaaataaagcacgacagaaaattagaaatttaaataataagagaaaaataagttaaatctttgtttttagaaattaaatttatactcttttttaatctactttttctctatttttttaaaaaacattatccgtattttctttaatctttatttttctttcctcttatctgacgatgtcattactatgtcagttgagcatcattcatatttcataccgagttga

SEQ ID NO: 2785 - DNA, 1200 bp, Glycine max
  Soy_ogl_5693 Gm17:15576401..15577600 Cluster 11
tctaaactaaaaaatctacccgccaaaacgcggccccttagaatgttcataagtttatctatatttatttttcttctttgttttatttcttcttcataagttcgatcatatcatattattttttatagctatatttattttccttctttatttttgtcactaattatcaaatactactttcatactattagtgtctaccaataaactttatggtcatataaaccgctgcacaactttttcattctgcaatgtggtgcattttggatcgaaagttttttttttttttttttatagagaagatcgaaagaagctaattaacatgcagacaaatgttaatggaacataactctgcaaatttgaaagggttcagttaaataaaaattaagaagaatttgtattttacaatgaaagtgattcgaagagaagacaatataataaatgtgttatataaattattatacaactttatgaatttaactaaaatattacagtgtaaaatttttcgactttttcatttaattattaatttattattttttaataattacttttaaaattatatatagaataatttttatttaatgatatatttttcttacactaacgatacattaaaatcaatctctaatttcattttacggaaacaatatctccataaaaaagtgctaaatgttaatgattgatatgtcaaaaattgcggctagctgctatgtatgattatttccttatggtagaattcctatatattgtcatataataatgcggatggtcgtatccggcgtatggcacgagtgcatgacattgagagatatccctttcttaaagggaaaaaagataatgaagatatttagacactaaaagaaagagaaaaatataagtattatatgatttataaaataataagaaaaaataaaaaaataagaaatattgatagaatatttaaaatgaaagaatcttcatgtattattactttttctaaagttaatatgctatagtaagaaaacatctttatataggacagatttttcccacgattttgtcatgcaaagagaaagacagataaaacgcaaggcaagatctcaacaaattatagaaataaatagatagatataaaatagatagtaaaatgagaaaagtttataactacaataaaaacttttattataaataaccttagaatagtttatactttatagtatg

SEQ ID NO: 2786 - DNA, 1700 bp, Glycine max
  Soy_ogl_1615 Gm05:26718901..26720600 Cluster 11
atgttacgacatcgaaagcttgaaaatatcatggtgttgcaaacatgatggcaatgtaggacagggtcgcaggatttatggcacaatggcattcataagtaccaagttcagatttttttcgttgatttaaaaattttgtagttttttttatattaagaaaatataaatgatacattataaacagttaaactaaatagatcgtcaaaaatattatggaaataatataactcgatcgtttaagaatggtcttttctcttaagcatattggacttaaatataaattttctttaaaaaaatagttgagttaagatgccatattgttaaaataataaataatagacggataataaataataaataataaataataaataaacttgttagaatatatgtagaaattttgatgtataataaagtactagaaatttagatgaatttttttatttaaaagctaacgtaagtttataacttacatatagtcaaaattttaaaatcatacttttcaaatttaacatctaaatgttcaatagaagtttgtttattaaagtattctttctttttcatttgacatttttcgaaaccaagccaaaaaaaataaaagaagttgatttcatttaactttcagcagttcatgtcacatttatcaagttttctttcttcctttactttttttcctctcacttttgtttctagtcgtaaacttggaaattttatctttttccatttataagtcaactttagttgtgcttttttttttttttttgtaaaaatatattggaacagaatcatctatcttttaatgagtttaaccttataatcgaaaagtcatcccggaatatttgcttaatggcttataattatgttacttaaatgtttatatgattatttaatttatatattgaaattaatgaaagattactttagtatgtataatacaataataaattaattttttttgtcagctaataataaattagttaacattatatcaaatgaccaacgagcattaaccaattgataggattaaataacattgagttcaagctcttcagttcaccttttgtctgtgataattatttatcgaaaggataacattcctctctaaactacttactaaaaaatagtatagtaaatgtttatgtcaacaattgatttttaagagaatgctaactcatagtagtactacacaaaggaaccattgactttgcagttttgtcaatactgagtcttaacactacgcattggcggtgaaacaaatggaacggtgaatgatttgattggtaaagtttgaaaaagttttacgagcaaaaccctatttctatttactttaatcttataagtttacatctttaaaatcattatatttttttcctcttcttacttcaatgtaacttaaagcttattcttaaaggtaaaacgtgtccttgcaatcaaagtaacggaatgaaaagcaaatataaataataagagtaataattaagaaaagggccagggagaaaagatataaaagtggcaatgtcatgatatatacgtgctttagagccttgtattagtgacaagctatcaattagcaaatgctataatcactgtattatagtacttaactttcttacatcgagtctgcttttgatttcttggctattaaggcacaccaatatgcataaagaagatgatcaaagagcgagtgggcaatatacacg

SEQ ID NO: 2787 - DNA, 1300 bp, Glycine max
  Soy_ogl_6655 Gm20:559201..560500 Cluster 11
ttttctacaataacatattaacatgtataattgtatatattagtacagtgtaagccaatattgtctgtaatcgttagataaagattatatgaatggaataaactcaacgcctaaattaagtattattacatgcattattttttttggtatgggtatatgaattattttacagtaaaaacgtatagctcccacctttctttttcttttatagttttgtccaaagcataacatgataaaataaataaataattcgcaatttccattttaaaaaattcaaaaaacaattttccttttaataagttaaatagatgaatatttcatttcgagcttggagcatatatagattaaaaaaccagcttaactatgtatgaaaaacagcttagtttcgcttaacctgttgtctcagtcagattcttttttttttttttagttacaaagtcagagtcagaattggcccctaacggtgaattttaaatctatctaaccaataagtaccaggtgcgtaatttgtactgttccatattacatcagttaacttttctattctaggttacagattctatatatcgttctgtacatatcattcagtaccgggcaatgtattttacattgtcaaataaacataatttttttcatataacttttatagtagttaatataaaataaacattttattttatataattatttgtaactagatgatataataaaaaaaatattttatatattgattttatttgtgggtataaagatggctaaaatatgtaaaagaaaggattgaatatcacataattatggttatttgtgttggtctaaacttttgtttttactaagatcacataaaacattccattaatttttgggtaggaaatatacaaataattcgagtcaagcattttaattttacatttagtctttctaaaaatatagtgtgactatttttaaacttgtttcgaacaatttaatctcaatgaaatctatttggttcaaaatttttaagatatatatcaaattcaagttatatagataaaaaaatataatttaatattttttactatcagataaagtttttcataaaaatgaattacaacaaaatcagtaaattttacacttaagaaagggacctagtgatctacatggtggttaaaatgaaaaaggattgacataatgaatagcatatttccatatgcagttagcctttgcgtacgtatatgtgtgattcctttggggtactttcgcccaccccatgtctcaaatttgagcttcctctgaaaaggaacccacacagaagtggggccca

SEQ ID NO: 2788 - DNA, 1600 bp, Glycine max
  Soy_ogl_178 Gm01:46889101..46890700 Cluster 11
atgcccttaatcatcttattccttgcccataaaaaaatggttttattccttgtattgagtacttaatatttaatgaaatgagataagtatatatttttcagtaaaaaaaaaagttcaatctagctacctaagggttagcttccatatcccaagtttatgtttatatataatattgtttataagggatgtaataacatacactttccgatgtctactaatttaacacaatagatatttatttaacgtatttttttgtattgtatcagggtgggtttaatagtccaaatttgattaacttttttttttttacaacaagattatctttcgattgttggtttagataaatagctgcttgtggactcctagatttatggggctgctatggttttatgatccatggattaattaatatcttatctctgtcatgattgaaatttgaaatataatctaaacttggattttcctcattttcctcatgtaaatgcatttgatttagagcatcttcaacgtggatgcgtaaataagttgtttaaagttaaacaatttaacattttttatatataaacaatcattgcttaattaattactataaaaaagaataatttttcaataaaaaatttatggtaactaaagttaagtatttactctaataattttagcattgaagtaattttttgtctaaaattcttaaatttatgagactttgtaggacttacaaatttaaaataaaacatctcagtaatcatgcattttacatgctcttatagttaccatttaagatatattattttgctcacacaaaaatggaagtaaattggaatatgtatttattttataacactcaaagatttttataatacatttatattagtacggtgagaggtgacaaatgagagggattaaaaatttaatgttgttgagagaagagagaataaaagagtttaaaaatttaatgctataatagatgagagaagagacagaaattattatcgtagagattaaaaaaatttgatgttgaaacaaaaattgtggttacaaacaattttaaaaaccttgcatctgacacattcctagtccttgcaagaattttatgaacttgaagcgtggaaaattcataggctttgttagcttgttttaaaaattcaattctttacatcgcaaaaatgagagctaaaatcaacaatttggagagtttgcttctacaccaaaatgaagacttttgagaacaaatattaaacggggaagaaaaaaagggggggaaagtaaataaagtgttcatatgggatgaaaagaaaattcgatttcggtaagacttgatctgaatcgtagttcagattcaagtcggttcaatgaggacgatcgcaaaagaagtattgattttgggactatttgagtcttgatattaagttatccatgtcatcaagtaactttctaaaaaattaaaagatttaattatattttttattcttaattttttacatcgcaaaaatgacaaatttgggagtttgcttctacacaaaaataaagacttttgagaacaaagtgtgcatatgacactaaaaggaaatctaatttcggtaaaattcgatctgaatcatag

SEQ ID NO: 2789 - DNA, 1400 bp, Glycine max
  Soy_ogl_4072 Gm12:33595301..33596700 Cluster 11
aataaataaatttctgcctaaattttggataagcataaattaattagtgcaaaaaaatcaataaggcccaataaacacagtctatgcacacaggatgaacaaattgaaggtttgtctacactaataatgtgtttgaataacatcatgaatcaattctactcctccaaatcatggtgatagaaacaattatttgttactttttttttcatcatgaaaaataattgattattttttatcataaatctaattcaaacacactaagttcacgtgttcctatctcatgcacgtgagcccacacctttattaacttatttagaagcttattaaaacaaataatgatatttaaagacatgatagcatgtaaaaccaaacaatgtaaaagtaaaattttagccttttgaaatactcacatgcatatatacattataattcgggttagataatctaaaaccatgttgaatactaactaacgtgttatctaaaaaaaaaaccatgttgaaatactaactaacttgatttaaataatattcatatgtttgctggttttgaaaatttgtttcgaagtttaactgaactttagagttagaataatttttgtgttgaatcaaaactctttttactggattttaccaataattttttttcaaataaaaacatttaaacgtaaactacttttgcttcaaatcaacttaatttaaactcaattttatcatggctgaccaaacagtgtatgtgaacgtgtcaagaagccggttgtgttcatccaattaggacctttttctttgactttcttggttattaatatatagttacggaactagaacaagagtacggactacatgaagctgagtgttaatccatcaatcaatagtatataacgtgtcacgggacacgtactttgaatgattttagtaagtttgaaactttggatatatacacaagttagttatatcatttgaatatatatagttatttaaaatagtcaactaattaatacattaagttaatagcagtaaaaaaaaaaagtaatacattaaataagtgtatgatggatgctctgtgttatttactaaactacatgtctgcagctgagcatgcttatgcaatatatattattggtgatatctaagctattataattgatataattaaaatattaaactacatgtctaaaactaagcattttcattattattgtctatatgaattatttgatgttatgtgttaatgtagatcaaaactcattatttataatatgaaaaaaaaaaaagatgaatgttattttgctgttattaggccttggaaattataaaagaaaaaggttggtgtaaagtctggttggaatgtgattctgaattggttatcaaggccttggaaaattattttgttgttccctggtg

SEQ ID NO: 2790 - DNA, 1229 bp, Glycine max
  Soy_ogl_5372 Gm16:29712172..29713400 Cluster 11
gttaaaggattgttaatgagtaaaaatactatccctaaatttactgtaggttgattaaattagcgtaaaattagaaataaaatattaaaatggggttatttaaaagaaatattaaaataaagttattttttttatgtcattaaaatggttaggacatgtgagattttttttttgtcacatatatagcctgataagtaagaatcattatccacttgatacattttgtaagagctaaatggactagagattctcatgtaggatgtcaaatgaaacgtggtgtagtcttttttctcttttgaaaaagagtttgccacatgaatgtcattagtctatatgataatctttcaaaagttaaaaataatagtataatataattttatatttgtttacgtataatcaaaataataatgaaagatcctaattcattttaaaatataaatatataaatctctttcaacttaacatcaataaaaataatcaatcaaaaaaataacatgtccaatttaaaaacatctccaactttaacaacaccaccatatcttgaatgtgcaggaaaattcatttttttttgtttaagatatattaccatcggcagtaaatataagactttttttaagaaacattttatgtgtattttttttataagattctttttaagttttttttgtattaattatttttttttccaaatattcttagttattttacaagtattaaaaatttaaatgcattatctatcttataaggataagataaaaagtttaacacacattaattaattaagtaaaaagagagggattataaatcctaataatttcaaggataattttcacaaaataatacaagttgttaacaaatttaatgctatgtattaaaaaaatgaatgcattatttctcttataattgataagataaaaagtctaatacatattaattaattaggtaaaaaagtagttaagtggaaagaaaaggattataaattttaataattttgataaaataatacgagttgttaataaatttaataatattaattatattaattaatttttttaaagaatgtgaattacttttaaaaaaattatatttaaatacgtagataataaagtaaaacaaatattataatgtttacttttgtaccatggatcccacgaaaactgaagagcaacgagtgctttgtgcagcaaccctaagcaagacgtgggtctcgcacagtttctctccaacgg

SEQ ID NO: 2791 - DNA, 1479 bp, Glycine max
  Soy_ogl_5983 Gm18:7557122..7558600 Cluster 11
cacacaaacatatatttatatatgtgcgttgcatgagtaatcatattaggagtaatccttattttatatattatattaattgatgaaaaaagtatctaagaataactataagataagtatattaatacattatttttaatgatttaaaattttatatgtactcataaaaaatgtagcaactttaaatacatatcagatttatttaatatgattttgcttttagacataaatttgaaatttaattatggctaaaaaagtaaaaattatatattctttagcataaatttatgttaataaaaataaattaaatctaaataaagcactcaaatattttatttatcaggtgtatagttaaaaaaattagtttcaattacgggagaagttatatatatacattttgtctctttaatttttttttatataaatacttgttaagaatatatacaatcatatactgaaattgtttacgtaagtacctttcttgtaagcagaaatgaaatctggttgaacacttccatataattgtggtggatctccaccttctgtatatgattcataagggtttttccataaatttactcaagagttgaccactccatttgtgtttttgcttcatctttgtaatgttttcaaccccttaacaattaaatgaacaacacataagaaaaatgaagaacacgtgcatggaacaataatcgtggttgccaaaccatagttttgtgaaaaaatagaaatcaaagatagtatcaaaaaatttataataattcatgttcaatcaattaaattacatcttcttaacaaaacatattttgaatcatataacaaagggaagcaaacattgaaaaaaaaaaaactacagtcacatgggtataaattttgtttaacaaaatttaattaaactattatacaattagacatatactgttaaataaaaaaatctacattgatgtatatatatatatgtaattggaattcatcttaccgtcacttcattctattgattaatatgatgcaataagataaatatgatgcaataatatagtgaatttttatttttgataaattgtaaaaaaaattaacaatacatataaattaaatacttaaaatacatacaccccataagaagaatccatcgacatcacatcattctatttactaatatcatttagcagtaggataaactcctatttgattactaagtaaattttcttggtagtgcatatatataagaattaagcctttaaaactactattatggtacatcatatttaacaattaatgtgatatacgaatatttatatcaattttttatgtagacagaattatttaatagtatgatacattaatatactcagtgtagatataaattttaaccattaatttattttgtcaaatgaaatttattccaattggaacaaattaaccataacgaccaacatataacattcttttttcaccgtataataaatcaagtaatcg

SEQ ID NO: 2792 - DNA, 1400 bp, Glycine max
  Soy_ogl_6120 Gm18:50916501..50917900 Cluster 11
tttgacttgatatgtaatactattttttaataatattaatacatttttttatcatatgaaaataaaatatgcatcttaatgattaaacaaaggaaaaataataaattatttaataattattattaattaccacagtaaaaatcaatataataatagtataatatttattcgatttggttcatttttttataataaaatcttaaaatgaaccaaatcataaaaaatgatttttttagatttttatttttgtaatttttttatcactttagtgatttacgaaccgtttgattctattttgaaggccctaatgtggggtagtattcttcctcaattcttataagaaagaaaatgctgaatatattcttattaagaaacacttcaagatatttaaccccctttttttggtgcaaaagacaatcgatattctttatttgaatttcataattagattgtgtataagtagttaagtttgacaaaatgatctatatccccaagataaaaagttcttgagaaggtttctgcatctgaatgcttgagaagatcttgttcagactacgcagattttcgggttaattgtatcatcaagaaattgtcaaagttatacggaggctctattaataaaatattcccaggtaatcaaattagatgagacagaatataaactgtcattttctatggaaatcagccttgaaattgtcaaagcttgcttttaaatttctaaaaaaattgtcatagttggaaataaagatatataggtattaaaataatcactggtactaatatgaattcatagactttgaacgggtaaaagttattgatatgatcctataacctcctgtagagatgccaataaaggatttcgataataattgtttagtttattttctttagattgtttagaaaaatgagaatagaatagtgtctacagggccggccaaagttaaaggcggctgtttgctttaaaaattaaaatcctaacaaaaaaagatataaaaaaattacttagtattaatatttatacaaattttacaaataagaagtccagtgtattgataataaaggccttttttcttgatgaatgaagtttgaatatgctagaaaaaattacttttattctttgtaacgtctttaattttgttattcgttttcatttaaaaattaactagtcatttttattaaaatagattgtctctaaatatgtcaattcgatatcaccaaatttaactcataaatgttactaaaatatataaaacgtaattatttacaataatttaataaatgattttgcatttcaaatagattgatgattaaattttaataaaagtacaatcattttaacaaaatattatttttaatatttttttgataaaaaatatttttattaattttaaaaatgtctc

SEQ ID NO: 2793 - DNA, 1792 bp, Glycine max
  Soy_ogl_3169 Gm09:383259..38357000 Cluster 11
tgtttgtggaactactctttaatgtatagtttatagtgattacaaatatgcattagtctcaattaagtgaccaaaagaacaatttaaccaactgaaacaaacaaaaactttgagattacacgacttatgatattattggaatcaaatttcagattagattttataagatttgagttttaagttatttataaaagttagactttttttaagagactgtaagtatattttatgggagacaatattgcttacgaggcaaataaaattattatatataataattttttttgaatatttaatataattatatattgagaacttagatgcagatttaactggaacaatcacgtatacattaatcaataatcgatccatgtagttataagtagttaaaatgatttttaattaacttgacttatttatttaatataaaaatcttttaaggcttaatctatccattagtaggtgtttaatttaaaatattctacaatttttttcaataattaatttttgtatttttattttgatcctatttttttttataaaaaaaggttatatgttttataattttgtttctaatttttttaaaatcaatttagttggtattagctgaaaaagcttcataagtcaaacaaaattcaacccataaacatacataggcatatagctctagccttagaaacaagtagattggattttttgtgtctaatatctaaataatttaagtgggcacttggcagaaaacgtgatacaacagggaacagcgaccgtattttaaattcaactttaaattttgattttccctaaacatggttatctaccaaaccaaacacgtcataccccgagaaacttcaatttcattatcgttcctggcaatggcaatttcaggccaactcaaggggtatattcgtactttctaaattcaaggataaattcattttttccccaaattaaaaaaaaaatcattttaatctctatcatttttcttaaaaattgtttgtagtccataaaaaatgataacgttcatgaaactggtgatataacattcaaaagggtacacgtgataaatgcttagaacgccatgtcaccgctttcattaataataatatctattttttggagtacaaaaacatgtttttgatatcagagacaattgttttgttcagtttgtgagtcactatgggtccaagatttcttgttaaaataatttcatatttcatagtaattcaatcttattttacacattaaacgttttaatctaatcatattcggatataaataatttaatttattaaaatttgaagtagaacagagtttaaattaaatatttttcttaacacatttatatttttattttgcttaaatatattttttatgtcataaaaaatatatttttcacattctcattttacttgtgtagttttcatatatgtcgacttaacatttaaatattattatttttataagattcaattaattcatcaattttttaaaaagcaataagaaatacattatattatagtattcaaaattaatttccaatatcagtttaaatacgtgattttactcttaaattaattttacgtaaagagtattttaatttgatttttaaccatcccatatcaatgaaaatatgcaggcaatattagagaccctaaacttttttaattacagtattcattttttttttctcttcgtagcgaatggtatctgcctctgacaagtcaatttcacctgcacgtgactctgtgtcttctcggtacaggtgttatcctctcgcacttattgtcaaaaa

SEQ ID NO: 2794 - DNA, 1400 bp, Glycine max
  Soy_ogl_2062 Gm06:42990301..42991700 Cluster 11
tcatagtagtatatttaattttcttttaactaaccagtggtggagcttaaaataaaagtttgcatggaggaataaaaataattaaaatgtaataatactaataatatgagttactttaagtatttaatgatactataattaatatttttattttcttttatgatattaaaatatttttctactttattagtaagtctgttcagggtttatcttaaaactttttttatactctagttttttcactgatcgaataagaaatttagaaaatttatttgtaagttatttttgtgaaaaaaatctataattaaggcctatttttataaaacaaaaaacaaaatttgtatgagaactataaaatattaaaattttctatcaaattttcaattgatttaaagacaaccaaaattttccagattaaagcaaattttgtggaaaaaaattacaagaaaattacaaaaatcataaggaaaaaattgcatgaaaagtctacacatgtagatttctcatcttttagaaaagttatgaaagaatttttacaatttatgcataaaataattttatattatgaaatagttcattttattttttcgtcttcctattttcttgtcttagaaatacttcagcttatccaaacaaacattgtataaactttctgtatggagtgaagatatgaaagtaaaagaaaattgagtttgaagaatgccaaaatagtttttatattgtgaaaatataatcaaataactttaaaatattatataaaaatcttattcaaaacagctctaaaatgtagtaaataattcttctagatccacatatcctcttttgatatccacttatttgtttaatttcaggaattttgagatccacttattctcttgaaaatgtctctcatttggaaattagatagtgtcacattctcattaaaatatctctcattggaaattagataactgtttcgttttattatggcagatttaaccagtattcacagtaatcacccaacatataatactaaaaagaactaacagaaaacagtgataaaccctgtttacaaagattggaatcacagattcatcactcattcactcttacacgcagaaaaagaaaacaaaagacagaacataacactctagaacattgaggttctgctaaactctgtgcacaaagtcctcatatcttcactcaatgactataatatatacctaaaaaagtttgaaggcatgcccgcctatgtcccaaagagaaatgttaaccaagtaatttagccatagtcacaaacgtttctgaaaagtcaatgttcaatcaaatataataataaaataggagtgccaattcatatgaatcccatgagtttgagagtgggaattacaaatggagaatagaaccccacatatttagtg

SEQ ID NO: 2795 - DNA, 1100 bp, Glycine max
  Soy_ogl_4076 Gm12:33688101..33689200 Cluster 11
aaatttaaataagaagtaacgcatgagctggtggcaaccaattgattttcacgagtgactaatgagattgttttttagcatgtattaagtatgtgtttggtcattgtttagtgtgtgtgtttggatatttattgggaaagtttcaaattgttactgaatgaaagttttttcaactattacttaaattataatttggaaattcttaactataatccaagcatgctattttaattttgaaaaaaaaaaaactctcaaaattaaataatttaaaaacaccattattttattgacgaaataacaattaaatgagagacttatataattttttcagtgtaaaaagttcacatagaatgattaacttgaatatatttgcacacacattgacttataattaaaaaaaatcatatcatctaattgctatactaattgatttatttttacacacttataagtattttgaatttatcaacattgtatatatcataaaactattttatactatctttagttttattaatttaaaaagataaaaaaaaactttaaactttttttttaaaaaaaaaaaaagaggagactcgtagattaattaacactaatgattggattctatatcaattaaaaaataataccgaaagagaatgatcttactgtatctatattttgtcagttagtgtttcacttttctcgttacacaaaacagaatacccacaaggaggcaagtgaagagtcagtccaatatcctacgtggcagtttcctatttgtggggagatcaaatcccacgtgctagtgatggtttgcgtcacgtgttcttagaccagcttgttgtgtggcagacatgcgcacacctttagatatcagaaagaacaaaaccataaataataatggagttcgatcgagctctgcgcatccttatccactcataaacctacacctaatcaactttgtatttttttttaattagctattctttgataaaaattaaatattaatctcttgattcaaattcatttaaggaattatttttttataagtataaataaaaaattaaactcataatcatatataaatataaagtaacaaagttatttaccaattctct

SEQ ID NO: 2796 - DNA, 1500 bp, Glycine max
  Soy_ogl_6122 Gm18:51043001..51044500 Cluster 11
cgttgtgctctctcattgatatctatataagagtaacgatagatttgattgcctattcccaaaacattaattgagtgccgtttggttttaatttgcatattcaaacattgcaaaaaatttgaccaacgtgaagtttaaacaatattgtcactttttcttctaattgatgtccaaagaattatgaaagaataaataaataaatattttttttactataaatcacatttaaacgcatcaaaagttgtcaaaaatgtattaattctaatacttttttttaataatttttaattttttgcaaactagtgttttaattatttgccctttttatttcttaaacatgttcagtagtggtacttgctttacctacgtggaaggctttgtatatattagtgcttagctgaaagaaattatcatcgtgtctagtttgtatttgctttataccatggcttcaagtgcaaccgaggaacaaatttctctgaaagttttggttgacgaaaagaaaaatagagttgtgtatgccgaagcagggaaggactttgtggatattctgctaagcttcttatttcttaaacttgcccttggcacgattgctagggttgtgggtaaggaattaaacatgaacaaggttatcgttggaagcctaagttcattgtatgatagtgtggtgtggccaatgtagagaaaaaagcatttttggacaaacacgtgtaaagaaatgctgcttcagtcaaggaactcaacggaaagctattgccaaaacctaaagctcaacattgatgacacggaaattgtataactaggatagaagtaagaaaaagaaatagaaaagtgtaatataaaataactaatattagacttctatttacaaattttttacactactatcctactgattatctaggcaaatttacaaaactggatttttcaaaaaaatacaaaaatggataaattttgaaaataatataaagtatggataagtcatattttaaagcatgactttagaatgttataattttttttaaaatacttaaagtcgtgattcaaaataacattttaataatttttttaaaaaaatataaaatacttgaagttatgttttgaatcatgactttaatatagtttttaattatatttttaaagttgtattttcaaatatgatttctttatatgaaatcgtgttttaaaatacaatttatttatatcctataatatttttaaaatttaccaattccaataattttttaaaaaaattaccttagttttgtaaatttgccacttatctatctttcttgcctttctttttcctaacaaatggtttaactttagaaaggtataaagtagaagtaacatgagccaaatgttgtgcaatgtttagtagatagtggacctacataaagaattaaagatagagttgaaatacaactacaaatattgttagtctagatttcaaaagatattctgtacaatggctcttacagtggctgcaaatgcaactccatt

SEQ ID NO: 2797 - DNA, 1278 bp, Glycine max
  Soy_ogl_1284 Gm04:7786164..7787441 Cluster 11
cagtacttttatatacagagaaaatgaattcagaatttataatcttcaaaattttaaattattcctagcttatttaaatcgatattctaattcaactattgaaaataaaacaattattgaaatgaaaagaaaaaattaattagaaagtaacactaataatacttaaaatattgtatctgaaattagtttttatttatttttattaattttcatccattaataaatattcatgaagtaatcaattcctttctttcgagataataacatgctatgaaaaggaaaacaataaatatcaaaatttagacatgaccccttattttatagggaagtgtgagtgaatttaaatatttttttcattgtgggaatcaaatatagcgtttggagataataatccttaacggtgaatttgaatataaatagttaatgaaaatcccataaactttcaccgcactactaatccagtgaaaagaaatataaaaaaagaaagatatacaagtgttttgtagctctcaccctaagtttagttacatttttattcgtttaaaagtggaatggtaattactctgctatgtcgttctcttaaattaaatagtattttttagaacactagttagtagttaccataatttgttaaaattaaatgtaaataactttgaaattaagtctaaaaaagtatttattgattttactatttctttaacttaaaaatcatttgttagtgtgttcatagatagtggaatttaaaatagaaaaagagaaagtgagctcctattatttttaataagcaaataagctattcatgtattaaaaatacttgttatccagtgaaaagaaaacaaatgttaacgaatgctcaaaacatttagaaaataattgaaaaaattaaattataaaatatcaggcaaaaacaaatgtttaatgtatttcatatttacaagtactactatttattatttttaagtgattaaaaatatttcaaataaaatttaaatactttttattcaatactttatcgaatatttgctattaagaaaattgtttaagttaggtagcttgtataatttttttttttaaggtacacttttgcatttgtagtttcccctttttcaatttaaatctttgtgatttcatttataacataggtcattataattttacggtattaaagtgttagtcccttttagatgaattccttaacgaattaatgctgataaaagaaaaaccttaacgaattaaaagtagtattccctagattattatctataagaatcaagttcg

SEQ ID NO: 2798 - DNA, 1500 bp, Glycine max
  Soy_ogl_1603 Gm05:5301501..5303000 Cluster 11
agaggtcgttccacccgttgtccccaaatatgggtattatgttctaaaaaggcgagcaaacatggacgctacagagaacaagatagaaagcaagtgtgcacctttgtttgcttcttctccaccaaaacggaacatgtttttgttgtgttaaatttttcaaaaaagagagtaacgcaatagaaacttgttttcatcaaagataaactgtaacttgtcttctataaaaaataaaaagtgcaagaataacaaaaagagtgtgaaaaaaacatggacctcgttaaaggggtatctttacaaattaactgtaacttgtgggctttgacgtaatacaggcccttcgtttttgtgctaaatacgacgaaaacaaacagaaactagtagaattttatagtcaaaagtatacaagcactttaaaaaataaattatacttctaataattaattttaattatgattatggtaaaaaaaattaacgattatgatttcagagaaatttaaatagaaatataataaattttataattaattatataatcttaatcattagttttgaattaataataattattagtattttatattctctaaaatacattccttttactttaaaatgaaccaaattcacacaatacatcaattgaaagactatatggtgtgatatacggtaatgtaaaaatatttaaaatatgtatgttcttatctcaatctcaagcttagtcttctttgtgtaacatccttctttagattcttccttgtatttgatctcacgatctatcagagtgtgaaatacatgcaaaagatattttgctgcccaagtaaagtttcagctcaaagcaacaaatatcaataataaaatgagaatgaataggatcactttacctcgagaattttacttttgtttatacaaatcttattggactttgagcctatgggcttttaggatagttacaatctcaagtaatttgatctaaaggtgattaggaaacttaatccaccatactctattaagtgtgtcttactaggacttagatacatgtatgtatgttggccaaatacatatttgggtataaccatcaagtatttagagacctaggtattttgaccaagtacctgtccaatataatatataataacaaaaaaattatagttatgaaagtctagattttttatgacaaatttttttgacacccgatgccctttgttaacaatacaatcattatcagtagtacaacacaatggtagtaaaagtaatgttaaatagtgaagagatataagatagttcacatgaaacataaaagtgcatgtgtaatttattcttaaaaaagaatagaagggacaatttagtaataaaaattattgtatcaactgcatataaaaaatgatgaggggttaaataaaaaaaaatgtgatattttgtggatgaaaatttaatcgactataaatttttaatctaataaaataattagttattgcttgagcttttaattcaatgatcaagggg

SEQ ID NO: 2799 - DNA, 1530 bp, Glycine max
  Soy_ogl_5115 Gm15:43286572..43288101 Cluster 11
ctttattccttgtgccaagagtttgtctctaagacaaattacaatgggttttatcaatgataaattatagacaacttttctatggataataacaacaaaatacagtggatttagttgttgataaattataatgaactttgagtctttatttatgaattacaagttattaattaatttatttgctggccaaagttatcatcaacgattttttagacactgttacgctagtaattacaatgaactaagcctactctaattaaaaaataaaggttatactgagttgtaaattatttttttaattcattaaaatcaaaaaattcaattttttaaaaattttagtgggcttagtccattgtaattaagaaacctaaaaccatcacacccttactcagttacttccaacacatttaacctcgaaatctttacgcacataaactgagtgactgtcttaacttatcacattattaacaagtctaatgaaatagttaaatataaattaaaaaataaaaatatttggagggaccaaataattatagttataatatctaaattaaatataataatttgataatatcaatacttcattaataattagataatagttaaattaaatataatatttaataatatcattcaattattaacattttttatgatatcaagagattattgtactttatcaacaacacctgtgaggtttcttttatatttaacgatttttatacctccaactattaccaaaccaaaaaaatcttgaaaaatctatctgtaatttttttaaaacgaactagtccagatccaaaaaatttcattagagggacaaaaataatatataatattttaatgatatatataagcatttataaaatacataatctcatgataaaaaaattcaaagtacctaagcttttactaagagttacacatattttgtcctctcaactttttgcaatttgattttagtctgttaaaaatttttggtctattttttagttattttaattttaaaatacacttataaacattaattaaactattttgaaaattaaaagtgatacattttaaaactagagagaaaaatgaacaaaaacatttagagaaactaaaattgaacttgttctctccttataatggaaggacaaatattaaaattagtattcatttattctcttatagttttatatattcattttaaaaaaatatatgttatgggagcaatacctattttttatggggtaaaaataatttattaaatatgtttaagtaaaaaaaaatcttgtggaaccaattaccccaaaaggcttagcgtgcatctgcaagtgaatttacctaaacatggaataaggaaataatcatatttttattaaatatgttatattgtataagtttttttcttcttccagaatgagactataagagtcatagaaaaaaaaatagaaacaataaattgatttatatatatagttaatgcataaaaatatattattaaataagtcagttgatgttttaaaaacaaaaaaaagtataata

SEQ ID NO: 2800 - DNA, 1313 bp, Glycine max
  Soy_ogl_6102 Gm18:48172501..48173813 Cluster 11
atagtttagacaaacttattaaaaaaataaaaatttaattattttattaaaataaacacttatttcaacaaataaatttaaacaaattcatccaataagttatacatatgatggacatgtagtataaatgattattttgagaagagaaatatcagtgaccacatttatttattttgtgaatttgctagtgtcatattaatttgtaacatacctttttgaacattatttttttgttgaaatttattaataatttcatggattttactttttagataatgagtctcttaattttataatttttaataaattttaacaatagtaaagtgtatgttagaaataatgcattaaatggtgtgttgttagaacttgttgagaagaaaattattttaataaaggtttgcatatttctttcatttaatagtaaaaattaaaattaatagttgatctcttccccttacactcatgcacgcacacacagagaaagtatttttccgatgtttgaaaatatcactaattttgttttattttatttaaagtgataaataatttttcaatttattaatattcttttaatttatgttgtatctcgactagtttttgtttattattgatagcatattttatgttttaattttattacatttaatttttgtttttaagggtatttatgttatgttacaaatatacattttctttttctctcattttttactcattcaaataggagaaaagaaaatttatacggttgtttgcttttcattttctctccaaccaaataattaaaaaaaaccatattgttttatattatcttttttccttctattttctatccttccacttttttcattgaaccaaacatatttttttattgtagagaatgagataatatttaattacatttttttcttagtacgcatgattttaacattgtttgataatggtaaactagtgattatatgtgtgtgacatgcgcaaatattgtatccgagttttctttccttttcttaattttaatttaatcataaactcataagttatgtcttaggaatttcatcaaataaattttcaaatgtaatgtaatggcagacatagatcattaatgcagatttattaatttgtttagtgttttttttaataatctttatctttatatttataaaagaaagtaggaggagtattattagaaataaattttatgatttttgcgggtaattttgaaaatactctgtaacatttgtgggcattttcaaaatatcttaacaaccttttaaaaaaacggattgcattaaataagagatatgtagtattaattt

SEQ ID NO: 2801 - DNA, 1200 bp, Glycine max
  Soy_ogl_6675 Gm20:1342901..1344100 Cluster 11
ttatttttaaagttttatttttttctttttatctccacatcaatagaaatcaaaataaaacattcaataaccaatttctttattaatttctctttattcaagtgacttcttaattatctctttttttctcacaatcactgcgaagatcacagcaacacatacatcaatgctatttctctttttctctctttgcctccattgtctatttcaatctcaagatccaaatggataatttccataaagaggaaaaaagctaatacacccgaacaaaatctagcacaaccaaccatcaaagtagaccaagccacaacttctatatcgagtaacctttcagacaatcttaaagcattgataacattgtcatgttttatatttacgaaaaattgtgtttcaacttataggaactaatgttttcctgcaccccaaaaacttcttcagttttcaagatcccaagaaacattttttaggacttttatgagggaaacttctccagaattgcccaattaatggatccggggatgccaacatttttctccattaatggaggcaaagagagaagaaggaaaaaaagagtgatgtgtgttgttgacatattaggatcaatggtaaatcccttttgaaagaggaatattaatttgcaatggtaattaagtttgttagttatcgcatagaaccgtctaataatattactactaaagatcataaaaaatattttatttttatagtaaccaaattaataagaaattttttatgagaacgaaattaattttaaattttacaaagattccaaaaatattttacccatttttttaaacacaatggagataagtttttgctaatttattttttttcctaaaaaattaataaagcgggattttgtggttgttgtgttaaaaatattaacataatgaaaacttattttctttggtaggggtgtgaatttaaagtacacaatagaataaaatttttgttgtattttatttttttaaaaataccataacaaaaacaaatttctgttgggttaattttttttaaaataacaaaaaaaaattgttcattgtggtagttttttggggaaaaaacgtaatggagacttgctttccttgtgttaatttctttttaaaaacaacgtaaataagtttttattgtgttaatttttttaggaaacaagtttccattgtgttaatttcaatcaacgaa

SEQ ID NO: 2802 - DNA, 1097 bp, Glycine max
  Soy_ogl_3046 Gm09:7876701..7877797 Cluster 11
ttcgacgaagacaaaaaaatgaagaacaacttctgaaaaaaaagtcacaatgctaatttctggattgactacaattcatatataatatataaaataatagtctaaaatccatttcactaatgccagattattcggcggcgggttttacaagccatatatatagaaaaaggaaattgtgctcatgataaaaagaagctactagttcaatttcttttttacattatgttagttgcagtgattataatcactaattacttaattaatgtcaaaaacatcagttcattttctttttctacatgaagttcagtgtatatacaaaccaatgaaaaaaactattataatttgttttctaaacaattataaattataatttgttataaacactcttttcgaagaagaacccttatttcttcaataaaaagtaaaaacaaaagaagaaccttaatttgattaaattatatgtacgacaatgatcagttccgataaattattgaaaaatatgtcttatgttttaacattggttagcttccttatcttaatggataaggagatggacgaaaaatctctctgcactagtacagaagcatgtaatttccggttgaagcatgaagaggaactctctttcttgttattttctttacaagtattttttcttgcaaaatttcaagaactaattttcaaaaaggctttaaaatgttaagtttctcaaatttggattaagtttattttttgtctcccaaatttgaaaaaaaaatattttagtccttttgctcagacgttattagaaatttcccatatttagctaacaaattactcctcagccacaaatataagccaaacaaataaagtaaaaatgttaaggagtgttcttaagacaattgttaagaaactaaaaataattttatttattgagatgcttaaaattctattgttcataattttgtatgctttccattatttttacattaaatatttttttagtttcttaatcaataggacattgattaagaacatccaaaaaataattattttacacttattaaaaaaattagttaaatataatttaataacataattctcatttaaaaaatattatt

SEQ ID NO: 2803 - DNA, 1000 bp, Glycine max
  Soy_ogl_1303 Gm04:38183701..38184700 Cluster 11
atagtagattatgatactatattaaaatttaaatttggttctaattaatttcaaaagttaacgaaaaggtaaaaattaccctccaacttaatatacacatatacacccatatagatttggtggtgggattttgttggcttgaatgatggatttgtgggtagacgttatataataattaacatttttatttaaaatatttttaataaaaacaatatactaattaataatatatatatactaataattaacagatatgataagaatgatatctctagctataatttttcatcaattatatatagttttataaaatttgatgttttttagttattattatatttaataagttcgtttctttttttattgagagattgttgttatgagtcctgcttaattgttaatgtgcttgtaaaatcaaaaagtcttccaaaacttagaaataaaaaaaaaaaatactagttataaatacaagtgcttctttctttatcatttgaaataaaaattaattttaattttatgtgtaaaactaataaataattttataaaaatcattatttatttatttgaagttgaatatttaaataattaaactaaaaaaaaaaaaatcaacccccgatgactgttctcattctcactttattacagaagtttggtggtgggattctcctcaacattttgttgcaactgagttatataggaatagaaattgtctctctaactataagttcaaatagttgtcttgcttatgggtttggtttttggccgcccatagttttgtataatcttttctcttttctggttaatgaatctcttcggtgtgtagctcctaatcatattattgttggtggtgccaatatagttaggatcatgttcactacgtgctagtgtgtctgttacctttgcttttaaaaaaagaatagaatcttcaacaacataatcttatcaattttactcttaaacattttaaataaataaaatagaaaccaatagttaaaatgct

SEQ ID NO: 2804 - DNA, 1400 bp, Glycine max
  Soy_ogl_1997 Gm06:17004301..17005700 Cluster 11
actttctttacaacattttcccaaaaaatttgtagggctaggggtttactgacaaacagttcattattgtcttaaattttaggctatatgcatcgccacaaattccatgcagttattcaatgaattgtgcaacacaagccgaaagtgtttgaagttacaagacaaaacgagttgaacagtcaactcctttcattcaacacattcatgacatatcttagcttgtttttgttcttttctttcattcttgttgaattatcatatttccacgaaaattcctaatttagttatgtttggtaaagtaacagtataaaaaccacacttttcacatataaatttttgtaggctcctgaataaaatttcccataaatatttataaggagattaaaaatattaaataaattaaatttctttatagtaaactaaaatcaacttatccactttgatttctagagaaattaaataagatagtttctataaaaattaaccatataaattaaattttaacttgtttaaacagctcaatgttggattggttgacctataaaagttaatcatataaattaaatgagagaacttttataaaaattaagcatgtaaagggtttttataattttcagtatcaatcaaataaaaattaagataggtatatgacatttaaatatttttattaaaagttaataaacttcaacatgaccatttctaagtaaataatagtataaaacttttttccttatcaatctatatttttttttcaattttctattacttatgtttttctatgtattttctcatctttcccacgtctattctttaaaaattagtttataattttttcataaaatatttttaaaaactaaaaaaataaaagagtaaataatctatatatccacagtataaattgttattcaatcaccaaattccaaatttctctagggagaaaaaagaatatacaaaagctcctgagcagcagaatttccatatttgatttgttagacacaaactcaaatatgatcatgaccactagagagaatccattttcattactctacaccttagcattattgtttacttgaagttggttgctctgcaagcagctgtaatggccatgaatccattggggtgggatacctggcatgtggttttctgatagtggaggtgggttttggagtcacctcagcaacattatgagttgataaagcatcttggtgttgatgacttaaggggacaatcaaaacttcatgtccttgctgcaatgtaggttctgtggtagacaattggagactctctcctgtaaattttgttgccttttcttgttgctgaagttccaaatgaagaggtgcattcaggtcaggtctagattgggttactcttgcttttatctcacctagaagtttctcaat

SEQ ID NO: 2805 - DNA, 1306 bp, Glycine max
  Soy_ogl_4353 Gm13:29844595..29845900 Cluster 11
gggtgttgaaaagatattattactaaatatttttagaagtacaacattggtcaacaaagattgacctagttagtaagaaaccacctaaaaaatatgagtttgatttctactacgcacataaagacgatgaataatatgtaaatctttgttgaaccttatgatctattgaccctggtaagtcccgtaaccaaactcacctaaactttaagtaagaaaaaaaaaagataattatcactacctgccattttatataatttattctttaaaagcaacaaacatttttttaaggaaatattaataacacaaattatattaataaaataaaattctttaacaaaaatatctttactaaaaaaagagtaaaaatgtcataatgaattcatttcagtatttggtaagataccaaaaataataataagtaattttctaaagtgataaatgtattgaaaattaaaaacaagaatctatttggttgaaaagaaaaaaaagtggaagagaaaaacaatatttttttagtacagaaaaatataaaatttgaactaaaaatttaatgaaatagaaaattgaatttttatgtgtgtatatatcaaatttttctttatttaatttctcttcaactaaattatatatattgggcagaggtgaatattgtgtggatcgtaatttattggcctagctatgcctgctacgctagctgctgccaacctgtttacattaactgctacgttgctagctgttagcaggttttggtgattctcgcttttcctttcttttctggtttttcgtcttctgaattttgtattttggaaatacataagcaattctgttacgagaaaaaaaatatatattcaattgtactttttctcccaaatttctataatatggcaacttttgtttcctattttgttttttttttcaaattttgctcacacgtaacaattcacaaaattatctttgatgtgatcaattattttgaaatatattaaattaaaaaaaaaaacaaaattatcaatgttatgatgagtcaataaattattaatgtcataaatacttcattatttaatgttgtagacaacaagatagactaaaattaaaaacaaaatccaagagactgaaattgaaaaaaaaaaactaaaaaataatcatattttataggaaccaaggagttatttaagttattaattaatgtttatatcatataatggaagaagctaaacaactcattttttaattttacatggaagcagaaaattataaacacatttttttttgtctaaaccacatgcattcttcaatgaaaagtaat

SEQ ID NO: 2806 - DNA, 1092 bp, Glycine max
  Soy_ogl_5153 Gm15:48194901..48195992 Cluster 11
tcatagcagtcaaaacacaaacaaacacgccacaagggtaagcttacgtaaataagcatacgagaacatactccaaaacagatagtgtatcaataatatttttatttaccacaaccgtatcttatctttcacgacacatcaaataaatcataacatgtcacgtaaatgataaatccaagcatatttcatcaattttaacatatcaaaccacaaagttatcaacaaccaattcgagcacataaaaagacgaatggttgccactgcataaacatgggaattatgatttgaattttttttttttacagaaaaatataatttgtataaaaaatatataagctgtataaacatgggaatgcaattttcctaagaataaaagatactccagaatatttttttataacttcttgacaaacatgagaataaacattctcactttgatatttctaaaactgctggatgatttcatgaaacaaatatttcattggtgttggtttcaaacaaacctaaaaataaaaagtttttataagtataaaaaatactaatttttaataaaatatctatgttttgtttaagataaattttaaaggctaatgttgcaaaaaaaactaaaatttaattgtaatttatccatattcaatctttcgtttccgttgctactagcctactatatatagctttagagacttgcggcgtgccatatcgttctctcttgaactttctttatagaaaaagaaatgtattgcttattaaaaaatgagatgaaaataatgaattgtctatcaatctgaggttgactcttcacaacgcatattaaatgaacacacaagccaataagtacgttatttcaaagtatataagctatcaaagactattttttctaatatttttctgttataaaatttcattccaattaagaatatgacgaaatattccttctaaaatttagtttatcatttttacttaactctcggattgagttctttaaaaaaaaaaacgctcggactgagctagggccaataaatttttaatatgatattaaattttatctaattttaatattgaattacttataaatatttaatattttaaact

SEQ ID NO: 2807 - DNA, 1200 bp, Glycine max
  Soy_ogl_5656 Gm17:12804301..12805500 Cluster 11
tattttttttcctcctctattttcatcatttgatcacattgccttcaattttttagttgtctaatttttgtcttttgactagtttttttcttatgttttgtttattttatgttttattctgttaaaaatttgattatattttagaggataaatatgtttttgatccctctaaattttttaagtttaattttagtctctttaaattattgtctattttttatccctttagttttgaaatgtgtaacttttatccttcaaactgatttagatagcggtttataaagggacaaaaagtggttcaactttgagaaggataaaaaatagtgcatctcaaaataataggaacaaaaaatcaacaaaagagacaaattgaatttaaaaaaatttaaaggataaaaaatatattttatcttattttattttttaaaaacagattatttgtccccgttaacccgagtccttgatagagcatcatcgttaaactcatttgtattttaaaatttagtagaaattgttcaagagtttttgtttttttgaacttggtggatgttgagagaatttcgggaaacaacgagtgtaagagatgcgtaaagtaagcttagattcatacctataggcatggcatgcctaatagagtagtaattgacatgtgaaacaattgtgtagttgtttgtgaaccatggcaagctcgaaggaggtccataacacaaaacctagtattgagagattcaaggtttaaacttcagttctcatattgtaaaaataacaaaaatacacatcctttaggtattagaatcatattaacattttaaaaatattaattatatttaatttaatattttatattcaattacaaatttgtgaatgtataatactaccaacaaagcacgtctcacatgaaacgaaagtatatcaagaatattgtttaattggctaagtatgatatataagttattataaatttccttatatttatctttgattttgatttgtaaaaaaaataaaagtattcagcatttgagcaaactacttacaaattgatttaaattattcttttttataattctatggttgaaatcaatccttttcattcacactttgagttcatgttgaattatctatcaatatgctaatatttttattaaacttcatatgtaaatttagtatattatatttcaaaagtaaatgcaatgcaaaatg

SEQ ID NO: 2808 - DNA, 1429 bp, Glycine max
  Soy_ogl_3391 Gm10:6462001..6463429 Cluster 11
tagggacaaaggccacaaggtcttattcagttacctctttcttaaaacatggcccaaatacatttccatttttcattgaactaaattgatcgaattggtagggactatattttcactggcaactcaaagggtagttgttttcgccatgataatcggtcaccttttcctagacactagatactatcacgacgataagtccctctcgcactttccctcccctgccactccgaacctgattgcaggttttcattattgggtgtgaattgtgatggaaattcattgccttctacggccaaaaatacttaaagctgcttgcagaacccagaatttttcccttctgggttccgggtacaataagtttccccccttaaattaactgacctaataacatgtttagttttcattaatattaataatgtatttacttgttttaaaaaatgatattttcagtgaagacttaataaagtctcgaggatgttataagattgagagtaaggtttgaagaagaaaaactgagatttttttttaatttttgatgaaatttgatgttttctaataagaaaatgtcagatgagcgaaggaaaaaggatatattcaaaattgtacaaattacaatttaattaaaaaaagttctatcttcaatttctatcaaattaaattaaatttttttaactttgtttcttacttaataacaaaggagatatttagaattgtgttaattacaaaaatataaaactcatgagccacactttgaaactaccagaataaggtgatcaatcatagatttttttataaacaaatattaattattaatatgttaatttttattaacgggatgactcaaactcataaactatctcttccttcttcttacttttaccctcaagacaatcttatatcccagtgatcaagcatagattaagtggaaagacaaaaattgcaaaaaaaattaatttggtttttatgtcttaaagtttacaagaaaaacatttatcttttatggagattgatagaaaggtgccagagaaaagaaatatgcctatatatgatttttattgacttgagaaaaacttatgtctgtgccaaaagaagtattgcgaaggactttagaaaataaaggttattttgctactccactatactcaaagataaattttatcctattgttatgtgtttttctatgttttataatagtgaatattagattttaaaaggataataataaaaaggttagaatgaaaataaatgacaatattaagatgtgaatgtgtggttataaaaaaatgataaaataattgaatgcgattggtgttggactaattgaaaaataaaacaaaaaatcaattaataaaggtggttgaaacataaaaggaagacttcgagagacactaataagaagaaaaggatgatagaaaagaatagtattatg

SEQ ID NO: 2809 - DNA, 1213 bp, Glycine max
  Soy_ogl_2061 Gm06:42919216..42920428 Cluster 11
ctttcctaatttttcccgtcataaacaaaaagagaataaactacttccttttactgccgaaacatatttacctactagttacaattacagaaaggacaaaaaggaaattttactgtttaagattcttctaatgtttctcaggattataatttgtttgcaccatccacatctgtttcgaaaattttcaaaatcataacagggtggtcaccctaagtggtttatactttataggcttgactatttgacaacgtgattcaccccgttcaaaccactattattcaagttttatggcacaggattgggtggtcagtctatgagaacaattttaattgagctgtttgattatatatgttagttgttaaattaaattatttaaaaatatcatttagaataaatgaattcttatgaagtttttaaacaatgaagttgctcatagaagaaactttaattaatataggtttattaactatgaaaaattatattttcaagtcaaaatgggattttttgtgagtgaggaaataaagtaaagactaaaaaaaagagttaaagaatccaaattgagttttattggaataaaaatttgagtatttttaaattttatttgacaacagaagactcactaaaaaataagaatctagatattaattaactcttgcactgtcaaatatggtagtttatggttgatggcaaatatgcagttcgatcagtaagatggtgtgacttggtggttatgtgtggttggtagaaaaagtgctttatatataagcttgtaggtgcaaaatgacaagggacgaatttaattataattttaaaaatatgagaatttaacctaagtaataagtttcaagctattaatctatataaatcactcttatatttttctttttatatttaacagttttagataataattcacaatgtatcacattttcaggtggtgcattcttatttattttgctatttccctcgtcatttgagttcaaacttccttttacttccaaaacaaactaacctttttcagtacgtaacaccctaaccctatcttaaggaagattcaatcgcttgaattttgtcgttgtgtattttaattcaaatataattctatcaagagaatatcttttctttagtcccatcccgtgcggactgtgtcctccctaaagagaacataacaattttgttctctcgtgtaaatattataagaatatctttagaa

SEQ ID NO: 2810 - DNA, 1414 bp, Glycine max
  Soy_ogl_3846 Gm11:13831271..13832684 Cluster 11
ctttaaaccttgaatcaatatcttgaatcggtttagtgataggtccaattttaaaaatattaattggatgtctacaaatcatttttgcaatataaattcttcatcgtttttctctttgctcatccaaggaatctcacatttgtcatggcatgaaaattaattttgatcatataactcttgaaattataaaaagtaacttacttgtgatcaagcaaatttgtgggaagcactttatagctaaagtgagaagaaggggtgcaaaaccaaaaccgattgttaataaataacattttccaatcagttttatgtcaggattttttctagccagttcattaacattataaatatcaacaaaaaattattaacaaaatttaactactttctagcttttgttactttcttaccttttgcatattatttctactattttcttttcacacgtgttaacaatgactacttctagtaatcatcaataatttttttatctattttcttttcacacgtgttacaaaattttattttatataagatgaacatttcttttaccttgttaactgatttattttgatcaatatttttctcctacattggaatgaaaaataatatttcaacttgattttaaaatgtttttccaattcaagatacttgcacgggatccataaacatgcaagatcatttaaaatgtttcttctataaacattgttttcaatatgtttttgaatatactacttttctgcatattcatcctaaaaattatgactgttttcttccgcattaatataggatgtaatgatttttttttcaaccatgattcgagtctccaaagcaagaagtctgagactccactccataaatgtgagcaaatgccttatcttgaattttatttatttctctaaatattgtttaaattttactgattttttttctttcaatatcaacaacctccacatattctaaattttcagtattttattttacttctacaatataagcgtattcatttttttaaaagaaaaaagaaaatgacttctttgcctctatgatttaagtttttagaacaaataatttgaatttttgtttccttaaggttcaaaaaggtcctattttagatttgttttctcttctacaaaaaaaatctacttttacttatttttcaacaacaatgactttctcatatgctacaatttgactattttactctactcctacaattacataagttgaatatgagtatattgttattttacaaagaacaatttgagactttgttctcttaagataaacaaggatctattttaatgagaagataatcactaaaaaaagaatgagaaaaaataacatataaaaagtatcatgcaatactatttaagaaattagtaacaagtatatataatattttttatagataaataat

SEQ ID NO: 2811 - DNA, 1169 bp, Glycine max
  Soy_ogl_4016 Gm12:7813332..7814500 Cluster 11
gttattgatgtacctaaaaggagtcaaatccaaataacacataagcagataaaatttgaaaatggatcgcatcgctcattgtctaaattgatgtgtttcagcagtagaatctgcataattgaaattatctgtgtaacggtactggtgccgggctatctggctaacggaagcacgtgttcaagctttatatccatcagcaaaaaatatttctaattattagtttttataaaataacaaggtcgtaaatgtaggtaaatattcaatatactataattctctcatttaaaagcaatttttttctcaaaatttatttaaaggctcacttatagttgagttagctgtgattgtgaattcgagggaaaagatgttatagggtccagagtatatagtcttcaggtggtggcgaggcatataatttaggaaggtatagctgctacttatcaaggatatacataattaaagtgaagccaatatattagttaatttagtcctgaagtgaaaggtctctctatctttttttacgatgatgtttaaatcttatatcttttcaaatgggtgtaaaaaatatcatgtatataaaaagactacctgtactcaattttcatatattccttttgcttataataaaaataataaaataaacagattatttttattatcttcttttctaattatcaatgaattaacactttatatataagctgtaaaaaagaataagacattaactaatgatgtataaaaaaatcaaacattatatttctttaaattctttaaaactaattaccaataaatcaccacacgtatgcaaattgcaaagtctacttagaaattatccacactagaggacccagatttgctcatctgtaactcttattaggactctattcgtctaaagtatcttcatgagttaacctaaaatatccaaacttcaccgagaagtccaaatttccatacctacctaccccaagtaacctaaaatcaatttttttggaatacctttttaaaccctccaccaactctgttctgcttaaatttccagcaaacaaatgctgtgtatttgatgttgaaaattggaagaaaaaatggttcccttttcctctttctccacgtaccattttatgcatgtcttttcctgtagtttagactttagaagaatggataataatata

SEQ ID NO: 2812 - DNA, 1400 bp, Glycine max
  Soy_ogl_22 Gm15:16025001..16026400 Cluster 11
gtatacaaagacattatattaattcaatttttctctttttttccaccataaaagggaatgcgaaggtagttttcttctattatatatttcatttatttatttttgttgttgagccattccttcgagcttagtcttcaaagcaagtccacttgccacttgcctcatccaatgaacacgggaagagaccttgccttattagtgaaccacttcgcattttctcaatggaccaaggtttagtttttggtgcacatggacccttgattttaaaagctcaagaaacaagcacacaaccaaactagttaacaggaattttaaactgtgttttaaaacatgattaagaagaatcataattgacttaaacacgattactttatgtcagagatggatgcacattcataactattggccggagtaattttccccacaaatttttatttgaatgcatttaataatatttttttgtccctataaaaaaatagatgttacttccataagacactttttaaatgaatgtaaaaaattataaagataaaaaaaatagaactaacattagataaacacaaacaatgacacatataacaactaaggtttcaaaaaagaaacattgtaccaaatagagaaagatattgagagactaaagagcatgacttcaaagataattttcttgatgattttcgatcaagaccactacacccagaggcaagaatggttgaatagaataaataatcatatgggaaaaaaatagatgaatgattatttggttgtatatatagagtttttttttaattaatattgacaatgaaaaaattatacaacaatttcaaaacatgaaaatgtgtagtgaaatttaaaattttagaaacttacgcattttggattttaatttcataaagatgatgtattttctaaaagcttataatatttatcttctataaaaatattatatactagtttcctgttcccacactacaacaaaactggtatttcgcgttagttgaatgcatgaactactggcagttacaacagtcgctatctcgaattccgacagttccaaaatcgccgatgaaaatggtgatgcaaagccacttagcgtcgttctccgataaccaccggaacaaccactgctaaagtgttttgtgattcactagcatatagtagtttgaaggctaggaggaggcggaagaagcaggcttttacgaaactatttggtctcactcctagaaattcattaacttcctgcggatttttttggggataaaaatccttaggtgtttattacgatttattatgtggaaaaaaattcgtaagtatttactgcagatttttctgcgacaactaattcgtaggtatttgttgtggtttttttgtgcgaataaaatccacaagtatttcctgttaat

SEQ ID NO: 2813 - DNA, 1500 bp, Glycine max
  Soy_ogl_5073 Gm15:18793901..18795400 Cluster 11
cacaataacaaattaaaaaaaatgacacgagtttatgtaaattaccatgaagttaggtgaaaacaattctgttctgtgcatctgtttggagcacaagcttctcatctctagaatggtactaaacaagcaagggcaacaaattggggagcttcatatcagcaatcatattaaatatatttgcaaattccaccttagtgggtggctttaagcccctgtttctaaatattgcaagagcaattgcaagtttctctgtttcaatttagcattggtcttgtgagaattagtcttcgtttatagaaatttctaaaaccttgcaattgcataaaaaaagacaaagggctcttggacagtgtccttaaagtatgaaacttttttcatattttagaagtgtttgatttgatatagaatttaaaaatacatgtaatgttttttttttaacaagaaataagaaatgagtttaattaacatatgttttgaaaaggaaaacaattttattcatcacaagtttttgcagtcacaagtgaccaaaccaagccaagaaatacaaaacaggtgctgtcatatgttaacatcagcagaatctgcaaaccgccatgaaattacaacagtcatgaatagacagtaaatactgaacctgataacactttagccttcacttgttcttaagcttcctgcaatacataaggcaatgtgtcccagcatatcccagtaccctaccactaagcatacctccaggctccagcatacctttcaacccgccctcccacgctttacaccgtagcagccagcccctaaacaagctaaaggctctaaaaaccagacgacaatcaggtttagaaggaagcgattgctttatttggaaaggaattcattactggctttttgttaactaaattgttagtaaattaagatagtcacaaaattttaagttgtttttatagctttttgttatagtaattagtttttgttaatgtaaattataatttccttaaattaagttgattgatatttgtttcccattaccacaacatatggacaaattagtaaaaatatcttatattcattttttaataatatttatattcattgttagcatacattaatttgatctaataatgtcagtttaagaaaatttatattcatgaatatataaacaacttattaaggagtatagcacacctaaaactctcgaccagagcattaaaatgactgttttttaaaccattaccagttgatatatctggagaaaaacagcaaaaattgttatctttacatataacaaatggttagcaaatagtgttagttgttggatcacaaagaattggaaactaattaatacaaattgattcaaaatatgtaattttaactttatataacattattattattattattaattttaattttaaattgctaaacgattatattaatttcaacatttctttgtattacttcagatttaaatttctttgcgtcaatattgcataaccttcgcaatcg

SEQ ID NO: 2814 - DNA, 1000 bp, Glycine max
  Soy_ogl_5079 Gm15:22583501..22584500 Cluster 11
atcagtcaaggagataagaaaaacatcatcctaaaaagtattatatcctaatatgtcccttccaacccttcaatccttgtttgatggaccatcaacggtattccaagtagctgattcataaaaaaagaaagcataatgaataccatttttatcttaaattgaaaaggctaagagattagttaaaaagataatatattttattgttgaacctgtgatgggggcggaagtggctataagaccctagacaatcccaaatcgatcattgataaccactgcaaaattaagattaattattacaaaaacagaggcaaatttaaagtatagataaaagaccaacaaatatgtcataagggttatcaaacaaaaaacttgaataggctattgtattggagaaatagttagcattgtcagaagtacgatttacccctctatgattatacattaggtagttatgaacaatatttcattttgagagaaattcttttacaagttttttctctttcattatatttagtggatattgttttaattatattataaaaatatactagctgaacagcataaagcaactaatactttatgtcaaggctgaggtagtatcaaagaattatctttgaaaattctgacattcctctccggccttaagcaccaaataacaacacgcattgtgcacccacaaaagagtccctctttttactactatagaaacctccaaatctacaaagcctaagctgctttgtgatgtgttacggatggaatgagaaatgaggaagaaaaaaacagtttaagtcaaaacgaaaaattggttgggtggcgggagagtctattaacgaagagacaaagaggaaacacttctagtatgagatagtaaaatccaaagtcacataaccttgaaactgtagacactaatgttttaaatctaaataaagaatatcatatccttcttggtctcgaaacagattcaggaaaaaggactggcagtaacctaattctaaagcat

SEQ ID NO: 2815 - DNA, 1173 bp, Glycine max
  Soy_ogl_5703 Gm17:16146201..16147373 Cluster 11
ctcagactatgatgatcattggtaacataatgaccaacatgttgttcctccagtattcagtatcttatagttggaggactgagtttgttggtaaatgttctttgtctctaaagttagtataattcatcgcgaacaaaaaatgagattcaaatgtttggcatcaatgtcttaccttcattacgttagaatgttttattaccatagtaggtaatgtacatgtaatttagattaaggtttttgaacacattctgaatggcttattccgatgatacttttaaggtagggccgaattaatggcgagtaaggataagtactaatttagtagttgccttggctaaatactttagttcttcagttgaagggttcttcaaaaatgtatattgtgtgtgttcgattaattgtccaagctcagtaccagatacattttcagaaaaatttatcatactactcaaatggttatggaaattttggggtgttcgacctaggtgaataatgaaacatttgtaacgagggttatggttaaatgtttaccttatgtttgaggggtatatttgggtattctgtctagcgaaacacccatatgggatatacatttaaaaccagtgactataactaaacaagtggcaacgtaataataaaccttgcaacacattttaccatagtacaatggttgctcaagtagtaaatatgaccgatgcatataggatttaaatcactttcattgaacctcttgctcattatcacaaataaagacatggtttaagtgaagtggctctctgattcaatgactaaaaataatatctaaaaatactatgaacacataattaataataaaatctcaaaataataaaaacatattttttaataatatctgaaaataatatgaacacataatttataccaatatatttttggtttcttttatattctccttattaatggattttagacctaattgtatctgacttcattaattggtttttttttctcaaacaaaatatttcttatcccaacacagtcacactgttaatgcttaattggccaaaactattgtttgacaaaaaaaattgtacaaatatattatttttaactagtagccaactttaataaacaaatatgaggattggagggatatacccaaccccatatggcggaatggggtgactacaaatg

SEQ ID NO: 2816 - DNA, 1100 bp, Glycine max
  Soy_ogl_6050 Gm18:16246201..16247300 Cluster 11
tcactgaattatttttaaaaaattacaattaagtgtaagtaatcttcttgaaatttctataaaacaccatttactttttttttttacacaaaaaagaataaaagataaaataaaaaatgaaaattataaaatagaattttttttaaaattaaggataaatgtgaatagtacttgccatcttaacgactcaaatgtagggtctattccaaacttgccccgacttccacataaagctatattagtattagataaagtttactaacatgagcttcgatttccattttacacgtggggcgttttgttctcagtttctttttcatgcatatggaaggataattcaaaatgaagatttgtttttctttttcctcatttcattaaaaatatgcataaagaaaaacagggaattagtatgcatagcttatgagtttttagttcctaacagctagcttataagttttacctaacacaccctgtataaagataaatatatcatatatgataaaactaacttaatatgttaccctaaaaattagaaaataataaggtagttcatttaattaattttttttatcaaatatcatataatttttaaagtaattattataaaaatcaacaaaattatcatgtattatagattgtaattgaataaagatgtaaaactttttacacaatgtatgaccgttttctctaatattatactctatatatttttctattttctcattaaaagagaaaaatgtctataactaaaaggataataagttttttagagaagaaacttgttttattaatgaaaagtgacaattgcatgtacatcagataaagcaattggaaactcctggccatagatcctccgtcaagcacatatgcttaaattatatatttttaaggaaaaatcgtggagactgaacgagtttagccatttcaaaagaaaaatatcacaaataaagtacatgaattcaaacattaatatatttttcactttttatatgatagaatatcctaattagtcaaatttgttcatttgatcatgagattagacactttaaaactctgcattttgccttctattcaataaaatgaaaaaatgtctgtttgta

SEQ ID NO: 2817 - DNA, 1000 bp, Glycine max
  Soy_ogl_6212 Gm18:56793001..56794000 Cluster 11
gcaacaactcaaatctccaagggatactgaattttatcttcttcttaaataaagtcttatgttcctattttatgaataataaagacataattaaggaaaaaagttttattaaaaataatcagtcaaaaattattatcgaatatttcatattaataataatgataaaagaaaatgcaacgttaggaagccgtcaaatctcttacgcaagagcgagaaattgcccactattcatggcggtgcgtgtgtctgaacgcaaaaacacacttgcttactactcggccacacatcacaccatcaacgtctgtgattgacttgtttagaaaccactctctccagccaacttccaaagaatctcaaaacaaatttactaatgctatgttcagattcataagaatacatgaataataataacaattttagggttttgtctaatcctttcactttcaatacataattccaaacaccattaattgattgaatactaccagcctacaatgaaacagtacaaatgtttgaaaagaggaaagcattcatctctttaatatatcaaaacctggaaaaaaaattatcaaagcatatccagaaaagctggaattaatgcacgaatattgtcatttaaaaaactttgtacgtaagaacctaatgattaattgaacaaggcaaaagacagattgaaaaatacgttgactgaaaggaaggccacatccatccattgtgcttgctaagcaaaagaaattaaacataattaatattattaaagggagcataaggttctcaaaccctaagaaaatgacaacaatgttacgtcccttgcacaattaactctaagatctaatacttttaagtggacacatacactaatctaagaaatctatacgagaaataatcaactttagcaacaaattttgaagcccaagtcaactttggcaacgattgaagagatcgaagaccaagttcagtcttggtgagatccataatgagtagcagaaaaaggagaaac

SEQ ID NO: 2818 - DNA, 1027 bp, Glycine max
  Soy_ogl_2031 Gm06:37757701..37758727 Cluster 11
cgccaccatcattttccgccgttcgatccgcaccgagtgcaacccaaaccgaaaaaactcttcaaaaattaacaaaaagttttaaatatttcttactactataattacacttactttctaatttttacatcattacaccttaaagataactatcaaaagtttacacaattcacgtacttatttttcatttttttatcccttaatattaattaatttgttggtttttttctgtaaaatgttaagaatattcaactcacaaccttattagaagttaagatgatagatgattgtagaaaattgaggttggtgaacggtagaatgaacgatgataaacaacattaacataattttatgaaaatcaacaaattcaatagataaatataattacaacaattaaattaagaaaataataaccaatatcttaagccattagttaagaaattaaaaaaaattagagtattgttaattagtcaccttaattttttaaatatagacttatctacagttttgttctttataatttaatattttttatttttgtctaaaaaatcattttagtttatgtaaaatatgtttgtttattttttattgttaaagtattttagataatattttaattgataaaaaatgtacgttgaacacttaaaaatattatttaaaatattttgaatatgaaaaataaaatacatattttataaggattaaaataacaatattaaattataaaattaaaaaatattttaaaatctaaattaagtatcaaattaaaaagcaagcgcagccagtgaaaaaaatatatttaaatctaaaaaaaataaaaattcactggtttatcgaattctttcggttggatccgaatagcaacaatccacaccacaaacacgcggatccgtctaacgcggcgaagtggcggagcgtgccgacaaatgtatgggggaagcatccccaaactgccgtcatgtttcttttatatgtagccgtcactaataaaaattatcctatttgatatacataatttagtggacaa

SEQ ID NO: 2819 - DNA, 1260 bp, Glycine max
  Soy_ogl_2369 Gm07:19627401..19628660 Cluster 11
aaagaatgtgagttgaaaatttgattcatactcttgctaataatgtagattttttttatttatgttaaggttaatgttagttggttgaaataatttttaatttattggattagtttaatatattgataattttcattattttcttattattttgtgttttgagttacataaatatttaaatattaatttagaagtgatatttttaaaaggtaaagtgatcaagcataaaagaataaatacatttttcaagagaaaatcagttgttaatttcaacacctttacctcattatatgtataattttgaattttgagtatataaatatgggttattactttttaccccccttaaaatatttagtcaacctacgccaccgaacgtactctaatgtttatatatcaaacacttctaaaatagtatacataaattttagcttttaaatatgttggaaagatattgcaaagtgaaacaaatttaattaattagaaagcacgaggtaattgaattaaataaaaacatgtttgcataaaaaatatatactcacgatcccttatattttgttgtaaatacacgtacgtactctccatgattttataatttatatcagtgttaagtgttattttcgctctaactatcttcatttatatatttggaactgacattaaatcaatcttgatctctttatcactgaaatttaatatgagaaataatcgcaatagttattgtaattgtttcagacactagtatgaataattcgaattaacttgtatctccaacttaattacaactagaaactaattgcttagaaattgtaaagcaagttgttttttttcaatgattttttttaagatacctaaaatgtctaatctctgttacactataagaatgttcattattatactaaaatcccacagtaatagctaaaacccactacaaacagactacttatagtgggcttagagtccatctgtaaaaattttatcggtaaattctatcgacagtcctgaagaagtcgtctataatacaataagctaatctcactgtaattcgagggtaatacagtgggtttagtcgtcgataatttgatcgtaaaaaattcataggatgtagctgttaataagtgatgagtaaaaatgaacttggactagcatgtataacgaattattgtgggctaagctgtcggcaatagagtgagttttctccactataagaaacccctttgaaaacggatggcttaacccattgtaattatttatttttta

SEQ ID NO: 2820 - DNA, 1377 bp, Glycine max
  Soy_ogl_5345 Gm16:8288201..8289577 Cluster 11
ctgcatttgcattactgggtggggctgtgacacattataaattaaatattactaccatatagttatcatgtataccattcttctgctaaaagataaggtgtatgtcaagattcttttttttttttttttgaatcattcaaaatatgctaataaatacaacacgataaaggcgataaggtgagttgtattatatcctttttgggaatcgtttgaattttctagacactcatacattgtgtaagcattaaattaatgtcattatcgtaaagttgggtgcataattttggcttgaagtcagaagctagctagccaataaaatctcttcattcttaaaattaagaaaatttgggaattatgaagagtgggatagttttaagagtttaaaagtaaaagatgaaattttgacaaatattgaagaattttatatataggaagtaagattaatattgaagaagaaacttttagataattttttaaatgagatttaatattttggttagtgagttttgagtaaaagaattttttaatcaattcattttgtgaaaatttcaagtaaaagaacgagaattcaaagtttttaagtaaatggaatttgacaaacagaccaagggacttaattaccaaaaattagagagaagacaaattcatgcataatgtaaactaaaagaataaaaaaaacaattatatctaatgtttaaaaggactaatgagaaaatatgaaaaataaataaaaaaatatcatccgataacaaaaattaatttataagaattcgtttaaaataaattaaaaatcagagtcaaatacaaatcataaaaagtattttattggaagtcatttttaaaaagttgaataataagatcgtgaattttaattattagaaagtcatttgtacaaaacttcttgaaccaaatttacaccagatgcaagtttaaagacttacattagatctaaatccttcattttaatagatctaaccgtttataatattttaaaatttggcacgagacattgaaaaatttatttttccattatttcttcctccccttcgtttttttttattatctacctttccaaaacatcattctgcttctccatctatatatattgttccagagcatcattatcataattaagaggaaagcttggaaagattcaacgtttacgcacagtaaaagcactgctaaaaatattagttttagaagaataactataactagttttgtatagctagttatataaaagtaattataaaattataattagttttataattatgattatttcaaataatttatttttatttaaaaaatacttataaaattataattagttgttatatgagcggttgattcaaataatttatttttatttattta

SEQ ID NO: 2821 - DNA, 1644 bp, Glycine max
  Soy_ogl_2364 Gm07:19008401..19010044 Cluster 11
caaaatgggtccaaagtgtgaatttggcctttgccactagcatggtcacgcacagtttgcatgagactttgaagttttgaacatagaaaaatatgaaaactacaaaataaataaatcagtttggctcatcacattaaagggacaaaaaaagtccccagcaatttgaggcatacagatagactatgaattggctgcgtttggattgttcgtggaaaattggaatgcgtccaagctgtgtgcgggtagggcacgcttgagatatactgatttacgggatatatatataactcaaaatatattctccaactaaaataaaaaaaattaatctcccaaagtacataattttcttaagaaattaatttttagtcaacaaatattttttcatatacacaaatttaaaaatcaactcttataattaattatatatttatcatatactattattttagctcgaaatatttttcaaccaaccatataaaattaatcatttaaaataatagatattcatctaagaaattaatttttcttaataaatattctttcatacaccgattcgaaaattacattcttaaccacatatttaatgagcatgactatttatcaatcatatatattacactatatatgttaattagacatatgcatgcatgatacgttacattaagaattaaaactatattttccaaaattatttttcatataagccaaataatattattaaccatgtagagttcaatgtaccgtactagaaaatagagcattcacaaaacatattttccgaaaattaataaggaaaagttataatgttttatgctatttttgaatagctatatacatgcatatgcattcgtaaaaaagaaaaagaaaaaaaaatagagagagagtgtttctccagaaacttttgttaggataagttaatactatatggtaacaataattttgagataacttttaattttttaataactatttttaaatcgcaactaaaaattgactttattatatgttaatttttgttcagcattactgacttaataaatatacgtacgtctaataagtattcttttaaggataataactgattcaaattgtgcttactgcttaatcaattagtctgcatctgcaatttgcagagcctgatagctgtcaaggggttgaatttcacttttcttcccttgtttcttaattgatatgtctattcaaaacaacgacgttttgtacccaaaaaaaattaaaaaaaaaaaaaaacaatgacgtttgtaattatgttgttacatgtagtgcataatgaatttgtgtgctttctgtaaatgttttattctgtttgaaaaactaatatgatctcattgcttacgacctatcttgcaagttgatcataatcatttgaataaaattatctggtagaataccatttattcgagccttcatgacttaacgaaatttctaaactgtcatttccataaatgtggataattgtttcaaacacatttttttataattttaattcttatttaatttaatacttttctagaccatatattttggtatgatctttcgatcctcagcatttagcatgctttaccgattggccgagatctatcatacatcgacatagtacttgaaaactgaaaagggaggatacat

SEQ ID NO: 2822 - DNA, 1200 bp, Glycine max
  Soy_ogl_2762 Gm08:19165901..19167100 Cluster 11
ggagaataataattttgtctttacataaacttgtaatttatttctattttttattaataaaaaccatgaaatgagcaataagtaagcatgagttaaataattgaaaaatatatgcattgttaaattgaagcatgattgaaaatatacagttttgtgtttagacagataatttgaaagaatttatattaaaaacatgaaaatatataaaggaaaaaaattgtcttgttttattttaaaatcaaatcaaatactctaaaaattgattaaccaaagttttttaaaatgtataaagcaagtccacatatatatgggtagtagtattccatataatattgtttgtcgcaagctcaataagaagtgattacgtatcttgcagtttcaaggaagtaaccagtaatcacttgttttaatgttttccagcaatcatgttttttcattcataatatttcaagatctatctttaaaaaaattaaatccaataccattcaaatcaataacttattaataaaataattgaccaacaacttattaataaaataactggcaactgactttttatttcacaatagtgagatattatttgcaaagactcaaacactaagtcagtatgaattagagaatcaagggatagagggaaaataccccttgagatgccaaatttagggactttttataatttttttgacaataggtaattattttattggaccaagcgctagtccaaaataattattcacacagttctaaatataagtaaaataatgaaaaaaataactttaaaagcagtctagactagattttggtgtacaatacaaagtacttttgtagaataaaagaagtctactttaacctgataaaaattacctttttgatgaaaataaaaaaaaaatcaaaacacatgaaattaaaattgtttaaaaaaatctttaaaattgatttagttggtagaagactcgtttagcggcaatgtattgaatgttgattgaaaggataaatattgatgaaagaaattgaagaaaataaaatctctttttattaaataataacaggaaaatattactttaatacaacttttaaaatagaaaagatacatgactatgtaaatatagtttgtagaattttggggaaactttacatttagtaataaagattcaattttcttttaaaaaaaaattcaaatttatataaatactgtaaagt

SEQ ID NO: 2823 - DNA, 1093 bp, Glycine max
  Soy_ogl_2767 Gm08:19234301..19235393 Cluster 11
gtgttgttatgtcaaaattaatatattataataatttctaattataatttctaaattttattcaatgaatgacacacttcaaatgcaaagattaaaaacaaacgggataacacaactaaaaataaaaataattgtcaaaggacaattacaataatcttaacttttgaaaaaatattcctcctcttctttttttcataaattattttctcattcacaatgacagttttcaactgcatatttcatgaaggtcaattaaattaattaaaacagtacttaataataaacaaagaaaataaaatgtagaaaaatatgtaaaaatgagtaggaataaaaaaaattggggataaaggttaattcattggaactttatacctacttatgcaatctgtaatgacaaaaagcctaattgtcctccctcacgtggcaactcttcttctttgattctcattcgggtataaatagataattgtatcatacaaaatagttagataaataaaaataaaggaggagatataaataaaataatgaagagtggttagagggtaattatttgattttaattagtggatcagataaaaaaattaacctattgagataaaagtgatggacaaaacaaaaccacagaaaaaataaaaaaataaagattaaaaataattaattattgctagtatttattattaataataaaatagtctaaaaattgtggagaccaggaacagtcacacaaagttatggattatatcaaactctcaaataaaattattattttgatttttaaatatagtatacatatattaaaaatacaaaactcaaaaaagttggtgggccccctatgaatgcatgtacttccatccatggaccaaagggatttggcagtcaggttgaaataaatctcgaatctgccgaattaaccccgtgcatgtataagtactgtaagtcgacagcattctccaatggtgtgataaaaatcaatgtataaaatggagagttaaatataattttagcttctgtaatttagtattttttatttttatttgtaaaaaaatgttttaaagtgttttagatatttaaatttaaatagacatattttgta

SEQ ID NO: 2824 - DNA, 1187 bp, Glycine max
  Soy_ogl_3063 Gm09:20183901..20185087 Cluster 11
tatatcaggtatagaagatactagtttttaaactcaaattgaaaaatgttaatcgatttgattttgttcaagtttttcaattattttataaaccaaatcaaaccaacttgatgatattcaatttggggtgagtcaatgactctactaatataataatgcaaaaaacaaaataaagagattgtaataatatgaaataaagtgaaatatatttttagttcatttaagttggcttttttcaattttgattacggtaagttttttattcatttacagtgtttataaatttgtatttttttttagttttgattattgtaagattgttttttcatttctagttcctgtaatttgtgcctttttcaattattttatttaagattttatttttttaatttttaacctcataagtttgtatttacaggaattaaagttaaaaaaacagaaagttataaaaactaaaaatgaacagaaaaaacttataaggaccaaaattaaaaatatataaacttacaaagactaaaaaataattaaacctaaaagaaaagttaaatgttctagttttatttataaaaaaaactgcataaatgactataaggaaaaatgatgtaataattcgaaacgtggctcttaaacgattttattattagctagataataggaattattcaaactcattaggagaaataacccactagaatcgctgtggtggtggaaagtttagagtatatgcgtgaaaattttagtttgatcctcgttgtcgtcatttagaagaaaaaaaacatagtagaggaaatttgggtagtcttaataaagtttaaagttaatcaaaataggtaactggaattatacacatagccacttgatagattgtattatgtcttataattttatgagttataaggttagtttgattcttaaagagggaacgagaaaaaataaagttataaattcgaatatatctcttttattaataaaaattaaaaaattaataattaatgtttaccaataaaaaaatataaaataatctttcttaacaaataaattaattatttaccagtcacattctttgactaggtttacaaatataattaatcatttcttctttattactaaatagcaagtatcaatagtctaaacttctagtcactaaaagtgtttattgattcgaattaatctaacaagtctaacat

SEQ ID NO: 2825 - DNA, 1056 bp, Glycine max
  Soy_ogl_3077 Gm09:29044631..29045686 Cluster 11
cattagttaaaatgatttaaacctaccaggctacttcctctcacttctttcttcaagtaacatattaatcttataataattcctaatttttactaattttgtatacttaattttctgtttctttttctttctggctgattcaaaaaatgattggtgtgggtagggtgtagggaagtgtttcatgtttaatttatgaccaacgtggtggggaggagcaggctgcgcaattgtctaggactatagaactaggagtccttgttttggtttatcatgaagtttcaatagaaagtcatcgtctttgcattttctttttccatttctctcctgattcaaacaatcaaagcgttttaattagtagcaggctgcgtaagattcaccaaaaaaagaaaagaaagtaacagctgcgtaagtgtcttggactatgtttcggcgaatgtttttaaaataaattagaaactataaggatcaatcaagcagcgtaagtattttatgcttatacttgtctgtgcttctagataaattaaattttattaattaaataaaagagtataatttcaaatttatacatgattttttaattataatttttcttctgattaaagaacaattcatagtagataaaagtattaactaaacataaaatttgtctaaaatattacatctcctcataaattataatgtaaccaaaattacaaactataaactaaaataattcaatttttagttgaagatacaataaaaaaataagataaatttaattaattattatacttgtgacaaaattaaaaatctacgtacgaagagacttaagcaataatgtttatttcatgcttatacatgcatgtgcttgtagaagatcattaagtgtttaatagccatcacttaaagactgttcactcggagtgatctgatgtatgatttgtcattatttgaacccatatgcattgatattaactaactcactttgtattaattagttagattaaaatgcttcctaaaatattattcaattcaatataattcaagtttatttttcataataatatcacgggtaag

SEQ ID NO: 2826 - DNA, 1409 bp, Glycine max
  Soy_ogl_5049 Gm15:14730360..14731768 Cluster 11
caaagaaaagaaagagataaagccactcaaatattattatctccaaagtcaaaccctactacattaaaatgattacccaaatatagatacacatattaaaattttaaaattagaaaaagcaaggggcaatcgccccaaatatatacacaaataaatccgtacctgccaccctcccaccactttatcgattatatatggagtaaaaaaattatagaaagaatgaaaaatattagaaaatcaaaatataaaatagagtttaaattttttgtttaattgataaatgttagttttgttacaaatgtttatgggaggaatccaacctacaatcttttctttcatctactttttcattcaaccttaagtctttttcgtttaatatgatttgttcttaagtttttcgttattagtccttaaacaattttttttaacatttttggtttgtatattttcttttgttaattattttagttcgtactattaaataacaatgttaaatgtcacattaatattctaatgatttatcacataaaaatttgacagacaattatatataatttttttataaattatatttttaatctctcgtctagaggatttaaaggacatgttcgtcttatgaggtgcagaccaaaattattagtagtaggctaacaacatcatttatatatgctccacttggagtaccatgtgtgactatttggcgtggttctaaacttactctcacccaacccagatagatgatcaacatgactgcttatgaaatatcattatatctctctcgttttttcttgtataattgcattatacgtatatatactcttttgtagattgtgtttctcggcattgctcatgatcttcaaatcatattgaatttgagcaaaatgaccccaacactgagacttataaccactgctctgaaaatcaaattggaccgatcagttcaagtggtccaaccaaaacggatttagtgatcggttgaaacacttcaagatatcaacacatttcataattggtcaaatcagtccaaaattgattaaaaatgacattaatttggtgctgagaaccaatttgaatagtgtttttttttcaaatttctatatttttaaatttaatctaaaatattttgaagataaataaaagtacatatttaaatattttttccactattattaattcgtatgttacaaaacatataattccacatatattaacttataactttttagatcttgatttttataattttatattttatattattttattacttaaaataatatataatataacaaaatataaaaccgattccattattgttaaaccattcaatcttaaaccatcttcacctgatcgttttaaaaacattgatatgtcctctttctggctagatttttgtatggcaaaaatta

SEQ ID NO: 2827 - DNA, 1200 bp, Glycine max
  Soy_ogl_6088 Gm18:43655601..43656800 Cluster 11
gtgtttaattagaagtagtgatccatcaatttgtttatgctatatgggtatgatgatgaatctttttgtcacctcttaatacacaaattgatgtcaccaccgcttaaaaagttggttctttcttaccattaaaaatgattaacaatgattatcaaaagaagaagtaatacaagttgatatatgttcacattgaactgaaataatattaaaaaaaaaactgaaataataaaatggcagaaacaaatgttaaaaaatgtcttttcgtatatctaaccatgtattcataactcatgtgactgttaaaatttcagtgttataggaaagaaaaaataaacatcttatgcccgcctaaattaatgcccgattttctgttttcctttcattaattattgacttcttattccaaatttttttgggggtgaagatttcttattccaaaatcattctttactccaaggtatgtatatcaaagtcttttctaaataatataaattgatcccccatgttgcagtatcatatatcatagtgttccttcaaaaacaaaaaaagtagtatactccttttaccttctcatatttgcttctctttatgtcttttatgagactttttttatgctccttttgaattaatggcatcaagatttggcttaatttcgaacatcatccctagaaagaccgaattgaggttgaaggcacgtgtttttcgtttatgggctataaccgagtacaaaaatcctcccaatgaagccagcagtcttcagatgttattaattgatgaaaaggtaagtttataattaaaaattaagataacttttttctaggcgacatgaacgatgcatcattttttgaatatagggttgagtaacttgtgttagctactaaagatgatatagttgataccataaatgattaattgttgtctttaattaattcctgagaaagaaaaaataaatatctggggcatttgtttcacatattatttagttatttccggaaatacaggtttgaaaaagattattctacgtttgttacacagtcatacaataattaattccgggcataatttattctcgaaagagacataattccactttcaacttatatttaatcccatcagaagagataggtaaaaattatttccatgagtaaaagttcatatatattcttattccttattactattgcactactttttttttat

SEQ ID NO: 2828 - DNA, 1000 bp, Glycine max
  Soy_ogl_593 Gm02:41008401..41009400 Cluster 11
taattaatgataaatttttattaggtgtagacttttgtcctctaaagatagtttaagtgtacacttacttaaaaagctactccataaccattaaacatattttaattctgccaatcgttgtaattatgcctcttaaatactttatattaactgtgtcataaacattgttaaatcatttttaatgttgtcatttatcttaaaagtatccatttttaattactaaaaaaaactgaataaaaggcttaattatacaaattgactcttaattataattaaaagtttaattaaatattttaattattaaaaaattcaatcaagttctttaattatttaaaaatatttcagttgaattcttaaattattaaaagataaattaggtcattcaactatttaaaaatactccaattaggttcctcaattattaaattttttattaagtcttccaatagtttaaaaatactacattcattaaacctaatgaaattgacaaaaaagataccattgtagtaattttaaaaaattgaaagacatactgttaaagaatttaatcaatgtgtcattaaataattaaaagatctaattaaattttgtaataattagaagatttaattaaatatttaatattatataatttaatcttaataaaaaaaattgtaaaatgtaatgtttacaagtattgccgtgagtgtaatgtgaacttttgtttgtaaaatgtaaacagagttttaactttgtttcttttgggtgctaatccacttttcctgctaatatcatttcaacagacttccgtgctctgagtttagttacagactcacaggatttatagatattaaaaaaaatacagataccttcctccttgaaacaaagttaataaaaaaatgtattgattttaaattattagacatcaatttaacaaatttaacaaatgtagcataaaaatatatttgcccactataaatatagccaaactttattactactatttttttacttttcttaa

SEQ ID NO: 2829 - DNA, 1478 bp, Glycine max
  Soy_ogl_2807 Gm08:35384623..35386100 Cluster 11
agcaaaaatgtatctaaatcattttaaaattttattctttaaaactcaagtaaatgaaaataccagatccaatggttagagccaattgttcactttatattttatagctatgtttctcaacaaaacattcttttaatattttttggattttttttatagaaggatatttctttcttaatgttcaaaatttactcccaaattaaacatttacccgttgatgtatttatttcttaatgttctagatttactctcctatgcaggaccttactcggatgcatgactctttgaaacagttgactttaattatgtttttggttttataaatataataacatttttttttttactttgatcattctttaatttgcgtgatcccttcacatagcatgcgacaatagcgataagtcaatgacataatattctatgcgtcacttaggatgtgtgttggtttgtatgacataattaattgacggaaaatgaaactgtttaccaatttggttggattatttataatagaattaacatacaatttgtgaggctcagaggttaaaatttccatcttttgagaaggggacgacacttaacaggagattaaaattcgataaaaaaagacaattttaggttaaataattaattttttaggcaaaaaataatatatgattttctttgattatcaagcctatccaggtaagtgtataactacaaagtgtatttatttagttctctcgtctctatctcattatcttacatatttcttttgaaccaaacaataaaacaaatcacttcatttctaccttatttcttccatttcaaattatctctttttcattatcacctactatgtcaaacacaacaccaatgtaaataattatacaaagacaaaactttagtctttttaaaaatatagagccacgtacagtataaaaatcactgtttaaaaaactaaaaacataggagtatttaattttctccaaagtaattttataatgacattattgtattgcattccacttcattgtattcctttttctttatgcaatatttatgattataatttctaatttttttttatagattagtcttagttttcaaacttttatttcatccaaaaggattataatattcaatgtttcacttgaaatagtaaaaaaaatccaattaagataaataaaatatataagtaattaaagataaatatattttcataaaaaattctttcacatcaaattctataacagtattttaataatttttgtttattttgaagttaagtgacgacgtgacgtttttttatttttattttattttattatatttgtttttggcaactgaaaattttaatttttaattttcttacttttctctttcccattttgatttcgccccttggagagagtcactttctctctccctgaactccctctgctcctaagagcctaagacccatcctcgtcgtcaccacctctttcttcctcagc

SEQ ID NO: 2830 - DNA, 1215 bp, Glycine max
  Soy_ogl_3073 Gm09:28661101..28662315 Cluster 11
actaatgttatttatataatgtttgggaagtaataattaggtataattatcaaaaggagttggctcaatctatatagttaaatacttacataatctttcccctatataaaacgattttatagctttaaatagcagcacaagtatacgaattgaggttgacctgtagaggaaatttaaagggatcggttgtctcaataaatattgaggcaactattagttaaaaaatttaatgcatgtaaaacaagaaatattttaagatattttatgttgttattcaatcagttattgtctaaattattttaagatatgtaaaaaattttatactgtgtcaatgtataaccatttatctcttagttaaattgtaacatgatatatcttaaatatattttttaatcaagaaacatcatctctatgttaacaaaatgtgcatgtccatgtagacgatattattttaagcattatggtatgaaagtgtgtgatgtagtgggatgaacttaaagtctttcttaatttaaaacactaataggcattgacttacgaagatatgaatttcgttgatattttgcctttgacatgtgttacgccaccaaaagaatccaaatatttattcacgttgataaaagacaaaagttaaggggttttttttcgtgtttttacatgaagttctattttaattaaaatcaaaattttatttcaataactcctcaatttttaatatcaatattaaacgtgtatattaatgaagtaaaatgttaatttaattaaaaaataatatcacaactaatttccatttactatttattagaaagaaaagaaaaagagaaaagaaagaatttgaaatttaaataacaaaaaatccgatacacaagttttgtggattgataaaatcgaagaaatatacttcaactgaaattaaaggagcattgtaaaacctaaagagaggaaaatcctcaagttgataaatgcttttaaatttttcgaagacgccggaaaaggaatcaacatgtctggatttgtctgatgtaaggatgaatggcatgtgcaaagaaattttattatacatttattttaataaaatataaattttattattgacaaatgataatgaaggcttttttaataatatctgttttttttctgttcgttagatacatgattttgtatttaaaaacatgattttgtcgttatttaacttaataatattgttatttttat

SEQ ID NO: 2831 - DNA, 1714 bp, Glycine max
  Soy_ogl_871 Gm03:33399822..33401535 Cluster 11
ggaaagtcgagctcataattgatgagcaaggaatgcattatactataataaacaactatacttcatttatctcattatttttttcattgatcagcaaatattaatgattaatatggttagttttttattatcaaatgagattttaccgacaatcttactccttttctctttttttttttttaactactcaagtcacctcatatttcttttactcctttatctcattgtttattctagctagttggacacaagaagctaccaaacatgtgcatcctcgtaaccaaagcaaggactcggaatatacgtgaactaattgtatacctaaaccaccatctttcaacatattacacctagccacacattttgaattaaatccttggtagttattgccacctaatactcagatactttacatcatgttatatatggagattagtttagaatgacgacacaccaatatttctcttctttagatcgagccatcgaggtacagaaaaattaaactatatcagtgcattcctttgtttgttgtaattcttaatttaaaaatctaagtagatgcatggccaagatttaaatatatatttatttttaatgttaaatattaaaataaaggttaatggacaatctacattctttttactctcatttctagtgagtattctctctttcgttaaaaaaataaataataaaaaagtgatctcactcttgaatttatatatatatatatcaattttgaaatcaaatgtagaaagcaagtaggattaggttgagaaattgacagctctcgcatagaatgaagccaccattgtggggccacgctacattattatattttataaacatcgatgaatccaaaaaagtatatggcagccttttcaaacggaagaatagaattggaagcgttacatcaaggaccaaacgatcgtgtgaagctggaaataattgaatgcatgaaaatacaatcatccaatcaaaaaatagttctacttgttagattatatttatattgctaactaatgctgttataagaaaatcactttcaacagttaattttaaaaaaaaatggcttaattattctcataatcctcgtaccttaattcatgggtggttttggtgtctttaatttaaattgtttgtagttaatcataattttgttaaagttaagtcccatatatacttcaaagttaaataatgagtagaaacgtaacgatgtgtgtaacatgatattgatctgtgtatagattcctaaaggaaataataataataaaatattcaaataaaaaatgtatgaaatataattagaagtcattatttaaatatctcgtatattagttatgtgagtagggaagtcaaatatttcataaattaatatgaccagtaattattaattataattgaattttgagataattttgacattatgaattaaattattatttcataagatgtaaaatgcacaatttacaaagagtagttttggagtaaagatatactcataatcatccattgcacatgatagatgactagtctatcgattttttttatgtcattagtgtcctaaatcattaggaatattaattaattacagttaatccaagttttcaccaaatggtttaggcaaaatgacttagacatagttaaactctttttccttaaatcccattggcaaattttcaatttgaagcatcttattggttttcaggaggggggg

SEQ ID NO: 2832 - DNA, 1388 bp, Glycine max
  Soy_ogl_6681 Gm20:1729571..1730958 Cluster 11
caatttatgtacgttcgtggtcaggggtgagtgatgatgatctttcacttctgctcttggtgggtcaacgtcagcaagccacgggagtttttttttttcttttgtttttggcttgttgaatgtatgtggaatgtacatataaagttattttatttatttttcttgttatttgttttaaggttaaatatgcttttaaatttatttttctagtaaaaaatcatagatgcttccaggactgccgttatttatataggagagaatggaatacgaattttttgttaaatatattattctcacacatataaatataacaaaatcttatatcattatattaaattaaatatatttttaagtttatgtaaatatagaaatgttttttataagcaaaaatgaaatataataagcccatttggactaattaactcatttagaacatctcaagttcagacttcatttacaggttatatgtgagagtttcatatattttatgatattacattataattgtcactcaaattatataatttcttttatcagcactcaaaaattttagttgctttaaaacttctagaggtccctaagaaatgtgactaaggtgatctctcaaactcatgtatgccatgtgatgcttattaagggtgttattaattgtgaaccatctgaataatatataaaaattgtgagccatctgagtaatattacaggagtgttcgcatttcctatttttatgtgaaatgtcattggatggaaacacatgtgaattgtgaaccatctgaataatatataaaaaaaaattaattcaactttattttattcaaagtagtttgaattgaactgaataatttagtttcttactttatttgttaaaaactctgattgaaaatgctcatggattgttttttggttgtgttagatttcttcttctttttttacatcgtgtgtatgagattaattcttgaaggataaaatactacgattaattaggctctttccacaagtggggattccacctcgtcaaattctacccttccagatagggtaactcgcttcccattaaaaaatactactcttagtttaatttttttgtttgagtgatagatcataggtgtttcttaaacttctaagtgagagattaattccattaaggtgtgtgattgttgttaattttttttatacaataaaaattaaacataaattctttcactaaatacatatttaaacttttatggatcaacctgccacactgattaggaaaaacaaaaagaaaaacaaagcacatgcactcacatagacataaaataataaattaaactaaattttttaatattattattattataattaagttattatattaaatatttgcataattttatcccactgggtct

SEQ ID NO: 2833 - DNA, 1041 bp, Glycine max
  Soy_ogl_1909 Gm06:11793160..11794200 Cluster 11
attttgtttttatacttcttttacactgtgatggaacccagaataacatttgaaaatacattagatatgtttcctatctctctccattgcagggatcgagaaatagactttataacttgaaaatgcatgatatatagatatatatgtgtgtgttaacagattcttatctctatatattatggatgtggatgcatacaatttgtctgaattattggtctgtttatatcatttttctattttattgaataagacttgatgagtcttctgcccgcgtaccaagtcgcgaaaatgttgcaacttgcaatcacctttgcccgcgtaaaagaaagtataggtggtccctaaaatacaataacaaactacttaaattctcttaaaaatatctccaaaaaaaattatacactcacaatataattttttcttacactattctccgatcatagcatatatgatatatgataagattattaatttttataataattacattaaaaattatatcaataataatttataattagagcatcatataaaactattttacatcattagtatataatcattaaattcaatattataattcatatttttttaaaagaaatattataattcattcttagtaactcttcgaatgttaaaaaacttttcaaattcgtcattaactttactgacatattttaatttagaaactaaagtgacagttattaaatactttagagtatatttaaataattttattacttggaagatgaaattagtatttttttttaaaaagccatgtcattttttttaaagaaaaaacaacaacaaaacaaaaagccatgccatgagatccgagccgttaaaatttttcaatggtcgagaaaatcaccacttgactgtagactctcttgtttccacgaataatagatgagttgcggactgagaatgttgttaagttacaaatcaaagcaaccacacataaaatcagaaagaacaatcgatatatatttactaatcataaataaactaataaaaaacatattttttaaaagataaaat

SEQ ID NO: 2834 - DNA, 1051 bp, Glycine max
  Soy_ogl_1599 Gm05:5211101..5212151 Cluster 11
gatggcagactcgtgcttgtgtatgcccatctaaagagggaagcaagaatctaaatcaaaatcctctagaaaaattaaaaagaaaaaagagatgaaaattcatctgtgtgaaggcgacatttgctagcaaaatttcccatcccatacatgatatattcttcaacatgccctacacatacaactatctttctcaccccgtaagatatttatgtggttgatattaaatacaatttcgattaacaaaagaattatttcataatcagaatgagctcattaacacaaatattgatagtattacatattagccatacatgcgactttgttgttggaaagaaaacaaaaccctcgatcggtcatatttaatgggaagattggtgttgaatctggatccacgttaattggataatggttgtggattgaaattgacttcattagaaaaacaagcataattttagatttgtttgatcggtgagttgggtccacttcaccttttaaatttttgagctccacttgtttctttcttccgtcttttcacaaaggtccacttgctttttccggcacgaggaagatatgtttatagcttttgttttattggaacccataggaacggtatttataattttttaagatgcagtacgttcaggaagttaatttgattcacatctacaatatttcataacacataatgaacaatgaatgacttgtttgagtatatttcagttttctcttttttacgtattgttttgtaaaatatttaaaaaactgttttctcaacttcctcacaccactaccccacttcatctccctaaaagaaattgtttttattttattttaaattcatccaaacgtaattttatattttaccttttaaatgataaataatactatcacagaaatttttttcattgattttatctaatcataaatataatataccaaaagtttattaacttttataatatttatcttacacttaataataagagtgatttttttatgaatgatattgtaaaaacttttatattgaccattcattaaaaacatgattttg

SEQ ID NO: 2835 - DNA, 1167 bp, Glycine max
  Soy_ogl_2763 Gm08:19178374..19179540 Cluster 11
tacatttaatttttcctgttaaaattaatcatgcctaaattagtatgaagatcaaaattaaaaatgattaaaaacttcgaaacataacactcaatcatgggcaaactcatttaatatttaaaaaaaaatatatcaaccttttagtagaaactctggtattatttaaaaaaatcttttatactaacccataacaatatatattctcaattaatatttctttaaaaattaatatgaaggacaagctcatttacttaaaaaagagagtgatataatttatttgcttgaatctacaatgaatcaatgatatattagttgatttaagcaattgatatattaaaaagtaattaaggtaattaatatcatgattttaagataattaatatattcaggtatgtaattaaagtaattaatattcaagtaagtaattaaaataattaatatcataatttgaagatttaattattactttttttaaaatcttgaatatacattataaataatctgttgagtgaatattgaaactctaaacgtcaaatattgcaagagcttgtcaaacattgcaagagcttctttttttttttctattcttttctaaatattattattacgagtttttaccttgcacatgttcttttttttgtgtgtatttaatttatagactttctcatgtgttcctattctcttctttatacttgcttttttacatgcaaaagagaaaaatctcttgcattttattgagtgtattgcaagatctaatgaatttttttgttaacatgtaaaagctaatgggttcagatcctattttggtaatgctcacatcttattcctattccgataatatttgcttcttaattctattatttttcattttaaagattgctggtacattattgtatttgacttagcattcctttttttggtgggttagaatttcctttattttatttttatttctattattttatgttgcaccatttttttattatccagtgaattactctatcattttttttcgatatacagggaaaaaaaaacgaaaggctacaacactaccaacccattttgaaagccataccgctagcatcatcagctaaaatgttgcacaaaacatgattaatgtgatcaatacaagatatccaataattaataatcattatggcccaaatg

SEQ ID NO: 2836 - DNA, 1000 bp, Glycine max
  Soy_ogl_3061 Gm09:125901..126900 Cluster 11
cctgggatattcgaggacacaaattgacaagtagatatatttgttgcgggaataggtagtggccaataccttaaataaaaaaatcctaatattaaggtgatgctcttcatatgataaattcaaattacatgttatgttaaataaactcattaatccataaattgaggtgaatgtacattagaacacatgtaaacaaaaatacaaacacacaatctacaacgtcaaccatgcttttaatcgcgtgttgtgagcgatacagaggttctgattcatgatgaatacaccaaacatatacttataatatgtcttgttctaaattctaacctgtttatagaatgttaccaagttacctccaatagctatgcatattttctcttcaccataacaggggttagacaagtgtggcttttacgtagtggtaggccagcaaaaaaattgtgatccctaaagcttgcttctgacccatacatgaaactataaggggaccaatagcccaaaaacctctctctttcctttttttttttttcttctctcaaattttagatatcagatttcactcaagttttggacttctttgtctggactatatattcttttaatctttttttgaaaaccaggataaaattgagattgaattacattaaacaccaataacattaattcgcgtggacccaatgcttattatttaatgttatatatattattcatctttttgctgctatgttataatattttttttttactcctctaaatgaaccgctattagcagttccagtatatcattggtctcccattttcttacattaaacactttcaaacatttttttgtatccctcataatcacattgtttatgttatttatacccctctctttccatcctctctctcgtggttatagatcattacgttattaatcatctgaatatttaaacatgatcttagccttaccatttgaagattcaaattcttgtaatattttttttttccaaatgtagtctga

SEQ ID NO: 2837 - DNA, 1500 bp, Glycine max
  Soy_ogl_24 Gm15:43714401..43715900 Cluster 11
ttctgaaattaaaagaaaaatggcttgctatatttaaagtaatcaaatgactactattattttagaaatcttaaccgttattgagtaacttcattaattaaataataataatcccttagaatgtatttggaaggcaaaatgaaaataatattaaacagaaattttgtactttttagtggaatgtatatcttttaaattttattttaattcaaaaaatttgattttgttttcatttctaaatcaaacaaccattaatattttaactgaaaaatagaaatattttgtacaatctttcaaaacttcatcagatattctaacaagaaaatagattatgggctgataacattaataaattttatattttcatttaactacatagttctttatataaagtgatggatcaagaaattttaagttgtggaaacaatatcatgcatacaaattttcgggaacaataattatattataaattatttttttaattgcatttcaaattataagaacaattatttttttcaactatgcatatattttatacaaaaaaatttataatattgtaaaagattgttcttttctattacaccggttgacttttatcataattaatttaaaaattatatcaaaaataaattataattaaacgatgatataaaataattttataatattataaaagattgttcctttctaatttctattatacccaaatccgttgacatattttttctctgacaagaagctagggcaaaagtaaggggcagtagtaccctcaatataatgactcccacgtgggtaatctcacgtgcggcgaaccatattggcacgtgcagcttcctccacagaagaaacaaaccactccatgcatcatgcacatgcactcctataaaggtgtcccaatgtctctgagtttctcttgtcaacaggattcccacccctattttaattaatttttcatattgcacaatattttatttgctatattattttatttattttttggctttcataaagtggcacagctttctccacctttcagaagcacatggacaaaagtgtcaccatctatgttggtcacatgtcactacactaatctttgcacggagaataattttttaatctttttcatagtacaatgcatcctcctaaatcctacttattacataggaaaaaaagtattagattattgtttatcttatcaaaacattaaactttatctagtgtataatttaatatttctctaatgttttagtgtttgtagtacatatgaagtcaactaccaattcgggatatctaagtcggaagttaagattaattctttattgaaatttatttaatatattgacattttttcaagatgtttctctatacacacctcatggaattgaatccttcaacatatattcgggaacaaaatatatcttaggaaaaacgtaataaattattgtcaagacattaaactatatctaatttatgtgtagaattatttatttaatatgaaaa

SEQ ID NO: 2838 - DNA, 1200 bp, Glycine max
  Soy_ogl_5704 Gm17:18190101..18191300 Cluster 11
gtgtttgctttcggccgcactgccgtcatcatggttcagtactgtgggatttttttattttggttacaacttggtagtagctagtaggccaaattattatagactaaattaacagtagtattttttttaacccaaaggctcacataaaattgtaaggttaatccatatttacacgagtaagaatcgtttatttaacggaaatcatgaattgtgaggctaattcattgaattggaaacacctaggaacggttctacatagaagaaaaaggaggtaattgtcaccactaaattttttctttttcttgatataacatgtatgtgtagtaaaacttagttaaaaaatttataatatatgttttatccctactaatttatatatatgaatattaattttacaattaaaattttttagatccgtcattggagacattcatgatcttcgacactagataaagataataatatttttagcataatttctgaaaatgtagaacactagttttttctttttttttaaaaaaaaatggaacaacttacagaactatagagtttctttgacttcaggtttttcaaaagtgatttgcaatttatctcaaatatgatgttatttaaataagtaattcaaagtgtaactcattaattacattagtttaaaataaaaaatgatttaaatgataatattaatgtataactaaagaccaaaataataagtagttaaatttaaagacttagatgaattaattaaaaaataagaatttattttgattttgtttttagttttagaaactaatgagataacctattatatttgtaagttgggacttactcaattattatatgattctgaattattagggtctcagcaatttttacctttctttcaaaaagaagtttttacctgacctgtaattaagtccggttagctctttttataaactgaaaatttaagacagaaatcataatcacatagtaattccagatcataaaataaattttttctagagactgcgtgcttagctatttacgaggccccactccattggatttagcatctgaagtgacgaaccccccatccaatgcactagcatctgcgtttgcaatcctccaatcacatcatttctccaaaattcactctatcactttcttttcttttcaatgcacactactacttatttaattctcttaattgattgctatgcc

SEQ ID NO: 2839 - DNA, 1698 bp, Glycine max
  Soy_ogl_6699 Gm20:3882821..3884518 Cluster 11
gtacaaatattacctacttatgacctttttttcttttgaagatacctacttttgggcttatggttttagtttaaaacatttaaatgaatgcactcctttactctccctcattccacacccattgaaagagcaagctttttgttccttatgagaacaaaagagcttttttttttctttatttattattatttttttacatttatctaaatacaaacttaactttttttttgtttggtgtttgattattaattcaagaataagttattttggttcatcttacttattttaaaatgttttaacaatttttctcactttttttggacataagcaaaattttacccatcttgcttcttagcttaaatatttgaattttgtttaaaagaaataatattatatcattgtaattttgtagcttttttttcttaaatatactttcgttacattttgttttattaaaataaaattaaaaaggtattatatgagttttaacatataaaataatcgataatataaattagtttgtcctgggattcttatccaagctacttggaaaaaaaatcaatagttaaaacagtacttagtaggatttaaatgtactaatgtggggccttcaataatcaagggttcattggctagttgactaagcaaaccaagattttttttctttggtgaatgataagcaaaccaagattctgttgcgtgaagtttattaactttttttctttttattaatgtactagtttcccttcaaaaaaaattattgtattagttttaacaaataaaatccctcatttgtgttttagtaggctttttatatgacattgggccttcaacggtggactcttatcaaacaagctcacgtaatctaactctaattgactcgcttaaataaacacaacaaacaaccacatttattcaagttagctctctttagctaactagttgtgactagctaaagtgagcataataagatgctaaaactttctgagatacttagccttagtgagtcagcattggttcacctaagctatagctcagtactttcaaaaatctttaaagttctcacattgtagtgttgggagtccaaattatctctccaaattaaaatatgccctccaaatgatcctacgaaataaaacaaaaaccaacaaagatcaaataaaaaaaagcaagtatttaaccgacaagagcatttactcaaagatcaattaaaatggagacatggacataacttaaaagcatcatagacatataataattgcaccaaatttactgcaaaaatgcaactatagtatcaatctcacgactctttatcagaatctaggagtttaaagggtacaaaatctataagaattatatattgcattattgtgtatatttattttggtttaatattcattgtgctaatattattttttatttatcctttaattcttttaaatactacaatttttctatttagtccatctacatatcagaatatatattttagagtcacaaaaacaatcaataaataaaccaaacgtcatcataagtgaaaaaaaataaaacaaactaaagtaaataataaaattaacatatatgtcaatacataataatatatacagtaaaagtatatcaattttagcatatgaaaacacgataataaaataaaaacacgaacacacaagtgcgacaagacaacatcatatatgtttc

SEQ ID NO: 2840 - DNA, 1300 bp, Glycine max
  Soy_ogl_6000 Gm18:8871001..8872300 Cluster 11
agctagactagactagtcaagtctagaacaaatactagtacatatcctcattaattagttttataatattttaaaaaaggaaaaaaacaatgctaataaataagtgatactctcattaatttctttactcggcttacaacatgtacgtgtttagttttataataaacgcttaatactaggttactaattactccctcttatttttagacatatcctcattaattagttttataatattttaaaaaaggaaaaaaaacaatgctaataaataagtgatactctcattaatttctttactcggcttacaacatgtacgtgtttagttttataataaacgcttaatactaggttactaattactccctcttatttttagatctataattactccctctgatattctaaaaactttgattgtttaaggttttgggcttttggctcataagaaattataaactaagataaatttagactaaaacactctacgcataaaaaaaatgtagactaaaacactcttaattattgttttctttattactgatgttttaaactcaattctagctttaaagtcaaatgagaatcgacactttgcagcataagcacactctttgatgggctagcggtatatatttgggaccagcataattcatcagtgtaggtattcctttaataaaggtggtatttatttacaatgcaaatatactattaagaataaagactccattagtagctacctagagaaattaaatataattaatttatatttaagggtatatcttaaaaaatgcttaattttatcttcagtttctataacagtcaaagcaggtttttaaataaaaaaataaaagttaaaacaattaaattttagaatgaaaggagtgacaaaaaaagatattgattatataaaaatatataaattatatatttaatatgttgatttcaatatattaaaaatgagtaataaaatgcatttaatgttctgtaaataatatctattggtgggtttatatctataagaaccttttggttttagcccgtgtccctctatagaagttaacacttcttttccttaaaaattatatatatataaaggttttaattcgtgtctgatgatttagataagacaaagttttacctaggttgaaaaggtttgatcgatctatgttctaaacttaagacttaaatttaaattatttatataatattaaatcattttttaaggaatagactagtttttttaattaaaaatcaggcttttaattatcttaaagaattaagaatttccttttgcaataaacat

SEQ ID NO: 2841 - DNA, 1800 bp, Glycine max
  Soy_ogl_1624 Gm05:28221601..28223400 Cluster 11
cttgttgatcattttatctagcatatacttttcactttttatcaattagtaggccattttgattcatgtatacaatttttattttattctttagtcttgactcttgactcatttttttattctaattgttgtttctccattatacttctgttcttttagaaattctcatagatatattaattaacttatcgtcaacctctgtattatcactcaactcacctctaaaatgttatattctatgcagagctgtccttcatcttacaatcccaagcactatcatgaactctacaatttccgaactagaggctaagttgcaagggcatcagctgattcgagggataatttggtgccatttgctcctctccaattggagtcaccagttggtcaacttctggaaaaaatctcaaatacccatccgcatctactaacaacaatcattgatcaacaactagagaatcttcagaatgttagagatgctcacaaagaatctgatacatctcaggactccctttacaagtaagtctaacatgtttttttttcctgtctttttcctctttattctgctttgactagaagtacccatgtggtaaggaaaaattgagaaaattgaaaactttttaggactactatagcaaatttaggttcatagagatgtaattaactgtagcacctttcttgcatcaaatgtgtttacgagaattaatgtatgagaatttgcctgcatagttttaaatttcttctaatgtttttctttttctgtcttgaatttcttcaatttcttactaaaaatgcaaaaatgattgttcaagaattagtggaataaaatataaggttgtggttttatataagttacactgaaagtctatttattatatgactaggaaaaacccttaaatataattggcacctatgagtaacattcaagaatattgaaacaaaacttggatatatttatagtgagttcattttttccatttgatacaatgcatgagccatcaagagattaaaatatccactggatgcatttagtttcttctagaatgaaaatctagtagaaatttgtgtcaaattttaacataaacaaatgcatgactcacttgtaaatctagtagaaattaaatattttttacatattaaaatatgcaaaaatacataaaaatatttggtgttttgtgttttttctctaatattaagacatgtttctataataagcttatataagtatttgtataattgtatgatagaaaaataagaagaaaaaaattctataaattaaaattaatttatacaaattaaaaattatcttttagataaattatgtgaaagaataatttatgaaaattaacttacgtataaattaagttaattttagctttaaaaacattatttttatttcattaagtgtttccgaagagtttatcaaacatactgctaacatattttggttcagcatatagtataccctgtgcttccttacattcgttaagcattattacatcgctttatactttcttttttacactaaagtttatgctaagaaaatattttatttattttaaagtcaaataaaaataataattttgataaaaatattaaaaaaaatgttatttattaataaaaatctaaaattttaaactcaagtcatactgttaattgtcattagttgaacttaaagagatcaacagtacgtcaatactaagatgcccctgtaggtcctctatgcacaataattatattatattataagcgtgtgtaaaaaataaactaaaaaaatatagacaaaatggcttgtgcaaaaaa

SEQ ID NO: 2842 - DNA, 1393 bp, Glycine max
  Soy_ogl_600 Gm02:41819201..41820593 Cluster 11
tagttaaatataattttgattttccaaatatccaaaaataagtctattgtatttggtcctgaattttaaaaatttatcttttaagtccttttatttaaattcattaattttctattaaatgcaagttatctccacctattgtagtcaatgaatgtttgttcttagaattaggttccactacgaacagagattatacgagtttaattgtatatacttgtttgagaataatataactgtagtttgatttatttttttctattattgctataaatttttaacagaaaaaatgaactaagttaaataaaggacttaaaaggataattttgaaaaatcaaggattaaacacaatgaaattatttttgaaggactaaaatcaatatagatcaatatttagaagaagaaaaaaatcatatttaagcttttttttcatccctctaaaacttaaaattattgatttttagtatctataaaataagtggattttggttttggtcctacaaatttttttcatggtttttaatccctccaagatttgaaattactatgtttggttcctaaagatcattttaggacagataagtaatatttattttagaagtttagattttttttttatggtaacacatgttgacattgtatcacagatactaacggatgttatctaggatggtcatttgaatttctctgctaaatacaaagtcattagcgagtgttaggagaaacaaaaactaaaattttactttttgggtgatgaaaactaaagatttttttttatataaaatctaaattaaaatttactaattttatatttgtttgtaattcagtggatcgagagatattcgtgatttctaatcatctaatctagggaaaaaagtgttgaacctagtgtaagttatgacagttctatgcaaatttccttttgaaataactttaatgtttgagttggtatttcggctttatggatgttgaaccacaatcgagcatttttggcataaaaactgaatacttgttagttgttttgagtgtaactcacttttgctggttcgaggtggatagatcagatcatagaattactaagaatataactatatatccaccaaaaaaaaaaaactaagaacgtaactatcaatatttaaattcaagatcattaattatgctagaacaacctacgactatagtttaattatgtatttgatagtaattattattttgttctaatttatttttcagtttttaaagttcaatttcatctgttaatttatttattaagtttaatttgattttttaaaaaaaggtttaattaagtctttatttttttttaaaatgagttcaatttaatctaatttttttcggtcagctccaaacatttttaaaaatgaaaccaaatttgatt

SEQ ID NO: 2843 - DNA, 1200 bp, Glycine max
  Soy_ogl_4080 Gm12:33839201..33840400 Cluster 11
ttccttctattagtctcttattcatttaaaattctccttcttgtctgatttcttcaaatgttccttccagaatattagcaaaatattactctctttattttatttttttgccaatatagtgccattatcccaattatccttacttaaagaataatatttaaagctgtaaaaaaaagagttatatttaaaatttttgggaaagtatattctccaaaaccttttttaaaagaaaaacttgtcattaaattagttgttgagaaaaatccacaaagagacccatacaaaatttaaaaaggaaaaatagaataaaatgcaatttgtttaggtagtttgattatgtttccgctttctttgacagtttcaccccttttcctctccaataagatcatacaattttcaaacactacatagctattgttttaagcctcaatcataattcaaatcacaacaactaaactttattaagattaaaagatattttgacaacaggtagaggcatactgagcatgaattgcatccaattgaaaaacttagctcctatattacgcaataactactgtccaaatggctgaatttaaaatgtaagaagtttaactcaatctcaactacataagcaactttagataagtattgtacatgtacatcttcattaatttatcgtaaatatcagtgcagttcgagccttaacttcatcaatctctaataatgtgagttagttataacagtgactaatttttacaaccaaaaaattaaggtttaaaaattaatttttatgttcttcaatgcattatattattttcacaaccttcagataatttttttacaatttattttttaatttctcttcaatacattgtttatcttattatacatttttttcattatcatttggtcgtgggctcaattatcgtaaatgatgccaattgtttagcattagtccatagaggaaaaatatttgaatggaatcttatcaaatttgcatgagttgaattctttatgattctcacaattgatttagggtatatttggtttaaaggaatgaaataaatgtaaaagtgaaaaaagattaaattattgaaatgaaaaagttgaattgaagttgaatgtaaaggtgtgggatccacgttaattttaaatacacctaaaatgaaataaaccaaacaacaacttagtgtttgcaagaggaaaataagtgtgtaa

SEQ ID NO: 2844 - DNA, 1424 bp, Glycine max
  Soy_ogl_2660 Gm08:13401877..13403300 Cluster 11
atatagaaatcaataaaaactcgtggccagctttacttatatcgatggatctcttaagtcttaacctttggcatggacaactaaaagactttaatataacatctgttaaacgtttccatatgtccattttattaatcaatttgagtctaataacattgtaatttgtaagaaacctgtatttggtttgaaggaaataaaatgaaaagagggaaaaaactaatcgaagaaaaaataaaaaagaccacgaaaaaatcaacatttgcattccttttttaaaaaaatttctttaactgaacaaaaataaattcgtgttcatgttttttccctcttaccaagcatactaaaagtttgtgacaagatattttatgtcaatttgaaagataagaaataacatattaaaattgttatgtaatctggcattataaatgatataatcagtttatagtaaaaaaaagtaaatgtaggttatgaatagacagagaaagaaaaagaaaagaagagaggaataaatgcgtttaacgtgagtgaaaggcagcagcgtgtatgcagaaaaggatgagagagcaattagcgacgtgaaggactgtaggtgtcccattccgtatccgtagtttgtttcagtacagtacagttccgtcactcctttttctttccacataagagtcgtatcgtatccatcaatcctatcccatttgtattaaatggaggtacttaattttaaatatattaaaagataatttgaaaattttgtattttgatttattttttttaatttattaattcattgattcaataacaaacttaagggtttattggtttacctaaaatctattaaatttactcctaatctactaaataaaaatttacatacgaactaacttatagaaatcaagtcaacttataagaatttgatatataaccatgctcttaataataattttaatataataatggttaaaaactgttataaaataatacttgctaatctaatagtgtttttgcaggcgtgattaacataatgataatttttatttgtcattataggctaaattatacatttgatattttatgttatttttaaattcagtttggcgtctttttttttaaatatcttttaaaattggttaattcaatttttttttcatttgtttaggatcaactctcttaataattttaatataatgaaagttaaaaattggtataaaataatatttattggcttaaccatatttttttcatgtgtaattaatatagcaacaatttttaattgttactataatatttaaaagatataaaaattataaatcctttgcaaagaactactccattttttgtgtatgatttcttgtttttttttttcataaatcttaaaattgatattgggttattttaaaacatacatttagacatgacaaaggaacata

SEQ ID NO: 2845 - DNA, 1283 bp, Glycine max
  Soy_ogl_2837 Gm08:40983418..40984700 Cluster 11
atttatgaaactagtgtatatatatatattttataacccataattataggcatttaagcatattcatgaaatcccatggatggatctcgacaactttattatggacttcaaatagagagttcttcataattatacattaacatcaaattttatatataaaaaaaagtagattatactttctttttctgagttatataaatcttacacggtcttctctattatattaaaactagtgcatgtattcatgagacaaattatgaattagaaattaatatttatattgttttagagatatttaaatttaattgttgaaaataacaccatgttatataaaaacccagatataaaaaatcttatgttatttactataaataagctattctcaagaatgagctagtatggcgtaaccatgggctaaaaaagatattaaggtgtgaaaaaggatcgatgtcggatttatatcgaaatccaactcccaggaaattggaaacccaatgacaagagcaacttcatatagagtccaaaataaagaagtctcttaaaatatcatttgacaagcatgaaatgtcctcccaataataattagactttattaggaaaattaagaatatattatattttttcctttttaaataaagataccatacatttacacatattcatagaattaattaggaagacattaattagtgatattaaaaatatatagataaatcatatgtcacaattcaatttaattcaattcttatgattagtcctagatttagcatatgtttaaaaagttcactcactctttactcaacgatatggatgatatgtttctctgtttttttttaatcacaaattcataatttatcaaaacatttctatagtaaatgttcctatttgtgacaaatgtgaaatatcttaaatacattaaaatagatatttgaatatagtgtgtatgtaaacttaaaacttttttaacaaagatcattgttttcttaaagaagatttaacaaaggactttgaaaacaagatcaaatagagatcctccaacactggaaatcaaaagtttcacggaaactaaattttaataagtatcatccaactacttaaaaatagtttcccaaacatagttttttgacaaacttatgtgtccaagacgtgtaaaaataaacaaaagagaaaacaagtataagttgaagtagaaatcataataagctttggtaagcaaatagtaactctctaagttcaaaagcttccagtaaatttagcacttttaacactgtaatttttagaat

SEQ ID NO: 2846 - DNA, 1475 bp, Glycine max
  Soy_ogl_538 Gm02:14121892..14123366 Cluster 11
gttaagatgattgaaatcattcaataaaaaaagatgattaaaatcacataatttaataattaatttactaaatttgtattttgtaaaaaaaatattaaaaaattaggtgagcaaaattttctctaaacaactttatttcccataaaaatacttgtggttaaatttatttttttttttataaaaaatccttctccacaccttcacgcgaaggttaacagtttctttattttattttactaaaaaaacgctaatcatcaattccaggtgactgactaatcgtgtttgatttagactttcattaatttatccctttggatagatgtttaatttattaaagtaaaatttggaattagtattatactagctactatacaaggttcgaattgaacattgaacggatccagatttatcattaatcatttaattacattcgtaaactgttgtatttaacagaagaaatatctttctagacttaaacttctagatccattttacgtcatttaacgtattgcttatttgctgattaaacaaaaaagtcttacttatttgggcactggaggtccctgtttaaagtttcattggaattcttttaatttttcacacacatttgatttcatttttaactactgttttaaacatgaaaatattttgtttgtaaagaacatgaaaatattttcaaaacacgattttagtaaaagaaaatttcatgtaactgttgagtcgggtaaaaatggcattaatttttactgtgaaattttaaaataaattaaaaaaatcacttaaaatttaattttaaacaaaattaattttgcaacattaagacaaaccaaaaatcaaatttataaatatttctctaaacatacaccgaccaaattttacattaaccgtgattccgtgaatatatattgatcagttcattttttttttaaagtaatatattgattggttcatatgttcataagatcgtgatgatcaaatactattagtctattaaataaaattacacgttattaatttaaaatttacacatatttagaagcgtcaaagagatgcgaaaagtcatgtgagcatataataatgttgattaaaaaaatgggtatctgaataagaatcattaggtgggagtgtagtcacgcagaatcgttcatttgaaaattagaatgaaagtaacacataagatatatagaacgtgatatttcttcacaaggacacttaacgtatttcataattgcttattttataacgctatgatgtgaaagggactaagattgaggttgaattcttctcacatgtaaaatcacgaccacaatataatctaacataccgcgtcacgtcgtccagaaagagaatttggggaaatatatgaatatcataaatagataattagggaaaatgtatgaatgtcataaactagtctccaagcccggctgtgtccggctactttttcattttataaattaaacctaaataaatca

SEQ ID NO: 2847 - DNA, 1300 bp, Glycine max
  Soy_ogl_1940 Gm06:14180601..14181900 Cluster 11
ttacataagataaaaaaataaattgatataaaatttatcattaaatttaagatcctttttttttcttttgattttttaaactgaaatactacactaaacaaactcatgcttatcgagcgatgagtgatattactaaaatgataaaaaaaaaattataataattcatacatattatttaatcaatttaatataaacttcattgatatttacttattcaagtaaaaagaagcttaattatcttaaaatgaggtctatttcaattttataaaaagaataaactttaagaagatttttgggaggagagaataaacgtcaagatagcttacttttaaattaattcatcaacccaatttgaaaccggatgtcaacggaatttttcttaagaaaatatcacgcctttcgttgacggaaatcaacggccaaatcttgcaggcgagggtttgtttttcagaattccaatcaaataaatgtaaactgaaagtaacgcttacggtgtagaattgttatacaacgtgaaacaaggtgtttgttcattgttacgatcactttcacatatatttttagtatatttatagggtctttacttggcacctctctagacttgaccaggaataggcaatcaaatttgttcacttggcaaacttaattgttatggcgtgcaaaccaagctaaccacaaaccacaaactggtttctatatctgtggcatatccattgatttagcctgagacattcaaaacaaattaaaatatagaatctggtatcagatttttgttatttttttttttccggtgatagcaaaataatcacccaacacatgaattattccaatttaactaaagatctttgattccaattctaattaaatatgcaattgcatgtattaaatacttaaaataaaaactttttattttctacaacctatttcattcgaatataattatttctaataaaaaaatacatatgatctacactaaaaaaaattgacggtaaaacacctttgtaggctgcctcaagatgagaaacatgagttgtcacttacacattaaatgtgttgctatttaggtatgggagcatacttggttcccattctcatgctcttttatagaggatccgctacaaagtgtggtatactatagtactatagtattgatggaatctagaaattgaaaatgcccatgcgtgaattgtttccaccaacaacaagcaaaataataataataaaaacctagctagcaaattaaacttccttgttgccttgtttgtttcacgaccaagaacaaccaaaaaagttgactcgc

SEQ ID NO: 2848 - DNA, 1400 bp, Glycine max
  Soy_ogl_1968 Gm06:15656301..15657700 Cluster 11
ttttttttacttttttatttaattttattgaagttatgttttaattcatgactttagctgagtcctaacctaaaacatacattatgttctttttatgtttataattttaaaaaacactcaagtgatgtttataaaaaaaattaaagttatatcaaaacaccacttcatagaaaataagttgaagtcgactttggaattacgatttcatttaaaaaattaaaaaaatgaagtctgatttgaaatcattgcttcatccaaacaaaaattaaaaaataaaaattgagaaattcatgtttaaaaaaatgaattttataacttaaattaaaaagaaagaagttgtgttataacataacttttatattcaaaaccttgttgtaaaatacgattgtccatattcataatttaaaaaaaaatcctatttagatgattaatttttttcaaaaaatactcctcaaatgtaaaaaaataaaaaattatatgtgtatataactatagaacaagggaaaaaaaaggttaccgaaatttcgatgattcaactccgcacagatgagtagatttattcaaagcacgtctccaaatccgaaccttatcatgatcaacaaatgcaatttcataactctccaattgacgtcgtacatgtgtgggatttacatgatagtaaacagggattacaatctgtccatatttctctctgcattcaagtattgttacaagttcatctaaacaccagctagacgaagcatagtcctgtgagaatattatcaatgaaatgaatgatccttcaattgctcgaacaagcgatggccatatttcattccctctctcaagtttatcatctacaaatgcatttattttgttcctttcaaaactttctatcatatgactaagaatgccacggcgaatgtctgcacccctaaaacaaatgaaaacatcatattttctttgagaattattgtctgacatgggtttttcatctacacccttcagttttaaaattaaccaagaaagaaagaaaaacaacacacgaacaaatgaacaagaggcaaagaaatacaacatattcaagagacaaaataactggagacaaaactggtgtcgcaaccacagattaaaacctttaaaattaagcccttcgtacttcttttttctttggccaaaaatgaataattgttggagatcacagtaaactggccttaaatactattacatacccgcctgatgctttagtgttagggttaaaattcaactgttgttcatgcatgcatgtttgccggccttagtagtttaagaaggaatttcattgaaagaaccgcaaatttaaataagcatggtgagaacagttgttttttaccttaaaagggcgagagagtctagattctagagtgaaaaccctaggtgta

SEQ ID NO: 2849 - DNA, 1439 bp, Glycine max
  Soy_ogl_2798 Gm08:34772626..34774064 Cluster 11
gtaatttgatcttatatataagaatgaagaggataatatgttatttttttggtgttgagtattaagtgattcagtgtatattgtccgcaaggttttaaattaggcttacgccttcttcgttacaatcaattatgcagaaatgtgactgtgtgggctcaattatatatagttcgtttctttttaattataatatttttttttattaatctatgtcggttataaaaaatagttaattatattgaatctatcaattatttgtactattattttaaaattattattttctatctctatatatttaattattttttattaatatttaaagagagaataattaaataaaaatatgtaaaaataataattaatacatctacaaatttttttaaaaaaaatcttataagaagacaaataaatttctaaaaaaagagaagtgaatagttaagaattagaacattggattgaagaccttgcaaatcgcaagaaaaccaccataacatagattatgaaaaatttgtttaaacttttaaaaaaagttattcgcaaaataaaataacttttataaaaagtgattttataagaagtagataagaattgtttcttagaaaaacttaaaaaaattagacaaacacaagtaaaaagtaaaaggaatcttattttattaaattctttttaagcttaaataaattgaccctatattatgataggactcttttaatcatattataagaattaaaaatattaataatttagttagtaattttaaatttgttaatactttttcttttgtcaaatctactgttaaatttgtttaaaatattaataattcttttgaggatttggttttcttaaataatttctatctaactaattaatgcatttgcacttagtggaattttgtatattctttaaaaaaaaaaaaaaagaggaattttgtataaggaaatgtgtatttgattaagtgttaaactcatggaaaaacatggaaaaaaaagagggctgcatccaaacgggcccttattctaagacataaaaactaaaacaatacgagaaagaagtttttttcaacgcgtttagtgaaactgatattcaaaacacacctaaaacaattaatgtatgatctatgatgtagacaatttaaaagaagttctgtaaaaaaaaaaaaatagtcatgtttattttgtagtaaactaaattgatgattctggtctctgtttcacgcgcgagaacagaatcctggtaagtaaatcatattgataacttctataaacataacaaacatttcctttgtccttttacaatttttattttcatacacctatttcaagttctctagaatctagaaagcatgcaactaaatatttttgaagttcgtacctattatcctttcatagctttgaagattttatattccctttaaacacaattttgtcactaagcaa

SEQ ID NO: 2850 - DNA, 1133 bp, Glycine max
  Soy_ogl_590 Gm02:403301..40375933 Cluster 11
cctagatacccaaatccataagcctttcagatatatcagctattgggcttttctcgctgcaaatcgtccataacttcagatatttattatctctattttgcattagcggaaacacgcgacaatgtctgtgtgtctatattatgttattataattttattatgctaaatttgatatatacattaacgtatatattagctttagcttgataatttctaattttttggttggctatagtttctaatatgtatagcatacgttgaaattttatataatacaaaagttaaaaaaatgaaaaagagagaaaaaaaaccttgggagtttaattaaaaaattggtatggttttacaattttaaaaataaaaagttttaattaataaattgataggtttttaaaattaataaaatggacaattttatttaacaaatcggtaaattgctaaagtttttttaaagaaaaaatcaagagtaactttagttaacaaattgacagttttttaaaattcaaaaactggttagttttagttaacaatttgttatgtttttaaattaataaaaataagcaaatttagttaacaaatttggtaaatttttaaaattcaaattaatggacagttttaattaagaaattagttaataaattttaaaattcaaaaattcataagtttttattttttaaagtttaaacaaaaaccagttctaactaacaaaatgttccttctaaaaaaatttaaaaattgttaatttttaaaattgagactgcaatctcactgttcaatcattatatgtttattatttattttgttctcaatatcgagtccaacacccatcatgggattttttctgctgtatatttatgttcgagaaaataaagacatcagtaaactcaagtaaaataaaatcttatacttttgaatcgcggggacataagtgaaaagataaacgataagaaagtatagtagaaagggagaggatgtgtgagtttttccttgaattttatgttaaaggctattaaaaaaattaactacctaattgcattcaaaatccaattaacttaattattatatgaaaaaacacaaaaaaccaatatttaaaaatatgataaactatctttttattccttaaacttttaaac

SEQ ID NO: 2851 - DNA, 1000 bp, Glycine max
  Soy_ogl_2036 Gm06:38795801..38796800 Cluster 11
accgcttgttatatacttttctatgtttatcttcttctttttgacaaattttctatctttatccaactatttattttgtatgaatatttttagaatgagttagtgagtgaaattagtcattgtgtaaaatatttacattatcaatttccatttaaaaaaacgaaaaacaaatgtagaaagtctctatatatagtatttgtatatgtattgaaacacaaatgtttaattttttttctcgaagataaactattttacgtagtaaagaataaaaaaaataaaaaatgtaataataaaattaggttttgtaatttgtttccttttttaaactatttttatttgatttaattatggcaataaaagtaacgaggcaaaacattattgattacttgttacactgaccgtgcctaagcttttttttttttttgagaaagagttatatattgattattcaatcataatccaatatatataaaatgtttgttgacttttaaattaaaattattcaaataatgatttatgattaaatgataatataaaattattttatatcatccttacataagtattaaagtcttcttttttcttaattgacgtcaattacacttaatgcaattgatttgaatggataaaattagatttttttggaaaaaatagatttcaaaacttgttgtaaaacttcacaatattttttttaaagaccaaacttcccaataatataaactcttgctggtcatatgaaagataaaatgcatattttcttttgtgatatacatattcacattaaatatatctattttatagttaaatgcatattttaattttgagtctaaaatgatacatgacaataatataaaggcacttgctatttacaacctatatttttgctaactacactcccatatccctttctaaatctttattgttcattatatcttttttccttaaaagtataccgcttggaattcttttttcttttcataaatttctttctagaataaca

SEQ ID NO: 2852 - DNA, 1400 bp, Glycine max
  Soy_ogl_6692 Gm20:2317701..2319100 Cluster 11
catcggttattgtctgtttgtaattaggttatttaaacattatcatgagacactttgataaaagaaataagaattgacttttctttcgcggttataaatatccaacaaacaaccaaactaatttcaattttttttttctggtggaggacaagacaccatcaaaaaataacaagatatattttacaaagcctttttactcaatgaaaagttacagttttttttttaaagctaacgaaaagttgcactgcattttatataataaggggcaaaaaactgtgaatttattttctagtacgaatttggtattatttcttaattaaaatagagatttgttttgttgtagtacgtgtcaatatttaatacgaaaatgattgaaattaaaaaaatacttaattttaatttaagaaactatacaaggatttaaggaatatgatttaatattctatataaaaccattgcgtgtcactgatgatatcatgcaaagaatttcctacttatgttacaaatatttatatttcaagctcggtattttcatcctaaaaaacgttttattaaacaatgaggaatcatttttttcatgagaatgaggattcatatttatatactatatatagaatattagaacatacttcctacattcttaattaaaaaatcatactttttgcaattttcatttatattatttatcattccataataataaaaatacatttattactatttttacaattttttccatctccttttacatcaattcttcttacctattatgttaataggtattaaaaaaatatattacaccaatgcttagtacgtacttattgtcttgagtattacaattttacagtttttttaattttaaattactaatgcttgcaactagataagttaatttcttttctttatagagttgaattattaacaattatgttattttaacaaagaggataagttagtcttataatcactttttcctcttagttatataagataattattatttttactattcttgtaaattattctaagtctgtttcaaacaaaaattcttaagtgacacttcagaataataggagtaaaaacagttaaaattaaaaagcattagcaaaatgatgaagcttctggattatatatatatatattcagtatgttttatttctgttgattaaaaaatgttttattactgtcactttcaacatcagataatgtaatcaagaacgaatacattatgtgcattgtccaattaatgacaatcgcaatcttattaaataaatagtcgcattctgctcagtataacttagacaagtgaaagatcacctataaatattaaagaggcgtgaccctttgcactttaacatatgtaaaaagaaaatgtctcgcatgtgatgatttcagtatgt

SEQ ID NO: 2853 - DNA, 1153 bp, Glycine max
  Soy_ogl_822 Gm03:3317001..3318153 Cluster 11
aatattcctatattattattttaaaaaatacattctgaaataatgtttaaatttttaattctaaaaagtttttatgaaacacaaaaatttaagcatcattttgaaaaatattttttttttacaatacacaaaataaattctaaaagatgcattctgaaatgatattgaaatttttatattatgaagtcaaattttttttaatacttttttaaatccaataaaaaaatgttttacatttattccaaaatctaaaaggacaaccatctcaataaagagtgacatacaaagaaagtatctattgtctatacctcacctctatccaaattacattgcaaattatgcatcggaatccaaagtaggtaagaactttttctagtttgtggcaagagaataaatctattatatagctaaaacaaaaaaagtgagaaagaaaggaatatcaaagcaagaagatatcatattggagtaatacatggagtgaacgaggaaaaaaatgattctaatgaaagagaggacaaatgttttgttttcacgaaagagggaggggagaagtatgcaatcgtgtgagagaaaagaaaagatttaaaataaaaggttattaaatcatttgaatttaaaaaaagagtgtacttaacaacaaaaaatagtgaatatagcaagtgccctattatataagacatttcagacctataaatacaaatttaagcctgttttatacatttcctacactcattaactaggacatgaagtgtgtgcaagttctatttctcaacggaggctttcgctgcttgctcgaatcctctctatcatttgaggcacccaccatatttggagacaccaaaatccctctaaagaacatgctttgttcttttctttccttctgtcttgagtagtttttttctcatctgatgccatgcatgccatgaaagatagaaccaatctttgagcctagtgtgaaagttaattatataacttataacatttgtaattgtagtagttcaattccttgttttggtgctaccactttagtcacttattggatgtttgatggtcaatagagatacacacttgtgaagagaattgggtgtttagctaatgcgcaggggctaaggtttttacaatagtgctattcttatttgaaattctcacaatc

SEQ ID NO: 2854 - DNA, 1300 bp, Glycine max
  Soy_ogl_2006 Gm06:18303201..18304500 Cluster 11
ataattgacaatcatcgatcatctttattaaacatgtatttttttaaaacttaagtaaaattttaaactataaattaaaatatttaaattctcataaatatataaaatttaaataaataaaaatatataagtacttttaagttgcaaggaaaaggtaatttatttaaaaataaaatattttaaatatatataactaagatttgaaatgaaaagcttaagataaaaaaattaaaataaaatattttgagaaatatgatattggaaaaaaaagaattttgacaaaaaaaaaatcaaaagtaattaagaattttaaaatattaacaggcacataatatataagtttaaataataatgaagtgaatcaatgtgtcttaaaaaaaggaatttgatgagagatgttttcgtgcttaaaaataaaaaagttattttattatatagaagtggattatatactccaaaattttctcaatacaaaaagtattagaacttcaatgttaatgaccatagtgtatcactacttgcttattattttattcttttagaagaatgttattaatatattatttagtatattttaaaattttattatttgacaaaattcgagaaactaaaaacaggctacttggtctaatatggaatcgtcatatgtcgattttgaactatagtgagttggctagaaacactcaaaatgaagtccattctcaacaaacaaaaaatctgattttccggactaaacctgaatcaggatatatatgatccaattaagctataaatgtttgcgtttaattttgtctcaaaattaatgtctaaacactacatttaatcttctaaaaaaataaacactacatctaatgtgtaacttgatccattttatcaatgagacctaaataatattcatctaatactaaatgttaaaatagctttttaccatgtcctaaaaaatacttcggtcttgcattataaaatttgacgtgttacttccttatccttccatcatattatatttttattcatttttcaacgatgatatacatttaaaagtgataaatttcattttatacctcaaaatttcacttaaaagtactatgtcccatatgttataaaacaaaaaaatggatatccaaaaactttttaggaggaataaaattgaaagacttgtatgtacatgtactgctgcaaagaaatatatttaaaatcatcaagggcaattataagaggaatgaagataattaatgatcataattgaaccgtaattacactaatataatagacatatttgctttgttttcattaggaagtg

SEQ ID NO: 2855 - DNA, 1400 bp, Glycine max
  Soy_ogl_3879 Gm11:18515301..18516700 Cluster 11
tcttttctatttaatccatgacgttggagtatttgggtagtataaaattagagaatttttttttacgaaagcacatgttattatataaaaaacgtgttaaatactttagaataaaatttgtagttgtattaagtattcataatatatgttacaaaatgtacctgtgaatgtagctagcaatttttttatatgtaataattgaacttaaggatgaagaatttataataattcactcatataactcgatcaattaaattaaactcatttaatatagttaacaattgatttgtttctttgtttttaatacatatatattttttgaattatgcaaatactatcttagttacatatatgaaaaaaataaaaaaatatcatcattttataatttcgaaaacaaaaatatttataatcatgaaaaaatagtaaccgaaaagtaaaataaaaaatatattttgcatttcatttataataagaaggataaaatataatcattgaataaactaatgaaaacttttgcatttcatttataataagaaggataaaatatatttttgattcttaaaatatttcataatttgattttagttattataaaattttatttagtccctacattttaataaaaacacgtttatagtctttaatgaaggactcaaattacattacttttgctaaatgtaggaactaaaatatattaaacttttatatgaactaaaacctaattttagggtattttgagggatcccaagcataatttattctaataagtaatattattttattcaaatgatttttcttgaaaaaagtattaatggtttttaatcaattagaagatttttttacaacgacaacatattaaaaacatttttttacttgtgtttttttttttaaatatttgttattattttttatgatcatattagattatttcattactatatagtatttgaaacagacaagtattatatttattaacttttaagaataaaaaatttaatacattttaaatttaactttaatcatatttgtttatttattttataagataaaatattaaatgtttttgttagattaaatggattttttgttaatttattctactaacttgttcaacctgatgacacttgtcaaattaggaaaatatatcacattagattaacgttttgcatacattaaccaaaattgatattgttattgtcaaaattttatcaactgaccgatttaatcaagtagagatattttaagaaaaaacatttttttgtgtaactaagatatatatggaatttttatttgacaaactaagaaaacatttttaacttaagaaacctaactgaaacaaaggtctaaaattttattttagctataaagatgttaaattaaaaataaataatctttttttc

SEQ ID NO: 2856 - DNA, 1117 bp, Glycine max
  Soy_ogl_2340 Gm07:14961801..14962917 Cluster 11
gaaaaaataagtgagtacattaataagttagttgaatacattaacaagttacataaactatatattttaagatacattttaaaaaaactaatgagatatcagatctcctcatttattgaacaagaattaagttatcctcataaaccagattttctgttgtgtgtatgttgtacaacagaaatatgtttctgtgtcagggatatttttaggggataaaacaacaaataaaacttgaggtgggaaaagcgaaaatttgcggtggaatagcagagcccaaacaagacattagctaatagaaggcgggctgttacttcctgcactttcaagttgctttttccactttttccataatgtttttatctttggattggtcattttgaaactcaaaaacaaataaaaaaaattctaaaatataattttacatttcagattgatcatagaaggcggcacatactttttgtttttgtacctacttatcaccttaaaaaaaaaaacacttcttatatcatttttttgaccgcgtaacttcttatttcattaatcactttataaatattggatgtatttaattaatacatcaataaaagaccaacatcaaaaaataattttcctaatgttatagttcacagaataaatttagaaaaaaatgatattgcagtgcaaaaggttttatataattatataatcactatatatcatatacgataacgttattgacttttaaaataattattttaaaataatttaaataacaatttaaattaaattacaatgtaaaattattacttttcatgtattttattagtgtcggattactattgctactagatttacaaaatgaaaacgcattgacattatatgcaaggacaagtagcaatgcattacttacgtggaatcgtactgaacattatcatcatatctgtcatctatagttcatgtatgcaaggacaaaaagatattttatgttttattatattttaatcaagtaaattttctaaaagaaaagttaaacaaatttaattaaaatctgtttgtttcaattttctaagttagtttttaaagagaaaaatgtttataaactgacagaatacaagttttaaagattttagtaagtttg

SEQ ID NO: 2857 - DNA, 1100 bp, Glycine max
  Soy_ogl_2993 Gm09:4525601..4526700 Cluster 11
tcaaaactaaagtacttgtaaacgaataagaaagtgtagtctcttcttatttccaactctcccatcctcatgcattacgaactaacaatttctacagatttatcactgacttcaagcaccttccaaaccacaacaacaatcaccacacatgataatgatcatagcaagaaaaacaaaagatggcaaaacggtagaaatccaaagaaaaccttcaccatgtcaatgcacaagctcgttctgaagcgctgggtatctttcaagaacttggtcctcattggagggtggagccgggactttgtgaggagaagggggttgaaggaaggagatgaaattggacttctttgggattcttatgctcactgctttcacttctctgtgctcaaaccaattcatcactagtataatcacctctcttgctcatggaatagatgtaaacttaccggaatatgtttggataagtttattcacaagaatttctagtagaagaaaataaaaaaaataaaataataaagttttttcgtaagttaaattaacttgtccataagttaaaaaattatcttttaaaaaaattatatgaaaaaatttatacaaattaagtaatgtataagctgatttgaacttataatgaaaaaattcattttttttaatcttagaagtatttttggttaagcttacccaaataggtatgtagtggttattgtcaaatatattcttaacccaatttaaataaacttatttgtattgaaaaagaaataaaaagataaaatgattaagttgttatcataaactaagtttacacaacttttgaagaagctatttcatttaatttcagataaattataagctgattttagtttatgggtgaaactaaatttttattgttacctttttttttttactttcttttactattagtgtttaagatgaaatttattcaaatagaaccttatattaattttatcttgatttttattattggtcttaataaaatcagtacgtttaaattcatactatttattatgaaaaatatagtaatgaagttagaaattaaataaattagagttgatgcgctctcaatttaattttaattatggcgatat

SEQ ID NO: 2858 - DNA, 1160 bp, Glycine max
  Soy_ogl_6662 Gm20:999701..1000860 Cluster 11
tttttacaataattaattaatgaatataatatatattaaatgtatcatattgcattaattatatagataactttaattaaatgtattacatttaaataattaatgtagatataattaattgcatgtataacatgaaatttttttagtcattataatattatttgaaatattcattacttgttccaaaaattaatttttattaaaaacataattaattatttttagtaaaatctctctttaatagcatttttttatacaaaagatttgtaccaaaaacttttctttaaggatccgatctcgatgtccccctgccctcactcatcctattgtacaattcccaaagccagtaagtcatttgacttatttacatctatttaatatatattaaatgtatattacattaattaatttatgtagcattaatttatatgtgtgtacattaaatgtatattataaatattaaatgtatataacaatgatttaaatatataccactgtaaattgatattgcattaattatatagatagatgtaattaaatgtattatatttaattaattaatgtatatagtattaatttaattatgcatgtatgagtaaaaaaatcataaaattttaataaatatttttagatattaaattttatatgtgtgcttataaatagataaagatagaggtatcactaacacgcctttgcttaccctaagttgcccaaaatctttgcttgaccaagattcccttccaatttgcttacccttaatctcacccaattaccttcccatcaaagtttctcctctatctcttatcaaagcttccgctcttagagggagatcactcatctcgttttggacacaaaccatgaggtggttcattcacttcacattcgagaaccacacccttataatccctctctcttaaagtgtgtctaattgaatccttgttttcttcacctagctagttctctccacaaaaacataaaaagaggctttttcttagtggaagtcctcaaacaccatatagtagagcaatgaagggcagactgaaaggactcaatttattacccaaactcgatcgtcttcacaaacacaagtagtaagtggtttttgggatttcttcagtgtctatgcatgtcattttcatttccaattaatgctaaattct

SEQ ID NO: 2859 - DNA, 1071 bp, Glycine max
  Soy_ogl_2025 Gm06:20865101..20866171 Cluster 11
ggtttcgttattatttgtagacaatatatgagtcaggattaggttattcttcatatttattctttacttttcaatctagttattaaagatggattacttgttagaacattagattaaaataataataaataagagttgagagtaagttttttaaagttttttctctcttttccctctattagagagagattaatgctaactaacaatataccttgtaatacattttttttaatgttctaacacattatttctaatgcactatattgttagttaattttctcttaaaactataaaaataacactcatcaaaatttatgatttacaataaataattaaatgtttctataacatctctcacacacacaaaagttacttgataaagttttttgtccttacttttaattttatttttttactcttttaacaaggactaaatgtaagaattcacgaaaaaagtttaacaacattaataagtcaaaaacaaaaaataataataaatttagaaactagaaaataataaagtcttaataaaatatacataacttaaacatgtgaaataacttggtttcacaaatcaaagtgaaatagaacaaatcatttctatgaattatttttattgaaaaaaaatatcaataagttttatttcactctttcttctttcttgcaagttccaatcgcatgcatatatggtgatcggtattatcctcgcctttgagttgttacattaatgtgcattgtttcgtgcctactataactcaaaaaccaccccctacacatcacgcaatattttctataattaatattaagagagcccaattgacttgtcgatacacaaattattcttttatcaatatattgactacttttcaaatctatcaaaggaattgtttatggctttccaattctataatgaaaggcttggcacttgtcacttgtcacataactcaaaggtcacctgcagtttaaaaagagaaatgcagttacctgcaattagatccaacaaatacaaataacattgtatttttttctttatcgacaaatattaatttattagttagaatgctagttttg

SEQ ID NO: 2860 - DNA, 1039 bp, Glycine max
  Soy_ogl_2797 Gm08:34461462..34462500 Cluster 11
tttatggttgtattttaattatcctattaaaatacttatgtttaaaaaacattttattataataatttatgtatagttaataattgtcttacaaaaatatgtattacgacaccataagataaataacacaagattttgttattataaaaaaacattgtatcataaaaaacattgtattatttcattattcacatttctcccgtagacactaccaacttatgcactttaaagcaacctcttctctttgcctacttttgtgttggcaactccattcttaattgttttctgatttaattaatttcaaccttggaatgtttcttttgtttacctctttgttatgtgaactgtttctcaattctcatatctgggccatttttattgtgagtgcaataattatttttctttttaatgggtattggatgctgcttcttgttatattttttgtttctttcatttgggtgtatatattaataatattatatattatatatttcaacttttttggttaatggggctaagaaggttttgcaacctgacgtcgatccctccttatcatttgtgctggtttcctccttttcttacgaagtacggacagttttttgttgtttaaaatgtcatcatgtcagatatatttttcccggacatttgtttattcaacacttatttggtatttttttaaaatttactttttcttgacttgaacgttaaacatttaagttgtcaactttacacacttaatacacttataaaaatatagaatgctgatttaaaaaaaataaatgtaccatcaatttagatatttttttcatattttttatttgtgtgtatatacggtatttccatattctataatttagatattaatcgtagtaaagtgtctttgttcagttttagaaaatgtatgcttcatagctcattttccatcatgcgtttgaggtatatgttggaattttcactgtgctggagtgtgctatttgttttgaggggtcaaatctaatcatagctctaaaggagaaaacattggtacaaaatttgatgg

SEQ ID NO: 2861 - DNA, 1100 bp, Glycine max
  Soy_ogl_3064 Gm09:20186501..20187600 Cluster 11
attttttaccttaggccaaaaattctctagacaggaccctccttatcaattggaccaatcattgttggtatatcgaaattcaattttattattttttagtttatggggtgggcaaggtatccaaattcaatctatgcattaagacatattgttaggaaaataactgaacaagaataatatactactcacttactcatcttagaggataaaagaaaaaatggcatatagcacgttttcagattccaaacaccaccttctccgaacctttcacagtttttgtatttttaatttataataaaaaaaatgtacatcatcttcagttaaagcgtgttatttgtgaccctaccaatctacttcaacgcgtcacggaccgcaatctccacaaagccaggcatttattttttatgaccccgttttaatttttatttttttacaatattaccctgcttttggtttttattttaaattaattttcaaatagataagaggctttataatttgaaaaattttaaccagtgctgttaggatattggttaagaaattaaaaaaatatttttattggatacataaaattgtattgcatataacttttttatgctcttatataatatattattcttttagttttcaaaccaatttaatgctagttagcaagaccttataatttatattataatttgtaaaactaaataaaaatatccaacagtgggagacaaagtgacgcatgcgtatttcaatctccttaaacttatcaccgttgagttgaacttaaatcggtgtgggcacggaatttgttgcaaaggagatcgatcgttttagtgaaatttttactcataattacaattttttttaaaaacattatatttttttcatcctagattttactttaggaaattgaggtaagtttcactagtattaataatttcttgatatgtcaatgtcattgaaggctattgtataaaataaaaaaaatctttacactcttcggtagattataaataaattattttttcattgaaatgtatttaggtgtgatttttgttcttgaaaaaaaaatatctttttttactcctcaattataggaacatagaccaccctat

SEQ ID NO: 2862 - DNA, 1243 bp, Glycine max
  Soy_ogl_3843 Gm11:11054701..11055943 Cluster 11
ttctttttctctcctctgttacctgatctctctctgggtctatttctatcgtgatttttatgttgtgttttattttgcttttttttaaaaaaaaaaaaaactattagtatcctagcttcggtaattttgtttgatatctcataaaatcattatgaatgtcaaacttcttcctctaagtattcaatataattgcaaaactgaaattcgaattcagtagttaagctggaataacacgggtaacagttgtgctttgttttgtatgtttagcccctcttattcataaaagaaattaagagaagtcataattaatatataaccttgatcatcatgcaaaatatcaagcctattaatgagagaatgcatgccctgctcgttacatagctcttccgtggatcagctggctaaaccttctgcaacacttagtcgcatttagaaaagaaaaaaaaagcactagaaacactttttttcacaatattaatcggcttcacgtgagactaaggacttcatgtgtaataacctgctgcgcattcgcatttaatattgtgggacaaacttatttttgttttatattttttttctcatatatacacaaaggggcctactgtttggattgtttggatctgtcccttgaatccaaacccaaactattttgatcaggttaaataatttgattaaatccaatctaaccctgcctttaaacacctctttatatttcacaaagtactttgtttgtaattatgtataagttttttttcattcggaattatgcatgcataagtttcgtgaatcatgcatcgtgccaaaaaaaagtttggttgtcaatcatttttttttctacttatttaaaattacaaagagaaagaaacacttatgagataatattaacttataagggcttaataaagttattagtcaaatacgttttaaaaaatttccaagtccaaactttattgaggtaactttatatgttgaaaaaccaacaactaagtcaaacataattaaaaaaaatcaaaatgttttttttaaaagccccgacttctttaatgaatataatcaaagtggaaatgaaaaacttaatgaatactcacttattaaccagagatggacaaatggtaaggtaaaaatcgtattcgggagcaccagcaatatgaattacttaaattcatgcccttaattattatattttctttgatctcagatataaaaagaaaaaatatatttttaattttaaatataaaaaatc

SEQ ID NO: 2863 - DNA, 1288 bp, Glycine max
  Soy_ogl_4248 Gm13:24329713..24331000 Cluster 11
tcagaaaaagataaaacaactataattatacaagtgacgcggaatcttctagcaatagattacctaattttaattaagttcctatatttttataattaataagggtcaaagataatcaagatttatgttttttactatttgatcttgaaatatttaaatggggttatgggaacaagtaaagataaatgtaatcatgaaattaacaacacgcaaatatatatataaggcctattagtaaaaatactttttttttaaaaaataatcaatcatattaagataactatgacttatatttgtattgtaataagcaggtaaaacttttgattatattcaacagttaaattaaataaagaatataagaaacattataatatattcacatttaatgaattttatatatattcaaaacaataataaggaaaacagtgaataaaaaatttatcgtttacttattctatactaacttttgttgttcttgtttttctattccttgacaacatgagaaattataataactgcattatttattttattttctcctcaaaatctaataaaaaataaggatatgtttgattataaattttttgtcccttgaatctattgggatgagtgaatatttgaagaggcaaagaggtgccttgtgttgttacatgtggtggtgccagagtggtggtagcactaagtgtatgtgttgagatgaatttgaatttctttttttgttgttgttaattttgattctcaaattctgctctttttaatgattttgtaatggttatgatcatttataagatgataattttgttttaatgaggttatgttgcttgttattttatgttcttcccaggagagaaaccactaaggattgtttgctccacacctcttctaagctttaggggatggatctccgttctttgctccacacctcttcttttcttcccctcctttttctcttccttccctttttatttatactatgagtatatgtggagggttggtgggcttcaacccgtcttcgacctcagcatcttattggtgtcctaatatcttcctaaaaatcttaacaaaagggaaaatagtagtaataacacccgacaacatcttaaaccatgcatttattatagcattatttctattatccaaaatcggggatgttatgattgtaataccaaaaggataaaaatgtagttaaaatacgttagcatacatgctaagaaacatgtcaactgtcacgtcatcgacacgccatcatattgtgttatgccagaaaattttattaaatatttaacga

SEQ ID NO: 2864 - DNA, 1397 bp, Glycine max
  Soy_ogl_4263 Gm13:25611301..25612697 Cluster 11
ccttgcaaccacacttactaagctatatttatttgcagcagtttgaaaataacactgtaattttgtaaatgctctataagcattattaatggtgagcttatattgatgataatatagggttaatgagcctgaataaacttgttaaaaataatagtacctacctagagagacaagtttaaagagtgcttgggatttgtctggaaaaggcatgatgaaatacttggtctgatcctaaagaggcatgttaaaagaatacttggtaattattcttggagaggaaagcggaagaatacgtagtttgttgaacttgaagagacttgttaaaagaatatttataacaatgtgaaatgctactcctgtaaatctatgagttggtggaaaattggtggttgttaaggacaaaatatagtcttaggttgtcaaatagaaaaaaatgaatatatgtattattttaattattctcttactatttattttgtttgacgctaaggaagttgaatatttatttaagtaattaagttattgataaagaatatttattaattttatcataactaatggcagctagggaattgaatatgaaagaaaacatttagatttttaacaaagaaatgtttaaaactaacattttttctcttattgacgatacctttaattcatcctattgagcctaaaactttcaacttagcttcgtatgttcacttttagtgtattttctaaaaaaactgaggaaattttttaagaaaagtagttaatccctttttcttatattttcatgtgtatttacaattgtaatcaagtactatagtacagaggtgataatttctttggattcagggatatttttaatgtaagttattccattcagtctcaaatataattttttgttatatttagatctcaaatataaataaattttaattatttttactttatttaataaattatcttcaaaattcacttaatttaataggaagtttatacttatatcaagttttaatagattgacataatttaataaagttaattatttttagttttttttatatgtttgagactgaaaaatttacaattttatccttaatctaagacgtctctataaaacttatatcttatacttaatctttcacttcttttcaatctaaggatttaatttaatttcaagtactcttttcaagcacaaagaacctcggttcgaaatctaaggattcaattaaagtatcttaatttaattttaatattttgtttcttaatttaaattactgtcatgaaagtaattttttctttaacttcccatctttttttaacatcattttgcttatctttatattataaattatctttgtactttatatataatgattttttcatcatctgtatcaactttttcagtccat

SEQ ID NO: 2865 - DNA, 1200 bp, Glycine max
  Soy_ogl_5411 Gm16:32188201..32189400 Cluster 11
actgataaaaaaaaatggttacctactctatttttcgtttcagctatatttctaaaatttaattttgtcatattcaggttaattaaagaaaaagtatggagaccagtctctagtctaatttgtgacccagtaggccagtactatcatggaagcgggctaaaagaataatagggctattaatttacgttgttatttggttgttctaaatgttagtataatcctatcaatttctacaatacaaactcatggtatacctttaaatttttgtcttcagacttcaatattattacttcggctagttcttataacataccaattggttacttaatcttataaaatattctacgaggtttaattacttattttgttttataattgcaacaaatttttcttttaatccctacagattaaaacaccttagtttaaagaatggcaacaacatataaagatcaaaatagaatgttttgctgtataaaaaactaaaatgataatcattgcaactagaaaaatcaaatgaggattaattaaacctctctacagtacaaagtcagggtatcattagaagtcgttacttaatcttataaatgaaattcttattttctgtgaacgtacctaatttcctatccactctaattacacgataatgttcacgaattgagtttagtaatatatatggaaaagggctttagctctagcattgaaatggtaacgacatctagttcagggaaataatgattattgacatatatagatgcgatgtatagtatgcaactatgccagatttttggagagagtcattcaaagaaagattccatggatctggccaaaacaaattatgcatgtgcttgttttgctcctttagtgggcaccttctgccagaaagaaaagtttaatttacaaccaaccaagagaaaagcactacagacgaaggaaaataagttttgatcgatcagatatttgagttttttgcatggttctagaattgaaccaaaacttttgctttctataacatactgtatgtattttaattgaattttttatatgcaaaaaaaaaagttattaagtgcactagtggtgttttaaccatgtacaagaaatagataattagccacgcaataaagtctgcttaatgcaaagcactggaatcacgtaccaaccagagagaatacaataatttccacctcctttttgagacaaacg

SEQ ID NO: 2866 - DNA, 1398 bp, Glycine max
  Soy_ogl_5698 Gm17:15721403..15722800 Cluster 11
tcatagtaactcaaattatatttagatcatttatatattatgcatgggaaatttaattaattttcatagattccttgctatattgttattattttatgaattacaactttttatcttatacataaaatgtataaattacaaaacaataacaatataataaactattatttttatcaatgcaataatttgcttaacgatttatttttattcgcagtgtcttaatgacttaatctatggagtacattttgtgcataagattgaaaaattcgaatgaattattattgatactatcacttgcgtgatcattactttaaacttttcagacacgtacaaaacgtggaccaataaaaggtagtgtctggtcaaacagattctttttatgccacgtttatttttttctaattaaaagaaaatgttgtcgacgacggaccagattacgtcagttactcagttttttttttcgttaaaattttcttcttccgtgtatattttatttttatcccatattttttttagagattttttaaatttaaacagatttttattaggataatttttttttaattttttagtgaactagtgttttttggtgtactggagtgtttattcatttatttgtggtttatgtttttaaatttgaaaaataaaaaaagatataaatgtgatagttctttttttacaaaatataaatgtgatacttaaatcataaattactcgtgatttaataacgaaataatcggatcggaggttcataaaaaacgtcaacatcagtacagtgtcccaaagcattatattattattgcttaatttattgtatatcggtcacgtaatatatatttggtgtttttttataacataataaattttataatatttatatttttctctcccacgaattgtctaatattttacaaattgtgacccagagaataaatatttacaaagactcaaagagtctattagaatcagaactaataaaagcacaagatgaataaccatcatataggtcaataaagcataaaacaaaaaacttaagatgcttccttaagacattctaatgggttaatgcatcaattagtaaacttcaggccacttcggatggatcccttgtaaaagaaccaggtccaatataagtgttgaatacgagagaacactgaaaaacgtctgctacatctccttgaaaaacaccactttattcctaagcaaccgaatagttaaatttatttatatttaattctaaattactaatcaacttttttagttgaaagttaataagtggggtgtcatttatctttttcctttctctaacagtgcatgttacaacccgataaacaattgcaagtatttcatcgacattgtacacacagaattaatgccaaaaccaatatgcaatgtcaa

SEQ ID NO: 2867 - DNA, 1235 bp, Glycine max
  Soy_ogl_6084 Gm18:136972..138206 Cluster 11
tgtagatcatatactaaccttcgttatcaaataagttactctagttgctaaactcatgacagtaaaaaaattaagaagagataactagtaaatttgtattgattttcaatgcaaaaaagaaaacataaataccagtaaaaaaggtaaaagaaatgaaccaataaaatttgagtcatttttcaatgcaagaaaaagaaaggtaaaagaaagacaatcaataaatttgtaccgattttcataagagaaaataagaaattaaaattaaaaaccataaaaataaagaacataaataccagtaaaatatagatcaaatattaatcttttttatcaaataagttgctctagatattaaaatcatgacagtaaacaaaagaagaagaagagataattagaaaatttgtacctattttcaatgcaaaaaagaaaaacacagtaatgcaaagaaatgaatcatttttcattttaaaattaaagaaaaataaaggttgaagaaagacaatcaataaatttaccgatttataaaaacaatgatatgtgcttagctgataacattccaccaacttctttataaaataatatgttgatttttggtattaatgttgattgcttatttccttgtaaggctaatgctaattttattttgtttattataccattaatgatgaaatcatttatttattaataaataaaaatcatgtgctaactggtatgcagattacctattgcgtggttcactacaccttgcacgtaaataagatcttattggaagggaaaaaaaacaacaaagatgcacatcatattccatgtaaaattaatactaacaccaggattgcaagtttattgcaattattaagcaaacaaaatgcttaatttttggtataaatcaggtaaaaaaagcagcttgatatttttgtccaaaatatttagaacggtaaataatttttaatcctccaaactacaatttataagtcaattgattttggtccctaactgtacaattaatatacctatatttgggtattgatttgaattcaaattatattttggcataaatgtgatttgttacccaattaaacatttacgaatcatgacatgtcattcaaatcttaagagttcgtcatatggactcgttgtttttgaacttataaatttattactagattataaataaatccttcaaaatttgtatttttcactttaatccttccaccctcaaattgaatcaatattcttac

SEQ ID NO: 2868 - DNA, 1000 bp, Glycine max
  Soy_ogl_2356 Gm07:17514101..17515100 Cluster 11
catagatctgtcctagtacatactccaatataacacaaaacactcccattaaacacaaggcaattctatattatacgcccaattcatacatagaaaacattgtatgtattttctctcgtttatccgagttgatagttaaaaagtcaaatagtggccctcaaacatgatcaatagggacctctgactcatcaatcaatacaattatctttttttctttttgacttataaattgcttgatcacaaaataaaatattaaaatcgtgttggaacaaaagttatccatattacagtcgactagccattgattattcacacgacaataattcttttatacttctctgattttggagatgttacaaataagaaaccttatttttatatcctaaaattctattattgttttatgtgtttttttcctatgaagcatatatgcataacatgctccaaaatcacatcaacattttttttacagaaaaaaaattgttattacatattatattcctttttggtcaatcttatatcagttaatgcttaattatattcgtatattttgtatacaacgaccatatttttttcaaacattacttatattctggtattaaaaaaaacattacctatattgttttgcgtacttatataaattcatttattgtcagcataattatataaaactttgtataatttaaattcaacatatgatttaatttaaagagggcgcaaaaaaaaaaaaaaaaagattagactccgttcagtgttttaagtaatccaaaccatttttgtcatgatttcataatcgtgcacttctgatgccataaatccattcttaatttcttgtcataattcttactcatgtacatttcttatagcaagcaacaaccacgtaaattttagtaatattgggcaagaaagcactttgattagtctaaaacccgtgatgggagaacattagtacactgacatgaaaatgcatgaaattattcataagatctaggttcttgca

SEQ ID NO: 2869 - DNA, 1085 bp, Glycine max
  Soy_ogl_3082 Gm09:29726242..29727326 Cluster 11
caaaatctccgtcaaaactagtataaaaggttttgtagttactttgcaaaacattgtgacatacactttaaaatgtagatggagttagtgtggtaagatcttgaaaagtaagaacaagataaaagttatgtgaatctatgattaaagtcctacctacattaagaacgttatgcgtttcatctttttattggaatttattatttttcttgaatttacttttttctattaaaagaataatataagttaaagggtcttcttctatttatactatgttttatcttttagtaaaagtttggtgacaaaatttaacaaatgagtaagttaccatgaaacttgttataagcaataatttattcattatttaatttaataatcattcatgatagtaatattttgtttatgctctaacatcattttgattttatttcaactgacttgctttctttttttgatatgtaggaatgaaatatatatatagtaagagatttataacaactcacccactatatttaatgaattaagtcatactctcttagtaattgatcttgatttcaatgttttgttgatacttaaggttatgtcattaacaaatagctacaattattctctattattctctatgcttaaaactaattctttttttttttcattagaatattttattttaaattaaattaaacttatttccacctttttttttaatgaaaacttagttatttttgaacgggtataattgatgtagtgcatccttgtgagagaatgtagtgacatttgcctttcataagaaaggtcttgttgcgaaaaatgtgtggacatttaaacccaagtacttcacaagttcacagcattaacaagccatttgaaaacttatttaagcgtgttttgtaattgtaaaattgttttttttttatcttaattgttttctaaaacttgcacacaagaacattgttcggtatcccgccaagttcatatcgcattgaattacacattaaatggagaggatctcactttacatgactttataagaccacttcaaactccaacgctaggtctccccataattaaattccccctttatacattac

SEQ ID NO: 2870 - DNA, 1254 bp, Glycine max
  Soy_ogl_4737 Gm14:13032101..13033354 Cluster 11
attacttatcacaaaagatagtaggaagatttgtaggaggacgaaacaggagttatttttttactgtctaaaaaattaaatgtgtttaattcctatatttactttttaattttagtttttttaagtagttcctataatattcaatgttttagccttagtttcgattgttatttagttatcgttaactatttaaagagacaaggattaaaattgaaaaagaggatacattaaagagactaaaaaaatacatttaaaagtaattaatttctttgacggcatttaaagtaattaaagtaaaaattgtataaaataacatctcatcgcatgataaatcgaactagtagaaaaagaaaattaaacaataacagtaactttaacaaaagaaatgttaagagttcttttaaaaattaaaaagactaaaatataaaaaaaaatgtaaatcttttattacataaagtagtgtatactgatcctctaaaaaaaagtagtgtatagtggtgaaaataatttcccctaaaagtttaagggtcatatttgtaattttaaatgcattaaaacagccatgagttttcaaaataaaattaataaatatattttctgctccctacatttaagttatacataatatatttttataaagtgaatcatcaatttagttcctaaaattacaatgattggtcaaattaatctttaaaattatcaaaatgacaacaaattcctaaaattgtatattacaatcaatttagtccctcaaattataatggacaatcaaattcattcttgaaataaacaaaaggaaaaataatctttaaaaatggtaaattattaatcaatttaatccttgaaaagtaatgataatccaaattggtccctaaaattaaaaaaaaggcttaagtgcaatttttattgattatttacaatttttaaaaataatctttcaaaatttggcaaattatgtcttttatagtttttgtctagcacattttgactctcaacttacatgtctttagaaagtagtaaaagtatttgaagacagatttaaacccttgacaacttccttcaccactaccaccaaaattactaaatcatttggattatgtataaacatatattattgcttttgttaattttactttggatctactaagtattttatatttgtataaaaaatattatgagttaagaagataatttttattaaatatttttattttaattatataaaagtagactttatacaaattcatttattcc

SEQ ID NO: 2871 - DNA, 1248 bp, Glycine max
  Soy_ogl_5116 Gm15:43303601..43304848 Cluster 11
atttgtcatgtaaaatgcataaattaaagtattaatatataaataaatatgagaaaaatgatttgtagtcaaaaaatgagaaaatatatatgtacttataatgtcaagtttttttttttttcattttcattcaatcacaaattatattacacgattgttaactttaataacaactacctcaaaattacatacaaattaatttttaattgattgacagtctaaattttttaatgttattaatacatgtccattaaattctataaatattgtcccacaactaaattttttggacatggtactgtattaatattttttttttgttaatcgtgttattggtggtaaatatctattgtctttttagtggattttcttttcaattacattctttttatttacaaaaaattaaacataaggccttacttaaaaaggtagttaaattccacactaaaaccaactacttgttattttcaatcagttgtttggtacagtagagagaaagtaaataataaaagaaaagttagaaattaaaatttaaagaggaattcagatctttcagaacaactcttatggaattagtcctactgatgtaaaaatggaataagtcttacctaatttgggattcgaaataagttttacctaatgaactttaatggaattaatcatacctaatttgggattcaaaagttttacctaattatcatacttatatagtcaaacaaattaatcatatattttttttagaaaaaaaaatgataatgggaagatgcgctgcggcgcagtgtttcattgataatagaaaagtagggggggtttataaagtactaatagggtcttaaaataaattataaataatacggttattaaaattaatcaagcataattttataaaagttagcttcttcaaagttctataaagatttttcggaagcaaattttttttatctttgaacaaattacaaaacttacacatttagatgagctttaaaatgacattaaaaaagaaagaaaaaataaataaacttattcattaatcgttaagtttaccttctttttatgggctcttcaagtttatgtttatctaagttagatgctttagtatttgaaattaataaaacaaaaatattagtttatgactttgcaaaaagtaattcactttttctttattatttgttttttcattcttgttttacattaattgataattaataaaagactaaagtaaacaccgtcttttaaagtaaaaaacta

SEQ ID NO: 2872 - DNA, 1000 bp, Glycine max
  Soy_ogl_5710 Gm17:24041401..24042400 Cluster 11
aggatcaatatgaaacacccataaatgaaataattgtcttcgaacttttgttatatataagatataggcattcattcttttcttgcttaacaagtcaatgtactttgttatgaatctaggtatatttatttgatgaagagttctacgagaagtttgaaatgtcaaaatttgctttctatctactagtacctacataacttttattcaactgctaaagtatgattaagttctttattatttgttataaaagtaatatgttcaattaattacataagtttctttttttgtgagttataaattgagtaatgttggccaaaaaatgaactcaaaatttctacataacatctcttatgtttgtattcatttattaagtttaatattatcttcaatttgagccaaacgtagttcttgttaaatgtacattattcttgaagtgcaaagttattaccaatggggctatgaaaagaaataatggtgggacaatgtttatttaacaaagacaaaattacagtcatacaacagtcgttacaaaatgcaatcaacttaccttatgtttatgcaaaccttgatataagttcttttggcaaattaaaataaatgtgtaaataacataaaatgcaaagaataacatcattttttgtgtattttatagtgattgtgacaatgaaatatgaaagacataatcaataccctttaataaatttttgaagtaatcaatcaatattactatattatcaccaatatgaatatttcaaatgtgaggagttgactaaaatttcctcatttgggaattatttacattttcattcaagttcataatttattataactaagaaaactttttggtagttaattttcaatactctttagtcactatatgagcaatttcatgcatacctatccaagtacatatggtaaagctaagtcaaatctagtaacttttaacttggcctaataattacaacaaaatacatgcgtataattgacttaactaacattt

SEQ ID NO: 2873 - DNA, 1072 bp, Glycine max
  Soy_ogl_6074 Gm18:20571129..20572200 Cluster 11
atagtttttaattttagtttctgtaatttgtttttagaattttgacctctacaacttgttatatgtttctgttttcgatcactttaaacttattgttagcaacacttgctacattgtaaaatatataatatttttttagtttaaatatgtttttaatactgtaaattaatgttttttcattttttatctctttaagttaatttttttaaatttctgtttttttaattttgatttctgtaaaatattttacttatttttagttctggtaagtataagttttttcaattttgattcctataaacatgaacttacgaggactataaataaaaaaaattaaaattttataggaaccaaaatttaaaaaaatgtaaacttatatgaattaaaaatgaatgaaatattttacagaaattatacatgaaaaaatatcaacttataagaactaacattaagaaaatgagtttataatgatgaaaaatatatttaagtttattttttttataactttacaaactatagcaatatgaaattacttttaattaggccttataattataatatttttatttttattcctagttattatccctataaaatacaataatttctatttagtatctattcgtggtgacaatcaaaataagtaatgattaatattacaattaataaagaaaagaaactacattttttacaagatcaaaacaaaacttacatactttaaagaacaaaaatatatttacagcttttaacattatatataactctcaagagtcatgacgttgatcaatcgtaatctttggaccttgtggcttcctattctctttttttcatccattgctattagtgctcttagtcaaaagtttattttttatttcttcccgttttttttttcttttactaattttcttcacaagtcatgtgggtgacctccttatcatgtccctcaagcatgtggtaaattggtattggatttgatatttagtttgtgcatatggaaaaacatatgtaaagagagatcaaacttttacacgaatcttaatatcttagaagattagtcattgattttctaccg

SEQ ID NO: 2874 - DNA, 1211 bp, Glycine max
  Soy_ogl_6801 Gm20:36923690..36924900 Cluster 12
gtaatagtatttatatgatagacacatttattattatttttctctcacgtgtcgcatagcacatcaatttttatgaatattgactcgaaaagcaaaaagaatttgacccctgccatccacggcaaaggtggtgaaagataaagcagagaatgaggaatctccgttggtgtgggccttactctgggccattgggggcccagtggcagaagagctttcaagaaactatataagtaggcgtgaaggctggctagtgactcacacagtcacagtgattgagatggagattaagtttcagatccagagagggcactcgttcaatcttgaaattgatccctccgaaacaatccgcgatgtcaaagagaaggtgcttaactcccagaacattcccattgcccgccaaatcatcctctaccattacgaacttctcccagacgatttgatcgtttcgcaatgcgatctccagcatggcggctgccttgtcctccaaatcagccacgatcctgcagcaccgtcgcccatgtctgactcagactcagactttctcccgcaatcgcagccaacgccggacatgcagatgtccaagctgattccgaatccatacgatccgttaggtaagcggccgatgactctagatatttcatccgcgtcaaataaaaaggttgaggagaaattggaagattcacgctcacggattgtgacgctgagcttgaaggcgcataaatactggactcatcgttttcctatggaagcgaacttggacgagaccgttctgaagctgaagaagtacattcttgcagatctgagaattcttgcaggctttgagatggacaatgtgccagtagagaggatggtgctgcactcgcattcaacgggtgtggaactgcttgaccatcagcttcttcgagattgtgcggtttcagataatcatgagatcgacctctccctcaaggaaccctagatggattcgtttctgcttaataataataaataaataaaaactagcttttgattcatgttcgttggtttagtttttgtataactactagttgcatagctagtttctgttcataactgtaattacaaactagctgttaggtttagttcgttttatactaccagggctgaactgccttcaaatatgactgtgtaaatggaagcagggttactttcattggattcatgtacaaaagaaaaatgtataatcatccatc

SEQ ID NO: 2875 - DNA, 1372 bp, Glycine max
  Soy_ogl_3173 Gm09:38660701..38662072 Cluster 12
gtaagcagtctgccatgcacaatcttccaaaggaaaactcaaatcttccaagggtcattccacttgcaaactaaggggaaaatactatcaacttgagacggatcatcatctagcataaaaaggtaataataaactgtttctagtggtcaaaataccatttgctgaatggcatcaaataggaacatcctctcctgatggggatggaggtttgacagctgaaatcaaatcacaaatatctgggggaagcaaagtagagatcgtgtcccatctccatccagattcacatgcataagcagaaatagggaggttaataacaacatcaacccctccaaatacgggacgcatcaacaacatgtttaacaatcgggataactcccatcccacaaccatacttagctctaataactttagcccaaatcttatcaggttcatgaataagagaccacccaaggttatgcggctagctagagacaaattcctggccttctagctagataatttctttttaatcttttccaagataccatcatactgatgacaaggttttcttccatgcaaaatagagaacccaagataagatgtaagattatctgtaattggaatgttgagcttaacacttaaattgacaacatttggtctaacattcttccaaaagaacatagaagatttcgccatcctaatagcttgatcagaagccccacaaaagagattaataatcctattcatttcattaacttgtctctcagaagcttctcccactaagttgttatcatcagcgaaaaagatatgagagataggagtttgagtccccctcccaaagttaaaaggaacccattccttgttctggaccgagtcaaagataataagatgagagagtcgttcatcactgaggagaaaaagttaaggggacatgggatccccttcgcgcataccccaaatgcatgtatatatgcaaagataaataagtgaaaacataaataattaaatatgatctcatgaactatgctaaatgcaaaattgcaaacatgtgaacctatcttagaaaccttattgtggctaacaaaacaaaaagatattttgaacttaacctaaactatatataaattaacttttaacgaaaaatctgtcgaagatatatgctaatttcattgagttgatataagctacagccacaacaagaatcaaactatgtagaggtgggaaatttatgactcataagccacgacacttccatgtgtttagttggcagttggccctactgtttgcttttttttttttttattattgatttagtttcattatttgaacatagaaagattaatatcatacgtgattattatctaattatttatatttatatttatatttaatt

SEQ ID NO: 2876 - DNA, 1300 bp, Glycine max
  Soy_ogl_4427 Gm13:33477901..33479200 Cluster 12
atctaagtgatcactttcctatctagaagaatttgtctctatccgctgaaaaaattgagcaatcaacttatgtgatgggtcatgggttattattactattgtcattgtcaaggacttgtttataaaacagtcggaacatgatatgaatgctcttgctttttctcttatataatattttagcctatatatgcaaagtccttttaaaattaatctattgtgccttgtaaatgaaatgcagttgcacatttcgattctgatcatttactctggattattcatccttggcccaccccggttgaggcaacaaagaagcttaatttatctaaatttatttctcttttattgtatgtgtttgtacacccttccgcaatataggatcttgagtttcatattattattttataaaaatcaaattcaaattataagagaatttcatattatctcagctaaagcaatccccttaatttggttctcatccttgataatatctgcaaaattctatcattctcagaaattctagaaagtttattatttgtgtttctatacatcgataaattttaattgttagtttttgttaatagaaagattcaaactgccaacctatctttttcttctttcatcctttatcaccaaattaactttatatcaccagtttattattggtgttatgttataaaagaaatcagaatttaatctttgtgaaatgggtatccacagattattttatttaaaaaaaggatctagagttgttgctaacgaatatagtattcttcaagatgaatggctttgcacatcaattaaaaactatatatgtacaatagtatcgcagtacaaaatattagtggggcatgcagctttatattttataatcatgctttccactatgacttgaaagtgtggcttgaccgttcgagttattggaatggatgacttgtgtgtgcatgtattgatttgcaattctgtttagtgttcattttcctcaactttcaggtaaacttttctgcatacggggtattttcttttcatgagaaaagcctacaagaaatggcctaaaaaggagggagcaataaaaatagatagcaaagatttaatgatccagtaattgactttataaaaaagccaaagccaaatgataattctttataggacctttgaggaatgtctgttcagctacatggtcatgagtgaatgagacaaaaactaacatgatcttcaagtggtccatcaaacaaacaacttttgaattcaaggcactactaggttatgaaaaacccatgaaatggtccccgcttttcatttc

SEQ ID NO: 2877 - DNA, 1600 bp, Glycine max
  Soy_ogl_3390 Gm10:64201..6452200 Cluster 12
aaaaataataataaaagaaaacatcaatcgaaacatattataggaggattttataataacaaagattgcaatataatggcgactccttaacaattcaaaacattattgttttgagtttttgtagtccggctgtggtcacagttgcataaataaaaattacggagaaaaaaggttctaaatgcgtaaaatctataatgtgtagcgtattgctaatattaggcatagtcaagtagttactaacaattccagcaaagctcttttttccaagtgctatagaagagtagaaagcagctcaagcttagaatcagagcttgaagtaattgtgctcttaacttggcagcctactcaacctttctcttgtacacatccaagcactcctgctctaattgaagaatcatcatcactactatcctaaccctaaaaatgatccagggttccatttactcacaatacataacctacaaattaatacttaacacacatctataatattaatcaatggttcaaataactaattcattttgctaatgcagagcatatagtaacaatcttagcaagcaatatacaaataccttgtaaaggcgttcaatctcaaatgctcttatcctatgaagtgttatactttgttactaatttgtattcagttcattttagttctcagatttcatccccaatttaatgatgttcaataatgactaatgaaataatttctactacgcccttgacacctataccataactttctcttgtgtttgttttcagttccttcaccctgttatgagaaattattatatgattcaatcaagactattatgtttccatgaatctgactaattttcaacagacacacataattaggtttttaattaaaaaaagagttcatattaataaaattaataagctctgtaataaaactaataaaatacaacaattcgagggttatgggttcttacctcttcggcttgctagaacggaggtgttgggaggtgcgatgttgaggagttgaaacctgaacccatgtgtgcatgaccagatacccaagtctcaaacacctgtcaccattcagaccaataaaatgtaactatcaacattcaacaattccaacaaattaacttaatattaaacccacatggccttactaccatattaacagaaaacttttactagtcatgttagtactaccgaaaattttactaagccatgttacatgcacagaccttttaatgggctgctagacaacttagcaatgaaggttttcgacccatattgcatagccatacaatatgctctggaatactctaactcataatcgttggttttttccctactagtgactctgtagcaactattgcagggttttatttacatcaatttgtgttgagactatttgctttacatgatcatagtttttggaaataagaaccgtgtttgaaaccattgtgaatctcaactgggatctttttggaggattttctcaccattatggatgttggtgatgcaagtttgtgatttgtggtttgagtagtgtagtgctactacttgtgcgtcaattcacatgttgagaattaattctagcaatgtgagacttgggaactcaaga

SEQ ID NO: 2878 - DNA, 1311 bp, Glycine max
  Soy_ogl_1915 Gm06:13191601..13192911 Cluster 12
aaatgtatcttttctttcaaaaaaattcctctctggctcaccctgtcctaacgatgtcttgtttttgcaatccaccacttttgggtttgcaatagcaaattggcaagtgttggtaatttggtatttggatacatcatgcatgggatataaaatgattcgggtttcttaatggccaaatataaacaatagtggctggatactggatgctatttaattgtagttgatgatgtctgatggcttttgtaatgaagaatttctttcatatataaaaaattaagcatattaagaatttacactgaataattcttgaaacctttgcctatgctgcctagacgtggggttgatgttgagatatgtttgatatctttagtatagaaaaaaaaataatgtggtttatttttaacaatttgttatttgtttcaaatattaaggatattatttagatttaaaattattatgaatttgtttagataaaaattaggaattgatcttatcatttagatttaggagattaggatgctagaattataaataaagctttttgatattaaaaaaatcacctcatctgaccaactcgaagagatggttatcacccaaaagggggttatacccaacccaagaggaggtcatgaagaaaggatttccaaagcttcacaaaaacttgtaatgaaaatgatgtacaagggattataattttttttcaaaaacttgtaatggtcatgaatgcaatatctatgaaacccatcctttataatatatctctttctccttacaaatatatcccatacacacaaaaataaatataagttgaagtggtcgcctattgctgcgtggaacaccaacaagatgaacatttttatatgatattttattataatttaatttttcttttatgaataaaaatttgtggttagttataattatatttttaactaattttaaaatctagtaatttttatttaaagataaattattttaaggtcaaaatatagttcttaacttattttttgtttttaattttgtctcttaatttttagaagttctaaaatgatatttttacttatttaattgatggcatgtaaattctttacaaaaaacttaccattctcaattttaaggaacaatttgattttttaaattgattcaagatatacaatttatctaattagattcatctacatgaaactttggaaattgaaaaaaaaaagacataaacatgataaaaattacaagaaaaattaagtttatgagtaaccgcaaaaaactgaaaaatcaaatgcattttgattcttgaacatgtatctattgatc

SEQ ID NO: 2879 - DNA, 1400 bp, Glycine max
  Soy_ogl_122 Gm01:38723601..38725000 Cluster 12
tgtatcacaactaacaaattattaacaaacataacaaatcctaaaggcctccaacggataaaaagactaaagacttagtcaaacacaatttctaaaagatagaaataaatagatagaaaatagtttttatgttaaaaaaaaatgattgagaaaaagaaaatatatttttaaaattttaaattatagaaaaatccaacatgtttgatatgagaattgttaatgggtaatagtgttaatgtgtatgaatttgtccataaaaacacacgtgagaattgaatttcaaatcctatatgaatatggatggattaattactacaatagattgtatggaaattgtgattggaagatgactatgggtgtgtatgatgttgttgatataaatgttgtagtgtttttcctatatgctaacctaatagaaacctctttatgagaattgagataattggtttcatcttaattgtctgaatagaaaaccacatgcatattaccccagttggtaagggagatggtgttcataatttgatttccttttaagaatcggaaagtataaatgcaatttaagtacatagtgcaattggcatgtttgagaaagtttaaatgaaactccagaaaatcattatgcaaattgttgggggtaagggctttttgtgaaaatccatctcttctcccatcttggcaaataaaaaggggaaacgcttaataattcaccatgcatcatggcaccttaggacttattgtccacctccaggacttggtgcccattcccaagacaagttgtcacctccaggcttagtgccactgtaaggcttggtgccaactctaaagcttaaagctaactacaaaataaaggtggattgttatatcccttgaagaaacaagcttaactcttgtggataggttgttatatccattgagattcaaatcaacttatgcagatagattgttatatccctagagaatcaaatcacctcaggtggatagcttggtatatcccctgaacaaacaagcttaagttttgtggataggttgttatatcccttgagaaccaaattaactaatatggatattcaaatcaactcatgtgaagttatatcccttgagaatgaaatcacctcaggtggataggttgttatatcccttgaataaataagcttaactcttgaggataggttgttatatccctttagaaccaaattaactaatgtggatagcttgttatatccatagagatgcaaatcaactcatgcagatagatagattgctttatccttgtaaaattaaattagctcatacgggtaggtttttatatcttcggggaaaacttttcttaactcttgtggataggttgtcatagtccttgagaaataagtaagctccatatgaataaaccattatggact

SEQ ID NO: 2880 - DNA, 1119 bp, Glycine max
  Soy_ogl_6097 Gm18:47733443..47734561 Cluster 12
cttttttgttacattgaggcttaactttcttcttttgtgtcattgtagtgtaatgtatgcggtaaaactggtgatcccacaatgatagtcaatttacctggttgcaatgcaaagattgcacacgcgtactgaacttcccttagccatgtttttttttctttcttctactcatattctttcttttcgtgtctctgattttggtgatgttatttccatcttatttcatgtgttgcgttgcaatgattccttagaaatgtaattgtcttggtgtaccttagaattgattttgtaaattccatgttaagtttagatgtgataatcatagtatgttaagagtttgttttggattatgtgatccatacccaaaatatgaaacattaagttggatcatcatttttcataaagattggaatgatgttaacaaacctttctgaccaaatgatgtcctatttaattgccacttaccacaataggagtatgatagcaagatgctcttcggcaaaattaagaaattgcatgctaatcattgtttccaaaatcataatgtacactttttagtcgcatgaatatgtaatccattgcataagttgcgaatgatttgagttattagtaaattattggaatttaaattgttaaatggtggattatatttgctcaactaaaccaataagtctatgtttgaatttaagcaagcttaattaaaatagtcaagtttaaaatttgtggacctgatatcaacaatattcggagttttagttttatttatatatttacatagaaattataattttattttttttccttctagtttagacaaagcaatatcaattttgccattttttgagtcatttaaacttaacaaatatgctcctccattgattttctcttttgtaccaaaagcttttcaactttatttttttttttttacaaattgaatacaagttactcctgactaaaacatgaaatttcacattataaaagaaaatcttcaatttgtcttcaaattatacaaatcttctaaatttttgaattattccatgtcgcaattcgtcaccaccctccaaataaaagaatttaagattaaaaatattttgtgtttataattttatgttgcttgtg

SEQ ID NO: 2881 - DNA, 1000 bp, Glycine max
  Soy_ogl_4819 Gm14:48393001..48394000 Cluster 12
tggatgaattttgaaattgtacatggcgtataaacatacgcatataatcaagaaataaaattgtaaatatattgaaaactcaaaaagaatccttgttaaattaaaatacttgttaataaaactagagagcatatttagtttttgctatcttaattcaaattggtgtcaagaggccatattcaatcgatgttaaagtctcgaaattctattccatgtcatgtggcagagtatgaccttgcatctctatccttatccttgctctcccgtggctctcgtgtagtccaatttatgttcgcttatgaatttttttatataaaaaagagtgaaagaaaaaagggtcaagttgcaatcgagttagatcgaggatccaaagaattaaaattaaatttagaaaggaaaaaagaagaagaaagaagataatgcaaatcactctgattattttggacttgtatttaggcttagagaaattggaccagcatattggctgtatactttcttctgggcctaaatcctttagataaggtccaaaacagcctttgatatgttatatagcagccagattctgacaatgttttgtagaaaataaaaaataaaaaaagtgtttctattttaacgtacgtaattatatgttgtactcttgttatttaataacttaacaagacctaagttccagctcaatgatgagcatactccccaattttttttcatcgatcattggaagtctggaattacacgtcttcaatacaccttgcttagcaacttgaaaacatttttaaatttacaaaaaaaaaactattttttggtgaatgagttccctgttcaaactattctcagatagattaataataaaatcttgggagtgcatattaactctcagtagagttattatgagcttttttggtttcaaaatgcatacagtttcaccggataataagttgcactccttaattcttatgaagcccgtaaacgatatttgtttgagccagcaagagaagttggg

SEQ ID NO: 2882 - DNA, 1000 bp, Glycine max
  Soy_ogl_2686 Gm08:14567801..14568800 Cluster 12
aaaattaactaaataaagactatgactgttaaaaaaattattaaaaaattcagaaaactatatctaactgtaaatatataaaaaaaaaatcatttgttaatatctaagaacaagattggacctcctgttttgttatcttggagaataaaacacaagacaaaccacaaggtgacgcctcttgaaggagctaggcagggtaacaccaccttgtctaatagatccacttgagaaggtggaagccttttgacttttgagtgttgtcttccacaaaagttgacctgaaagtgtttttttgactggtgtcacccaaatcctatacgaccagaatcacctatgacaggtaaactgttttgaaatccacccaaaatggtatttttttatgaaaaaaccctgacccagctagtcttaaacctaaggagttttgttcgattcccaaggcactgattgttttttctgttttctgagttggtaagcatcaacaatcctacttactgctagatggaatgagtgttttttctgcatttccagaattactttttgcactttcgaaattgcttcctgaatgattattccgggagtaatattagaagtgcaaggaagcaattgcatgcttcaattgcacagcttgagcaatttttatggcctggcctgtgggccgagctacatttgggtcataattcatccgaaatattttggaaaaatactttttctaccttattctttttctaaatacacttcctgtagttttttcttttaaaatcaccattgtaggcatggggattcagcattctagaagtatgcaaaaatgttaatacttctgaatttaattccctgaaatatgtaagtatgtttaaaaagttaaattcttgaagtattaacatttattttctgaaatgtaagttcaatttggagagatgtccttaaatagaaagatgttctgaaaatatctctattctttgtgggttgcatataccatctaacatacgccaatttatgaatc

SEQ ID NO: 2883 - DNA, 1000 bp, Glycine max
  Soy_ogl_1921 Gm06:13522001..13523000 Cluster 12
ctaataatcaacaaaagcatattaaaaacctcagactcggtaacattcatagtgactcgctttgttgagccaacatttttttatttcaagggtctccagtgtacaaaactcatttatgtagattatggtatgacaacaagattacaaacattaaatcatcttgaacataattaaccagtgtggacatcctcatttcccaacagaatcgattgatccaagagtccattacatcgacacttttaatccttgaatgtactcaacacttaggtgagttttcacatatttggtagtgcctgggatctgtaacatatgcgttaagtttcagacctctacaatagtcttcagaggagtttattggttgcagtaacattagcctacacgattcattccccaaatattttgcatgaagatttttcacattttcacgaagcctgcggagacaattaaccaagtgcacatgatagaatattgaagttattagctaataatcatgaaattgggtgcctaaagaaagtgtgagaaagcaagctgaatagtatatcatcaataaaatcttttccagcttcaacaaaaacaaacaactttggtggggacattctcattatggataactacgagagccaacatgatcgaaggcatttctattaccattgtccaaaattgaaccgatcgtcctcaaaaaaatcaaacaattttggagaaaaaactaaactaatccactttatgaaaacggttcagttaaccgaatctttttttaaagatgtttggttatttaaaaaaactgatccatttttacatctctattttaaatttgtttggtttttttaacagatatttgaatttgatgattgttttgttgttacatagaggctaatggcctttcgagtctcaaatgatactgtaatgcaacgttcattttctggtttatccgctaacataggaggctagagtataatgattttttgccattgacaagattgttttcatgactagtgtaatt

SEQ ID NO: 2884 - DNA, 1100 bp, Glycine max
  Soy_ogl_5674 Gm17:13764201..13765300 Cluster 12
atttgtttctgctttggtattgggtggttttggtctcttgatttcattcatatatatcttgtttggtgggtattggtttattgttggatcttgtaaccaaacaccagagtttgtgaggcttgtgtattttttttttctttagttggtttgtggtttgtcattcagttttttttttccaacacctcttgtgctcttaatgaaatgttattgctgtaaaaaaatatagatgtacatattgtttttttttagagaaaacagaacaaatatctttatgggtgtatgataataaatatttattccagtttttttactacatgtgcactacaattaacttcaatgaggttgcaaataaatttgttatatttcttttaatatagaacaatgagtggtgataaggaaaaagttgcatgcgatgttatggcaactaaactttatattcaattatgcttgaagcaatgggataaaggagaacaaaatggaactaccctttcaaagaaagggtggagagatatagaatctgaattcaataggagaattggaagaaaatatggcaagacttagttcaaaaacaagtgggataacattaagaaggaatggtcggtatggaacaagttgtttgggaaagagacaaatttaggatgacacaatgtaaggaatattgtgaaggcaccaaatgatgagtggtgggaaaaaaacaattggtatgaagtctttaagcaagttagatttttttatattgttttgcataatatattgtgttgattaattgtaaacatgcaggagaatccattacatgcaaaattcagatataaaggacttttcttttgttcatgagttagataaattgttcgatgatgcggtggctacaggtaaatacaattatgcaccttcttctggaatattaccttatggtgtaaatggaatttgatgatgtataacatccacaatttgaaagcggcaatggagacctagaggaaggcttaggggatagtgaggaagtagttgctagtgttggagtaagttcagatttggaaaatatcaatttaagaacttcacaaggaaatagcgaaaatagcaccggaaaaaggaagagggttgga

SEQ ID NO: 2885 - DNA, 1100 bp, Glycine max
  Soy_ogl_1971 Gm06:15771501..15772600 Cluster 12
aaaaagaatataatgggtaattaagatgtaaaaaggggtatggggatgtacatagcaaaaaccaaagtgtaaatagcaagtaacatagttgcctagcccgggatgatcaacattaaccgaggttcaggattcttgaaatcatatattgcactgggaatgggatgcatccttttctggcatgtcgattccagacaaggtatggcatcatgctagaatctcaggccccatgtcctatttaggtctaaaccaaattaagtattgacaaagagattgtcattcaggtcattatcttaaagactatttcctattttaccataccctagttaccttactagtaattaagattgatgacattagtttagaaaatctcatgagacctatgaatatatatcaccaaacacctataaataacaaaggcaaactctggtgccgtatggcatctcctatcttattgttactctagacgtcaaagtctttattatcattaagacttaagagcaccaccatcacttaccagaggttacaccagattctcaacactagagtagaaccttctacttagttattgacatccctaaaagcaactcgttgatcattattttaagttcatagaattgaagcttttattcagcatgagtttttgtcattaaaaaaaaactaatataaaaattgaaaattaaatttaaaaaaaaaacaagtaattagtttatttaagaaaataaataagttaaattgattgcgttcagagttcaaaagggctgattaaaaaaaaagcacgcaacaaaggagggcaggagttaattattaaaaaggcgggacggaaaaaataaaccaaagaaacagaaagaaggtagagattttcaaaatcgtagagtataatttgaataaaagaacatgcacaaaaagtaaaacaaaaatttaagcacaataagagagcaagatagaggtacaaaatatatttgagttaaataggttttgttacatgaaagtttagaatatattatactcgcatccttttgtttttagtgaattgcatatgatatttctctgttatttgaccctgtgttagtgaattgcatatgatatcctatgaaaaatcg

SEQ ID NO: 2886 - DNA, 1200 bp, Glycine max
  Soy_ogl_553 Gm02:14863901..14865100 Cluster 12
ttaagcattttgggatagtaggaactgtccacaatttcttccaaaggtttccgggacaaggagctggatgatgcttaggaagcttgatttctcctaagagcatgaaaatagccagatttcacagtatgttggccatcactggtgaatttccatatcagacaatttgtattacatctccttctgagtggaatagaagaaagaattttttcagcattaactctggtactcagaacattttggctgaaagagacctctgtcttgttgaggttgattgattgttcggaagcagtctcagatttttaagagacaagataaatgggtagcttcttcagaagtagccctagcaaacataatgctatcatcagcaaagaataagtgagatatgtacggggcctttggacacactttaatcccttgcaatgcttgttgctccactgatttggtaataagagcagaaaaagcctcagggcagagaatatctcaatcccctcaaaagatgaatattcacttccaagggcgccattaatcagcactaaggactcaatagaaatacatctccaaatcagattgcaccacctagggagaaatcccataaaaaataatactccccccaagaaattccattacaccctgtcaagcttcaacaccatataacttctcattcattcctgtcttctttgtattcaaatagtaaaaagtctcaaaagccactagtacactatcagtaataagtctaccaggaacgagtacactttgatttatactcactatagaaggaagaattaccttgagtctgtttgcaattgttttggtgatgagcttgaagataacattgtctaaattggcttgagtgagtaggcttctttaccttagggactagtgcaatgaaagtcttattcaaggtaggaggtgtcccaaaccccattcagctaagttctcactagtcctcttctaattatccatcactgcatctcctgggacccaagaatgtgtaacaatttccttgtaatcctcttctttttccaaccacaactgttcaaatctataaaggcagggtctagatcttattctccctacatctcccgtggaagagctgcaatccaccataattgggttatgatcagaaaaaatgcctagacattacacttttgttttctggtctaataattattatgtcaccctttatagttcaaaagcaac

SEQ ID NO: 2887 - DNA, 1000 bp, Glycine max
  Soy_ogl_3871 Gm11:17430901..17431900 Cluster 12
aaaactaatattaaaggactttttttaattgatgttaaatattttttttttgtactagtgaaacatattgctatctttcaacaacatagaaaaattgaataaataatctatgagaagagagaagaatataatacctagtcaatagagatagactaaataattagaccttgtcaaagtttagaaaccctatttatagttttttttacatgattttcatctgaaaaaaacacatacgtaactaaaataagtctaacattttttctatccctatcatacaggtatgtatacacaggttctaatgccttgaaggtggcacgatgcttagttctaagacatataagatctaacattggcattcacttcggtcaactaactagcattgttgtaggaaataatgtatatattattatattgtcattgatggaggcaaagcaaattaatgcactctggttggtatgtatccataatgcagttgaggagtctcacgggcccagctttaattgtggtggcggtgttaaaaggaaattcccatattctgcttttgccttttcgaatattttttgtgttgagagtaagacttacatatacaacaggagaagacagtgagttttgacaaattcatatcaagtgtaacatgaactgtcgtttttacactcctggtggagaccttttctctctctttttatgagctggatgaagcctcaaggcattggttgcatgctccatttctattccacgcttcaccacagtctgtgaattaaattgtgagaacatagtcaaacttcatttagtctgcatgattgaaaagtgtttgtttcatgcaaccttttaaaatttctagaaatgtggtagacatggaaatgtatattttcacgtttgtttaaagataatcaaaaaatatttttagatatcttttattttcaattaaatgagatctttatgcttatgttaattttgtattgagatgatttctatgaaaaaataatctgaatatggattt

SEQ ID NO: 2888 - DNA, 1800 bp, Glycine max
  Soy_ogl_3807 Gm11:9043501..9045300 Cluster 12
attttgtttcctataggtttatgcgtggcatgtaagcactattttgtaaagattgccttgtgtttttctgtgtcctatgggggaagggttgtgatcgatctatctggatctgccaaagtcaacttagtttctgcatcagaatgcctacttgtgtctatagcatataattttcataaggaggtttgaattggtttaaattcttaattgattaatgtgttatgtggttgaagaaacaaagcattctacttggaattattttgttttgttttttaatgtttgctgtcaacaatgtgatgctatttgatcacgacaattaaatggcactattgactatctgttccattaagaaataaatcttgaaagttatttatggcaccaaaagttgcgtacgtcactctaattaaacaatgttcgttcaactcattaaaaaaatatacgtgggaagggagaattaacttttgaagtaagccattggccaagtgtttttccacattagttaaataaagtttagcaatatcttcccatcccagacacatataaatatattgggaaatcagtgtcttatttgggtagctaggcattagagcaaacctgattagggtctagacccaaaattgggacgttgtcatgtgattttgaaataataatgttaaattttcaaagcaaaggaacatctcatgcatgaatatgtatctatatatggagcaaaagaaatatgcatgaaagtttgaggagaaaactagattgtcctcattcgctcatatttaagaaaagcataattatattgtttttcgcagagttaatttggattagcttgatagttaattactaaaatttctcaattgagataaatatttgtttcttaacttccggagagaaacaaacccctataaatttataagtattttaaaaaatttagacaataaattttttaaaaaggcacaaacactactaaaagatagtcgtatcatgttgtaattgtgtcagtaagtcaaatagtgtacaaacacttcaaatgcttttagtaatatttttattccttttttacttctttttttttaatttttttataccaatactttttagttataagttttaatgattcatacttatttttaaaatatgaaattctcttacgattttcaatttttattttatgttaattttatattaattttatgttctattatagtcatgacatctagttcttgttattattaaaatttgtcatatgttcgtgtctgtactgtatttatgttttattcaaacttgtttccctttttttatcctttgtcgacatggtcaatatttcagataatttctatgtgaggagtacctgaattgtattaactttttttttaaaaaaattgaaaattttgactgtgtcctagacaccaaatgtgtcatatatatatcctttagcttatggtgtgtgaatcaccaattaaatgagcgaagcaaggttgtcagttgtcactttaatattggtttctaacagcttatgagttgcatttgagatctttactcaaactcaaacacagccttaaataaaaaggagtgggttgtttggaaacttttgagtggtcttgtaagatgagctaagccttgaggttcatgacagctgctgcagattgaacagtttagccaacaatttcagtttcccactacatgggacgcacaaagagtcaaacgatctgatcaagagaaaccatatactttgataattagtcaaatattgagggaagtatatgaatcaagaaaagtgatatgatctgttgccacttgccactattcatttta

SEQ ID NO: 2889 - DNA, 1596 bp, Glycine max
  Soy_ogl_1720 Gm05:37932205..37933800 Cluster 12
tatagtgtaatcaattttaactaaggtcataatagcaataaattgaatttggtatatattaattctgcctttcttgacattaattccattatatttacacacatgattcaatactttaaaaggttgtaaaaagtatttaatttcttacccatcatatttaaataactgacttgttgaggcttttaacacaaattttcttatagacttacattgaaacaaaacccagaatagaaaggaaaacagaaggtgctgtactgatacacatacctatccgaaacgggatattgatttttgtttcccacccaatactgctggtttcccatcaaattaataaatattactaaattaactaacatgccattttctgttaacttgaagtactactatatttgtttcatatttgccaaatattaacctaaataaactaaattttagaatttaaaataatttttaatgatagagttaaaatagatcgtttaaaaaaattaattgaagtttatcaacttctaaaaagaagtaaagttaaaaaagaaaatcttacttactttcactttttttattcatttttcctaaatctaattaaatttaattcttaaacttattcagatgttcacgttcacgaaatctaattatgaattcgtcacttattatggatacataataaccaataaacatgtgatttaaatattctatgtttaaaatagcctataagcaataaaaaaattccataatttttaaaataagattacaaatcaggtgaagaacttgaaaagcctgaaaatagcgtgtatcatgagcacacaaaatgagtggcacactgactcctacggatgaagttggaaaacatggataggaggaggtgggtcaccaacctcgcagattcttagccttatttaaatgtatttctgtttgtttcagtgcttacgttgaaaataatctaaatctcatattaattaataatataattatattagattttaaaaataagaatatgtgttaaaaataattcaaatctcatatcaattaacaatataatcatcattttgtaagtgagaaataaccctcattctttgagttaatttttttgacaaattttttatgaagatacttgtcattggcaatgttatgtaataaaaagataaatggatcatgtgatgtttttgtatgaactcacactgttactgccatgtccccttatgaacaattttgttttcaagggacatcagcacaaagaacatacacgtcgcatgaaacgaagttggtaatgggaccacccaaaaaggcaaacatttttctttttttcttcatttgattttctatagtatgtgtacggttcacttggtttttttttattaagctattcttaactaacaatagcatcatcagtaaatatttggtgaattaattaataagaataaacatgattatatatagcatcacaacatctagaataaatagttgcttatcttagttttatagaccttatgtcatataaatttaagtatttcacacaaaatattactttaataataaaattgttaaagtgaatacataacttaattaattttttgggtctataatatgttaatttctttt

SEQ ID NO: 2890 - DNA, 1924 bp, Glycine max
  Soy_ogl_2895 Gm08:44902977..44904900 Cluster 12
caaaatggtaaaaataataataagtttggaacatatgtcaaatgttacatgaaaaattagataggtgaacgtactttttagttttacagaatgtaaacttgaggatgtttgttttatttgttaaaaagatataatgttctctaaaaacattattttttgggcatgtattgtactttatatattttacataaaattattcttattgaaaagtgaaattttgaattttttcgatttaggaaaaatgtttcaatacaataaaaaatagttacctgtatagtaaataaaaaaaattggaaaaattgtactagaataaaatgtcaaaacttttgattttcatgcaatatatataaatattttcaaaaatatttgatctccaattaaacagaatttacctattcctaagattcatgactcataagattcatgcatatgatttccattaactataatgtccaaaaatagaaatttttatttcaaccaaatccaatgcataatttcttaaggaaaaaactgcataatttcacactaataaattatacatatgtacttttacaatggctatttgaaaagtcgaaaacggaggaaaatgtaagcctaaggatttgacagaaatcatagtgaatacagatcatagtgaacatttcgtatattgttttgtctaaaattttcagcaccaaatatgattgggggccatgaaatattacattgggctctttttattgtttgggttcatcaaagctgacacctgtaatattcgaggaccataacgatgcaatgccaaaaacgtgttctttgtctcgtgcgtaagttttaaaaaatgaaccaatttgctcccatgcataaagtagcttcgtatattgttttgtctaattttttttttctttattttataccaacattaacagggaaatagagagaagaaaaagaagtataagacagctaaagtgttattatgtaaaatattgtagtgtaaattattattgtggtcagagaatatgttaatggtaacattttagttcctaaaataataattttatattaatatagctagactgttatcctatttgtattccttgtatcaatcgcctcacaatccttcctttttcgtgatcgaaccaccatctacactagaagatcgaaagtgaaaatcaaaacaaaaaaaagaaaaaagagaaaaaagggatcaagaaatatactatatgagagtaaaaaataaaatgtgactaacggtgatgacgttataaaaaaacgttccaacaacaaatgatgatatatataaaatgtcaggtaatcaatgactaaaataaaaaagtaatatatgtttaggaacacaaataaaatataatatgtttgtaaggattaaataattaaaggaaaaatgtgacatttttgcaaaaaaatatttaagaaaaatttgattattgctaaataacttgaaaaaaaattggttcatttgaatgggttttttttattacgttatgtttttctttttctatttatacaataaaccgaaattaattgtttttcatatgataactatattcattagttttctcttaagagaccataacactgacaatttgacttgaaaaatgcttccatatgcattaatttcatgttcaggtttaatttgcttaacactgctacaactttcagattaatcctggttgtaggccaccagaattactttatctgtcattagttatcaacagcccgtcgtccaataattatcaaattttatttgttgaatattagtaatcaattataattacttatcaattaaatgttacttgtttaatatttttatttaaatatgacattttttactttagttattgtattttttttatccttacaactattatttgatgatgtgacacggtaatgatgccgttggcatttttatggaaaccactaagtaaca

SEQ ID NO: 2891 - DNA, 1242 bp, Glycine max
  Soy_ogl_6814 Gm20:37613201..37614442 Cluster 12
tgggttctgtatatttgaattgaagcaattaggcccgaagccttgaattttggtgtatatgactcttttgacgttgaatgatggctccaaaataaaaacaattgtgtcatcattatgtcatttcactcatttggtaatgtgaactgtacatgctgggaaatgaaagataacaaggtaggttcatggcaagcaatgactggggtctgcgtatacataaaaattcggttttgttaaccactgttactaggagtactgtatgttatttaaggtgtatggagagaaattgagagaatgaaaacaagtaggtgggaaaagaataaaatagaaataattgaaaaatatgatggaaatattgattgtttagtttaaaagaaataaagaaaataagattatgaggtttttagtttgaaagaaacggacaaaattattaataaaaatattattttatccttaaaagtaattttcagatttttgttgtagaagtttttttttcaacacatactgattatcatttataacctacaagtaacataactatatatatattacgtatctatacatgatcgattgtgttaaaaataattgattatgtatactacgtcatgttaaaaagataattgttttgttaaagcttttcatttttaggtcttttttgtttgagtataaaaatttgtacttagaaaccaattttttttttttaaaaaaaatcttctctactttgttgatatcaaacaatcgaagtttacttacacatattttatttctttaagggttttattacatagattaaaaaatatttaatttatacaaattaattatagaaataatgatagattatattacttatgtgttgttttaaaaaaaattatattatttctattaagaaataacattaatgctttgctatatttttttttcttatctcaaataaaagaaggaaaaaatcgtgccacaaccatcctttttgtcatcaaaatcattatcgtgatcatatcactacctattgaactaataaaaataactaataattaagagtattttttaagaaaaaatataatgcaagagacattctaaattaattcatatataaaaaagacaaaactctaattgattttttttaaaggactagaaaaaataatttgcaataacaaaaataaagagcatatccctgtttgatatgtaatttttttagactttttaaaatcacaaatcacctcactattttgtatcaatctcttgtgt

SEQ ID NO: 2892 - DNA, 1300 bp, Glycine max
  Soy_ogl_1951 Gm06:14912101..14913400 Cluster 12
tatattattggtgtgaagtataatatttattaattttattaatgactaatttttgttataaaatttgattaattatctttattgaagtttatccttctaattaaattacaattttctatttataaaaattgaattcaaaattttattaagagatttaaatcaagtttcaatcaaattaacgtaatgatgatatttgaaagggtctttaactattatcataaattcgttaaagaaaactattatcataaatagaaaaatacaattccaattgatgtttatttgttttttttttgtccgtggatatctatttaaagcctatttggttttacgttgaaaatttgattttatatatatttttatatatttaatttcacattaaagaaaaatttaaaattgatattaaattgaaacaaatttgagtgatttatgcattaaatctaaaattttgtattgaactttatttttaactttataatgcaaacacttaaacatgaatcacattattttaaaattaattataactaaaatctattttacaaaatgaattttattcaaaattattttaccaacactcattcaaacacacacttaattcaattcaattggctaagaaaagttaatgcaagtggatatgaaatatgtcagtagtcacagcccatgcaataagtactcaggaaattctgaattcctcttgctccagcctcataatttcaggcccactaattcagaaacggaatatggcttccagccatacttgggatctgacaaaaaataaaaggccatccatcattgggaccactgatgttatgggccacatcataatttttgcacgtttagcctggtctgctcagggcccatgcctctccagtctccacaacgcatgcataggtcacacaatgtctcagtattcttttggcgttcatcaagtgttgaacttacgctgcttgactaatacatgtcttttcactaagcaaagttctcctttggggtaattttggttacatttttactgatggaacaataaaaagctaggcattaaagggagtccatgtttatgtgttgaagtatgttgtctttttacccctaaagagccactgattttccattaccattaaataatcaagattcatcttaaagttgacttggaagtttgtatttatttatttgttaacaggggcgcctaaaagccccaaatcaaagaaataatgtcaacaaaaaacataagaaaaaaggtacgcacatcatggtctattaattactgcatgagaacccaatgtctaaatcggccacgttcatgttt

SEQ ID NO: 2893 - DNA, 1100 bp, Glycine max
  Soy_ogl_3170 Gm09:38358701..38359800 Cluster 12
aagtgtaaccaatattgaaatggagtgattaaggcttttaataaaaagtctaaatcgtagtttgattgagggttgagaatgtagacacgtcaccaaaaaaatggtaaaggaagcaattgattgtgatgcattgagattgagcaattagttatgagagagggaatattttggaaaaagaaaagggtggatgcggttggcacgtgtgaagaaaaggcctatgagttggcgtcctgcatgaatcgaagccgcagatggcgactcctgtgaattctgaaagccgccaccaaaccaaagatctaaacaattgtggcgtagccaaacgtcacaagttcacaaccttttcccacgcttgcgtaaagcttttgttttccctctttttcaccttcattggtttttcacctattgctctagcctctagctatacatttgtttcatattcagaccagtatgcttatacttgaacagaacaatagtcttctctaaaaaaattattttagtaaatatgttactgaaaaatcttatatttttacatattaattaatgagtttatatataactaactaaacaaaaaattacgactaaaaaacctatcacattaaaaatacttaaaactacaaaaacaaattacatgtaagttatatttgagaagttattttagctggcttttatttttttttttaagatcttactgataggtgtctttagaatattgattaaaaattaaaatgctaaaatatttattacaaaaatcataaataacataattttatatattttaataaaaaaatcattccttaatatatatttttttattaattgaaaaacttctatttacttttgatatgctactttaagtaatttttttaaatgttagctgtaacttgtattatttcttattgttaaatgatgataaaaaatgatgatattatatttaatattaatattaatatttgtattaaataatattgttataaataaatcagtctaaactcacaatagactgtcgaacttgattaaattgtattattaaaatttctgaaattgactttttgttaaataggtaagcataaaataagctttgaacgaattatacggtaagt

SEQ ID NO: 2894 - DNA, 1193 bp, Glycine max
  Soy_ogl_1361 Gm04:43370108..43371300 Cluster 12
tcagattaaaattatttctttaacgattgaaatacttcatatttgtttttcggatcgcttaatccaaaattatcaaaaagtaatttcgaatttgcatttctggaaggctccaccaatttgtatgtgtttcagattgtcttatccataatgttgttgattatacttctggattaggggatctggaatgatttatgaatcttgtagcctaattcggattgcctaatctgaaagtgttactttgtaactgaaccggattagatcatctggaacatataaattttacttcggaattgtcaagccggatttgccacttttaataaattgcgtcagtgtcttgcggcatggatatttcactgaacccagattgccaacgtatacaatttaaaaatgttgccgacgaatttatatttatatctataatctgtaatctatatctatctatattttatattctatatactattacatttctcagtcattttcgggaaaagttttgttagatgtcaattcttggtgtattttgtacgtctttggctgaatgcattttcaaacacttttctactggcctaatcaattaaaaaatcaacattaattgattctctaataaaataattcaaatcaatattagttaattccggatattatacaaccttactgaatattacatatttaaaatttaaaaaatttcatatttatcacaatttatttaaatattttagacaaatataaaaggacaattaattgtgaacatttttagaaatattttgaattataggaatattatcatacgggacattatattatgttgagtattttaaaaaaaatagaggcaataaatttgcatcgtataataatatccgtggaataatttgcttttaaaaaatttaaatcaatcaacattgtaaccactcagaactccataacatttagacttttttaaaatattacttttttaaaagctataggatattattatacgggatattcgatcaatcaagattatagcaagaattaatattaatatagattgacataatatttgttagaaatgtttatcagatcacgagaagttatacaaactcacgtacataatattatccttaattccaaataaaatattaacagattttcttaaatcatctcggttttttattttttgacaaataaatcatctcagttcagtccttttaaat

SEQ ID NO: 2895 - DNA, 1472 bp, Glycine max
  Soy_ogl_986 Gm03:39853229..39854700 Cluster 12
tgttgatctcttctacgttcctgttgctgttgctgttgctgttgctgttgctatcataactcaggtttaagagggaaggtgtgtacctgcaaaaggcattctagttttcaaccctgaagttgtaaggtttgcactggtatagtgcaggcatcaaagatgcatagatgagtggttaaaagttaaaaccctttatttggcaatgagtggttgatccactgttttacagttgtacacgtacttgctttttctgtattttttagcaatttattccaacattagcacttaaaataccctagttgtaacttgtaagccttttcatctatagattggtttaatgatgtgaaacagagctataaagttgaaggatgtcaacttacatataaagagctaagcgacttcatttataagactgtcctgctgagaaagttgacttacttgcaccggagtgaaggagaccaggtggcttctactagtattggaaaaacagaaactcttcttgttcggaaattaccaattgcagatccaaagtaatcatactcattgtgcaacagttctttggattgtagaattgttaactgctattgtgagttggctgatatggtccattttatgcttaggatgtgtcattctcctgaaatgcaatatttattccttgcttttcatatgaaaaatctttaaacagatgcttttctcatcttgatttcatatattacataataattgaatctagagtttataactgttgaactcagaaaataaacacattgaattctgaataaatcatagaatctatctgtttttttggccaaatttaagtgcaaacatcaacaaacacaaggtttccccctaacaagtaacaaggagttttctccttcaaaacaccgtaaataacaatttgacaccttaaccgccacatcctaaaacaaaactgccaatacataattgaaaccaacataactgcctaataactgtcctaatgcagaattaacacaaacacagctacctaataactggctgtcaattttttattgtaacaaaaggattgatttgtgttagcaagttagtatattgatatcacatatagatttgactgtttgtaagttactaaaagtctctcattttgagaaactcctaccatgtcttagtttgagcactagtttactatgatttatcagttctgaagttaaaatttaaaacataaggtggttcttgcctatgatgatttatattttaatcgttgtaaagctccatttgaggcttttggtcttgcagatgttacttttttaaaaaatatatatggtaggtggcaccaacaatgtgataaacttcatgcttatgcctgtgttatttgtagatttttttaaaataggttttctttttacattttgtaatctggtcggtgatatggtctatggatggtataatgagttctgataatcctccccttcctctcccaaaaaatgttgttgact

SEQ ID NO: 2896 - DNA, 1107 bp, Glycine max
  Soy_ogl_1722 Gm05:37955928..37957034 Cluster 12
ctttttctttttcttttttctgagaagttggttaaccaaatcaataaccacaaattattgtcatgcaaactatttttgaatttttttattgatattcaaccttttcttttttgccgttttacatggctgacatttgtttgcatatctataatccaaatagccaataaactcaagaaggtcagttttgtttgaaaatttttcaaaataaaaatataatgaatatgtgaagaattttcaaataagagtaattcaaataatgtgataacacaaattaaagcacttaaaatctcacaaaaatgaatcatgtttggatgaacggaattaacaagaacaagaacgtacaaaaggtttttcaaagaaggtaatgttttcttatcttgtttttcagaaaccttgaggtgcaattaaataaaataaaactattttaggaaactatcatgttattaaaaaccaaaaaagagacttatttttaaattggaaattccaataagataattaattaaatgttcaattatattatgaactttcataactcatagtcaataatcaattataacttcttaataatcaagtttgttgatttgaatgtataaaaaaagtttgtttatttgggacatgaataatcaataatgattcttatgatgcatcagattatataacattttttttataatcaatttatttgtgtgaagtattcattaattcttattagggagacatatatagtttcattcaaatcaaagacttgttaaaagatcgtataacatgaagcaaatacggaatgaacacaatcaattatactttaaagataattgattatcccaacatcaaaagaaagtttaataaatttattgatttgagaaaaagaatcaaattaattttctttttatgtataataatgatattgaggtttgaatctaaaatttgggaccctaagtcaatttattttaaataaaatagtaatataatagaacggaatggaaagtgaaatggaataaaatatccattgtaaagtacctaaagagctaaaaatgaaatcaaatataagaaagaaatcagccactaaaaaaattagaaaatagagtgaaaaattggagataatggatt

SEQ ID NO: 2897 - DNA, 1425 bp, Glycine max
  Soy_ogl_1719 Gm05:37911176..37912600 Cluster 12
tactcctaacaccctattatttttttttaagataagaggtattgttaatggaccaaacaaaagtgttgggtcttgtcatctagtttatattgacagatcgggtatagattcccatctctaaatttgttattaactactcttaagtactcttaagtgtgttttaaattttattctccaaaaatattctctttatgaaaatatgattcgatgggcaaaatacacaacgaagaaaaggaaaagtggtgtgttgggaagtataagtaccttttgatttctctctattttttaactgactttgaatctgaattctatttcgtatttttgcgaactggtttctcttatcgtctgaggtgtacttgcaataaagattattacacttctttacaaagttatcttcacatacaattttttttattgatttaaaaaagtttcatcaacaattatgataaatcactattcaatccatcatctttttataatatgtctttacatataatttattaagaaattcatattaaagaacaatagtgtatatgttagcaaagcaaaccccacgggcagttgccaacttacacatccttatttttttatataagtgtattaactagttacaccattatatgttgtaagatattttctaattataatttactgatatagttatactgaaaaaataagaatatatatattaacaaaacctatatatatacacacacgcacaagagttacctaaacccatagatacaaacaacaaacaaagacaagggttatagagagtttaagggtacttatgaacctataaattcaacataacccacagataaaagagaaaaaacatagtacaactagctgtcccatataacagaatatcatattctcttcaccgttcctaatgaacaagcatccgcaagcactcttcatatcatcgaatatcatcaacgtggccctcatacagctctaccataatttatggctctaggttacacaatcccaaaggaacaacttcggctatgatgaccattgtgggaaggatgcttcaaaatcttttctagcaaaccttaacgcgaacaccacgtgtggaacatgatgttttgcattaggacttttctgtcaaaagcttggtctctaaaaatgcaggaatttctagctatccatgtgttccaaacaactgagcaccaaaggatcttccacctcctaataagcttgtccgaagttacaccacctgtgaattgacaaccatggaggaaattgtttctcgacaaggaatagttcgggtctaaaacaaattgaggctctcttataaaagaagcccctagataatagaccccaaaagaaccactgtaaatgtaaaatgccgtaaatcacaggtgaattttgtagattaaatctaactttctccaattccttttctctaatgtgaatttt

SEQ ID NO: 2898 - DNA, 1800 bp, Glycine max
  Soy_ogl_2110 Gm07:1137201..1139000 Cluster 12
aataatcaaaataatagattattctttcttttctgacaataaagtaaactcatagtaagttatgacattaatttttaaagaaagtagaatatgaaaaaaaagttatatatatgtcgttctatttacatataacatataattaaaggactcaaattacttatcgcttatcatattttgtgaattactcttcttatatttgtgcgtgtgcgcaaattttcaccttttttggggaagggaataatgttattttggttagaaatggtattgaaaataacatccagcaaactacatggacaagtggtaataatattgtgatatagtgtcaacattgagattaaaatgagttattttaaattagagagattaaaaaattatttttaaatttaaggagattaaaagaaaatcatatttaaaggtcaaaaaatatatttaagaaaaactttaaaggtcaaaccatagggcacccacgaattatttggtcgggtgagaaaaatataaatatattacaataacatttttatttagtaggagagaaactaaaaaaagaaaaaaaaatcttttactttctctttaaatcaaaataaatgtaattcaatggactaacacatgcgctctatgagagataatcttaatttgatctcaagcaacacatccttaaaaagagaaaacaaaaattcatcaaaaaaaagagaaaacaaaacttaaaaatgagattttaaaatatcagaaagagaaaaacttctagcttttaattttttatatttatttttcttttgttcttgataattttttaattttttatttaagataaaattaaaaggagaaaaaaattcaatggacaacacatgcgctctgaataatgcacgttcagagatggtgacaaatgatctaccaaaaaaaaaagcagcattgcaacctacagaaaagagatggtgacatagggtggtgagtcaccggcatttatcataatgctctagacccaccagcatcaaccaattagatatgcacgatttttaggggaaaaaaaaatctaagtgtccacctcattttgggtgaattgacgtagaaggaggagcaagattagaaaaaaaaaaaagaagtaaaattaaagaacatgataaataaactttatgtaatgaaaaatttaacaaaaagaacatttaataatatttttatcctcaaatttgtgtcaatactattttagatccccgaaatttaaatttgttttttttttctcaagtctataagttatcttttgagtttcttgtgattgatttttttcccgtaaagatgtatagtttgtggcatttttttattacaagaaaaactaaaaaaaataaaattgagaaactaaaaaaataaattaagatgtttgtctctagtgtagcttttaaaatatattgtaatgctgtataacatagaatttataaaaaaaaattagtaaatttattttctatttaacgagtttttctgttgattttataattttaataaatgttaatcaataatttattaaaaattatcttattacaaataactcttaatgataaggatgagataaaggcccaacacctatcaaaaattgccgcagggtagttgaaacgtgcttcttatgccgttgtgactttgtggtccaaaattaaccgtacaatctgcaattattgcaatgctccgtctttttttagcgtctgtatgtcaccacttggcacgggcacttaccgataaaatataaaatgtataaacaaaagtaattacaatttgaatataatttaaaacaaaaaaaataaaaagtatatttta

SEQ ID NO: 2899 - DNA, 1613 bp, Glycine max
  Soy_ogl_2571 Gm08:8931863..8933475 Cluster 12
ttaggtacattaattaaggtatataaagattcactttctattaaaatgtcataatcgcttcttatctttgagttagacacgaagaactaaacttcaacatatcatacatgatggccaagacaggtagttttgctcttcgtatcttttcaagctagctaatataaaaactgtttatccaaaaaaaagttagtataataactaattttaacttttgtgctacattagaggggagatcatcatattaaatggctgagatatgttagaatatatttttatcgtaagaaaaaaaaattatatgaattttgggagtaagcccaaatttatttgatgagatccatatgaaatttacttaatcaataaataataaagattatgttaaaaaatgtgttaaaaaatatctaaagaacatatatggggtacttgcttaaaacattaacaagattctgcaatcactaaaagttcatttcttttttatgtctgtttttatattttttttctccagtttctattagctaaaggtaaaataaaaaaaaaaaatgaccgggatccaaatttgaaattttatttatataggagttcaaaagtgtagagtgtccagttgacaattccgccattaaaatgattagtttatttatagaaaaagaaaaaaaattctaaacacaatgttaatagcatttgtctatgagaaacgaataaaacttgaatttgtatcaaggattaaaagaaagatttactcaacaaattattaacttgattgatatagaagacacgtgagaatgcaaaatccaccctatctttcggggttcaattatttgtatttgtcgttcatatcagaatactaaccgcatttcaatagattcaagaattcacaataatatcccaagaaaaatcttcattatatataaattgcagatacttcgaaaatctgcataaagataatctgtcatcactccgtaatccctatcctatccctctaattagatcttttgacatataaattaaaaattttaggcaggttatcatctgaattggacgtcccaccttttaatcaagtcaatcccaagtaaaactcggaacattggttttttttttaaaggttaatattagttgttaatttgttgattttcactagtgagagagatttgaatccaccatttttttttatcttttaaccatcaaatcaaattagctttataactccaaactttgaaacttgtgtcttccaattcatttttcatatcaaattgttcacttgctctatgttgattatattttgttccagcaccgacacctcatgccaattccataagcttcaatattactaacaagaactcgggactactttatcaaaagaattagttgtttgagagctcaagattttataaacttgaaacttctcatcagcgagatatatctaatacagtacttaggggactgtttcaaaggaaaggagacgaagagaggagatagattttaattagatattttgtttggttgaaaagagaatagaggagggattttaatgaaaaaaagaagaaaataatatgtgatttcagtttagtttaaatacattattaaatctaaatcaaatctatttttacagttgggttcgg

SEQ ID NO: 2900 - DNA, 1000 bp, Glycine max
  Soy_ogl_3513 Gm10:43267301..43268300 Cluster 12
aaaaaaaaactgtctttcaatatattattttgttatagtggaaaataaagagtagtcagagagtgagagtattccaaatttttttaataagaaaaaaaatcattaatggtataaatgctaacaatttctccaaactatgtattctaattttaaagtagggagccattatagtattctacatatacagacttcttacaacatccttttataattcatttatcatctttatctttctttatttcattaattacttattttaatcttctctctctttacttcatattgatcgaattaatggacataattacaagaaagagctgtaaaaatataatttctctttataatatagaagttgattatgtgttatcataaataagtgtagttaaacttattttaaaaaataaaactatgcatcaaaagcagttttgaaacgcaccaaaaataatgttattaaaaagttgatcttccatataattgcaatcaaacacttttaacgatatcttaaatatgcaattgaatataactaacgtaaaaaaatattacatgtagattcattttaaaccgtttaagatgttttaaatgacctgttaagattgtagttaatttctctaaatgaagacaagtcagacgcattcatgcatcgcagagatacgaccgtcggacacataggcgacaactaactcaagttgatgcctaggtttactttagactttcaatcatattcatgcatgcacagtaaaacaatatgtatgatataatttaagaataataacatattaataattaattaagtatgggctactatagagacgtagattataggcaaattcatttgctatttagtttcctcatcgttaaatttattttattctgtattttgaattattattattcttatctctaagcccacgaggaatttctttgttgtaacaaaaaagacaatcagcccatgtgcttcacgaaaggactgcttgcgttgaccttaaagttaattaggtgc

SEQ ID NO: 2901 - DNA, 1305 bp, Glycine max
  Soy_ogl_3514 Gm10:43271001..43272305 Cluster 12
tctttaatctctactggagtataatatattttgttaagcttttcgtgtacaatttttatttattggatttcgtttatggttcagatatggactgacagacccatacacgtctttttgtaggatctaagcagaaagtttgaaaacataaaaagccatgaacggaacgaagcacttcacaaatatagaataagaggaaacttttcatatatttcatcagtgtttaactagtgtttaaattgtattttctttatttatttttattgtacgtgttcttattgtgttgaacaattgtaaggcacttgtccatccaagtacttccagttgcctgcatgcaatgtaattttcaaagttgtgtctgttcgcatatcatgctgacaaggcaacatatttaaaataacagattcgctaaataggaagaataactattcatcacacctcttgggtgttgacattaagaaagagataaaagagaaaacacaaataactaataagattggtaatgtgatataaaaagaaaataatgaatgtcaactagatgtttagaccctttagatatccataaatgataactcttaatatgagttcatttgcacggaaaagtattaatcacatgtggcacatcttaagttgaaaaaataaattcataaaacactgtggatataattgatgaaaggatttgtagaatctaatttcgtaatatttaaaatttctcataaaataaaatattctctcttatttgttattccatagtatttttgttgtaataatatatacctaggaaccatacattcttaaaatttggacttactgatatgcgcaaataaaattcaccatggatagaaaatgggccaagtatttttaataggtacttgtgagtaatggatacacaaggaatacatatagaaatttctgacagtttttaataggtacatttaattaggtatggagtatatcaattttttcacaaaagcttctaacaaataattttttacagttttgaaccgcaaaaaatgaaccattataaaatataataaaattaattaatgtcaggttatcatttaatgaaagaaaagactattttagatttatttgcaaacttaaaagattaaaacaagacttttaaattataaatgaccaaatacaaaaaagacaaaaagataataaactaaaatgatattctaacattttagttacgagcattatgaatgggttgatgaatgcacagggatgcatttttgccaaatcaaaaatcactcagatgaatcctaaaatattataagtttggataaaatatactttttagtc

SEQ ID NO: 2902 - DNA, 1030 bp, Glycine max
  Soy_ogl_3515 Gm10:43272901..43273930 Cluster 12
agaatcaaggagtcttgctaaaataagtgaatgacgattctaaaatatttcttggatactttgtcaagctagctaggtaggtagatctcaaagatgtttttattttttaataatttacaagagtaaaaaagtataataatttcaaacatccctaaattgctatatattttaactttgtggttgaaatggaaaacacgccatatggaatatctgccttcaagaaaagggtttaaatatttttttccttataaaataatgtttttattttagtatttaaatttttttatttttaaaatttatttattttcatttaaatctttcttgttagataataatgacaattaataatataataacaatattgttagttcattaacttatcaccttataaaaaaattgataagaaaattatgtgcattttttatttacttaaaaaattataaattattatcttgttacaatcttgatagtgataaatcaatggacatgattaactttactgttaccatattatttaatgaaaaagagattaaaataaataaaaattgatatttttttgaaatgattaaaataatttaaaaaaacttttaattttatagggactcttaaaaaatatttattaaatttaatttgattttttttttctgaatttcgagtcgctttgatacgtccgttgtggagatttcatgcactattcttccgcgctgttcattattctctggttccttcatgagaatgagatcaagtcacatcacaggtctgatcatctttttttttttttcctttcaatttcatgtccccaagaaaaagggaatatagaaaatagatacagtaccatcagtcttcgcctactccagtaagctataggtacatacaaatgcacaatgcataatacacatcagttttcgcctactccagtaagctattggtacatataaatacatttttttcctacaattgataatgtgaagaaataaaaaaaagacgctaatccctcaatcaaatagctcagatttaaataaattttatt

SEQ ID NO: 2903 - DNA, 1400 bp, Glycine max
  Soy_ogl_3591 Gm10:46856301..46857700 Cluster 12
taaaacttgggctttgctattgttaaaggatacatggtgtcctatagctggggctcattatattattcatttaatagtacacaattgtaatcgcaatatcattaaaatatgggggaaaaccgatttaatagtacacagttgttggtcgagatagtaaagttggatgcgaagtgaaaatcaggctatatcatagacgagatcattaaaatgcaactgagccaaatacaacctatgttacctaacccctgctacgaaattcataaaataattatcatgcctgtatattaatctcttgcgagctagaactagtttttgaaaaacgtgtaattcttgttttttctaatacaggggcggataaaaaaaatacgagcaaacggtggaaaataattaaattctactagtaatatatattataaaatagcgatattaacagaaaaaggttaaaatattaattagacttattacttctgtttgtcagtgtaagtaactagtattagtttaataatttcaacaattaattataggtttatagtaattgtacaatactagtacattagaataaaactgtaatatttatatatactaataatttaacttatgttaaataaagagtatgctggttttttttgacagacaaagagtatactgataaaaataagtaatacctaattgttagtacatattgtttttagtaatacatgattaaattgataaattatgtaattttaaaatattttttaggggaacccaccctttgaattgttctatttgtttatataaattctatatacttattagtaacaacattataacaataacaacaattttttttcattaaaaagagtcacttgcatcataaaacaacattaatgttccactctaaattaattactatatatgtagacaaattattgatgtttagaccatttttaatgattttaatatgtagattgtttagtttatattcttttacaaactgaattaattgacaaatctgtttggtaatagtaattggtcatatctaaaggtttaagtaagctaattatatttgagtcatttttgtttgtaatagtagttttaaattatttttatatgattacatcacttttggctacgtgggtaattaagataagataaacaagatttattgacttagtatacaagaatactgagaaaaaacaaaaaataacgtggctagctagcatagatgcaatgcagcaaaaggtagtttgtaaagaaggagatagattttgccttgaaataatataaaaaaatttctttaaagactatttaatcaaattagaggaattggctttgctgaatatgatatatgatttatggtaggtgaatatgtgttggttagtctccctttctctctctgatataaggtacaaaatatt

SEQ ID NO: 2904 - DNA, 1100 bp, Glycine max
  Soy_ogl_3592 Gm10:46870001..46871100 Cluster 12
gcatgatacatgatgttaaaaatcttgacaagtttagctcttttttggggatgtattataattacaatcttaattgtttggttaaatttgttttgtagtgtttggcatacggtttaaataggatagaatgtttttatacttttattttatcgtgatttcattcagctcgtccaaataaacttattttttccataattttttttataatatattaatcattgtgtgtcgttgtttatttttaaaaggcaaacactgtatactcgtctatcctcattttctattttttgaaattgaatttactgcatatgcatttaatatgatttgtttttatcaatgtaactaatgagagaggttgagaattgaaataaaatagtgagatattttgcaataaaatttaaaaggtgaaatagtttttaaaatgtttagaccaaatatatgagagtcatgagagagtgagggagttacgcatgtaggtaagattgaaagaatgtaatagttactattgttgtgtttgtgaattgtcttttattattattattttagtcctaagcacgtgatattttagtaagatttaattaatacagaacattaaaagtaaaatattatagaactaaatgcataagctatgaaatagttcatatttaatattattaatataacacgtggggcctttttgtagttaaacgtcaattcaatgacgactgatataacaataaacctttgttgatacttgtgtaagttctggcttttgaatgtcattccattatttatattttttattataaaataatgtagaatgaatcgttacaacctcgttttttttaataaataggtatttagtttcaaactatgataaattccactttacatttgcatcctaaggaaaacaaaacccattaaacaagaaagatcagaccgtagagaatgtctcggagttggattttgggagtaaaaaagacattcttatttttaataaatattctccattttaatatttattaaataaaagaaataaaataagaaactagaataaatttaacatcccaatttttatttaaaaatttgagacattataaaaatggaacaatttgccttttatt

SEQ ID NO: 2905 - DNA, 2426 bp, Glycine max
  Soy_ogl_3593 Gm10:46879701..46882126 Cluster 12
taaaccatgcaatatactaggaccactaaccactttgcccggaatttgtacagaatctaaattgattataatggctgtttaataaaatattgcgaggagatgtaaaaaaaaattactcttttaagattttgccaagttatctaaaaaaagggaaatggatggaccatgcatgttgggtgatacaaacctcacaataagagatatgcaccctactgtctcatagtggaccggctagttaacatagcaataattgcattgatagctaagcaacagttggcatgcatccaatccatcaacctagaaactaaacatttgatctttgatgtgcgtgttcactacactgaatactaatagatagatagatatctttctcatctttcattgagaatataaaattgtgatatacatctgaatccgaagtagaattggtaaattcattgggtcacccgatctggttcagtctggatttttttgggtcaggttaggttatcctgtcttgaatttcttgtatgttacaaatttgatgatctaaactagcttttatgctaagctggtatgtcaatatataaattaaatacgttttaagtaaaaataaataaaattaaacttaaacatgtttgatttgtggcaccataaggaagtcttgcttacaattaaaagaattgcgccatatttttccagtaaaatactcacaatgaggagtatattacatgtttttccccattaatacttatagaaatataataatctattttttcatttcttctcacctccccttattatctgagtaaggcaacttgcttttattctttcgatcaaataaaaataagagaacttttctcttacaaatcgtaatattaatgtgtagtgttttgattctcctaattaacacaatcttagattcttcttctttaactcgtctctttttaggtcttatcaacacaatcgcagagtcttttgatttatgttttcaattcctttttcaaatatttccgctcatcaatagcttgattagaagaaagtagtaattattttttagagctcttcatcaaaattataaaaagaaaagtatttttatacttaattacttaattaattagcaaaccatgcttaatataaaatgcattaaatgatgagctaaacaattgcacgtgatgtcattcacgcacctgtcttttcaatttttttggctacatattatcggattctgcaaccttttcaaaatgactggtaacacctcttgacgtcctccaattcacgtgcaattttataagtaatgtttgaaaaaaaaaaagagtgaattatataatattaaaagtgaaattttattaatataatattagaggagataataaataaataacaattttataaaaatattgaaagtaggaaataaaaaattataaaacattgtacgtcataaggaataaattcaaacgcttcttcatcatttaaaaaaaaatatttataagccataaaaataaattcatttactatatacttttattttaattactttgataattttacaaactaaccaaaataaactataatttaaatgaaaagaaatgccaaaaatactattgtatcttgttcttaattgctcagtgctagtagcttcatgtttactattctgacaaaaagatcaaacgtgcaagtaaaacgatatgagtattaaagtcgtagaatattgacatgatttgttatctaaaacttatagaaattgatgattaaagtgattgacatgtaatgaaaagtagaagattatactagaaatgcaatgaaatggcagaatatcatcaagtaaattgtatttaagaaatttatcaaataaccagtgaacgtacgaaattgaggtgaaattaataatgagtgaaacattgttggaatcggatttcgtaggaacaacctctacacatgtaatcaaaatcttagatcacaattctacttcaacgaaatttattaattaagttgaaactcgatctaagcacaaggaatgcgcgagctattgcagagtgcgtgcaaatacaacagcgttccagcttgtaaacaaggccaaaacaagattcggccatggaagagctttagacagaactccacacccaaaaccgtctcaaacgaacttatgaatcgatcgaatgcatcttaaccttgtgcattgtccaattatacacgagtttctccaactaaaattgttatttcagctttagcatctagggaagataaaataaacccgaatcttatgaatatactaaaaaatatgattacttatttattgggactgaggatggaggcgcggatggatacgtacggatattataatacattctacccacgcatatatatagcatatatatatcatatatgataaatattaatgtattaaaatatgttatttaagttaataatttatattataaatatat

SEQ ID NO: 2906 - DNA, 1100 bp, Glycine max
  Soy_ogl_4129 Gm12:373001..37749100 Cluster 12
aacaaaaaaacataataaaaaatcaaataagtcatttgacttaattattttacacatgcattggataaaaaaggaaatcccatgactatttacttagaatcaagaaaactcggtgacttcctttatttctacgtaacaaccttaaacgacacactgaatagagaaagtatattacaagtggttattaattataatcataactataactactaaatataagtatattacaatttacaagtgattattataatcataatcagttttgtataaccgattatttaacaagtatatatttttagttggttatataattgattatagaaatataattagatttaaaaatgaattaaaaaatatttttaaatatttattacatttttataactgattttatgtattaataattgtgtcatgtttgactaaaatttattttaaatattaaaaaaattataggtaaaaatcaattattaatttaagatttataactagttatataattggtttaagttataatggattatataactgattttggataaatatggttattaaaccatttttttcaaatggctatggattgattataataaccgctgtcatatgtgactaatttttataatcatttacgataaaccagttaattataaaataattggttaattatgattatggttaaattttttataatcagttattatgagcattcctattcgaattcgtaggatgttcgaagctgccacctgtgaacgaggacgcacgggcaaatccgggttcccaacctagggggtcaacaaaaagaattaaatattattcaataatatataaacattaaattttgtatataatacttatagttatatattttaaaatgatccaaaatatattaatataaatcacaaactaaacatatttttcaaaggtctaatcttacaactagctatcaacatattagttttgtgtagcagtaggaactttcacgtgtttataattaaaaataatcaactatatttttttatgaatacaaaaagtgaaaagacaataagtaaagaataaaaagcctaacttaacaaatggtgtacaactgcagaatattgagacgc

SEQ ID NO: 2907 - DNA, 1289 bp, Glycine max
  Soy_ogl_4130 Gm12:37752112..37753400 Cluster 12
aaatcaaaataacaagttttacgagtactaaaaagttatataagtctgtaatagaaacccaaagctagctcaactttaactagggtacatacatgccaagttgtagtaaaagtttctcatgaaaaggttgactaatcactgaacatatccctgaagttgtactcccccaattgggcccaaacgaacccgatctacataatgtttcatgtgaccagttttaggagataaaaaaattggtgatggcattgagaaccagtgtagccaaaggggactttcagaacgggtaaatgacatgtgggtttcaacttagaatatgataagggaggttctattaccaataagttgtttatgattattacaatcttttcgaaaaggagccaaaaggcacaaaccaccaatagggtattctagggcttatccaaaaaagaaaaaccaatacgatatcctagtatttttagggtttttcccctcttcctctgtgaggtttgaatatatgcagctattattagggcccatattagaattctcctccaaaccttaggattcaccaaatctactcaaaggttcaagacacaatccctaagacaagcctaatagtttccggtgcttgcatacagcacaagggcataaggagtggagtagcctaagacatatatattcctctgcttcgtttctcttcattgattagtaagaagcttcacatgcattaaccactagctcgcccaaaacggaaagttttgtctctgcaagccaagccagtgccatattttatggaaaactggggttactagaaggactagggtcaagaaaccatccattctatgaagaacctgaagggtatatgacttcacaaaaattaatattagccctaacaagggctaacaacaatggcgacaaataattaattgttctcaaggcaccctcaaattattttctaattaatcataagaatttaatgtttttattttgttttgtttctctggcatgaccatccccttcaatttttttctcctcttattaactcccctcactgcaacaagatcaaatgaaatgaaaaaagttattttgttttatcataaaatatcaaaatgtaacttttttttaatttcattcgtcgaactcacatgcctatactctgcagtctgcactatctcttattccataaaaaaaaactaaaaaacaagagaaagtagaaaaactctataattacaatttgaataattttttgtctaaatttccttcttatcgttaccttccaacattttctcccgacagtcaggcaacgggta

SEQ ID NO: 2908 - DNA, 1200 bp, Glycine max
  Soy_ogl_4171 Gm13:20457501..20458700 Cluster 12
aaatagcctcatgtccaccagaatggtaagaccatgcttagctaacacatctaccacattattgacttctcgaaatacatgagaaaaatatacagaggacctagtcctaacaagattcctagtatcaatgactacgttaaaatgaacatgggtatggaagcatccatccacaatttactccacggcattttgctgctaagactcagcagatccccatagcaaataagtttggtttaacttgagtttgatgtaagttatatcataggtttttgatgtattttgtcttattttcatctctagttagtaggctttaaatttaaagtttacttttgatacattaataatacaacttttactgtgaactgattgtatttatcttaaatatatttttagaaacaattaatataaaaactaacaatcttatatatttcgtctataattacacaattaactaacctattttgatatatgttttaatttaactattctgtttgtcttattttcataactatatctttttatttacttatataactcaacaatatgaaatatgttttgcaacgaaaggtcgacgctttgctcattcttctctcctaggtgggtcttgtatgttagaaggattttgacatttgcacaaccatctttcaataccacaatgcaaaatcaacctcaacatttaaacacagtgccctcgcgccttacacgatagctatatatgtcccactttattcatgttgaaccaattacgtggccataagaaattcaaaagcttcaaaatttcacacatactaactagtcttatttcatgaccgattggtaatacacctcgatcagtttgcggaacctgatcaataccgatacaaatatgggtagaaaaaaaagagaagaaaagtgaacgcacacatggatccactgtagagtctagtcaagcttaatcgtagattcatagctagtggtaatgtctattttggatcacaatgggatcacattcattataccaattatctcattttatcgcattctgtcttgatgccaaaaagtcaggactcaaaacttgtatgcgtatcactttaatagtccatgcaattattatagatatcaaacctatcccgttaatattattaatcccttgaaacgacatggctctgacgtcgttgcatgtgcctgcaaccaccgtttttatttcattccgttggtttt

SEQ ID NO: 2909 - DNA, 1686 bp, Glycine max
  Soy_ogl_4527 Gm13:37663715..37665400 Cluster 12
ctaaagacccatttggtaaaactccccgtcctttacacatttaaatattgattatacattcatgatttatttcttgttgttaattaaattatgtcattttatataatgaacaataatgatgttagtttccaatactatgcaatttttatagaacagtaataagcaactacgaagaataatagtaattgaacaagtagccactatagtattattttataagacttttaggtttaatttcatttttgctacgtgattttaatcattcaagttgtctttttagttttataatcaataaattgttataacttcaaatttttatacctaaaattctcaaattgttattttctatttaaatattatgatattttataacaaacttgtcatgtgaaataatttaaaaaataaagaagttggaaattaagtaaaaagtaataatgatagctataaaatttgaaggatttttttagatataagattagaatttattccgttaaaaaaattagaatttacaggagaaaagatatgatattttttagtaaatttgatattttaatttagtggttagtttttagtacgtaaaataaggtttgatcaatttaatttgttaagattttaaataataaaaaattgagaattttttataaacaaaaatcaatgatggaattaaatttacatagcgacgtaattgacctccaaaatactaacagactaaaggcgcacatatttcagactaccaaagctcttataaacttgtgaaatattggttaatatttttatcatgaaggaagtctagccgagtagattatatagaatgtgttagtcatcataaatgtcttgatattattattggtttttatggataaaaaaataattaattattttaaagttaataaaatattaaaggcttgcttaataaatatagtttatcatccatatagtctttctccgaactcattatacagatttgatctgggtgtcagcttaaatgtccacgattcttctctttcatcccattgccacgagtccacgaccttcttaattatctctttctgtcttatcttttatatgtcccttatatatttgttaaaacttttttccatcgatcactaaccctatatttggcagaggcaggaaaccggaaggagagaaaattttaaatttaaattaaagaaaagtgaaagctaggaacgaaaagtttaaatctttattttaaaatttaattattcttttattttcttttcattttatctttccttggtttgcatctattagtcattagtcatgggaaagaatgaagatagaatattaggaacataatctctagttaacacattctcttattagttttaatttattaattgctgaaagagaaatatcaacaatattttaatatattttttaatacttattttattattgattgaaatttattaaaaataataattttgatgggtttcatttttcatttaatgttttttatctcataatttatgagtggcattcactaaaatatataatttcctataaatatatgtaaccggttacgaacgagtgttagaaaaagagtgttaaaaaaatattattagcattcaaaactataaaattaagtgaaaggtttactacatggaattctcttccataattatgtatttcaaaaccattacctaatcccggatacctctttta

SEQ ID NO: 2910 - DNA, 1000 bp, Glycine max
  Soy_ogl_4528 Gm13:37673601..37674600 Cluster 12
tgatgtttaggtataatttgtacaaaatcatagattataatcttgttgttgtgtccattgtaaaaaaaaatagtaatataataattatatataagtataaattcataacatttatattaatcatttaattttaattaaattaaataaccaaacaatactatttaaaataaagacaattaatacctaacattttcctagcagtgctatattaccttgaaaaacatttgctaacagaattagtcttttttttgttgaattgaaatacatcttctgacttgaaattcccacaaaacatgggattttttttctcaattctcaataatatctgggataaaacttctcttttaaatttttttagtaaaaaggagaaaaacacaatgagtgtgtgggactcacacttgatcaagagacaatctaaaccataatatttaaaaatttaatcacgacaatgcaagagtttcatcttgaaattcatagaatgtataaatgagagataaaatcactgatgaacattaatatcatattatttctttgtaactatttttcttaaaaaaaatacagactttaataaaaacatacacttattcgttgcccatttaatgagtttattttgattttttacaacattcgttgttttggtaaataaaaatgttatagtaaacataaaacttgttatatataccaaactgtaacatatacatttaatttatcagtagtctttttatattacgagaaataatattagaatggagagacactctaaaatctcaatatcatattactactggagtctggatataacaacaatgacatactaaggcggctaataaagactaatgtaagagactactataaatacctaaagtataaacaattttatctcatagtaactatttaactagtttctaaataacaagaaatagttaaggaaattcagcttaattagttataagatatatgaatgtgataaattttttatatcgaatttaatttttaccga

SEQ ID NO: 2911 - DNA, 1300 bp, Glycine max
  Soy_ogl_4529 Gm13:37735901..37737200 Cluster 12
caaagaaggacatatttgtccatttacttactttaaagtttcctatgagttcaaggaagcaaaatatgaggtacatgaagcaattacctctattcatgcatcgagtttcttttccacttcaactgaaattaataaatgggctaattattccagttaaacaagttcacttgggctgctaccagagtatatattgaaatattatttatgcatttgtttaattaaactattctattgaatcacatgattaatgtaaaaataacacgttagtaaaactatcaaaagaataaaaattaaatcacatggctaatgtaaaaataaaaaattcctgaaatgattaaaaatatcaacacgagattaatgtaaaaataacacattaagatcttttatgaaaatataagaatttttttatatattgttaaaatttatctaacatacccaagaaaaattatctaataatatccatataaatttataatttgtgagggatataatattcagccgtcagctgggagcgaaaagaagccatgttttttatcgttaagtatacatatgtaactttataacagtctgctacaaaattaacaacaagcgcatctggtgtagtggtatcatagtaccctcccacggtactgaccagggttcgattccctggatgcgcaaattgtatagaaaaatatattaacttttttttaagagagaaaaatacattacttgaaagtaacgaacctattgcatatactctcgtctctcaggaccagaacttccttctagtctgtaatctaagagattaggcaatgtgatggcttcagaaattttaaattatgaagacaatactcatttaaaattagtaaaggtaatactaatacaattgattattttttaattatgtttcaaattatagggatgatttataattatgtatatatttttaaaaagaatcttgtcccctaaggaagatttgtccctcaatgaataatgtacttgtaaggagaatgcttaaatttattattaatagacttcatactaaaataagagtaaaaagagaaattagtgattaacacatttaaaaatgagtctaagatttaaaaaaaaaaaaaacaaacttttttcttctataaaaaacacataaggctaccttcttaatttcctcatggcaaccaaactctgttaaatgacaaacagaatgtcatgcattgattttgtggcttgtggttcctacacaagaaatttctaccgatcgagtaacacaccttctcgtgttcacattgatacatgattatagactctagagccatccatt

SEQ ID NO: 2912 - DNA, 1908 bp, Glycine max
  Soy_ogl_5417 Gm16:36363193..36365100 Cluster 12
cataattataggtatttaaatatgggacaatgaacataaaacaaaatctagattctgcgtcgggttaaaagaaaattgatgtaataggtaagactttcaacattgattttgttaataaactgatgtaggatgtgacttgattcatatagatgcatgattcacttcctgcattaaatttgagaagaacctatgttggttttcttaattcaatgttggtttgatgatgttgaatacacctaattaacattgtgttgagtaatatccattatttgagaatcaatgtaatatagttccataacttgccatcttatttttttaagccaattcaacattgtaaagaaatatttattatgtcaaaaattgatcatcttgaagtatttttcctccttatcatattttttttatgtataagactcaaacttaaaattttattaatgtaataagattttatcaataactaatttacatcaagaaaattgatcactttaaaatctctcttacctattttttttcatacataatattcaaattcgacactttaatttaagatatataaattccattttacttagaccaatgacacgatgattggtacattatattatatggctatcgtattaataaaaattagattaggaaaaatatattaataatatcattacatgtacgtaaaaaatttaaaaataagtaaatttaatatacaaaaatagcctggaagaaaaactctctttttgtcataaaaagaaaatggtgttcggtgattgaaagcaacattgcacaaggtctgggataggacttcaagatatacaaattcattaggagggctagctgtacccagccaaagcaaaaaaactaactaaccatatggagccagcataaattgatagaggggaaaaccatctaagttaaagttaatccaataaatttcataccaaaaaaaaaagttataactatatattccaaaatattaattaaattaataaattattgaaatatcaaaaaatatatttaacataagataaagtaaatgtttaaaaacaaaacaaattacaaatttcaatcattggtttcgtatgccactgagaaccttcatatataaatttgtaataaaaattagtatttgcattaattatatttttttaggaaaattacgtcctattaatcatgtttcaaaactgcttataaaaaaaaatcatggttcaaaactgtactacctgctaaatcagaatatattattttactaaacagattatattttatgaaaataatatcgatccaacaaccatttatgaagtttaacattggacaggaatgtctccgatgttttatccttcttatatttccaattgttgaaaatctgtttttaagaattttgatgtaattaaacttttgcattctaaggcacaaaattaaatgaagaacaagaaaaataaaataaaatacttttgaactttcctagttgacatctaattctaaacatactcttccctgtgttttgcattcatgagctgcatatacccatggaagacgcaaaaatcaaaaattagatatagcgttacttctacgttaattaactcggatagtaaggtgtaaaaccaaacacgcatattggtttgggcgtcccaggggttttaaaagaagggaaaagtatgtgggggttggttgggagtttggaatttagaggtggatttcaatggaaatagatcaacgtgatacaaggatagctgtactaataaagaataagaaaaatatttgataaatacctatataatataatatgtgatatgaaatatttagaaagaaaaataaaataaaagcatatgttaaggtttataatatatataggaaaagagagttaaagaaaatgaaaataatgatgaaatttttaaaatataaaatatttattta

SEQ ID NO: 2913 - DNA, 1003 bp, Glycine max
  Soy_ogl_2568 Gm08:8918401..8919403 Cluster 12
caacgagtcaataaaaaacatttaatgtaatgtcgttttaatttttttaaaagtaattattttttttgttttagacgtgaacttattattattaatgaaccttgtcgtgtattttaaatgccatttttttcacagaaatttgtatattaaacgttaaaaacttataaaatgcttttaaattcggagacaacagatactgacatttgtcatacagatccaactgaccaacaccaacactgaaaaagtggaaaaagagaaaaaaaaaaatgaaaagcattgaatgaaggtattttcgtaacgtcataactcataatctctgtctaattactattgataaagctgcttatattcattttgcgcataatctttgccttttctatttgaatgactagatatacgctgccaaattgccttaaaattaaaattagactaatctggtcagaagtcgtataaagatgcataattaaagtttccaagaataacataatttaatattggcttacattgtttacaacctaagtcttatctaactggccggcctatcatattgaaaaatgaaacccttaatacaataaactataattttattcttacacctattttaaaaaaaaaattacagtttagcaagaaataaaaaaattgtgagaattattataataacatgatctaaaaataaaagatttttttaaaacttgcatgcgacacattgtaagtttgagtctcccatctcctttaaatgatgtaaataaaagtttttattttttaaaaaaatgatgtaagtcaagggatttttctcacttcaaactatagtactatctctttttcgttgaatatattacctataaaaatattgcattctttgtttagaaatatttgagttaaatttatttacttaataagttaagtaaaaaaatgatatcttatttagaaatatacattaagttttaagcactgatcatctaaatttttagtgcatcacatattaacttatttaaataaataa

SEQ ID NO: 2914 - DNA, 1173 bp, Glycine max
  Soy_ogl_2569 Gm08:8919428..8920600 Cluster 12
ttcatgtgtgttcacttttttttaagatacactaatgtcatttgacaaatttgtaattttttttctgttttactcttaaggtagtagttaatgtgaaaaaagacctttgtcattgtggggtttactgtcaagacataaacttgtattgataaaaggtcaccggcaaattttatccactcccaaaaggataatatgatgtgatcacttccatcattgacttaagatgttaattataaaaattaggtatgaccaaatgcatactaaatttgaaaatggcagcatccaaatccagtgaaacacaggtaaatattcgagctgacgcccaaagaaaatactagcaaaatcatatagtccactaaagaggaaataaaagtgtccctaacataaataattaagagatgagacaaaaaaataaaaagcataaccatgtaactcaaaaagaagggaggagcaggatagctacctcagtttttttaattattaacagaaatattagcaataataaaataagataactctcatgaaattaaatcaaattagttgaatttgttatatatatataagcattgaagtttgaagtgttttttaatagttttaaagttgaatgttatattacattttgagtaatttgagttaagttggatgaatttataaaaagagataatttattttttccattcacaagattgagatttgagatttgagaccataaaatctttactagtttaactaacaaatgttataacttgttagttaattgggcctaaaccattctcgatcatgacttcactggttagttgaaagaatagtgatgaaaaccgaggagtcaggttgatgaggggatagtggggtgagtctacttctttcgtgtggtatgatgtctggtgctgatcatgttgaagggtgagaattaatgaatttatcaaatactcacactcgatcgttgaaaatgttatcaattgtgtttgatatctaaggtgagttggtcatacgtacgtagaatattaaccagttttagagtaatacgatcgacttcttctgtatacacgtgaactatgatgttcttggacttaagttgtatagatgtttgacttcagtttacatctgaactttgactcttctagagttgaactccaagctagctaagcctaatccgaaacgcatattttttag

SEQ ID NO: 2915 - DNA, 1263 bp, Glycine max
  Soy_ogl_2570 Gm08:8922038..8923300 Cluster 12
cgtaaagattagtcgcaagatcataaatacatagtaatttaaaaccatctaataattttctaaaaaaatgtgtggtcgtatgagttccgtccatattataaaaattgttgtaatcgtgtcggtcccttgattagaattttttcttgtttgataaagtatccgtacgtagaaatccattctcttatgttttcgttgtcatttgcttctaagaaaacttgaatgttttactaaagggaggttgacgttgttggtggaggatatgaccaggtcagagaaaaatttgcaaaacgggtgggccatgcagaagcacggtactcgtgcaatgcataatgggggtggaaatggaatcaaaggtactaacttgaagaagaacatggcgcggaacatgatgttgtggttgccaacattcatgagagagctggttgttggttggagtgtgaaactgaaacatgtatccacgaatctgaactagtgaactaactccagtttccacaaacgagccatcatcatccacgaatgtgaaattggactgaaagctggcaataatgaataacctgaggctcaaactacgtacaaattaattaaactatcaatattcggaaaaaaaaataaagataaaaaatgatttttgtgcttcaaatatactggttttaatacttacaaagattttatgttttattatattaaattaaagtttagatttttattttgcttcatataatgttagtttgagtagaattaagtctaaatttcttaagatatcgaatttaaatattgtagataaaaaagtaattgaaaaatagaatttgattaaagatggttggttagaattcttggcagagttattttattcatcgacaaaagtaattaataaacaaagtatacctaaagggaccaaaactagtaaataagcataacaaaacgtagttgggaaatgatcatgaaacctcactaaagacgtgagcatattttttcagcaagaatctgaactgttttttctatgtggtaagatattaattcattttattcgaccactagcatgcaattttgatttttttattttacttaattcataattttgaacccctataaaaataaaatagaaatatttgataattttttttcaatttttttttggttcaacgtcatgagcttaaccgttgattagaaaatgttgatcactaaattgtttacacaacactataatattaaatttttaattagattcttaggtgatttaaagcgattttaaataatttatag

SEQ ID NO: 2916 - DNA, 1516 bp, Glycine max
  Soy_ogl_3112 Gm09:35618347..35619862 Cluster 12
atattgtcattactgtatatgaatagaaaaagttattctaatttctaagtcctcatacaataacaaagtactaatcctcccaacatttgttactaatattattttttaagtttttattaattttgtcaaaataatatttttttattaaatttaatctctgatttctttagtatggtgagtatttaatgctttttaatttttcatttaagtgtattaaatgaaaatagattaatgcattgaattttttgaaaatacaatatcttattattaaaatgaagaagttctataaagaaattttcgcgtcctttttttttttattatgaaaactccgctaaaaaaatcacgtaaatcacataacatgcatattgatattattattaaaacaaactgtattaattagtgcctaatttatattaaaaacgaatgtgaatcaatgaatatattatccggaatctctgtagtaaatgagcccagaaacaagcttattgattttcatcgaaattcggcaattaacaaggtaattaagcagccgttaattgtatcgttattttttgcacataaatttagtatccactaataattgaattaagaacactgattaatttacgaattaaattagaaaagatttgtttcgttaaccactatgtagtctgaagcttttcacatttaatagaaaaattgaagagaaaaaataaaaaaaattgaatgcaaaaagtagaaaatagtccggtagaactaaaatagaaaagtaattatatttaataacaccacactatttttaagtctgtaaattttttagttttcaggatgaaatgttcttataaaataagtttacgttcatatgaaacaatactttaataatttattaaagtatatactattatcttaatgtacatataaatatgattaatgtaataattaaggtttgttttaaaggatgtaatttgttttaaagttttatatactgcacctttaatttttaatatttgtggtttgggatattttagtatttgtggtttgtagattccaagggcaaaagaaatttacaaatataatgaggaataaaaaatgtataaattcataaacttcaattcttagactttggttttgtagatcctcaggttactaaatttgcagtcttattgaaatattttgatagcaatgaaaaattcgtttagggaattaaaaatatcataatttaaaataatgagctttcactttttttctgtcttacaagagagaaaggaattttcaagatgaacattatgattttgaaatttgaaaggatgtttagccacaatatactacaaaatataattcaaacgtctatatagaaaattcaagcatcttccaaaacatatgtttttcatatttaactatgaatacatattttttctactggttaaaataaattaaaagtccttcatctatatgtttttgttaattttgattactaaaatttctcattaattattttttaagaaaaaaatcccatagtagtaagtttaaaaaatgg

SEQ ID NO: 2917 - DNA, 1012 bp, Glycine max
  Soy_ogl_4116 Gm12:37297789..37298800 Cluster 12
tatttataattttaaaatcttaaataatgtacgacttcaaaatcaaattaaaaagttataaatttttttaggatttcactaaacgaaataataaaaatcagaaaataatttaccaatttaaactaaaaaattataagatattttattatttatcttttcgtaagtatttatttaaaatttactctcgtttaataattttaaaaaaattatccctaaacaattatttacccgtaggtaagttgaaaggtggatatcgtggtttataggatggcacggagtagatgcatgtttcgagacatgtgatcaggtgatgcttttgttggtattcagatgtggatctcaagatatatgtgatattaattttatttcgcaactatatatgccaaagcaagatagatatacaaaaattgataaaaaaaatcaatttatatctaaaaaaattgagatgtgagtttaatttttagtgtgaatttgataatattaatatgtaagcatgtctttaaagtattctttaaattttatcttaattgtgagttcccgaattgaagtcacatcaacttttataaaaaaaaaagagagagagaagatatatatggcatttttgtggaacagcataattaatggtacggaggataccatttgtttggcttataacagctggcttctcaaaatatcatgccttgtggatttggaggcttagaatgccctagaaatatcatgttttttgtgtggtttttgatcggtcctcgatgctttgccaactttatgtggttctcaaggcacatttcataccatgcatcgtgcttaatttcgctgcacaaattatatagatgaatcttggctgcattgcctcggacaatattatatgaatatgatagaagaaatatattaatataataacaagaaaggcataaaatcatttaaaaaatgataaatattaatcaaatgcttgttgtgtaggaaatttctatttatcattactctaacgtgaaacggctatgggcgatcacct

SEQ ID NO: 2918 - DNA, 1338 bp, Glycine max
  Soy_ogl_4117 Gm12:37324201..37325538 Cluster 12
aaaacaaataaacgattaatgattgttatttcctatctttattatagattttattttatgagaaaaataaaaatagttatgcattcaccctataaaaagttttacatattcatccaattgtaatccattatatatagtaagtttattgacttttaaaataattattttaaattaattaaaataataatttattattaaataataatataaatgttaaacaattttacacggtatataaacatttaactgttgttttcttaccattttatattttcgtacctttgtatcactatttttaaaagccgaaacctaaatatatacttgtactaaagcccatataaaaatcggcccaatctaacccttcttcagttccttctcccaagtgaacaaagcccgattaccgattactgattactgcatctgcttcgtactaatctaggtaggtattaagaagccatttatttgcttcaaatctcgcataatcaccaaccatttgcctataacagtataatagtttgcgggttaatttgaatccttaaaggacaagattcttctcttctttcatttcgagtttgatgttcttgttttatctctttattggtttctccatgaccgagcttgagtagtttaatttcatagtttatagggattatatatatattaatgttgaaggattgattgttttccccattgttaatgttttaaattctcaaacttattaaaaaatataggagtatatgatacataagctttccttatttaattaatcaagtcaaatttcaaacttaaatttgtttcgttttaaaagttaaaatgtaaacttaatttgtttaattacctaaaactcaaatatttgtctttcatatgataaatatcttctttttttatatttattatttgagaatttgataaaaaataataacgtagagaaaatataaaaaatttcaaattaaaattaggtaatgagaattgtttggataatagtataacttaatacttataatatcgtatttctttaatccaaaattaacatgttttattgcataaaaaaaaacggtgttgttcacaagtacttttaatttaaaatagtgtcatttataaaattaagtgtaatatcaagtttgagcttatttattttactacacaaataaacactgagcatttaagaagttcacaactcaaataagggtatttgttgtgtggtttgatttaatttttgattaaaaagtcatctaaaacatacataaaagttatatgtgatttgatttgattccgtctgaatagaatatcgaattcaaattaaatcagtcttttatactttagtttggattaattttt

SEQ ID NO: 2919 - DNA, 1000 bp, Glycine max
  Soy_ogl_4118 Gm12:37327301..37328300 Cluster 12
tgttaatgtaaaaaaaactagtagtcaaactcaagaaaatgttagactatgtgtcaaaattataagatgatgacattataatagttgtggagtagagtgtcacttttttttaataattttttgttacttatagtcataattaatacaagaagtggattttctaaattcattctaataaatgtagaaaatagctttcaatacccaaaaccattattatgtcatcatcatacaaatttgacacaacccttcattttcttttgaggttgactacttgttttcatgacattaccatttcaatgttgatgatttgctctacattagttgagataataagctttcttgttaggaagcatgcggatacaggtgattaaatgatatgcaataagcataagagcgtacacgttagagtgaaggagcttgaaccaacttgaaacgtgaattttctggcttcgacttcaaatcaaacactttattgagccatgtggttcatatcgacaactgcttaattagactgatcaccactatagttataggactttgatttctgggtaatagaatttatacccatccaaataagccttttcttgatgttttcgttctggatcccagtgtttattttcttgggcaagtgatgctacgattatctgcatttgtaacatacataaccagagggaattaagtaaaggaaaacaaaagaggctatcaaagcattttcttatgagttaattttttcatttatctcttttttttttcatttctaaatggtttaatagtgacagttgatgaaaatagcaggaaataacctagtttcatattattaaccattctaacaatagaaaaatttcaaagcaaaaaaaaaaaaaaaaagctaacttgtttccaaggagagcatgaagttgagtagtggtgggatcttccagagtgacaagctgaagtttccttgttttatctctgatttgaggttgttaatctacctgagtctgcaactctttctacatct

SEQ ID NO: 2920 - DNA, 1370 bp, Glycine max
  Soy_ogl_4346 Gm13:29512796..29514165 Cluster 12
ttgaatataatttatttttttagtgaatagtttaatataatttgaatatactgtgaaatttaccgtcatttcaattatagatgatcgtggaaaatttgttaactttaccgcaattattattttaaaagtgatatctatagtaattaattataattagttgacattgtaaattttttacatcaacaataatatatgaaaatcaaactgttctaatgtaatatattaatttattaaatattttatttataaaaatatgaaaatattataagatttggtcttgttacaaaattacatttctcctttgcaaaaaagtgaaatccaattaaacattagttctattttataaatattgatattttaggctttttcttgcattagaaataatgtgtgtcttctaatttagtaggttagatgttaacaaaaaaaattaaatacaaattcttttattaaataaattatttttctatatgtgaactaaacaaaaatttatgatattttatactacaaaatataaaaattattaaaaataaattatacttattaaaaataataaataatttatttgcatgtggtgacaagtcaccactttttttcttatgaataattctaaatcttcctgtaaaattttttaagtgattcttttatttattttgtattttaagatattaaatatagagaaagaaggttatgcactaaaaagtagaactttgtatatatagtcatccaaattaccaccaccaattcatattgtatggtaagtttattgacttgtaaaatagttatgttaaagtaattcaaattgtgatatgtgattgaacgatcgtgtaaatttattttacattaccaatgcatatgcattaaactcttaaatatattatttttaaaaaaagatagactaaaatatttattttcatccctataaaatttttagtacattttttcatttttataaaattaaaatgcatcattttttggtttggatttctatgatgacgactttgtacatcgattatatatataatcgatttaaaaagttattatcataggttcaaatgttcgaaccttattttgagaaaagaaattatacatttcaattttgtgagatgaaaaaagactgaattttttgtggggactgattttggaagattttcatatttataaagataaaaaatatattttaactaaaaaacattaagcatctttatatttatttaatattttttttttgaaaatattaaaataatttatatgaaaatttgtaaaaaaaaaatcttcttcttttttgttgatcgcaaatattaattattaattttttattagtgaaaaaaattaaactgttaactttttctttcctccaacactatcttttc

SEQ ID NO: 2921 - DNA, 1200 bp, Glycine max
  Soy_ogl_4347 Gm13:29557901..29559100 Cluster 12
caatttctaggcgttggagaccaggaatgaggtcccaataagctccggtgtctctttggcatagtgggacaggcagtggacagtcagagatactgagagaagccaaggagttaggaaaaccctgtccaggtagagactctagattttggcatccttttatttctctgtgtctgaggttctgaagattccagagcaactgtggtaaaactgaaagagaatcaagattacattctagtatgtggagatcatgaagtgctgtgaacagggataatggaaaggatgaaagactgtcacaacaactgctttctatgtgcaaatgcttacgtgcccggtaatgccaggtaacatgttcgtcccaaaagcggtccaaattcctacactcagatacgtgtagtgactctaatgtctagtgtttgcgctctttaggaaaggactccagagatggacaattgcagatgaccaattcccttagacaagtattgcctcgcatcatttccctgtatgcaaaacactcgaagagaaggaaaaactctgcccgcgtctagctcccactgttcccagttaggcatttatccgaagtcaaaatttcaagggaactaaatggcatatcatgattgccaaagaattcagacttcacaactcttagacttaccattttttctctgtgaagtgttttaagatatagaaattgatcaagtggtggcaacgataagcaaatctcacaagaaacaagatgcacagaaaccatattagagaaagcagaattccccaaccaatctgggaacactgcaccaccatagtgttcaattttgaggcctttcaaatttgtgtgtggccgcaggttatcaagaacaattctttccctcctaatattatgcctacattgtgtctatttgagttccaattcatcaagaaaattcttttcattcaagttggcctcagatgcttcttttccttcagcattaaggcagatagtatgttgcttttatgagctggaagatctcacatattattttgcagtatattgttccaattcttagcttctgttttgaaagccaagagacttccaagtgttttaagagataaaggatgccttttgcatttgctaactattttctcaccaatttcctttaaggtgacagttgcttcaggatttctggttctgaatgcacggcgagcaaataactaccagcaagcctt

SEQ ID NO: 2922 - DNA, 1500 bp, Glycine max
  Soy_ogl_3594 Gm10:46883501..46885000 Cluster 12
tcgcttgaaattatattcaacattatagattatataagaacttataattaagaagcatgacgtcgtataaactataaagtgttgaatgtggtatgctcgaggtcaatgtcgttttaggtttctatttactacctcctttcatgtaaagaatacaattatttttggtttaaatccactcctggtctctaaaattttatagttgtataattttaatctctaaaaaaatataacacatttggtccttaatgtgtttaaaatttaacaatttaatttggtttattatttttttataagaaatatagttattgtatttcatcaaggataacaaataaacatgaaaaggaatattatcatcataatcatgagaattgagagccaacattgtatcttgatgtcctagctagcttaggagccacaaaattaatttgtttcttacaaaatttcaccctagagttatctaagttggataagagctgtttacaattgactcgaataatataatttaatgttattgtgcagttaatattttaacaaaaaatggtgacataacatgctaataataatgtggcattaacatgattacatgactaatgtgtaggaatgcaatacatattcttgatttcttgcacaacaagagatatcttgtacaaagtaatatgatacaacctatttaattatgagaactatgtttgtgtttgtgtgctttttttcttttctttatttggcattgttatgtatactatatatgtcttatatattgccttttttgtacaactttactacaagtcttctttttagctcttttttattatttattttggtttgattttggtaacacgagagttacgtacaataatttggtagaaaattattaacgatgagttattttaagaatttatcttttcactttttttcaaaaactatacaaatggtaaaaaacttttaaatagaatttaaaataacaagtagtttattatgaacactttttttaattcgaaataaacctccccaaattttttatagtttttaaaaaacaattcgtatactttaatttctaagataataaaatatagcttttaatacagatatatgatttaaatacacatacacattttgactatgtttaatattttataaccaattccattaaaataaattattttgtcaaactctaaattaaactagtaattaattattttgtatggaaattttagattttttttctacatacaataacaaaagtctttttttattacatacaataacaaaagtcttgactgctttaacttttaacattgcagcagaacatattcaagtagagtttggacgacgacaaaattttttggcttttaagaaacttactccactggggcgttgaaaacctaacacaaacagtctatttttttttaagaaaaaaatatatataaatttttaaactatcctttaattataatttattatatgcaataaatttattaattttttaaaaaaattaaataa

SEQ ID NO: 2923 - DNA, 1253 bp, Glycine max
  Soy_ogl_5418 Gm16:36365948..36367200 Cluster 12
ctcatatcagtaagcttgatatattaaaataattcacacaatcaaccaaacatgatacttatttcacatcctctttcttacttttaattgtcatgccctttctgcttttatttctcccttattctttctattaatcatctatatatcatatctatttttcttttcctttctttttcccactcttcttatatatctctcttctttctagcaatccatttcacactcttttataaggttgaaacaaattattgttgttgttctaatatatcttagcacttttgaattgtgggaggcgtgcaaaaattatattactccataataacatatatagttaaaggattttaactaatgattcgtatatgttttagttttctccatgacataaagtaaagtcaggtgatggatatcctatcatgaaaataaatacagtaacaattaagagcatccgaggtttggcaaaacgctccttctgattaacataaaaacataaaatattatttaatttaatttttaaatttgaatataattgtatgatctatatataataacaatatataatagcagacatctcttttttccttcacttttctttatatgactttaccaattgcacatgagatcatcttcactctccccatcataactgattttttaccccctcaactgtaaacttgcatttttatttaacttcctccctttctctttattatatgttttattttaaagaaaacgtagaagcacaaagtgtctccttttgccctatagtaataataatattttaaaggcaataaatttaaaaattataaaatcttaaaaaataattttattctgagaacttgtgcttgaagatcattatataataaaagaagagagagagagaaaaaaagtgaattaattaaaagagtgaagagtctgacagtctaaaggaagtgctcaaatttatgatataggagatcaattatgccatgaaaaatatattttaagggggcattagaaaacaaaatgaaaattgctgataattttcaagtaagagacatgcaattaattgtaggtatttttttattacattgtacaattttgtgcagatgagaaggaaaagtggcttaatttgatcgcaagtggggcaagaaaagttggtgaatgcatggcaaggctcttttggaaacatggggcaaaggtggtgattgcagacattcaagatcaactacgacaatcagtacaagatgacattggaactgaatatgcatcttata

SEQ ID NO: 2924 - DNA, 1090 bp, Glycine max
  Soy_ogl_4131 Gm12:37771601..37772690 Cluster 12
tgaagcatcagcctatacttgacttctgaaaaccatgacaaaaacatgctacatcaaattcaatcattttcccttcaccgtctccattcacagaaccacttatcacatcagtcataattgaatcctatatatccctttatttttttatattatatttttgttctaaaacttgctacaaaattcacttttaatccctataaaaatcatatgatatagttaattgatgatatgataattactttgtgaagtaggaactttccttgttatcaatgagtttaacatgatagtcatatattttttatataaattatgtttttaattttttatctttttaaactaatcaatgacactaaactatttaatgatgaattaaaagcaatatttttacatcaaacttatgctatgacaaatcacataattatcaatgttactttatgtgattaattaatgttgttaattaacaatagaatataaaattgttaacaaaagaaaagaacacaggtatcaaaaatgctaaagtttttgtttaggaattaaaagtaaattttacaaaaaaaaaaattaaaagataaaaaatgttgttaattgacaataagtataaaactgtacgttaacaaaggaaaaaaaacccgtatcgaaaacgctaaaaattttgtttaggagttaaagtaaatttaaaaaattaaaagataaaaaatataattaacctttttttcgtatgagtgttcaaaatcttgtgaagattagaaagaggtgaaaaaaataaacataagacgtgtgataatgcacgatcattatttaccttacaaggttaattttaaaactgcaaaaatccttaaaatgcaacaaatccatcaaagataaatctagttgacataactatagataacaaatcaatcttaaaaacaagtgaggaaaaaaaagatggaggagaagaaaaaaaatataaatgcatatatagagagtaagaagagttcataaaaagaaaaggaagctaagtaatgatgttacactaaacaaaatttgatcaagtataagtcttaacttaccaaatgaaaacttacaacggtagacgtttataagattattt

SEQ ID NO: 2925 - DNA, 1100 bp, Glycine max
  Soy_ogl_4169 Gm13:20426701..20427800 Cluster 12
tgtttgaatttgacttctcataaactaactactggttgacattcagcagcacttaaaaatttatttcctgaagatttctatatacattcacaatcaacaactgttcaatgttcatcttcactatgactcagtattccgggcacttccagtcccactttcctgaaacccttcccacacgaacaaaatagcattccaagcaatttcttcacaccagagggtgatcatgaagcaaatagtagaagcatttctccgcgtgttctatttacaccttcttcttcaactcctcagcatcatcaaccccaccaaaattttcccaattatgcttcaataacacatccagaagatacagcttccaagagatcatatagaccagatataaacccaaacataacaccccatatgttggggttcaattttcacacacaaagcctgcacagtagatcatttggattctttagaaacttaaatttgacgagaatgagagaaagcaatcaagcaacccgtccgattattagtactcagcattatcatacgatatcagagagaaggcgaggaaaactcaatgaaaattttcaggcacttcgagcacttcttcctccgggaactaaggtacatatatatcaaactacatttcagcacttctcttgtaatttaattagcaatgcaatgctcatagctttttgatacgtgttgttattattttattacaaaaacaaatgtcttatggctgaccggccggtaggagttaagtttatacatctgttgctgtatttcttgtctaactgtagcataatattaataatatactactatgaaaatagggagtaaacaagttaagttattcgtgaattatacggatttgattggttaataactcgttcaagctcgtttatttaattaaataaataaatttaaacttaaaactaaacttgattatttaaatatatcgaatttaagttttaaaagatcaacattaagaactggtgaataactgtcaactgtcaatatatattggtaatgttgtatatttgcataaaactttgatacatgttgtttcaacattaaagtttagtatattctttgttttgtaacagtcaata

SEQ ID NO: 2926 - DNA, 1196 bp, Glycine max
  Soy_ogl_1026 Gm03:41777001..41778196 Cluster 12
cggagtattttagatttcatgtcagagaagacccaacaactatattgagcccaatcaaaaagcaattctgcaatttaaataaagtaccttatcgtgttcatagcttaagtcaatgttttgcacaacaacaaaaaaagttaaattctagatgagtatttgtggatttaatagtacaaaatttacttttaatacgtcaaattacttcatattccaaacaaaacgaacaactgtcttttggggcatgcaagaaacaaaaagcgatagaacagagaagatgcttggatcgtaacacaataaagcaaccggaaatcacgaacaccaccaatgaattattgacattggtatgtttttttgctttctacatttgtcaattaaccttgcatgtgaaacccaagaataagggcccctacaatctatagtgatctacggctcctgtcttattcattattgtagcagagcaaaagacagaattacacagaaccgccgaatgattaacattaattaacgtgcttaggcacatgcaaagtcttaattaggatctccctttacacatgatattgaatactaaagggtgccgctataagctgtaatttgtgattctcactctcagtctactctaaatcgactctatactcttcactctaaagcttacctatgctaatttcatgtgaaactgctcgtttagcaaatcgatacgtaataaggcctcaaaagtcaaatgaaacatagcttaaatatatttataaactgcatacgtcacgggaaaggataggcttcaactacttttcttcattttttgtactataattcatttctgatagatataaataatcttggaaaagtttacgcaagtatttaaaccaacatcgaacgtgggtaggttgtgagaattatgataagaatgtatatatatttaaaaaaaaaaaaaaaagctttcaaatgtgtcaaacgtcaagctaaatggtaatggtaaaaaaaaattcttagaatatctcaatagtagtaacgggtgtgcttataatgtgtgacttgcaataatttatgtacgtacatctcactattaggtcgtggttataacgttattgctttttaccatatgccctaataaataagagatataggtttgaaaatctgttaatgggtgtggaccataaccccatttccctaatgaaagtggctagcacacgacaatatgg

SEQ ID NO: 2927 - DNA, 1600 bp, Glycine max
  Soy_ogl_57 Gm01:22601..2570300 Cluster 12
agtcttagcacagaagagggaaattggatgagctgcctccaactcgtgcaatgtcagagagaggagttgaattaaaaccacaacaaagcatacattacgggcctgtcaattaatctaagtccatagtagatgatggtccacctcaattataggccacgacccaaatatgccccaacttgctgaggtcataaattgctattaagtactaatgacaccgcaccgccaggccctaaacaccggcctagatatatggtttttcaacattgagaatgacttctttttttctttttttttttctccctaaaagcaaagtttttctgcactcagaagattaatttcggaaaaagtaatgtaccaattaaaagataattcctctcctcacaaatattgttcttttacataactagaaatcgaacccatattatatatttaaaagactttaaactattagtcatttgtttcacaccttgtgggtacattgagaatgacttcaaagactagcaaatgatttctagccacaaggcacatacattattcatttaattagaaaaaaaaatgaactgattagaagcttcagccaagcgtgtagggaggggaaataaaggaaaaaagaaatgggttagtagagtttgtaatgattaatcactgcccccactagggaaattttgaaggattcttcttggtgaatgtctcactcttaattaaacatctttttgacattgtgaactaattatacagattataattactagtaaacggttcatggtgcttctacacgtcagtcccacgagcactttcaatgttcttggacttgaaagttcatatgatatttgcatgttcttgagacttttcactctgttctccattattcatgtcaggagatagctgtagggcatgaaagacctatcttaccattggaatttggagaacgtgggctttctttcaactctgatgaggtctttggcgtagagaatttggacattaatggagaatagaagtgtgagctaaaataatttatgtgacagatacagagataataaaaatactgttgtagaaaatgtaaaatgtttatattgaattatataactcaattgatacgttgtagaaaaactacatagtgtacctataataacttctacgaatattaaattttatcaatttaaccatggcattaaaagttttcacgaaataaattaattagtttatgaaatatcatattatgtaaaaactaattaatacttcagattatattttaacctgtaatatgttatttaaaatataagtaactttttatgattaaattatacaactacaaatttgtagattatgaaaaaacgatatagatgatcattaggataaaatcacataatttaatagttaaattgataaaattcaacatttatataaaaaaaagttcttaaaaatattatttcaacatgtttgacgcgtgtcaactaatcgtgcatcaatcaaaatttgaaagatctgggagttgctacaatttttatccattaaaaatgggatgaggaaattcgacactttatcctttgattggtgttggaaaaattaattccaattttcaaatatgaacttaagtgag

SEQ ID NO: 2928 - DNA, 1700 bp, Glycine max
  Soy_ogl_5050 Gm15:14763401..14765100 Cluster 12
cattctttcttttgttcttaaaatagttgtgatttatccacgtgcccagatccatcgcattcaatcggtcaatttcatagtatgtctagcctctgtagcataattctagaaatgcttttctagaattatgttagcataattttagaaagttttacacctctttttctctcgactccatctgtgttttagttccctgcactagagtcaccgtggtggggttggatggtggtgtttgatagtagcaatggtgttgggtggttgggtggaggatagtttagtctaattgggtctctttggaggtgcatgaagcaaaaaaaaaaggagtgcaggaaatgattgtgaacgttttgtatgaacctaagaacttctgaaagtttaatggtggaattatgggctatttatatgataggctcaagtgagctctattttaagctactcctaaaatctaccattaaagctatagagaaaagctataaaaaaatgagatttgatatttcttcattgatatagctaaatgagaaatacaatatataatctaatgattgtctataacaaccatacaagtgtccttatttatttttagaaaatttaaaaataaaactaaataatattctagagataatatctaaattatctactctcttttttacaacatataaattatctactcttgaaaggcacctagacctccctagacccatcctataattatatctcaggaacttgcttgggccttggagtcatggtttgtataaaataattgggtagaaactagattctaagttagctactgatatgatgcacaatggagttaatgcaattctttttcttatttccaattattcggtcaagagttctgtgaaaggtatattagtccaatttttacatactatagagaaggaaatatggtggctggttggattgctcattttgcggttttaccccttttattgtggcagaattgtgttgatgtgtgtgtgtttttatgtagtcttggtgcttaagccctctataaaaaagttaatccatatgatagataaaagatatataaaacattaaatcatatataatcaatatttgtactattaataaaggaaataagatgttttggtgtatacacttctttttctattctatccttaaaactattttttaaaatttcttttttatctctataactactctctccaatcaattcacatcttactcacattctaaaaactaaccaatattattttttaaaatttttagagagacatagtgtctttttaaaattttttagagagacacatagtgtcttttttgccctagtatatagtaaaaacgatatattaaaaaaaattcgtgtcatacttccaactttaaacaaaacttaaaacgtaatgataaaaaacatgatgagtcgcaactcattaactagatctatgtaattgtaaatataatataaataacttactaatgaaaaacaacgataatttacaattatataatcttaatcttaatcaagctcttccactttttctcgtggattttagtgttttttgggatttcttcccttgtttccaaaaaaaaaatcttaatcattcatcattattagatcatttagattgatttatttaaatttatttaattgttaatgtaaagttagatattgaatatcacctcttactttttccacctcgatattctattaattccta

SEQ ID NO: 2929 - DNA, 1101 bp, Glycine max
  Soy_ogl_5081 Gm15:22861901..22863001 Cluster 12
cattatcttgcttggtgatgatgacattgattctctttttatgggaattgtaccaggttggcttgctctcaacacagttgtggttgactcaacacaatagtgtaggatccaccacagtcgtggttttcaacacaattttgatgttcaacaaagtggcaaatttgagtccaaaactcaactttgtagctctttagcctattaaaatacctttctaacactaacttggaccaaatcgtgagtttttctaacaaatattctcaaaaactcattgcaaaatatattcaaaactcgattttatcataagtcactatggagtatgtcctatctataaggtggttcacttcaaactgaaacttaaatatttatatagagtacacagtaagtggagataaaaacttgaagaaaatatagcaattatttacttttatcacaattcaatgatccaaatccaaatcaaatcaagccgatcttaatcaaattggttgaaattttttccaaaatccaaaccaaaccaattcaatgtaactaattcaactttcatttaccctgagacaattgttaaatggaaaaaagttagatatagttcttacgcacttttagtattgttgtcccatcaagagttagagtttcacattagtaatcaacataataaatttgtatgcatgcaaattaccaatattctaattctaattggaaaataatacaaaaagtacctaaataattgtatctaagtttttccttgttaaattcacctccctaaattactaacatatcttttttctccttccaaaatacccttttttgaaaattaattttcaaaactaaatttttcagaatgtattcgttcgctcctttctctctctcatggcttccatgttcgttcccaccctcaccttcccaaaatagaagcttgttgttccttttcccaagcaaacgcctgctctcacttcttcctttcccaaatatatttttacaacaaaaattatgttcacataattccgctgcagttaaattatgttaaattattgtgtatttgtgtaatttgatactcccttccggtcaagattataaggaaagaaaataacttttttacacattaaa

SEQ ID NO: 2930 - DNA, 1746 bp, Glycine max
  Soy_ogl_2343 Gm07:15147855..15149600 Cluster 12
gtctgctgaataaaattttgtttttttgttttgttacgcaacgcagaaacgatgcatagcatcaactgtggcaacttgttatttcaattaaatgacacgatttcataagcaaagaattattgtgtttagagtctagctacgataaacctcttgatattgtctcttattcttcacagaaaaaaactaaatttatttgctttaaaaaaatcgtatgaaataatcatgtcccttgaacctccttctaccatattttagactatgcaaaatatgcttcatgaatctctcttccaaaataattgatatttaattaaaattaatgctcatttactgaagaacatttagtaagtattaaataccaacatactatttaatctaaaatgtctttatttaattctattttcaaactcaaatatatattttttaattatggtattgatatgatgttgtttctgttcgaaatagtgaaaaatatttattggagaggatcttaaacacacattgtgaatatttttctgttgacatagtttatttcgtatttaatgactaatcaaaatttgaaccgtaaactacaaactcaactataaaagaaatgtttatgtttggtagattggattataaaaataataattaatttaaccatatttaatgttattattaaaaaaatgtcattaagttaattaattaataatttataaatacaattaataatattttaggaaatatagttccttctctatattaattcaagaaaactaaatgaatttaattaacatccttacttaatcaatgtgaaattaggtatgtttttacttatattctggatgaggtaaaatataaatgttgtttgtgatttgttgacgtattttttttaataggctaatgtgtaatgttctcctaaagatcaatcataatagttttaaataggattaacatgaaaacaaattaattactgagacttaaaatttataaaatatcagtaatttcaaaacaaataaaacaagcttctttattttaagacatccataattacaaatttcaaaatgatcataattattaactgtagctactgttcagaaaacaagaaaaacatgtcattgtccgcgcgtatatatattgggcattagggtaattttgaacatgaactgcaaaattgtcttaaaccattttcccgctaaatagcaatcttggaatcttccgcaccactcctcgcctcgggaagcctttgctatggtaacctctttttggccgattcaattttgttgtttaatcatctcttcatcgtaaatttattgctaggttcaattagctgcactgaattttcgtatattgaattatgtaatggaatagcaaaaattaagactagaattaacgcaaaatcctaaaccaaacattttaggtgccaaatcggtctatggctttctgcaaattgtgttgaggagctctgctccctccgtgtttgtgaaattgctcagaattgcaatttggctgatgtgctttgtttggtgcagttgaagaaaaggggcctctcattggaacagaagcgcgagaagatgcttccaatcttttacgagtcacaagacttctacctggtactacttgtaaaggatagcactaataacagaaatatagcagcacaccaaaatttacttgtgctatcaactatcatttacactatccttatcctttatagtatcttaatgtaaactaattatgattttataaatccatgcacagcttaggaatgtg

SEQ ID NO: 2931 - DNA, 1400 bp, Glycine max
  Soy_ogl_6685 Gm20:1761601..1763000 Cluster 12
tgtgagacactctaggcattaattattgggtgaaactcggatttgtttgattgattaattattcctagaagttcccatcggtttttgacttaaacgcaccgagttttctcaaacaggatgcctgtctcaatgtcccaacacgctttctcaaggtttaggggactgcaaaactctaaatcaaatgaatattaatttattggcataaaattttgtataaagccttctccttgcatgcatctatatatccatatacaatcttccattcatatctattctatggagtactagtactactatatttcggtatctttttatacaaaaactaaaatactagctagtggtttagttaagaattaatcaataatgttttttacattattatttttataaaaaattcttttaattatgagttaattagctttctaagttaaataaatactgtagtagacaaaataaatttaataaaatgtcttaattttttgaaagtttaactttatcttatgagaaaatacatcttactctgtctctttgtatgtatagctaataaaacttaagcataacctcaaaaaaaataaaaatcaatagccatatgctttattggatataaaaagaattgaaacaaatatttatttttttttaaaaaaagaacgagaatatgcaccattattgttagggataatttttaaaaaacatataaggtaagtaaaaatttaatatttttaattaaattaactagttttttagttcttgtaaattaattaattatgtcttagtgaaaagacccgagtaagtattagatttcctttatataaatgtttaacattaacataaatagactaaaaatatttaatggaagaaaagtatagttatatttagaatacaatatatttttagtcaatacattaaaatacatagtaatatataaattaactgaattttttaattcatacgaagtgggtagaaagagtcttgtacatacaactagctataaatacatttcataaatgaggcactctttctaagaaaaatacattactggccttccttcatttgatcaatgagcctacaaacatccttgtgtgttggggaaatcagaggaccattgttcagagtgctccacacaggaccatgcatgctctctaaacatatatacgtttgttagtatttttctgcctcacatatggacaaaacatggttgatggtttcaaggtgagagtgagacatatataagccacggaaacttccttggaatgagtttttttcaacaaagttccataaaaccccaccgaaaagaaatgctagagaagaggggtgggggactagatatatcataaatcctaatacaagttttctgatcattttttaattaaattctctgttcaagaatgagatactttatt

SEQ ID NO: 2932 - DNA, 1135 bp, Glycine max
  Soy_ogl_1945 Gm06:14448401..14449535 Cluster 12
atcacctatgtataatttcaagttctaaagctatttctttagtttgttataatttaaatatgtacgctatatatcttgccctgtggctgtctgttacgcagaataaatattcggatctattacagcttcattcggatagggaaaaaaagaaagaagtagggagagagaaaaataagaaaattatattactatatatttctaatttggtgtatagagaaaacaggatatgaagtgagaagaaaaaaggaaaaacggaatccacataaattggaataaggaggcaaatgcttacttttttttggtgaatggatgggcaacgcgccccattaactatcaattaaactcacgacaaaaatcgtgacatttacatcagccatgactgcatgaattaaaggaacaacatgatcaaaaacttgcaaaaattctgagaaatagacatcccaaaactagctctagtttgtctgtaactgaattggttgaattctctcatgacctgagtctactctaattgtcctcccgattgtgccaaatacataatactcccacaagttcattgtgtctatatatctctccaactagaaaaatccagtaaatggagaggagttttttttttttccttggtgcttgcgttgcattttgcttttctggtagggatattgtgtgactttttttatttttttttatttctctcctctctacctcatttgttatcatcagaatttaaaataggatacaatctctaaattataactttttcaagaggctctaaatttcaacttaaaacatgcaacaaataatattagattaaatattttttagtcctttaaatttggataattattttgttaattcttgaaaaaatatttttattagcccctcaaattttcaaaaaaatatttttaatccttcttttttcattgtttacggtttcacaaattttaattatatttaaccgttaaagttaattttttaaaaaatgatttttaacaattttaaactacaaaaatatttgactcgtatgatttgactgtcgtttttaacatatttgggcggttttaaagaaaaaaaaataaaaatatgaatgcaaaattgtgataatttttttacatattttgatggttttaaattatcacag

SEQ ID NO: 2933 - DNA, 1200 bp, Glycine max
  Soy_ogl_1315 Gm04:38971901..38973100 Cluster 12
caaaactcatataagagcaatttgggtttaacaacaaaatgcataaatccaatctaacacaaactgaagtattttgattaattttggtaataggtttaatcaaactcaatttgagtcatatacactcctatcttgaagttgtgtggtagatagggcttggtgtcaaaattttttttctcccttttgattttcaatgcatgtaatttttttatataattttagggaaaaaatggcattcatggagggaatatgggtagattttttcatgatttaggaaaagcaacatgcttaccttatatgctatcattctgttgtattatcaacttattattattttatagttttcttttatttctttggaaacgggatgggatgtcttcgtgtttgagttgctggtttttgctttccttttgagaaattgttgtttttttctaatgtttttgtgcactcctatgatgtcctatttggagcaaaagtgaaaagagaaactatttgtttcatctaacatccatctattgaagcataatttcgaaaaataatttctagaacaattactcattaccaaaaatacatttcaaaacttagttttcggaaagagtatttatagaaaaaaaatataaaaaaacatagaaggggtgtataagcaaaaatagggtgcaagagcaattgcccttatttaccaaagaatttcttttttttttcctcctcaaacaaacaaatatgttaatgagtgcctcagctcccttcatcttgggtatgcgagaatagacttgttggatttggagcttttgtatacacttagagttcttgctatttacactcctgtttttctctaagaacaccccggttatcctttttctacctctcaattgctcattataccctttttctaaaagaagtacaccccttttactttctagaaatgtatttctagaattacatatacctattttagaaatgtacctttagaattatgattcatagttccagagatatacttctagaataagtatatatttttaataagatatcagttaagaattaagaaggttggcagaaaataaaaaagatgataaacccttatcttatactcatgtttgttagtcttattttcatcatatcattagtattttttaaatcatatctaaaatcttattttcatcttatctttataattctttaattcctaattttaaacta

SEQ ID NO: 2934 - DNA, 1600 bp, Glycine max
  Soy_ogl_2673 Gm08:14141501..14143100 Cluster 12
ggtaatccaatagatcatgttgctcgtcaccctccatttcaaaacaagatgaaaagtttcccatttacgtgcaattttaaattcttttgttgcacttccattctctttatccactggccactctgatagaagttgacatttatctgaaccaattatctcgttgctgcctaacatatatggaaatcataaactaaacaaccaataggcaaaatcaacattacatttctttatatttgtatattcaatcctgggactgcttttccctccttttcaacgggttttccacatagctcgaaatttaaattctatctatatatgcatgacattatcaaggtatcgaggttataaacagatacaaaactttaatcaataaaaatatggtataatatggttgaaagataaccttactgtaagcatgtgattagaaattcaatttacaaatatttttgtttatttaaaataatgcttattaaaagaaattaatctcttaaatagattttagtatatcaaatgagtaatctttgaattgagagattaatctttagtttatgactaagaataatatgagtgattcaaaaaaatttgagttagtaatcagtatataatgtaacataattaaaacataatcttattccttaaacatgagatttaaggtttaagattaaatatttagatttatttgtataggaaaatatttttaaaaaataaataaattttttaaataaattttagtacattaaaagattaatttttaattttggatgaagaagttaatcttaatgtcctagatcatctaaaaaaatttggattattcattttatttattttttaaaagaaaatattaggatgttgtgttcactgttcacgtagcaatcagtgggtcaattccaatattcccctgtgcatgtgcaggggagagagttaagctttgagacgtttctacagttgaaagcggcgttctcggtttatataagaaatattagtcaatttctgtcagtgcctcttaggactttggaattcatgtagaaaggtggatttagaggcatcgttggtcacaacagattcttcccacttgtggctgtgagagcttcacaaacgcaacattaatatctcacttttgggtgcacatagaggttgacaatgaaatcttggtgaaatgcggcttcagttttcacattctaccatgcctgtaaatgacactaaattacaggcatggttgcttcaaactaggatccaaggaaaatgacaaattgtaaaggttaaataaagtggagattaatcaaaaccttacatatatatacgcatgtcaacaaattttaacaatgtacgtgatatgttgcactttctctatagaattctgtgaggggtgttggagagtaagtttttcattaatggattagaaattagtagaagggtatacggagtaatcaatacaaataggtagaactcattaatggagattgccaattactgtaattattgtaactttctgcacttgtacagcttatatcaatacaaattttactgatccaaaaataaaataaaatacggagtaatcaataagatcatgtattcaaagtgttaaagtaattttgaacaa

SEQ ID NO: 2935 - DNA, 1500 bp, Glycine max
  Soy_ogl_4023 Gm12:8022301..8023800 Cluster 12
tcgagaacgacagactatatttttatattataaaaaagtttatcttgttatgagaatattgaattccgatcctctcttataagaaagtttttctaaaaacaaaatgtagttataaaattattctagagaatgttagattcttgaaaatgatttttaaaattgtaatattgaatacaaaaatttaagggtgtgtttgataggaagggaagacaaattataagattatgtaaacaaagtgaatggaaataagttaaaaatgaaatgaaaatataagtatatgattttagaaaatagagaagaaagagaaatagaaaaaaaaaatcatttgaaatgtgttgttaaagaaataatcaattttttaaacaatagattgtttgaaaaatataatgaataatcttcacaaataaatatcatttcacatggtagcttgccattctctcattcatttttttttccgcatctcccatttcactctttgttgttttgaggagaaataaagaaattgtgagacccacatttttttttctcctcttctattttcctactagcaaacacagtatttcttatcaccactctattttcactctctcctttctattccactttatttctctttctcgtgtaccaaatcaaagtataacattttcaccttaacatttttggaaaacttaaaagaatcgcctatcaaataccccttaatatcaaagtttggttcactaatctatatttatcgctaattcttcacttaaaaatttataaagctataaaaaatagatataccgtgtcactcatataaagatttgaaaatatttaagtacttttttactttccaattgtaatgcatctaagctttagcatgcaaataatttgggtatttaaccagtctgtacatttaacaggtttcacatggagcttgtcatcaatgccacaatcactagattagttttttctcaggttagaataggatactgtgtatcatgtatccaagtataggctctagattttccatctactctgtgtgatattctttgttatgctccactaaaaactgaccagggacagaagaatatagttttgtaatgatttttattgctgattcagttttattttctgactagttaaaagttcagaatatcaatgttcacctaccttcccctctggcagatagtatatgttaaagcatttttttatgtgaacattactgttttagtatttcatatgattagttctgttcttttatcatttgctctatatattagtgtcatacacttggaacatgtcaagcattatgtattttgtgaatcagtgttactattttctaaagtgcaattttatgcaatgttaggtatttttcctggctagcaagaagttagatctgtggagacttccagttccagagatttttgtcattcatctgaagaggttccaatatagtcacttcatgaagaacaagctggagacatatgttgatttccctgcagataatctttgatctgtcag

SEQ ID NO: 2936 - DNA, 1800 bp, Glycine max
  Soy_ogl_3835 Gm11:10692401..10694200 Cluster 12
tatgggatagaggtgagtggcaaaggattccaaaaataatttgaaattgataatttaaacacaaatatatcataatttgattgtggtattgacaagttggcaatattttttttgtcgtttattttacgtcattgcttactaatcaccataaggatcctaatttccacttttatctgtttcaatatgatgactgatgaatctagggttagcaagttgactttgacatacttgtgttgtcttcatcacctgagtgtgaaatattttttttatcacgtactagctagtgatgcacgtttcggaagcacgcacccaactttgtgttatatgcccgtaaaaactacatcttatatgtaaagaaggtgcgaaatcaatagtttacacatcaacaactagtctactcactaccattgccagagctaaaagacactttcatcataatactctatgcatgccaaggtttaagaatgaaattcatatcagcgtttcataaatatatttgtacttgtgatgagacagaattcagcatccaatgccttcctgttaaaaaatggtcaaagatcatccaaaggtcacgctcaggctcaatgacctattctttattctcagccaaatggaacttgaccatgtactaatatcaaccacatcaatctccatataaaacctttaaacaatattctctcattatgagaattcccaaaaaaaaaatcctagtaatttaataattactacatctttccatggtagccaaagttccttcaattaactttcatcaatgaaacatttcagcttcaacctacgccatcctcgaactcaatcttaaacaacatattacttccaatgaaatcaatgcaatcatgttgtgctaacacatggtttcagtttaacagcttgtcacgaaaagaaaccttatgtggagggatatccaccgtttaacagtttttgacaatgaaggtatatgcgaaaaggaaagattttctttcaaatttcaatcattctttctatacactctctgtcgtgtgtgtggtagcctaatttttgtttggttggtaaggacaaaatgtgttctttatgtcctaattgttgatttgtacaattagatagatagttttaaaaaaaatctcaacatatttttagtaaaaaaaatatatattgttttaaacaaattatttgcaagctgattctatgaacttgataatgagatataaaaaatctaaatttatcctaaaaataattttttcaaaagcaagctgattcacacatgattgtaccaggaaaatgttaattgtacctcccctatttaataaatatacctactttttttaatattttctcttaaatatccttctaatttattttcaattttaaattattctcgttgattttctaaaacaaatttttttctcaccccttttcatctaccactcacccctcttccgtggctctacaactcacccccccttgcacattggaataaaaaaaatatttaaatacattttgcaccctataaattaacttttttttttcattttcttccttgtaattttttttattttaatcattgcaaaatatgtttattttatttttcattcttaaagtgttttagataacattttaaacagtaaaaaaagtattttaaatagtaaaaaaaatattatctaaaacactttatggataaaaaaataaaacaaacacattttataatacttaaataaaaaaggagaaaaataaaaataaaaacattagattggaggaaacaaaaatttatttaagccttgaaaaaaaaaatgggacgcattcaat

SEQ ID NO: 2937 - DNA, 1274 bp, Glycine max
  Soy_ogl_3054 Gm09:9994601..9995874 Cluster 12
ttgcataatttttcttacatgaagctgctagaaattcattttaaagtatttttattgtaaaaataagttagtatgattcaaattttaatttttaatccaatgcaaaaagtttcttaaaaccaattcctagttagtatttagctaataatttgcaaaaaaaaatagtttaattttatattttaacatgattcaatgtgataaagtatgtgacataaaaaaaagcgataaagtgtttacttttatattggtgatgtgtttactaatattattacctttaacatggaagcaagtcttttgagctgcaaattgacgcacattatagtgttttcagacgcgcaacaaaattaacacagggtaaaatggttgaattgaaatcacatactctttttttaaaaaaggcataatcattttactcttaaaaatttgaatcctgttcttaattaacaacagttattttcatcttcaatattttatgtctcttgccaacttctacacattcggcatttattttttttatttcttttcaaatattatttcttaaatatatatttgatttaaattttagtttttgatacattaagattgttgtgaaagggtttctgtaaactttggttttgttagaatagaattagaatatagctctaatatattctctggttctgttgttgtagaagtatatatattccactggtgcagccacgaatctcacggttcagtggaaggaatgggaacccatgacctctccctccccttaggtttcctttctcatccatccatcaagtcaggtttatatctcctaccgtcaaactccttattttatctggaatatcaaactcatgatgtgtggcagtggaatctctgatcatttccttcccatctcgtcaaatgcaataattttgcataggagtgaatgaacccaaccaatgaagagtctcattcaagagtgacccctcctctctgaatccacgcctcctcaagtgtatatccggagaaacagtacccctgaatgcagctctatgaattggtcctccaagaatggacctcctgaggttgaagttccggaaatgctagatagtcatccattgatgagtcatacccaatgtcacatacaaatgcacagttagcattgcaatttgatgtgacgtgtgattttggcttaaatttaatccaatcaaatcctatgtatttaattttttttcattcaaactaatttgaataagggatgtacgatttggtgatattatttgaactgtaaaacaaatgttttgaatatg

SEQ ID NO: 2938 - DNA, 1600 bp, Glycine max
  Soy_ogl_2527 Gm08:6231301..6232900 Cluster 12
ccatggtaaatatgaattatattaaagtttttgcccatcagttaagttatcccaaatggcatgggataatatcgcaattttcatataatattatttcacctattatataggttatagggggaaaatcgtaaactttcatgcaaatgtattttttttaggttttcatgcgaatgttaatataataaaaatttgaccgtccgaggtacaaatctcaactggaccaccttatacgtgacatgttagtaaacaaaagaaagaaaagaaactcacgtgaaaatcaaattgatatggggtggtccaattaagttttagaccatatataggtggtctataccttacaacttgatgcaatgtgtaatatatttaccgtaatattgtttggatagttattaaatcttaggaggcagttatttaaaagtttgaaattgtatatgttgttcccataaattgctacaatcctccctctctacaaccataccaaactccattggcaaactagcacaggctttttaattaaatcaaacccagagtctccatgaatggacttcttttagcatgcaaatgcaatgaatggaccttcttttaacgctcagcacaactttctaagtcgtttcatgtcactcgattctttttttctctcatatggttattatcctctcaaccttcatcctcttttgcttgcccttcttcagtagttcatgctcaaaaggacatgcttcacgtgccatgtctctgttaatactaggacttttttgcataatatttgacacgagatgatattgcaaatgccatatatataatacgaaaattagttgctttgcatacgagtttacaacaaatatttaatattttaattttataatcatttataattatattaaatagactattttacatcagtatatatttcaataaacaatgtattatgtttatttataaaaacactaaactacttgtttagtatcatgaaaattcacttgatatcaatttgattcttaaaagatttacatcctcacccaaaaaaatggcagcagtagatctgaattctgtgttcaagtgtttgatgtggggggctcggcccaattaatttttgtccattgactttgttgtctttaattaatcggctctttatcattttttgggcaattgttaattatatattcttgcgttactaagtgtacctcttttagcaattttttctccctaaaattatcccttttatgaaaacaaaattttggaatacattttgattttcgctacaaaacaaaggacgaccgacaccaacaaaggttgaaataatgaaaccacagttgcttgctgaagaagataagcttcaaatctttgaagcctgttctcttttcttctattacattttcagacaacttggtcatctagttcttttctcttttcttccatttccattcgacaaatttctcttcttttcccttttctcactctccataatttcacacaccattgcttgtgctaattttctctaataacatttatattttataagcgtgtaattggttatgcgcataattgctttgtttttttttcacatgttaaatttattatttatttttcttataataaaatt

SEQ ID NO: 2939 - DNA, 1600 bp, Glycine max
  Soy_ogl_868 Gm03:33092801..33094400 Cluster 12
aatcgaaaaaattatcaattcaataaggaaaataacaaaaacaataacacttccattcttctgctgtaaacatgagttatcacagaagaaaattgtcaaatttgtcaacatatttgcaaactaaaacaatgaaatttcttgcttaaaaatcaaaattaatgtccacatcacttaataataactaaatgatatttaaaaaaaaaaacacaatttaggcagtagcaatatcctctcttttttcaatagcaaccaagaatggtaccatgatcattgcactcttgtaagcttgagtctatatttataatagaccttgatatgttcaacatagaactacacctagaagacactttagtactatattctaagaaatcaagccaaaatgcaacagtttcatatcattactttaactttccatataattaggctgtcaattattgttattaaaaactctattacatatattataccaaggaagattcataagcattttctatgattcacaagataaaatcaaagtgaaattaaccatgtacacagaaaatccttgcaactctcacaacaacagagtcatggaggtaattttccacagaagccaagttaatatcattgttagacattagcagaactctgtagcaattaccttatcatgaatttgttccatgaaacatatcgaaacagccagaacacgatcaaagtcctaacatgatcagctgcaaaactgtgactgtgcagttcttaaaactccaaattttagtcacactaattcttgctatgttaaactcgtttctcttaaaccaaaattatatcagaatttcaccatttagtttgacagtttaaccaccgaaacatgtcaccatatacacttaacacttaacagcaaggaaaaaatcaaaaaaccatgacaacaaatttcattacaaaacaagcaagcatcaaatggtttcatcacattaagcagaaaatttaattcagctttcaggtacagtccaaaatttcctaatataccccaaaaccattgctccacttatactttcttaatccaaaatctccatttaattaataccccaattcggtcttagtatgcacccatttgccaattcaattcaacaaaatggagcagtaaacctcgtgttatcagaaaccacagcagtaggaaaactccaggaaacatatcagctatagcaatcataaatagacaagaattggtcaccaaaagatcaaaagaacatgttgcaaaactatctccgttggcaaatatatagaaccatgtgatgttaaatgtccatacacgaccttttgcaaatatcctacttttcacatgcatatggttgggatgcaaatagggtctaatagggatatgttcacatcacaagttgcacaaaattatcgaacacatccactttacaatacaattcacggataaagaattagggatgagtgtcattggggtagggactctgataggctgggcctagtgagcccaatagaaagaaaaatggtttagacattttaaaggatgggtttgttttttacaattaaataggatgggggttaagatatcatttataatgttatttagttttaattttaactccctaga

SEQ ID NO: 2940 - DNA, 1500 bp, Glycine max
  Soy_ogl_4280 Gm13:26417801..26419300 Cluster 12
ttccaaatataagactaataagaggttgatcggggaattttagtgtctaattaatttgatttttaaaaaatttatttctcatttttaaaatcaattataattttcttacaatatatatatatttttttatttttaaatgtttatatacaaaataatgaaaatttagtttcattagtcattataaaaacttttaaaatgaaacattcaagcattacacgacacgcatgcgcatgacaaaaaaactccaaaatattatttagaacaacattactatttgttacaaaatacttttgagaaaaaagattatacataaacaatataaatttttttacaccatcattcaataatatataaccattaaactcaatttattttgaggataacaaaattgaaattgatcactaatcaggtttgtgctttaagttacttataaaggagaagaaaaatctacaaattaatcacgtttgacaacatgcactggacaaattttgccttcccacttgggaagttttccttttcaacagtgcttgctgccgacattaatgtgaatttttcttttggggagagacaattatttaagcatcggatttctctaaaatgagtaattaggaaagtgaagtaattttagttattgactaaaaattaataattaatattatatttatatatgtaatatttttttttgtttagaccgttggtcaggtaaaagtaacctcacgacaattgatatttcagtaaaaaaaaattgaatgcactaaaatatcaataattaatcttttatcaatgattggaattacttattttgttcttactttatagaactcaaatattttatcctttattcctttcgcgataattacacttaaaattttatttgagaaacaaaatcaattatatttaaaacaatcattacttaaaataataatagcaatattttttaatctctataatatttgtattttgttttgttccttgaaagtatcaatctgattgtatctttattatttttttattcatttttgtcgctaactaacatcaagatttcttgttgcatgattatatgagtaatcaagattgaaaaacgatcttggtgttccctaaaaacatgaactaaaaagaacatctttgatcaatatttttttatttatagaaataaaaaataggtagtaataggtttacaaaatagtatcaatattactttaataataaatatcatactttaatgaccaaattgtcagtgtatttaacaatttgattaattagtcacagcacaaatatatttgtggacaaattgatcatttaaaaaattgtcacagcataaatatatttgtggactaattgatcatttaaaaaaatatagaaactaaattgtcaatgcatagtttaacgactaaataggttattaaattgtcctttatattctaatttcttttttcttttcatatgaatttacacttgtgaatttttttcctctgtctgtgttgaatagccaaggggtgt

SEQ ID NO: 2941 - DNA, 1268 bp, Glycine max
  Soy_ogl_517 Gm02:12713633..12714900 Cluster 12
gcattgatccgttattaaaaataaaagtttgaaacacaaataataaaatacaaaaatattttttaaatagaaaactaaaaaataagtacgtacatcaaaatatttttcaaatagtaaactaaaaaaaagagtattacatatataaaaaatatatttaaccttttattttattatcagataatacactctaatgttagttgaacctaaagaaataagaaagaaataagaaaggaagagaaaaacaatatgtaaatctttatctttatatatataaaaggagaagggtggggtgttttttgaattttaaaggagatgagtgtggatagatttggaagaaaatcaaattcgtgaagaataccttaatttatgagaaataggtttcattgtgttaattttcataattacatattataacttttctttcagttcattacactatatatatgttaatctcctatataaaaatgtatttgtgtctttcttatttaaagtttaatttgttggcaactttttaatacggtagttttgttatttaaatgacttcatcagccattctattacatctgattttgatttcgaaaattaaaagctatcctcaattgatagccaatgaatttctcattatatatacacaatatataatatgtggcaataccttgagtttgtagatataaagattttttctctactttcagactttcttgccttttttttcttttctattttgtgttgctctataaattttttgtgaaatcatatcatgttttaacttccagtgtacgagttgaaacaggtcgttatataaatcctggggggcaaattttccttctagggtataatggttattaccatgatgcaacatttctttattcctttttataatttccccttcctatatttctaaaatgattttggttttttaattgtcaaattgaataattatgatgatttccttcttgagaaacaacaacaaaggatcacaaaaggtaaattactatatgatatttatgtgaatatgcatagtttatataaacgatgacaataacatcttagatgacaataacatttccaagaataaattaaatttcatttatttccaagaataacatttccaataacatctcatttttttcttattcaattcaatttatttattttatatttttttaaaattaaattaaatttaaaaatatttccaagaataagaaatatgtaccaaacatcttagatgacaataacatttccaataataaaattatcaaaaatat

SEQ ID NO: 2942 - DNA, 1271 bp, Glycine max
  Soy_ogl_2082 Gm06:452330..45276100 Cluster 12
taagtaattaagtaatttagatgacgttcttttttactgtttaatgcattatctaaatcgttttaaggataaaaaataaaaaaaattcaaaaatacaaacaaaataacttttttataaggataaaaaataaaaaaaatgttaaattgtaaggacacaaaatgtgtttagtctgtaatttatttattgaggattagaagggagaaggaatatacaaattttttttaactattttaattatttttttataaaaactactttttttctttatttttacataaaattaaattatttttttaagaaacactgttgtctgtacgtctttacaaaggctagtaaaacttgatgcaaggctagtaatgcctatttctttctatctcttttattctacttgttgtacacataattggttttacttgaatatttttctgcaataattatatctcttagtaaacaatctttatataaatgttcatttcatttatatttcatctcatttctgttttgtatttgatttttctatttctctttaaaaaaaattcaatcgcatcacttaccagcctatactacttttttcttacttttttttttataataattctaaatcttctttctatcgttttcaaactaatcaattacggtgaactatctaaaaagtaaaacttttgtaaatcaattaatttttacctaaagtagtaggttatgactgaattaagcaaaataaaataaattattctgacacttccttaggtttagtctagttaatacatgcaccccttccaaatgaagatattacttttggtacctctatcttgacggtgttaagttaacgttacggttcaaaactcaattacaaaaatgtcctcatcacatcccagggaaatccaaaattgcccacaaccagatgttgttcattgtttgcttgctcttcctaaaatatatttcataggagtgtgagtagaatattaataaatgatctacaggaaatcataatttcatgaccagatacgttatttaagaaattcagttaataatatttaattaaaaaatcttcttagattatatttcataatagtgacggtagaataaagataaatgattcattaaagataagattttattaaatgaaagatttgataagaatattatcattaaatgagataaaagttacttaatatttacttaaatttaaattcaatttttttgttgttgtttagatttagatccccaaggagtattatttaaaatcatggatgaggagggtgtggttgta

SEQ ID NO: 2943 - DNA, 2002 bp, Glycine max
  Soy_ogl_2721 Gm08:16228099..16230100 Cluster 12
aaaaaaaatattaaacaaaaaagaaaataaatatgatattgaaaaacattagaagtgtgcaatactttattcatttaaaaaaacaaagtgattattacgaagatgttacaaaaaaaattaaaattattcttatatttatattttttatgaagcacgttatacatgcatggctaaaggcttaagccacctgaggccatggcaaacaaatagtaatggtgcataagttcacagagattctaaaaaaggaattttggatgctatgttggcgagccaatagatacacaactttgagccaacaagtaggacagtgaaagtgaagcagtggaggcaactaaccttgtatgtgatttatattgaggaccacattctaattaataacattaatggtgaggtttattgtgttgtccaggtcaatcaacaacaaattaatgaactatatcaacaatgattcgaggaaggaaaacaatccctactctaatacgcaggaatcatccaaaccatttatgtaaagacaaatgggtataaaggaagtagctcaactctactgcctgttgaaaaaaagtctgaactataagttttaatttaaaaattgacctcaaagttcataagacaggctaatttctgaattcatgatctgataaattcatatttgattaactcacgtacataatttcaaataaaattggaagaaaaagaaattaaaataaaataaaaacttggaaaatccataaaagtggtttagttttagttcatagttgttttcttttgaaagtataattttcataagaaatttcatttgattgtgcagaaagaaagaaaaaaagtaaaacacttgtaaatattaggaagcaactgtctgaaatgccacaagagaaagaagcgtggataagtgtagttgtgtagctagtaatatagtaattattttttggtaaatgatcgttttatttgctaatttaatttttaaaagaaaaaaaaattaatttagtttttattagtggaggtgcaacaataacgtttaaaaattacttttttttttaggtaactttttaaaactcaatcctaattaaaaataacgcttaaaaatatcccttttaataaaaaagcagtgattgggtgggtgggagacacgttccatggggcttcccccggattgttcatgccatttggtacatctcaatcaacttaatttttgtgttgtctctttaaaattataattaaattaaatattaacataactgtaatattgttttgaaggaatagaacagaaataatagttgagatctacaactgggtgcactgatatatactccatatattactatttactgaaaaaaatagtaaataaaaaaatgactccaatgtatacatgcctacatatatctaaaaagtacctagatccaacgctcaccgtcacttacatatggtggaaaacttgcattactttcccatccccataaatcatattatacttttttaacatgttctactatctgtatgtatttatgtagggtttattaaatattaaataggtggtaggtcttgtatcattttgtagggcctacataaatttcagttaataggaaactgttttgatgtaattatacataatttaaatgataaattttaattttgaaacaaagatcgattttttttacttcaaaaaaaaatattgataatcatgtgtattttttttcattttgtgttacttttacatcagctcaaaattaattttgattctttagttatttaatgaaggattaaatgtttcttacttattgaaattctgccaatttatattttggtatttatgaaaaagtttcatttagttactcatcaatttcttaaatacttatttttagttattgttgttagatttgcttcattaagctatgacttggtataattatttcacatgtcaatgatttatttgttgtgtcattacttaagaaatttagggaggattcttattagcgaggattaaaaatacaaactttaataaaat

SEQ ID NO: 2944 - DNA, 2162 bp, Glycine max
  Soy_ogl_2722 Gm08:16231201..16233362 Cluster 12
ttagtcagacactcaaacttcacacttgtacgatttgtacagtgtttataaaagttgttaaatagttgctgatagtaaaaaaaggagttttcaccaaaaacaaagaagtttgaaagaggagtacgaataactgataacgattaatagcctttaatttcttggtcagagtaatattttgttgaatgaaatagtaaaaacatatttgtatatcaacaaaattcatatttgtttagttgaagtgaaagttagtgaaaaaaatatttaaattaatgagttggtagataggaattgaagaaataattgtatatcaacaaaattcatattttatcacttattcaatacatacatgtttgtctaatttaattttttacaaacactttaaaaaaaaataaggcttgtaatcagttatgtctaacatgacataattaattatatgtcactttaaatgcatgtttgctttcaaattctttaacgcgattattcatgtcaaaacaaaagccacaattacttgcttatgcttaatgggagtgttggacatggagagagaatctcagatccaagttggataatcctttctaatcttttgaaaagtagtcacaagttgcataagctgggtcacgagggggctcttttggatttttttttttacagtgcatttcacttctttttaatttttatctctaattggcattggaaagctttatgatgaccacttattaagttatagtgcgtgtttgctttaaccaccatattcaagagaaattcattaaacgtacagtgatgaaacctattaaaatttatgatttaaaacaaattataaatgatagtaaaatatgtgttcaaaaatcaaaagaatgtcttagagaacattaaaaaaagttatacctgatttatcttaaagaagaaaaaaaaagttaggccaaaaaaataataaaaaatacagtaatagaaaaatacacgtacaaatcacaaattttaattctctagagtagttgaccagttttatctttcagagaaatgagaaattatataagagaatttctataaattaaataataattagttaatgaaaattaactctggtggggactacaattacaatattcctgaaaattatatatattagaacaaatatcgtataaattataaaagctaaaccaaatatcatattagaacaatacaattgttgaaatttattttaatgacttttataacaaaattaattaattgagtttttgtttttaaaagtataattaatgtagattttttaatataaattcaagaaatttatatttggctttccttacttctgcacctgtgtccgcccagcttatggcaaagggtataataatgtctgtaggtacagaaaagtggaatgagaaaattgaaatttttatttatcttttatggcaaaatgttcaaaaatgtcagagggcagagaaaagtggtatgagaaaattgaaaatcatgaccagcaaacgatggcaataatgttatgagatggaggttggtctcctccgaaattaatggtccgtttagttggaaggaaaaaaaaataaaaaataaataaataaattgaaatttaatttgaaaaaaaatggaagaaacaaaatttttaaaatgttctttattgaagttaactttttttcttccttctatttcgattttttttaattaaacaaaaaatatttataaacatggtatattcttttttatttcatatatttttttcacccaaatatatggtaagtgcaaaatgacacaggccaatgagttggcattgcatgtcttgattcagttcaagaacgtgcgggtttcaatttttttgcaacgaaagcaaaagttaaatatagcatgtttatatagcaatcaaagttagttttagacctaaaatcatggtgaaaattttaaaaacaagtgattatttgttgctttggcttttaatgtgattttagaattaattatgaaaaaattgaatctaatacaaatatgttattattcgagtttcaatttggtggccgttgatattggagagatgcgcatccaaacatattaataaattttatattggataaaagaatttatactaaacttcattagtaacccactttttaataagcttaattatacattttcctacttaactattattattttgtaaa

SEQ ID NO: 2945 - DNA, 1600 bp, Glycine max
  Soy_ogl_4200 Gm13:22084101..22085700 Cluster 12
aattcatcaattttgtgccatacgcctacatttttatgaatccttccagaagcaatattagtctttttatagtttccaatccatatttattcaaacaaaattttctaaaggagtaatcattttttaaaagagacagatggaaaggcatgtggagaagtacaattaaaaaagaaaaaagaaaacctgtttgtttatatttgtataatattctaacaaatttattataaaagaatttatcatcataatgattttagaacttgagggtttatttttaatattttaaagtgtagttgaaggtttgctgagaaacttttggctccacgtactgttttttttatcagccaaaagaaacatatatcattaaaagcaccactatttttttatagaaaaattaatgccactaataatttattgaagtaattttgtgtcagtttatatactttgcaaattagtaaattattatttttacagaattaattagtaaattcatttgttctttcgaatttttatcttcttgttattgaacattcaacaaataaattagactgaatttatatttttatatatacaaagagatatgtgtgggagggtacatctcactccaactgaatggacatagcaaaagttttcctcccaatattaattgtgattacatatctaaagttttatcttaaaaccattgattaaaatgtaataatttcatatcaatttatttatgggtttaatagtaatattaatggatgtcatttaactaacgggataatcaataacaatattgattaatggggatattatattcttcttttttattaatatggggatattatctcaattaatactattatgatatggatatgtatattgattagttttgtgttaatttaaggatcttgtgtaggacaatggattaattagttcatttctcacaatataaaagaaaaaagttacttttccgcaattaacattgattttctttcctcaattaaacttgtttaaaataaattgttgcaacgaccaattattatcagtaacagttaatagtaaatattatcttattatattttgatcataagctttcattgattagtttactcttaacttaaatcctacataagtataacaaaggttataggttctcttaacttttttattttataaaaaataaggaattttttattgtcaaaattaatttctctttttcattgcttaaaaaaatattcaaattgtaaaaataaaaaaaatcacaagatagtgattatatgataattttatcttcagtaatcaatatcatcattagaaccacaaggatatgatgaaaagtccagcgcaacaattaatttgttttaaaattaaaatcttctgttcaaaactaaaatacatcagtgtaaaaaataactaaaatcaatcaaaccataatattctcctataaaataacgttgattttttttttcattatatccacagacaatgagaatgcatttatcctattatgcatgttaaaaataatttcttatagcactgtttacttcttttgattttcaaaattaaatttttacaattccttaaataaaaattatttttcttatttccaaattttttt

SEQ ID NO: 2946 - DNA, 1241 bp, Glycine max
  Soy_ogl_4348 Gm13:29589490..29590730 Cluster 12
actttaagaaaaataaattattattttgaaatgattaatttttacaaaataaaaaataatttaaatttttttagactcgattaaccaaattcaaattaatctatttatgatggaattgatttgactaaggtaattttcacattagactataaggccatccttctgttttatcaggagtaaatgctgttataagtgagtgctcagatatcttaacttttttccctaacttttggatagatcgaattggttagacgataagctaacatatatagttgtttatactctggcaagagtagttattgactatgctagtttctttatctatcatatgattctttattgtatttctgaatttttcaataatgatatgagatgagtttcctttggtaaaaaaaaaaaactataaaattgattgtggcaattattttacttctttcttaattaacactttcatatttattggaaaattaaaatttatagacaacgccaacttctccctccttataaaaattatatagagaaacaattatttacgactattttttttagggataagactcattattctttcatacttgcttagtgcattttcctatattttctattaaaaaatgttatataaataggatactacaattataaaagaaacttctttaaactaaaaagtaaaaagcatataatatgttatcccgtacagtgcacacttataattaattatcattaaacatattcacgttatatagtctaaggacaaattatatcataaagaaatacaatcatacacaaaattatatgagcagtggcaactgacaacttattacatccggtaaaacactattgtatcatcataaaccacttgactagttattccgccatattatcattttcatcaaaaggttctttttctataaaattgaaattgaaatttcttattcatttccacattataaatcgtacgttattttatggaattgaaatttcatattcattttcaatgccaatttttttagtttaaaatcaatgtaaaataatttcttgggttttgtaataagtaataagacatcttaaatactctacaataacacctacatacgtatttttaaaatacataatcctatcaatattataaacttgatcatatagtaatttaaattaaaaattatattaagaaccttatagtctaagaatactccctcatttgccttgaggcaactacaggcctacagccctaaattaaggat

SEQ ID NO: 2947 - DNA, 1357 bp, Glycine max
  Soy_ogl_516 Gm02:123201..12687257 Cluster 12
gaccggaacaaaaactgtaattgatagtaaaagtagacataaactgtaaaatataaaatgatttagttaaaatcaattgttcgtgataaatggcttagataataatcttcattgcaatttattatttagcttgtattccaatatatatagatgtaaacgaactgtagaatttatccaaacaagcacagaaaattttgatttacattttatacgatgaagcgcgtgtttggatctgcctcttgcaccaaaaacgtgcgtaaagaacgtgaaaatgtgaagcaaatttttctagcttttgcgtaagtcccatggtagacgtggagagagaagatcttaattgacgttttttaatttttttccaaacatacgggaagtatttcttaatttcagtcaatttttcacatgtagatataataaaaaagtactgaatgtttagattaaaaaagaaaacatgtgtaggatgaaactgttggaaatgctttggagtagtaacaccgcaacactgcaacacagtttgatcaatgaaagtaagagaggcaaaagtctgagacgtgtgaaaaatacactgtttttaaggatttatttgtgtagcttaaaaatcctacaggattttaacatacgtactcttcttaaggtagcacaaggcaactattttttatcaaatatgtatccaagaaaaactgatttttgtaccaagggaaagagactgtcgttctctccagatttttctatatcaaatctgaattttttttaaaaaaaaaagctgatctcattttgttagaaagagaacttgcttttccaaaacaaaatctggctcaactactgtgtttgatgcataaaaaaaatattcaatattttctagaataacgttaacagttttttttttttcaatcaaaacaactttgataacaaacttagaagagaacattcaatttaaagataagataaaaactgaaagccacgttcaaacggttcaaaattgtaaaacaacaaagataataaaagactcagtcaaagatatttttaatctcaacataaaacttccgaaaaagctccattaattatattgatttaaaaaatcaataaattttatgaactttgaaagcatttgaataacacttagcaacgaaacactttgccacatgaaaatattaactttggaaatatatatatatatattattgtaatttatacaacagaaacaatacaagtttatcaaggttaaaatgcattagaacaaaatcaaaattattgatatcgctcaagcatgtcttatgagaacaatgccactttagtctcataatcaatgtcactcctcttgcatccatagaatagaggagttgggaattatttttct

SEQ ID NO: 2948 - DNA, 1033 bp, Glycine max
  Soy_ogl_3113 Gm09:35662401..35663433 Cluster 12
ttttatattatgagataagattgatacaaaattcatacacaatcctatcatatgatatttgaccataataagaagatccgcttatttgaacacaatcttttatgatcatattttttacttataaaaaaatcaatacataatttacacataattaatcttattttatgaaatttgaactaaagaccttcccagctagttcctttagtaagtgggagttaactttccaagaaagggttattatcttctttttctcttactagtactttggaatgataaaaaaaaagaggctaaaagaaacaagaaacaagacgttcactattatattgagtattgactaggcacagtagtattttttagtatatcagggattttgacaaacatatcatttctggacatctacccgatcacaaatttaaacattaacatatgtgaagctctaaatttataaaaataactttttctttcttacattgatccaaatatatatagttatgaatttgattgtggagattggtatgatcaattgggttgtcgttctatacttgtttagtgcagagatacacgcatgcatgcagtctctttagttcacccgcaggaattcaaataaatatataatttaatttcataaagatattaagtgggttgtcttaatctttcaaagtttatataaatataaattttttcctaaaaggaagaataaattagcaagtatataatttcaaaatgacgagcttattaactaatgtgttgtctcaacaataatggttggtcctagctagaaaaaagattgtgatagactcgatcactcaaaatgaagcccggccacgttatatattgatgtaattgctaaataaagcatttaaattgcttttttttttatcactgtaatacaatgatactataattgttcccttgcttatggaaacatattcatgattgatttagccttgtttcacgaattttgtttatataagcaaaaattagaaaaatgttttatttaattttgattcttttatcattacgtcactaatag

SEQ ID NO: 2949 - DNA, 1900 bp, Glycine max
  Soy_ogl_4199 Gm13:29001..22072900 Cluster 12
aaagttggtctggtaatgtctcgtaaattattagatcaagtttagattcaaacaaatctctatcaaaattataggtcaagtaattaaatttgagctcaatgctactttttttgtgtgaatcagatgggctaacgccccaagagagaaaaacagttgcagaaacatatgttaatacaacgagagagataaaagtcaaataaaatcaaacatcctctgaccataatttgtcaataggtcagcaacttgattcgcttcgtgcaaggtatgagaccattgtaaactccctccaatgcaaatgaaatgaagaatccgttgaaccatattgggccacatgtaattccggatagctgtgaattaaaaaataaaaaataaaaaattaatcaccacctgagaatcagattccattgtctgaatcctctactccaagcaatttcaatacgaaaaaatgggggagatatgatatttcttttgtaaatttcaaatttccattataagcttcgatcaagacaccgcataactacaagaaaataatttattggtctaagcgttactaaaactttagggatgaatttttaaaatttacatataaattgattcatcactaaagttaacctttttttaagcacttcaaaacaattactatttaagtgtttgccatcataaaaagtgagagaatgtgaagtatgcttgaaagatgatgaaggacttgaagatcttttgaatcttgatgattgaccacctcacactaggtgtgatggtttgatgtaattttttgcttatatgtgtgcgatgtctcttaaagttttttttttttttttgcaaaaaaaaatatatggcttttaaaacaaacaacattagaaaggataccaattaggttagcactcttgttattgctgttggaaagcaacacaaccaataatatattccaatagaaagaaagacaaaacacggggggaggggaaattagaccatggataaaacactaggtgtcgcttaaagttattaattagcttctcttatgtctaatcaacgcaattttgaattaacattctcttaggtgtttgattattttttatttatgataaacatttcatattgtcagtcttgtgacttatgctaagccaatgctaattccagatttaacattgacttttttcttatcattacatttaacatttaacattcacttttgcactacagatttgaattttgaccagcttttttttttttttgcagtgactactatgggttacactaattattacatcatgctttttttaaagaattttatcctaaaacctattgttgaattgattcttttcttttcaaatcgattatatctacgaaatcttgtattaatatacattaaaaaaatggcatacgtagtatatgctttaaaaaaatataaacatatgcactctttggttacatatttatagttgctgattttttaccccaaaagtcaaaatagtatataattattataattaacggttggatcgataaaactattgatagtgtattagcaacacattcttatatgccgttttcaatacctcttctcttattggttaaaatttatattggtattactagttattagttttgaaatagaacacacaaaatagagaataagactcattattaaaataatattccctagctatgttctatataagactctcttcaaaaaaattacttgtccattttataagaccttttctctaattttttcttgtattaattatttttttaaaaatattcttagttaaaaaataaatgctgaaaattaataagataaattctttctctcttattagaattgaagaagatgaatagcaattaggtgggaagtaatcaagtagaaagagaaatatgattaattttaaaaatgcttaaa

SEQ ID NO: 2950 - DNA, 1496 bp, Glycine max
  Soy_ogl_4201 Gm13:22119201..22120696 Cluster 12
agtggtgtttaatcatgcgatttttgtatacattttcttacatgaatcttgaaattaagaagttcacaacccttgagataagttttggctttatatctctttcgcttcctttctcattataaattattctcgccaatttcaaccttgttggaagcactatgcagacatttattcgcagaagcctctgctaatggctcacaggttggttcaaaccagagtcatgtttcgcaagtggttcggtctctgctatcttcattcactattcaagttttgctagcattcatcggagcaagcatgtggtgccaacgaatcatcgtgaacgtcatttccgttgctgatttcctaacagttgtctctggaaatagaacatgaactacaccacaataatattagaaaaacgtcattgttccagtcttcagcaaaatgcataagggaagaagcacgattagggttccagtctatgcttcccatggatcatgccgccgccgcatgaagattattaggaaaacaaacttctctttaatattctgtaatggtatatatataattcagaagaagccaacagctagtcaaaccatttaaattagataaatgatggtgattatctcctggttgaaatttattgttaattgttagttttggtcaatcaagaaaaaaatcattaaataataaataaatcctatcaaaatccataatttttgataaatttttattaaataatagagatagtattaaaaagaaaatatcagagaaaaaatatttgtaatatttctttttaaattaaataacaaagtcatgttttcatggaagacaacttcaaccatttaaatttaaaaacaaatcatatatttaaactcgattttaattattaaaaaaataaaacaaaaattatattttaaaatactacttctttgttggaagtattttttaaaaaacgacttatctatctctagtaaaaaaattgaaattccacccattttgataattttttaaataattatccccatcacgtaaaaaaagtctagatttataaatgtaacacataaaaaaaataccaaataatgatttttttaatgttacattataatttggataaaaaaactaaaatgagagaaaattttcaatatatttcaaaaaaaataatatagaaaaaattattacacaattgtatatatagacttttttatataattttttggactactttctaactttagaacatgtgtcacacttctaaaatggggaaagaaaaaaatgaaattctccggtttcaattttgatcaaagctctatcaggaaaaaaaaatgaaattctccgatttcaattttgatcaaagctctatcagccactagctaggttcttctagtttgtttggataatttttttctataaacattcaaacatgaaaaacaaatgtaaaatgtgttaagtttcttcgtcaacaaaattcaacttaagaatcttagctttaattagaagaagttaaataaagagag

SEQ ID NO: 2951 - DNA, 1231 bp, Glycine max
  Soy_ogl_4661 Gm14:4931857..4933087 Cluster 12
gtgtaattctaacaaaaaggtaatattattgtgaaggttagctggtgttcttagaaaattggctaaagaataaaaactgactttttattaaaaaaagtattactgatacacctacatcataatttttaataaaaaaatattattaattgcttaattaatactgtgatatgacgacactgacaaggcaatttgtaaataaaatatagtgtatagactaaactgtaaacgttaattaaattttgacatttgaaacaatttagtgcatgcattttcttaatatttgaaattactacttaatttacaatgtaatactaatcaacaaattgcattaattcctaaaaataacaaattccatttaatatgtgcttaatttaccataaaagggtgatgtagctttaagatgagtcaacaactatgtaatgttctagatgagagtcatgcaactttttcttgtcgggtatataactatatatactattttgtacactgaagttgaatttatctgcaagggactgcaataaagcatggttcacgttctcaacaaatacattatccattttttatagtcacaaattaatgatcaatttttatcaaagaatctgaacatctttgattttgaaaaaaaatatctttattaatatactttttcttttgcatatttatcgttattaaaaaatataatggaaaatatatagctagctatatatttagaatccgtaataaaaataaataatttattcaccgaaaaagcttttctcatatgaagcactaatctctttttaacttataattagatggggtaatcattcaaataaaaaataaatgaaagttgattgctttttgttttcctattataaaatccttctccgcctatttgtgcccttcctccccaaagcatttcggcatctgttattcctggcctcaccagtgaaacaaagtaggacaagaacaccttttgttaggatattttgtatcgatcatatttttttattcataaaatttaaatttaagatttttttaaaaaatttgaatataattccactcatactaacaatatgtttacaatatattatattaacataattaaagtgtaagtatgcaaaattaaaactagatcgattatttatattttgacgataaaagttatgtacataattaaattttagggatttgagattatttttattttgatttttttacaggaaaaaatgttaataacaactaggaaaac

SEQ ID NO: 2952 - DNA, 1628 bp, Glycine max
  Soy_ogl_5333 Gm16:7039373..7041000 Cluster 12
gtattaactaaaatcaactataataacttcatcaattattttacaacttaataagctataaaattagttttaagtaaaattataataattttaaatagttttaattatttaaaaaaatacatatatcaaagtttactttaaacctaaatatattattgcgtcggtgttgtgtcaaggattctgcttgccaataaatgagcaagtgatcatcaataatagaaaccaaacagtaaagctttctttaataagttcaccaattcaactcaattattgaggttaacagtaaggacggagatttatttgcatgggatatcttatcatatctttacgaaatgaatatgaatccttaaatgcgtgccctacaaaaagatggaacggagaaggtgaaaacctaatcgagtatctgccacgctagctacaatctcataaaataattataattgttctttattcttcttctgtcatgttttgcatgtcatgtttgcttggatttccatcagtccttgttatggttgcagtggagaactatggcttcatgttttgcatagtaggtatgtacaatgggaatgcaagactcgtaccattatatacacatatgttacaaataatttctattttgtttcactaataaaagattatcaaactcaaaaaattacataaatttgttacataataaaaaaatattaaaaaacttattaattatgtacaccatcaacaaaatactcttaacacaacaataatttaatattttaacttataataaaaccaaatggtaaatcacaataataaaatgtaataacacattaatactaaaaataagatcaaaatatataaatgattaaattagacataaattagtaataacatataagttattaaaatgaaaatattttaaaaatgaattgattttttcaaatttttgagtcataatagaatattatcgtgagatctatcaagaataaaaattatagttgattttaaactctttaacctcacttgacttgacttgagaatttatgtgagttcatgagaatttattgagtttatccaaaaaaatattattagagaattgagtcattttatctaagtaaactcacaaaatcttaaaagttttaaaattaacccgagagtttaatgatatcctaatgatcccattactcatatatgtaacatgttttagccaatgattttatatcccaagagactgtatttactttttaattgaagtagtgatgatttgtttgttattttgtaacttccttaaggtaaagtctgtcgtttaaatagagtttacgagaaatttttcaaaatttatttggccttatcttattaacttgaatatatttttaatttataaaaatgttatttttaatttagttcgtatttaaatttaatttatttttgtacataaatataacaaaacagtacgtaattgttgtaattttaaaaagactacaaagaaataaaatttgcatatatagggtttagttttaatatttttaggagttcaaaactaatttaaacctatcttaatatataaacactactactttaaaaaattaagtgtttagttaaatttatgaaactaactacagtggctaacttataatatctttgattattttata

SEQ ID NO: 2953 - DNA, 1400 bp, Glycine max
  Soy_ogl_2724 Gm08:16260901..16262300 Cluster 12
agcatcaattttaaaatatgataactaagaaagattgtgttgtacttgactgattgttcatttcttgttttttatctgcatatcaatgtcttggtctcttcaatttcatgtattaggtgatggaataaggataacttagtgggattatgttgtgcttgttcatcacatgatatttcattacaatagcttatttcattaacttgttttgcatgcggctagcaaatcattggcttgtagtatgctcatgatttcttgcaaaattatattaaaatgattagttatgaaggatttgacaatacatgcattcagctttatcactataggtttagctttcaactagtatgcggtgttaccttggtgagtcaatgattttcttataggccctaaaactcttgtctaacgtatacatgctcttttgctattcttaggatttcttgtacttaggatttagtttgtggtgggctgggtttttcaaaaaaatccttgttgagagtttaggatttactgtagatgtggtggtggcttgtaaaccttgtccaagcgtctctattaagctatttcattattcttccttgttagtttgttttggcagtttttttgttttgtaatcggtatgaatggagagactaaagctaatcaacacattttaatttggaatattttgttgcttaagttccaggacttaactcattaactagtggttctcctattattttataggatttacataaatttatataataataaaaaatatattgcgtaaagtgtgtgtttttaatcttgattttcatctcctcacagcttttcacatacaaaacaacataagtacttagttggattgtgtgggtcgttgcattatgcgcaggtattactatcttccttgatcaaaacataatcttactcaatacatttccttaggaaattatgtgacagctatgttagggtggaccattttcacatgtaacaagaaagtggaactttaatacaattttataattttaaatctctttcatatatataatgtgaattaaatttgtgtgatgtaaatggcttgaaaaaaaaagataacaacggttaaatttgtgaatttttttattttctcttcctgaggcctctttgattttattttttttgttctctaattctctgtgtgctttgagattggcataaaactggaacgatttttttcctatgattaagtgatatagagtttttttattgtttgtgtgtgtattgcctctatttaacttgtcatttttgtcttcaattttgaagagctaccttacgtgttgattgaaacaatacgcaaaccacaccgccactaaggggtttgggtctcatgaaacagtctggttgggactcttataccatggataaagagatgaatgagttgaatacgc

SEQ ID NO: 2954 - DNA, 1104 bp, Glycine max
  Soy_ogl_3529 Gm10:44108597..44109700 Cluster 12
ttgttcatttgatgttttacacggtttgtcaaaattccaaaaaaaattctttaattaatacaacataatttactgatgataaaagtagttaaaataaaaatatgagttttaattttaatataaaaaatcaaaagtgggttaattgctaaagaatatttgttttattggtgatttaaaagtatcttatcatgcctagctaacgtcgattgaggaaatttgtgagaaaattaaagaaaataaaaattaattctttatcaaagtattaattagttgtgatataaaaattaagacatgtcttacaaagggatttgatagagatatatatattatgacctatgataaatgataaaaaaaatttggtctctaatataaaaaatcattgttggtcttgataaatttaaaattttatttcttgtctataaagtattatttaaataattttatttcactgtttaaaatgctatctaattaaacatttaatattttttttctagagcattcttttttttactgcaccatagagtactctcagtgaaagtagttgttattgaataataacaagtaaatgaaaaaaatctaattaattagatgcataaaaatatactaagttacataatacggtatattttataaaatttaaaatattaattacattttgctattactttgtcaaaagactcaaaaccttaatcctatatttgatagagaggaaaaaaaataaaatttaaaattaaaattaaagagaaaatgaattgttttttaaacaaattattttttgaagtcaattttttttttctgatttttctttcattttctcttcaaccaaaaaaaatattattatgcttgtttattttgctctcaatttttttgctttcactcagtccttcctaattggagtacatttgttagttttgtttggacctatacgaaagaaacgaagtgagtggttttattttcactggtccaaggttgttggagtaacacatatggctatctccgtcgctgggttgccaaaccagtaatgcaatttgtctttatcacttaagttatgagactgcatttaatatgccaagttggctacagtaaaactacctgcagcaaccg

SEQ ID NO: 2955 - DNA, 1199 bp, Glycine max
  Soy_ogl_58 Gm01:2579502..2580700 Cluster 12
aaaacattcaattttttaaaaaaaaaatatcacgtctgtggcaactagcaagtaacaactaaaagcaatgcagccaatagaaatagtaatttccgctcaaatatgctcattttgaagatgaaataaatagtattagtatttctctgcacttcttcccatttaggtgcaatcagattaactgcgcacacatcgtaacatccactcatttctttgctattctattcttcccctctcaatttagccacaaccaaaccacccctatatccgaatggtgaaatctgttgtcacttttcccttctactataaaatgaatgaagctaaacaattgacattgggtaactatgtaacctaattcaatctaaaatattaggttcaaaggttggaattgcagtggcctagaattttgttcagtcacggcaattccaatccttcttttgaagtattattcattctgactactagctgtcagtttcttttgtgctttattactaccagataaataacggatatcatagggtcacttttactagctagatgtgtgtctgcattttcttggtctagcgtgacacgagggtctccttgaccatgcccattaaatgatgatgctttattactaccatgtcctctgatgtaatgcagaggaatctgaagttcgtgttccaatgcaaacaagaaactgtttcaattggcttaattcctacgaatcagaaattagtagtagtaataatacacaacgtcgtttgttgaacggcgtttgccattatattattaacgtccaaatttacggtgggaaaggtaagtttataatatgctacttctactattgtttagacacgtatatattatgattgaggtagcttaaaatatactggttggtaactaggtattcgaattcgaggttcttggtcatccacttgcactttctgtgttataataaatcttactacatttattaatctacgagaaaaataaaacagaaacaaaattcataatatatcttatataaataagaataatgatcatttaatacctttaaggttacgagaaatatagaaagatatacgaatttgagtgcgaaaaaaaatataatttatataaaagttagtaacttttattataaatatttttgtgtgctttcttagaaacataatgctccgaaagtacactgataaaaaaaaaatactacgaaagtacgaaag

SEQ ID NO: 2956 - DNA, 1720 bp, Glycine max
  Soy_ogl_1688 Gm05:354731..35479200 Cluster 12
gacactaagtcaatcttataattgtttcatatttttaagtgaaatgaaactaattaagatcttttctagattttttatactcttttcgtccctacttataagacataattgactaatttatccttattaggaaacttaattaatttagttattaacattaaattttcatataattataatattttttaaatttatccttaacctgagattctattatttttcttcaatctccataggaaagagaaatagattattcaagatatttaagtcaaataatataacagaaagataaaatgaagtcttataagagaaaaaaaaattattgactgtcttataattgggacggagggagtttttttttttctaaaccataagtattttttgctgaagtgaattttattcaagtcaggtgtgcaatataggtgataaaattcttcctccaaatatttaacacaattgtatttcttttattagataaactaatgtatttaatgaaattgttttttatacgcatagttataaatccgaatctgagttgtgaaaatatatgaaatttgaattgataaattataatgataagttattcagaagatatgaaaatattttttttatctgtttgagtctttgagaagatgtaaaattggaaaatggaagatttaggataaaaatatttaattttacgttcagattttttttgttgaatattaaatatattataaagattatatcttttggtaaaagtatattataatcatgaaatttccttcaaacagcatatattaatatgacatagatcagttttattttgtaacatcaaatcatgctgaatcggtaagtcgtatcatcttttgaagaggaatctcaagtggttgaaatatatatcttaatataataatgaggacataaattattggctaaattattgtccataatctgcaaagtccagggcccaaaaggatgttgttcttgattgaggctcttactacaatttgatttagtggttaatatcatattattaattctgattacatttttcctccaatagtgtactattatagaatatataaatcctcatcctttgtccacttttcacttcacaagcaccttctagctagctccatgtagattatttgataactaaagtatcatttttgttttacgtttttgtatctcaaagatgaaggtcatatttgccgtacgtccttctaaactttgttattgcttcacctaacttgtgtgctagagtaaggcctgaggcaagtcctagcttcaatgttgttagctacggagccaagggggatggcaaaactgatgattcacaggtatattttttctagtttcatataattaattgtctttataaatgaggctacattaaacctatttggcaatactacttgtaacgtgtgcggtgcaactcaggagactgcaacacttgacataccagggggaaaaacattcatgttgcaacctgtgtcgtttcagggtccttgcaaaccagaaaccatgctaggaatatcacatttgaagatattgtggttgttggggttaagaaccctctgattattaaccaaaactattttgggcttgaagaagaaagtagtggagaaggaaatgcagtgcaaataagccaagttacttaccgaaatgtgaagggaacttctagtgtgaaggatgcagttgtactgaattgtgatcccactgtattggacgatatttg

SEQ ID NO: 2957 - DNA, 1381 bp, Glycine max
  Soy_ogl_3373 Gm10:5319241..5320621 Cluster 12
gcacgcgcgcctcgcgttgattcgacccactaagaatgagttggtggagggttaataatggtactatatgataacattatgcgaacaacatatagccaatcttgttatatttggtaattggtgctgatgtggttaattacgtgtagtccacattttttttttacttgtattccacatttaatgtgaactcctttgcttgagcaatataataattgttttttgggttttatggtacattgctactctaataagaactactttgaatagtatatatcatcaattttttattttgaaaacccatttggctgtgatctgtgttaagactaattaactcgtctatttaatttttaagcatgtttcctagagaaaggaagatgactgcttctgtgtcttattatagtgcagggaaaatgtaaaatgtttcctcatgcaagtgattatcgcttcggttgaaacattatagttcgaaaactttcaaaattaaaagtaaaataaaataaggaatccactgttgagatttttactcgctgtattctttttctttttctaatgtttcagagcacaagaagactctttaaatctccttacactactgtgaacgtgtgtgattacatgctgtgtacgtgtttatcattagcttcttgcttactcactataaaataattaaggagtatttcatagaaattagtataagagaagagaagtgatatgaaggtacgtagtagtgtttataggtatgagagaatttcagttatgattatgtaacatagatttttggaatagaattagccaacttattgaatataagaataatatatatgaagtttgacgtgtataatacaggctatcaagttaaaagcgtgtcctgcaacttgagagacacaaaaatttcgaatttcctaattggataaactttttattggagtttttataaatagaaggcaagcatatagataagattaaaaaaaagaacataaaatggtcgatttttattaaaaccagtaccataaaaattgagactagctaccagtttaatctctaatagacagatttgtgtcagttcgcatgcatatatctagtttcataagtttttagttcaccaatcaaacttgtcagtttgatccgttagacgaattaggatagtttttacgtcacacaatgatttgtttagttctaaatttggtaattacttacttaagcttgtattatcatgttacttcgattataaggacaggtttagattcagcgaatgaattggtccgaacaaaattaaagactacaacaaaatgaaaacattacttgttctgcaaacactccaaattaattacagtaatatctaaggaatatgtaattatattaagcatctgtttattttatttag

SEQ ID NO: 2958 - DNA, 1340 bp, Glycine max
  Soy_ogl_4175 Gm13:20912061..20913400 Cluster 12
catcatgtacatatatattttgttaattactcaccaatattagtggtttaaaatacctcagagcaagaaaaacctctactcacgtcaaagtttcataaaaaaactttaatggactcttcatgcaagggcgccatggcgcttattaagaagtaatttacaaaaaaatgctcaaacatgagcgtatgaaaaaaatattaggtgaatctagattcataatcttaaataatgtttgtataattcatatttaaattttacaatttataagaaaaaaattaataacattaattatgtctcatacaaatattaacaaggactaaaatttttttttactagacaaggactataaattctatattctgtaatagttaaaatctgcctaataatttcccatgagcatacacccgacgtagtacgtactttctggtttgacgttaaaggtttcccgtcaaatgtatctgttttataaactaaacaatgcagataataaaatgaatttatatactctttgaacaggaaattcgttattcgacattattgactattatttgtctcctcctttgtaataaaagttttaaaaaattacaataaataatgataacataactaaaacgataaatatttgataacacgaagcaatgtcttctcgtgctatagatccctaatcaatatgttatgattaagacacatgtccttatccaataaaattaagctatgaatattttatttagttatacatgtggtccaaggtttataattaagctataggtgttttaattatacacgtggtccaaccgtccaagttatagaattagataataattcctttaaaaagataataattgaaaaaggcaaaaaacaacgaacaggagcaacgtggctcatacgcaggaatcccgttagcccaatgcattagaaatttagaattagacaaccccgtggaagaatcataacattattccaatattaatgggtcaaatcgactagggttgctctcgtagtccaatcctatactagggtttacacatttccttttacataaaaaattaaattcactttctcctcttcttcctataagatcatacactaataacaattaaaaacaaaatcatacaatttcaaaagtgtaaaaataacattacaagataaacgacgtgctcaacacaagttcccctgttatatatcaaagtacacgtctcctatatttcactcatcccgtctttgaagcaggccacacgtagacgactttttttttaataaattatttcgtaaaaataattatgaaaatgggtgttttataaaactatttatttgttactggtcatttttatcagctaggactt

SEQ ID NO: 2959 - DNA, 1314 bp, Glycine max
  Soy_ogl_4213 Gm13:23137801..23139114 Cluster 12
tgattattttttaatctagagtgtatgataacaatgttatataaatttagaaatcaaaatgagtgtttactcccgcaaatgtcaaataaacgataaatgttcatataggtaattttgttttttttaacaataaatagcaacaaaaggtaacatgaacaggagtaatcagagctgaacaaccaaatccagagttgcatgaaaggcggcgaaaagaataccttcccgacgtcataaaaacaaaaacgaataccaatcagaagatgatcttcacgacctgttcagtgttcacatatggattaattagttcaaatatagggccagtttattcaaaattataagcaaataacttttaaaacaatgtttttaataaatatataggatttattcttaaaactaataaataaaaaatttaagtagaaaaaaatttaggcaaacataaaaaaatataaaactttttattttattaaaattagcctttttttaataaataaattcacacattaataattttgaaggggaaaaaattgtaagagttgttttggactaacaagctataagaccagtagttaagtttccattttttcccccctttttgatcagttcaatggaatcacacgtactatagtattttcaagcgatatatagttccaccccccaaatcacttggagtttatttagtcccaactagattttgttgtaacgggtaagtctctaaaaatgtacctatggagaacgatagtattgatactaattagagaaaaaatatacgacttttttctataactatttttttttacaaatatatatatatggataataaagaagtatgagataagataattaattaagtaacatgatgataaaaaaagagttataaaaagtgtgtacaaacgtaatatcacttatgttattatatatattgggcaaagattagtttgataactggtatgcatgagaaaataagagaaaagagaaatgttatatgatgagaaaagaagagagatggaataaaacaaattacccctgtatatgattcaactcatttaagtattatattacatctgcccgctagcacagaaaaaatatatgcaaaaagcaaaaccgcgttcatcatctattggctataacattctatatgacattgtatgcatgcatgattaattactaatatatgacattgtcaacgattttattcgtgatatgcctctgggttattcatgcatggtcgctgcagggaactgtgcgtagaagaaattataagataataacaataattctaatccacctcaaaataagtagtgttgtatttgaaaa

SEQ ID NO: 2960 - DNA, 1476 bp, Glycine max
  Soy_ogl_1981 Gm06:16123301..16124776 Cluster 12
cttttctttcactgtaagttctctctcatttgtctaccaatttagttcatggtttgtatcgctttaatcagcttcataccgtactcatgtcacatttcttcattttttcgaacgattattactgatgttactgttctagagtgctatttagctttcactattgattttgaatgtaatttcttgagaaaattagaggttgcatgccgagttgttaagtgaatggcaaggttttaaattgcgattgcggtttcatggttctccttgatattgcgggctagagttttaaaaatggtccacaagggtgacttgggttgcaggatcaaaggttttttaggtcaccgtgaccacaactgcatttgtctgcaatttcctacggtatcaagaatcatgacgaaaccaaagacacaattgtgaatgcaatttaatagcttgattgggggaaattgtggataaatgcagtcacgattatggttgccttgtagtcccggacaccccaatgtcacaaatctaaaagtgaagttacatgaatctaaaatcaatagaggtatcacttttttggatgagtacagagatgtttaacaaattgcactactccctttttgttttatttttggtttaagatggatagaccaaaaataaaggaaattattagacaatctgagttattaaaaattatatatttgacccctaatttatttctacctatacagtgattttaaagctttggcaaaattgtccagcttatattctcttctttgagattcttccactctccttctattctcttcaagcatcttgtccagctcttctcaccaacaatgtgtttggttgttactcttaaaattatccttgttggttttggatttgctgagtatatgagcttatatttccttatcttgatttatctccctgcagcttatatttccttattagcactttaactatttatacttcattgttgttgttgctgagactagatgttatgacagagataggtctcttaaaaaggtaggcacaaacacaaattacaaagagataggccttgtgctttactgttatctcatacttgtgtgccatggctccttaagcttatgataagcttatatatcctctcgggtgaagataataggccttgtgctctgctgttaaatgtatgtttatgcattagtttttaactaatttttttcttatgttggtgtagacccatgaattttatcagttggcatcagtggcattctgcctacttgttgcttgggtgtgtcttctacttgtgtgtaaaatctttgaattctaggacttgaacaactttgatagtgagcttgaagagtttgccagaatattctacaaggtataccttgtttccttgttttctcattgtcacagtttgacactggcttctcatggacgagaaaatatcaagttgaggagttccatcattcaagttccttgtttccttgttagctataccagaaaatg

SEQ ID NO: 2961 - DNA, 1100 bp, Glycine max
  Soy_ogl_6677 Gm20:1432401..1433500 Cluster 12
gttattagtgagtagccctacagggccaaagttaattttatctttgtgtaggagttagaatataaatttaatagagtggaaatgaaatagacacaaaaaatattcagttttatcttcctatttttcctcatcttctatcctttactaagctttggggtctataagttttttcctactaacttgaacctcagatatattatccgaaatactacttaggaaaaattactactgtagttccaactaattttaataacacttaatttaattattattggttttcctcggaaattaaaaaacccaactacatgttatatagagataaataagaactataaagacttgctaatacatgctatctaatcatttttcctaactttgacaatttgaactcgagcatataattaaatgtttcagaagaggctacatattagcaatatgatctttcactatatggtcatgatatgcaataccatattttgggtatgaatacgttttcccttgtctcaaccctaaaagaatgaacaaaaactaaatatgagctattacttgatttagtaagtagagtaaattttgtacataaaataaaatttacctgcttcttatactattttaatctacgttaaattttcttttaattatcttttaaaaaactattaattatactaacaaatactatatttaaggctaatgctatctttctctggaaatgagcaggagtagaatgattaacatgtattcaggagagatcttctcttttcagcaaagtgtaacatgagtttcacgtgtgattttttaaacctaataaaatcaaataagaatagagttgagttacacttttttgtcttcatcatttataaaatcaaatccaaatctatcatgctttttgcggggatgggaagatcaaatccgcctcccacttatctagttgtcatacctatttttttatttctatcacttacttagcatgactattatatatattttatatattattactcattgtgttccattttttgtggaaggcctagggagcaggcttttgggtagccactaatatattgtactatttttcttttaactcttttaaaatgttaagaaga

SEQ ID NO: 2962 - DNA, 1016 bp, Glycine max
  Soy_ogl_712 Gm02:47260101..47261116 Cluster 12
ataataaaacagatataaaaggacctgatcattgtttacataaataaattttagacctaattagtaaaataaaaaatgaaaaaaaaaatcaaaattacacattttaatactttagggaagaaaagtaaaattaaacttttttaaaataagtttttgtcataatttagctttttttttaattatgtggttagtcatatataattaaacttttcaagtggtatagtgctttttttttattcataaaaaataaatttgatagcaatgaccaattaatcagttagatcccttgccagtgatgcagtaaattgagcataattgaaatgatagtgaagtaaattgtaatgatttcaaataaaactcgtatacgactcccatggcccagttatttggttatctgaacctttctttgccctcagaaatgggaatcttctcgaaacaagccacattaaagggacgtcaactcacagttggaggttggggagaggggttatttttatttttatggtacagagggaggggagattacactattcattatgcaaatgctactacaattgcttaaatatgaattgtgatgctgaacactcacactcggccagcaccttcattaatgaacctaaactcattattaagctaatagtagtttgatgtgtaaactattatagttgcttctggtgtcgactatttttgacgtatgccgtcacttggagtcattattttattaactaaatattgttgcaatttgatagtcaacatcacacaggcagaaggtgcatgaattaattaccggccaaagctttgttaatttgttctatagcacaaagattcgacggttcatgtcatttgccaactggccatttctatttaatcacgttatcaattcagcagggtttttttcccaattttttttatatactccgttgtatttttaatactttttattattttagatacaaataaaaaatttcctaaaatataagaatggttcttaacttatttgtaaattagttcaataa

SEQ ID NO: 2963 - DNA, 1000 bp, Glycine max
  Soy_ogl_6799 Gm20:36905401..36906400 Cluster 12
agttaatctccaactacttcataaatgattgtggttagactaataatggtagtaagtgccaacaattactcttaagtgagtagtgattaaatgttagattttggtgggataatgtaatccgattattagattacattttaaatccgatcaattaggaaaattaaatttactagtatagtattttaattgatggatgcactacagcaaaatcgtaaatatagcgacagcttaaattgcttctaatcattgaatcaaaaaacaaaaactgcttctaatcaagggttaagtgtcggttaagtgatctaaagatgctgaactccgtcatgtttttcgtaacaccgttgtctcctttaacactcttcctttcaccactcctctgtctcaatcatgcccttttcctcacttttattctccgtcaatttttttcttcagaactatttataaagagagtttagtttttcaatgaaaaataaaaacttttgttaatgctactactgcattaaattatgcgataccttaataatcatgtgttatagtgaacaaggaacggcaaacccacaagattgcatcgggtggagcttcaaccgtctcaagctacttcgtaaacgatggcggaatgactaatcgtaggtaccaacaaatactttgatacttaagtaagtagtgattccattaaatgctagatttttgtggatattgatagagtgctgaaagctagactatcactactcctaacaaaaacatcattaaaaactagagaaagaagataaaataataactccaactagtaaaaagatagagacaatacaatttataacttaattgctactaatgaacatacaagtgtcaccatcttagtttagggaattaaaattaaaagctaaatactaaataggtaataatattagggtttagaaatggcaccaagccagggttttcttcatggttcatgaacccgttgatatgttacaaagaaggcaaaaatccttttaatgttttt

SEQ ID NO: 2964 - DNA, 1200 bp, Glycine max
  Soy_ogl_1649 Gm05:31896901..31898100 Cluster 12
gagaaattaagtttcagtttaaaattaattttaagttaatgtagtacaactttaggtacttttgtgttagattaaaaattataattaaattttattattaacttgcttttaaagatatacataattaatacataggtcacattacttaaaaattaatttaattcaaaatcaattttcaaacattcactcaaagtcacaaacaacttgtcatatgtatgaagcaggttttcatttccccgttattaattttttaaagccaatcccccaaaagttttactgttataacttattgcttttcaaataaaaacattaatacataaatcacatcaagttgattttattcaaataaaattttcaaaccttaactctcaaactcacaaacaactgtgtgtcatggtgcaccttttcgtttcctgtttattttttcaaccagtcccccacccccacccaatatttgatgtaaggacaacttgttttaaaggtcaggtatttttgtagttcaaaaaataaccgcagagaatcgtaatctatgattttaactattactaattgaaatcaaatgtggtggacttacatggaaaagaaaaaaaatatctttattcttttttctgaatcataatatttaatttgaattaagtcaaatttaacagtttactttatgtcaaataaaggttactactactatatgtcatttttctagatgtactgaccagaaagcagaaaggcaacacgcgtgccgacatgattaattgaaattgctcaacttgcacctttattatcctttacaaatattagaattttcttaacagatgaatgatatgataattgatattttattaaagttggtcgatgaaattaatcattagtaaaattaaatattttaattcaataatataattaataaaaaaaaattaaataatttaattgagttctcttttctgaaataatatttttaaatttaaattatgtatttactaacatacccttaacttaaagttattaaacctagatttgcataattaatttaaataactttattttaatttaactatttaatataaggatatcattaatgcatacaagctctgagaattttataataattttataaatttattttgaacaaaaagaccattttgtccctagtattaaataaaatactataatagatttagtgaatacaaataaattccaaaatca

SEQ ID NO: 2965 - DNA, 1285 bp, Glycine max
  Soy_ogl_4771 Gm14:44274401..44275685 Cluster 12
ggtacataataccttatattgtttctccacatgattcatttcacttttcttcagctgaaatgatcaggtgaagtaataaggtaagatataaatcgacaccaattccctgttagaaaggaaaatgggagagagctaccaagatgcaaatgagcgtaagtaatgtttcactatttcatgttaactctctaacattaagatctagcattgtacttatttactagatatattttccaacttaaataacctaggagaaattaatatttactactgtaagacactgaactcaatcaacggtatacttttgaaccaaaaaacaaaaacttgataatctatgtacctataataatatatagaagttgattttactattcaatgatctgatttagactagttatactactataggatatgatgttctggttattttttcttccttgttaagagatcatgtgaatattttccttcttcattgtgacattgatcaaatatcttttacttgatgatttttattgttggtttttaaagtttagttgaagtggtttgaatggttaattttatgttccttgtattgggagaaggttttctacttccccagggtcacttgaagcaggttcaatcttctttgtcatttttctatgatccttccttctttattttactacctattattgtcgtcttatctttgttgttctaaattcttctaattcctttttgtagggatcttttatgtgaactatagagtgaaaatggtaacttccaaggtggtcatgtattattacatttaattgtattagtgtaaatgaaacttagtgttttaaatctctatcagtttaggtagtgtgtttcttttctctttggatgataaacagatctttaataatcttggtgtgttttgaacaaattatgatcacgaaatggattatcaagggccacttttagttattaatcttattgtttagtgtgtagatagcttaagaatatgttcttaatgtcattggcaggttaagtaatgaattgagtttgcagaaaatcaattgttatagaagtaaaataatttagcattatttttgtaaaattagatttgtcatataatttatcataaaattagtttatgcatgcaatacagtaataaaatataatcaagcgatgggaatgggagacccaaccagtaataaaatataatgtatcaaatttcagtggagaaaaaaaggtctacatgctacagtgtcagggcatactgtgggcatatgttaataaactaattccccacaattgttataaagta

SEQ ID NO: 2966 - DNA, 1100 bp, Glycine max
  Soy_ogl_3040 Gm09:7460101..7461200 Cluster 12
tgacgtgtagaggataagtttactgacatacagataaacatggcatagtcacaatgtagcaaatttggggaaaaacgtgattcatatatatgaaaagttcttataacattttttaggtggtaacatgaatcatttagaaaagttttaacagaggttttcttataacagcgctacctattgaaagtttgctttaataagtaccactattttttagcttaagtttatttttaatgaagtcatgatgtaatctcatttactattttagtagtgaaatttttacttagtgcaatttagtccttgacaatgaaatatttttttactattgttaattttaattatattatatgcaaatttgaaacactttgaacccaaatggttcttttagaaaactttcaatcctaacactattatcttcttctccctgaacgttctctttgctcattgtcatgcatgttgtctaaagatctattttcttcctttgtatttctcattatactcaccatggcatcaattttgccgttaaagtcactcatgatgggaaaaggagggtgttaatacgtggatcaattcattatcctagaagcacacatgaggtccaacactaatcttgaataatcatttttcgttgatctatacgcccaacattatttatacgcttctatgaaataaacgtttatttttttcaatgaagtaaacgttttttttttcttcctttaatttgttggaaacattgcccaaccaaaatggggtcacctctaaccaattatggaaacgtatctgaaattgatttgggcaactctgtaaaggtaaacgaatagaaaatatgatacacaaatcgcttactatgatattttaatattttatagattggttaatcttggcattcaggaagttggtttcatttggcgagattctttaccttcttgtattgtattaaagatatttttttagggaaaaatttaatcttcctagttatagccttataggttttactaactatgggtacacacgcttttttttttttgttttgtacttggatttggtttttctctttttaataattaataaaaatcaggtctgctgcagatgatcaataattt

SEQ ID NO: 2967 - DNA, 1332 bp, Glycine max
  Soy_ogl_2759 Gm08:18890601..18891932 Cluster 12
tatttgaacataactaatttctttgagattagagattggacgcagaacaattttaagaagaactcaattcatccctctctttcgttattgaagaaaattggttaatacttaaacctaaaacaaaaacacgtgcaacaaatacagtaataagtcgtaaaatagaaaatcaatgaaaatgataatgaaatcaagctaaaaaaaatggaaagatgcatacaacctaccacaagtactatgcatatgtgatgtaaaatgtaactcgatcaatttattttatgcaatactacagatttttatttttattttttacatttcaaacaatcgtaaaccttttcaaagttcaatgatgtttttttttctttatgatgttaattatttaatatatatttttacaaaattattagttcttaattttttactcgaatcacaatatgttctattttttagttaaatattttaagttgaataaatttaaaaggatcgatacttattcattctaacatattttctcttgaataaatatcctttatattagaaaattatttttggttttaatagaagacttaattcttaatttcatcttttagttttattaaaacgttcaattagggttcttgagaagtgtgttggggaatggaaggaagggggtgatgattgatgataaagactctctttctttctctctgagatggatttgggaaagggagaagaatatgtgcaagtggtttagggtagggtgtatttgcgaaacacagaggttctagaagtaacttgggtgttgcgaggaaaacagtttgatgctggtggcggcgatgggggctttggattcccagtggaggagggatgcattctttacattgttttttaaaataataataaatacactcaagattaaaatttaattttataaattttattttgttttattttttaattttaaaataataataataaatattgtggttgttgaaaacagtcgttgttcatgaatttgaactgtcggtaactcaacgttgtcggattctattggacggaaaggactggattaattatttttaaaaattgtaaaatttgattgaatttttttaaaaatattgaaacctaattaaacactttaaaatatttaaaggatcaaattgagtattaaagcttaataaaatgaaaaatgatgcaacacataggattctcatgcttaacatattggaatgtttttatttcaaatttgtaagttatataaaatttttaattagaattaatttgatccattttttccaacttaatttatgataacgttcttccttctaaactcactaattctactttttaaacgag

SEQ ID NO: 2968 - DNA, 1000 bp, Glycine max
  Soy_ogl_1648 Gm05:31876601..31877600 Cluster 12
attcaccccctttacaagtagtaatttatctaacaccaagttattttattttaatcgacaattttgagtttgaatctagattatgcaagagatgaaaaattcattaattcacgcacttggcagtattattgattttgaccatgaaaatatttcaaagcaacaaagaaggtaatttttttggagctagtgatttctttcttacaagttaattacaataaatagcgcaacaagcgttcatgcaattgcatggacacaataacaattattactagctttgaagttgaagtacagtatagatgtagaaagtactaaaaaagggtgattggctcaacatgatctatttgtaataggagctaggaagaagaaacccaacgatctcgaggtgaatcttaagaatgaaaatatcattacattcaccaaaaatttcatgaaagtaagaagaggtatgcctttgaatttcattttcagcatttgtttaaagacaaggaagaaggacaatccaatagtgatgacaatctttgttgctactgcgatcagagtgaatgagaaggctattttagagatagaagaatctttccatttggctttcttcggtggcgagaaaagatgtataaaagctgcagaagctaccagagccattgctatagagtttgttaccatgaatgctttcaagaggctctttgcccccaaaatagggctacctttatgttcaccatcttgtatggtacctcctagtggcgtaatctcaactacaaagcttacggttgcaattgtaaccactaatagatgagactcatttgcttccttagtaaacactaatgtctgctattataactcaacaaagatatgtataattatccaactattttatggtgcatttgggtttatggtatgcaataacactcctataaattgaattatttgagtaatcacatgtgaaaatccatagaatgaatcttatttcagtctaaacttcgacgaactctttatattttaaaga

SEQ ID NO: 2969 - DNA, 1083 bp, Glycine max
  Soy_ogl_5094 Gm15:34882118..34883200 Cluster 12
gaatgaggattaattctaaatgagttactactagtaaattaatctcttgacctataagatactataaaattcatttagtaatgtgcattccagtctgacctaatacataatacgagtaagtttattaattagaaccatgactaattcttgtatagatagggacgcaagtaacacgtcatattcttaagcatagttaattaaatcattttcaaaataaataaataaaaaacatagcaatctgcaaccaaaaatggggcatttaatttatttcagcctaaacaaattttatttatttaattattttataagtattttcaaaacacattaattaacaaaaacttaaatgaaatagaaataggaacatgaataagaatattaatattggatcaacaagtttcctattaccatattttaaggcaatgcatattcagtatgataattctagaaaatattaagaacgaataacattattaaaactgctcttttggcacgtaagtatcctcttgttatttgcagaattaactgatatgttataataagtgatttttttatcactatactaagtgattttttaaacaaaatcattataccaagtgattactaacgtgatctattactttttcaaaatgtaattgaattccctataacatttctattcatattatacatcatattgttaaaagtatttatttaaattattcgcttaatttctatagttgtcatcatttcaaattttaatattttaaaagaatttaaatttcgattcctacatatgcataaattaaaatcaagttttactgaatgatgtaaatataataatacaaaaataattattagtcaaactctaattattttttaattgatctccaaattaatcaagatttttttcctataactaaagaattaaaaaaatacagaagaaaactttaggcagtatataactataacaaaaaaactgtgtaagaattaaaacttactatttttaatatagaaaatgaaacttaaaaaggaggacagctataagaattaattagtttaaccaaagcatttcatcaagctttgcatattctaaaattatttgtt

SEQ ID NO: 2970 - DNA, 1257 bp, Glycine max
  Soy_ogl_6636 Gm19:49977101..49978357 Cluster 13
ttcgaggttagtgaaccgtggaataggcctttttgacacgaataggaaggaatgatgaggaatcttcatgcttcacacttggatggatctaacaagtagccacttaactacttaagtattcacaatgcactgatggagcatcaaaactcaaaagtgtcctatgtccgtacacggataattaatagcaatgttcgcacgggaaatctttgcttttgcagtaacacattatacttttactttaatcagttggaacatggaaggtggatgggaggaatgctcatgttacttcaatccctcgtcaatgatgatgtgcttaacataaacccctagaatgtatacataatagcatattataaaattaccgatagcatcattctgaccttgatagctagatagaaaaggcaattgtggatcaccactgaaacaatattgcaagcctataaattacccatttgggaaaaatatctgtcaccgcccaattaatgtattactaattcaccttttttttagaggatattactaattcacttaaaactatagataattatatatggtattggaaatttaaacagatattaaaaatcatgtgtttacacgtcatatctgtgtagtattttacacatcaaatatttattttttatatagtatctaataatctaataatattaaataaatcaagatttttacaagtctgtcttgtaccacatggcactttcttaatttttttcttcagaaaataaaatattgtattttaatttttaatttttatatttttgtattcaatttgtttaaattaaacacacgggattatataaagtaggatttcagtgcacggaatttaaagttgtgtgtttttgccctattcacgttttctctaaaaattaaattttattatattttgaaattgttaaatgcatacatcggaagcaattaacgcaaataagtgattagtgtatttttttttatttgtacatctatgcatacaacctaaccgtacatattatcatataatataatattagcatataaagtacgatttctgtagttaaatcttacatctcgtcttaccttgttagtcaattttttttccttccaaaagagtaaaatattttatatcttttaatttaaaataaacttttgtatgtaagtcttatgtaatgtattagtgccacctcatcaccttaatttctttgaaaagtttaattataatattacatctctttatttatatctttaacataattaagacataatgac

SEQ ID NO: 2971 - DNA, 1144 bp, Glycine max
  Soy_ogl_2480 Gm08:3046002..3047145 Cluster 13
catcttccaaattcaaatatgcttgtaacacgtataagacatattctctagtacttttaatatcaactacattatttaaattaacattttatcttttttttttaatatatttagttctacctttaaaaaaattataacttgagtttcaatatttttaaatacttagttttaaaaaaatacttagcttccagcacgtgtatacggaaggtagcaaaactgcagattggctcgttaaaggggaatctcttatcaacaagctagatttaactatcttgcagcagtgccatagttctctttttgttgtttactttgttcatgttattatgggactctcttccacgagctcctagttttttttttctttctttctttgtctttattttctcaatcataaaaaaataaaaatattaactcattagcttataacgctattttaaataaatgatagtttacaaacataatttataaaaaaaatatatatgtagttgttctatcaatttgttgtcaatggactcccaacgtttgacaacaacgaataattttttttgaaaaaaattaatatcaaaacaaaaaataaatgttttgtggaggttaaaaagttatttaagcctaaattttactataaacttattttcgagttaaatatttttaaataaaattatcttgtgataaattaaaattagttttaaatagtcgaaaaccaaactatacctactgtgatccctacaaaatgaaatcaagcaataacaaaacatgaaatcaagtttgtttgattgttactttcactactttcatttcataacctactttgccatgagaacaagggccctactctgggacttgacgttgattgcgctgctttaaaacatctaaaatgcataaaaaataaataaaaagttatccactctgcaatttgttctttaaaaaatgtataacaaaattcaaaagattccctctcctcctttcattaaaaatatttaattattataaaaagttttttttttttaaatttagagtgtgtttttactatagacatatacaatttaaatataattaagtaaaaattattatatacagtatcacatatcgcatcatttttttattagaaatcaatttttaatttagttttctatcaatgttgtgt

SEQ ID NO: 2972 - DNA, 1100 bp, Glycine max
  Soy_ogl_915 Gm03:36791901..36793000 Cluster 13
tgatcattcacatccactaatcaattaataacactcatgtaaatcgcactcaaacaataccttcaaatctcttattttcctccatacacgtctcatgtgcaccacttttaccatcctatcctccatcttctctcatatcgtcaaataatatcactcacatggatcacacttgaaacataactcatccctaatgaccatttatatgcttgtgtgattttcatggctctctttttttgtcttgcgtatcatcgtcattcggtaaattttttaacttgaattttttttactatattaagttggttatctagtttaacacaaaacttagttcttaaaggttcttcaaatgctagttaaaacgctcagaaaattcaagcttctaagtatactaaaagtatatctgatatacaaatattctaatagacttcaaatctataaagtaaccatgatctcaattgaaaagtatcacatatacaattcaaattaaataactttgagtaattaaatttttttagacaaaacttttagctgttcatataaacaacctttattggtcaaaatcttacaaataaaacttttttgtaattatccaaatgaaataagttacttaataagatatattgtacatatgaatctcaaatatgaatgtgtttcacaaaggatttattaaaaagtaaaatatattgtatgaaattaaaaaaaaattgtgaatcaaccaatagttttatcaagaaaactttagttgatcaagaatattagaaaacggtgagagtacacatatacaaataaaccaatgtgagagataaagatatgtgatgttgcacaaaaatattatcttgtttaacccaaacaatccttaggctacgttaaattctcacacaaggtgagatttttcaaccacatctgtcaataatacaagtattctcattgtcttttctagtttatattattattattttacacctaatctttacaagcttaaaactcattattaatttatttatcatatagcctctgcagacttcacacacaaactttcttaaaccaataatggtaaaacttattagcttggaaagtgatatgactcaataacgtagaataat

SEQ ID NO: 2973 - DNA, 1267 bp, Glycine max
  Soy_ogl_3967 Gm12:1399534..1400800 Cluster 13
gtgaatctgggatattatttggctggaaatcaaagattaattcaattttttgttgattagtagaattaaactcgttggttaatacttcttccctcttctaattcttaaaaaaactacttttttaaatttctcttagtttagaaaattttcatatatatatacacacacattttgtgtaaagtaaaatttgtgtgcagattctttccaaaaaaaattatgtaaatggcatatatataattttaaaaattaaataaatgaagactttgtgtgtaaatcagaatataatttaaaagtcttaaatatgaaaatgctggttaaaaaaatatagttaagaattattatatgtgtgaaaaaaaatagttataagcaaaataaaataattatatggagtttaaattaattaaatgaattagtgaaaagttagtatttgggttagtaagaaattaactggattaggcaatctatttttttgtgcttaaggtcaaagtgggatagtttatcttgaatttgttgattctgttggtgttgtttttatgtaaaacgatattatttagaaatttacatctttcttgtgtatatcacaatttcagtaatgttccaacaataaatcactattgatgaagttgtatttcacagtgcggtggcgatggttaagcgtgaaaagggaaatgagtgagtgagaagtgggaggcaaagagagagttattgagtgaagattttaaaaaataaatgtatgaataaacatggaaaacaacaagcaactccaagtgagtgagattgaaattcttaaattttgtttcaactggttttgtaaaatacgaggaacacgtacaggaaacgtgtaatgggagcatccaatttgtttttgctcgacaatggacttattggtattaaaatggtgtcaaaaaattttgaagaagaggagaataatttaatgggctaaaacacttcaacttaggagcccaaacttgtaatatttaatttatgcaacagcaaaataataataataataaaagaaactgataaacaaataattaaaaaaaaattacgtgtttttagtttttgttgaaggtgtattgaaagattaaacatattgtttttattaagtatagatattaactaatacaacttattgagtggtataattgaaaatgaaatgttatattttttaagattaaaagcaaatctcaatattaaaaaatgatgtcgcaaaagaaatataacacaattttgtgttagaaaaaaataaaattcaatttaattataa

SEQ ID NO: 2974 - DNA, 1300 bp, Glycine max
  Soy_ogl_2523 Gm08:5310801..5312100 Cluster 13
ttactcatttatatatctcttcattttattttggcttaattgaactttttatcttctaatttttcaattttttgagttttattccaacaaattaatttgacacatttcaacctctatcttttaagaaatttgtaaattttacctttaaaataattatactttttatccccaaattttttttggtaaatttaatactaaacttttttttgacaaaatttaccttaaaatttttattttgttggtgaattttatgcttaacttttacacttattaacaaacaaatgacattcaccaataaaaaatgacaagataaaattcgcaagtttattaaaagtaagagtgaaaggcatcaaatttatttgttgaaaataatattttttaaaaattgaaggaaaaaaatgtaattagaccttttgtattctttcgtaagacatagaggagaagaagaagctacaacgaataactaaatatactgtaagtgtcagcaagctatagaacaactctaaagtctgtgagcccaagtcaacataattaggcaacaaatgcgaaataagtgggatttgttgaaatcattttcattcctaatatccaagtctggaagtgcaaataggtgtgtaaactgtttatatgggtggggctagagaaaatctatccaatctgacacaaaacactatatttaggttgagtctattttacacttttttccccaaattcgaaccaaagctattcaatcaataacagataataattgataagttgctggtgtgtagaattgtctgttaaatttttttcatcaataaagttaagaaatatttcataccaatgttatgatgactaaaaaattaatgatggatagatttgggttgtgtcatgaaaagtaaaaaaaaatttacaattttgaaaaattataaataataacaaataaataaaaattataaataataatttaataataaagtcccatgtgaacgggttgagtaattaacttcataatacaatctcaatacctgaactaaatggcattgggtttgataaggatacgtgaactaaatggcattgggtttgataaggatacctgaacattgacaaaactcaaagaatcgatttttaagattatttaaatttgtgaacactcataagtataatcaatataacccatgaaaggaaaaactaataatccatttatttatttatttttttctaaaaatgatgattaatgaaacaataaacaaattggtaagataattttttttccaatttgactttttatttcctagctactgccttaacagtaataatt

SEQ ID NO: 2975 - DNA, 1354 bp, Glycine max
  Soy_ogl_3365 Gm10:4458659..4460012 Cluster 13
aagaccaaaggtagtatcatacaacttattatgtgtatgatcctactttttttgtttttcctatttcttttcctaccacccaaatctactcaaaatggaattaatgcacgttgatacttttccatttaagaaaccaacaccagcctctcaccgttgcagttggtttcgtttgtgtgttgaaacaatgtaccttttttactttcaattggagttcacctatacttattaccttttaaatcatgtcgtgcatatttattgtgtggggggaaaccattaattaacttacctcactgtggagtggatggagtgaatggagaaaagagataaaaagaattgatttaaatatgtttcctattcgctaatcgctatgtatatatatactctaggtaatataagtttttcaatttaaggcattgaacgtgtgtactgtgcaacttttccaaagtcagataatataatttgcatttcttagctagaatgacaatactagtgagagtgtaattaaactcgatttatatcattcacattcaaaatcttgacagaaaagaggtaaataaaaaatctatattacatcaatcaagtcctctggtgatcataacagtactggtttgaaccaactaatttctttgaaactatctgtcttattgtggataagaaatttagttcatcagcaacacaaagaggagagataccttttttatttgaagagaagagaggagatacctgtattgttatttttatttattgagtgatagtcacatgttttttttaaaatccctcacctatgttgttaatgttaacaattaaggacaatgatatgggaggcagtgaagcaaatcgtaatgaaaaaacaatgtctagaatctctcaaaacaggagttaacgggttatgctctctatgttaatcataggataaatagtaactttcttgaatgatacaagaaaattattttattataaaactatttattagttttacacataaaattaattttttttattttaaatggtacaagaaaatacatttattataacttgtataatttttttaagttttgaaagatttttttatctcacaaacataattacatttaaataggactcacaataaataaaaaagtaaacacatcaaatataataataactaattaaaacgcatcaagttttataataattatatataatatatataaatatatttataatataatgttaataattagatatataaataaataaatgagacttccaataataaacaaattataattagcctagataatagcaattgacgaaaactcaaataaatatgtcattcttattagatctattaattaacatgtatatctcaagg

SEQ ID NO: 2976 - DNA, 1058 bp, Glycine max
  Soy_ogl_6195 Gm18:56195901..56196958 Cluster 13
ttgacctcatgagaaagggagagagaaaattagatagggttttggtggtggatgtatgtagaacgattatagggttgttttggtgcttggggtctttttttatttttcaaattcgctctcatgaacccttttgggactaatatattacaattttagaaactttttagtgtcataaaatcgtcacagaatatctttgttaaatagcattttatcatgcaactatcacattaaactagttattcatgttacatatgattgttgcattatcgcttgcttaacggtaatacttaataagagagattaaaataatgagagataatagttgagagattaagatcaatataaaaaaacagttgacgaactaaaaataaatttcttgaatagattgagactaaacataatttatctaaaaaaaattacatgtaatcagattattattttacgtgactacatatcaaaatatataattatgatatcatcacttaattataataactcatagcaaagaataaaaatgataacaagatataatatggggaattaagactagttaaaattttatttaaagactaaaaaaataaatgaaaaaaaatgaaaaatcaaaacaatatttaactctttaaatatcatacttaccttcaacttcaatagaaccacccaaagaagaaaactaactttttacattttttaagctttcttacttaatgtctttttttttgtccttaccagtgttcctcttttattaaatagttagattttttttaatccatataaatagaagataaatattaattcacatacaatatttaatcaactaaactaaaccatatatacctagttagacttcttttataatagagacaagtgtttaaactactattttttaaaataaataattctaatttcttttacaaattttataaaaataaaaaacggttatttttttgaacaaaagtttatgcaaccatcacctaagtttttaggtaagccattttttttttttttgaatttgaaataaatcttgtgaaaattaagatagaatttgacaaaaaaaaatt

SEQ ID NO: 2977 - DNA, 1059 bp, Glycine max
  Soy_ogl_3677 Gm11:1437642..1438700 Cluster 13
gggaatccccctgattattacattatcggtttagtcacttaattggtttattttactaatgtcaggacccaattgatagaatttttttatacttgaaggactacttgttatatttttttatatctgggaattatttatataattttcttactttaagaaccatttaagagagagagagtaacattttagagatgaaattgacattttattctaatattaaatttatttattattgaaaataaatgaatttttcagcctttttcctgtaaatgtatataattataagatttttcagtaactcatcttcccattttatgacaaaatcaagtcataacaacgttggagattgctataaacaactactatgcagactatttatctcaatttatgataaaaactcttaacattagctaacaaaatcatagtccattatatatcaaaaaaggttaaaagaaatttgaaaaaatagtttttttgtcaaatatatataaatataagtgcataaaagtgaaactaagaatattggaaaataactaatgaaggggaaaaaaatgaaaattatatataatattcaaacaggtaatttcttagacaattcgttccattccgtacttggtatgggctttgttatacttaccctctttttgttaagtttacatttgaaccttttcacctttgttacaaaaaaaaaaaaaatcttaacagaaacatatatttctaattgcatatttgtcacaacaaaaatgtatttctactttgttacggaagtgtgacggcataaaataaaaaatacgcttctgttttgtattgtgaatttatatacaaatgaaatgtgtttctattatactatatagtgaatcccatgtgtcatatgaccaaaatcttaaatgaccttgatcgtgagatataattttattataaatatgaatcagaatgtcaatagtgtgcacacaataatgtcaactctaataattaatatcaaacttgggtacacaatcacaataaaaatatgttttcaatgtgttttgaaacacaacaaaataatagagacatgttttc

SEQ ID NO: 2978 - DNA, 1000 bp, Glycine max
  Soy_ogl_3294 Gm10:966401..967400 Cluster 13
atgatctggttcttcgtttttcgtttgtttagtatgagaaagagtactttttttttttgttttgaatttttgcgtggtttggatctttgaggaaaagaacgatagaggaggtgttagttaatttggggttacagaaacgggttaaagaataagagatttatttttggtttttaataaacaattaacttaataatcctattaatcacaactaatagttaataaacaaaatataagtgtcacatcactggtttaattcgtcaactttgtaaatcatcggtcaatgaaaacagtttgactgagaaattaaaattattaattttttaaattaggaaaactaaatgtttgaattaaattttaagggaactaaaattatgattttttaaactaaggattaaaattacactttaatcatattagaattactaaaccaaaaacattcaagcctctcgaaccttagtattaaatagtgattactttagtttctaaacttttaaaaataatagaaatttaaataaaacataacatttgtataatttttcaagattaatttagaatattacttttgaatcaacgtgcctgtataaatagctagaagttcaaatttaatggttgttgcaagggttggtgtcaattcagtagtttaaatatatagaatcgggtttagtttaatcagcatagttcctttatatatttggactcctataatagatttgacatatttgtttcaatggtacaacaatgtaatttaggattgaattcagcgttgagagcaaccattatggattcacacaaagaaaaggaagtaatacagtcatgaataatgaaggaagaaaaataagtgaggtctataaaaacacagtactcatgcaaaggtgtataaattacaaaaaataaggtaagtaaataattacaaaatcaattaaagaacacctgatacagatttctaagataattgtatatctctacatgattcatcatccttataattaattatactcat

SEQ ID NO: 2979 - DNA, 1004 bp, Glycine max
  Soy_ogl_304 Gm01:53179438..53180441 Cluster 13
taataactatcatttgtggataaaattttatctgattaatgcaagtttgtatatagataattccagcagacatgagtagcaatagtaaatggcattaagttacttgtcttgtggtgtagccatgcatgtagggcattctataatcttgtgagatatataaagtttagtcgatcgtggtccctcatgatcattcatctatctctcggtttcgcatgcaaaatgcaatgcctcgaccatccctcatgcccattatatatattgtacttcacaattggaagcctagctaagacaagcatcttatatataccaagattaatttatggcaaggcctgtttggatcgaccagctagcatttgttgggtgttctcgaaattaatttcaagaaaaacatcggctctagccacttcttcccattattatcgctattctgtgttcgcttgatgagcattattgtacattaaaaatcatattgcagtttaattaacaaacaatcctcgttaaacaaaagcaatacattaaaaataaattataagcatataagtaaattatttttaaaaagtgtattgttaaaagtaaattagtgaatagaaaagtaagaacaatgtaaaaatcaataaaaaaaatcagtgttcataatatattaaataaatatgagagtaaatcatatgtaattatcttattagtatcaaaatgtaaaaaaaaaaaaactcttattcatataaaataacaaatacattacttaattgtttacacccctaaaaataatttaattatcttattttaaaatattcaataaactaactagaactactagtaaggactaaagaaaacgataagaatatgtcatgatataaaagtaacataaaatttgcaatgactgaaagaaaaaaaatgtcacatattagcaacatattgattcttttttttaaatacaattatatatatttttcattcataaaaattataattacaataacaacgatcattgtgattgtataattttt

SEQ ID NO: 2980 - DNA, 1414 bp, Glycine max
  Soy_ogl_6271 Gm18:59212701..59214114 Cluster 13
atttattaaataatagaaaatctttatatataagactgtgtgactatacgttatcaataataacattcaatttgatctattgtataacactccacatttttcttattttcctcataatcgaagttataaaaaaagttaacatacaggatttattaactcatcctagctattaaatttgtgacatttgttgatatcatttgcacttggcagtacgtagtaacgaattctgataatttgattgactctagaaaagcccgatacaattaagaagaagttggcagcttctgacgagggaagcaccactgagctagcatcgtagaaaataacaaagcaacaagccactcttccctggtttccttgcaaattccttttctgttatttactatttagtatttactgcaaaatagcactgatatccacaaattaatgtgccacaggcgataacagaagggaaatttcgtgtgaaaaaatatctattgtaagtgactaatccaacacttccaaaagcagcaatttactgaacacagacaattggcaaaaccataaaattatatacttcgcggatgttaaccatgttctatatgaatatagaagcatagaatagaagtcgcactgttgagaaagagaaagatggtactatactacaataattaagtagaagagacatgagcagtgaatttgagagtaagagtgtgatataagataaggcatgtcctaatgactagagagtggcaaatcattaacttgttaatcatagtatatttattggcgacaaattaagccagctaattaacaaattgtgacagacatggtcatgcttcttttattatagtttcttgcatgcatattgtaggatttcattcatatttcttaagtattagaaaaaagaaatgctacgaacatacctttcgatatacttaatttttgagcatactctctctctctcggttaaaatgtattgaaattatgaattttgattgattttacatcttatttaataatttcttattctgattttgattgattttagcgctcatcttataaaaataattctcttatctgcatttaactcctctaaaagtaagggtgcattctagaaaataaagtataattatataattaattaaaaaattatgttttttagaggaaaaaaatttatggttaagattgccataaaaagcatacacatgtatacaaaataaagaaatttagttttttatggttaagattgccataaaaatcctacaaatacgtatatgtgtatgttatgaatataacatacaattatatcaagttttattaattagtttaatattctatttatcctaaaagagatgatataattatatttaacttatgatgatttttaattttcagtattcaagttatattatatattttttaaataaaaaaa

SEQ ID NO: 2981 - DNA, 1405 bp, Glycine max
  Soy_ogl_2141 Gm07:2938196..2939600 Cluster 13
taaaatatacaactcagatatgaaaatcaacatacctgagatttgtagttccagagtgtaaacttgctagaattaatcctacattaatgatggtaacatcacacaattcagcaaaacatctagatatcaactattttcatcatatctttctaatctctacagtaaaagaataatgtcaacaacgttcccagataatagacactatcattagacacaaaatgctcataaactatccttaattccttatagaggtcatgcttgagaaataccaaacgttgaaatcatttctaaatattcataatgagcaacaaatcataaaactggtaataattttagcttcatatcctaaaataattccacagataaagtcacaaagaacagccacggttctcttggatgtagatccacaaaccttactctcctcaatgatcttcgttcatcaagctttcgttgttcaaccatggttctcttggcctgtttttgcactatacgtctaagcgatgttttttatataaaaattatcatgctatatatttactttaacaatgaaactacctaagagctaattcttaagtttaagaattctataggctaatttaattagagatgctttaatggagttgttattctcattatcaactattttcttaaaatgtatctaaaccaacaaaactacgtacccaccttcctttcctatacaccttccctttttactcctccgcttttgactggaatggaattatgattttattatgttgaaatcttgggaacacatgtaattccattgtaataaaagaagtgaatataaaatctaaatggaaatatgttttaaaaatgtacactcatagacaactttattaattaaaaaagaatgagaggaactacatagtacttactgtcaaaataatttttaaaatgtacactcatagatgactttcttaaagacgatgtttcgggttgacatttgggccaaattacccttcaagaaaacacactgacccaagtgagaaaaatcataacagataatatgataaaactgtatcacttgaaaaatagtagtatttcataacgagcgtatatagttcagtacaaacatatcatccgatccatgtacaatggcatgcactgtgggactatgattctttttctttttcattcaattgttaatgctatctttgttgaggaataatatataatggttgaatttaagttcaagttttttttatctaactattttttctcttgttaaactcaaaataattcaatgtacacaaacgttgatgttaagaaaagaagatagtgtaagcaataagagttgttatgtattatatttttgtctatgctcttgtctttcattttcttctctcctctttcaatctttggtcgtcttacatcaattaaagca

SEQ ID NO: 2982 - DNA, 1273 bp, Glycine max
  Soy_ogl_6979 Gm20:44201501..44202773 Cluster 13
agtcgatcaaaaccagctccatctccttctttttgctgatttaatatagatcatgcgtatctttcacgaaataattttgtttgaatattgtgtgattattataagtgacaaactctttctttgaatatttaacgcataattcgaatttaaaatctcttggttaagttagaataatcttatttggtggtcttttgtttctgacttaagtattgtttatcctgctaaagaatcaaactctcattaatctaaaatttgtatccaagagtattctaaacacgtttagcaaatttaaaataatatcattgacattcaaaataaacggatacgtctgaaatttgtaatggaaattataactttttttactgaaaaattagtaacttaaacatgcattttaatcacgtttaacaatttgaaactaaaattatcaacatttaaaataaacggacacactaccttctccgagaccctttgttgactgcagctaccactccactttcgtagtctcttttaatttgtttttttggtagaaattaaagatatcctttatcaattatatggccacttgcctcatattttattaatacgagattttgtcaatggaaatttcagcacgaaagcgaacaataatctacagatgaatgaacagtaataaaggtgtccccctctattttcataaggaacacttttcaaacataccataaaaagaaaatgtttgaacctttggcaaccaaaagcagaaacaattttatgaaaagaaataaactttacaatgcaatcatcatgagaacttaggtctaaatcattttgtcattgtcatctgccgtggaagaaaacctcattcccaatgactgttattgtcgtcgtgagttcccctccatgctgctagaagccaccaaggaggtcctactcagtatctttggcgccatcctcaacctcattgttcagattggtggaggatggagagagaaatggctgggaagaaaaaagattacatgtggagaataatgtagcctacaactataaggataagataaatctaaaaagttaacaaaatttcttcatcatgaatcacttaaaagatttttccactatagtttgaccgcccaatttgaattattattattatcatagaaataaaaagacactcgcatttagacacattatacaaatgtgtcatttgcaactgttttttttaaaaaaaaaacttttgatgcatattatatctgcataagtagtgacaaatgtgtactctatttttcaaatacatagctgg

SEQ ID NO: 2983 - DNA, 1301 bp, Glycine max
  Soy_ogl_6335 Gm19:2221501..2222801 Cluster 13
tggacaaattttaagactttcacagatttagggttatgaaattgtatgccatcagttgtatcaatgtaatctcatacaaggcataaatcccgtgcctctgtttatacaccataaattaattaccgcatattattaaagagtaaagttatagtttcttattacatctctcttgatgttataataaaatttagaactattttattaaaaatatttttaatttaagtttggtaccaccaatgccaaacatgcttttggaaagagagtgttaattgtgatgttggctgagaagcaatagatctcaccaataattcatgacacttgataatgaaacgatttattatatatataacagagttgactgatctcataatcatgtatactttaatcttcaatcaataagaaagcattaatacttttttttgatatcttctatgatactgttaacacttgtcacattaatagtagctcttttatatagagctttaatttatatacaacaattgccactagcacttccgataaaagcatgaagcacattgcttacaagcaaagatgaaaatcacgatcactccacaccttaaacgcaattaattttaaataattaaatataatgaaaataattttactgttagtttgaaattagaatataagtttaatacgttaacattattattgagtagccagaatcattgttaaaaatgagttttaagataattataattaaaaatcaaccaaaacttaattactacattattacttattcttaagaatatatgcaatgatacaaaataaaaaataaaaaatctttaggttgccatagtgatcgagaactacaattttggtgtgaaatcaactgaatatgtaattatcaacacgcatgacttccaacttcaccttaataaatgtgatatgataggaaacaagaaattgtcaccgacatgttttggttcttccttgaaatgccagtcctgctaacactgatatcaaaattaaggaagacaattcactaatcacttgtacgttgtctgttgaatgtttattttacacagccacacattgcaatggccacatacatgtcttggtgaatggatgcataagatatgcaacccattaatgctgattgttctatatagagttatggaacggtttcactatcatttatgtgtcagttcagatggccccaatctcttaaatacattagcacttcctattggaagtttgtaatgccggaactagtacatttcttattcacatgcgtgatattagttaagcaccaatagctatccaaacataataacata

SEQ ID NO: 2984 - DNA, 1151 bp, Glycine max
  Soy_ogl_1742 Gm06:404401..405551 Cluster 13
aaactttttacaatgtgggtacataatttttttctcaataatatatccttatgcctgcatatttgcaacaaaaaaaaaagtctaatcgatcaggtattaaaaaaaatcaaatcaaattgccttaacaattttgatccgatgttaatatttaatgcaaaattataaattaaaatgtaaacctagattaattgattgtaattaatttcttgtataattcaaattatatttaaaataattcaaatttaaaaatactaaatttaaaatattttataattaatgactataaattcgaataactaaaatgaaatcaatcacttatttttttcaaaaaaaaaaatcaaaccaataagatattaacaaaattaaatcaaatttctctaagaaaaggaactacgatatttcattttaattaaaaaaatgaaatcaatcagatattaaaaaataaaaacaaagtgctctaacaattttattccgatattaatatttaattcaaaattgtaataattgaatgtaacctaggattgattgattgtaattaagagtgcaaatatgcaatggaactacagtattggttaaggagctaaaaaaaattatatctacaactgttttgatggacattaataaaaagaaacaaaatattgatccctaaaatgaattaggtgcctacggacccctgcttaccctttaaatgttagagaaaacaatatttattggttttatgttttgtaacaacgattaataaaagtcaaggatcatctttatctcatttgggtatctatcttccaagacttatgttcactcacggataattatatgttgcagtttctagagtaaggtcaagacataatcataagattttgatattagatgatcatcataaagtatacatattaacaaaaaattgttatttacagataagtatttgacaatatataaataataaatagtatatatattattcttatttgtattggtatatgttcatcaatcatactatttataagttcgtaaaatatacattttaaactataaaaagtcatagatatgttaaatttataatggtatgatagacatcaattttagtttattattagatgtatattaaaatttcatttaggatataatatagcatattcaacaataatgatttg

SEQ ID NO: 2985 - DNA, 1359 bp, Glycine max
  Soy_ogl_5450 Gm17:1793101..1794459 Cluster 13
tattttttttcatttttatggaataatgcagctaaaaaatttgtaaagttgttaagtagtatttgttcggtaatgagttgttgagtagtataatagcttttcgcgcgcagtaaaaaggtatacactctaaaattcgggttacataccaataaaacaattaaatttagttatattcaataactctatgaattaattattcctttcctttaattacttttttttcatgccatacagattttccagtccgcaatttatatcatcctacaattatgttgctgagtatataccttttgcttatgaaaaaaacaattatgttgttgagcaacaacatggtgtaacgtttttgtttttatcataatgttggactctcatgatagcgagcgagtgagaatacatacgagagacacgataactgtttcaatgcattctttgtctaggagccaaataacgtaattatcataatatagagtgttaatcgtcatgatatagattttataacttttttcttattttcacaagttaatgttagcaaaacctgaacactatttatgacatatgaattattacaatttttgttaattttattgcaaatactaaacaagaagaaaaagaacatgggctatacaaagcttttttattctagtatcccatcataaattaccattatcatattactatatataataaatttgtttacttcgatccataatgattgtcctaaaagtcacacaaaaaataattttaattaattgacataacaaccgataactaatgtatatttattaaactcaataaaaaatgtgtgcaatcaattttcagatagtatatattagctttggtacgttataatttaagtggtaaattataatcctcaaacaattcatagattgatcaatttgtatgtttgatctctcttgtttttttttttttttttggacagcgtcattcaatctctcttgttttaaaaaacatattttatgaaaaacagtttgcttatatttattatatacttctcagacaattaattcatatataattagttagcaaatgtcgagacagtttgtaaaactcaagtgtgaaaacaaaaatgaataaaacccgacataagagatattatctccctatgagctatcaagtcttcatatagagaataaaaccttgcgtgttaaaagtattttgaaaggaaaccaaaattagtgcgctagacaacattcaaggtttacatttaatgtgatcacagacaatgactgctaattgttagtcattcccagatagtctttcattcttcgcttcacgattatggtttaaaattaaattattaaacgagaaaatatataggttatatattgataatgtaat

SEQ ID NO: 2986 - DNA, 1000 bp, Glycine max
  Soy_ogl_300 Gm01:52888201..52889200 Cluster 13
gcaatgagtgcagagtgcactttcactatcacaatttatatttttcgagtatttgtttgaacttggaataaacgattataaatcattttttttttgaaaaatgattttaaaattaaattttgtaaaatatttttaatggaatttatttcttacttttgttgatcgtatttatttaagaataaatttacgttcacttaaaaataactaagtacattttcaacttaaaaacccattacattatgactaactatacatttggtggtccccaccacctaaccaatcatagcataaaaatttaattagttttttaatctatgaaaatacttatttcaattttaatctttatttaaatttcatattattttctacatttaacaaaattgttgtgttttaagtttttttcctcataaactaaaagtatacgcttttttatataagtttttaaagactacaaatgaatgaaatttaaataagatttaatttaaaaaaatttaaagatgaataacacatttaagtctggaataatttactggatgaatttcaggcacggtataaaatactttacaatagaaaaaaaaaagtataagatactttaaactactactcgagctagttaatattctcgcgtacatgtcaattcttaattataaagtttttacccttaacactcaaacaaaatatatgaaagttagaatataaggcttagttatgtttttagattaggggtctattttttaagtctttcagataaaaaagtatcccctcttaatttattataaaaatgtgttgattgtcatacactcatgcaaatatactaaaaataaatagaatttttaagcaatttttcatcttcttatctatcacccgtaactcctccatgtcattatctagctattaatattataattgacacaaatatattggttcactagttatttgattttagaattaaactcgtgatattctttgtctattatttttcactcatacttttgatcta

SEQ ID NO: 2987 - DNA, 1228 bp, Glycine max
  Soy_ogl_1705 Gm05:37372536..37373763 Cluster 13
gttaccgtttgaaattaatgagaaaattaatttcttattattttattggaaaattaagggtaatttcttattcattgatgagttagtttcttatttattgtaaataaagataaaatgagtaatcttattctttgaagagaaaaatattattaatattcgtacaaaatcattttttttatttgtaacattatttattgattttttcattagcaatcaatacttctaaatttatttcctaaggcgaattaatcactttcgaagaattgaatcctttatttttatactccgtaatagactttaatttaaggattttagtttctctacattgtttttaattcgtaattaacaaaagaacttgtgatcggaagaataaaatcacacatatataagaacaatagaacaatggtgagagatataagattggttcgctaccactaacaaaaattaattcagaaaaaatataaatttatatataaaaaaagcaaattgagaatttgggacaacttaaaaaacttgaatgccaagtgagagataaattaatacattgtcacgttttgcaaattgaggagctatataaatattttttcttcaaaaaaaagaatgcatttagctagtgacatactggtaccaagaagattgcttggtcacagttaacaactgttattctatgtaccaaaataaaaataaataagggtgtcttgccagcaacgttaacatgcttgagagcagccagaggattttctcacatctctcgtcgaccatgttgataaacaccaaagttcacgatgaagatacattataatattatattataccctatggacgtgattacgtgaacgtgaaatgtccacgttgacaacagcgtgaggggtggaaattctgaaaaagatgtataactgttttcctattgtggcatcaatacgcatcgtttataaattgttaaagtgaaacaaatcagatcttagcatggtatgggagaaaactactttttgtctttttaactgttaggattttttttaattgcacacgttcaactatcatcatttgtaattttatcataattttttccgcacattttattatatactctttaatttttacccattctatcataatattgatataaaaatgatgtcttttcataaaataaattagtagaaggcgcacaacaataccaagttgaaggcgccgttaatgaagatgaactccatacattttattagagtca

SEQ ID NO: 2988 - DNA, 1400 bp, Glycine max
  Soy_ogl_2458 Gm08:1985401..1986800 Cluster 13
attctaaattttaaaatatctattttttacctcatgaaattttccctgtaatactttgcagtgtgttgtttattgctgccttgaaaaattaaaattattcattactgttgttgatacgggtaagttacgacgaataatcacccatttattttcattctaaaatatttcgtagactgaccaatttctcacatgacattatcccttttatcaaaaaaaattttattcatcaaatttatgtttagctcccacacttattgtgtgttcttcttctttgtctgaagtacttaaccccatttttctagtttctactatatccattaatacaagagagcatactataggacagttgtgttgcgacccatcttttagtttgttcgcggaaaactaaaatactcattttttggtcaaagaaaaaatacttacaaaattttaaattttattaatatttttaaaataaggagaatatgaaaattaaagttttaatttatttcacttcgtctatgatggagtgaaatatttgtttttcatgaaaatagaagtcatttttggattacatggtagagaaaagagttgtagcagaactttctccaagctttccaatgacataacagttgtagcttgcattgtcttttatggtatttaacataaaaattgagcacttttctcttaaaaaattccctcatttttctcttttccttttatattttatttttatctactgatcaaacaaaattggctgtttacgattgtatagccaattgagaaatatctacatgcgatcaattagtttaaaaagtgacatcccattactcaatatttcatacacacataaagtgataaaacactctaaaaatgtgcaatatgctctgaacacaagaactgagttctctcatcattatagattcaaagataaattcaagtattcagacacaaacatttttaatttgaaatcatatttagtaagaaaaataaatttacaccataaaatcatacttaaatgatgaagatttagtattgcatagtcatttaacaaattattatctttttttaaaaaaatcatatgacttagtgtgttttaatattgatcattaaaagtaaaatttaatgatcaatatttatttttcttcttctcacataaaaaaaatctaattaaatatgctaccttcttaattcctctctatcacgtattgattattcatatgctgtattttatatctatacattctaccgttgctttaaaattcatcagatacttctaaaaagagggattatatttccttcatagcagtgccacaaaaacacgtgcagacatacgcgacaacgaatgttgacattaacaagaatcttaaacaatattttcatcctaaaaatcaaagtgatggaagtctttccgagagaaa

SEQ ID NO: 2989 - DNA, 1383 bp, Glycine max
  Soy_ogl_4600 Gm14:1376801..1378183 Cluster 13
gaaactctctaatattaaatacaaattttttaagtatacgttattaaaagagagacgaaaataattgtatatgaaatgtaaaagtgaaaaaaaaaataaaaaaagtaaaagatatactaaaaagatttacagataattttagtatatatgataagattatttattttttaatttgtgtatggattctgataaacgtactctccattttgatgtgtatgagtgaagggaaaagaaaaataagaagaaaatatgataaaaaaagatgtagaagaaaaagtgagggcaggaatataattattatttgtgtattagaaccttaaataataggggaaaacaaggagtattaatttttaaataggtatgttaaaaaagaagaaaaccattaacaagtatcttcaaatgttgtcagtttttcatttggtgtcaaaaagaagtaaattttgtgatcatttaaacacttcttgttccctttacggtgctattggtgaggaaagatgtgtccttatagtgaaatagctgtagggttcctccattgagactatatttttgtcccaactccttttcgtggttgggaggtatcgtccactttgaaattgattggaatgagagataactcaacctactttagtacttgtctggcaattatgcattatttttgcatttagatgtatatctaggtattcgcatttttttaataaaaaaacattgtatcaaatttcaattcgtgttaatactaagataataccaggaatgtagatagcttaattctgatcttatcctgaaaaaagtataagcttatcatatttaataggtatactttaattgattgagtttattaaagataatttgaatgtataaaattaccatttaatctaatatgaatatgatcttgtcctgataaacctattaattctgattttatcttatcagctatctttttatcaatttaaaccttataaagacatacataaataataatgataatatgtttattgtattttataaatgttttcttcaacttacataactttgttttagtcaattatcattttattgatttttcatcattgatataatattataaatgtcataactttttattattttttcaaataaatacataataaaatatatattcaaattaaataaaatacataatctggataaatttgtatgtaaatgttcgtcttcatataccgtcctgatatatggataatatcttctttgcttgtgaatattttttagagtacccacaaagattctgatagactttatcattcctatccaaaaacctagttagtaatatacataccgtgaaatttttattaaatattttttttattaagtagtaattttttttaaaactctttttttatcatccct

SEQ ID NO: 2990 - DNA, 1139 bp, Glycine max
  Soy_ogl_6835 Gm20:382192..38246100 Cluster 13
gtaaaattagcattaatttattctctttttatcttttataattatttacatttatcttattaaaaaaatatcttataagtatttacacaagacatatgcttctggattatggaaagccatttcaaattaaggacatggtcttaaagcagaaatcgaagttgggtgttactacataaaagagaaagtggtataggtttgtatttactctttctactcatgaatgccagcttgctatgactatgaggggaaaagaaaaagactttaatatttacaacatttttagatttaggaatgaaaggagagtgagtgtatcctctagtccagttggataaggatacacataaatccaatgaaagtgtgctaattttaattttcacagaaagacgagtttgtatgtatctctctacaaggctacaactgagctgtccaaaatgcaagctttctttagtagaaggaatcttcacctctaactcatcttttcatttgtaattcctcactttcccttatatgtgggctccgtcacttttaattagtttttcatcttcacctaaaattctttattgatttttttcatcatccctcctcccctgttttttgctactgacagtgcaggaatcaaatattttaacctttgttttttctaataaaagaaattttattaaaaatgcagtctggttggatagaatggattgaaagatgtgattggaaaaatatcataccggattaaaatatgtgagctggttatattatctatctagaaaattttaaaactagacacttaaaaaaaaacaatgaaaaaccactattttcgcaatacgaagcttatcaatttaatatattttgacaaagaaaatgcggaaaacttttagaaatcaaatgtaacaaatggtaattgaggtaaaaatatatatatatttttttagacagaatatatattttgaaataaaggaagtcaattatcaataaagttcaattattgacggttaaggctattaatcttcataaacttcttaaaacgtttgaaggtattttttattttatattatgttcaaggtatactttaaggtgttaattaatagtttctaaaaaaagatagttagatgttagtaaaataaagttgtccaagatttttttttctt

SEQ ID NO: 2991 - DNA, 1246 bp, Glycine max
  Soy_ogl_3547 Gm10:45346055..45347300 Cluster 13
ggttgagtttattatattaaaatacgcatatatctcccattaataatttaaaaaaattgaatacgcatatatctgcaaaatatctgtatacaagctaattgtttattttagtacttatggctagcatcccttatatatctataaatttctctaattttcaattgctacattgttattcattttctcttctaattggtacattggaatttattttctcttccaagttcattatttaattatgtttaatatttttatatttattaatgaataaatagtgagattgatgaagtaaaaatcttttacactatcttccaataataaattatcatacatgatcatttttttgactttgatgttaatatatatcttataaatcatgtcattttattattatttttttattagttgacaacgtaaaactttttacattaataatacataaacataaaaaatttattaattataaaatcacccaatatgttatacttattatagcacgacatggcttttttactcaatgagggtaatttcattttcaaatttatgacaagggagtagattttgaaaaattactcaatcaagagtaagtcgtgtttcataaatacaacttcaataagaaagtcgcgttctattttacatctgatccttctacttcgttctttccaaatgtgtctccttgataatctgaattttctccagcttcttcttcactccttgggggagacttacactccctttcagaagaagtactccaaacatatttgtgatctctcctacatgagcctcaagaacacacaaatacagatatacatgaaaagatggataaaagattcaaaataagacggaaaaaccttgatatttcaaataatatttgtcttctatatttttaaatatatacttaggcaaaaatagatgatgacaacaattcatgattagtagtcctaataaatttatacatacttgagatcgacctcaaacaaaactatcaaaatctttcatgcattattatttgaaaaaactaatcttatttccaatattgcatttctaatagttccatgtacttccacgcgtattgtgatgaactgcaattttattgccggtgaatagtgtgaactatgttacaaaactacaaaagtcatcttctttgaaaaacgggtgcgttgactcttggacaaaactatctagctagggatccaaaacctggttacatgtgggaagcaaattgtttatcacaattattttatct

SEQ ID NO: 2992 - DNA, 1007 bp, Glycine max
  Soy_ogl_6340 Gm19:2394994..2396000 Cluster 13
cagaaaagcataaatgattaaaagaaattttttaaagcttaatatactaaaatgaaataactgctcaacataatatattaaaagtaacataaaatgaaacaactgctcaacataatatattaaaagtaagatgaagccttttttatataataatggtaccaaggtttgaactttcaatcaaaattttatgcaagttatttcaacaccgactattaggctgattttacggggttaggtgtaatttgttttggttcactttgatttgacaacaggaataaaaaaatcaaaccaaaatgaaataaaaaaaggaagtattttttgtttccagtttttctggtaattgatttaatttttttttaattattttgacagtttaaaatattttgattagattttaaatattttgtgttttattgatgataaaactgttgataattactaataagaaatatttaagacaattttatatttcacccctctatctagcacttacacaatcacgtgaaggtaatatataaatttcccaacaagcaagaaatccattggaaattggccagttgtttccatgttgttgcttcctcaatctattcagggaatatttatttatagttaaaagttatttgaatacaaacgagattagaactctgattgaaacttgatttcacacagtaattaacgttagcttctgcactgacttattcatggcgctgtcaaaattgctttacagcgattctactttgtaacggataaggcctatgggttgaatttgcggcaataacttttcaattaagcaaacagtatcttaatcggaatgtaccattgtgtaactgcaatataggtggtaaataattttcacaattaattaaatatgtaatttgggttaaggtgtgaaaaggagttaggttaaattaacctaaatttcttacatattatatttttttgtttgttggtttgaccggacacaaaagttcaagttaaattggctcagtttttttcaaaataatttt

SEQ ID NO: 2993 - DNA, 1069 bp, Glycine max
  Soy_ogl_4648 Gm14:4380701..4381769 Cluster 13
ttactttgtgttagttagacaaaccctaaaatttatataaatacctttactaagtaacatttttttcatggacctaaaacaaggggtctggactactttatacttgggccaacttgtgcctcagattttgcttagttatttaagagtgtatttgttatatctattctccttttttattttttcatttcccttttctaagtaaatctaagagtgtgtttttaaaaaaaaaattgaaaaagagagtgaataagcaagggaatagatatagcaactgccttttaagagttgtaatatttaactgattagttattaagtcattattatttgatgcttttataaggcaacaagtgatcaattttgagagcaaattatcatcgatgtctttttcctacgaggtgtctaatgctggtatgaaattatgcagtgaattatcgaatatttaaactaaatgatatgaacttatacaatgttaaatgaaattacatatttaatttactttttctaatatcctttcgttcttatagaactatcatttgccgccgctagaagctattatatattgagggtgacttttttaatttagtatttaaatcaatgtataaaataatgcaaataaaaataattatatatttaatgatacttttcttatagaaatcatcattcgatatatatagtatatattaccatagacgactaatattgtatttgtttttattttgattggcaccattttcctggttgattgaccaaattggtgtaaaattacgaacaaattatcaaaattagtcaaacatattaattacctcactgtatcacaatatatttcaagtatttttttttctcatgatctgacagaaagttttttttttctggtatcgatgctagggtatgcaatgaaagcttttcgagtgaagtagatgtgaagcaatattgcgtccccagcaccttcagatatgttaaaagtttaacatatttactaataaatctaagtaagatcgtaaagttcaggggtgaatttggttaccaacttattgcctgcacggattaatgcaaaagtaaattttagtac

SEQ ID NO: 2994 - DNA, 1000 bp, Glycine max
  Soy_ogl_6635 Gm19:49976001..49977000 Cluster 13
acctgtttttgtgcagaggataggattcgatagtttcggaaggattcatccccaatctaaaacagacttgttatggagttgtagatagcctcaatggaaaaggtgaatctaacgtacaaaaaataaataaaaacaaccaaaaaaaacaagataaagcaatattttatggtttatattttgatttcaaaatttatataatgacattgtagaaaaaattatactatcaagtgattagaaatcaagtaaaaataactttagttacataattatcatatataataatttataatcgttgacagtaaaaattatttatgctattagtatatttataactatatacaaaggaaatataatgttttgatgtacatatctttacattcattttattcctataattactttcacaaatcatctactaatttctattatcttttcatttaggtacatagtgtctgctttttcctactccattattaagttccaattgattgacttggtaaaaacggttattacgctcgtctatggcataagctacttggttaaacacttgcctcgggtaattacatactagtattacattattagtaaagtgcttgactgcctaacgggcttccactaaatcattctttaacgttttcttgggagattaataatttaattgcagtaataaacaaataatttttccggtgaatcatgcttcttgtatgtgaagaccaccatcttcccactttacaacatctacttgttgctgagataacaatcatgttaatttcggctaggactacaaatattaatattattgtggaactttccttcatccctccctaaaaaagaaacaaactaaattagcttacatcattttgacaagttatatatatttattatttgagaagtgtagtaacacagtttttaatgcagtgcttcatacacactttaaagtgtattaaaaattacaaaatcagaaaaaaaattattaaataagaaatgaaacatactaact

SEQ ID NO: 2995 - DNA, 1564 bp, Glycine max
  Soy_ogl_6620 Gm19:49207469..49209032 Cluster 13
tgctaggaagtaacattcgaccattgttttactattaagtgcatagatcaactcatgttgaatttttacaatcaatgtcactatgaagttttttttttttaaactaatgttctcaaatttgaatactaaatttatagttacattaaatacttcaaaaaaaccttttatcattcatcaatataactttaattgaataagaaaagttaaagaaaaagttagataaaattagattaagaccttttatcattcatctttatttgtttatttctattcaatttgatagttaaaaagttaaagaaaaagttagattaagaacaaatagaataagataaaattatttttctttcatctccattgtatattatgtaacttctttgctttaccatcaccaacaatattataataatggtcatcccttctatgatatccaatatcatcacaaccattattattattgctaccgttgtaacattaataacaaaactattaacagtaagaattaaatactaattttttagagattaaagcgatatgtataaagagaatttaaacatattagtcaatacattttttcatttatcttttatctagttaacttcgtgtgttgttattgctttttatggcgataatgtgttacctaattataaaaggctgttaaattattgaaaaagttttcgatataaatttttaattatagaattcaattttttattgttgaattcaaattttaattattacttaatatgcgtaaattatatttcaagatagatacacatttttgtgtggcttacatgaatttagattatcacataatgagttgaacatcaaaaataagaaattcttactcagagattttttttcttttttttatcacatgctgatgattattattactatgttaatgagagacttgaacctatgactttctttatcacttcaactccccctccccgaagtcgccttataactccctcttaaccagagattgataaggctgccaaatttccatgatagtacccaaaatcgactgtttactcgcttgattgttcaaaaataaaaatagtattaaattgcgagatgagttgtaccaaaaacaaaaggcccatgaagtacatcccttttgtatttttcttagtttcaacataatttgagggcttgacaaaaaaaaataaaattcgaggataattgaaagtaaagtgcaccaatttatatgttaatctgattgattaaatagggattttaacaattttatactcaacatggcctgattaaaaaaataatattctttaataaaattgtcagtataaaaatacatttaatgtgatttaataaatgtaattcataaaaaaaattaatttttgaaacacaatatgaatcttttactttttttggtatagtgggaaaataaaagagaactacatcagagatatatatgtctaattctaaaagataacttttgatgacttccagggattcagcaaataatttggcggtatcccaggttccatgcctccaagagaccctccttaatggctaagaactcagctcgatcgatctaagtgaa

SEQ ID NO: 2996 - DNA, 1000 bp, Glycine max
  Soy_ogl_1417 Gm04:45501501..45502500 Cluster 13
cgaacaaatgggagcttatacccggaaatggaattttaaacgtgaaaaatgttgtttattttaatgttgtaacttatatctcaaactggcttgagttcaagtgccttccagggagtggtttcaaataatttcaaatcagggacctttatttcccaacaattaagaataggtcaaagaaatattggtaagtaatcattaatggctttaaaattaaactaatgaagatattgatttatggtttattattgtaactatagttgaactataaccgaactaattgttattaaaagtatgctgttttaaaaaaaattatataatataataataaagtaaaaaatattaaaacttcgtgttaaatgaaataataaatgaacatagagaactaaattttatgatttgtaagaaaaaaagagctcaaagtaaatcaagtaagtgaatattacgagaaaaataactaaattaggtcaaagatgcatttgaaagagtttatttattgtttatttgagtttttcttacgtttataatcatttatgtaagtgtttgtgagaatttatgaaaataacataatatatttataaattattcttagtttatttcagagtaactaaatatgttttacactgtaaagatatagcaagcaacatgacggaggggttgtaaagatgctggagagtatgcataagtcttcactttatacctggtggacgtttttcatatttgtcaaaataaaccagaatcatactttagtcaaaccgcaacctatttgcaccgttcagacacttcaaagactgatttgcaaatgggtcttgctaataagtattttaggacattaattaaggaaaaactaattttctgaggacgtagttagtatttatctttgcaaattagcgtttcaaaaagctggactgtaccagcctaagggtaacaaagtaattttgttctttataattttcttaaatatttatttttctatttatacaagaattatttggatgtatac

SEQ ID NO: 2997 - DNA, 1013 bp, Glycine max
  Soy_ogl_3713 Gm11:3907252..3908264 Cluster 13
cgaaactaaatggtaattatagttttttactgctatggtaattatacttaatgacatactcataaatgaaaagatgttttttccaccgacaagtctaaattacattgtaaatattttaataaacagagtttttgtttattttaataaacagagttagttccatagagaatgagttatgagtgtttgtcttatcgataaacttcacaatcaattattatagacataaaaaaaaaatgcatatgaaaatgtgccaacatttcttataaatataaaaatagaattatttatctaatatatgaaaaattagaggaagtatttttttattaacatgatttaataaaacataaaattgtataacatatacagtttcactacagaaattcctacaattggaacgtcaagtttcaacatgtttaccacgagacaaattcttgcgctgatatattggctaagatggaatcatcttcagatttagatattttggctctaaactcttgtcctgatgtcacagggaccgtgttcttatgtatgtggttgttctatctttcttactcatcatgtgttataattaggaggaggtgtaaaattatttaccgatagtggacaacatgttaatagattttaattatttttgtttttccaaagagcgggaaatggttgtttgagtatgtgcgatctgccacgtccagacaggaaggcccaccaatttcatccgcccaatttaaacctaagcatctctatcagagctatttctcttatttcttgccggtgtctgtctttgtatatttattaattttttatattagaattagttaatacagttttaaatcttataaactttacccatcttttttgcattgaaaattttaatgagaatgataaaaaaaattttagtcagaaaactaaatgaatgaagagagtagtttaaatataatagcagttaaagggagaagaatttttttaaaaaaagtatacattaatggaaatatttttttttacatgagtaatggaaa

SEQ ID NO: 2998 - DNA, 1400 bp, Glycine max
  Soy_ogl_371 Gm02:4137301..4138700 Cluster 13
gaaagattattatttcccctaaagttattggattaaagtatgaaggaaaaacttacaagaacaaatgaatggaagaaatacaataaaattgttgctctaaccagattcttgaaagacattgctttattgcccaaaagggggatcatcacattgagattcataccttgaaaggaaaattggttctctatgcactgtgcaaaaccatcaatttcagagatggtaaccatggtagtatttatgagcattatatttttcttatgtgtgcacttagagttgagttgcccatcaattagcctatgtttttcaccaataaaatggtaaaggtagaggaagaacttgacatctcactatcttatgctatcttgatctttacccttattgctaaatctagaattgagcttgactctagtaaatttgctgaaccttttatggcaaatttgctgagctagtagagtttagaaaattaacgtatgcgccactccgcgtcaaagaagcattggtgacagaaactgtccatcctcttcattaatccttgactctagctgcagttttcatgaatgtacaatgtttttttatatataatattttgtgtataagaagaaaaatagagaaaaacgtttcataaatgaatgatataaaaattgttataagaattttttttctatattaattatatcatttttataatacatgaaacttcgcacagtacctgcaaacgcaaaatacaagtttggttatctaccgcaatttaaattacatgattttatattaaatttaaattaacaaaatcataaaatcatatgtcgtctaataattattataacgcgccgcatatcttccaattggccatgtgcttaatttgtggctatgcaccttattctctaagcattggttttaaatgaagaaaactttagggggggaaaagaaagacaaaagttggaaaatgcaaaaagcccaaaactctggaaaactactatactttttatttatttatttattctgaaaattgtggaagggaaacatcacatacttcttcagggttaaagccacatggataaatcccttaataagagaattttttttagtaagaatcgagtaaaaaacctcttgtagagtatttttgttaattaagagtaaaaacaagtaagatcaagtccggttataagcataacttacatcacaattactaagtctaaacttaatttatttattcaataaaaaaaagtttttaattcttgacctaatatgtttaaaggtctcatctggtctaaaagattcataaataggcttaagtaggtcaacaagcctctcaaacttattattaataatgttaatttaataattatatacattattatacaaacaagttagcgtatcaagcttaattaaattttttaaaa

SEQ ID NO: 2999 - DNA, 1079 bp, Glycine max
  Soy_ogl_3833 Gm11:10642330..10643408 Cluster 13
cttagtaggggctaaatatagcgttatctctgagtgtgaccctacccaccacatccgccatggcttaactgggtccaagttcacgtggtccactgtatgtacacatgaccaccgttcatctaactgctttgacttttattcctaactcaaggataccatttctttttctttggcttagtgggtcccacacagtttggccatgttctgttcaaacattaacatatgctgcattaattataattataagcaacttatttggccatgggagagttggaattattatccagaacagttttcataaaggcaactcatagcaaggcaagcttttttttcctatttttttttgtttattattgaatgaaatcttatacaagtcttcttaaattatttagacttatttatttattaataaaattaatttcattaaataataagaataataacttcagttaaaaaattaaataataagaatatttttaaaaactttttaccagcatatttctttttaaaatttagaagattttttcctcgtttagtttaccatttcttaccatttaatttataaggctgcaaatattaaactattgttgataacttagtatgtgttttgaatttaatatggaacccaatgaatttttatatgccaaaagaacttatttttgcggtcgtctttttttcttggacttttgtatgatttgactgagcaacactcgtacaattcataaattacgtaatatattgattgtgtttaatattaatcgtactgtacataagctctttgtttcaagtctctctcttaaaaaagagcgcgcaggtattattttttcaaaacttcaacaaaaaaaatcatagctactattttatgatttctaatgggatgaaaaatagtgataaaaaaatggtgaaagagaagcttaaaaatgatagaaagaaagcaataatacgtatgatggaaaaaaattatataaaaaaatagttttgaaagttacagattttgtaacaaagatatgaaatttctataaaagtatacaagtttataaaaggagtatcatattatttgtagaatgattagatgtatt

SEQ ID NO: 3000 - DNA, 1084 bp, Glycine max
  Soy_ogl_718 Gm02:47505317..472400 Cluster 13
ttggaaaatgaaagtggatatttctgttttttgaaaattttgtacatggaacaaaaagttatttgtgatttattgagtaatcaaaatttcattttttgtttgtctatttttattttactagtgttgccctatgatttttttataaaaaaaataaatcaaacacaaactttagatttgcgatgcccaataccataaaatcaaatactcgtttattcttctttgaccaatagtagagttgggaatgagaaatttgattttgtgattataaatttagaggttagagagtgttgagataaaaatgggaaagagaggacatcaagttgtttaagggtaggtggattaattaagtttgaattacatggaacaatataatatatagtaagaaatgtaattgatatttttatttataacagtgtttaactttttaatataactttgattactttgaaaaatatttaaaatcatattgaaaaaaatatataactaacatattgatcttcgtaatcctacacatatgagtagcttttacttcctaatacttatgaggatgcccatagttaattaagacataagtgagaaactggaccgcaacatatatgaatcacattaattccaccaattctttttctggtgactacattccatgtcctttttcagccggcaaacaggaagttaacgcattaattgtaatatgaattaggttgaacccctatacacatagtactaattttgtccaatagtatgatagttaccatctctaatataagccattcaaatttggccactagatccatttgcgtggggtatgtaattaaagaacttttctccactaattacttagctcttgtgacttctctaatgtgattgaaaggctaaattttagacaacgacaagtaaacaaaccgtttattcaatgaacatgattttttttaaataaactactacgtctaattaacaacaataaaatttaaactcaggttatgacctctttctcttcgatgagattgatatataatcaaacgcgacaaaaattatgtcaaatatgatgtttatatatggcagtgacttcgcgtaggcacctacc

SEQ ID NO: 3001 - DNA, 1000 bp, Glycine max
  Soy_ogl_2144 Gm07:3045301..3046300 Cluster 13
gcctttatccagccactttatccctattttgttttcgattatagacggcacaatatagccaccattgttgatcaaattttagacagctatctatatcactgttaacattcttcataaacgaataaccacatcaagcaccaaagcatcttagcatcatatagctccatgaaaattggaatgcggagagtaaagttaaaaacatgttatcataaaaagataacttacttgactaaattgaatttataaagttaagaagactaaattaaaatccaaattgaacttaggagccaaatttctttttaataatattcaaaatccaacgcgaataatattcgaagcaaattcgagaatctcaaattctcaaattatgttcactatacacctgcacaagtcttggtacatgggagaagattctcaagccatgcgttgggctatgaataaatacttaggtttaatggcattaggtcaatgcttttgctttatttatgtgggcttaggtctgattaactaactcaccgggattaaaaaaattggtcaatttagttaaggattaaatttctcttaaattaatattttttttcaaatctatctcatcaacaaaactaacaaatattaaccagtgttacattattctaagactaatattaattgataatatttttgtgaaaaaaaataatacaagaaacattttaaattgaattttataaaaaggatcaagttcatcttttaatttataccttataataaagagttgaatggagtaatacattaagtaataagacaagtgtttattgataaggtggacagcatcataatgatactacatgttttcatttttctttcttcttggtttgtaagtcaaggtagtgaaatgttaccacttataaccttgcgaaggagtgctataggtagttagtttgtaagaaatatttattaactccaataagttctatatttttttttcaaccaacaaaaggataaatattaaagaacaagcccc

SEQ ID NO: 3002 - DNA, 1167 bp, Glycine max
  Soy_ogl_4464 Gm13:35829101..35830267 Cluster 13
gatctggcgtttttggcacaatccatgttgttgtttggttgtattaaattttaagaggaattaatattatttattataggttgaaatgcaataacttttgaattattaatagggatgttttaaaaaaattaattcttcttatatttagagttattttttttactcctctcaaaattaattgagttattaaatttgagaatgaaatatttcaatcaaacacaattaatttaagctcaccgcgtaagtgtttctttgactgaagtctaaaactaacatgcagaaagaaaaaaaatgattttcaggttgacgagcatgaacatcaaacttttctattttctaactcatacgaaaaagaaaaggtaaagaaagaaagaaaaataagattgttagaataataaggctgatggttaacattagatagggataaatttgttatttaaaaataaatgcgccaggaatgttttatattttttttataaaggaatgatttatatttttatgacaaaatcaaattgtcagaaaaataaaaacattatcttgaaagacacacagtttaatgacacgttcctttcctttttaaatgccttgcttcaagttttttttttatgcatgtaaaaaaatgccttgcttcaagtgattttattaatctttaagaagattttgagtaaaatttacctcctgtgtaactttctcttcttaattgcctacacttcctttatacagagacagaaagagattctaataacctcgtcactagtacaaattttcaacaaaaaacaattaaaacaaacaaatgtagtgataaagcttttccgtccccttttccaataaacataaaaggaaaaaaaaatacaattaaagaaacacttttattataaaatggaagctttaaaaaatttatcagtgagattcaaacactgcataaggtcatttttcccccacaaaagatctgtttggtatgaccataattaagaccttaaactttttagtagtatctaaagtattctcaaaaacttcaattttttttatcgattataagactaatcatccattgtagaaatcaaactcatattttttttccagaaatttaacttgttttgttaataaagctccaaccattccattgagtttccatgtatcatagcctcactacatacatataaagcc

SEQ ID NO: 3003 - DNA, 1200 bp, Glycine max
  Soy_ogl_6841 Gm20:38375001..38376200 Cluster 13
ttaatgacaataaagtatttctctaattaatgcaaagcaatattttgcaaagaaaaaaaagcgcactatctgagaaaaatttcgtgagaatgataattatttttctaactcatcatggtttccaaatgaagtgttgactaatgcatttttctacatataatcagttttcaaactatggttcagttaaaatttcgtgagaaacttcttaggtgtgctttccaatggcaataagccattctagcaattttatattttggatggaaaataattacttgatgatagtataatgtaggcaatgaatgcagtttcgctatactgattttttagacaaattttagtattaagactcacatatactaattttttatggataaaatataatacattttatactagattgtaaagactcttgccttgaaaagaagaaaataacaacaattaataaatgtggcgaatgcccctgcataaatctgcatgtataaaatgtcttaattttttacacgtatcaggtttattatcaacaaacacgggggcagattgactcgatccctgtcgaaccttaaagaaatcgaattcctttgaaggttagttgggttttcctgaaaataaataaaaacatattaactataccttagcagctttagctgtagaacgtttaggcagtataaagcaaaacatggtgacttctacagacaagcctggcgaccctgaatacaaaacaccttcaactccaactcctgcttgagttgattcctttaaatttgaaaccaatgctttagttaatatataaccttgctttggttccttattatgagagagagcttttaagtgaagctttccattactttatataaatggaaacaagacaagcctagacaagaattttcttggtggagaatagttgttatgtgattaatttgtcagaatccatttttaaaaaattaccagaattcgatttttgtttcctattaataatgctttggagagttaattttattgaattaagttttatttttaatgcttcgttgaacaagtgatagtctaaattattcacctaaaaaggtatagattattgatatcttaacaaaatatataaattctatatagataaaaaaatataaatatgtgagtaattccgattagatttgtaaatgtgggtgaattatgcatctaattgattttgaattcttttttccaaaa

SEQ ID NO: 3004 - DNA, 1329 bp, Glycine max
  Soy_ogl_397 Gm02:5305572..5306900 Cluster 13
ataaatctatcaaggttaaataatttcaaagattattcacaatggatataagactcattgataaaaaaaaaaaacaagagctaaaagaaataaaaatacttttaaaagattattcatgaagttttgcaagctgaaaaaaggttcagtcaaagtaaaatccaataaaaaaaaataacttaaattttttttttggagaatataataaacccaacatttcacagtactcaaaataaatatgcgaactgaagttataaacttatgtgcaagtgaacatgtaaacttgtatttgtattattttatttactctaattaattaactgttcatatatttactctgctacgtttttggtagaggttcaatgttcatatctgatccaatgggacttgttacagttgtaacatggttctatttattataagtgccaatctgcatgatgagtacagaggagaaggactagacgccatttcacaaagaaacagcgtcggtcgccgcatgcaatttgatatccaatgcggacgtgtaactaatgggtactaatgcttatcttgccaatgagacaaactccacctcgaccatatccaagtaattacttggatgcagcgaatccagaaagaatgatactttcattttgatagcgaaagaaagaaactcaagcagataacattaaccagaatgttcaaagcattttaactagtcagcccttgttggccaacaaacatatatctttaaatattcattataatttcaattaattcacttatccacttaaagtaatctgatcaatatctaattaataatgattagatgtagaggatgtagaagtagaatgctattttagcagcaatttcggatttcaatattttgctgtttcagttttcaaatattaacattactttcaaactttattttttggtaattcaactatttatgtaaaaggaaaaaaatatccaacgccatacaaagtcctaaattgcctacaactagatgggattatttggcctcccaattgatcttcacagaatggctgaagtctaattattaagaaaggaaataacttataatggaataatggagtgcgagaccactttatgtgagctgaatgatcgtttgccctcctccttatcaatccttgcaaggtcaaattcaaaattatataatcatataaatcaagtcattttctactacctaatgtttgcctacaaataattagtttcaagaaatgacattattttatacccaaagttttgtgagtccagatacatatattttgggtggaagaagtttgatacggcccattgttttttaagataattttgattctctaagtt

SEQ ID NO: 3005 - DNA, 1259 bp, Glycine max
  Soy_ogl_1793 Gm06:5323301..5324559 Cluster 13
aatgaattatatatttttaatttgtgagtctataataccacataagtttaagaactttacacaaaaatttactttaacgttaaagttactagaataaatacttaatgacttattaaagttgatagtacattaaaagcgtgtgagaaagaataaattttgaaataaaaaaaggtcatttaagttataattaaattaaaatagagaaggagagtgtacttaataaaaatggagtggatatagcatttttctaatttttttggtttagttgggtcatttattgggccttcgtaatgtcatcggcagtttccatttcaaagatgagctaatgtagaggtgggaacgtaaaaaaaaaaaaaacaaaaagactcttgagcccttagatatcttcactcattcaggtggtgtcgtggcattggtttttatcccggttcggtgcaaaactggggatatttttcgcatcttgatgcatggaccctatatcatgcattatgggtagatgattttttgtgtgaagtttctgctcatatggttaactttagtcttagccttttacatgatgtataatatccttatccattttactacatgtatagatcagtgaaccttttgttagttcatatataaatatatatgccttatgactttaaaaaaaaatgtgtcttatactcttttttcttttgagagggtcttgtactctttccaaaatcagtaaactttagcttataaaaaaaatgttttgtatcatattattagttttgatgtacaagaaaataaatgttactagttttgacatagttttgatgtacaagaaaataaatgttactagttttgacatagttcgttgacgacagtaaaaagctaatagtcaaatgtttcaccttacctacaaaagaaaaggttaaatgatataatttaattttagaaatctaatgttattagatcctacattttagatatttcaaattttctgttcaacccttaattttacatatattttattttagtccaattgaaccctaatggaatatatttatataagatattgtccacaaataatttaattaattaaaatataaaaaataataataataagttatgcaaaatctagaattgaatagaaattgcaaaattttaaaaacgtagaaactgaaatggtgaaaaaaaaattaaaaggacaaaatcatggatcaagaattaaaaagagactaaaattataatttagtctatttttataatgcagtacgaacaattagaatttt

SEQ ID NO: 3006 - DNA, 1053 bp, Glycine max
  Soy_ogl_1195 Gm04:2691601..2692653 Cluster 13
gaattgtggagtttaggctggagatttgatttatatatactaggggaagataggtgactctaaatttttaaataataaaacaatagaagttaaaaaacaatggcagaataaaaaaatttaataatataaatgtaatgaaaatttaatttaagttagaataaaattttaaaatttaagaagtgatttaaggataaaattatctaatcaaatatgaatactaaataaaataattctcattattttaattatagattaatagttatagactagagggagagagacattggtgtctctttacgtattttaaacatttatttttatatagaaagaaaaaaggatttagaagtataaaaaaaaaaaacttataacaaatgagaataatgaataattattaagagagagtggtaggagtttaaaaactgataaaagataaaattgtctaaaatttatagacataaaaaagatatttccttattaataagatagattaagataacatgattttcataggaaaaaaataacaaaaatgacgagggacgtgaacaagaaataaaagtgcgagtgtgtgaccattttggatgagtcactgaaagcatctcgttctagagggctgatgatattcgtaatgacgtgtctcgttctatttcataaatgattataagtatgcattggcaatattttgatttgtatatgttatctttacttgaatttaatgtgatgtatgcgtatgtacatacgtgaaattaatttagttgaaattaaaggttggaacttacgatgttgaccatttcgtgaactgatggcggccttttataaaaatgtttgggtttagcagcctcttaattgagttgtttattaacctatgacaatctgtttccagaaccatagattcgagaaaaagtcaaatctaaatatttcaaataaaaataacgtttaaatataaaaggtttatttattttaattcgtttaaatatatagttaggacgcagtattttcagttttgtataactgatagataaccgacatttccatccacaccacatttcgcaagtc

SEQ ID NO: 3007 - DNA, 1000 bp, Glycine max
  Soy_ogl_3607 Gm10:47543301..47544300 Cluster 13
atgaatatagtcagggcaaccggcctatcaggtataccacattttcaagatgtgatttacgttttaatgtgacatggttatatttacatagtaaacagctccaaatcctccttatcctatcttatttgcctcagaaaagttattggtagcaaccgtgattgtgacgaagtccaattgcaatgtttccactgatataatttcttcatcgttttcagcttcaactgggaatgagttgcaacggatcagttttccaaatggaatactagttcatttttggaaatacgcagcttatttgttttcattaatgttaataggttaaataacactttcgatattcctttatttttttattcaatatactcaatccttttatcttttaaaaaaaattcaagtttgtctttaatttactatcgttgttagtattacaacaagcggatcaaatttacttaaatttaaaagttaaatgacaaaattgaaacgagtgggcttctatgtaaagttttatgtcattatgatctataaaaggtcttcaccataatatctatatttatttgataatatatttaatataatataaattttaataaataaatatataatatctgacaaataagctcccttgtaatgcaattatttattttataaatcttgatgtatttttatgaaacattttctctccgagtaatatatatctgtttcttatgattgcttttagttaaacattgttataaaattaatttatttttaaagtaaaaaaatttgtttctactgtcaattttaattttttttaagggtatggtacaataaaaatcaaataaaacatcaatatatcttcatttttttattttaataacgaactcaataatttcactatttaattccatatagatgtagttcttaaaaaaagtatattccttaaaaaatattaaaaaaatgtatatattatactgaagtggatggtgtgaccccgcctttcaaaaaatatattggtaagttaatt

SEQ ID NO: 3008 - DNA, 1004 bp, Glycine max
  Soy_ogl_6646 Gm19:50369901..50370904 Cluster 13
aaccttaaccatgtgtgttgatattatagtgttctttacaccccctcccaccccccaaaaaaaagctcgatttcaccattcagagaccaagttttcttctcatgctttgcctctttttgattcagaatttcttcttatggactaataaatcacgtctcagactcagattttttctttgcatctaaaattcaatgtcacttgatacctttgtatttaaggtgcaatatgaggaaaagggacagttcatctaccagatttcgttaaacaaaatctccccatggatacatttattccaagtttttaaccggtggcaattactttacttacatacctatgtaaaattgttttaaattctctgtgcatcatcattaaactaaaaatatatataaaaaaatatattaatacatttctaccatgattttcagtacactccaacatcatttttagtaaataaatttctgttcattgattttgtacactttcagaatgttaccgtgcaaacaaatgtcggaggataatttacaattttcctaacaacttttctattatttcaataaattgtctaatgttataatatatttattatgaaataatattgtatcgtgtaaaacctaagagggataaacatcataaaaattttcaccattgagcaaatcatatatataaatttaatatcacaatttgaccaaaatcttaaaatttaaatttatgagttttcttctaatttatataatatttaattttttaattttttatttatctaatatgacacttttaactcatatttatattctatttcgataatcctatatcttaaggtcatttctgcttcatgtattgaaacaaaaccaatcctttctaattcaaatttaaaatgttatatctaaaggtaaataattttcttaaattcaaatatatctttattaagtatctcaacacataacaaaatcaaggttaatgaaatcgattaaaatgttttaaaaaaattaataggacgaaatcag

SEQ ID NO: 3009 - DNA, 1100 bp, Glycine max
  Soy_ogl_1788 Gm06:3562301..3563400 Cluster 13
taatggaaatacatgttagaaatgggtacacaataatgtaaagctataaaaaaattagacaataataataatattaatgacaatcatttcaaaaaaaactaaataactgcttggtgtttctgtaaaaacataaaagaaaacataagtatagtacatatgcaaaagttgtcatataacaaaaatacaatacataaaaatataattaatataattggcttttttcctaaaaaaattctttataaattacatttgaagtagtgtctaacatatttccatcattgtcacgtatatattagtatctttagacaatatacgattagtaatttttataccccatcatataactatctataagagaataaaaaaaatactttaggagataaattttaattgatttgactttatttaatgaatctattattaaaatattcattatttagttgaaaatttatttccagtaacttattcttaatatcaaaatataatatcaattaataaacaaattaaaaaataattttttctcctaaaagaattaataaaattaaataatattaaccaatttttaattaatataatttcttacttatatatttaagacagaaaaaagtataacctaatcaagattttggtgttgatggccacttggcactatcaaacaataaagaagtcatcgaatgacacgtgtcactagataaaatgaatgacccgattccaccaggtgctagctagtcctacttctgtggatggtaaaacctcatctccattgagaaaatcaggtgatgagctatcagctatgtcttttggcaagaagtagcagaacaagtataatgtttgtttgtatcatgcctatcttgtttactatttctttctcttctgttcttctgtatactaatccacatcttttctttattggtataaattataatcaagccgaataaaggaacagatgagtaaatgagtttgagttacattttggtattatgtctattgtatttctcatgccttttttgatatataaaataaaatattaaactttgtttgttagacaatattaaaaaatatagtttatacacttcactattttgcatgacagacaatat

SEQ ID NO: 3010 - DNA, 1100 bp, Glycine max
  Soy_ogl_2477 Gm08:2802601..2803700 Cluster 13
aatcacaataagaagaagaataacaacatctttgatgacaatatgtaattaaaatcacaaatgttgtcaatgcatatattattgtatgtattttatgtttattttttaaaaattgttcgaatagaaaggagagattcaaagtgtccaccacatctttgatgtaaaatgtaggagactcctgtagtagaatttaggcctccatttgctagatgtgcccttgttagagcatttggttatcataattttatggggccttttaatttcatatagatttaaacactctatatgaaattcactttaatgttaaaattgttattaaaatgaataattaacttaattttatgagtcttataatatttaaaaaatattttatttatggtataaatttgttaaataacaatgttttatataagcaatattatattatttgctccaatagaaaaaagtttaaacaaggttacttaaagttaaataattaacgtaaacactcctggagatactttagagtgttattatcactttgggctgattgtatgggaattaaatttccaggtatatgtagggtctcttgtatctctacatataaaaaaaaagagaataaataaataaatcaacgtgaagagcaaactagcaaattttttgccccagctttaatttgcttcccaaaccaaagccacgcatattatttccctcctacacttaaaaaaaaaaaacaaaaaaaacccaatattatgatgaggattgaggagcagtctggaatgggcaactaggaagacaaagacagcatgagaaaatcactttaatttaatatactaattattatattaaatttaaactgagtgtactaattaattattcaatataaatataattctatttttaatttattttgacaatacagtatttttgtcatatttatgttaaatagactgcatgacatatttatattaaataaactagatgatgtagtagttttgttgtttgtgtattctcgtaaggtcaaggttcaaatctgagaactgacaataatttgatttattcagaaaaaaaaattgatttcctacatgttggatcttaggttaatatatggatcaaaatct

SEQ ID NO: 3011 - DNA, 1108 bp, Glycine max
  Soy_ogl_4894 Gm15:3627824..3628931 Cluster 13
ttatttcttgattttttttcatttttcttcaaccaaacaaaggaaaaaatattgttaagtatgttttttttttctttcaatttgttttcctttcactttaactcttttcaaacggatcctaaatgatggattttttttttgtggtgaatttggatcgcccttctaggtatagatatattcatatttttcttttaataaataattgattaaagaaaagaactaatttgattcgatattaaaatttaaagggtatgtatcattaaaggagaaaaagtgaggacataaattcattagagtgatcattaattatataggatataaagtggaaaaagcataatgataatacaataaattcctagaaaacccgtacctaaaaatagaaaaagaagaaaatccaagaaggcatgtcttaattaaggcgttgtagtcaaacctttaaacccatttgagttcagtttttttggatttaaattcttcaatttgattgaactttttttttttttacttggtcagaagggggaaaaaaagaaaccagagaaatgatttgatttctaatcaatataaagcatgaatactattccattataaatcttcatttttttattcatccttacctaacaaattttaattcataatcttaaaagtgaaacatctaatctttgttcacattttcgtttttgcatagttatatatctttatcgtatacgttatataagttttcatatcaaatcaaaatatttttaattgtttatttaatcactataattcttattttcttttattttttaatcaataatcaaattcctactacagaattagataaaatataatgaaatattttaaatcaccagaggtgttctgtttgatgtgatctttactaaattgatctgttactgtttgattcgaatgaattttgtgatatttaatcttttgattattttttataattttaaaaaatagcacaacaactaacaaagatattaacacaatataaaagctactaactaatcgaatcattacaagccttaaaactgacatctacataatataaacagtaaagtaacaaaaaaagtactaattaaaataagaagaaaagttatgtttcacg

SEQ ID NO: 3012 - DNA, 1233 bp, Glycine max
  Soy_ogl_5456 Gm17:2285701..2286933 Cluster 13
taaatccgattttgttagtatttggtggtgtgtctctcaagatttatttttcgtttgttcatgtaaaaggctaagttgtaattgaattatgcaagtaacttgtaatcaattgttagtatttgttgtctacttattaacatatctaatgaatttatgtttgtccgttctttccatttcaaatattagttaaagacatatttttagtaatatatgatattttgcctttaaaggtttatttttgtttattttcatcaaaagataagttgtaactgacaagtgaaacataattaaggacttatttgtgcattaaatatatactttttttttgttgttgtttattgattaacatatctaatagctttatgttgtgccttcgatatttatttttgtttattctcgtcaaagaataagttctaattgaattacacaagtaacatctaatcaattacaaaactaatgaaaactataatccctagattttcccttgtcttaccattggtgattgatttccaattgattagtttgattgtaatgatatgcaagattatggcaagtgaaacataattaaggacttgtttgtgcattaaatatatactatcttttttttttgttgttctttattgattaacatatctaagagctctatgttttttcattttttccatttcaaatatcagtttttttataagatttcaaatattagttaaagacttgtttctaataatatttgatgttgtaactttcaagatttatttttgtttatcctggccaaaggctaaggaatcacacaagtaacatgtaatcacttagttacaagattaatgaaaactataatcgatcagttttttcttgtcctatcatgggtgattgatttacaattgattagtttgattgtaataaaacatggtcaaacatgtaataattaaatatgtcataactttttaaactttagtataaatagtatttttcttataatttaattgtttactttcattatctttttcactcacggattaagaaggacttcaccttttttctttttattttgtttatccaatcaatacatgtaaaaataacatcattattcttatttttctacgaaagtgaagttcatacgtatttttctttaaaaaacgaaatgaggttttaagaaaatatcttcagtttttttttcaaagcaaaagaaggaaacattttcaattaatcacatctttgaatcgtcctgaacaccaa

SEQ ID NO: 3013 - DNA, 1093 bp, Glycine max
  Soy_ogl_6995 Gm20:44693708..44694800 Cluster 13
tcatttatgttacatacagtttataacatttgttgaagtttctctaaaaaaaacatttgttgaagttaaatcttggtaagttcttttttactaaagtaaaaactgtaaaagcagcataaactattaagtaaacattactccgattataggggggggaattacgttacttcatttttttttggtaacactttacttcatattagttaacatttttaattatactaatttcatttaatattttaaaaataactttttttaattaaaagttaatgtcaagaataaaagagttattaaaaataaaatctcaattaaataaagagtattttagattaaatagtcaattaagtcaagaaaatttatttcaattgattgaataggacatataaatgattataaacatctgttttgattctaacaaataaaaaaaaaatcaactaataataattttgatcattaggtaatgaacaactgttttcctacgcaagaaaggatttacatttacggatttatcaagtaatcgcagacaaattcaccccctgaatttgttttcctaactaagtacttcgcaggaaaaaaagaacgtctatatgacccgcattcgctgttccaactagcatattaagatgcttgaaaaaatcatctatattaccttcaccaaataggtggtaactgtctatatatatatatatataaaggtggtaactggaaacaaacaacgaacaaagaatgttaaagtgtcaactactccatctgtgtgccatgtatctccttgagttttttactttacaataatctagttactgccaaataaattaaataatgtgcaagaagcataatcttctatagcactaaataaatatctaaagatagaacaaaaaaaaaattgtaaaccgcttcatccactgacatcataaaatttaaggagactatcatagattatttttattaagaaagattatcgtagaacattagtttttgataattaacaaaaaaaaattagcatggccgtgtcactttgaacttagaagtataattatgtgaacatgtcacgccaacactccatacattagtcaattatcacacatatgataga

SEQ ID NO: 3014 - DNA, 1082 bp, Glycine max
  Soy_ogl_1120 Gm03:47095501..47096582 Cluster 13
tgaattttcacttttactctaactctcatcaaaggaaatttcagggtctgtttcttcgtcaaaagattttctattgaaaccgcttaataatactcaaatggtagtctattaattaattcataaccgtaattaatccagtaatctttcagaattcagaataattttatgcgcattctacttttcgtcaaaaagcattcgcgcgtagtttgaagttgattaaagaaaataagaatttgattaatcaaacatttttaatttttttaatttgttttttaatattttattaatttcagaaactaatttaattaactattataattttaaaaactaaattagtaattcacttgtatttaattattttccattacagctgtatgaaattctcatttggattcaagggacactttgcataattcggaaaataagaaggcttcaaaattcaaatagtcaatagtaaattagcttatcgtataaaagtaattaaagaagtgactcagcgccgtcaaggttaataatgttccggtcggtcccatgttccaacttggtttatgcccaactgttattatttttttttttaaaggagttcaatttttattttgtcacaatcttttcttcttttaaaaaaaataataaatagcaaaaccaaaaggtaggtttaaaaaaatatatgcattaaaatctcattcaaactccataagaccacgacggagtaatttccagttgcttatttaatgtaagagtaattattacaaaagacagaactcattaaaataattttaaatcaattaataaagattcagtccaaaaagttcttcaactgattaaaaaaatctacaaagtaattccttcgttagtttttagtacaactaatatagaaagtattttttaaatttgttttgaagcagttgatataatgtgttcgtcgcaatattacaaaaatatcagcacctaattaatatacgacttcaaaaaaaatgtgaattcatttatttcattaaaaaaagagcaaataagttcatataacatgcatattttattttttaattatttatagaaaatattatttaatttactctaattaa

SEQ ID NO: 3015 - DNA, 1321 bp, Glycine max
  Soy_ogl_1110 Gm03:45968380..45969700 Cluster 13
atctattttagttgttttccacatctacgttatgattgattatgttttccttttcatttcattgtgcttgattgggtttgggcggtttcctcctagtttaggacatggttacattaatttttgcacaacgtgttaggttgtttatttggaaagtttttttttcccttgagagtgacatatttgggaagttattctttaaaacatatttatacgcatgaatcatgattaatccggttagatataattcattttaaaataacatttagtgcatttttattttttttacagtcatctagtgtatacttagcaagtatttcagttaatttttagtttttttttttataaattaaaagatttatttgatttattaatgatgtttgataaataattttttaatagcttgtattattttttgaaataataaattaaataacattaatgctaacttttagcttattttttaattcttaaatatttattaattttttatttctctttttcacacacacatataatagctaggatttcattatttttacccctcctcttcttaccctatttattttagttattacactactatttatattattttaacattatttttaagtattatactaattaacataactaaaatatgacaagagtttaaatttaattaaaaaaccaaaattataattactttaaaaaatattttttcaacataattttcagctcttcaattcagaattcacgtgagaatgaaaaggaagatggaaaatttaaagcatggaccaaaaattaacaataaaagtcatggtttcacacatgaaattaaacaaccataaccatttgtcaataacttgtgcacttcttcaattccttgtgaaactcggtcgcatatgccttcaattaacttaagtgaaagactggtatagttgctaaaaacatttcgcatgatcttcaccaatgtaatacagaaactcaaccacatacataaattaagaaagttaattaatacgcccggccatatttgtgccacaaacataaccaaggtgaaagtaagtaatgatcaccatgactatatggaaaactaaccttggatttataaggtagaaatcgtgcagccttcttctgaacgccatgacaatttacgtgaaagaaaccatgggagaaaaacaactaatctaaacaaactaattaaggtaaaagtaacttgggttaactaccaaaattctattaattataaatacataatttctaatggaaatcgtgcaaatcatcttctgaaaaccccctgcccattcacgtgaaaggaaccattggagaaaaacaaggattt

SEQ ID NO: 3016 - DNA, 1100 bp, Glycine max
  Soy_ogl_1188 Gm04:2477201..2478300 Cluster 13
gtccgtgctcttttaaattttaatttttaaactaaatgatattaaaaaatagaggtaatattttttattttttacagtatatctctaaatatgaaatcgtattataaacacactaaatattttatataatatattacgcactaaatactacacaacccttcctccattttcttaagtgacgattctttgaaaaaaattatttctacttatctattattttcaaattttaagataacattaatttttttaataatatatcataagtttctaccaattaaacaccaattagataattatatcctaacattgattcttgaattaatgcaattgtcaccgacacatttatatgcatgtgtgttaagcataacgtgagttgttgtaaaatcgtacttgatcggttagatatatattctttaaaaaaatatatcatttcaactaatctcatgactaaacacaatgatacaaggatgttaaaccgccaatcatgccacttattctctcttacaaaaaatcattttgtactagttacactgagtatgttctgttcacttcacttctactgaatattaacttgaatgtcaaaatctatgcaggtacacaccccaacgctagtgacaacctcatcatgactaggtttatggatttaacttataaagcatcctatagcagtggagatgaacaaaaattaaactcttaatattttaacaaatccatttataattaaaaaaattaaacttatttttaggcccccacaaatatcatcattcttgattttagtctttatcaacattttattcatttccagttcttaaatgttaaaaaaaatgtgattacaatccctcaaaagccccctttatacagcgacttaaaaaatatatacttttgtagtatatagattaaaaagagatacagttttgataaaaaaatttaaaaataataataatttttcaggaaccaaaattatatttacaccttaaaaaaatgaaagagtttatgaaataaagataggtgtatcaccactccattcgaagcttcagcattccaaaagtggtctggttgatttcgttagccttttataagaatctgctggtttcgatttt

SEQ ID NO: 3017 - DNA, 1073 bp, Glycine max
  Soy_ogl_5869 Gm18:1566443..1567515 Cluster 13
tttgtggtatcgattaatttctatacgacatgtgtttataatttttaatttatgaaaaaattaataatattttactactacatgttatgtagagattagtagggatagagtgatctcaaatcacctaataatatataaagtgaggaatccatggtttttgcattagcagacatgcgcacacaagaagataatagatgtgaagaggttcagtggactaaaaagaaagcaagatgttaccaatcatagctttgaaaaccagccaattttaagggaattgatattggttcttctaaaattaattttggctcttattatcaatgtgtaaatatcaaaataatacaaccaaattatcatttggttttgctatagaaattgttataaaatacaattataatttcgttgtatcataaaaattgtaactcaataaaatcatgatattcttggattgcaaattatgcaataataatggaaaagatatacaagagaagtatgttatatattgtacaataaaatcatatttttattatacattttttgttaacttccacttatataataaaaatatgattttattgtgtattttttttatacattcaattacacaacggaaatacatttccgctaatggctgcgaaatgtgattgtgttggattagtagggatattttttaaaatttaaaaagatgataggggccaatagtaaccccattttaatttcaccgttgcgtttggttatgtatgctctttagcttctcacccacttttttctttctttcctaatgttgattatagaggggcactagtggattttcagtccacttttttggatggcttctttatactattatttaaaggttttctagtgttgattacagcaggtgtatcgtgtgagagaatctttatattattaactcaaaaagaaatatttgaagttacattaaaaagaaaaaacaatccaccatcggccttattaattaaggtttttgttttttttttttccgtaaatttcatccatgacctatatcttccaacactcaaggcattcccacggttagatttccatagaattagagg

SEQ ID NO: 3018 - DNA, 1000 bp, Glycine max
  Soy_ogl_1006 Gm03:40779801..40780800 Cluster 13
aaacattactatactagctaggaaacttaattccattgtctgcttaaatctcaactaggtgttgtcttcttcatccaacttgaagtacttacgatgatcagggagtaaggggctcaagtttagacgttgatattggaaaattgtactaatccaattttttattcaaattaaatcctacaatatatattacacatactttatacaaagattgagttataagaatatctgaaaaaggatgaatgtgagatatatccattaccaatatgttgagaagcaattgtaaccaataattctcatatataaggtaaaagacataaattctcataaccaataattgagtaacatgaacatccttgtgatcttagtcagcaaccataaaaatagtaaacatctttgtgataacaatatgaggtaacccatctaattaacctggataaactataatgatttaaatcatttactgatacacaattagttgtcatgtttatgcctcgagtcgatcttgtgtctattaccatgttgtttagtgacaaactatatcaacatatacccgagaaataaaacttattattaattaagtattctaacaaatcaccattacatattttttaaaaggaaactaatgttgatattaatcctaaaagttaattttaaacattcaaaagcaatcagattataattaagaaatattttttatatcataggaaatattaaaatataatgaattttttcattttaaaattaaagtcatccttaaagttttttttggtacgtcctagttgttaacaagatcatttttacatatattaataacgcataaaaatgaagttcaccataaaacgtcttaagaattgctatatataatctcacaattatttaaattttaaaataaaaacaagacatcatgaatgatgtggcaaacagctgcaaccaaccgttgcaacttttttttaaaagttaattaaagttcataccaacttgaagtaaaaaaaaacggaaa

SEQ ID NO: 3019 - DNA, 1257 bp, Glycine max
  Soy_ogl_5440 Gm17:1251428..1252684 Cluster 13
aagttcaccgttaaatattcaaatgcaactacaaatgcattatttttctccccttgtaaaaaatatgcaattataaaattctgcttctaccgcaaatactagataaattttggaatatggttaaaagtcacaaattagtttgattatgatattggtgtaaaatatttattaattttataaaggttgagagtttgtaaatatatctcctaatcgacttaattatatttataatacattttaaaagtatccgtccatatctctaattaaaagtttacgattattttttcataatgatcctcaccaattaaaaaacaaataaaattttaagaactaattgaaaaaaaattcataaatctaattaaaaaattgataaaaatattggaaatccataataattaatcccaaattaaaaattatattcttttaaaagtttttttttaaatacacgattcttatgaaaactacagctaggcatactcacgattggtatttttaatttggatgatcttatatcctcttattaattttcttacatattctcctatattaccttataaagcaagtattaaatgaaagaataattttaaattttttaacaacattttcttacttaattttattcttttgtgtggcaagtattaaaagtaatttatgttgtgtaacaaaaaaaaattatattttcaagatattattttttttcctttatgtaagaaacaaattaaatgaacactaagtctagttactattgccttctttgttagcctgtcattcatcattcttgtgttggaagctggtcttgggtttgagatatgaaattacccaaaaatatcaaatacttttttttggttgacctaccatggcagtctttccactaacaacttcctttttagaagatttgtatcgcttgagtgtggagacttggattcataccttgcgagattgtcttgccagctacacaaaacttgaaagttgttcaactttgatggtgcaatatacctcaaatcaagttgaagtgcttttcatcaagaccatttttgacagtgttgttactaagagtagagaaaaatcctagacaactctaacgggttgctctcgaggagtcattttgcaagcttaatattgatggaaatttcattgggaaccatgatcattctaggtttggtggtttgtttaagaataacttaggtggtcgttgggttctcgtttactcaggttcgcgtgggtatattacaaacattgataggaagtattaatgat

SEQ ID NO: 3020 - DNA, 1164 bp, Glycine max
  Soy_ogl_742 Gm02:49117001..49118164 Cluster 13
attttataggcttgaatttaacttggtttataattatcaatgataaaatgacatatttaatagttttttaatcatctagtcgttggacatatattattttgacaattatctaaaaacaaatttctttgtatgtaatttaattgtaaaaatttaactatatttttaaataccatattacacacacatattaaaataagatattaagatggaatgttaattaatttttaaattgcatgaaatcttgtaaacttaatgtaattcaaaaacacaaatgtcggatcaataaaatttaacttccataaaaatattattgcagttgtaattttatcaagtctaacattaagtatcagtgaatcttgtctcttaattaaagaaaataacaatatagcaaatagcaatatacaaataagagtggtggtaaaaattctcattcattaattttaattcatttttacacttgcttacagacgacaactcactcttataagaagaaaatcctatttcaaaacgtatacatctcgtacgacttcaactacaagaccagaacaaaattaaacaggatgggataggtatacggtatttatacggataccgtgtgacattttaaaaacgttttaaagtttaaattaaaccaatgtcctgttctgagattttaatacgtcctgtatttgtaaactatttaattatttaattactagctaagctcttagtaattaaagtactttgattttgtacattttcaagattggccgccttttgcttggtatatatacttatacttctgagtcgtaaactttcatttgtattagcttctatattatgcgtgtgttatagtttcactttatgatatacaattttcaaaatgcatgcttgattattaatttcatatgggtgacattcctaatttggcgtaagagtaagagttatttcaattttaagggagagagtgaattaaatggatttgccctaaatattcattttcaaaaattagtttaaacatagagaattatgcaagctttataagaattattttagtcttatcactacctgaaatgaaaaacattttaacatacgtacccttctcatattcaagactaaacaattagaacataaaatttgtaagatcagaccattacactcgggtcaaaatttaaatagaataga

SEQ ID NO: 3021 - DNA, 1400 bp, Glycine max
  Soy_ogl_1416 Gm04:45450701..45452100 Cluster 13
ctcagtgatattcttgacagtgtaataaggaccggactaacttaggttgtagggtaaaatatttgtataaatattgtgttaattctcattcgttatatctttatatctgttttctaactagagagaaattaaaattgtgaagtatttttttctaaaaaaagtaagaattttcttcaagggtattttctttaaatcgacctggttctaacttcaaagactaacctttcttataaatcttttaaacttttatttaacaatatcttttgatatatcgaattgttttaaaaagaaaacaaacaaaaatacgccctatttaatgcccctctcgtattttgcagttgtctttttcaatactaacctttgtcattatttaatattctttctccgtttcttttagtctatattatttagcattataataaataataaatagattaaaaaatgaataatttttctttttattattaaaattaattataagttctagcatgttgtatgtctcatatttattactttgacattttacatgttaatagtgtttatctcttatcataaggacataattgaaaaatataaattattcttagaattataaaaaaaaaatcttcaatttttttttgtcaaattaacacaaggaaatatatataaattcaatggtagaaggagtaccaaccacattacaagtagtcagggtgacaaaatgggttcaatccgacgaattaacccactaagcggaacatatatgggggtggacttgaattttcaagtagctaggatggaccaattgaggagtcaacaataagacaaagcaaattgatccattttggcacccctgcaagaaagggaagcacggtgacaaagatgagaaagaggttaatagctcctatctcaaccgtaactgagcccttaacccacgtttacatacatgattaaatcagaaaagcatattgcccaaaaataaataagcactggttgtttgtagaaacaaccaatgcttctacgaacattagaaattaaacatgagagagaaattttgataatttttccaataattatcctgacaaccgaaaaatataaagaccattcatccatagatttaaaaccaagaatcaaatcaaaatcatcataatagaattgtcgattgcctatggagtgtcccagcaagcttttgtgaattgctagggatagattataattttgctttgacagctttaatttgtagtctggtgattactttctgaacatcaattacaaaaaaaatcaataaattcataaacaaatgattaaaaatatgggtttcataactttttggttgttgcatgaacaattcttggaaagttcatcactttctctctagatcatccatgaatttacaaccaagaatttaatcaaaatcataa

SEQ ID NO: 3022 - DNA, 1028 bp, Glycine max
  Soy_ogl_1540 Gm05:2084637..2085664 Cluster 13
gattttttttcttagttattagtattattattattttaatggaaagaatcgaaagactacattaaaatgagtccacaacataaataggaaagataattgtttttgccaataaattatagtaaattaagttgctttaaaataggtcattaatgaggtttaacctgtgcaaagttacataggttaaaaaaaacctaataataataataagtggaagcttgatcaacactttcattaaaaaatacttttaacgtattattcttgagcctagttcacgctttcattaaaacataattttgctgctttaatttttttaaaaaatatttttaattaatagagaagagggaggtgagattgactgagttttcgcacttaaatgaaatattaacaccaatccaactctcttagtaacatttatttaatttttaaaactataaattagtgttggttagaccgacacaaatgattcttccttttaatattagaagcgtcggccatgactgatacaatctcaaaaaagagattatatatatatactaacaaaaaccattttattggtgaggtaacgttagttaaccgatgctatttagtgatcatcgtctaatatgacgacgctaattcaagcttttcttgtcgtggtagctaatttacttgtgaaaaacatagtcatatatttacatagtaaaaaaaatcttccaacacctagttatatatgtgacataaagtatattattttattacttaatatatttaataaaagaaaatttaaaataaaatgctttttgctaggtgttttaaggatgtatgatattatgtagtagcatgcgtatcactgctttttctttgtgattttttcctctaagtatccaccctttattacatatatagataaggccacaagggttgaggctggcgctaaaggtttatagataaggtctgagatctaaagtttgtctgtattggcaagctgtcttaattttgatggatatatctgtagattatttcttgtttctacagcattcctggaagag

SEQ ID NO: 3023 - DNA, 1122 bp, Glycine max
  Soy_ogl_1839 Gm06:7899579..7900700 Cluster 13
atcacaaacgaacacaaccttaaagaaatgtcacatgtttaaatcatgccacacaaatattcattttttttattttaaattcgttattttattccaattttcgaagcagtgtgttttaccacacatcatttaggcttttttttataaaaaaatgcgatttttttaaaatcaccaaatgagagcagcttttgaaaagaaaaactcaatcatgaataagtcatgtttcatgaataaattaccaaatgggattttttaaaaaattaccaaataataactatatccattcagtaattttgaaaaaaaaaattaccctagtctgataaaaaaaatccatcatttatgcgagcatcgatccttttcaattttgtatcaggattcaaggtgttggggatgggggtaagaataaccaattactaaaacttcagacgctgattaatgattataggtatatgcagtttgacgccacaatgagtcggaattatgtttttgttcagctttttgatacagcttttgtttggtttttacatgcgaatttggtacccaaggtgggacccagtttaatgatattttatctattggctgatataaaaaaatccagtttgacgagacgaatttgattcgaccccaccagaaaaaataaaatgaaaataaaatcagtgttagattcactgattagatttaatttatattaattcaattgagtcaagttgagtatttcatttaacaacatcatatcctatttttgtccattctttatagatttaggcacgatccgaccctaatgtgaccattcctatgaggcaatcttctaatcctgtatcatggaaggatcacttgtcgataatgtgggttggtatctatatattatttgttagccaccaaaaacagcaacactaccctacttctgcgatctaccattaaatttacaaacaaaagctaatgagaataaaatattttttaacaaatattaattattaatttttattagtagaagagatttaaacccatattttttcctttttttcccttcaatctaacagttaacaactaatacttattaataaaaaaaattaagataaccttataattcctaaaatattttttttcattgattatgatagc

SEQ ID NO: 3024 - DNA, 1032 bp, Glycine max
  Soy_ogl_3708 Gm11:3796469..3797500 Cluster 13
atattttctaatttagggtaattttaaattcagataagatttaaaaaattacaaatatttaaatttataaaatatatatagtttatatagatgaaattaaaaatatctggacatgaacagaatcaatgtattgttccagtgatgggctcctcctctcaaatttcatcccataattttttttatcattaaaagtaataaaaaggttagaatataaaaaccaaaaacaacttggaaggaaggttttcgttgttgggtgcgccttcttttcaattgtgcaagtgtacaacctttttttctctctatggtggtgtgggatattttggtatgcagcgttgatattaattttcggagagaaactttgcttatcaatgataattaacgtttgtactttgtacagcaaccttgcctatcaatgccatttagattgattacagtacaatttttcctaactttatagtcttgctatttagattgattatagtacagattgattactgcacacgcgacaatttttcctagccacgaggtccaaaacattattataaattaataacaacaactacaatgtattatagaaaaaattcaaacaactattaaggtgtcaataaatttaagtcacttctaaccgtcttaaaattataaaaaaaatataaaattttattaaattatattaagaaggacttgtatgtatgtttttacatcaatcctctctctaaatataaagtagaataactgttttattcaggagctattatttaatgagaatatatttatgagtttttcttccattagagcgacttgtgagtttttcttaatttcttattttttatgatcaatattttcatttttttagaataattttaaaaataaccttgtatcaaatgacagatgcaaatgggttagtgtgggcaattgcccctacaagatttttatttttacttgtgtgtgggtaataaaaaagttttttcacccataaaaaataggtattccctcataattttttttagttaatgtacaaaataaagaaacata

SEQ ID NO: 3025 - DNA, 1300 bp, Glycine max
  Soy_ogl_4005 Gm12:5071501..5072800 Cluster 13
tcagccatagcaaaaggcaacaccaaaggaggacacaaatccaacaaggtgaattcaactttagaagaagagcccgttttggagagacaatcagtgcatgggttagcttccctaaaagggcactgaaatattaatttgtcgtttgaatttgtgcatctctttgttgtaatgaggtttaaattgataatctcctacataaacccaaattctgaccatgaacgtaatcactcaaagtgagctctagaaacatacaaaaatgtttttttggaatttaaatttttgaaatatgaaaaattaaaaaaaattaaatgttggtcaaaataaaatttaccaacattttatgataaaagtagactttaaaaattaaattctagagctaactttatgtatttacgtaaccactcatggtcaagatttgtgttgtatgtcggaaatcatcaattttaacctaattacaatttacaacaaacagatgcacgaattcattgaaaaaatatttttaaaaccattgaaaaaatcactcatctgaacaaaaaaaaaaaaaaatactgtttcctattatggtgataagtgcttgcaagaggttttcaacagcattgaattttgttgtcactaatgatgttttcacaacaataattatcattttcatttttacatttttttgtcaacttatttatgttaataatttaaattgttgtcatatatatgctatatatcccaacaaaaaaatcattgtaataaaataattttctcaataatttataagatgtttttcctaataattcttattatgattatattttgatttttaaattactaatgtcaaaatgttgtgtaaaaatttactagaaaactaataaaaaacaataaattaaaatttgttagcattcatgttatattgcattagttaattgcgagaaaaatatcaattaaccaccaaaatttatcggtctctaaaaataattgcctattttagcaacacatgaacattttggcaaaaaattgaaataaacgagttaagcaattgattttttttgtcacaacaaagtaaaagattttgcagtcagtcgcaaaaatgttagatgaaaacatgacaatgttcaatagtttgcaattgaaaattcgatcgctaaagttatttaaaaaaaaaaaaacctaaaaaatcaaacgtaaaaataattggccaacatttaattttctaaagtctttttttcttcataaatgttgggtcaatttttagtttgaccaacattagtaaaaatgttcaccaacatttattttttttcattttttttttcta

SEQ ID NO: 3026 - DNA, 1045 bp, Glycine max
  Soy_ogl_4441 Gm13:34025501..34026545 Cluster 13
taagtaatattaatatcaagaaaacattttttaagacaacatttttttaggaaactaagacaacatataatatggattgttttaaattttttcattaaggtcccaaattaatggttcagattttttataacttcattatttattattcgtgtgtttgtcttctgtcacagtcaatcttaatttttaaaattttaattaattaacagttataatttcgtaatgttattaaacttgactaaattctggactcaatcatggaagtaggttattgatttgactaataattattagtcaaaccagttaaaatgcatgtgtgtaataaatataacaatagaaatagtataaatactataaggaatatatagttgtggaggtagttaatgttacttaattattatatcttaggacgataaataaaccaaattttaaaagtatgattctctatcaacccatttatcccctttcccgatccacgaaagaataaataacttcaatatcataattacgtaggtatgaatgtgatgtcttttatttatttatcttaaatcgttgcacttcacgtgttcaactatcctagctatgtattaatatatagaactttttgtgaaattctttagcactttttgaaaatctcatatgtacatacataccttgtttcactcttattctgtaaagtgaaattaaaaactttaaactaaattttcaataggatcaatgaatcgaaaggggaaatcgatcatgtttatattcggtaacaacccagaaatttcaggtataatgggaacaagattatacttatgtataataaattaaagacaataaaacttaaatcacaacttgatattatattagtccccatatcatcttaaaaagacaaaaatatgatgttgattggggtatgtgcatgtccccatatcatcctgtataggtccttccctacgtatgttcacatgtattgtaattaaaagccatcaagaaaagacaagacgagaaaaataatgcattcccaggatcaatttgtgcttgataaattttttttccctta

SEQ ID NO: 3027 - DNA, 1216 bp, Glycine max
  Soy_ogl_4647 Gm14:4329485..4330700 Cluster 13
tttgttaattttgcaattggacactaaatcatgtttcaagtaacgtcttcattaccgagatcacccttttctttatcaatattagttaaggataaaaattatcgagcaaatacaaaatttataattatatcatgaactagaaataagtgtcaatgattgttttattaaaaacctcaacataaaacataaatttattttcaatttattagaaaataaatgcaaaaattaaaatgattaatgcttgataattgatactcctattggttatttttacctatccgttttttaattatgtccttcgattcatttaattcttaaatactatactcatttatgataaatgagagaagaataatagtaaaattatattttaaagttaaaaaataatttttacaaaaataaaatattaattacttttcttaatctttgtattaacttttcaaggggacaattgaaagaaatggagggaatatatcaatacattaatcacagacattattttcaaaaaaaaaaaaacgacagatattgtgtatgtttggatttctcttgaagatgctatgacatacattcctatagacatataaggaacgaatgtagacaaacacaaaagataatcgttggatctgttggtaaacatattctgagagatgcaaatgtttaatcaaatatgcatattattgacaaactaaaattggtatcattatttctaaacacttattaaacatctacgatgcataattagattatttattttaaatttgtgagtgggagaatgttacctagatttaagaatttaacataaaaattatttaaatactaaagcattgctagactagactacgttaaatttcaggatgactgtggctgtgacaatgttaattactttttttgaattttttcaaacttctattttctctcttataaagtataagccattgtccattaattaatgcttgatacggatgggaatctaaccatacaagcctgtagaagaagttttcagtgtcataatgaaattgcaattatttcatcaaacctaatttaggcaaccttgttcatagtcacagtcatatatactataggctatagattattcataaaaatagaaaagctaggtactgaaagttgcttggggtgattaaacattttcagaaattagtgagggaccacaaataaaaattgaaggcagcatttgcatcataactgtcggtgatag

SEQ ID NO: 3028 - DNA, 1167 bp, Glycine max
  Soy_ogl_5001 Gm15:11567134..11568300 Cluster 13
tttaaacatctaaaaatgtagtgattgcaaattttaatagaatgactgatttatccctaaaaaaagttaactttagcgccgaatcaatttacaagtgaatttaaaaaattcatcactaaaattttactgacactcacattaatgacaaatattacatattcgttattaaattcactcactaataaattattttcttgtcatgtattttcctagaacactgggaaaacaaaatgtcttaaagaggagggaaggaattttaatggagaagaagagaaataaatcttttcttatttagttcacaatgagaggggaggaattttaaattttaatttacttttataccctattaatattagagttcaaaatataaatgaggatattttggttaatatatctaaaatgtttttaaatcctctttcttcatcccctccaatattggagaatagcaaaaatttaatgagaaggaattttgttcccttctccttccctcctaaaaattaaatcaaacaacaagagagatttaaaaaggttcatgcccactatttccccaaatcaaacagtatgttaaaggacaaaccccatctaagaacaaactctaacaaaacaaattcacacaaaaacgagttctcatctacaaaaaaaatctaaccttcataatatatagctattttatttttgtatatattaaaataagaatgtcaacttacacggtaaaaagtaatgataaaaagcttacgaaatcaaaatagagcattaagatcaataaagataaaagtacagacaacaagaaaaattcatataaccaaagcttagaaaatatagaatgttaaaatacgcatttcacattatctattagatcaagtttaaaaatcttataaatatctatgtctagctctaattcttacttaattatctttaagtttttattaaaaaaaattatttgaattatattgatcttgcgttaaatggctactatgcaaggatgaaatttagataaaagcatgtttcttgataaaagtcccaaaccttcctctatcttcggtgtttcaattcatccgcaagcagagagtttttttttttctcaaaatgaaatgaagatatatataacatgaaatcaggacgcaaaagcctacccttttattggcaagtttttttttttttttttat

SEQ ID NO: 3029 - DNA, 1268 bp, Glycine max
  Soy_ogl_6176 Gm18:54807203..54808470 Cluster 13
aattttcctcttcaaaattgatctaatccaatccagaagcatccatattgatactgattggtagatttttatgttgtttccttaccaatggattggtcttcaataaggatatttttcctttagtgacacttaagccatcaagagtgactgttgaattttgtttatgtttcccattatagatagattggaagttagttggtaggttatttttctcttaccgagggttaagctgttggtagtttaattctttgtaaggtttgcctaaatgaactatcgtgactcttctttctcattttattcttctagaaatagtttgattgagtttcaaattgtctctgattattataaacgattagtgtttaaagctcgaataaattctcaattcaattatctcattgcaacttgcaaggaagaaaaatattaacacaagtagttaatattacaatagaatttgtgcttctaaagagataaaaatgcttacgagaagaaatatattcatttgccaaacactctgttattgtgttcatcatttgtaatcttagagagtgtttttaagactttatgtatcgtacatttactcatttagcgattatctagaaagggagaaaaatagagtctatccaatcgaattgagaaaaaatagaaagaaactcgtaagattaatcaagtggatatgatgctcctagatggtaagtttgcacacacacatgcacacacccacgcttttgaaagtacttatacaaatttcaagtaaatttataactgtaaattatttttaatttatttaaataaaatttcaagtaaaactttttaaaacaaatttgttttgaattatttaataagtttgttaattaagtttataaacaaattttcatattttttatattgaatatgcattatttaattaaaatatttatctttaacgtatttatattgctagctcaaaaaaaatcaacaaataagacttgattaacatacaaattttgctacattgaatttagtttaaatattctgatagtgtaattttttttatatatactatcatccattataacttgtcttctactaatctctatacccgacgttgtctaggtagtttttatatttaaaagtttattcatattttagtcatatatgtatatgcatattagtatgtatgtaaacatgtatgaacaaaaaatacattaggttatttatcacatgattttttatatatataaacacatcgaacaactttaacatgctaaaaatttattacaattatattt

SEQ ID NO: 3030 - DNA, 1119 bp, Glycine max
  Soy_ogl_6839 Gm20:38295011..38296129 Cluster 13
aagctaaactttctctcagaacttcttttaaaagttaggaggtcatttgtgtctttggtcaaattaattttaactttatttccaaattcaagattttttttctttatttacctcaaagaagcaaggcaacaaatttttttaaagaaataaaattaactattaagataagtacaaaagtttactttaaaaactctatatattaatataatgaggaatgctgacaacattcaactaattatgaacatgaaatgtaagtttagtgtaattcattgatgcatcaccacgacaaatatatatctcgataataatatatttatcatttaacatccttaagttattatataattattcatctacgacatggcactcttccattccatccaccgcttaattatcgtagaatagattgattattattctatatgaagtatattcaaaactctgttttctaatggtggcattttctcgaaaatcttagttgcaacaaaaagacattaacgacgacagcttctcgcaggcaactaaattcaacccatattggtattctcattattgattgatggaaaaggaaagatcagtcactagaagttcaattgagagttcgaagaagaaatggccttcgaactcaggactggagccagttagaaagtatagaaatcaaaaaaggagaaatatctttattcgaattccgacaatgaacgacacttgccgatgctttccatgccaaagatgatacccaatgcgtagttgaaggaaaagagaaaaagtaaaaactaaacaaataaaaccaaacaagattataatatttttttttcatgccctgaatttttaataaaagactataaaacccttaatatatatttgatgaatacctcttttccattttgttttctgtataagatttgtaactagaagtctagaattgtagaggctatttttagaagattttaaaccttacaggatacggagaaaaccttgagataaattaagtagaggcgactattgaaatttagttttttttccaatgatatttagaaaaaaagagttatagttattaattaaaaattaataactggattcagtatttctcacatttgtaacatatcttgaaagatttac

SEQ ID NO: 3031 - DNA, 1142 bp, Glycine max
  Soy_ogl_1091 Gm03:44905689..44906830 Cluster 13
cacgttatgtagcaaaaacttgcgtgatatcgctgctgcaagctattgtggatgttcttttccagaatctatatggtagtgtttctgaattgtgataaaaatttattacatctttggcaattttattttgagaagaaatatttttttctcaaagtcttttcaaaagattgaaaaaaaaaattgaatcaaacatgtaatcatgtttagatttttcaaatatcacatcaataatcttcataagattgcataaaaaagaatcttcttaagattaaaaaaatggaaaagttaaataagttattattagtccctaaaaatatcacaattttaaattttagttcacaaaaaatgtgcttgattttgaatctttaaaaattacaaaaatggcatagtcatcaaggaatttatcatatgtgtttcaattaataatttaatatagtcgaaagtcaaataactttgttgaagcatatatgtgagaatcaaacataattacaaattttatgtaattcattttgttttgatttatgttttgggtccacattttatataattgactgaaagattcagattacctctctcataaaagcaacatattaaaacatgtttcactcgaatcaataagaaaagaaaaataaattgggtcaagtttttgcgttagaaaatttcatttattttacagcacaagtttaacatgatttgctcaatccttttgatgtaggcatccgttcgttgcaaaatttaagatattttgattagaatgcacatcgatctatagtaatcccatatcaattttaagatttatagaacaaaatgagagaaattgagcatgaaaacaatctagttcttcacaaagagactttttatttttactgtttttaaatatcattttgccagttcaaaattgtcacagtattaataaggcatgtgaaaacactttgtgattaagtattgtttgtggtggtttataagcgttgttatgttaaaattgttaacaatgttaattctaaactaatagaatgataaaattggccaaaatttaaaatatgtacgaaattgatttttttttttaaaagataagagactaataaaaaataaaataaaagatcaaatatataatttagttatttagtcattaattgtatgat

SEQ ID NO: 3032 - DNA, 1100 bp, Glycine max
  Soy_ogl_1104 Gm03:45628601..456130 Cluster 13
attataagtttttagagtaagtatccaagatttaatccttgtatatacacatatgtacgtacgggtagatgcaagttccattatgcgaaattttataggaaatgtagcttcatgtaaggttccgcctttcacattgagatatatatttcaatcgtgatctattaatacaggtaggtacttttgtgttccacggatttattggtttgaagtcaaggtttcaaccgtgacaatttgtatgcatacttttataaaactattaaaatgaatgcataaacagtaactcgtcaacacatccaacaatgaattatattagatttgactagatacatccatgttaatattggtgataaaaaggatgattaagatacttttttttttttgctgaatgattaagatacatatatttaagtggaaaacgttttttgataaaaatcgcgcactaacgtatccgctgactaaattaagagaagtcagctattgctttgactttttcgtgtgggggaataatttcaattctgaaaatcccctcccctccagcttgatggcgtatatagctgtaaaagttttaccagaaatccgcagcagaaactttctacgtacattttggaatatcaactatagctgtcttaattttttttaggttaccatattataaatatgaatatttatcggcctaatttcttaatgtcttatttttaatcacattactcgaattcaacactttagtttagagaaaattaaattaaattctactctgaaaaatgtaatgtcagtaatagtctcaattttaatttcaataaataataaaatcaatattttatgtatatttttgggtgtgtggaacaaattttatagcattaaattcctttgtttattttctgagaaaaaaaattcaatttacgtaaaataaatttagtttttttaaaaatttaaatatattttttatctttgcaacttagcatttttttttttactttttcgttctaataatttttaattttgttttttttttcaaattatgtttgttttaaggatgaaaactcacaattattcaaaacttattaaagagtatgatcttccatataagagttgaacaagga

SEQ ID NO: 3033 - DNA, 1100 bp, Glycine max
  Soy_ogl_1656 Gm05:32172601..32173700 Cluster 13
ccattttcaatctacctaacgtttctgagactctatctttctctattttttccattttggctatttgatattgttgaacaatgaattattaactcgcatgtttttatagattcaggtataatgtagtaaaaaaatgattcgggtaaaacaagaatctttccaactacgacaattttattctggccgtacttgtatcagaactacaaagaactctgatgctaactcaaaatggattgcacagaaacttgagagcttaattatgactgatcctaacattagctattcctcaatgtggcaagttctacttgaaaagtatggtatcgaatcaaccagcaacatgaaactatatgaagctttaatatatgtttgtaaaatttatactttttttatttgtaaaaatcgaacttagatcccttgacatttgtaaaatttatacactattaatgttatttgttatttcgtttgattttatagtgaagcctctatatcctttttaacgagattttctctcctactctctttagctaaagtgtcaaccacccaatacatttaaaagctcatatttaaatagagggaaaaaaagacaagaaaaaaatcacataagcaattcgaccaaaacgtaggattcctttaacgttcagatttaaactaataactttatgtgttttacatgttcattatttattatcatcgtctaataataatggataaaaatatttatgaattactatgaattaaaaaaatatcaaggagttaaaaaaaatgaaaactaaactttttacacataattttgaaattcaattcaaactaaattatgtgtataaatatatacctttcatttataaaaataccatatcaaatacattcagcaagatatgaatataaaaagacatccaatattttgtaaaaatgtgaggaaaagaaaaaaacacaaatttatacttgttcactcaataattaaaattacatctaatccttggattcagaaggatttttacccacaaaaataattacaaacaagtatttaacacctctttaggcaaaaacaatcatgatcttatcccaatatcactttacacccaagtattctttcacactag

SEQ ID NO: 3034 - DNA, 1050 bp, Glycine max
  Soy_ogl_2512 Gm08:5023501..5024550 Cluster 13
taatcactgtctaaattatttccttacaataacgctctgtttggtgaaggagagttagtgcggagtcgcaaagacgaaaacatcaatagtgggtaagaatgattcgacttagaaataattaagttcaacaaatgcatcgctttttctcttcttgcacgagtatggttggttgagggagagatgagacaaatatgaaagaaattatagaagagtctcgtgggaattttatatactttattttaattaaaaaatttatcttttattatcctctaaattagaaactctgtaatcatgttaatcatgtaagatgagaggcactgtaaggatcaatatgtcattcttttgtcagctgtataacaagggcacaatgatgactgatgctaaattacagtagggacacaattgtgcctttattgttgtgtttgatagaggaaaaataaatataagataaggaagcagataagtgagaaaaaaaaagaaatataagtaaaaaaaaattgtttgattgaagaaaaataaagtgcaacaaagaagaaatattttaaacaaattgaaaggttaaaaaaataaaaaaaaaatattgaataaaagatgacactttacttcttctcaaccaataaagggctaaaaatgtttttatactgttcatttttgcttgcttctaaaaattttgtgggtcacgcatagtttaaaaatatttctgcaacatttcctgggcaccaaaccgatgaagagcgcgaaagttcgtacacttccctgcctttctcttcatttcttcgatatctctttgcttccaaatagaggctatatgattttaaaattttctccacttattttcactatatttttacttattttagtacagttaatagataactaaatattctaaatatgttatatttgattcttgatcttgtaaatgaaaaatactttattaaaataatcaaaattccttttctaaaataattttcatactctgcaatgactatttaaaaattaattttgggtaaagagtgacataaatactatcatacaacaatttattagaag

SEQ ID NO: 3035 - DNA, 1042 bp, Glycine max
  Soy_ogl_3451 Gm10:39122101..39123142 Cluster 13
tatccaaacaagcacatattaaattgagagttatatattgataatcgttgcgtgcaagggaaaaaatcatatcttttctattttagactgaaaatttcaacgtaaatcaacttcttaatgtgaccaccatcattcagtttattccacaaaattttcaacgacaatctttgatccagatgggaattttttttaaaaaaagaatggttttactggtattaatcaacaatatgtaatatcttattctcattttaatttaaataagtggacatatataagaacttccaactttcagtaaaaaaaaaaaaaatccaactttaagatagcttatcaattaaatttagacaaattctagagtgtacaagtgttgtaggtctcacaccgtgcacaaataacaaaagatgttagatttaagctggtggctaggataaaagtatgtaataatagtcttttaacacacatgattatatttgtttatccatcaaaagacatactcaggtgtagagctgtcaaccctggtccatatggattaggaccatatagtccacaatgttttatgggctagggccggtccatgagaatttttttttctttaattctcataattcaaatatatattttagtataatattttttagttttgtataaaggaagttgaccgaaatcagtcaaaattaacttagttaagattggccgaaatcaatcaaaatttataacatactgttttaaaaatatataaaatagaaaaaaaagcactgtaacaaaaaaaatgtcctctacttaaatactttcttttattctttctgttatttcaaaaaaatttagtgaaagaatttttcattttatgaacctatatatttccggcatgcaaataaacgagaatgacccgtctaagtagagtgatatcttacaagcttaaattttaaaaggttaaattataattctaatctttcaacaatccttaattcataattttaatctttctttttgttagattttggtatttttattttaaaaaatttataatttttgtgaaatcttcaat

SEQ ID NO: 3036 - DNA, 1055 bp, Glycine max
  Soy_ogl_4421 Gm13:33359312..33360366 Cluster 13
ttaaaatgattttaatttgatagcatttaaagtcaaatttggtgtaatttttaaaatgttcagagcttataaaaaaatcaaattaaacccatttaaaaattagagacatcgctgaatttttaaaaaataaaaggacataattaaaaattttaaaaataaagcaatcaaactgaatttattaattaaataaattaagtgaaaataatttaacctttatttttttaatcttttattagaataaaacttattataatcggcctgaattttagtagcttgcataaggtcctataaattctaatttttttgtgatcatttaaaaaaaaagattatcctaatcctatgagacaaatattttaaaaattaacgagttgttatgaactcgccatcttgtgattctcaatgtaatttcaccgtgctttctaataaataaaaaaattactatgtagtattactatttattgaaatctcaactttgacacaagttatcaagactcttgttattaacgccaagttaagtttatcctattcctctgagacgaatatttaaaaaaccaacgactacgtagcaatgcttgaaaccatggcgttcaaattaaggtcttgtgttggggagtatagtagcaatgcttggaaacttggtgttcaaattaaggtcttgtgtttgcctcattttgtttcgagaaagcagaccatcttgattatagaattagcttaattgtcactataaaataatgattcaccatgaatgagccatgttcatttatttataagaaattttaagtcattgaactcagcaataaatttcagtatcccgcatatcacacacggtatcttgatctttaattctcaagatctcttgggatttattaatgaggttgtatgcgcggtgtttataggagtagttcttagtgatttttaattcttttaaaatgaagagtataagtagtatatgttaagttttaaatagcgaattttaaaattttaaagttgaaataataatttgtgtgtgtgcgaaattccgagttcacacggttaaattttagttaaactggcag

SEQ ID NO: 3037 - DNA, 1200 bp, Glycine max
  Soy_ogl_6805 Gm20:37188101..37189300 Cluster 13
ggaatataaaatctctaaaaatattccagaaagtagtttatggaatataacaaatgtattccaaaattattttagcgattttctattgcggaaagtacttcccaagatatacaatacaatggtatgaaaactacattcccgaatgaaattaggatgaacaacttaataaggtgttaaggaaattagttgaaattaattgataatcttaaatatcaataattttcaccataaaaaaatcttaattataaaacattattttgaaagtgatccttcttaaaattcaacaacttcattaattttctccatattttaattattatatttattctaatactgcattaacttatattttttttttggacagactattgtattaacttattctgttttttaatgtattaacttatatctacaattccatccattcaatcaaatccttttacctgttttcctaaagtaattttggactctacatatttttcagctgtattttttttagtgacctgtaatctttaattaattaacagtttttgagaatgataatagtatgcattaaaaaacagaatgatattagtataatattttaaaacttaataacaattctagttcccatatatttattcaatatgtgattctaatttctctaattattatttttacatctaacatttattgtttctcaatgatttaaattatttagttattttttatcctctcgatttttggcagtaccacttgcttatttggcttgaggttggaggatagaatacttgtctatttgtagttaagcagtatgttaatcatgttcttcttatgcgttattttaggcctcatttgcctctttggctcaagatttgaagatcgtgttccctcctcttttgttggataaactccctatatacctgtgatcaactgcataggagaaatgtcccaattccaagcttagaaacctgttgctatttttgtggtaatcatatggaaactaggaatcacttgtatttgtatttttgggctgtgatgaaagaatcaatcaactatggcaggccagttttggatgcatggctaggtgtgaactttgttcttccagctgaacagtttgcaatcctgctaacaggaaggaccagctacaaatggagacatattacagttagcagagatctttgaatttgttcgtcccatcacttggcaatggtttttata

SEQ ID NO: 3038 - DNA, 1000 bp, Glycine max
  Soy_ogl_2886 Gm08:44373501..44374500 Cluster 13
atattatttatattttcttccttttcataagccagtaagataaatgtcttccttccatgaattatgttttcgttgcaaccaaatgccaaaggtacaagggagaagggaaagggaaggccagtgtagggaaatgaggagaggtaattgtgtcactttacagttttttgaaaaatctgggggagaaaggaaaacaaggagatgagaatagaaattccctgaaaaaaaaagtatagaagcaaaatccaatattgggctccaaaggtgacaggtctagagcaattccaattaaaagtgttttatgtttgaataagattaaccaaacaagctgctgagggtataatgtttatttggtttaataaactatttcatctatttatattcaatatattgtaatctatatagatagatgttccttcaatacatacattgcctaccccaagtagcttttaagcctaaaatagttgagctaaatattactttaaataattttttatgggttaatggtgtttttagtttttgaaaaatgtttttttatttctgacttttacgatttttttttgtctcaataaccaatttcaatccctaaaactaacattgtagcagatgaaaacttatgattttagaaattaaaatttgggtatttgaaagaatacaaggacaaaaacttatagtcttaaatttcagaggctagaaagactattaaccaattatttgttttctcttgtgacacacatgcaaatacatataattattatgataaaaattaataatgccagtaaaataaaattatgaaatattattttattacaaaataatattttccaatataaaaattgttattacaattactttattattatacatttgcataagttcaaagtataaattatgattcaattctttttcgaagaggggagtaaatatatttttatctcaattttacaaatttaatattttcattcttattttatcattataatatgtataacaattctttcac

SEQ ID NO: 3039 - DNA, 1027 bp, Glycine max
  Soy_ogl_6936 Gm20:42449155..42450181 Cluster 13
taatattcaaactaatttaaataaaacataaataaaagaaggaagtttctagtgttttataaaacaactccacttatcctcaggtgaatatcacattcccatctcttttcatgggaataaaagtgtaaaaaaatatgataaaaatgaaagttaaagcattcttagaaatcaataatacttaaagcttgtaacattctcatgtttacgttcttaggaattaattttaatccgtgaaataaacatactgaggaatttcacgcattgttatctacatgcgaaaattattattgggaaatatataattggctagggaaaggcacaacagaagcatgagaaaggaaaaaaaaatgaagaatggtggtcaacattgatgtaattgcatttaaaagaaatatgttaaaagacaaatgttcatataataaaatcaattcataataccgcccctgtaaacaacaaaatgacaaaaaataattgttttttactttattcttcattgtcactttatcctaatgttattttataaagttgggatttaaccatgcatttttaaaatataaaaaactaaagtatttgagtcataatctgaacttatgttattcgtgtcccagttacaatcatttcttcaatgatcaagtgtttttttattcttaattttagattgttaattgaagtgggtgtgttattgtgatgtaaactagattgtggtgcttaatgtaatcgaagatatcaatcattgttaattgaagcatatattgcgtgtctttagatatctttgattactaccaggagcgtctatgttatgacaaagaaactacctgagatgaaagacgtaaatgtcctttaacttcatccatttgttgactctagtcattttaataaactcaaagtcgatatgaattcaaaagaagaatatatgcagtatggtgttaattaatttttaataaaagtgaaatccttcatcaagcttgtcaatttcttaagaattatttccttttaaaaaaagataaagaaaattcccaagctttca

SEQ ID NO: 3040 - DNA, 1183 bp, Glycine max
  Soy_ogl_2696 Gm08:15071863..15073045 Cluster 13
aaattgaagatttataatggagtgaacatataatgtgtttgaatattgataattcaaaatattttttcatttggctaaatgtgccaaacatgctgtccttttaaaatatgaagggcttacaatatttttcttacaaaacacgaagggccttgcatgtagtattcatgctttatcttgattataaattaaataatttctctgccttcctttttttctcattttctgatagtaaaaaaaaaaaaatcaatcaaattgaagtatttaaatcctaaaaactcaatgggtttagagaattggctgcaacgccttaattaagacaggtcttcttggattttctttttttattttttattttaggtacgggtcttctaggaatttattgtataatcattatgccttttctactttatatcctatataatataatgatcactctaatgaatttaagtcctcactttttatcctttaattaaattagttattttctttagttaattgttttttcaaagaaaaaatttgaataattctatacctagaagaccgatccatcaactaaagttgcaaatcccctcagaaaaaaaaaaaaaaaactaaagttgcaataaaggagacaaattcgctaaagaattacgcaaatccttaaaaatctctgtatgtattgcatacattttttgaattgcgactaaaagtaaggaataaatttttgtacaactacttattttaatattagtgtgacttctgtgaaaaaaaacaaaatatgtatctatcactactcactaccaaatcagatataatatatgcactatatatatattatttacaactaaatatttgatatatcagaaaaagtaagtcaactaaataatccttcaggaatcaattttttaatcttgttttagtgggaatttttttggaatgattgcgctgttttgtttttctttctgtttaaaaaattatgtagtctaatccttcccatttgaatgagacggacaatataaatatccagcatatttctcttttgtatatctgtatcttacaaaagttatatagcttttacaaataaccattgattaatcagtcataaatagactgggcatttattagttgtttattactccttctatttcaaaacaagttgcgttttgcgaaacaaaaactcattacgttttttaagttcttaatg

SEQ ID NO: 3041 - DNA, 1100 bp, Glycine max
  Soy_ogl_4010 Gm12:7635401..7636500 Cluster 13
tttgttgtttctaaagtatgtgtggtaccaaggcctgcttgggtgatatgaaataggaaaatgaaattagagaggaaaaaaaaacgtaaggggtgaaataagattggtgggttccacaaaaacattttccgcccaagagacatgaaatggggaggaaatcgctatgtttttttttccccaagttttttagagtcacataattttttatttgtatattttttcttacaatttctttctttcttctattttctattctattcatttaaataagtagagtattttttgtatcttttgttccttcatatccttgcctatccaaataacacttctttctattttatttatttattttcttgttttatctcctctatttcattttttacttaactagaataaaataagtgttgactaattaatttgtttccagaagatgtttattttgtgttcttagcccatgtactagtatttttttttcctagtctttgtttgtgaagttttacttctgattcaatatgaagtttctatgttaactaaagcctatatctttgcaataagctatcattttttaatttaatactttttatctctctatctgttaggtatataatataaaagtccttactaaaactgtcccgtgatttttttctctaaatttttatttatttaaaactctttaattttaaatcttttattagtaatttttatttattatatatatgtttcgtcactttcatttttcaacatttcaaattttaagtttttgttaatttattaatatttataacattaagaattaaaaattctgaaaaaaatattaaaacttaaaaaggttagaaacataaaaagtcaacacaatgcacacgaaataaatgaaatataaataaattaaataatttaaaagatacaatttagaaaaatgtcaagtggctacttcaattaaagcactttaacattatacataaacatatatatagattcttcatttatataattttgttaaaagaatgaaactgcaaaaattcttgttcatgtttgggaattgctaatatttatgatgtacgtttaactttttatgggttccctccgtgtatacattgtag

SEQ ID NO: 3042 - DNA, 1000 bp, Glycine max
  Soy_ogl_5378 Gm16:30638401..30639400 Cluster 13
ctattttttggaatatgttaaaatgataatagttccaaaactattttttagaatgttttaaaattttaatacttccagaaactattttttgaaatatgttaaaattttaacacttttgaaaatgtattgaaattttaacattttttaaaactcctctacagaaaaaaaaagatattttttggaaaaacaaaatcaaataaaactagtagctggtatattagtaaaaaaatgagacatacaaataacaattgccttagtttttctctttaatacgggccctaaattccttggatgggggattaccttataaatcatacttaacattatggattttagtttattgtgtaaacattacaatgataatacatagaaattaaaatcttaatattaatattataaatctacattttaataacttaatatattaaatgaaaagtcatcatcagttttaggaaaatgataatagttaccaaatgattttcgtaaaaaacatacaaaccctatattcagtcaaatcccaattaatatttttctaattgttaaataatatttgttttcaaacaaaaacaaaaagcccagcgtttcacgttgcatttcgtaattcgtacaagtcatgcatgcatgtgctattcgtattgtgtactaaataaaggaaaatgctgaaggttacaaaacgattttcgtaaaagcacatgaacatgtgcatctatataacgaatactcatatttgatgtttatattttattagaaaatattattcttaaatcacttaaactttcaaatttttcttctaacctatattaattttcctttatttccatatttttgttaattttttattaactaaatttaacttttattttttatttaattttttttagagagacacgaaataatatttgattttgaaaaaagatcagccgttcaaagttagatttcgtgttattcgtgcaagatagtgttcgtactaaacagcaacactcctaaataaattgcagca

SEQ ID NO: 3043 - DNA, 1086 bp, Glycine max
  Soy_ogl_609 Gm02:42514415..42515500 Cluster 13
tctattgtcaggttattcataatctttctagagaataaaaaatcctaaatttggagaaaaagtgatgacaaagttcataaagtgatggctaacaattacaacaaaaacagttagatagttaagctttgggattttttgctataaccatgtaactccatgattctgttttcgatcagtatttgtcttttctaaactcgtcctcaagtttgtcttgtggaatacagttgtttttatcgatcacaatatacaacggtcaatttaattataattttttttgtgaataatttaattataatttttagtttaattaagcaacaatatttactttttaacatataaattacagaaataattaaggtgtttataaattcatatattttgaaactatgtaatcaagatcctaagtttaagaagtttatttaaaaaaaaaaaagtttaagcagtttagatttaaatactcgtagaggtatgtttcaagtttcaacatgctttaggatcctaaaaaaacgacgctttagagacttaaatggaatttatttagcactaaaattatattcattataattttaaatagtttaaatttattttttagctaaaaaattcttttgattggtttgaactttgtataattttggtctccaagttattcttgagtcatttaaattttttattcttaaaattatgtaaattcatttctataaccattctttctttactaaaaactattaaattctcattttctacttaaattcttacaaattgaatcattttaaatctttctttattcaaaatctattcaccaaaacatcaaatttcaccaaaaattgaaaatccatatttctcctacccgaaccaccaacttctataacagaacattgtttctgttcagaaattgtgtatagccttctatatttccttcctaaagtctcctcccctatccaatggtcctcccaaaataagacttccttgctctcacccataggaaactgcatttttttggcttttaatttgcaggaccgttcttatattgccccgaaacaagctttaaaactctttaaaatgagaatattgtttttaaggatttca

SEQ ID NO: 3044 - DNA, 1000 bp, Glycine max
  Soy_ogl_3485 Gm10:40829101..40830100 Cluster 13
aagttcaaaggcttgacacaatgtgtttgaaaggaacaataaaagagtgttcaaaggaaaaatactcaatgaatcattttcttccatggatattaataataaaatgaccataaatattttcttttcttgttatgcacgagccacatgcgtgaaatttggtccacttaattcagtttctatatcattttatgcatatatttcctgaaacagctctagaaagtcgaaaacaatttatgtaaaaaaaatatactaatgttatattgttaaaattttattgaaattgaaaaacactgattgattctctctctctctctctatatatatatataagattttcttcgaactttcaaacaggactcaggattttcgaaaagtagaatggaggcttggctattatacaatttttttaaccttacaaaacctctctatcatagatcaatgttacttgaaaatctgcagcacatcctcagcatattatatggacaaatcaaatcacataattaagacagtatacattgatattgatttgacattccctggttggttactttgggagcttagaagtgaaactatttttttttctaaacttatggtcgatttattgcatcttaatgatgggaaggtgctttcgtagaaatgatgttaactagatccaagtgtggttattatcttttctcatatttgtatatattaattattttagatagctagtgtttcaattttaataggtgttaattggagttttagagttagttttttttttaatgcagtgttagagttagttgtatgtcgtattttgcgtcagcatatccctggttaattttactagtatttacctttactaatttgtctttcaaaaaaacactaggcattcgacattatgcatataccatcatcatgtaaaattaatatcccttttttagttttttaaaaaagaaaaaaatgcattactaatatttttaagatgacaagagtatttatgttaatctaaattttatta

SEQ ID NO: 3045 - DNA, 1112 bp, Glycine max
  Soy_ogl_1820 Gm06:7119101..7120212 Cluster 13
taatctcttgaaatttactttcattttaaaacaatgttatatacaggatttttttttttccaaaaaataaagtagacacagtttttccttgaagaaaaaagaaaaagaaagtaaaataatttgatttgtctttatttcttcacgtcaacttaatttcaagagtcagggtcattaaaagcactatttctctgacttgtttctcctccccccctctttttcttcaattaatttgattcttgctatgagatgtacgtaaaaaacttaatatggtcagcctaacagtgggagtgtagttaatttgtataagctcctagattctaaccttattactgtctttttatagaagaaaaaaaaatgaaaacacatggatcaaaatcacttatcctcattttttgtctccttctatctctctttaactaaagttgatattagtttaaaattaacactctttctcttggttgttaattttttttatttgtgtcattcttttgatggaaggaacaaaaaaggaatagagaataaagacaaagtaatttggttctatatatgaaacatttttttagagatatgggatatcctttacaaatatgactattatgaacaataattcttcttttaaaattacgtattcaaagcttaaataatgtttatagttttttttttacaaaatcttatatttttttttatcagccagaatcttatagttttctatgagtatggttggttgtggggagaaaaaagaagataataggtaagaagaaaaataggtaagaaataaggtggaaataaggatgatttgattgaagagaaatatataaaaaaaaagaataaaaatagaatgatagaatttatgaaaatataattttacccttttaagattaatatgtttttttcctgcacaattaacttaagaaagaaaacgaggataacaacgtaaaataccaaatttccttatctgagaatggaagtctgcatcggtggattgccccggttttttcaaaagaaatctcactcttattcttaaccaaatcaccctgtcaccctttcattcttcctcttccctccttcactttcttgcgcatgtacctaacttgccaataaggggtcccctg

SEQ ID NO: 3046 - DNA, 1100 bp, Glycine max
  Soy_ogl_6326 Gm19:1904401..1905500 Cluster 13
taaattagtttcctggatttgaaatttatttaacaccgtttttataattggttcctagtacaagaaaaaacatttggtgatttttgccctttttcttagtacattatgtatcatcataactcttaacttagatcatcattatagaatacactaaattagtttcctggatttgaaatttatttaacaccgtttttattgaccgtccaaatgattatagctgtgtgcataaagacctaattaaagttgttcgatgtgttaactatattcatgattccaatcgattaacaatattttgctactatatattcgtgttttatttaatttgtctgttaattgttaacgaaacatcaattaagcgagtgaaaacgagctccttttcaattcttacatacaaaccctagattaaataaccaaaaatcctgtcgtatatatataggggaccattggagaattaagacgtagctttttttttttttttttgaagatagagttaagatgtagctgtttcttagaaaattgaccaggttagcggatggcgcattaatattcgacgacaaatcaacaaatgcattttttttttacttttttctttcaatctcaattaataaaaagaagttataatgttatttaaacggttatattatatcccagccccaaaattagtttcttatttgagaagaagaaaaatactccaaaagtaagtgttatatttaacttttaaatgaaatgttaattattttttttcctgtaatacctctaattgattttgtaaaattgtcactcttttttacatatttattgacttttcttagtatgtctaaaataatttagaagatacttattttgggataaagaaagtattgattatcttactcgatttatttcaatgacaataataaattcgaccggtcatgaaataaatttaaaattcttaaattgcttggttgaaatacatataaagtaattaaacgaaatagtgatagaatttttccacataatcctttacctcttactctcttattattgctttggaatcttatgacatttgctccctgaactcaagcgtaattaattttccacaaggagggcgtcttctattt

SEQ ID NO: 3047 - DNA, 1011 bp, Glycine max
  Soy_ogl_1205 Gm04:3921190..3922200 Cluster 13
caaaaatcagttcaaaacactacacttaaatattgaacatgaggagtgttggaaataaattctctaacacacattttttaattgattgaaatttatttaaaattataaaatcagagaaaaaaaatcattgaataagatgcaagactacaaatttttattatttttaataaattttaatttataaaacaaaatatgtttaaaagaatgtgtttatataacatttctcattaaacattattacgcggagaaaaatcatgacaaagtaccaccaagcaagccgactcaagtgttacaagtttggcagctaggaatcaaattacatgtctcatttaaatacatttcttctctaataaaaaatgaacacattagtgggaaaaattagttgataattaaaagagataaattgagtagtcaattaaattatttttcatttagcaaaaaaaaaaaaaaaaacagagagatcaggaaaaagatagaaggtaattctgatggaggtttcttgctaaaaaatcctatatttgatctcaatagaaataacttccatttagtacgagagaaatacagaaaaaaaataagagcatgtctgtgattttttatttatttatcatttaacccttttatatgtatctttctcatattgaaatttttaatactagacaaaatacatacccactcacccacaaagcaaaaacatgcattaattaaattgcttatgaacctactgtatagaagtatatatcatgccgaaggtcgcaaaatagatatatcgaaaaacaagataaacaaactatagtttggagatataaagttaattcgatgattggagaaggataaggatgaaggaagaggggaggaaaaagaaattataagtttgaatattttcaattaaacatttctaataaaactaatagattaatatttgggggtaaagaaaataaaaactatataacttacaaatgccgtgtacaatttgtggcattcaccccgcgaaagcaacaaaaattaacggct

SEQ ID NO: 3048 - DNA, 1400 bp, Glycine max
  Soy_ogl_2442 Gm08:847101..848500 Cluster 13
ttttttatataaaactttaattttattcatttcctaaaaaaattggacctattttaacgtgatgtggtttaagctaagtcataaatcaatcctttcttacctatttatattcctacatgtgagagtgagagtgcgtgcttccaccgtgggaacgcacgttgacgttggtgttcatgatacactactgttaagataagaatatatagataacattgaatactaagtattatattttgtataaaaaaatatttaatcaatattttagaatattaatactataaaagaaaatataatgctaatcgcaagaaaatatactgtgtattacagtactgtatttcgttttaaaggaaaaaataaaaaaactatcattgatgcagtggccaactgccaaatttgacttggaacttggaagaatgcttagaaatggtagtgagtgttacttatatctgtatactgacaaataatgtacgagctgcattagttgttgggattggagtgctaatgtctgtgccaatacaagtaatgctgtttgtctatctgttttaaattgtatatcaattggcaagtgctattgctgtgaggccactcatcaagatatctttaactgtatgtctgatcataattgcagtgccaacttccaactaaatttataatcattaatacagcagccaatgtaaccgtttgtatagatgtaagtccaaatgtatatgttacggataattaaattaggactagcagccgttatatattattttttttattgattttcctaattttactactcccctaaatataacattcttttttcaatttatttatatctttttataagatttattttcgattctcttttgcattaattatttttttatccaaatttaaatgtattatctctcttgtaagaattagataaaaattaaaaagataaacacacattaattgattaggtgaaaaaataattaagtaaaataaaagattatgaacccaacacttttaagggtaattttggaagaatattataatatgctaacaaatttaatgtaactaactatattaattaacttttttaaagaatgtgaattactaactttcttaaaaagtttaaattagttaaaaaagtcttatattttaggataaaaatagagttataagattggttaaatgataaaaagaggaaaaatgttatagatttaattttcccactaataaaaaaactaactataaataattaacatttgataaaaaaaggacggacatagtattaaaaaagatgtaaaatatggttagtttacagaaaaattcaagacggataaggaaagagcaacgttttttattgtaaaaaatactataagttttagaaaattaaaaggagcaaaaaaaagtaagaaatcatttttttt

SEQ ID NO: 3049 - DNA, 1290 bp, Glycine max
  Soy_ogl_183 Gm01:47163824..47165113 Cluster 13
tttaaaaaatgtcctcaagtcagtgattttttcattttaattctttaaaaaatgtcctcaagtcagtgattagtaacgacctttcaattatagtgtaggagtaggggaaaaacacacagatatatttatatatatatactcattttaaaattaaaagagacaatatttttatattcacaaaacatttttgttattattaattggaaatccaaattaaagatgaaaagaaaatctatgatagccatatagacaacaccttgtgacagcaaaactcggtatatatggttcggttaataaaatagattcagacaaattaaagcattcattattacacacgcaagattttgtggataatatattctttattagaaacaaaaatgagaaatcttacaagttgacagattcgtagtttctagctacttttatcgagaaatcattggctttgtgattaaacctcttcatttaattgaaatgaagaatgatagtgaaatccaatactatcacatgattaataaaatattgttaattcgggtttaaacgaaaatgaaaaaccgaatgtttatgttcgttaattgttcatcttcgtcttatttattagtactaaatatatcattcgtgttactgtaaatttaaaatttaattactacaagaaaagcggagtatagcagcctccggacacttaattagtgttggccatggcccattagaccaacacaagttactagtgtcggtataggttgatgtaaaattgattttctttaatgtttttttttttaattttattttataatcatttgtattgggacaaatttattatagaatgaatggagtaatacatgtaattatagcgtgaaaaaaaagaaagacaattaaagaaatatttaagaaagagataaaagacaataaatgtgatagatgctagctagttttaattaataatttaacaagtattaatgataaaattaaaaagtatgtaagctcttaccaaataacacagttaaaattcacataacaaaagattagaattcacatgcaaaaaatactaaaaagattctttcatctctctcacaatatgtatatctatagatttgatttgaacgtatatgaatatttttattccataccactgtttttcaaaatctggcgctgttaacaattaattaagtgatgaaagtttaatcctagctagagagttaattagtcttataataactcaatacttaaactctttgccttgaccatgatgagaggtaggcacaactccccgtgtgtaacacttatatatatata

SEQ ID NO: 3050 - DNA, 1117 bp, Glycine max
  Soy_ogl_2607 Gm08:11357301..11358417 Cluster 13
tttcatcgtttcattaatttctacacgcctattgaagttctaaatctgtaaataatgcatatcgcagcacattagggacgttcataatccacccaacccttttctttgtttgtcaattggcacacgtcaattattgagttaattaaatatactttctttagaatttgatttatagcatttttttaatatattaccttgttcaatcattaaataacatctaataaggaacaattctattaaacgatttattatatttctattttctggtttggataacgagtgtctaaaaatactgaattaaaattatttagtatatttttattaaataattcgaattaaacgaattaattagaaaagtatgaattcgttttttatttttatttctttgactaatacttcaacgactttcttcattaatattctttttagttcaaaagaaaaagatataacatattagaaaaattgtgtaatttttaattttttgtataagtaaacatataacctctatgaaagataatccgagtagaattattataaacaataaatttttatctcagaatgtgtttcaaatttaacttgttgaatatgtcctttaaactttaagcaaattatcaaacactaaagtaattagttattgggagtttgtattataatgtgttataatttgttatgaatcaataagcataagaaaaattccaggaaacataacgtaatatactattttgaataaattttttaataattaaaatttattaaaaattataaattttataggtcttacatcatatttaatcaatgtttttgtgttaattttataattttctatcaaatttttatcaatgacaaaagtatgtcgataaaaatgagtgttgtcagcattttccatgacaataaaggtttaagatgtttagtaaaaaaaaaaaaaagaaatcacgtacgtatacatgttagtgtttctttctcccctaaccacgtggaaacgtaataaaaaataataaaaccagtagtcgtttaaattatgtagagataagaacttttatacgaggtatgtagatttgaccgtgtttggataaaagtaacaactacttgagtaatatttttactatttggttagggg

SEQ ID NO: 3051 - DNA, 1100 bp, Glycine max
  Soy_ogl_4342 Gm13:29251101..29252200 Cluster 13
agttgtatacccaatttctcatttgatgacacttctggtttactattgacattttcagataattttaaatatataacaatattaactcaccattgtaacaaattaaagaacattttgtaacagttctatatttgctatttgaatttaaattatgataattttttaaaaggaacataaggcaaaactagccaattcaattaatttgtataaaggaatatgacctaacgtaacgatcgattctttcatcacgatatacgtaataattaactttgtaatcagggatttgtttttataaagacattgacatactttgttctacattttccccattattaatataattttatatatgtatgttttatgtttttttagtaaattaaggtatagatatccataatttttcacttaataatttctttcttgtagtatatggcaatttcgtaacaattatgttaagcaggtttggtttgcaggataacaagctaacccgtagaccgtttaatgttagcctaaatattaaaatactaaaacaataccaaatgtttaatgtgaggtaggatttataagtagtactccttttaaaatatatctaccccttaatattttttagttaatatttttagtattaattaaatatattaaaatgatactttaaaatagtgagatcatactatttacttaatgtttagtattaaataaattaaatattaagtattttctattagtcttttagtattttaaaatattttaatcttttaaatattatattaaaatgattataaaaaatattttgaagaatgtaaattacttttatttttattagtataccttaacattgtatccccaataatgtataagctagcagcatatagaattataaaaaaaaattgtgagaaaactgtgctcgcacctgataatataatgtgatttattgattttaataaataaagaaatgataaataatagaatatactataagtcatcagtcattatggacagtagattggcccgttagcccgagctatctgagggctaatgtgaggctaaaacaataaggtagttgctatttgcactctgatttttacttgtacagttccttt

SEQ ID NO: 3052 - DNA, 1200 bp, Glycine max
  Soy_ogl_4609 Gm14:2541901..2543100 Cluster 13
aagggtagaaccttattattggcaaggtctatgtgtattctgcatatggattgaggggttttttatattttatttttcatcttaattattgatttttttaaaatttaatgattatgattgattatttataatcctcataagattttaagaaaattaataataaaaatgagaaataactccaaaaaagatactcttgaataattaagtggatccttccttggtataattgatatgtagtcatttgattagatagtaaaaatgaaattagaagaaagaaaaaaaaaaacgaatgatgcaatgttagaatttggtaagcatgtgaaataaaataaaagttttgcgtatgtcattattcaaatataaagcatatgtagtcaatgctcatacacaaagataatgagttgcattatcaactcgtgagcatcttaaagtaaaggaaaaacaaaactggaccatgatatatataataccgtgctatattttgacttttgataatttacaaaatattttactttttatataaaaaaaatcgataatttatttctcataacaaaacaattgtatattgaaatttctaatagttctcttgtgagtagattattcagtcaatagttaaatttgtactatatatcctagtaactaattgtatatttcgtgcatgtttattgtgtataaagtatatggttttgtatataaactttgaaatattcttaagtaattgagaagagggataaaatgaactaaacaaaattatgagtcggaaaggtcaatgctctttgtataaaagaaaagtcaatgctcatcgatgcattgattgaaattcatttctttgttaacaatgtgttgagtcaacttgggctataataaatggttgaatggcccaatatgtaacctgttaatcgaattaatctaacttagtcaaagcccagttcagtgtatttgcccccaaaaaagtagtgcaacaacgaaaatgtctagcagcaacatttttgggggaatataaagatatgagttcgagcaatcaaacgttactgaaaaatcaaaaatgtattataggtcagagtttgagtcaattttaccagtctgaagaagcataaaaaattggcgcttcccgtataaacaaaatattatctataaaaaggaaaatattttttctacaaccaaaatgagataacttatttttttgtctcttttagtttt

SEQ ID NO: 3053 - DNA, 1200 bp, Glycine max
  Soy_ogl_173 Gm01:46774901..46776100 Cluster 13
cttaaaataatcacaaaattattttacatttgaatcactttttttaaaaatatgttacaaactggacataaatcacacaaaaatagcgatacaacaaatttttgaaaccataagaaacaatacaactataatatgatatgatatacaaaattaatatttttttatcattcagaaaaactaaaaacaccaaacaaaggcacgaagacctaaaatattttaatatataaaattaatataaaataagtttttaaattacaaaaggctttatgtcaaaaaatttgaaaaagaattttttttaaggaaaaaaattacaaaagagttgaaattcatattttagaattaacaaatcattataagcataataaaacactaaaatttatctaactattttgacatcccaatttatgttggtataaaaatttaaaaaataaaaatataactaaaagtatttggcatatccgtatatatgaaaatatataacaaattattttggccatatcataatgttacaatatgatattaaaagggttcttataatgctagaggttcaagaatttaattaacttttttttgtagatttagaaaacaagttgattaagttaacaaaagacaaagttacttaacctctataaattatagtatatagggtttttttcggtagaagtaaaaaataagttaacgcaaaaagaataaagtgcattttaatttttaatagatttagcctggagtgttttcttaaagaaacctcaaagagcacatatgtaatttatcctaatgtgtgtaaagaaaatattttttttttaacacaagaatatacaataaacataaataattaaatataatactaccgtagtatcacatatactataactttttttacattcaaataatgaatgcgaatctaatgtacaaacacgtctttagagtaatttaaagctggcaagcggggggaggggaaatcattcaccccaaaagtacatttcttttgttttggccaaacatggaatttaattatgcatagggaaatgatgtttagtgtgaaagttaatgcacaaatattatattggctgatttccgttaattttttaacaataatttctgaaaaattttagattttaaaaattttaaatatttcaattaaaatcattttattttcaaaattttgtgtttagataaaaaaatttaaaataatgagaatga

SEQ ID NO: 3054 - DNA, 1082 bp, Glycine max
  Soy_ogl_2240 Gm07:6753001..6754082 Cluster 13
tcacagcctatgtcaaacaaatcaaagtgtgtgacaataaaatagctagtttataggaaattagttattggctaatgtgtatatagttcataatccatatatatgatcgatgatcaagctgtcaatacatactcattttctcccaattatctgtcttttgtaagtcataggccacattagcttgctctccctattttctgataaggttactttcccatttatgaaagataataaatagataacattagaattttttgtttggatcatgatatggtgcaaagtatccataggcaatttattttagaaaatttaattgatcattttcagtctcctctcaattacattaataatacattagtagataaaattagaacttgacaataaagagtttaaataagttttttcctctcattttatatgacttctaagtgatgatacaagatgagatgtcatgtgctgattttgtttgaaaaaagaaaggattttttttttttatttcagataaaaagaaaggaatgaataataatggaaagaaactgataagagaatgaaattatttgattaaaaattgatcgttgacaactcaagcaaaaatattgtcatcacaaaagcaaaagcaataccgatctattgatgtctcaacgtaatatagtctatgcttcagaactgatatattatatatataagaagaggactctaaaatgaatgataataggtgttttataataaaacatatacaacaaatttatataaataaaagaaaaagatagcaagagatgagagaaaaatgtttttaaggttattgttttgaaaatagtaaaaatgaaaaatgtatacatgtgtggcccaattaataaatcaaataatgatattgggatggagatgctctcaaaagcacctattaccttacctgatctctccatcccaatacttttatttgtttcttatttgaatcccaccaaaaaactcacatcactcatttctatatttttttaaaacaaaaattaacatggcccacttttaaatttgagcaccggttcttaaaaagaacctaagtttggaaccaatgtcgcaaatcaacg

SEQ ID NO: 3055 - DNA, 1103 bp, Glycine max
  Soy_ogl_643 Gm02:44458301..44459403 Cluster 13
atctaattaatttatttttaagagtatgtttgatttatagtcagcgtccattaatacaaattctcatgtgcaagcaaatggattcctagacacacattacaccttgatttgacaactcattttgttattttttatattatgtgaaaagtaaaaaaaaaatgtaaataatacaataaaagggtgatattaatgcctttttttccaaaaataagaaatgtccactttctgaagaaagaaagttagcctctatctctcctataagattcaccatcaccaccttacatagctagctagctagcttgaataataaagtagatcaattatgaagaaaccttctccactaaaattcactcactattagaagcacactattgtgctttccatttttgttgccaatgcttgtactcattcaaaatggaaaaacaacacactagttctccatacctttcacgcgctgtcaattatcttccctacagtattgtgattggagactgacatacacgctgctaatgctctcatcattttgattctcttacgtacgaatcgtgtggagatggcagagttttactaaacacgtaaatagaatatgtgcacatgtgtactacatccaatccaactaatttcacacactacgcaattaccatactctctgcaatcaaagctttatatttacttttcattcattcatttaatttagtcttctttttttgttttttttttataaaaaaaatcactttaatctatgtaaattataaatacaattatttttataaaaaaaaaaccacaaaattatagagagagaaaatatttaagccgcaatcaaataatgaaagatctgagacggtcttcgattatgccggtaatttcaatgtgtctatttatatttttatattcttcacttttttaattaaatttatttttatttaagttttgttgcaaaaatcagtaacaggccggagaacctactactgaggtctgcaacgtgtcgatatccgagattaagcacatgtttgtacagcaactagggtgtgtttggttgtagaaaaaaggaaaaaatggaagacaaataatgcgataagagaagaaaaaaaagaaatatgtga

SEQ ID NO: 3056 - DNA, 1095 bp, Glycine max
  Soy_ogl_1664 Gm05:32694206..32695300 Cluster 13
cgatttgataggggaagattacactactaatttttttttaattgaatttacttaacgtgtatttggattgtagtttagagcatgagaaaagaagaaacactttttctaaagcacaaaattgagaaatgagtatattttggtattgaaataaacaacaattacgttctaatgtatccaaacggaaaaagttttctgtcttgatggattgaaatgaagtacttggagatgctagaacgaaattccgaacacacttaatttggtacttgatcaccttaagtagagccaaaaataaaaaatgtaaatcagggtacgatcgaaaaacttatgttgctttcagagttccctgagttattgaaggtgccatatattagaatgatagcccttcaaatacgcattgctctttaaaactggtggaaagataaaggattcttgtaccgtaccgtagctatctagaatatatatagaggcagactcttggaccgtagcaatctaccattgagaaccaaaaagggtagggatgcattaaaaggtggtcccagaaggcactagatatcattaacagggtttttgctttggtttcaattgtcaaaggacaattaccatactccatccacacccattttttctgaatgtaccatagataaacttaaatcattgattcttaaagctctataaagaaaatgttgtaagcaaatggtttttaaataagttgattttattttagtatctttttattcaattacttttaaattctgactatttattattatatataccaagacttgtacctatacaacacattggtatatgtatttttctattcatatgatgttaattacttagagtttattaaatataatattaattaatattttgctaaaaaattagcttaagggttatagttaacaatgacatgcagttaatattataacggagtagcttatattattttacaattatactgttattttattattatttcaaaatacagtaatataataataataataataaatatgaataaaaagtttatatataaagatgatttgattttgatacactgttagactacaattttttgcactattaagtgat

SEQ ID NO: 3057 - DNA, 1043 bp, Glycine max
  Soy_ogl_1639 Gm05:31368301..31369343 Cluster 13
catgttgaactttaccgttacatttttattattgcttaattatgttatatttattatacacatatataagctttttagccttacattgcttacaatgacttttcaatcttacattacttatgccggcttttcagcctcactttttaaattaagctactttgacttacaattcttacttacaccactcacgacttgtaggattatgcaacatcgttgccatcatataaagaacttcataattttttttcattaagccactttgcacaaactgtgctcgtgacttggggaacttgtgtactgattaaaatatagtggataattactattcaccccacttactcaactaggtaacttcccattccaataactaacaaactctactattacaaatacatgggtacactgcaggtaattcatctttcaattacatattaactctgataattcacttactgacataagtatcagagtttcttttacaagtacccaccgctacctaaaaaagcttggcataccaagaaggagaattagagaagagcactctagaatttggtaagaaaaggatgatatattaaaagagagattaaagttgaaaaaacaaaaagattatatatatgagaatagaattttttaatagtttttaaaaaatccatttatgtttgtttccctcctttgatatttaaatatacaatttaatccatcacatcattgaagtaaactatactattctcttctataatatttttctaatgaaagctaacttacatttaatggaaaagttaaaaataaaataaagtgtcatatttaaataagtcaattaaggagaatatatattttaacataagaaaatttgacaatacttacgtctataatagaaggggaatgcaatttaacaaaaaaaaaatggtattttaattcagtattttaagaaaaatttaaaatcaaataatctagtattttaataattaatcgaagaaaaaaaaaattgtttagaccaaaattcgaggggagtgccttttcaagcatgttttggcttctttttt

SEQ ID NO: 3058 - DNA, 1100 bp, Glycine max
  Soy_ogl_6328 Gm19:1917401..1918500 Cluster 13
atactaaagaattgatgtgaaaaacattttttctattaatgaaaaactaattaaatacttcttagttgtaaatggcttaaagagtacggcaaaaaaaattaaaaataaaaacagcattttcaatatttcgctgatgtgtgaacctttgagaggtgtgctgggaaatttcaataattatccctatgtcatacaaaaaaaattaaacctctttaatttttttggatatttaaaaatgatatttaaacgtgtcgtgtgtcaggatgatgaaaaggcgacaacattagaaagttgatttttagttaacgttaaaatattcacattttattttctacccgtttttcattattttttgtccttttaatctagctagaaattaaggttgtaattttctatgcctatacttttctaactttggatcattgattgctagcttgtaactaacccaagaaaattatttttcctatagggtatgtttgttttttaagggagaaataatactttagaaaaaaattatattttttttgtatgactcatatttttttatattttactttaattaaaaaaactatcttatattttctttttcttgatttgcatcttctaaatcaaacacaactatagagtgtgcttaattagtcacacaagataagactcttgtgctacgagagaagtgaacaagtcaatagagtagatcactgcaaattgcttggcaattgcctcaagtctataaatttttctttcggtctacgttatttggtctatgaattgctttcaagtttcttttgtgttctggccttcagggagtagaaatttatattctggtccaagggtgtagaaatatggacataaaactttcattttgtttcgaactaggcttgaaactattttccgttgttcacagccattttcgtcatcataaataataccaactcttgggggtttagatagcaatgagggtgccaatagcaagacacgttttggtttcatttccctacccatgtggaggcatacgaccccaagactcggaagacaaattgcaccctaggaaaggaagcatagaatcttcaacatatatttttttttttttttgtcttggattc

SEQ ID NO: 3059 - DNA, 1117 bp, Glycine max
  Soy_ogl_747 Gm02:49332901..49334017 Cluster 13
tgtgtttaaatttggatatcaaaaacaaaatatgtgctggattaaggtttctgaagccaaatgttaacaagtttcacggcgtcttaacacgtaggttagtttttttttaatgagcatggattacagtgcaaataatataaatgtttgaatactctcagcttgagtgtcacgtgattcatacttgtgcagaatttatagtgttaatttctttgtagctatctgcatatacaagtagccaattcaaatctcaaatctgtatatatatgtaatggaggagtgtacacaattggccgttcttcagttcttgtatataagagatgcataaattgataaatataaatgctattgtacttgtacatgttccttaaatatatgactagaatttgatggcttctgtgtttccgtgcatgcataaggtaagcaataatttttagtttttttttacgcaagaatttttagttaatagaggtggaaataagttaattaacctaagttatgttttacaagactcgagtttgatttacattccaaatcacagattctaacttgatctatttatttaataaaaaatgtttgccagaatctcattcttgctatcattctttgacatgtatatgggttgggtattccttgtgcccatttatatatatcattctttttcgcaaataaaaaaaaaaccatcaaatctttcttaaaatgacaatataggttaggttagaggtgtttaacaatcaaaacaataattaggtacaatcaaaccttgcttaaaatgataatgtacactaagtaaaaagtttagaatgacagatggatagactatttcaattcaaacatgataaaaacttggacaatgttatcaaagactctaatatatgtctaaattaaaataccaattcaattatataaatcaaacactattttaaaaaaaaatagatatcccaaatggcataatacatgtctcaaacaacactaacaattacttaaattacatatataataaatatgtatacaatattaagtgaggagtctgggtaaataaatttgaaacttattaacctcacaaacaacttaacctaattataattaggtcaattgaaattatatttgacaagacatc

SEQ ID NO: 3060 - DNA, 1100 bp, Glycine max
  Soy_ogl_6345 Gm19:2473001..2474100 Cluster 13
catatgccacaaacaccttagtagtattaataaatgtgttatcaatagaaggttattagtgagcaaaaattaagtttaattttggttctataactttcaaacaagttattgtacaaagctcatcactgttcgtaaataattgatactttaaatatatgttaataagggttctattctaggctttatacatataaaaagatttgctagaggaagcaaactacgctttagtattctctaaccttaaaaaaaagttttcgattattagtggaggaatatttttaatacacagaaaaaaaatatcattttttaaacaaagttttttttaaaaaaaaaaacgaatcatgtaatagtcgttaaaacattccgttaatgtttttttgttaaattatataaacttaatgaaaatacagataaattataggatccaattgatatacaaaaaacacaattaaataggttgcgatactttattcataattttaaatgagtctttctaattaaaaaaatggtaatgacatttagtcagtagttgctcaattaaaaaaattaaaatataagatttttttatataaaaaaaacgtttaatctttttctaattaactaggccaatctttttacttcacttttattattcaaatcaatcttattacgtaattgaaaggatcaagaaaagaagcaagttgtctttgcaaggttctctcaagagttggaaagtgcaagcaaggaagggtcaaagttctcttaactctcaagagttgaaaagtgctttttagacaccaaattaatggcaccttatgggtctgcgatacactgtcacatggtccctaatgaatctatcaaagtaaaggagcatgtgaacagcaacaggaggtataatggtttgccctaatcggttagacaaatgggctcttccttcttcctttcacatgccttgagtctgccactcctttggaattagacaatttacaccaacaccacttcccgtgttatcttatatctcaattcaaaatttgtgctccattaatttcccttcttggtatatgcgtgaaatatacctgagacattgagaaattcacaaagaaacaattaaagatgttcct

SEQ ID NO: 3061 - DNA, 1000 bp, Glycine max
  Soy_ogl_743 Gm02:49316401..49317400 Cluster 13
tttccctgtgtctcttttatttatatatttttatagaataactgaaaaaatttaattaatcatctgatgattgtcaatattaattggagtgtttggatttgaatttgtcatccacgttttctaatattttcacttccaaaattatgaagtgatgtagaagcaaccttttttttggggggctttaacttaattcatgtttagtgttgttaatgttcaaccaaacatgcactacattttagttcatatccaaacatgattttatttgttttaattcttatccctctattttatattgattcacctttccttcttggaaattcaatttttacaaataactaaaagagttttgttattcatataacagctctcatacaatattttatatgtctaattctcttaattaattgttgtgtttattatatcttatattttctctcttctctttttctttctctttattataaaagttgttatataacttgttgtagaattaacattcatcgtgaaaactattgatgttgggattatataagatggggagctaaccataaattgcaagataattatagtatatagacaaatctcgtacagaaactaataactcttgtgtagataacgtgtcaacattgaaaggaaactaataacaattttttgtgacaggaagtaacaaagctgtttacgtaaaattgggagataacgatcgatgtacacagggtagcaaggaagttgtcactcctcgccatgtaaagatgttctattttctttgggcctatatttacccaaaaagaaaaaggtgataacgtcttttgagtcgcaagcgtctaccatttattaaaatggttgctttatatacttttcttcttcttttttctatagactacacgtattgtttatgaaattaaaagtcactttatttaggttgaaagtatctaaaatgttaattaagaattcttctatagacaacagaactcaaaattaaagagttatggtgatacttaaa

SEQ ID NO: 3062 - DNA, 1300 bp, Glycine max
  Soy_ogl_6464 Gm19:39962201..39963500 Cluster 13
tataaaaaattttataatgttaaccaatcaaaaattatatttgggatgactttttatcctacataacgataacggtatgtatgtaacactataaagtgaatcttaattaaattattgtgtttatatctttaatgaaaaacatggtttttatatctttaaaaatatttttttaaaattatatttatgataataaaaatgcaaaaaaaaaaatcaatgcttaaataggttttttaattcagtatcagtacatttttaattaggtcagatacaaatttagggaccaattgaagaaaaatataagtttaaaaatctaattaaaaatgaaaaatagacctaatcaaaattgtcaacttttacaagccattattcttacatttacatgtcagtattatcacttctacaggttctaaacttagtatactagcctgcagaggtaaaaatacttacctgcatatctagacaatttttaataagtctatgaacttttttttctaatggattttttaatttatatttgttttaattatgtctttatcattaatgacaagaatctaattaaaaaataaatataagtttaaagattcaattgaaaattaaaattcaaagacctaattaataattatcaagtaatttaaaaatattcagattttttcccataaacattgatatgcaaaaatcacaaaaggaatgacattttaactatattgacacctcgccaccctaatgatcctctactgcacacccaagaactttattaaacccaaagaaaaaaaaaaagatgagaacaaaaaatttggggaaacatgaaccaaacccaaaaacattacaagcgaagcttattaaaaggcaaaaggtatctattcccgaagaaatctattctaatgaagttaggaataaaaaaatcccaccaaataaaattgtagcaatgtaaaatcaaaattagctaacttatgtgcacaattattttcctccctatatatgtgggaatatttaaagtgtatcctgcgagttacatctaagtatttaaaccatttattcctaatctttcgagggacatgcatattaatttaacatttaatctatttaatgtaaatgagtcatttggaaacattttttttttttgtttttctttctaactttcagatttatctacaattaactttgaattcttatgatgaatcttacagatttaaccaattagtaggacaggtgatttatggtggaacattattgaattttcctctttactttcccctttccctcctccatcctcagctcactgccatgcctccaaccactc

SEQ ID NO: 3063 - DNA, 1059 bp, Glycine max
  Soy_ogl_781 Gm03:868601..869659 Cluster 13
caattattttgagtttttactttttttagaaaaaatattatgaatattttaaatatatcttttaattaaagagtttaattattatatactattggtataacaaaaattacttggtcaactaatcagaaattatgattttaactattaagattttaattattaatacaaagggctttaaacttgtcattttttatgtttatttgtgattaaaatgcataaactattttttttcttaattaaaaacattcttttcgtaaaacaaccttaatcgaacctgtccaaaccttatcttcgatttaatagtacaaatatgaataagaaaaaagtacaatatgaaccaccaaagacatcacacaagaagttagcaactaccggcttaataccctttgaaccgacacaacacgaacccaagtacatctataattggtacttgttcaagttatgtttttttcatgtaaaaatttcaatttaaattttaccgaatgcaccatcaaagtgtgtgtgtgtgtgtattataaacaaaagagaaagaaaatgcgggagattaagtgtcactagaaacatacaaatatcaatatcaaaaagaagaaaagaaagacacaaatatttgatatctcttgtcctatgattaacaagccttggtcattttcaatgagctaagttcctctctatttttttaaattgctaccggtatttagggaaataagtgaaatggagatgcatggtatacatataatggaaagtgtcattaattattttctcaaaactataattaaaaagaaattgagagagaaagaaatagagaaaatcttttttttttttcattttcaattcggagatagtttaagtttttgctggctccacatctctattggcatgtttgtgggaaagctggtatgaattattacattaagagtaagtgcttcctttgttcttcatggtcctcaatttgtcatgcatccaccctacaacccccactcacctttaactacatagaatgacttgagagcaaaggcaaaaataaaatagttgtacctctcacatgcacacacacacaca

SEQ ID NO: 3064 - DNA, 1027 bp, Glycine max
  Soy_ogl_3125 Gm09:36337901..36338927 Cluster 13
gtacttctagaattatgcttttagttacatgcaacttctaatattactctttgacaaagaaaacatcattgtccttctaatattggtatcttgcttttgaagttggacaaactctgagcttgaaacaacttcattgtaagccactgtttcacactttttacatgttttttgattaggttttgtctttcgaatttcacactttttacatgtttcttgattaggttttgtctttcgaaaacactcaaggtaaaccattggtagtacaaacaaatttaagggactttaaatttatttctcaaaagtttatttttattaaaacactttagtttagaaagggttatgcatggatcacaaatatatccctcccaaagggtacatcatatatggcattattaatatcatacaagatagtcattggatcccaaatgtaaatacaacaaacccatttggtgtaatttcaaaaggtaaaaaatgatgtgatatgctttaatttatatattaaactgaagaagataccctggttctatttttattattatacaagattgctagtggatgcaagaggtgattacattccactatgagcgtacctcatttgagacgttgagccaaatattttgtatgaatataaaaaaagcaaaatattgaatcgttactaatagtatcatttttttattatgttgtccctagcatcatgtcacttaattgcattatggtacttatagagtacaataagaattttgtgtccttgtttgcaagaactgtttcgatggtgtaataattttttatagataattattaatttgtagataataactagtatatgataatttataaataatgcgaattggagtatcatgtcgcttgtcatatatattttttgaatcctaaacagtacaatattatctcaatttatagaggcacgaagaaaataaatatatgaagatttaaaactctataatgttcatccgcgttacaaagaagaaagagaaagaaaccatctattgatttcgtattttgtaacggg

SEQ ID NO: 3065 - DNA, 1300 bp, Glycine max
  Soy_ogl_3955 Gm12:235401..236700 Cluster 13
ataaaatgatttaaaaaatataaagaccaaaaacagttacacaacattacatccgttttatgtatccgtatagattcaataataaaacataaataattcttggtacaaagcaaatttggtattaaaaatacaagcggtttttttttttttttctatcacgcgattttcttttgcaaatgcttttttgttcctttttttacactgcaaatgctttttttcccctttttttacactgcaaatgttttttttttatatactttttttataggtggttttgtacaattatgtgacaaaataggtgataaatatttcttcctttttttaatactacaaatgctttttttttttttactttttcaccaaactatgtgatttcctaaaactatatatgtgtggttttaaaaattatatgaaagattttgatttttatatcggtttttagttataattgatgtagaaaaatgatttttacatcggttataactatcattaatataaaaaaaatacttttttatatcaattataattataatatattgttttttttaggttttgatgaaacaaaatcatgattattgagaattttggatcaaattaagtatttgttattttatttttcttttaaaatttaaatgcacattattaaaaattgaatgtttcctgtgattcgtgctatttgatttcgtaccaaatagcattgctgataataaaatagagataatatcattctaaatgaccaacatccttaagctagaaccaaaatataatacaagaggacaagaaaatatctcatagccgtatatatttttttaaaacacttatttatacatttttaaaactaccaagtaacacttattttggaaaagaaattaatggcaaagtaacataaatttatttatacatattttaaaactaacaaggaaatcaagagactattagagtatgcttagttttcagttgtaaaattatatattaaagtgaaaataattttatcaacaaataatgatctttatttttgcgttcatttatttatttattgaatttatattaaaatgtatatagcaagatttttaaatgcaaattaaatatgtgcttatctcgaacaatgtctttgtagcagtttggagtttgtgtatgtgtaaaaaaaaaacttataaaaattgtttaattttttgaaaagtaagaaaaaaagaataattgaaacgtgaggtccgatggaggtctttgaagcccattcctcattctgctttttcggaaggcaaaggaattgtcttagcttccccaccatatctctgagtac

SEQ ID NO: 3066 - DNA, 1116 bp, Glycine max
  Soy_ogl_611 Gm02:42623485..42624600 Cluster 13
tttgttccgggaacagaataacaagcatcagtacctatacaatccttctactcttgataaaactgttattttattcctataattacttttacaaatcacccactagtttttattattttttatttattttaaaaaacataaagaacagttggacaccgagtgtctatttttttcctaatatatagaatgaaatgaagaaagaagagtaacgagaataactttgtaatattctatatatcttttgacaaagaaatattccatatttaatgttacagatttactgcaatttattaggaccatagttttttcttttttaatctgaaagagaaatgaaataaaatcacattatataggagaatcatttctattctacctatcaactaccaagcaacacaaataagtagacaaatatgaatttcatttaataaaattaagtgacatccttcaagagttaaattcatgtattaactgtacaaaaagaaaattcatgcattaattgtttaattgaatagataacgtgtcaataagattgctgatttacgtgattgatccttgtcttcaacgtgggtaataagattttttttttatggagacatggttactaactactaagattccagatatcaacagaggatgatatcctcagagaagatgtgataagtgaaagagcagcatcttttttcacttctattacgctcttgttggtgaagggagtttttatatcttttaaaaatattattttagcataacattatgtgtacatattgtgcaattaatgattacattaagcacaagtttcgaattaaatgaatgatgagaagtgtaattaattgaattaacttggggtgtatttcactttaatatttaaagatgatcgagttcaattaacataataatttagtgtttctaccttaagaaatcagggcaaattttagaatttgtctctcacattaatgagcccaattaaacccccattaatgtgtgtacttttgccacccccattaatttataaaattagttaatttgttcctctccattttctccatttaaattaaaccacacacatttccatttacactaaaaatctttatttatttttatccataacaatcaaaa

SEQ ID NO: 3067 - DNA, 1013 bp, Glycine max
  Soy_ogl_766 Gm02:51440801..51441813 Cluster 13
tttatgtagcaattcatttagccgtttcaaaaaaaaaaaaaaaaactgattccttagtccttcatgacttgcaatggtcctaatttgaaatgttcaattcatatcatcgtattatgtgcaaattggattcgaatccaatcaactctaaccttgtcaatcaattcattgtaagaataagtttgaatcttcaattcttacattttactctacttattagaaagaataaagtattaaatattttttatattttaattttaagatattcagtatatttatttttacaaataatattttcttcataaaatattaagctagtaagacatataacattaatatttttttgtaactgtacttaacaaaaaaaggaattccataattggaaaatcatttacttgtgtcatattttgattccagcaatacgcatcttttagttttttttttttatcaatgtgcaaaaatagcttcttctttttttatcaattgatctggtgtgcattatatcaacatagtgtgcatagtatcattagcggataaccatatctcttaatctctcaagtatatggatagaaatttgatctccaaattcgtttgtactgaatatataacatctattaatttacaattattcactattaaattaaactaccatataacattaaggggttacatactaatttctttggtcagatcagacttttttgtttttattttgttaacactaatttttttggtcatttagttttttgatatatattaaaagaatataaaagttaattttaatatattttcaattaactaaaagttgctttaaatttatattttaaaatatttattataaaaataatatttttatttaatgataatataaaaaaatgagactgcaaatacattttaatcaaattaaaaaacacaactagtcgctagcacgatgatcaccatgacaaacatctgccatgtcttctacgagaaaatcatttggattgattgggcatcaactaggaatttttctttta

SEQ ID NO: 3068 - DNA, 1342 bp, Glycine max
  Soy_ogl_1801 Gm06:6391440..6392781 Cluster 13
attatcctaaggtaaaacctttccagccaaactaattatcacatgtgattcaaacttataccatttttttaattttgttgtattttcataattgaacgagtttgtgtgtctgtcattttgaaacttatggctaataattactatacataatttaagtttataatttctattgttagtttcaaaagtctatgtgaacttgtaaactcaaataaattaactcaatttgagactacaatttcaacttttttttctttgaagacgaacacgtgaaaaaataatctatggtgtacttaaatgttccatttactacacacattttgtacgtattaagaaactcgttgagttcggaaactcgttgaatatggaagaatcgcgtttgggatgtaaaagttgtaactattagtttctaaaatcatatccaaaacataaaaatcacatttgatacttgaaacaccaaacacgttatgcatatactgttgttatatttatctttggttatcgcaacaattttacataaatacaaagaaaattatgcatataaattatcatcgatgtcaattgttatactgtcttgaaggtggacgtcattttctcctaaattttcagtgcaacaaataatcaattgcaataactaaaagacttaaatatgattttgacctataaaatgagtgagttttaattttagttgttataaaaagttatgttttcatccatcaaaaagctaaagtcaatatttttatctttcactgttatgtgacactcgttaatgcatttcgaccccggtttttgttctaaatcattttgtgacaccgggcaggctgaacgagaaaaagtgttacaatttatgtatttaacgaagatcaagtgaccatattaggtgatactagtatttctatgaacatgttaacatgcgatacaacaaaaaaattagatctctaaaataaatgttattgatgtatcttgaagtgaatgttaagaacaaaaaaaaaaagagatttcaaatagataaaaataaacaaaaattaaaaggactaaaactaaaactggatccttttataggattaaaaacatatttaattataattaaaataaaaataaattatactattttcctgaaatatataagatttatattttccttcatatgataaaaatttaccctccatcttatggcatttgataaagttaaactcaatttttttaattttcatcaaaatttcgttaacttctactaaaaaataaagttattacaaaaatgtgtttcacgctatcattccctaagagatgtaagtgtttcattgtccttttgtgttaaaatacacactacccttagtaacaaata

SEQ ID NO: 3069 - DNA, 1018 bp, Glycine max
  Soy_ogl_2586 Gm08:10030183..10031200 Cluster 13
tatttatttattatatatatttccaacaaagtttggttgttttatatatttatcatgaaactaaacagaaaatgaaaaaaataactgacaagaaaattaatcaataaattaaagaaaatataataagaaattgaataaatatctcaatggaaataagaatatcagatatattttcaaatttaatttatgtataatatttttaaaagatacttaaaaatgaaaggtactataaaagatagattaaaatgtagtggccacgaattattttctttattcaaaagaatataatagtattatttgacacgtagcaaagggtttgtgtttcaaattatagcttcaagtgttagtgttagtgtcacaggaaataaaaaataaaaaaaagcttcaagctagtgttaattatacaaggatggtattgctttatatcgtctgttatatatagttacctagttaatttgataatttttacaaataaattgtattggtcgtttaatattaaattaaactattgttatttgattttacatgtctcactttatcgtattaaatatttatatatgaatggctaaataattattattcttcgttttttttaaaaaaaaatcaaccccgtagcatggcgtatttaagtgatgaatgaaaaatttacaatatgttttaaagaaaatattttgcaaaataaatttccaaataaaaattcaaatatacaaatccttgaatatatttaattaaataaaattttcaaagtatccttgttttaagaaatacgacactggctatgctcgattgggcaaaaagataaaaaggaaaaaatacaaataatattattttgtttggttgaaatgaagataaaaaaatagttttgaaaataaaatcatttttgaagttaaaattttctctttgaattattttttattttctatttaatttgaaagttcttttttctatattttgtgtgcaaaggagtatgtaggagggtcatcctctgcatttaattgccattattaggccccctgct

SEQ ID NO: 3070 - DNA, 1040 bp, Glycine max
  Soy_ogl_6730 Gm20:33714201..33715240 Cluster 13
atggtgtatgtttttaaaaataatttacataactaaatatgaagagcagtacgtattatatgtcgacattgacatatttgccaattccagttataaagaaagcatttgcgcatcctcctttccatgctgttgcactcagaaaaatatttagttatctgaaatcagaattatacacacctctaatttcaagctaaacttctattaatatttttttttattttcaatgtttttatctatttttctagtagagatcacatagaaacacaatcttaattatttgagtatgataagattgttatgaactatcaaaactctattcctaaatatttaacatatgctactctccttaacactctatttgtcatttactaatttattgaatctcatatctaagtagatttcattaattaatgattttcaataaatttaaatcaataacaaaaaatatattaaagaaaatatgttaacatttctctatttaacatactatatactaatatcatactcgaactcgatacccacgtcaattatgttaattagttctttctctacttacccacgataaccatcgtcctcatctatagtagtcacctttgcaggagatgacggtgactttgttttgagttgtgactcatgtcaccaactaataaccatgtgtttttacactttgattcacgtataggaaatttcttacaaaaatttttaaaacaatttattattattttttaataaaaaaagctaatattattctacatttatttataaaatggagagaatctgaaaattgctatgagataatcttacaaaggccataaatacaaagaaagaattaatgttgacaaaatactatttgacatatattgtataaagtaacgttatatctttctattaattcttctaatactttataaatatagtattaaataaaaaaatatttggatttaatattttaaaagtacaaaaaaatatttgtttctcatctcataaataaggagattatttttttataagacattatataagaatgcttatttttttca

SEQ ID NO: 3071 - DNA, 1100 bp, Glycine max
  Soy_ogl_4008 Gm12:5141801..5142900 Cluster 13
tatattcatataacttaattgattaaaaatttattattaagttcactgtactaaattatttttttatattttctttgataatgtattttccacaagtgatgaataattaaagaattacaaatctgtttctataatttattgtcatttttaaaaaataagtttaaattaagtttaaataatgatgagagacttaattttaaatatcaatacatattttattacataataataactcagttgctttcttatgttatctttattttattatattaacttatttttttggatgttttatttattatatgtcacaataaacaatttaataaaaatataattttttaagatgattcttgcttgtatatatatatataaaaaaaaaaaaaatcacctcccatacacaaacacacaataacccggcccctacgaagcattacagaggtcaaaaaccagtaagtaataaaataaaataaaattgaaatggtcacaagaatgaaaatattttaaaaaaaattattgtgcattgctgtacttactctgtcagtcacacactgatgcctccccagtgattgactatccagtcaaatgtgacaaatgccaataatcataaaacaagtaaggaatacccttttcgactgagttgactcggtcctgtatccatatacccccgtaaatatcgtacgtcgtcgtccttgacttcacattcaacaaagtttcattccccactatgctttggcatatttaaaactggaattgtttctgttacaacttttggggaagtcatcacatgcttcctcaagggtcagttattatggtgacattgccccttcctcctagctccgatcctaaccttactaacataagaggaatcattcccaaatgctctatgctcaagttaatggttaaaaaggtcattttaccaatcaaattaataattaaaaactcaacaatatagtgttaggttaaaggttcagtgaaatagataaatcaaaattatattttaatttaaattaatttgataattaataacataattattttggtcttaagtcaaatcaaacaagaaaacgcccaaccctttaggcactacaataacaaaatta

SEQ ID NO: 3072 - DNA, 1056 bp, Glycine max
  Soy_ogl_1004 Gm03:40742545..40743600 Cluster 13
agcaatctaatcattcatagcaatcacggaattaagttctgtttaatgctacatcaaaattgtggacatgaattaaaagttcttttaagggacgcatattctaaatcctcctttgattaaattgtatgatatgaacatatataattatatgtcattgtattttgtgaaatccatcaattttgagatagaaaaaattgttgttattattttaatggagaatgcaagcaacatttttttaattttctttttaatatatactctctactattgagtggaacttttttttattttttttatcataagttaaaatttattaaaaaatgaaaattttaataaatctcacttcttatttaatgaatcttccttctaatttataaatgagactcatcatcaatggtaatataagcgtgtaagatactcacaaagagataaaaaaaagaagataaatgataaatattattaataaaatgatgtggtacaataagaaatatcaattaaatgtttaccctcccggtgaaaaaaaaaattggagtcattcactgatgaccttttgattttaaaaattgttttctaaaataattaaacaccattcaattatcaatttctcacataaaatttgctaaattttgaaaattatttctaagataagtgttaaaaactaaaacactagaagatatttttttatcaacttttatttttatcttattaaacctctccctcaaattcacactttaatttgtatcttatgccattctctacaatctatatgaacaattttattgatttacattagaaaactaagaccatctttcaagaataaaaatgtaaaacagacttatcaacttttatttttatcttatcaaacctctccctcaaatttacgttttggcagtgccatgccctcttattacttacagttcactttattatttatcatgaaaaagtcaacgaagtgcaaattcactgcagaatcgcaaatacaatgctcacatggattgtaactgcttcctaccttggcacgtggagacgaggaatagtctggacggcaagtactaa

SEQ ID NO: 3073 - DNA, 1000 bp, Glycine max
  Soy_ogl_4807 Gm14:47552401..47553400 Cluster 13
gcaacttcctcagcaccattctaacatcatcactagatgcccaaatttttggttcatggcatgcatcatgcttgtgccctaggacgacacatccttcattcctatgaatgtttttgaactcattgagcttctccatgatgcttctcttcttattgaatgaaatttcactctccttgagcacaggctgttttattgagtataaaagagaactaaaaaaaaagagaaataactaggagattggaagaagtacttatttgttatgtgttgttttcaactacaaaggacttcttgtttatatagacccaacttattgtaatggtataattgatgctccatggtaataatatggttgcattacaatgttttggttcaatatttgctaatcaatattatttatcttttgtctttttaaatgtttttccatgcaggaggaataaaaagataaacacaatctagtcaagttgaggattttgctttctgggtaaggaatttgatgaatattagttggttggtagctgtatacaaagttttaatttattattagatgtatctattgataaattctaatttaacattgttaccataaggtattaatttaagttttgtgatatattcattaattttcttcctgtacaatccttctttttttgaaaaataataattagattccttccaattcatacctcgatatgtttatatgaagaaacataattatcttcctaaagtactgttaaaaaatgattttatattaattatttaacaaatatctttattgttaaaaactatcaacttgttgattatttataatttttattattattacatttaaattttactatgtttacttttaaatatatcttctcaaatcagaattacttatatttatgttaaaaactatcaacttttgaatattttaaaacttttttgttgattttgttgattatttctaaatttttaatattacatttatattttactacttttacttttaaagatatct

SEQ ID NO: 3074 - DNA, 1111 bp, Glycine max
  Soy_ogl_6180 Gm18:55053001..55054111 Cluster 13
aaactttaagttaatcaatttaattcttaattatgtttaaaaattataatttttgtctcttcccacgatgaaaataatctgtgacgaaagacataatttttttttataatatttagagactaaattaatcaaaattaaaatacagaactaatgtcagttattacaaaaattacagagtaaaaatatatgctattcatatattagtataacatttctagcctagaaaaagaatttgtaggtttgaccaattccatgtgatatatgagttttatataaattcaccatcttccatttcctatatatccagttattgaaagcatttcaaagcatcggagaaagaacaactggtatcttatccaactcagtttttgaatcataaacaatttctggacctcactctcataaactgcaactcagtttttgaatcatgaacatttatgtcaagctttgtgacaacaactcctatatactcaagtgcaactagcttgctaatattgaaatctagaatccacatacaaactaccatgaatactattgagtagagtcgatagagtcaacctgactcaatgcatcgacttcacccattcatatctagaattatgttagatttcaaaaatataaattatataaaaataagtcttttagacctggtccatataatttaaccagttaaatagacaaactttctatcaatttgaaagttattttctttaatttttttaatatttttcttacataattaatttttaaaattatttttgtattaatctgaataggctcaataacgttgagtttgacataaaaatgatcttaactgaacctaaaaaatttcaatccacgataatatgaatcaaccatgttgtcaaacctactattgagtagcatcatttctttcaagaaagcttttgttttatttaaataattgtaaaagaagaagaaaatttagctccctctttccaaagatttttagatccttccctgatgattggtacatatattaatatcaaaagcttcacaaaccaaaattaaagtaaattgtgaatatataaaataaatattaagtaaaattgacattgattaactaatatatatgtgaaaggctcctgaatta

SEQ ID NO: 3075 - DNA, 1000 bp, Glycine max
  Soy_ogl_6186 Gm18:55598801..55599800 Cluster 13
ctgtgcattttgaaccaccgttttggtaggtgaaatgtaaagcgagtgagttaggtgtcacgtttttctcaatttgcatgtaccatatacctctgttctaagcgaaataatcatttcttgtactcgcattttgcttttagtaggaaaaaaattggcttataaaaaaacacaactatcgaaaccaaaactcgatcactatatttataagaaaaaaataaaacatgtttaaaccttgagttttatatattatttcaattataatataataaagttttaatacattttaggtactttaactttttgaaaattttatttaggtcctaaactacaaaaacaaacttttgcattttaaagtcataagagagtgcacttttgcatatcttaataaaatacttttgggaattaattaagattggggaataattttgattccattattttaggaataattttttttatatttttttctctaggtgtcaactaacatacataatgggtgttcaaatatatttctcctgttcagaaagagaaaagaaaatttggattgtcaagaataacagttcatgtgagtgagaaagaaaagattttggataaattttatttaaaaaacaaattgcacagttatccttttatttatattggtttaattaataaaggaaaatttattatttttgtcaaaaagaaaaaaatattaaatgctaacatagaccttgaaattttttagttagtctagctttgcaaacccatatatatataatcaacattgtacaggaatatgcacaattttctcatgcagtgtgccattattatttttccttttcttcggggttgagagtggaaagacaaattagtggatcccacaaataatttaaaacaaaattcaatctttccacctcaatcaacacactcaataatgagggcaatgctgaaaaacaaatatcaaactttttatttattaataaaatttataggatcaacacgtttaattgataacaactat

SEQ ID NO: 3076 - DNA, 1266 bp, Glycine max
  Soy_ogl_1794 Gm06:51435..5352100 Cluster 13
agtaattcgacaactaaatataaataatacaaataattttatgttaaaaagattgacacgttgatattataaataatatacgatcccattgcaactctaacagtgattttggagacgaaatttacagaatatatattttttatattaggacatacgaacatgaataatgatataaataatagtataatactactatcaaataaaaatataaaactattttataaataaataattatttaattttacaaatattatgttgattaaaaaaattagtctatttactcacaaatcaatcatgtttaacccatggactaaatgagtcaacctatagatctacatttaaacaagtttggtttcttcctacactcccataattgcttccaacacctaatctcggatgtaaaattatattttggattagccttgctggaagctaaaatttatattctaaaaaggcaaatccagaatgtaattttatattttggaataacctttccgaaagctttaaaaggtgcaagaatcaagtttaaaggtgcaggaagtaattgtcctaaataagctgataaaagttggactgaaacccgcatatactgtcagttaaatgggcccgcccacataccatagcccattgttattacccaactctatctactaagaaatacttcttaaatcggtaaatactcttttaataaatgcccttctcgtcccattaacatcccactgtcaatttcccattcttggggtcattcctgttgttgtcgtcgtccggccaactcagactcgaatcacagggaataatcgctgtaaatatataccattaattttattataaaatagaatatttataattatgtgaggtatgattggttaagaggtataagattactcttttataaataaaataggagtaacatattaacattcaaacactttgaattgagtacgtatatggtgaaaaataagttgcaagctcggccccatcctacatcctttaacgtgtatggtgaatctcaataaaaataaataaaaaaattcttcttttttaacttcttaaccaatatcttaacagcattggttatgatttgtcttctaactatacccatgttttaatttaattactcgtgatccagtcttgttattttcaaagatattaaaaaagtgtttatcgatgttaaaatggtttttttttatttaaaaaaaaggctttgcgcgtagatccctagttatttcccacgtagcacatatatcgatctcaattatataact

SEQ ID NO: 3077 - DNA, 1000 bp, Glycine max
  Soy_ogl_96 Gm01:3887701..3888700 Cluster 13
atgataaacgtattgagaagtaaaggaaaattgttttgaaaacagtttttgaaacaaaaaatgaaaagtaaatcaaacaaaacagtttttgaaacaaaaaaatgaaaagtaaatcaaacaagctcctactaacccaaaggaagcgtttgttttatagaatcttattggtttcctgaaattatggagatgaaaatatatatatattttcatgtttgttagaaggtaacttaaaaagattctcaagtatgttttattttataagaaaataagactctcatgcttacattgattttatattggttttattctatgaaaggaggatgagaatgtaaaattctgtgtagtaattaagaattgtattcattgtgtaaaaattctaatttataattaaatcggatttctcttcgatacaagtgtgttaagagggtattttaaaaaactgtaagtagttggtgacgtgacatcataggttttgcctatcacatagcaacacatatgaaattaactcttgcctataaaaaaataatcgttgtgttgtgatgagttggcactatgcaaaaaatgctacttaacatcagttttttaacgtccgtttttaaaatcgccgttaaattcatttaaaaattgtatttagtgtcggtttttaacgttggtttctaaagttattggccattctcattctaacaatgcaattgctgttttgctttgctctgatttttatttctaatacagtgtgctactcaatctggtgatgcgtggaacgaaattcccttgctatctctggttgtttttctaatagtaatttcacttaaattttcatggatttgtgaaatttctaattgaacctcatatagtgaacttcagagtaagaactgcactgcattacgtattgttttgctcaatgttttgattattttacattttcaaaatgaatttggctagtggttaggaaatatgctatgaaaagctttaaatgaataatagtacaaggtataattaa

SEQ ID NO: 3078 - DNA, 1000 bp, Glycine max
  Soy_ogl_393 Gm02:5227501..5228500 Cluster 13
caatgctagacaagaaatgaaagcatgtccgctttgtctgtccttacttatgttagtgttatccatctctatcctaatatgtcgcgatatacgggtgagctagatagtgggattgaactggatttgcgagaaatatgtaaagtttgtctcacattctcttgctttccaatatcatatccatgaccatttcttcatgatacattttctttaggttctaattaaggtcatatcgatcatttgctctaataaatgcaaggatccaaactagcttatctttcaagtttgaagcatattagtactagctctatccatcatcacctttctatccttaggcattagcggccaaaagattaaacattcaaacaaaaaatatcaaacaaaacaaagaatgaaacaaaaggctctatcctactataccacttataagtactgaatatctgagctttccaacgtttctttctttgatggagagagtttttcgtgttctttagaaataagctttctatgaataattattttccatttactaaagaaattgattccgctttttttggccaagtttgcttgtaatttcaatgaaaataggtttttttttcttcttcaaagaaaacatagtccacttcttagtctattctctgtagtctatacttctttctccttgtattaaattttaaacattttcttctttcaatataaacttttttagactttacatgggctaatgttacattttttttattcttaaatttgatctttttgtacaaaagcttaccttttattataaaaaaataaatcagtatccttaaaacattgttaagaaattcaataaaatatttattatttattaaaatataaaaacaaaaagtactaacttttaagtgtagttaaaaaataattaatttaaagaaaactagtaatttgtgaaaatcgaaaagttgtggacagggaattgaggccgcacaatcagtgtcctatacaaaaaacattactatgccctttc

SEQ ID NO: 3079 - DNA, 1033 bp, Glycine max
  Soy_ogl_4322 Gm13:28225252..28226284 Cluster 13
caaaatttgagtctatgtttacatgtatgactacgtataataatcgctagatcaaatacagcatgtatataaaaagagagtccgttgactgtttcacacgatatatatatatataacttggttaaaaaaaatgagatgctatattgttactcaatcaattttatattaatcataattagtaacatacatttactaagggctcagatattatatgtcttaggtataaattttaaaataattattatataagttaataaattttcgacacataataatttatgaatgaatactcacacattttatatggttattacattataattaaatttactaaatataaaaatccgtaaatatttaaatatttaacaggtatgttactaatatattttcattattccatatatgttcatctaatcaattttataatttgaccataaaaaaattgtaagttgtaaggtaatgtcgtatatagttactattttatttttcattttttaatattaacatctcaaaatcaaaagaagaaatatgttattgttgacataattttatccaaaaaaaaattaattgttagaactagagaagtgataaggtgcatttatcagcacatatatgatgccctttgagattacgtggtgagatggaatggaacaacgtaacccattttcccccacttgcgccgtactcacaaattcccaaccacatcagtaatatgataatatacttacaaaaatatatggaatgaaaatgttgtttaaatattattttaaatatggataatatgatacaaaaaaaaaaaacatgaagctaggtcccaaaatagatcatattttgttgtcttcatattttttgtttctactatatgtatagtactttcagaataacataaaagaataggggccctgttaaattaaacccaagcaccaagcatatgagatgtgaaagccaaaaaatatcacttcattttgaatttttatcctttcattattttttaaaatgacttattcaagaaaataaagctaccaacaattcc

SEQ ID NO: 3080 - DNA, 1000 bp, Glycine max
  Soy_ogl_4892 Gm15:3561801..3562800 Cluster 13
agataaacataactatattttatttaacaacacaagaggatttaaattcttcctttttattagatttcaacgagaatatgacaacataaatgaactagttaacattaaacaattaaaaacttgctaaaatattattttataagtacgtagttttacggataattaataattctaattatggtgctaaaaaaatactacaaaatcatcaatcccgtctcatcctcaccaattgacattgacactgtccgtcacagtttttttttcgtcccccaattttagtttcaagcatacacagttctatttccacgttcacactcattagagcatgaatataataaactgtttaaatttggttgtgttagtaacttagtatatatatacaagttcctatggtgtaagtgaaaaaggtgttgcactactgcactagaaattgaatttattagaatatatatattcaagtaatatatttgctaatgaattttgttttcaattggaagttttaagatttctgggtttatttaagaaggactaccctaaaaaggtggaatttaaaggtggggagcggtaattagaagcaaacagtttcgtaagtttttttttagacaacacttatatctagcacttttgaaatctcttgaataagttagaataattttatactaattgattcacatatttagtggtaaacagtttcttaagtctgaacatacatgtaaccattatctcctaaaaatattgaaaaatgtgtaattaatatataaaattgtcttttagcatataacaacctatttgaaatttgaaattacaatgtaaaaaaaggcctttgtccaaaattaatgaaatttatcctttttagccatttactttaacattgcaacattgtttattgtttaatttattgttttcttttacctctttaatcgcttatcacaattggtcataagaaatcaacaattgatgactagttattctcatagatagtcagtgcaacactcacacc

SEQ ID NO: 3081 - DNA, 1000 bp, Glycine max
  Soy_ogl_6462 Gm19:39659001..39660000 Cluster 13
tatatttgtgcaaccaaattatattttcattgtttatatagggttgcgaaaataaataaataacagaaaacacaattttggtatacatttatttaataatcatcaaattaatcacttctaattttgatgaacagtgaagtaaaaaaattattaatatattgaatgtatacttggttaaaatatttatcatgtgaaatttcatataataattttaaaaaaaaaaaaacacaattcagaccttgatttttcaattattttttctaattatatacttcgtaaaacatacaatggtcaattatattaaaaatagatagaatcatggtggaaaaatgattcatttgctttttaaattatttggtggaggagattttggtaaaaataaataaataaatcaagctcttatttttgtcttcaacactaagtatttatcactgccttaacacgttggttgcaccgttttgttcttagaaattaaatgttcttatgttatttgattttaacactaagtcctgcatttcatttcttctcactgatgtcagataataacagtcttgaagcttttatattttatcatgtgatgcgggaataataggctgagttctgagtctcttattttttttccatatttaccgttttggaaatggtcctcgcatgaggagccagtcttgtattttgaccaactagtataacatgagccttctctcagttaatgaatgatgacaaaacgtattcgttggttctaaaatcagtatacttctggctccgtgtttaaaacaaaactagataagtaacatgtattttgcacagcaaagagagagtgaaaataaaaataaaaaggtgaaaaaggagaaaatataatgaacctgtagtgcaccatacaatgacaagtgacattagtttggacggatttaatatagatatagattagaacaatggtgagaaatagtttttctttcctttcaaaaactatgttctaattattttacaaaacaaagtattc

SEQ ID NO: 3082 - DNA, 1390 bp, Glycine max
  Soy_ogl_2883 Gm08:44284210..44285599 Cluster 13
tcattaacataacaattcactttatcaaatatgcttgggagagtcatttgtatgcattgatttttattttatttttttggtactttgttccctttaattttgagttcccagatatattttagatacatcaaattaaaccaattgaatggttaaatattcaaaaaaaaatctcaaaggttaaatggttagaactttatgaataaataatgaataattctaaatcatctcgctacatcattttgagttcccaaatatattttacatacataaaattaaaccaactaaatggttaaatattaaaaaaaaaacccaaaagttaaatttttagaaatttatttgagcacacaaaaatctatgaataaataatgaataattttaaatcttctcgttacaccatcctactaatcttcctatcgtttttaaaataaatagtattgaatacgttttatattcttaagacattaaatgccatttatttcatttgataatttctttataaattactagtaaaattcataagaggatataatgatatgtcattactcataataatagaagtttttagcaaatactaactgatgtacttgaagtattggttaaaaaaacaaaaaaaaaaacataaagattttattaataaatatcattaatgtgattctcctgtaattttcaataagttttcaatgccttgacacacttgttagcaagttccaagttttcttttcacacaatgaattttttttataataatcatcttacaagtcatacaaataatggttttaaaattataattggttcacaatataaattttttataccatgtgtattaaactcagaatttattatatcatcagaaaatcatatagtattacatatgaaatcaagattaaatatgttagcaattatttgaaaggtaattaattcggctaataaaaaacatttgcaggtaattacaagttttaccgaagaatttcacagataaactatctataggtaaaagttaaaaatatatatttttcataatttaaaaataggatttattatcttgctgtccttaatttttttttaattttctcttttagtcccttatttaaatttttatcattcttaaactttttctccattatcacctttaatacttgttgttaaataatgctaaccggagacctaacgatgacactggcattctaataatttgttgtgttgtcaagaggtcgaaaacagtatttttttttaattatagtgatgtttattttacggattttattatattcttaagaataatatttttaggaatgttattaatataaatattattcccataaaagatgtttgatgaatatttctaatccatgataaatgtctttaaatttgttttaattttaacaaatat

SEQ ID NO: 3083 - DNA, 1227 bp, Glycine max
  Soy_ogl_3717 Gm11:4044974..4046200 Cluster 13
ttatctaaatacatacactagaaaaaaatcatttataatcaatttatcattagacgttgtcttggttgatattaactttatatttaatcaaattttatttgttaacttcatgaaaatatttgactcgttggttttttagttaagcgatgatatggggatatttttttttatattatatactccgtcaatattttttatttttctctatttcctttttcattttttaacttttattgattttggtgagtcgattcacttgtcactaaattttaaaaaaaaatcaaaaaatctcacttattatctttagtgagatttattatcttattttttttcattcatataaaaaatagactcaaatttaaggttttgcttaaaatatggaagttcactcaacaaattattggtattattacttcatttataatcttacgtgtaattatcaaacttatatgaagcatgatcattaaattgaattaaaaaaaacttcatattttgaaatatcttatgataacttttgtcttcttataaaaatatacatctcaatcaagtgattaacgtatattataatattttatgcatagcgtatagtatttaatgtaattatatatccaaaattaataattgattataagtgcctcacacgtaaaattatatttgttgttaggatcactgtaaaaaaattctatttgaccaaatataatagaatttgacaattaaggatcaaaaccaatttccacgctcaacaaaattactacaaaagtgtattgatattttttaccactaaatattaattattaattttttgttagtttctccctaccttctcattttaatattgttgtacttctattatttttcaatatttatcacataataatacaaccttataactcctaactgtattgatattatgcaacataacatgttttaaacaaaactttcgatattttttatttattaaagtcttcgaagttgattaacattctatgaaaattatttatgtgcacaaaaattaaagattatattgttgtacttgtaattttttcaatatttataaaatttctatgcatggcactcgtgaattgatcgatcatgtcacctagacaacagtgtgagaagtttgtgtcgtgggcaatgcaaccatctaaagattattgtcctttccatctaggtggtatgaacgtgggaaacatggaatgaaactttgggttattttaagtaggcata

SEQ ID NO: 3084 - DNA, 1558 bp, Glycine max
  Soy_ogl_4588 Gm14:1801..412158 Cluster 13
cttttagtatttaaccaataactaattagtatggtttaagaaagaaataaaatctgagaaatatacgggaattgtatttttttgcttgtgttggggattcttaaactcgtgttttgctatatcggtgaaaataattttattatttttcttatttgacacgacttattatgtaactatatttaaatattggaaaattttcttaacactctgcacgttatccttcattctgaagatttgaactattccttcttgctgttcattttgactttgtaaaactaattgcggacaagttcatcggttatttttaaatagtaaagtcaaatgttactctcatgaaaacttgaaattaattgttaatctcccaagtttactaatatttgaataataaattaaaatcaaagaacaaattttattttatatataaaaagagaattctataataagtactttacacagaaaaaatacataaataactagagagattatatcacaacaaaaactatgatgaaaatttcatgtcaaaactattaggatatttgtttacttaactttcattcgaacaacccaatgcgtgtttggaaaattttatattgattcagtagttgatacaagtaattttggaaaattttcttcacgcttaacttaaaattgttaccaaacatgttattaaattttcacttcaatttaaggttgattcaattgttgaagacgaatgaagaaaaaaaagaaagagagataacaaattcgaatccttttactaatgttttttaacaaaaaaacatttacttgataaaaaataataatactacattcttttaaatatcatcacgtattagtattctcatactaattgattaccagtataatgctaaaataataaaataaataatataatgattgaaataaaatatgcaatgtaaatacaaaaaaaataatagcacgaagaaataataaaattttatccaatgtaagtaaaggaaaaagttaataaatactttaagaataaaatataaaaaattataagctacaagttaatgtcttgaaaaatatttaaaaaatgtttatcaaacgtatttttatctctaatatgaaaaagttaaaaattaagtaaaaatactcaccaaacatactatagagcaagagaaatattgttattactttttttatttataatgtcaagtctaattttttagaagatttattcgaaactgaaaattcaacacatggaggaataaaaaaaatggtgagtagctaataatccagacactcttacgaggatattgaaaacaccttttacaatataacgtcaagtctagatgacattcaaaacacctcttacaaattctttcctaaaatttattattattcagagtgagttttatgcattaagataaaataaaaaatgggtttgaaaaatattatctctaataaaatatacaatataattagacataataacgaaattgtgtatgaaatattgtaaaaggtatccacaaaatattacatactcattctcattagataatatatattacataaaaaatagaataatttatta

SEQ ID NO: 3085 - DNA, 1433 bp, Glycine max
  Soy_ogl_654 Gm02:44743268..44744700 Cluster 13
gatagtttgtttgatcacatgaacaaggttttttctacgagtattaaattgaattacatacacaatactcagtatatgcaatttcatttattgcattatcaacgcatctaagagaatattagttaatatcaaaatgaaattgcatacatgtttatcataggagagctacatcgcataaagagatcatcagcatttttctacttccatttccataccagcccttattttgcatgtaaaaaataattgatgttacaaaggtttcatatacttatctaaatactttcttttgacatccttctacataattgatccaaaaggaggccaggatcagtacaagaaaagttgaattcgatcataaaagaacgcttgagatgcaaaccaataaaaacaaaaattgattgtgctggtataaacaaactataatcttataacgaagactaaaatttgaaaaaaaataataatggtaatatatcattgagttccttaaagaactttgtttctttgttttcactttgacataaataagttctgccaaaaaaaaaccttgcttctttgctttctcttttgctttgatttcatgaataggtaattatcagttcgacttgaagtcattttcatataaagcaaccgattcctctctaccacaccatattaaattttttatgttcttttagtcaacattttgttcttttagttgatgatggctagtcgttcgaattaatcgtatcacatggaatattcaaaaaccatttacaattgaattgcagataggaagagaaaaaaagacaattaacagaggattgattggtatgctaacatgaaaactacatgtttttggttagattcatatactattgtttaggcactaatattgtattagctggtgactagtaattaattcaatcggacaaattacttgtaagattagtgttgccaacacattttttttaatattacatattttattaatgattaaaatttattaaaaaaattaaaattatgagtgaaattcattaaataagaagtgagattttaaaaaaatatgatttttaataaattttaataaatagtaaatattatgttgaaaataatattaaattaagggatttagcttagttaattgaatcatgtacatctcacatctgaattcgatttctctattaaaaatagcaattttcttacttgtcgatgacaattacctaattaactttgtgatattgaaaatgggagagcctgccgtaatttgatagcgaagtgttaaggaaactaagacattcatcactagcattttggaatctttgctgacatagaagaagcagaattgcaaatgattttgtaatccttttgtttgttgtccatcattgttagcagactttaacttcatttttattttgaggtaaagatttcgtcaactttttttattgaggtaaaag

SEQ ID NO: 3086 - DNA, 1249 bp, Glycine max
  Soy_ogl_1067 Gm03:43182101..43183349 Cluster 13
taagctaagtaaactaaatgggggaaaaaggaaagaaaaatgaaagggtgtttggtgatgatttggttctcattagttctttttaactctaaacttagaactaaggaggtgctaatacaaaaattagtacataaactgactctcttttaggtatcttgagatttcacatggtctcatgcttttttaaacgtttatagcaatccctttatagggtacaaagtataacgtttttaaatcaattatgggagatttatggaatatataagaaatgtaagcgtaatattttttaaatcattaaaaaaaaaagtcagtgtagagattaaaaaaagaggagagacatcaaggaaattttaacaaaaattcaggacttaaaagtaagaaaataaagaaatattaataatttacctttttgatatattttagtattttgataatttggtaagttatataaatttcttaatttaaatgtaggatgcatcagaatttgatcaagatacataaagtattaattggttttggaataaacaaaaaagttaaactgatatatattaatttgtcgaaatcacaataggaacaatttgaatgatacttagagcattcataatgggagttatttaatgagttccttaaaaaaaatagagagcattcaaaatattttggtgtatcaagtgattttgagttactttaaactagagagatatttatataaataattgttgctcattagttgtttaattttatattaaatatgagaaacagaaataaaatattcatgagttaaataacttattaataaaaattaacttctattagagagaaaattagtcgagttatttaaaattaaggtgacataaaattgcttatatgaagacctaaagatgctctttttttttagttataaatttgtgtgaatttttttggtgtgtgaaaaaacctcaacatcatatttcatttattagcaacaattaaataaacttaattacagtttcaggcatcctaattttttgtccctaaattcaaatttgcttttctttagttcctcaatgatgaaaattgctcattttatcccctcccataagtatgcgttaaatagataataatatattgataatttgtgaaaattttaattaaaatagaaaattttggcatctaaaaattaaaaacctaatgaaaatctattaattaaaaacctaatgaaaatctaaaaattaaaaacctaattaaaatctaaaaattaatttgtgaatgc

SEQ ID NO: 3087 - DNA, 1300 bp, Glycine max
  Soy_ogl_6768 Gm20:35199201..35200500 Cluster 13
agaagaataatattcctcagtctttggaatatgacaaaatattcatctctgattgattatataaatttgtaccgataactaacaccaaagatataacattacatgctaagtcaattatttgttgaaaattatttatttatattagcaattcttttacaggaatttcatattttattatgtccttttgtatccggagcattttacttttagcaaatgtattaacaagtctttgtgtattatatgagtttttcaattttaataaaatttaaaatagaaataaaatattttaaacacaacattattttttagcagtatttttgaatttaagggaaagtttatgaaattaaagtaattgaattaagatacagttttggtttaaataaaaagttgatctattatttaaagttttccacataaactaagaaatataattaaattgtaagaatatttattgaaatttactttgaatccttagtttattttatctatgttccctatatcctttttcaagataggggtgtgataaggaaaataataatttatattattctaaaatggtgaataaataaaaaaattaaaaaggtgagaattaaaaagaaatagaaatacaatttgagaagtcatgtgtcgtcttaaggataaaaaaaaatataatagaagatgttctcaatttataaacatggaaaaaagggtaatgcattgaattttctgtaaattataatgttaagtaatgaaagaatttaataaaaaaaactattattgatccaatccaacaattgtataaactatttttgtaaacccaataataaaacattaaattttaaaaccattttatgtaatttaaaatatatgtacagagatatttattattcagagtaaataatatattcactgagagtatctataattatttttataatgtcattaattacatactattatatataataaatttgaaagaaaaaaatacataataaaaccacgttagcaattttttttaaaaaaaaaagcatttttggaaagataatttattattttgcaaatttccaattcacctcccttccaaaccatgcaaagcatgcaaggtttgagttgcagcaagccagcaaccatttgttacttatacgttgtatcaaaaggttgttataattttttaaaatattttttgacattgcaaactgaaaatagaccttcaacacattacacactttagagaccatgccatcatcatccaaatgagtcttgactcttgagtttgggttctatatatatgtactcattactcaagaacattgaactc

SEQ ID NO: 3088 - DNA, 1344 bp, Glycine max
  Soy_ogl_4571 Gm13:39391601..39392944 Cluster 13
tgaagaacaaaatatacacatatggaaattatattataacttgactgttatgtggaagtttatgttttttctttaactctttagttcataaaaaaaatgaatcttgcttaatttgaaatttgataaaaaaaaaaataagtacaatctaattaaaaattatttttattaggtatcaaactctttaattatttgttacccgtccttagtggtgtctttcttaatttgcttcatcacaaagagaaaaagaaagaaaaaaaaaacttgagtgttcaaagaaaaaacaaataaacgatagtgtatattgaactattgatagatgatgtgaacaagatttattagaaagtaacgtgggccgcattatttgaagcttcaagagcaggtccccaagggcacaatacatagcgtttcttgattctccttgtgtccccatgagtaattcacctccactttatttgatatttattagacacgtgtatcattttttagggaattttataaaattttaattataaataatttttaaaatcagttaaacttcataaaatgtcaatgagctatttaactggtattttaaggtaaaattaaattaaatattcaaataaataatatcaaaatgaacatctaggcatctagcagaacataattacatgcagcaatgtagaagaataactaattcatataccaataataataataaaaatttccctcacatcaaattctaaattatatagtaaagtggacttttatagtccaattttaaaagtcatacttaagatgatttttttttattgattagtagtaaaaatatttttattgactatgtttgaaaattaaactctaatgatttttgagggaaaactcgaatgataatatggttatgcgtgacttcactaagtgttagataattaatttaattgtttaaataaatgaaatctcaaaattttaatttggattatctgtatgattatttacaagggaaaacaaatttatttttttacataaaaaagagtttaattaattttaaatcactattaatgtaaagattttatactgtcaactaattaaaaagtactataaatataattcgtaaagtaattattgcaaaatttaatatttttttaattatataacaatttaaattgaatagcaatataaaaaaaaaccttcccatagtaaatctattccgtttaaattctataatgaatacttatttcaaatttattaatattaaattttcaaaacatcttaagaatatagtctataacaagctaatgtacatacacaaaattacttagtcactatgaatagagaaagaaaagaagaagaaataggcgggtaagagag

SEQ ID NO: 3089 - DNA, 1351 bp, Glycine max
  Soy_ogl_3566 Gm10:46193774..46195124 Cluster 13
gtgtatcaactctattagcttgattgtaatgtttttaagcaattggtggactcgaataaatttttcgataattaagaaatttaattgattttttttaaaattagatccctaaacttatattgatccaattgaaaaaaacagtttatgaatctaattaaaatttgataagtatcaacaagcctacagagtaactaaacctaatacaaaagtaaataatgttaaatataatataacttgtgagaggaataattgagaaaaaataaaaaagaaaagaatttaaagagaataataatgatatgtattcttttcgagagaaataatttatttataaatataaaagataattaaagagttacaaaagataaatacaaaataaagatatagaaaggtaatatcatcacaaaacattaaaaaaaatataggcataagtacctcaaaggtgcatttttcatggggcacaatgtgtaagaaccccccatgtatgcctctagcaggagttttgtaaaaacgtgaacaattaaactttgggacttaacctttcaaatgttagcacgataagtaattttttttttattaaaagaggaaaaaccccccaacaagaacactaaaaccacggaggaaatatctatcataacagcgtttaaaaacaccttcaattgaccctgtaagacaatctgccacttgattccctttacgcaaagtatgagaccaatgaatatcacctccatccaagactgaagcaatgaaatagcaatcagtgaatctgattcaacaatttcttgaaaccatgattccgagcaatttgtatccctatcaaaattgcccaaagctcagcaactacaactgaacaagcaccaatatcagcagaaaaagtaatcagaacctgaccacctgcagtgtctaataaaaaaatattcatgttaagtttttctagatttttcaagaattaaataaatgttataaatctttaaaagatcaaattggtattaaatgcatttttaaaggatcaaagtaacactgagcaataaattggcatatgatattttcttatcgcaaatctagcgtaatgattaatgtttaaattacactatttgctaattgtcatggtaaaaagaaacagcgacaatcacgcaaagtcctgaatgaattggcatagacccccacacaatcttcaacaatcaactaagcaagatcacgacgagggtatatttagtagcgtagtgtaaattcaaattgatttaaaataaaaacaaattgttaaaaaaatcaaaaattggattaaactgattctttttttttaatttgtttgaatgatttattttttcaaattaataagtttggttcaatttat

SEQ ID NO: 3090 - DNA, 1492 bp, Glycine max
  Soy_ogl_63 Gm01:2693801..2695292 Cluster 13
agtagcttactcccaactcgcaagatatttgctagtgataaaaagaaagtggaatctttcatatctaaagaataaaatggagactaaaaaaaaagaataaaatggttccgcattattacgagaatatatctcttgaaaattctcataatattttttaataaacataaattctcataatattgacctatatatcttttaaaattaatggttaaaaaaatagaaagtacttgtgtacttacacaaaacttcgaaaggtcttactctaatttgctctaatatttatctttgctttttactactagttttaggattcaaagtaataatgttttcctactgtaccaaaaataaaaatgttttttcttaaaatcaaataaaatcattattatgaataattgccaagcgtgtaaatcagctcttaagggactagtatattcatatgaaagtctcaagttaaattctcgaagaagagctttattacattcactttttttcttactgaagctatattacatatagttattgtatcttacttcactcggattaatcagacgtctaatgtagtattccaatactactccggtatctttagacaaaaaatatgcggataaaaaaaagtatgattcatgctagaatagggtattatatatacaagtaaaaagagagaaaatgaaaatactaaatgacattattttacgtataatacgtgttagatgaaatataaaatatgcttatataagagttggactcctagtccttatcaaataagccaatcagtagaaactactcttaagatatcatttacaataaaatatttttaaaataaaataatatttttgagatatttcctaaatattttaacactaaccttgattaaatttacccgataatatgggaaacaaataaaaactatataaatgtaaatcattttataaaaaaaaaatagtaagactttctctcaaaaaaagaggaaatctaaaaagttctctcttccaagaagagtatgtcgttttgaattagtctactcttagctattttggactagctcacagcaagccaacaaacatttggattaggttaactcagtgtagttgtatgccaacaatttgctagtccaccatggtcaactgtaaattgcaggccgaacaagcattgaactctattttttccttttttctaagaatattatatcacaagtgcattaataatataataattaacatagaagaaaaacattataatataataattagcatatataatattaaaaatacgaatttactttcatattttagtattataatagtcctattttgatatattgtctatcaatatttcatatgtattattaacatatttatttatatatctttgacttggtagtattttatgttataacaaaataatttattacaaatagattcaacccattaacatttttatttgttatacttatttatttttaatagtttagtatgaattttttgttcaaagt

SEQ ID NO: 3091 - DNA, 1400 bp, Glycine max
  Soy_ogl_1148 Gm04:896501..897900 Cluster 13
gtgtttactataattcaaaaattctcattttatttttttgtcgactacaaaattattaatcaaaattttataatcatacatttatgatatgtcgctctcaatatataaattttaaaattcattcaatctatcatttagtatagttaatataaattaaacaagatttgagtcaatttaattttaaaaaatgcccatgaattaagtgtaggtttaacgtaagtccaggcccagcttgagcttgcttcgcgccgctaagacatttcctttgccaggatcccacattttgtacggactaacacaataaagtttgaaaaaaatattattaacttaaataattgaatagtagttttattataataataggtattatatcatattaaaagattaaattctattattaatacatgcattaatgataatagatattcctttatcagcatcgatataacattattaacataaaatatttgtttttttttctgaataacaatatctttttgttattattattgtgagattttcttaaaaaataaaaccacttaaaattagatttgaaattaattatttacaaaataaaataaacaattaattgtattattcattgaaagtaaaatgataaaaatataagattataaaaatttggcaacactattacaacttaaaaagttaaagtaaaataaaagatataaaaatttagcaacattttgcttaaatctaaaattctcaaacacgaatttgtccaagcccttacatatgtagaaagagaaatatcagtgtaattgttttttaaaacggttcagcattagtctaaactaattagaaatagagaggagactacttctatttttttattgttttagaattttatatgttaggcaataattattttataaaatcataattataatagtcatttaacacgtaaaaacatattaagacaattttatatatagggttagttaaagaaaccaaattaaactttagaattttatacacttatacacaagtttcacatatatattaaagtaggcttacataatttgaagatgtaattctaattggatagatattaacacgtctagaaaatatttgcaagttacactacgtaatttatatgtaaaataaattaccgccttataagcccagagatttgagccataaaattgttattggaagtcaatggtactttgttaaattttctttttgatatataggtatttttatattaaattataatttttaaactatagaggacaacctatatgtagtagtgggtgatttatcaaattagattgtaaaattaagtgatttttaataaatatttttcatcctatatcataaatttttataaagctttttatctttttatcatgtataaaaaaatgatatataaaacagag

SEQ ID NO: 3092 - DNA, 1460 bp, Glycine max
  Soy_ogl_1431 Gm04:46071143..46072602 Cluster 13
ttttcatcatgcatgttttatttttcattatttatttccgtacatactacatatagtaaaatatattttgataaattgataatgctaaattcccttttaattgatatcttattttttataaaaaaaattaaattagtgatgataattttttttcaaatctaaacttttagttaatgtatatttacataaatatattattatttaagcatttaaatttaaataaataagtattagcatgcttttaggctaaaaatataaaataaagaatacaaaataacacaacttttaaataggttaacaaatttaatccaaaaaataggttaaaaaatattttgataaacattttctcaatttctgaaatattttcttatttttttagaagtatataaaataagaatataatgtaattttacagtttgaattttttttatcaatttttaaaatttattttatgcattttagtataaattattatattagtacttgtttgttttgcttttccttactgaattgataatatgcttctataatatgaaacttttcattttcaaattttattttctcatcattaattttaaatttttttaaaaaacatatgaattaaaaggggatccgttattaaaaaatcaacagaatatatgtaaccgtatatattgattataataacaaaaataaaacaaataataaaaatatcattaattatgattttaacatatccaatttttctacattgttaattttcctttattatttatacaattgttcatttatattaatctatttttttgttttcttcaatcatgtaccttcaacagagacggaaaatataattgaatagaaattaaaggtggttgattgaagaaaacaaagagatagatgagtataaatgaccaatggtataaataataaaagaaaattaagaatgtagaaaaattttcataattttaatttttttgctagggttttttaaaaaaataaaataaaaaaagtgagtatattttttttattggtaggaattaaagaaaatgttaaagtttataataattaaacattttattcaatgaattgagataaattttctttacggggagttaatatattacacataacaaacaaatgagtttgttgttttcttttacaagttggcttttagaaattactctccaaaacttattaaaatttcaacactttcataaactactttatggaatgtaaaataaaagggatatttttgggggaaaaaaagaagaatgagagctatatcagtaaaagtgaaaggtataaataacagctgcgtacaagttatcaagtattctagcattgggctcaaataatgtaaaatcccaaaatcattaccaaaaaaacccaagagtccttttggtgcataaaattggaattgtaatccataatttaattcttacatggttgttaacccatatgcatgatcgtgcccgtatcaa

SEQ ID NO: 3093 - DNA, 1185 bp, Glycine max
  Soy_ogl_1569 Gm05:3232981..3234165 Cluster 13
taaaataaattcattgtaaatataatatgttattaatttcatctctataaccatcaagcttctagatcaaaaatatgaaattattttggtttaatcataataataatgctactttatttaaataagattgtttttagtaaaaaatatttgtaatctaaaaaaaagatttaaatatatttaagtctctcaaatctggaataagtttatttttggcattttaattttaaaattaatctttataatcccagttgtttgaagaagaaaaaacttgttttagtctctttgttcaaacaccattagaaaatttccttatctgaccatcaaattacactatgttttcatgataattcacttgcattccttttatcaaacaccctaccacatttttgttttactttcaaagctagtattcaacatttggatacaggacttttgtaaaaagagactaaaatagacttttctcaaatacaaatattagaaaaattaattttaaatttgacataacaaaaatgaactaattattttaaatttgaaaaagttaaacatatttaagtcaaaataaaattaccctgtccatcgacgattaataatccacttgttgtttcattctgtttttccaaagtaaataaagtccttaaaatcaagtagtacctttgaatgatctattaagtgatagcttaaagggtttttttaacgtggttaaaaatattattttgtaagaaaactaaatcaaatctgtgaataatttatttaagcataaacttttccttgaaaatatttaataatatttaaaatatattattagtcaacctacgtactaagagtagttatgaagttccagtcaaacaaaaaaaaagagtagttatgaagaaatatacatatagttatgaataaaaataattgataaaatataattaaattaaaaagcacacacacattacctttcaaataaaaaattactctttaataacattatatttgaattttcgatttattgtgtttttaataataaataaaatatttttaaaatataattttcaatcccactgatttattaattatatataaaataaaatgacttaatttatctgatatataattttttatataaatcatacaacatcgacaattttaattttaattttattatttgtggtaaaaaaattaattagtatatcacccttg

SEQ ID NO: 3094 - DNA, 1239 bp, Glycine max
  Soy_ogl_2176 Gm07:4146262..4147500 Cluster 13
atttatctaacaattataaagttatcacgtgaatttttttaatttttatcatttcatttatgtcatctataaattttttgagttttacttttacgtattttaaatatttcaattttcaaattttattttttaactaaccttgaattgttttataataagaaaaaaataaacagggaatttaaatgtcatatgtaaagcattaaaagaaaatagaatttacaaataagagaaaaatagtaattaatgaatataacatgaatactttttttattttcttcctattaaggagttatataatatattttttctgatttactctattaaaattagttcactattagtttctctttttaaataaaaaataatgaaaaattaaaatgaaaatttgaaaggttagaaatatgaatagttaaaaactaaatttgcattaaaatacaattgacaaatcatttgaaatatagttatattttaaaaagtgagtaaaacattattttagcctaaaaatgaaggagtcgatgaaattaatctctgaaaattaatagaaatgatcaaagggatcaccaaaagtttaatttaccaataaaagtgttctttgtgtttttttaataaaaaagtggtctttgtgttaatagacatgagttgatagtaaaaatgctcacaaaaaaattaagtatttgttttagggtatgattaatcagtatttttaagatattggttaaagaattaaagtaaatatttattatataaatcataagataatataattttttttataaataattttttttatctcttaattaaaatatcttttttaagtttttaaagcacttgttaacatttctctataagaattttatttgacaaattaatcctttgattttaccctttcattctttatgatttcctccctcgccacttctctcacttattacgtatatatcctttttttaatcttttatcacatccttcttctcgctttgtcttttctttgttatctcattttattatctaagtttctcttattggtttgacatgactagtcatccccataactatatatataagagaaataaagttacatcctaaaaatcaattgagatgaagtgaaattatattatatatatataaaagttacatcctagaaatggaggcatgtgaaactttttaacagtactcttccaaatgcttgctaaaatagatgatacatacaaagagacatactatactgaccctaagagg

SEQ ID NO: 3095 - DNA, 1546 bp, Glycine max
  Soy_ogl_3312 Gm10:1981401..1982946 Cluster 13
aggtgtatttgttcccagagatccgtctgtaaaataattaaataggaagtgctaataccagtgtcaattgtaatgacattacatctataatcattacaaagcaagtaaaaccttccgtcgtcattaattttagaatatatcaaaatttattcaacccatttatagatatataatcaatatgaaaattacaaattttacttttttagattaatttttttttaatttgaaaaatctacatataagtttgatttttactcaccataaaaatacacttttacattcctagaattcaaatcaaatttgactttcaacttaaagaccaaattaatttgaataattgtttttgacttttcttccttgtttttgtcttcttaaaaatattttttttgtttaagttaaatattttttattcctataaatatgcaaatgtttacctttagttttgtttaggatcatcaacattttagttctctgtttgaaaaatgtgttacactaaatcccggtcactaactccgtcactgctaatgatgcttaattaaccttatacatgaacattttgggtgacattgcatccctgtgattgccacatgacaaatggttttcttttcacccctagaattttttttttaatattttttagtttctataaaattttaagtttaattttaattcctataaaatttaaattttggttatagtcttcatcaaattcattaatatgattttagtctctataaaatttaatgtttaattttagtccttgatttattatcttattttaatatattttttttacttttttaatattttcttcatcgattttcacattcatcttaccaacactaagaagagaaaagaataggagtattttttattttaataaagatatttatgcaatatttataaaaaaatattatggaatttaattgatactaaaatatcattttagttactttatttaaaacaacatcaaattagaaaatatttttcatttctttttctgcaaatctcactcctaaacatattcttacgagaaatgatatgttgttgaataatgattttttttattaggattacatatatattttatagaaagtaattatatttaattttttatccataagaataaataaaaagtataaaattttataataactaatataacatgctttgagctaaactctttaataattataattatatttaaattgagacatttatagtatggtaagaataattttcttcaggatattttatttttcatatattaagacttaaacccaaaacttttccaaagaaaaataaaaatataccacctgaattaatcacttattaatataattgaattatggcgcaaaatttgtattcatgcaagtgtccttttttgttttatatattgaattagtatatggtttatgttttcttcgggcagttagatatttcgcatttgaatgattgttttttattctatttccacagttttctttttttcaattggtggtcaacatttccccttcactctatccaattatttagtgtctctttg

SEQ ID NO: 3096 - DNA, 1300 bp, Glycine max
  Soy_ogl_3531 Gm10:44846701..44848000 Cluster 13
tatgattaatgtgatctaagcaaaaaattattaatttgcagggtacataacaaggtgtgtgtaagctttagaaaatagaagaaaaaaaatttgaaaggccaaaggtgatagattaaaaataaataaaatatatactactgagtactgacttttatactggtctttagttacaaactgtatttatgattgatttttataattattatctataaaattttgttaataataatttctgattaattaaaaatgtaaaaaaaattctatcaaaaaaatgtaaaattttttacatgcatatgtatattaaattaaactcataaattaatatagaaaaggtttaggttttgatgcttgttatattatttttttcgtaaaaaatagaaatattctaagggccacggaactctagaaattaatgatcatatacataatatgacatggtaaaaatatattattgtgataatcataaaaaatttaagagttaaaaacctttagattttaattttgaaaaatattaaatgttatgaaaataaaattcatgcatctcacatgaacgaggtgaaaaacatatttgtttctccttctgcttatttctcttaatttttttttttttgagttgtttcatcattcaaccacgtacttgatgtatgcaacgatcaagagagaaacaagtgcagaaacacatgcttaagaatatgaaattatatgcaagtgtcatgataacaaggagggcatgtcatgcatggtggaaggcaagtgtgagaagcacaattacatggttttgattgttttgttgtgtattgcagtgtgagagtcaaataatataatatcatgtttttcattttattaataagtttttttttgtaaaaaatcatttttttatttaataaattgtgcatataattaaaataaatcatttgtgcacgtattggagaaagatatacatattgtttgtgcatttcatgtttgactgattcatgattttaaagaaagtgaaatttagattaaaatatattctttagcacgtataaacccatatttggtggtcactaagggagattttaactcaataagaaatataagttatatttatttttttaatacactcaaatatgtttgataaagtagattctcacttagtaagaaacataggttgcatgtatttcttaatatataatacacttgtattttgtggttaaaaaatcttatattttaacaaaaaatatgaatagactacatgtattcctaatatagctattcttacaaattttatgatgatctctatctctttaagaaaaagaac

SEQ ID NO: 3097 - DNA, 1264 bp, Glycine max
  Soy_ogl_4123 Gm12:37441224..37442487 Cluster 13
ttatcaaatttaaaattaaataattaatatatcaattagttcgacaaatatttttattaaacactttcaagtcaactaattaactcatcgaacttttaaattttaactaatctattcgttaaatttgaaaccctttacaagatgcatataatccatcccactccatgtgcaatattagcaagtctatgtcagagtggtcttaagtacatatagagtagtggtgcatgtgattatgtatcttctatggcgccatttctttttatctctaggcaaaaaaacaaaacatttattttcaaccaataatttgttgttcttagttaaataaaatcggcatgtgtggtagaggttttcgtgatttcttccctttaacttttccatttgttgactcacagtgtatatgagatttgaaaataaattatcttatgtgaaaattttaaggatataaatataattttcttaaatatataagtgccccattgtattaagtttgatttacaaaatgacgataagtcaatttttaactaaaaatgttaaattaactaaattagttaaaagaacttaataaatgcaaatgtacataatataacatatttctatattttaaaaaaatgttttttatttttatttttttataacaatatatttttagtataattttaggttttataattaattttaaactcttataaattttaattaaacagtataggttattaagaattaaaaggatgatttaatattgaaagagttaataaatgcatcttttattaaatattaaggataaaaataaaaattaaataataaggtataaggtataagctcaaatactatttcaagtaatatatgaaatatgaaaggtcactataagttaatgaaataaactcctaaaatgacctcacaagcacgctttaaaattatcctttatgaaatgatacattcccattgacttcatgaaaaaatgaggttagctttgcctttggggtttcttgttgctttaggttagcattagcgagccttctaaacagatcattgccgatgctttgctatcaaggagtatatattcttttaagttctaatctcattctcatgcatttaaaatatagaaatagtataccaaaaataaataaatataggaatagattcaaaccaatacaccacaaaagatagcaagaaaaagaaattctgagctatatattgtatggttgaatttatttattttaaacgtatacatatactcaaattttcattgcaaattctaccaagc

SEQ ID NO: 3098 - DNA, 1419 bp, Glycine max
  Soy_ogl_6924 Gm20:42050582..42052000 Cluster 13
ttttaagaaaaattatttattttttaaataaaattggtataatttaatgatgttagttttttaaaaagtaccgtataagttttttatttattttactttttatatttaaaagacattgcgcacaagttaataaattaccccatctgtctgttttattaattcatgtgacgtgtttgtgagtgaattctgattgaaatctatacactagaaattctgcatcaagttttaattattgatcgatctcattcatcactattatgaaaatcatataaaaaatgagtttcatgaacacaattaaaaaaatatgttaataaattttttgttgttgttgaattcatttttcactcaatgtttatgacattttttgcttagaacattagttgtattcaaaagttttcatgtatgtaaatttaatgagacaaaattcatgtctccaatcaaccaaaaaaatttaaaattgtgtgtcaaaataaaaataataattcttttgaaagaaatattttgactcactttaaaaacataaaagaatatttttttgaaaaaacaaattaaatataattgaaaacataaaagatttaaccaattttctgccacattttcttgatggacaattgagcacttgaattatattgattttccaaatggtgattcttttcatttttagaatttatggatactttatataaattcaacgttttctttttcttttcactatgatatattatccggtttatcccatatccctgtaaaactcgaaaaagactaaaatgaaaaggacttttatgcagatcgatccaatatattctaatgcctaaaatgaactttatgtttaaggtgagcctttttttttataaaattaataaaaataacaaaaaaaaattaagggctttataaataacaaaattgattttttctcgagcagttttcgaacccgacctatttaccaaaggaaaaacacattttagttactactacactcaagcaattaatagcaatttttttctcccggagagcctaaaataaggacttggatcaccttatatttggcttgatcctgctttacctatatgtataatgaaaacttacaaatatctcaaaaaaattaataagccaagttaatgaaccaacatccgttatttccataaaatcataatactccaggtccttctaaaaacttaatttacattacttttaagtattattttaatcaagttataaataggttgatatagtttaattttttgagacatgtccttctaaaaacttctaatgattttttttatcgatttatggtactttaaaattcgttaatgagcatttacaattgtttaccaaccattttgcatgaattatttaccaaccattttgcatgtactgctatgacagattctagagacttaattaagtttcataatacgg

SEQ ID NO: 3099 - DNA, 1300 bp, Glycine max
  Soy_ogl_6974 Gm20:44101601..44400 Cluster 13
agctatgatattaaaaactaatgatttagtgatgaatatgacgataaattggtaagaattattttagtttaatcgatagtgtccaatttgagtttcaaatatccaattaattaaagagaaaaccttttcatttataaactataatgatcttaaacatcttcatatatatatatatataatcttacgtaaattatttcaactttcaaactcaattctaatagactagaataacaatatatgtaattcatatattttagagaaatatctattataaaagataaataatacaacacgaaaggaataattttttatataagacttaactggtctttgacaaattactaatctatttaaagttgtgttggtagttaaaaaatcgagtaatttataaaagattataatgttaaatatttagcatcatttgtttagaaaaaaataaaagcaaaaggtacatatcaacttatgaaaaaactgacaaagttacaaaatcgtatattatccatgttgattacattatatccaattggagaatggtagctagagaagcatatagttgaaaaatgggttattattagtatatttagaggataagtcaatcattttcggtattatttttgcattagatttctaaattgactgattaatgcacattggtgagatcttatagtatactactagtacataattaaaaatattgaacctggggaagctttgaaagaatgacgcaatgatctagcggctcgcatcagactgggaaagacgctcctgttcctacgcccaaagtcaattaacgtcatcattcccacctaacaatgcctctaaaacctacaaaatatttatcttgtccacgttaatttggatattgatattgttctttttttaatcaatacaaattaagttgtatcattatattgttattttaatttttaatgataattttttttaaaaaaatatcaataaatgattaatttcaagaaaaaaaaagaatacgccaattagtataacaattaacaaacgatatgacaacacaaaaaaaatatgattaaaaaaattccaattttaaaattttgaattcagttcttatttgttttttttatcatttttttatttgttatcatatggtgttatttgttattatgctaatcggtatatcttatttgttcttttttgctttaccttaattttttgttaacaatttttttaaaagactaaagtttcttttttaaaattaatattaatttttaaataataatataatagtacagcttgattcctattagttaaaaatcagccatattaa

SEQ ID NO: 3100 - DNA, 1525 bp, Glycine max
  Soy_ogl_269 Gm01:51504867..512391 Cluster 13
gaaattcaagatacaaaataatattcttgattatatacgagtgagcaagttattagtgtctctgtatcagaatttgcttgtttgtaggacagatcctagggatgttaatgtagttgttccattattgaaggaaaaaccaaatgtcggtgaaaattgaatggggtaacttttttccttttcagggacgtacaatcaatgggtgaagttaatgaacacagtcggggttgacttttgtttatttagttttaaaatactgcgtatttgttgttttgaaaaacccagagtattaattaatttttagaatcatgcctagtactcatttattgctatcttacataaacaattttttttttttttacaattacatcctaaatcttttaacaaaaatcattttgtaaaaaaaacattttatcatagtaatttatgtagtaattgttaattttattaggacatgtatgttacctcaaaagacaaatcatatcagatatggaggaaacaataataaccccctctgttttttcttatttactttgtaagataatacacgaattaaagcatataattattatatttatattaaaaatatttttttaattttcaaatgtaaattctattattattttattatattgtgacaaatatataaatatttaagaaataggtagaaggaaaagtatataatgaaataataataattgatgttatcttgaaattccaaattaacaaataattagaaacttttttttaaaaaaaaaaagacaagagaaacaaataagtaataaaatctgcttttttgtgtgttctttttttaatttcaaaaaaacatcaataactattttttcaattataccatgtggtgcacaacatttcacatttgttcaacagaaaagaattgaaaatgtgatgcgttgattcttttctgatctcacagcgaacaccatttatattactcttttgactttgttctctttttcccgtcatcttcgtagactcgctttgaacagtgatacagataaactttttcagtgaaagtttacgatctgtcttttaagacgataaaaaaaaaaaaaaagaacgcaagactatgtgagtgagagtaaatagtttatatattgttagtgtaacaatattttatattattatttaattaaaaattattatatttaataaaattttaacttttatgataattaattaaaaattattgataatgattaattgacagttaatatattttacaataacatgcatagaaattacaatcaaatgagatatgattcattgacatcaagagtaaatctaaaaatctgcaccatttttaaactgttaatacaaattaatcttacaagtaaatgtaaaatattttgttataattaattagttaactttaatcaaacaattacataatttgatttaaattaattgatttaatttctcctctaactatttatgaaaattattaacatactgtattatttgtttacaaatttttccagtaataaatagcaaaatatatgttttatgg

SEQ ID NO: 3101 - DNA, 1469 bp, Glycine max
  Soy_ogl_702 Gm02:46907601..46909069 Cluster 13
tatttataagtttttcattttaccaaattgttactattcgtttttttttacaaatgttattattcatttttataaactaaaataaatatacagaacaatatctttgaatctaagtaaataaatgatatccaaccttggtaattagtctcacatatatgactgagaagataatcaaagacacacaccaaattgctgctttttttttttttataaaaaaaagacacaccaaaaccaacaaaaactagtcttgagaaaaactttaaaataggcttttttttaagaagcaaatagaatttgccttaataatagaaataattcagacaagcacactaaaaaaataaaaattacttattttattaaaataagtgtttatttcaacaaataattttaaatgaactgatccaatataagttcacgattaaatgcaccaacttgtggaatagcctgcattttttttcttttttaatttgaaaaaatgggttagtctaataattggcttatgaaccaatttaaaatggatttttttgtaaactttaaaatcagtattttttttccttagaaaaaagggaattaatgcagtaaacaagtacaaatttgtatacaaaaataagtttttattatataaattttatcatgttttaaggaaataaataaattgtaataattgtatataccaaattaagttagtttcgcatattaacctatgtaaacttaaaattgaacgagacaacttttatctaatataaacctacacgaattgcagatttcataatcggcagctagaataccctatttaggcatagagttttataatctagagaaccaaaaaatagaagatatttttttttttaatttaacagagttatataatgtttataaaatactgtaaataaaacactaggttcttatattaatatctcatttatttcttaaaattattaaattaggaataattattagaatggaattaaaacattattttcccttctccttttctctaaaactctatttcccaatccttcatgaaatagtcacatgcattagatgatgagaataaagtttttcaggtttagtataaataaaccaaaataatttccagaaaaaatatattcttgaaatattggtttctaaataagtagaaatgaaattttcttatgataattgaccgttaaaatactaaaaaattttatggtcattgtcaataaacattgttctttaaaaataaaacaataaagagatacatttttttataattttaaaaaatatttctaaaaacttattttgatgaaaataatttaatgaaaaataaacaaattcaatcatacatcacttgaagttgaagaaaatatactatttctttccgacatatttggtcgatgctgaccttagactgcacggtctaatttcactttcggtgcatgcatgctttcacttttacagttgatatcggactaatttatttaaacttt

SEQ ID NO: 3102 - DNA, 1349 bp, Glycine max
  Soy_ogl_2257 Gm07:7668401..7669749 Cluster 13
caattcttggtcttttgattatagtgtccgagttatctgttataggattattattaaaaatatataacatatccggtttcttttttagttcatttttactttattttttattacatcatttattatagtttttttccttcttcttatctcttcctatcacttaaatccacaaaaataaagtagatattgatcaatattttctctctcattaatttctaaatagttattttacgtaataaatcgaatcaataatgagtatagtatatgacatgacctgattgcaccttaaatttagtaccaaatcctcgttcctttgcgtagacttggaacatcaatcaatccaacaaagataacacatttatgatattttaaattataaaagttgagtaattgacggtgttaattatgtttaaattatcctgtacttttttttgggttttaatcagtcgtaatattttgtttaaaataacatattaatattatgtttcatttcatgatacttaagtttatttataatatatgattaattatttatagaatttgaatacttagttagatttttttgtttagtttgcagatagattttagattttctttattaaaaatcttaaaattaaaatatgtgatcataaaaaagatttaacttttgaattcggagagattgcataatgtatagacaattcttgtcattgttgactacttatatctttaacaagtaaataaatcttattttattagtattctaaatttatattaaatgtgttgttgttggtatgctatttattttacaaattactcacttactccttcccaatcagtcgttttgatggccactatttttagtccctctttgtgggaaagtgatatttgctcgtttttaaagtgcaaagaattttagaaaaacataattacatattttatttctaactaccttcaattagacattttctgttttatatatagaatggtatcggagttaaaagtggtaatcattaaccaggtaatattctcacaatctaactgatattcaagattggacaaacaaattactgtaaattaattttaaaacgtttattatgttggagtgattatgtcaactagtacacgtactccatgaaacataacaagattaattatacgctgaaattattttcaataatacattgctataatcgcagacaaattaactttcaaacacagatgaaattcctaatttcatagtgtggccattcaaccggaatgatctgtaatatgatagcattttacatttgcactcttatttttctaatctttcaaaggagacttctgctacattgttttcaattcatctaccgtcatcccgaagttag

SEQ ID NO: 3103 - DNA, 1560 bp, Glycine max
  Soy_ogl_3490 Gm10:40906041..40907600 Cluster 13
cagaaaatatgatttctagtatttatcaattttgagtatgacaaaatttatctcttgtcaaatgcccctttatatataatgatttgatatatgaccgcgcgtgttttaagaaattgtttaagtagtgaaagtaaacatagatctatattaaattgaaataaaaataaaactatcaaatatgttcactttagcagcaattataaaaaaatgttcactttagtagcatattcacaattctaaaaaaatagtaatatacacacaatatgagaggattgtaaatacaattaagcttaaatatcaacttagtagttgtaagtttgtattttttttaattttatttcttgtaagattttaattcaattttataaatattaaataaaatggtaaaataatcccaatatatttaacaaaagagatatgaataaatgtagagaacaattaatgaataataccaataacaatcaaattagttaaaatttccgcgaaggaactttaatattaattatgaatattaattcaaatcatgtaaaatccagcatatgattcttatgcgctactttaaataattattttaacaatttaaattagatatcatcttttgaaatcaattacattttttcctttaaaaaaattaattgtatttttcagacctcagaaataataattaatatgctaaattattatttactgtcttaagctactttttattaaagaccgatattcttaatgctattttcaactaatttgcatatcattttattttaaattaattatattttataatctgatataatgaatattatgccaattataagaattgaattttaaacattaataataagttatgtaaatatcattaaagcttatttaaattgccgattaggtctccatattcaactcatctaattttttttgtgccaaaaacagttaatttaaattatttattctccactaattaatatataatatacttttaatttattttacatggttttcataataatagtaattaatatattggattacccttttttacgttataaaatattaatcttgatttgaattatttactcttccattaatatatttacatgaaatataaaaagaaacagaaatggtattttacatgattcttataatcatgtaagtttcatatagtgtaccttaacatgtatctaataaatagtttgtattatctcttgtttttttataagaaataaaagtgttatcacttcttttttataacaagaatcagaaatgatattaaattaaaaagtctatctctgattcttcttataaaaaacaagtgatagcaattttatttcttataaaaagatcaaaagataatacaaactatttacatgtcaaggcacactatatgatatacatatacatcagaatgaagaataaaaacaaacaatgtaataagatatattaaaaacaatcccttaggaaagcctaaagaatatatagatatatatcctgccacagttttcttttggcaaaatccatttcaaacagaagccaaaacgaagaacaatgcaagaaaagcaaatccaa

SEQ ID NO: 3104 - DNA, 1467 bp, Glycine max
  Soy_ogl_6229 Gm18:57369234..57370700 Cluster 13
aattgaattaagtttaagcattttagagtttataataacttatgcatattatttaattaattgagttaaactttttggtaaagtctatttattgttattttttattggttattttttaaatgtttatcaaatatttaagaagaattattagtttatttttgtccgcttcttattttatttttaattaaaagttatgccaatgtcttgcatataagaaattacccacttaagaaatctcacttttaaaaaagttcatttccatgttcataaggatttgtcttgtaaaattgaggaagatgcatttaaagaatgacacataaatataattatggagtaaaataaataacgattgaaattttaataattttataattatatatatgcatatataattaaaatctcaaacgttagtattttttttatcagtaaacattagtattttaactaatactggtattttatatatttcctctttatcaaaatcgcaatcgttaatatttgaattaatactaatattttgtgaataatactaatattattttagtttttaattagcataggttaaatattgtttatataattctaattatcacttataataaataagtatttcaaattgatacatatactatgattaagattcataatgaataaaattttaaatatataaattatattttggatttataatgaaaaattaaattttgaaatatattattttaaaattgaaatggataattttcttagaaaattaagtatataaataaagataaatggaaaacaatttgagattattgaaatatttttaaaaaaataggtttggagtgtgaaatgtataggaatgcatttatcttggtaataattgttgaaacatgtagtggtccatttaaaacaaacaaaacaaattttattttcgttgcaaaaacaagacgtataattatatttatttcattttctaaggataattgtaagtttcaagttttttgtgttttaaattaaattttataataaaacttgtatggataaatgagggttaaaatgatttttaaaactatttaatggttaaaattaaaaaaattgacaaatatttaaaaattatacatacaagaccaagatataatattttaacaaatattacaattaagtccttgtataaaatacattgtaaaattatttaaaaattatacatacaaagaccaacatataatattttgacaaatattacaatttagtcctggtataaaatacatgtttttggtctatttaaaaataaaaactttcaaatattctatttcagggtgagaaatcctaacaaagaagataaactaaggatgtacaaatcttaaaaaataattactggttgaagatcgaagaagaaataattaagatgatattgaaaggttcatgatgatggttatttgtaaattttgtatgtaaccctcctactataatgaaaaatataatttt

SEQ ID NO: 3105 - DNA, 1300 bp, Glycine max
  Soy_ogl_6316 Gm19:1202301..1203600 Cluster 13
aaacaattataatctagttgtatacttgaatttgttttcctcatgttctaactataaacacattaaaatgatttgatcgagcacgttttgtataatagtgctaaatataatttgatattttaaatattaatgaaacactttaaattttatgaaagtaaacgctttttgttctcaagttcttgcttagaatgatatcgcactattaatttgataatttgactcatgtataattatagtaacaatccaagatttggatggtggtggtttttcttggtgggagaggaaaaaagaatgatcaatttttttttatctttttattttgaggatgaatgatcaaattttattgaatcacactgtacatactatatattgatgattttatattaaaaaaatgattgcaattgcgcatgtgtacaaatatgtcaaacattatttgatatttgtatttaaaaaattattaagaaaagttatatttgtttttaatctctttgttttgaaagttaataatctttaactgttgaccaaaaaatatttttaatgaatacacacatacaaaaaaagcctatttagttctaattattttgccatcctgattcattttcactatgggtgtttgaaatttgtattgtgccattatctaacgtatatgccattgtctaaagtaaatatttattcaaaatgaatatgtagggtgtatttaacattatattaattaaaaatacgtcatatttttaactcatttaaaatgacatatagcattactcatcttctttaaatataactagcaatatattattgataagttaagctgttagcataggtttataatgttgatatttgaaaatattttttattacataaaaaatatattaacaaggacaaatttaatgattatataatattcacttttttttattagaatttaataaatatgtaattccaataaaaatatacttatatttttttatccataaatattagttattaattattattttttttagctgattgagaaaattgaacccaggacatttttttcatccttcttcttttaccaccaaattaattgtaattctcaaaatatgtttacattattaatcaattaaaaataatttgtatataatatttaaagtgattattataaaaaaaaactttcaaataatacaaccatttgtcattagataattaataaacttatcatattaatcaaccattttgttagtgtaaaagcttatcatatttatatattatttctattaatatatacattattgtagtgtgtagctaaataacgaattct

SEQ ID NO: 3106 - DNA, 1202 bp, Glycine max
  Soy_ogl_1182 Gm04:2272286..2273487 Cluster 13
ttatgttttaaaataattaaatggtatttttatgattttaaatttaaatttttagatttactatacatatttctataatatttattaactcgttgtttgaaacatgtttaagttaattatgcatattataaaaattatttaaattattatttgtgtgtttatataaattttgtttaatttttaatatacgtattatttgaatttgaaaaaccattaatatacaatttaaatgaatctttaacgcaattttaatttttaacaacttgagatagcaacagatgtaattattggggtggttgaattcttatgctcttcgtgtaggttctatgaatatttttttaaaaaatatacttaatgataaaaaatgtatatcttttatatataaaaatattttttattttaaattattttttaaaattttacattcgagtactaaatttcttaaatactttaaatttaaaataatacaattaactttaatagaataacatttttaaacttttagattttaatgtgtttcttataaattatttttttatagtttcaaatgtttactcgtttaggttgttaatttaaaacatgagtggataaatttattattttgtgaatgaatttataaaatattttttcattaacattatattagtattattggacaaataattgcttgatgtgtcatgtactcatgtgtcgtattattctagtataaggctttcacttaacaccttgtccttgcaaggcgtcaagtatagtacaatgaagaatttcacgagaatggcacattagatagtgctaagtgaaggagcgaggtcattccaccatttgcaaagagtgaagtgaaaatgatggagatttaatttatgtcaacacttactacttactccaattaaataattttttttttccaatatggtattgatattcctttaaaaaatatttgttttgtcaaaatacctccttctcctcctttgtttctactttgattccagacaatattaaataaaccataagatattagttagtaatagttattatattaaatttttaattaaataaatataaaaatgagaccaaacaaattgaatccgcttagaatgagaacaaatctgcctaattatcatccgagcctcgtcattggcagaatcattcggaagaaataaaataaaccaaagtactagtaattcttaagatactagttaaag

SEQ ID NO: 3107 - DNA, 1313 bp, Glycine max
  Soy_ogl_1395 Gm04:44352027..44353339 Cluster 13
gaatatcataggttaaattgttttttattttttatgatagataccatgaggagacaattcttatcaacactattatgtgaaataaagtctttctttctgtgagtatttaatactgctttatatcaaagtctaaatgatatttattttttactttgatatactttaaaaaaaattacttacaaatcgagtaaaataatttatttaattctaattagttagtatatttattacaaaataatattttgaccctaaattttttttaattaatatttatataaaatttttatataaataatataataaatttattaaaattaatttcataaacttatttttattataaaataattttaaattacgttatcaatcatatcataaattaaatgtatggtatgttcacgaacctttttgctttggcactggtttctcttcatcgcttgtaagttagtttacacttttggtctgagattttctttgttgtcagaatttttcatgtaaatttagttttctccttttttttttctttcaaaatttggtctattgttaagaattgcaagtagaacaagattaaagaagaaacaagaatgtcgaagaccatcttcagtgtgtaagttttcaacatataagtgacttcaagatcttaaataaaaatgttttttattcttttaatgaattatactgtataagtgataaagtaaaatgaaagtatcataataaaaaagattatggtttaataactatacaatcaattgattaaacttttgattgagtaacaaagaacaattaataattgatttttattttaattaaagttaatgagaataaatgaaaataattggctaacagaaaattcaataagcaaaggaagctaggcattagagtcctttcatttttctcctaatataattaataatcaatttctctaatctattttaccgtcagttccttggttagtaaatcctttattagcaattatagatcttaattgttttggcgaacacaattttttttagaggatttagaaataagcaaaagattaagagattataggtttatggtttatgatttagacggaatgcgcacatagtcaaaccttaatcattacgctcaagaattatttgattattagactagaacaatttatagaaaagtttagaaagagaagttataattacaaaagatttaaatcaagatttatcctaatctaaccgaacctaactgtaaagaaattgaaaattcatagagatagaacggaaaaagcaaagaaaataaagaagagaatgccatgaatcttcgagaatcattcctaaatt

SEQ ID NO: 3108 - DNA, 1266 bp, Glycine max
  Soy_ogl_3247 Gm09:40714435..40715700 Cluster 13
ttgagtttgaggtccacaaaaaatttatttggcctccatctttgacattttaaaagtaattaaaaaataattagtcaaaaatagttttgaatttcgattcaaaaatgaaaaaaaaaaaagcataaaaagatatgaagttagttgagttaaatttaaaattttcaataaaaaattaaacaatgaatcatcatttaaaatttaaagaaatggtattcactatgatagtatggtttgaccgtgaattttttttccttctatggttttctcaagctttggtttagactttagaaaacacaactattttttactggatgcattactgtatggctgtatggttttctcaagttacagtagaactacattttagttttccgaacacagtatccaataaagaagcacgtattaaatctgaaaaaaaaaacttaaatgattttaaaaattctacaagaaaataaattattcaattactaaacaaatttagaaaattcaacatagaggaaatggtgaagaataaatatattattaacaatttcatcttatgaaataaaaatacttcgcttttgttataactttgtaacaattttctaatactaaactttaacttgctatatttttttattaacttatattcttttaacaacaagatagaaaacttcacatattttttaaaacataaaaataatacttgtgtgatttattgaatcctatgttttttttacggaatattgaatcctatttaaatttcacgaaactggagtagtgcgtcattaagaatgatattcttttataggctcatactattatagttgtaatgtttcactcatatgttattcaatctaaatggtaataagtgatgacatcaaataaaaactgcacctaacatatttttataaaaaaattaaaagtatttttaagaattaaaaataaatattatcttattgataagaaaaagaatcatgtttaaccttataaattttgtcatcagccacatttaaccaaaatatttttactatcaaaacaactttttttacatcatcaaaataaccttttatttttataaactcgaatgtcttttaagaattgacatcctccatattttttcataacatcaattaacaataaaattcatcatcatatccatcaaaaataaaattatctactaatcatatcacatcaaattaatatcatcaaaacaacccttgtagtttataataaggaataccttacccttatggatctaaaggtaacctaaaatcacttattgta

SEQ ID NO: 3109 - DNA, 1186 bp, Glycine max
  Soy_ogl_5469 Gm17:3160615..3161800 Cluster 13
aaaatggattttaaccaaaataattaagctctttgtaataacatttcatttttatactactggtaagtaacaacgtaacatcaattaggtggtcaattgaattgaaataactatttttgaaataaatgtccgcttatgaattaatcttataacatctctcaatttagattaaaatgactatttatttttataaatattattatcaactttcaaacaaattttacaaaagattgatgcaaggatttaagattttaatatgtttatataaattaaaatgatatatttaatacgaaaaatcgtattcgatccacataattataatcatacctaataaaatcatgtataagtaaatattataactaatatgagtataatttgatataactagttattatttaaaaaagtatagatatataactagtttatttataattagttatatgtaacaagttatatctaaaatatggagatgtatataatatttaaatattatattctaattctaaaatataaatagttattctaattaataattttcttttaatagattattctagtagtaatatatgtaaactttaaaagaaaaaaaaatcaagggagatcaaggctcccaacacataacctacatttgtttttgggattgagagatacacgtaatctctcttccaagattaaaaaaaaaaaaaattctacaaatcacataaaataatctgataacacttctcaatttcaaagaataaaatgtctatttattctcacaaatactagtcaagtttcaactaacttttacaaacatggtcgcatgtgatgacttttcatttgcaattttccctcggttcatttaaaaatatcctttaattttatcatgattgtatttttttttaaatcattattatttcttttaaaataataattaccagacatgctattaaaaatagagagaaattttttttgaacatgaaccttttttatttgatatattagccgtattaattaagaaaataatattgtgtaaatgttattaaaaaattactacataattttttcttagtatttcttaatttatactcttcatgtataaaatggaaataaaaaatacttgtaatatttttaaacgagagaaagtgaaattttcaattctataaatattcatcataacattttaagattaaatcgaacttataga

SEQ ID NO: 3110 - DNA, 1006 bp, Glycine max
  Soy_ogl_6759 Gm20:34829215..34830220 Cluster 13
atgataaaatttagatttaagaaaacatacatataattttaaaataaaaatatttaaagaaaaatgtttatgaaatccaaatatataaaaaaaataacataataaatttgacgcacttttaaatattttaagaaaatgtaacatttaatactcaaagataaatcattttgtcaaatatccatttaatttgaattcattttggcagggtcatttctttatttccttcaaactccctcaggctgcgtactgttgtcttaatttatataaatcttgatggagtggtactttagatatatatgttaatattcttgcgagtcatattaaaaaaattcaattctattctagctgaaaaaaatcttcctaattattaaaactaggagagcgagagaggaaaaaaaaaaaaagaaacattccgtgacttgaataaagagaaaatgtaaaacttcagttttttcagaggcatcagctaaatgtataaaaaaaataatataaacttacatatatttttaatttatataaatatgattttatcaggccttttgtcttgcaaagaaaatattaattttaatccttaaaaaatattaaaatatttttaaaatagtattttttttagtaataacataatatgtaattaaatatgtcatgtcacaatattaaagtattgatagatatcattttaaaaaaaattaaaacttacaagaattaaaataaaaaactaaaacttagatcaaatttaagaggaataaaacacacaaatatgtaaaggaaatcacaaagttggagaccatgacacgctcatgtcatgtcccctcatccctatcttacactgattacactcgcaaagagagtcataatgcaaaaatatttattttattgtggttcctgtattatgattaaatatctaataataaaatttgactacccagtcattaaaataaataaataaaaacttaattttaacttaatatttagaaattaagttgtcttcttcttctctttactttag

SEQ ID NO: 3111 - DNA, 1317 bp, Glycine max
  Soy_ogl_1118 Gm03:47010140..47011456 Cluster 13
ctaatccttatacttacaccattaatcagattttaaatctataacaactattagtgttgttttttacgtttaacatctattagttttggatgaaagaaaagactagaagatctaaagtagtatttcatacaaatgatgactttaaattagagataaaataaataaatatgaattgtacgtattttttatctagttagaaagacaaaagataaaagagttaatttttataaaaaaaaaaagtttaattattacttctgtcattttactaatgttatttggtgaattagttttctcatttctttataaatggattaatatttatatatttaaattattttataatatccttctattacaaatcacgacgatttaaataactttaatataattattttataccttaaacaaacttatcatcttaacatattataattagataattatatataactttttatattatcagtgtcaatacatgacctttttgttttgtttatttatttattaatttgatattcaatatttaaaaaaacaaaaacttaacactctagtgcatcgcagatcgttcatatatatgccattttcaattttatgattgaactttcattcttattttttcaatttgtgatgtgaacacattcatgctgatgtaacattctaaaatattaaaatattaatatttttgttatatattaaatgtcaaatgatcgaacatattaaaattgcataactaaaataataaaaatatttttaaaaaaaaaacagagaaactaaatttgcaagatgataataagagaattaaacgtacaattaagttcaacaaaaatcctttatttctctttttctgtaatctataattgtttcaaaaaaatgttaatttgatatttgatatttaaaaataaaataaaaaatgtaacactctaatgtattgcgaatcattcatatgtatgccattttcaattttatggttcaactttcattcttatttttcaatttacatgtcaacacatttatattgatgtaacactccactatattgacatattaatatttttgttatatactaaatgtcaaattatcaaacagattaaaattacataattaaaacaataaaaattaatttcacaagaaaatagactaaatttgtaaaatatcataataagagaattaaacgtacaatcaagcccaacaacaatcctttatttctctttttctataatctatagttttttttataaaaaaaaaactctcttcttactttcatatttccagctttatgaatcactaatatagggtgttacatatagttgtaaattc

SEQ ID NO: 3112 - DNA, 1203 bp, Glycine max
  Soy_ogl_4122 Gm12:37388401..37389603 Cluster 13
tccattgaaattaaatgaaatgagaaatagaaaatatcaacaattagttatttcaaaagaaaaaaataacaatgaaattgaaaataacaatgtacacaaaggtatttataattgaaattcaaattatacaagatcttttaaagttttgaagatgatcgatcttaggagtacaaaatgtcaacatatcataaagttgacaaggatgatgaagcataagaatgggacggagagaaagagtattgtgtggttttcatttaaaatatgaatttatataaatgaagaaagagcacagaagaaggcataacaccaaattttacataataatatgtaataatcaaattattatcattattgataaactcattatgatttgaatcctcgtatttgtgcgcgtgatacaaaataatttatgtaaataattattttgttatttattatgatagaaaaaaatcattttaaggtttaaaatatattaatctattaatatacaaattgataaattattgaattgatccatcaattatatatttgaagtatttatgataagatagttatttgcagaaatagagtaaaaattaaataatgtcctaatagaatagactcaatatataataaaatagaatttgtttatataatggaataatatttattcgaatgaataattaaattaaataatatcatttaattatatatagtcggtaattaaaatctttgactttccaataaaatcataaagtattttcagaaaactttgatcaataataaaattaatcattaatgtgtattgttatttgacttacacttattaagttaatagtttcatagtttagttctagttataataataataatatttttacgtacacatttttttcattttatacctaaaaccacttttttaatttatttttttattcttacgaatactctattcaatcaacccacaccatctctcatccgaaaaaatactcaatattatttttattttattaattttatttttcaaaaattttaaaagacacttattttatttaatgttatctttcttctcgatatttttactattgactattataaatcactatcgcattttatattaattttcaactgttacatctttcatagtaaattatactcactcaagtacatttacaagtaacttcttgtatacggtagttggttgtaacttatttttccacttgc

SEQ ID NO: 3113 - DNA, 1209 bp, Glycine max
  Soy_ogl_1538 Gm05:1994300..1995508 Cluster 13
gtaaagcattaaattttacacagaataaaaaatatcacaatttttcattgtcaaattttaatctcccatttttataaatttttttacatcatactaagtttttagtaaatttcatattttaaaattattttatataaaagtacatcattaatttctgaatatttaaatataaattaagaaatttaagtaaaatagtaatgacagaatacatttgcttaattttttagaaagacttaattaatttgaaaaatattcaaaaaaaaatgaaaagtgtacacgattctaaataaaaggactgaatattcaattaaaattataaaaaaataaaaatgaaaattaatcagtttaagattatattatgttttgaatcttaaaaaatatttctatataatgttttttcatctttattctaccttatttggggatcattttctaacattttttaaaaaccattgcttcacttttcttgtagacttttttcccccaccaaaattggtacttttgcaaaactatttagcagtatgggtattttagaaaattatttacctattgggatgattcttgtgatctataagatttaggaggtgttattgtgaatgatatcctatgtcacaattttcacttaatataacattgacttaaatgtattaacaaaacacaatatatcattcaggaaaacatctcttacatttcatgtgacaaaacaataaatagtcttataaaacatccacttaattaattttgtgaaataattcattttcttagaaaaaggttttcttttcttccccctaactaacatcactcactctatccctctccacctcttttttctttttctttttttcatctgcacccggtttttcttattttctgcagtcgaattctgtctcaatacattgggccttacctttgggaaagttgatattcaacacatggaatattctttagttgaggatgcccactgtatatggacctatatgcaaaccgaaacaggcaaaaatatttgtagattgtgtgattttttttttttatcaacaccgcacttttattcgtgaaattatttgtagatactgtgattttttatcaaccccgcactaagcacacaatgacatgtcattaatttatattaacaactcaaataacttgcagtactatactgtcattttacatttgctaaccagaaaaaaagttattttacattcataatag

SEQ ID NO: 3114 - DNA, 1200 bp, Glycine max
  Soy_ogl_4135 Gm12:37824001..37825200 Cluster 13
tctctagtcaaaagtatacattttatggattcatgcaccatgtgacattgttataggaccaacttaacttaactcatgccttataaatatctagaatattgctaattaacttcggtctctgtgttatttctttagaatatacattgattttacgtgcttgtgatttcggttctcaagaaattcacacaatgaaagattatgaatttgaaactttctacacaaaaaaatattcttttaaacgagaatattcatgtgtggatggcagctaaggataagcctcatgaaaatcattcctcttaattgctttcgattccaaagctttaatttggattacttttttcgataacagttggttatatttctttttatgttatttgttatggacgagtgttctcgggttgtcactttggctctaacataatgaggttgtttatgttgcttcttataatttaattattttttatataaaagttgcttatacaagtaactaccaccaaggtgacttaaaaataaaaaaaaaattctttaagtgaaataaagtttttttgtgaacaattaaataaaagtaagcttattaaaaatagattttattgcacttttagtatatctggtatcataattgtattattttagtccttcaaattttaattacatcaattgaatattcatttaatagacaatattattctttttatgatgatgtacttaaagaaccaattggaaaattacacaattattttatttgaagggtccaatttatataatcggaatatgatagattaattgcacattcctgacaataatacttagaatattcaattgaaacaattaaaatttatcgtactaaaactatataattgtaatacacaaaaataaaaaataaaataattattaaaaatattttaaaattttcaattgagttgtagaccgttgaagtgaaaatcattgaatattcttaaaccctatatagtgacaacgggcctaccaaaacagagttaaaaatgatagagttctttttattagagatgctgttagcaaaagtctttaaggccttaagggtcaagtgacaagtcctgacagatatgagaatgggcatattttttttttaagaattattaatataatatttgatttatacaaatatatttaaaaatacaatctaatatactttaaacgggatcggacatccgttcacaacga

SEQ ID NO: 3115 - DNA, 1090 bp, Glycine max
  Soy_ogl_5888 Gm18:2214101..2215190 Cluster 13
tgcatccgtgggttccaaaagtgtgcataaaatcattgtcatcgtcggctacatttgaattctgaagccaagttatagatggagaatgtagcagtcaaataacatgtcacccatgccaacactttggactttggagataataccatccaatatcaccaaatcacacagggcctgggaccctgtatatcttttgatgttgcagaagaaatttattgaatatcaaatataaaacttgaaatttattttccaaattaattagagattttaaaataatgtaattgcagaaatataagacgcgtcttaaagtattacgtttgtcacaaaatactttttctttttcaaatacatgatgaatactttatagaatattattatttcttcctattactataactttaccaaaaaagaaagttaaaaattttaaaaatattagttacatttttttttgggtacagaaatcctagttatatttaaccatgtcttgtgaaaaatttaaccatttgattaattaaatatttagtttttaaatttaattatacaaacttaatagctaattttatatatcaaaataagaataataagttgtaattatttattttttaaaatttgtattcttttggcacataaaatttaaaactaaaatctctgattaaattagagcaatctcacaccatttgttccagacactcaatagttgaaattatatcattgaaagattaatgtaatcacaaaagaaaaatagactaatatatttatgggagttaactttaataaaagaaactaacctctcatcaaaccaaataataaataacagtttgaatttccactaactaagattgatgtttacatttattgttgaatgatacattgattattatataaaataaaatactatagattggttataaaaaaacactatagaaaacccgaaaaagatcttaatatttatgatatgggccgatatctgataacacaaacctaagactagataccaaacctcgactgcaagcgcacgcctctatccctctatcttttcttttctaattttcttcaactttttcttgttgcttttatttggcttttgatattt

SEQ ID NO: 3116 - DNA, 1437 bp, Glycine max
  Soy_ogl_5952 Gm18:5857501..5858937 Cluster 13
atactaaaatcgtgaaattatgaaacatgctatactcaattttacaattaaaaatcaggacatgaaaatgacaaattttacaaattaatgaccaaaattataatttaatttaagataaaatatttttttgctttttaattttttttaattcaatttgtcttttttgcctgtttttttttctctcataattttgaaatatatcactttcgatctcctcaaaatatcgtttgaaccaccttttgtctttctataaagtagtatctaaatcattttaaagtataaaaattgcacatttcaaaattaggagaatgaacaaaaagaatttaaacggactaaaaccaaattttaaaaattttagaggaaaaaacatattttatcatctagaatagaatccaatgtttaaccgaataggcataaaaggaataaaacataagaaaaaaaaaattgaagacagtacagtcaacttataaaaatagagaagacaaaaaaataacaacactacttatatcgatcgttgtgattttcacaaagtcgtgggtgaatgcattcctcaattatatctaggtctctaaataccttgctttttggaagaaaaaaaagaagtcaaattgtaatgttaaaattaaatataagtaaatttcgctggactaacctaacaacatatttcaaaataaaatcaatcaatttttgttaggatataatttgttttgaaaaaaataaaatcaataatagtaacttgatatataatttttttaaaaatcaaatctgtagggacatgtaattaaagtgaataacaactaatatacaaaatgtatggatgcatatttatatcagaattataaagaaataaatattataggtgtaattatattctctatattggagattgattcacatgatcaggcatctgttgaggaattttactcacattcgtttggagcagtgtatagagaagggaatatgtgtgcagacaagctagctggccatgctcgttttgtttttgcttagttgtttcttggacctctagtcctattatttatcaaaaataaataaaatcacataataaatatttatatcaaaagagggaactcaagaagagatatgaggtttttttaatccgtatcaaagaatttacaataattactaaccatatttttcaatcaatcaattaaactagatcttttttataaaatagagtatgttgaaaaagttaaatcaaacagatagtaaaatctttagagaagaaaaataatatttaaaaaggtgtttttggaataaaaaaattgaaatacgtgggagctaaaaataacaattgaggaggtgagaataataatccccttgagcagctaatgtgtgagttattggatttggacttctaagttgtaggctcattaaattattaataaacttaaggcttaatcatcaatttaattttta

SEQ ID NO: 3117 - DNA, 1200 bp, Glycine max
  Soy_ogl_6537 Gm19:43799101..43800300 Cluster 13
attcttagcttttgattcagtagtcattgggagatttcggaacgttaaaccaaacacacacgatatcatggtgaaggcagataaaccaaaagcatcaaaatgcacacccctgtccaattgaaaggcaacataaaaaagaaaccatcgtgattatacattccatcagtttcaggaacagatcaatagaatcggaatatttacaagaatgaagagtttgcagtactagtagcaaaatcaacagtctacactagtagtgactcaaacacgaattagcagcacaagctgctgtaactataagtaggaacaaaacaacaaaaacaatcacaagcagatgagaattcaagcgttgattatgtaaagaaagcaaaaacggtgaatgagaaaaggaaactatatgttattttttaaattaaatatttttaaataattattccaaaataaaaaccaaaaaatactcgttattctaaattctttaaatattttaaaacagggaaatataaaagaaattttgatcattaaataatattatcaacaaaggagaatacttattttaaaataagaggatcgcggaattaataatgtaatactcataagtcatattttctaaaagagaggagtgtaaaagatattttgaagataaattttttttctaatgggagttaatgaaactttgactgatttttctttaaaaaaaatattttagtataattttacttgtcgggaggaaaaaaatatatatttatataatatgaaaaacagtgtaatacgtacatctattaaaaagagtgtgattgatccaattctaaatgttttaaatttttataattattttaattcaattgaatattctcttttactgtcctttactatccttctattaaaaaaaataagttgtgtgtgtgttaattttttttaaaatatatatcatttaaatttaaatgaaaattataaaaatatatttatgcaaaattgaaaatactacacagcaaaatggccagtatcaatcaaatcatcaacaaacctctcttgctttcattttaattttgttgtcataataacataacttgggctcagctctgatgcaatgcatcttgtgtttgagtaggcccaatttggaagtcctgaactggatgttatattgcttcctgcatctcatttgcttccagcacttcttttttattttccggaatgaccattatt

SEQ ID NO: 3118 - DNA, 1641 bp, Glycine max
  Soy_ogl_2171 Gm07:3933813..3935453 Cluster 13
acaaattataatgcattagatgcaatctttattaatatataatttttagatgcatggtatattaggatccaactaaagaaaaagacatatccttttatatcagtaggaagagcaacactttgtttctatagtctttattaaaaatcaatatattataatttgctaattataaataaagagtttaatgaccatttattgttaacgtaaaaaactttacactgccaaccaaataaaaattactacttgtatagctttttagatcattattgtaaattaaaatcagcaaacttacacatgaaaattcataattagataataatacaaattattttatattctcagtaatatattttcttttaaataattgcaccaaaatagttcgatctatatcaatgcaaagcaatacagtgaatagtcaagataaattagaataagattgcagcaacgtacagttgttacctccttgttcacaaactcacctgaccctaaattaagtttacaaactataccactatatattaattaattaaactctcgccaccaattaatatagtgtgacatttaactcatctctttattacataatatgttttggataatacatatatttctttataatttatcataacatttcaccacgatgtaaaacacaattattattatgatttcaagatcttgagaattacgattatcaacatctcgttagtgtgtatatttagttaactttcaactgttttcttttctttttggttcatgtacatctcaaattatacaattccaaaattattatttctttattagttagttaatatttattgctctgtcacccataaatataagctaaccggggctgaaatctggaattgtttttccagaatctgtgtaccatttaatatattacaccttttgctgattttaaaaaaatgtacaaatcaaactaccttagcacttggtaagaccatagtaaggctgtgctcaagatcttgcaagtggatgaagtcttatcttgacattaaatattcgttaattaagatcaaattctatcttgaaaactttgtaataactatggtaaaaaattactaaacttattaattactcctaatttcgctatggttatctcactttcaagtttcaattttgacacattattgttgatggaaagaagatgagagacatggacacgagatcttgctaagtcaagacactttaatttcattattaattttatgttgaatagatatttcttatttttattatatgccaatctacttggttctatccaagattaatttattgtttccaaacatcagaaccatgcagcacctttgcactttgttttatatccattcaatgtaatttaaaggaaattatggagtccttaagtaacttaattagattataatataatcctatgttggcttgtattgattctaactaatgcagtaattactacttcctcaaagataattttagtctctagttatttgaaacaatatcatatttattattctaatttgaaataattagagatcaatttataattaacagtgaattttaccttatatagtatataaaaaataagaataaatcctatatatattctttctttaaattcttgtcttggtatgtttctctaaatac

SEQ ID NO: 3119 - DNA, 1500 bp, Glycine max
  Soy_ogl_4816 Gm14:48304401..48305900 Cluster 13
ccatgatatcaatttattttaataaataagaattaaattcaagtataataaatttataagtattcacccatattactctactaaactaactaatatctaataaaaattaataactaatattaatctctctaaaaagagtgaaatatgtttaattttttaaaataaagttttatatttgtatgtataaaaaaatattggaaaaaacaatcctactatattataaaataatttttctaggtcgaataaaattactttcttgaaaaatatttattgtgtaatttgattggtcaaatttgtttacttaaaagctagtttttaattaaagttaaaaatattttttaaaaaaataaagtaaaaattatttgttagtggttttagcttaaaaaatatttgataaaaaaatttataactttttaaatgatcacgtgatattaaattttgacaatctatattaaattatatcgtacaaatttaattttacattcttatataaaatagatcttctcatatgatatgttctatctatctatatatctaaagagaaaagacattttgctgccaacttaaaaaaacatgaaggacaaaatctgatacacagaagaaaactaggagctttgcatggaggatttgaagtggggggttttgctaaaaccctaaatgtctatctatttatttgtttagttaaattaagttcatttaaataaataagctacttgagagttttttttttctcacaactcaaacataaacttaagtgttcaatttgactaatttttttggttttttatttttgtcagaaaggacgaataagtatcaaagaaaagtaaggaaacgaaaaaaaaaggcaaaatttgttttttagttgggaggcttgcagtgtgcatttaagaagtataattaaaagagatttttgtttgatttttaatcgtgtctaattataaactgaattttgccttaattttgtcttgaaattcagtttaaaatgtaaataaaggtgaatttgtttttacgaactcaatttactaaatgaaattaatcaaaacataagtttgcaaagtttaatctaatcaattttttttactgcaagtttaatctaatcaataatcatgcattaagttgtcctagtttgtatttacactagcttttatttccatcatcgttattgtgggccgaaatgtatatgcgtgtattgaataaaaaatcgtagctagaactcatatttagcatatcttaactgggaggcaaaataagacttagcatatctagccaacaacaaattaagctcatcctacatggaccaaacccaaacacttatgggctgttgctacatgaatcccatatattttcccctacacctccataatttctaatatcccaacatcacccttcctattttataattttttgtctgactcttcattctcctactgtccacattctgctttttgtgttacatatttgttaatatgtaacttatgcattaacatttcagattacgta

SEQ ID NO: 3120 - DNA, 1423 bp, Glycine max
  Soy_ogl_4828 Gm14:48945501..48946923 Cluster 13
aaggttttttttttaattaaattcttaggtaacttaaagagattcttaataattagtagtttttaatcaaacttttattaaatcaaatgttctactaatcaaattaataatttaaaaattaatattggagtatcacgttagcgttttagtggttaacatttttatttagaaattgacgatggaatcaaaagtttgaaaaatagagggattaaatgtctattttttttttataagaaaccagaattatatttgaatgaaatagaaagaataaaattatatttaggcaataaagtatattaaactaagagtgtatttattttagggattaaaggtttatttcccataatgtaacatgagaatattacatacccatgcttgttataagttttatcatatgtttttcacacttttatttccacgagaagggatgaaaatgaaatattctcataggaataagggaaactatttcttaaaatatcattaatttttttatatgtatttttatttaaattatttttgaattttaaaagatattctcaagaatattgaacatataaccagatatttttttaaaattttttttttcaagaaatgatattctcatgttaaatttatgggaacgaaaaaagattccgtgaaaattttcatttttttaagataaaccttttctacttaatcaccttacagtggcttatttaaatattttgcttaatgactcgacgttttcattttttcgttgacatgtggtcattgaatcattcaagtgcaacgagttttatgtgtgtattttagttgccgagcataattgttaagccattttgcgtccaatacttcgtcttatatataattgcgtgataaagcacaatatgagtgtcagtaaaattagtttaattatatgttggttaaaaagttgaaagcttaaaaattagttaattataaacaaaatagcttataacttacttgagaattatttaaatgacttatcaaatatatgaaatagaatcttttaagaagatattaccttttaaatacgattggacattgctcgtgacaagcttagttttgacatacctagctaatgctttgatggacttaggaattgtacacaagaaattggagttgcgtggaaggtttttgaacattaataatttatgaatctcaatattttgtttattttctggaattgatttttattctcatgattttttccttttcactaaatctctcccatgctttcattctcatggagaatggaaaacgtagaagaaaaaaatgtttcatttttcaatttttttattaataagatatgatttcaataataactcgagtaacatgcacatatgacaaatgaaatatataatttattttgatacaatagaccttatgatcgattataataagtttttgagaaaaaatgttatac

SEQ ID NO: 3121 - DNA, 1200 bp, Glycine max
  Soy_ogl_5526 Gm17:5417101..5418300 Cluster 13
tttacaaagcaataccaacataattttcaataaaaatatttcttaaccacatatgcattctgattatcaatttaaacaaatacaaacataggcacagtcaatatatatgtgcttacgttcatgttatatgtgttgtgtctcatggctataagtggctcatgttttaatttttgttcatattaaaattgaagttgtatttatttaaaaaataattataaattatttgaggttattagttcacaattactaagtatatttattaattttttaaaacaagtattaaatatttccctttataatatcttatacttattttgaaattattgtctttagttaacattcaacaattaagagatcattagttgatttaaaaaataattatactttgactaaaactcccttttatttaatattcacttgtttcatttagctagtaaaaataacttgaatgtgattaaaaaaacagaccaaaccttgaatttctaaaatgacaatagttttgcagtagagaatatatatatatatatatttgaaacaaagagaataatatattttgttatgccttaaagatgtttattaataattgcttattcaactagtaggtatctcacatcatacaagcatttaaaatctaaagtaatatttaaaaactaaaattataaaaatatagttaaatttatgacttaaaaaaaaagggcatgttttatttgagagtaaaaggttaaatttgtgtgtgtgaaaaaaaatattattaatgataaataatttagagaaaaacgcaagttttagtttgatatgtttggaaatttgttaagggttgatttggtaggatggaagaaaatagaatgaaaaataattaaaaatatttaaaaaaattaattttttttctcattcattcagaccaaacacacaaatatacctataaggttaatataacagtgaagaaagaaagtgagagatttcacactctcactaattaaaaaaactgacaattaataactaatattttaaaaaaaacacacacacacaaagattgaaatcaacagtaacacctaccatcgtttgacttgttacagacttgcatatatataatttaagtatctcgttgggtgacaggaaaatcacgtttctttcgttgaaaaatctatttgaacagtgttttatgtgttaggtaggttggtatctagttaagtgtctgtt

SEQ ID NO: 3122 - DNA, 1200 bp, Glycine max
  Soy_ogl_4688 Gm14:5557501..5558700 Cluster 13
tttctcatatataatagattgtgactggatgattgtgtaaaaaaattataatatcaagcgtaattttttttctcatagataatctatgttaaaagatgactttttttttaaaggatgttaaaagatgacttgtaatgaataacatatggagtatattttatcttgtttttcctctgaaaatgtcagcatgttgtagaacttagaagctcgatcgaattcctcatcactccccattttatctgaagttctaattgttatcaagagatttttcaacttacccatatgaagtgtatttaccaccatcagccacttaaactattttcttacttaggaatgagtcgcgtaatgtgctcgagttcttgtgatgctgtcaatgtcatgccacaaaatgctggttgtttgggaggaggctaggtaaaggggcaatttcatatacagtaggtgatgatatagtataaatcaagtaaaagaaatggcccctgcaaatgtgaaggcatttaaatgctttgatgaaagagcttgtccggctgatgttgggccaatttgatcaaaaatagtacaacgtgcccgttacccacctggccaccttaatccattgcacgatgacacaatttatttttagtctttgtcgaaaggtagaatcataaaatttatgtcggctcaaccgttaatggctaaataattttatatgaataaaatcatcttatcatattttttttattaattttttatgtgttactgtaaatgtaaaaaaataaaattgatttaatattcttacactgaaagtgtaataattttatataatcactcaataacaaatcactaatgaaatgatttttaaattaaatataataaaattcatcaaacttatcttacataatttattgtgatagtaaaaaaattatttgacagtcagtacatagtttattttctctaattaattaatctcatgaatgaaaaaaaaaatcatgggaagaaaaaatataaagtttaagtttaaaagaaaatagagaaaataaaatttgagattttttttcttaaatctaacttcttttatttctttacttcattttctttttacttgaataaaaaatgtattgataattttgtttcttttttctttgtttctccttaaccaaacatagtataagaacttatatgatatttttaggaagttcttttcttgttttatcaattcca

SEQ ID NO: 3123 - DNA, 1488 bp, Glycine max
  Soy_ogl_2951 Gm09:2482701..2484188 Cluster 13
ttgttaatatgttatttctaaaatttagattgactcaaataactcacgttaacaaatatttttattctgttttaatcaattttggctctatagcttaattatagtgacacaaactttaaagcagaatatagagattcaaataattttttagggggtgtttagagagttagcatttattagctaagagataaagaagaatttggacaactttctgatcacctttactaaaatggcatgcaactatgcaagtaagacttagaaaaggaaaccgaacacaaatagtaacaacttaatccttttgtatttagttccacaatcacaatctcctttcaactcgatagataaactccttcctcaagacgaagtaaagaggaaaaaatgcttgatataataatatagctcgtccttaactaaacgtcccctttcttccgctacacttcataaataagaaaagaaggtttgacaaagactttgctaagattaatcttgaagtagctttgaacggaatatattattatatcttaggtgggaaatgagttgtctctttcaattgttttttcttattttatttttggtattgagtctctttctaattagaagggatcaaagtcagtggaaaaagtccaataaccctcacttggttagtgccggctaagaagtgcacaccaagatagatagataggcattgaaaattcaaacactacctaatttcataatttaacacactcttattaaatattatcttaattggtcattattcatgacgtataaaatggaaagttgcatgactttgccgtatctccaggatagaatagccaccttccacagagcccacaaaacattattggaaaaaacaaatcaaaacaaaacataactgttgacatgcttaatggttcacatgcatgcataattctttttcatattggcaagatcggttttgatagtagacatttggtttccttccaaggtggataaaggggaatcatgttctcgccttaaaaatcgtctgcaactaattgtactaaaattgttttattttgtgggatattgggtttttgtttgtttttttacttatgatataaatcaattaatgaaataattgatattttgatattatgttaaaaataatataccatttaaataaaattttatataaatactcataaaataagaaaataattaaaaaataaaataaagtgaatttaaacttatgggatatattcaatttattttatttacctattttttcttcttataagtgtttataaaaaaaaattatatcataaaaaatattcaaatataaaaatgggtgttcatgaaaggaataaaattagttaatttcttcaagttagttgtgttgttatactgcttgcgagaataatgggtttcttaccctttatttatttatttttcatttcttttatcttattcttttgtctccttctctcttgtaagaattatgaggagacgctttagtattaaaaaaac

SEQ ID NO: 3124 - DNA, 1376 bp, Glycine max
  Soy_ogl_1655 Gm05:32136402..32137777 Cluster 13
ttacctgcatgaaaattttgctgcaattttatattgccaaaaagtttttgtaatagttttaacaacaccatatttaatgatgttaacgatcgacaaggataaaaaccttagtaataataatttttctttgtagtttaccttcatgaaaattttgcagcaattttatattgccaaaaagtttttgtaatagttttaacaacaccatatttaatgatgttaacgatcgacaaggataaaaaccttaacttttatcatgtatatgaactgaaactgaaaaaataaagacatccaagtaaatagttatttagcaaaataatatttcagatattatcacttagaaagaaaattattgagcacatgaaatattgagattattccaatttaacttatgatttcaaattaaaatctcacacacacatatatatatatatataactcacataatcattccagatcagttttatttttttgtagtaagaaaatttaagtgggttaaattttagagactcttcacaattaaaataaatctcaaaaatcaatgaatacttatatattatttattaacaaaattctctccgcggcggtaaaaatcatacatacaacctctttggatacaaatttatttcataccaactacaccaatatttattaatagagcatgatcaattgtagccaaaactacaaatgcaaatgatctacttttactttttgagatataagtttattaaccttacttcaggacataattaattgtacccaaaactgcaaaggtagagatgatctgctttgaaaggaccaaaatgccatcgaatataattccttatttcaattcagctgtatctgtcaaatgaaatatctgaaaataatatatccgtcaagtttcataattattatttaaatgtaattcatggataccacaacaagttttacaatgaataaaattgatttacttaatgaagcttgggaaaatactgataaagaatatcacaaaattaaaataaataagaattaagttttaaaagttaaatgccaatgtttaaaatgatacctacaaataataattatacagttgactataataatcaattatatgataaaaaaattaataatgaattatgaaatcacaccgcctagctttaataaggaggaccgggtagcagccacctaattagaccccgcttgtcaccgcgttttacattgggaaacattttgtaaattaaattttaaaaaatatactttaaagtattttaaaatgttatcctttccgattatatttttacgatcacaaaacttaaatccaaaagtgaaaattttcagtttcgctcaaactaacttattcagctgttgtcatgtgtcaacaacaggataattttaca

SEQ ID NO: 3125 - DNA, 1300 bp, Glycine max
  Soy_ogl_6862 Gm20:39359601..39360900 Cluster 13
ttaagatagaaagtcaaattaacaatttatatgttgccacttaggacgcatgcgagagtcgtttgaaaaggatgcatatcattaagagattttaaaacaaatagatttgctttaagttgttgttatcatacatttagactatcaatttttctaagatgatgcaatttcgataccttagtatagactatagtagtttataaacaactaactagaaaaatattgataaacacgcgcacgactttgattctgacataaatggatataattttttcaaattggacaagattgaaggtagaagcatcaagcccaaaatcagatgcctttgcagttccactaaggtataatttatacggatatattgtggtccaacagtgatatgatcagcttctcaagacaccaaattgaggtatgtgtctaggtttatatcttttggcagaatctggtaatcacttgacaaaactagagaaaagacgcgtgtccctttcattaacattagctatatatatcatcattagtcactaagtaatctttttcaaggtcacaaaatcgtcgttttgtcaagtaatgggagaatttcaaagcttaataaaacagaatgtgaacacactttaggggcactaatactaatcacgactttgggatctataagtaagcaaggattatgtttaataaagtatgtcttgattatctgaaaacgacacatgttttaatatatttttttataatgataagatatatatgggttttaatattaaatcaattggtgcgttggctttattttaatatcatcaattttgacgtaacttgatttttttaaaatgataaaaacatgacaaatcataaatattaagtaacaacgacattatagcagctattttcgaatttcttttaccaaagtcgtgaacattaaacatgatttaacatgttctttaatttaattcaattttgggcttgacataaacttgtgattattatttttaaataatattgagttatattcatgatataagatttaacaaacaaagtaaagaaaaaaatagtataaaaacttagggctcgaataacaactttagaagttattctttttattcatgatcgacttcacttaaaaaaaaaaaatcatccattacaatttcaagttaataattttgaaaaaaaaaattacttaaatagatagtcttgaactatgatcacgatttaactttaatcaggttcaaaacaccaacagacaccctgaaacacaacattttaacacattattcaaatggaccaaaccacaacataacaaaacagatgatga

SEQ ID NO: 3126 - DNA, 1000 bp, Glycine max
  Soy_ogl_1175 Gm04:2111801..2112800 Cluster 13
aatatctacccgtgtcttattaaactaacttttaaaataaaaactttttttttccttagaaacttatttcgttctctgctttattttttcaaaatttgtttaacttatcttctctttttagagagaagaaaattcaaaataagttggaatttaaaatgacctaaataccttatatgtatacaacttaaactcgtcccgtgacccccaaaaaaataacaccccaaaattgacatatatcggatttacacactaaggtgaataatttttctatcctttttcaatatgtagtattccttaatagaaggacggagggaatttagtttgatagttgaaaagaatttgaattgttataaattttttaatattatctagatatttttgaattttaacaaagatttgaactttgatttaccgttaagtattagtcctttttactgtacccaaccctcatgattataataatcttaataatagtatggatatttgtagttacaattatacgattgttttcaaaaaagaaaggtatggatatattgatttaattggaattaaagagcaatgattatattcaattgaatattttaatttttaattgaataaagataaattgcagagaaatgaaaaatcatgatgataaaaataaataaatacaaaaatttaatgaataaaagaaaatgctcaacatatttaggttttgtttttaccaaacactattaatcatgtttaagaaagtgttaacaaaacaaagaaggatcaagtcattttagtagtaatgttgaaagagttactttaaaagaaaaacttttatttttatcatttatttctttttaatctaatgattatcatgagtaatttgtgtgtagccattagattaagaaaaaataaaagataaaatgaagaataatttttttaaaattgtttttgaagtaacttaattcctcttctactaaagtatcactgtcattgaaataaaaatttcattaatttatgtgagatttgt

SEQ ID NO: 3127 - DNA, 1358 bp, Glycine max
  Soy_ogl_1196 Gm04:3470743..3472100 Cluster 13
aaattcttcattataagatatttttggtagaagccaatagatcaataaagagggtaaccaaaaccaaccatggtgttgatttctttatgaatctattggtttagtatcatgcattataggaatggacaaattttttaaaaaattatcataatcgatatttttaaaaaaattacaaaaattgataaattattctttgatatacgattttaaagcatgatttcacttttcatttgtttaaaatatttttctctaaaaattagaatcgtatgttaaaatatgatttttaaaataattaaaaaaaatatgttgaaatcatatgatagaatacgattttaacttttaatgataaaaaatttaaaaaataaaatcatatatacatatataatttcagtgtaacaatatttcaaaaaataaaaatcattctttgaagcacgattttttaataatgaaattatattttataaagtatgatttactcattttcttaatttttttaaaatatatttattatggtaatttttttttaaaaaaaaataccccgtaaaggaaccgatactattactagtaaccttgcacagcaattcatttttagttgacagctaaaaagcacaaggaaaattcgtggaagaaacatcacaaaagggaagaacaacaaaatcacaattcgaaataatataaaaaatccaaatagagacctttctcttggtactgatagggatacctagtcagagcatctgaactttgacccttgcaatttcttctataccatctacgtttcacgcggtcgtctgttgtgttgatgttttctaatatttgttagattgactctttgatggtcaaatcaattagatctccctatctttgaaaattagaggccattaccaaactcccaacatataaaccctaacattaatgtttcattaaccctaacaaataaatcaacacaaattacttttttcagatatagctattttaaattgaaaaatgtacttcaaagaataaaaatgtgtgcaattattgattaaaagattaataattaaatattaatatttataaaattaaatatatgtataacaaacgctataattaattacaatttttattattaactttttaatcaatagttatttgtacactttattttcacaaacgcatttccctcattttatttctgtcgattattttatcttgtaccgttgttttctacccactgaacatacgcatacacattttttcactcatataataacaaatttaaaatatatataaacaagctcacagcagtaccaacatattctttaatttatggattatactttatattaatattatatttagagaaaaaagaaaattagctg

SEQ ID NO: 3128 - DNA, 1273 bp, Glycine max
  Soy_ogl_2108 Gm07:1046201..1047473 Cluster 13
ctatttttatatatatttctgttgaaatagttcacattcattaaaatgcattaaaataagagtaaatcatactaacatttcttaaaattttgtgaaattacactaacattttccctgtctttatctatccttatattaaccccgttagttaatttatgcacacacatccctcatccattacattaaccctcaaaacattacatcggactccctttaagggagattagtctaaatgtgttaaaaagcatcagagatttatgtaattttacaaaatctcaaaaaggatatttttataatttacttttaaaataaggttaaaatacattttttatattttatgtttttttattatatatttagtttgattgtttatcttttaatgatcctcaggagtaaataaaacctgtctcgttaaatttaattacttgaaaattgtagaatgaaactgatattcaataaaaaaaaccatgaacttgaaaaatatattaacttttttttgttggtgaaacttattttttatcatgtttataactctttttttttcaaatattagttgatttttatagttttatgtaagtgaattgaatgagaaaaattttatgtattaaattagttaaaaaatcatttaaatttgtgctctaaaattaaaaataattattattttgaaaagaccatttttatctattttacaaatataaaaaaattaaattgaaatttttagaagatgagagaataaattaaatataattgaaaatataaaaaattaaaagtatattttaaccttaaaataataaaaagttaagatatgtcgacgagatgatggggagataattaaattccattactaagaaacagttaaggcccatatttctttttgtttactcattatatataattttttcccctagaggattaaggtttgagattgtctaatgattgtgagctttttgacaatcccatagagtgagaaatgagtaatactattttgattctcaagtcaataataataatactactaaaatgataacatgtaataaatgattaattattacattaatattagttgttttcatttttacaaaagtttgagacgaactaaattcctgacagagggtttaaggcctctcacaaacaataatactactttatattaatgtagcattaataagataactttgctttaagtctattcataaatgcatataattaatacctttgtacctgcatgttaatttgcaattgggttatgctaaatagtatacttagaatattg

SEQ ID NO: 3129 - DNA, 1500 bp, Glycine max
  Soy_ogl_2459 Gm08:1986901..1988400 Cluster 13
atcaccaatcaaaaatatttttgacaaaatttcgaggagcatcgtgtatttttccaaaaattaaaaatagaggagcattacgtaggttagtgagaaagaagtgaatttccagtgtcccatctcctttattttatttctctctaataggtagtactgtttatccaaacaaataaaacctaactagctcctgtgtgtattccctttggatcatgtctcgacccaccccaatatacaaacttaaccgattattctgagatagagattgcgattgcgatgctgatgcccaaaaatgattggcataattaaagaaaaagaaaaggatgcgttatttacgtattttatttattcattttcagataattaaagattaatttctatgctaattgttctaattctatatctaaaatctagaaatggtttacttgtatattcctaacgaaattattgttttggttggagtttttataattattataaaaattaataatcttattacacacagcaatctatggtgtaaataatagtgcaaatttttttatactatcaatgcattttaattaaagaaattttttttattcactgtcaatgtaaagatttatcattgataaaagacaacaaactcatacatgataatttcttattaaatgataacataattgttagggataaaaaaacttaattcttgtaataataaaaaaatttaaacttaaaaataacttaaaaataattttttttgtataagcatttttctaagaaacaaataatatttgtttcaaaaaattttagacaaacacattaagaaaataggaaattacttattttattaaaataaatattttttaactaataaatttaaacaactccactcgttatcacatatataccaacggtaagggtaaaaaaattatatcgtgctttttaattacttatttcagaccattaactagtattttctatattgcataaatatttagaattttacaaaaaaaaataattcagataaatttaaaaaaattatttggaaaatattaaaaattatgaaattttgtatcttaataaaaaaatgtatcaatctttaaaaatgataatttaaaaggttattattcttaagatagtatgctttaatttaatagggattagtagcctgttttttgtgtaagaatatattagtttttactttaatttatggataaaataagttaccaaatatttcagtaacctaataatgatttggtaacaaacataaaagaggagataatgttaggagagattgtcggacaaagataattaaggaaacattagtgactgcgatttaccacggacgacaagtcaagagagaaggatgccaagttacttttctaatttattgattttaaataagagagcacattttatgtgcttaatgcatgcacataaaaaagataagccaagagagaaggaagtgaattacttactttactaattattgattaaaaaaactagacaaaatcaagttgaact

SEQ ID NO: 3130 - DNA, 1119 bp, Glycine max
  Soy_ogl_2530 Gm08:6751982..6753100 Cluster 13
cttttataatattaaaagaaggaatttttggcacacgtacatttctcagtccaaaaataagtgcatttaagataattcattttcaattatttaatttttatttatttaagtaataaataatattaattattaggacatttaatatatagaatgtgggttttaaattcacatttattattagatattaggggaatgataatgatcttaaaaaaaagggaggaatgataatgaattttaatggtcattaaggaatatttgaattcatgcattcaataaatggttattgcacattaatttattgtatttataaatttaattattttaaaaaaatagaatacaaagaactaaatttactaatatgtaattacaactttaacaaaaaaaaattatacttttattatatatattattgttgcaatttattgtcaaagaactaaagaaaaaacataaaaatgttttatcatataaagtaaggaagttgttgggctcttttttcagcccaaaaataagagcatttaagataattcatttttaattatttaatgttttatttatttaataaattatattaattaatgggacatttaataaaagaaataggttttaaatgcatacttattataaggtattaaagaaaaggataatgaattttcatgttgccattaataagtatttgaattcatgcattccattactgattacacattcatttattatatttatgaatttcattttttaagacaaaaccacatatttaaaaaatagaataaaagaactaaatttattaatatgtaattataaatttaacaaaaaaagaaatataatattttttatgatacattattgttgcaagttagtgccatataactaaagaaattacataaaaacttatataatataaataaaggaattttttgcactcttttttcccaaaaatataagggcatttaggggaatttcttttcaattatttaatttttaattattcaataaattatacactctttggtccttattataggacatagtttaaaagaaattggtggtcctttttataaatcatttaaaaatttctatgaaacatttttttttctccgttagtttcccttattaaatata

SEQ ID NO: 3131 - DNA, 1139 bp, Glycine max
  Soy_ogl_3606 Gm10:47446901..47448039 Cluster 13
tgactagggtatgcaatgacaacgattcttgtggcgaaatacctaaataattgagcatccattaagatctcaatctcattgattgtttaacctagcccataaaacgtgtttgaattacacctcattttaaaaggatttttattaatcattgtcatatccataatgattaagaaagtaaaaataaaaattattttaaaaatataatatttaatgttattaatacatctatacagtatttttaatagcattttaattgattttacaataattatccttaaataatagttaaaaaattgaaaataagaatcactttagggttatctataaggataaatacttttaattttaaaatattaaatatttatttgactacattatcttcttattttattaattttatcttactttatttaatagatactactataaaggtaataattatatagttagacatttttttttcaaagaataattgctttaaaataaaatcaataatttattattaaaaaaattaaaatcttttgaaaggatttgaaaaagaatccttaagcatatgtttgatttacattttcatgcgtctattatgctactttattttgatagcacatgtctttattttttcttttaaaatacaattaaattctttgactgtgagttaatcttataccaattttttaattaaattgtacgtatcttttttgcaaatataacttttacctttcattctagattcttttttcttcttgtaaaaatatatctatattaaaacaaaatccaaatcataataaattacagaaatcaaaatccaataaaaaatattaaaattaattaatataaatacaaaattatacattaagaatggaatacaccattgaaaggaaagtattttttttttcaataaagtatcttcttctttaataaagataaaaataagactaaaagaacacttcccaacagaaaaaacatgtatagaaaaatatcctcccggtcgttgttttataagggattttattgtattttattttggttagtaaaattttctttcaaataagttttcacaaaattatttttgctcaccaattaaaactctactcaatttagtttaccgtgcgacaaattttacttttttttttttttac

SEQ ID NO: 3132 - DNA, 1082 bp, Glycine max
  Soy_ogl_3733 Gm11:4732801..4733882 Cluster 13
taattagacagatacaatattaatattaatcgcttacgcaaagggattggcatgcatatcacatttactcatacctctagagaacagaatggaatggtcaattgattacgaatcactctatttacttttctttaattaaattaataataaaactagcattctgtcaattgtttgtatcttaagaaatcattatctttttttattaagtaattaatgaaatatgactttactcattccaattaattttatcattttctaatttatcctttattaaatcttaggcaagataacgcccaaaaccatcattttcactaatcatttttttaatttgtaggaatcaaatttataataatttatatactgctcaaccaattaaataaactcttttgtattttcataaattaaattttaaatatgtatttatcatttttttaatttacgcttgattaaatcttaggcaagaaaacataaaaaatggaaaagtatcacgtataatgagaacaaaaatgttacttttctctctccattttattaaagaacaaatagaaaacttatccgcttttatttggttcaatttcgtgttatattcttcataccgaatgacgttgttcaatctaataaagttttaagaaaagacgctaaacactaaggtttgtgtttgtttcaatggaaaaaaaaaataagtttgaagagaaattttatattttatttatgatatttacatttcttattctttactttaattttaaaaaatacttctttaaatcaaacacaccttacaaataaaaaataaattgcacgaacctttccgagatttgtccttttatacacttgatatttctttatttttaattcttacagaaatctcttaatttttagactttctttacaccgcctctccttagatatgtaaaaaagtgttacactcacccttctttaggagggctcaaagtaacatgaaaaaaatatatgaaaaagtatcatgtataatgagaaaaaacattaagatcaaatgaaattatatatattgaataccgttggtcttctccatcgaagagaactattgttttttaagtgagaac

SEQ ID NO: 3133 - DNA, 1500 bp, Glycine max
  Soy_ogl_4844 Gm15:859801..861300 Cluster 13
atatgaccatttgtttttatctcccaatgtaaagtactcgtatactttatagtactttatgtattcaatgtcgtgatctgattaaccttaatcgataactaatgtcaatattaattgttctatccatctgattttgggttttgttagttcgttaagaaacaataaaatatacttcatcagatattcgcgttgtacagtttcgtctaaatatcattagaatataatttacactttcaaaatatatttaaaaagttttattttctagctgtacaatttattataaataattcattctagacaatatttatagtattgtgtgtatattttatttattaaaattaacagtatgaattataaatgttttatagagctgtggttaaaaataaaacatataagtggtgattgaatgaagtacgtgatttactaaacatctcatttttttaatactttctcacatatatcaccactaattgcctaacctgtaaaagttatttaatttgtcaaatctatcaaataatttacttcacttgaaaatgctgtattgatctctcatttattaatattcactcactattttatttgaattgctaactttcctttttcttttagtctagagtcaagaattcgctgaatggcctatcaatggtttagagtcaacttatttgttaattgattaaatatcatctctatttgtttcagattagttttgatgaataatcatttttccgagattccgattaaaaagatgacaaaaaatatgaattttttagaagaaaatgttaggaatacatttcatctgacacatacttttaaacatattttttattattggttaaaatttattaaaaattataattttgtgtggactttacatcttagtagtatttaataaaaatctctcataaatttgttgttcttaataaattttactaataagaaatatgttaaagtgtgcgtttctagcgcttttttttttttttgttttcaaaatacgttgaactacacttgcacatgcttgtttaagtacatgtcttataaattatttaatgatatttgaatttgttttaccttcgtgaggtgaataaatataggtatagacaacaatgtttaggagggaataaatataaagagaaaatatgaatctattaatgtaaataaataataataaaaatactatgacactgcttaaaaatggtttaaatttaatattttctcacacaaataaaatgaaaaattagtaatataataccgtttaaattttgtatatttttcaacgatatacactttatcatattttgtatattacatttaataaaatagaatattcagtactaaatgcacagtcaaatttatttattagattgatacttgaattgcttgaaaaatcaagtattaagtgatttatgttctatttatataaaaaaaatgttttctaatatttttaaatatttttatcttttctaaaaatcaagtattaattgttagtttgctactgaagaa

SEQ ID NO: 3134 - DNA, 1133 bp, Glycine max
  Soy_ogl_998 Gm03:40512768..40513900 Cluster 13
atatttttgccttgaagaataacctttcaatcttcatcactacgctccacaaaacaagcaaattaatgtgcttcaagttttattaagtgtttgagttagttctttaaaaggagaaatttggccaacaaacacactttctaaaatgctcttaaaaaattaaatagcttatttttattaaaaaaaggtaaatttttttaaagaaatcaaggtcaataaaattttagaagaaaaaaatcaacttatcttgtctttctctcatttctgactctctcttaatcattttttagctaatgaaataaaatttactatatagtttgaattttatttttaattaaaactcttatttttaaactttaacttttaaaatacaaaatttaagactaaatataacttcggccacaaaaatgagccctaaattggtcaagggcacaataattttatatatatatatatataagaatgtggagtaaaaggcacaccaatttgaaaaagaaagttggtacactgcctaaagaaatttaagagttgagtaattctaatatattttataacatatatattccttctaatgtacttttattattattcaaaaattattaaaactaaaaaattaagaccaagacatattgaatgagaaataagattaatatataaaatttatgagttttattaaatgttactaactaataataataaaaagatattaaaaagatatcttagagaatctattgttgtcatttctaaagtatattttttttggactaacaattgaatgagtttgaacataataattaaaaaaaggagatccttaaattatagaatttctttgaaaaggagataaaaagcgctgccaacattagcaacaaactaaatcataaatccaacatttattatgagatataagtcaatcacttaaataaagtgtgtgaaattttataaatcctttaatatctatctttaatttctaagaataaaaaaaaaactaaaaccaacatctgaccttcattaaatctgtcaacctaacataatctaccttctcatgtgtaaatataatatcacattatgcagaagtcaaggggaccaaaaaaagcatatgcgaaagaatatttctagagcttattatctcttttttc

SEQ ID NO: 3135 - DNA, 1200 bp, Glycine max
  Soy_ogl_1197 Gm04:3584701..3585900 Cluster 13
tagtgactggattgataaactagtatttgggtgacttaattcataaataattttttttaaggaataaaatgaagttttgtttttgttaggcacgtggtatcccaacttgaataatttatgacgaatatttactcactttttttatgtaaataacttacatacatatgtttatgtttatacaatttttattcatatattttttaattattcgatttagtttttgaaaatttataataattaaaattataaaatccaagaacttataaattaaaaattctgtatttttatttcagttaggttacatatattgtgaaagattgactagcaaagtttaccaagtctaaaaattagttgttaattattaaaataaaaatattcagataaaaatggtatcaagtaaaccctcatcccttttatgcttgagatattcatttaaaataagaaaaaaatcttaaaaagaaattaatctgaaatattatattcgatctttttaaataagatttgaatcgtgtaaataaaagaaaatataattaaaaaatcattaaaaataaaataattaaattttatgatgaaaattaattatcacataatatatacatattctatactaacctatcttacgagaagaaaaaaaaagaattcattgaaaaaaggcaacataaaataaaataaaaacccggtccagtgcctaacacaagtttccatgccacatccgtggtacgcaccttactacgaatttaccgtaatgtcaggtaaacctatattaagcggggggaagttttcactctttcaattaaacattcttaagtatgaatgaaattgaaagggtaaaattttaattattcattaaaaaataaatcaatctttcaattaaacattcttaatatcgatagaaaaatgaattgaatcaattgatttggcttgtttaacgtgctaaacacattaaattgagttaaattttttaattcactttgaaaatgagttcaactcaacttgctttttgagcgggtaaatacaagccaactaatacatcatatcaacaaagctgctaaacacattctatttttttttttaaaaaaagttaattcacagagtacaaattgtagtcattttggtaattggagcaaattttcttcatacataatcccatatcatatagttaagattttttttttttgaaactaaacgaactttatattg

SEQ ID NO: 3136 - DNA, 1070 bp, Glycine max
  Soy_ogl_1484 Gm04:48118801..48119870 Cluster 13
atttattaatttttataataaaagttatattataataatttataattagatgtcagtctaaaattatttatgaagttattatagttacataattatgtgtaaaatcttaaatcaaatttatatagatcgattgtccttccttcgtatatatcttgcagagcaaagagtctcctgacactactgtatgttattttagtttagtttatgtatattcaatcttgtttaatgattttttttactatgtaaatacctaacaggctaacactaagattgtgtttgaaaataaacttttcctaacataaacggactttaattcaacgaatagacactctttcttctatgtttcttgtctatgaaaatatgaatatctatttttgaatttcaaataacaattcaaacacatgctaaatcaattttcaaattttatgagagtaaaaatatataatttagggatttggcacctctaaagtgaggagtgcactttaaaggataaagtacactcataatcattgattagaaaattaatggttaaaatcaaatactgtacatgtgtaacaaaatctaaaattaattacaatctcaaccttaatttcttaattaatggttaattggttatcattgcactttgttctctgaaatgcggtcttcacatcaaaggagttaaattcatagtttagtacacaataataaatgacttcaacttttatgtaagaataatgtaaaaaaaattacacagtaaattggtaaaaaccttgggcagtttaattagtaaacaataatattaggaatgatttttaatgtaattattaatataaaattcaataaaataatcatgataatttttatttatttaacagtataaaaacctttatgttgtcaatataaatactatttgttcataattaatttttcgaataatatggtgtatttgccatctatacactgcccatggtttataaaaatccaataattgatatgcgggttatttctaatatttgggaaataaagattaataaaagatctagcaatgtcaatgttattggttttaataagtgctagcttagactttt

SEQ ID NO: 3137 - DNA, 1249 bp, Glycine max
  Soy_ogl_2439 Gm08:634101..635349 Cluster 13
acgatgtagtattttcaaacaactaaggagttgaatgtaatatataagatctacgtaaaatgttagatgttattttttcattgtttaaaagaaaagaaaatttattttcttaaaaataatttttaaaatagccaaaataattattgaaagctaaccaccaaagcaaacaaaaatattcataaataattgaagggaaatatatgttacttctaaaaccggtaaatgatgggaaacaaaatatacttaaataactaaagagtttaacactgatagtataaaatagcttaaaaatattatttaatcataaatcaagtaaaattttgtacattattaatatataatttttttctcatataatttactcttttaaaactgacatatgtttttcgacatgcatttaagcaatgaaattagcgtgttgtgattttttcactggattgaaattagtctgttaaacacaatcagtgtgttttgtggcatttttaaagtatatgctcccttggtgtaatatattaataaaagttactatttagtcagagatatttatctcaaatgtattatattttttataaaaaatctcagtgtgggacttagaaaagggaaaatcattcaccaaacaacaagaatcattaggacagtaacatataagtttaatctttatgtagtgatgatgatgaagaaaaacagttttgcattgttatttaacctcaatttattatataggataaatttattaaacgttttatatgttgttcatgattttgtaatttttaatattttaattaataaaaaatatagtaaaataagtgtattgttagagctcctctttgaagtttgtgcttgtatgatggtacatgaaaaagaattcatactcaacaattatgatttatactaattatgaatcttgtaaatgatgttttttttttaatagaaggaataaacaaagttgcacatgagtgaaggaaaaatatatatatattttaaaaaaatatttatgatcaactaaacatattttatatacgcgagtttattggaaattaaagatcttcaccgtacttaaaaaatcaattatttatcatatcaaataatataacaagagtaatgtagcatttttattacactgaagttatttttaaaattcaaaaaagttaaattggcatctccctccacgagaacagttttgtaggaagcttgagtatgaaacattcctagaaaaccatgtacaatgagaatgttattttaaataaga

SEQ ID NO: 3138 - DNA, 1351 bp, Glycine max
  Soy_ogl_2848 Gm08:41218350..41219700 Cluster 13
aaagagattttgaaaaacgtatggggcattggccccctgatttttttttcctgaatattaaaatcaatgtatgaatgtgtgacagtgtgagtgtaaaaaaaatgaaagagtagggtgcgcttaacaaaaatagtgtaaatactaatagcgtgactattgcgtaaatagcttatgtgcaggtgttaaaggagaattttgattttaggttaaaaaactataaatcaataaataagaatttaacttttaggactaatgatactaaatcaaagggttttttgttttcaaactaagtaattgtttagatttttaattttataaatagtgtatttcttagaaatttataataagaacaaattttataatgggtacgaaacatgtactatggttatagtagttgattttcacaaatataagcacttttggtatataaatataaaataacacttgaattagcaacacttacgaatacaatggtatatttgtaataagaccatattgtaaaacatgcatgcatatataattaaaagtagtaaagaatgagttatatatagacagagaaagaagttatagaaagaaaaaagaaattattgaaagaaggacatgtcatataaaggattactttactaaagagaaaaaaaaaatagataagaagtacatgttttcataactgaaagtcatgagcgtgatagagtttgatgtacaagaaatatgtaaatgtttgtaatcgaataaaaataatacatttttgcctatttgtaaaaaatacaaataaccagtcttcgaaataacatgtgttttcaaacattagttgactctttatatacttttaaatgttataaaaacatgtatattcttgaccattttttctctctttactagagtaataatccttttaatgacatcttctttcaataactctttcttctttttataactcatttttttgtctatagctcattttttactgcttttaattatgcatgttttacaatacggtgttactaaaatatactaatatatttgtaaatgttgttaatcctagtgttattttatatgtatacaaaaagtgcttacatttgtgaaaatcaactactatacccatagtatactcattttgttagtactcactataaagtttgttcttattatatgtttctaagaaataagctttgttaaattgaaaatctatacgattgctagtttaaaaacaaagaaccttaaaagtgttttggtttagtattattagtcctaaaaatcaaattcttttttattgatttatagttttcaaacttaataccaaaattctcaatcaaccgtaggtgtttccttgtgcgtaaattacttatgggaa

SEQ ID NO: 3139 - DNA, 1024 bp, Glycine max
  Soy_ogl_3261 Gm09:43151530..43152553 Cluster 13
gttcatattcaaataaatctgtacaatatgactaacatgcgtgtagttttattacactattagattatttactttttaaaaaaaaatatttgtttttctttccccttcctaagcgatacaataagttgtatttgtaacactatacgcttaatgatattttgatatatttgcagcagtagaaactttattggttcatcttaatcttaaatcatacacctaatcacaccaaattctatatataaaaatttattattaaaataccacatcgatacatttatagatattataaaggatgaatataatgtggttaagcgtataatttaaggtcaagattgattaataaatatttcactgcttcaaatactgctgatctactcatttacaatgacacattatctgatatattattttgaatatattatttattgtagagactacatatttaaaataagacaattctaaacaataaatttttcttttaatatttaattcaattgcatatttaaaactcaaactcaaaattaatagttaagttaaaataatcttgtgcatttgatttatgtgcttggtgatttaaaatacactacttattaataattaaaatttattagaaattataaaattttgcaaattttactcttattcaatgagtcacattcatacttttgtattttttaataaaatttaatcaataaaaaaaaatatgatagaattagtgtattaaaaaatttattactaacatccctctaaaacaaatataggcaagtgacgatgtcccctaaaagcttcctagctataaaagattaaaaaaaaaaaaacagcaaaaagctttgaacatattacatatgtcccgttacgttaaaattattttgcatttctttaaaattaaacaatttagggaattgttaaatgaaagaatttcttttaaaatgaatttgtttctaaagtgaatgaataaggatattagattttggtaaattgggacaataattgattttaaatcaaattaatgatacatgctagg

SEQ ID NO: 3140 - DNA, 1400 bp, Glycine max
  Soy_ogl_4577 Gm13:39615301..39616700 Cluster 13
ggtcgaaacattgacccattcaaggttagtgccgtctcgttatatataaaagaattttatatatataaaagaattttaaaaagtatttacgcgtcataacaaatgtttcaagaatttttttttaaaaacatgttttatctaacttttgttttcaaaataaagagacataaaaaaaaactgaatcaaacattacttatagttatatatccatagaaaaactcaactgtaataatagtttcataatgtttcactccaaatttgtggtagataggtgttgaaaaaggaagaatagaaaaataaaaaaatataaggactgatataataataaaaaattacaacttcttaaatatggttttgtaagaagtaatgaaatatttatagatttcactctcttacaactcatttttatcttatttttctcttattctctttctatttttttccaccacatatcatgcttatagtttttttctttattttctctctccagtctcctccctccgcccaatcactttaaaataggatgcatatgtttaagtctttagtaagaatgacaatgcaatcagaaaaaatttaagatgggacgactcatcatctgctgcaatcaaacgttaactttgactaggaaaaggtaatggtacaatatacaattccattttatggggtcgaaaagtatagaaagggatatcaccatttattgtaaacttgactggtagtgagaataattgatacgtgagagtcgagacatttccttaaagtagaatattattacatagctgtatgctagtcattttgtaaatgtggcaagctttttggcttctgaaaatccaagcaaaaacttttgaaattttatttataaaatatttatatgtaacctttttttatagataaaacagacagatacaaagagaaaaaaatataaaataaaataaatgataggataaaaataaaaatattaaaattattctatagatttattttatgaaataacatgtcatactcatcttcaatatatatttggatcattaatttaatgtcaaactattatactactaccatgattttttttaggaaactactagtgtgtttgattccgtgttttaaatataattaatttttcacatctctaatgtaattttcaaaagttaataattataactttcagatttctttaatgtgattattttaatttcaacgatttttcaaacactctatacataaaacaaaacaacaatttgtttgcaatacgtggattgactattaaaattctgatccatggtaagaggtatcatgcatacatagacttgaaaaatgaattaagaaaatataggcctaaataaataattagccgaagaaccctttttattctattttcaagaaaaaaaatagaagctatgtga

SEQ ID NO: 3141 - DNA, 1168 bp, Glycine max
  Soy_ogl_5439 Gm17:1250201..1251368 Cluster 13
tttactggagttgtatcatgatattcttagtaatttaatatggaatattactaattaataaaaaataaagaatacctttcgaaaacaattataaaggttaagaaatttaaatcaagtgataaaagagaaagaagagaaatattataagtaaatgatgatccaaattcaatcttaaatttgtgtgtgtaaaaatgtatctattgaaaagattaattctgtaaatgaatcttggtatattaaaagatgaatattgttttttgaaaaaataatctaataagaaaaaattaagaataaaaatatctatattagaaaatagtgtagttcactcttgctttatagaaggaaatttttttaaaaatgcaacgtgagatgcaaattttctaaaaagatatattacattttaacttgaatttgaatcactttagaattccattgaaagatgttgacttgatctacttaataaaaataattagcttttgtaaaaaaaatagttaacacatagaataaaaaattattttatgaataaaactactattaaagagaacaatttatcaaaaattactcttaaaatactattagttttttatattattataagtacccgtgatataattggagacatttttgctttgaaaagcgagtgttcttacttagttttgttttattttcttgatttttttactttttgttattaggtcattctagacatccaatggtccaaaaagagaaacagaaggaaatgaaacactttcaatatttagtgggtgaagaaagtttgtggtttaacttcaatatatttttccttatcttcggtttaaatttttggttctatatgttgttctcccctactaattatgctaaaagagaaaatctcacgattttttgtgcgaatcattttattattttctcatatatataaaaaggctttcttcagcatattaacttcatttgaatgatgattttcctctaaaacaaagccttcatttggatagacgaaaaaagaagcaaaaatagaatccattaattaaataggcctctgctgacagtccaagatgtcattgatgttctgctaaatagtattagaaattccttatatgttctactacttgattcaaaaaaaaaaacatcttattgagtttatctaaataaaatatctaaataaaaataa

SEQ ID NO: 3142 - DNA, 1100 bp, Glycine max
  Soy_ogl_6573 Gm19:44774101..44775200 Cluster 13
gattctgtcctattttagtttttgtaaaaaaaaaccaacttttagatcctaacattttatatatcgtgccatttttaagttcttatcattaattatagttaatttagtgctgaaatgactaataaaatgaagaataataattaagataatcatagtaatgaaaaatattaattaagatggctaacgtaattaggtaataaagaatattttaaaatgaaataagagttatttaaatttttagtccttaagcttttttgaattagtctttgaacaagagtttcactgatgaaatttctttaattttttttattaagatttttaatccttaaactttttaaaaaatcaattttttaattcctaaaatcttattatataaataaaaataataaattcaaactttttttaggaactaaaaagtaaaatttctaaaaatttaaaaacttcatcaatcaaacaaaagtaaaagaggagcttcatcactcaaacttttgtttaaggactaaaaattaaattctaaaaaatttaacatattaaaaacttagttaaccttaaaacaattagattagttttaggtgtacaattcaaaactatcctaaataaacatgaataaaaagattattaataaaaaatactatcctaaataaataaggtgattatgtataatttattttaatttttaatattttaacgagacactcaaggaacctgaagtgttgcattgaaatattttctcacaaatcatacaatgagttataggatagatcatacctaattaactttcacaagccatggggacaatgaacaagtgaataggctcaagtttggacaataggtgtgacataatcttggagttttaaaaatgatattatatacagtacgtttatcttgacccagtgattcctcctcagctattaattgtaggtcttctagcatcatattgcactacatcatcttatatgtgaaacaacctttattttggtaacctccctcactttagtaatgtcgccttctctagcacccttgtgtcatgtatgtgcttataaatcactcttatttctccgataaaaaaattataaacccttctcatttttagcttaaat

SEQ ID NO: 3143 - DNA, 1291 bp, Glycine max
  Soy_ogl_6879 Gm20:39808610..39809900 Cluster 13
attttttaatgtggaccagcccatttagtaggttggcttaacgatgtggttgtggactcgttaaaacaaagctcgtttaaattgcgggctttgcatgacaaattatgctagtgcaagcttaaatagatggactaacccacatttctaactttaattaagagacattcgtaatacctatggagaatcaaacaaactacaaaatggataaatttagtataaacataattaataacaaagctttagactttattttaaatataaagggagagaaacaaaatagatattaattaataaataaattagtaaatatatttctcccgttacatcatcaaaataaacaactgtcgttaagttatgtaaattacaatagatgtcatcaaaacatttgtatagttaacacgtgtatttcatagcttgaaagtttatcttgaaacgccatatatagtctaaacaagattcacaaatttattgtattagatatatattagtactattaattgatttgaataagaatatatacttgtattattagtttgaatcttcaaaccaaaaaattatacatagtataatttccataattcatataagtctataactacaataattatatattttaggatttgttaattaaaaaatacaataaaaaaatttgatcacattttagaggaaaaaataactgtcaagtgatatttgcctacatataaaattttattttataaatacaataataatatatagtaattactttaattatatattttaaataatttgattttcataaatttattaaaatgtttaaattctagcagttgtaaaaatttagatacgattgattctttttagatcaaaatccaaattagataagatttgttttatttattgaacaaattagatacggttgattttggacacccatactccatattataaactttcttacaattaatgttttattaattactatcttttattcatatctctagtccaaattctgaccactttaagagtttagattagatatagtgattctttttagattaaattccaaattagaaagaaaaaaaaaatgcttcttgacactggtaagttatatacgtgtatcctaaactcttttacaatctcaatcttttaccaattactatcttttttcatatttttctacttttttgtcaacacacatgagaagggtgaagctttctggtcctagatgcgattgtacaaaatggcacaaagctcgttaaatttcgcacaacaaaggtagttatgctagaaaacacacccgcaatataca

SEQ ID NO: 3144 - DNA, 1026 bp, Glycine max
  Soy_ogl_28 Gm01:1659448..1660473 Cluster 13
gaaaaaaaaataatttttaattgatattaatacaattaaatatgattaattaattttcttaattaatatgaattgattttttttcttcttgttatgaatagatctacatttgtttgataaaagtcactcaaaattaaaagaactaaaaacagagatgaagaaaacaaagatggagattgtggagaaatctctctttactgattgaattagaaatgtatagcaatgaattaacttgcgaatcaaagtatctttttatatacatcaatcttagtttggtgatcacgtatcatgtttgtcacatattatttattatttatgtaagtataatgtattaaaaaattgacttctttatttgtgtctaaaattaatgcctaaaattaatgaattattatcattttagcccctaaacttaattacttactaacattttaattcttgaaattaattatatattattattttaattccttaaaacacttttgaatttttaattaaatatcatgttgcatgatattattaattgacaatttaaaagttaaattattaataatttcatactacatgagacttaattaaaattttaaaagtgttttcagaaaccaaaataacaatgtgttaagtttaggattaaaatattaataaatgattaagttaaactattaaaatgataataaattaacatattcaaaatcaaatcaaaatttaacttgttgatatatttcagtcatataaatgactggatcaattatcatattagcactgaaagtgttatgtagttaatggaaaaaaaaacttaccttacgactaatatgtcactttttataaatttgggatcaaaatttaattttttatatttcaggaatttaattatcaatatcttgaacatgaaaatgagtatttaaaaaaaaataatgtgaacaagctgaccgtaagtcttgatgatatgtgagaaaagtcaacctggatgcagagaaaggcatgaggagtcatgacatacggaaccattgttgacctacactcttccag

SEQ ID NO: 3145 - DNA, 1132 bp, Glycine max
  Soy_ogl_251 Gm01:263569..264700 Cluster 13
ctcttttagaatgatctcttgtaataagtagatcctctctttagtagtaggtgtgcatgcatgtgctcctaactggtttcacttagataattggcatatttctatttagtctttttaacaacattatatgacactaactaataatgaaagaacttaattaaatgatataatttacaactttagaaatgatttttgttgattttttttattttagataccaatttaatcatgattatagtttcaggaactaaaataattggccatttaaactttcaaataatattttgctattttattaatttcctaaaccaatttaactaaccgttataattttaaaggttgaattaattattcactctttaaaaatttatatccgacgcgaagattaatttgaacgaatccgtggtattacactattgagttttcttttcaatttgcagtcaaaatattttttttctttttcttatatatagaaagctttctagaaaacttgcattatgcatattttaatattatgttttgtatgtattagagcagattttgaatttaggttcaatattgtctattcttttttttttttagtattcaatgcctatttttaaacattattaggctagttgcacattctatacgttgaaagatattaaattttgtgtcacatatattaatgagctttaacttttgtcatgtataaattcctatatatgcatatgtttaaaaaaaagtcaatacatattttcaaattgatgtatgaaaatgacaagttggtgcgttttctttcctaagatttaatcaaggataaattagaaaatgatcaaattaattggaatgagttaagtcatttcatttcttaataaataaaagataatggttgatgtatcaaattaaaaaaaaaaaaaagaagataatgttggcttaagatacaatcaattcaaagaatgttaactttattattaatataacgaaaagtaaattgagtgatgcgtactcaaatgaccattcccatttcattgcatgtataaaaataaaagatgataatggcttaagatacattcaattcatggaatgtttattttatgatttagtgaaaagtaaatagagttactcgtaaatgtaagctctatcattgcta

SEQ ID NO: 3146 - DNA, 1148 bp, Glycine max
  Soy_ogl_388 Gm02:5102101..5103248 Cluster 13
aacaatcgtaaatcatcattatccaataattcagctatctcatgtgacatattattatatttcatgtatatatgtttgatgcatgcatgggaaggattattgatcctctaatatgcatatatagtttaactcgtcacttttaattttaatagtatctttcaaattaatcttattttcattttgtaaaaaaaattaatttttttttaaatataaagcagaacttaagaacgtatgatttatattataatatacgaaagcacataaatgctcctaacttttatctttgaaatatatatatatttttttgaataattgaaatagaaaagttacatacttacatatatataatactaattaggttaaattaattcgtatgtcgatctctaaaattgtgaatgaattagtaatgtgttacatagtcagaaaaaaaatagtaattaatgtgttacatgtgtagttacatcatgtgtcttcattttttatggaagttacatctcttaataagatgtttatataactgctcacataaaattgttttgaaataactaagtttctcatatattctaaaaaaaactgagtttctcataaattagtttcgtccaaaataatacatgtttaaaacatccaaaatatcattgtacacaaaaaacgtacgtctaaaaatatttttttataactggtcgtccaacacttgcttttcaatagaaacatccaacactcctattggacaataccttttcaatttgaccttgttataagttatctatgttggatgaaaggatcttcaaatcaagtaataagaatgctttggaaaatttggctaagtgtcttcaatgtgcttcaacgtctaaacactgccacgtcttttaaagagttcgttcattaatttaaaaacttaaaataagctctaatcatagtactcttgagttttgtagggtattcaaattcaaacagattcaacaaataaacaaattaaataaaaattttgagttaatttaaataaatattaaatattttttattataaatttaattgtatacgatttaggtattaaaatatttatttattataaatttgagttgcataaaagtaagtattaatttatttgatgcatagcaaagttaaaatgttagttgtaatgaaaatcc

SEQ ID NO: 3147 - DNA, 1500 bp, Glycine max
  Soy_ogl_996 Gm03:40300401..40301900 Cluster 13
aaaaatggaaatttaatttaacttttgtctgaattgcaatttcattattatttttaatttatataaatatattattatttttaattatagtaactagtaagcaaagagtttatactaaatatatcataattcggtcaaaataccttataagttagtaaaaaaaattacaagcctccgaatcaggattttataataacttgttgtaataccaatataccactactccctcctttcaccaacaaaagaaagctattactctctctatccccagggactaaagtttaagattttttcacactaataaagaaaaatagataatagtatttattagaaaacaatttgaatataatattttatttttttaatttcaataaatatattattaagtttttcaatacaataaaattagagtagatattttttaatatctcattaaaaaagtgagaatttcagtcaattttaaatatttttttgaaaaactaaaatcgttgtcatatttggacggaggaaatataacaaataagggtaaatgttaacttaataatagttaattacatgttaatcaataacattctattattctatttccttaaattaattttttttgttaaataatacaatgccattttattttatattcataaaaagacataattataattattaaggtaattattaccagtatttttttatgatttaaatattcaaattaataaaaaagtgtctattttgattaaaaaataattttatatcatatcaaattaaaaaaaaaatctcacgagatttatgctgatttcaaaacataaatacataattgataatttatataaagaaaataatctataaatattagttgttagttttgttattatgttagtggaaggaaggaatttgaatttaagaattttctctattttttcttcaactatcaagacaactttataattcctataatttaaacaatatatataagaatatctagtactctttagttatagaacataaaactacaagcgtaactttaggggaaaaaagtaagattatgtttaataaaattagtaaaaaattgactgaaagctaaaaacatagaagttgtaaaatgggtcgaggtagtcgggccaacccgatgaaaatgtatgatttaaccttaaacaaattagacttttcaagggtttgagtttcatttaagcctaaattaaattttttttgacccaattcattatagacccagcattgggttgggtagtctgtttaattagaaattgaaaaattaattttttaaattataaatgtttcaatttgttaaaataatcaaagagtgtaaaattaaaaaaaattacaatttatttaatctaaagactatccttctccgaaatacctgcatatgccaagcccatattgaaagcggcatctgttttgtcattccagacaatagtgtcataaacattggagatcacatggatcagtttgcaaatattattagggacaaccttaattttt

SEQ ID NO: 3148 - DNA, 1200 bp, Glycine max
  Soy_ogl_1398 Gm04:44659501..44660700 Cluster 13
gaataaaattaaaatataaaaatcctaccggttgagaaggaaaaaaatagatagaaaaaaactttatttaccaagaaacttatataatatttttaggaaagtgtatgaccaatcaaacaaattatagtcattcttaaaaatcatgattatcagaattcatcattttttaggaatcgtaatttttaaacataaaaaaaataaaaaaatcttagaccaaacgtccccttacagtaattccacttacttctttttttgttccacatttttgttataattgaaccttaatccaacttgagttaaattcaatcatctcgctaataaagttattaccgttgctttgtatacactgacacccatttcttagtatagtttctaggttccatcgaccctatagaaaataggcattgtagtgtataaagcaatggtagtatagctttgtcataaatgtaatccaagtgattaaaggtttataataacataaatgtgaaacaaaaaagggaaggagaggtatttaaaggaaagaataagcttctatatattgataataataatgaaataaaattaacttgtattttgatagatgaaatgtgttatatatatataaaagcaagttgcagttctattttttgagagttatttttttaatagaatatatttttttttatctttatcccattatttattacgtctcataatctcgtactctcacttttagttgtataattttttatatgagttattgtataaataatattttttaaatattagactttttacattagttgtggtgataacaaatgtaaaatgtaaatttttagaaatttttaaatagattctaaattttattgactttttatattgcctaattatagacctacttgcagaactaatttaaaatgccgaaaacaaactaatcataaaagtttttttttgtttagtattagttcctaaaagtttttaagaaatttatttttagtttttttttagctttttttcgtttttactttcggtcccttttttttaatgaactttgtcttatttaatgaattaaaagtaaagagggaaaaagttataggacgttgaccggtcaataaacaaaaaatgtttatgaactaacaaatgaaattaaaaaaatagtaaactttttttttataaatgaaattgaatatagtttttttataattattaataaatattttt

SEQ ID NO: 3149 - DNA, 1200 bp, Glycine max
  Soy_ogl_1516 Gm05:12601..1507800 Cluster 13
ttgtgatgtaacgatttattaataccagaatatcaaatttgagattttaagggaaaaaaaataataaactacttaaatttaaatataactacaatattaacaaggataaataaaaaaaattatagatagagtcaaaaaataaataatttttaatagggtgtagctaacatgtgcatgcatgcacgtgttagtagtttattacatgcattatttttggaatttttttaatttttgtctaaatcttaaaaactaatttgattttttttaattaaaagatatgactattttgctaataaaaagtaaaagataattgagtgagatgattgggagacaaaagataattaaagaattgatttattttttaattaaaaaagaagatcaaattagttattaagattaagacaaaaatttaaaattttctaaactaatgcatataataaaactactacatctaaattagtataaacaattaattatattaattaaataaattaaattataagataacatttttatataagatattattacttcacatcagatatattttgtaaaagcacatctttaaatagctttctacaaaaatatatttaattattctaattaattgttagatttaaatttacaatgaagaaaatcaagtttataaaatttatataatttaaaaatgagttattattccctaaaaatgaattattattttatcatactattttattttaatatacgatttggtatttaaaataaaagtaaatatatatagtaagtatatatcttcaatatttaagttatctaaactttaatatatgtgatcatcaagaatatatcatataattcaatgaataagctgatatagttactttttgttgtcttaagtcctatgatttaaccattcaaaaaataaaagtcctataatttaattcctgtccaaaaaaaacaatcctatgttttaatgctcaaaatactccatcaaccatatatacatatgtttgtgtttttctctccccgtgagagtatttttcattccttgtgagagtttttctgtgagtgttttctagggtttctactatggcagaaccatctatggctgatttgtctttggacgatgccaaggaagatctggtggtccaagttgacagtgccgaaggggaaggaatcaataatatttttccatttgtctggtggaagattccttactga

SEQ ID NO: 3150 - DNA, 1031 bp, Glycine max
  Soy_ogl_1548 Gm05:2319701..2320731 Cluster 13
ttgaaaatgaatttccagaattatgttaacctaattatggaaataatttctacatgttgttttctagaaatgcctttccataagtgaattttttttctcaaatcacagcttttgtagttttaataaaaaaaaaatgcaaacatataactatgtcttgagatcaaatttcaaaatatctagagtgcactattcatcttttgatttcacttcacttcgataaaatcacgttaaacccaaacccaaaatgaaaaaaatagagaatcgaaggtaaagtttgtttcaaaatccaaactatgcaattacattaacaaaaataatattaagaagaatgtttatttttgctgtaaaaaaaatgtttatgagtaaattaaaacaacgatttcccatagaatttaagttctaaaagttttttttttcaaaattcaaattgtaataagaaaaatacaggtgaaataaaaagttattggtgttacttctaacacaaatgttgagattcaagcaatttttcatggcaataggctaggtcctcatttatcttatttgtgagtcattcaacaaactgttgaccatttcattaagggtatgtttaataggaaaaaaaattcatgctcgagaatcataatttatggaaataaataaaattcatttggttggttattgagaatttttaaataaattttataaggactaaagagttatgtatatttttatcgattattttaattatttaccatattatataattaataaataataacatgatatttttactatatcaaaagaaaaattaaaataaaaaatgttgtgggaaattttttgtgagaaaataaaaaaatattcttgagaaacataatttataaaaaaatcttgttttttttttaatatgaataacaaacatcggatattaagctttccaacttatgattcttggaaaatcaaaaacttttctcataccaaaatgctccctaaagaaaatgtgatttccactcacccttattttcctcttgttcaaaatataagaagtttcaccc

SEQ ID NO: 3151 - DNA, 1445 bp, Glycine max
  Soy_ogl_2131 Gm07:2385956..2387400 Cluster 13
cttaaaggtgaattattttaatttctttgatttctttctttcaaaatgtatcacaccacatgtcacttttaaacacattttttatttgttagttttttttttctattgagtttttctttaatatgattgatatttttaattactacatatatttttgtaaaactaaaaaattattgtgtaaacttgatttttatgacaaagctcccttttaaacatgttgcttcatcttaataattgcaaagataaaaattagaaaataatagcaacaatcaaacttaaaattttatatatttaattaaaaaaagatgttgcaaaaataagtgagtaaaaaatgataaattcttacttcacaaaaataagattgatatgtcaaaataattactacgtttatcaagatgtatatccttttttattagaaatataccaaatgatacagttaattagaaatgacaaaaaccactacatcaatattaatagagaaaactaactgatggggaagaggggcatcctccatcccatagaagaaagccttttttctatagtagaatatagtagatagattatagattaataaaatattaatttgtaattataagcgcaatttattttcactctctatataattatactaaagataactataaaaataaacccacatatcaccttaaatcaataagttttaatttgaacaaaaagttattaaagagaatgagtttattaaaaaaattattttcagaacacactcacatttattttttatattcattaaataagttaaatttcaatgattaaaaattcaaaataagaagtgaagtcttttttttagagaaccaaaatatcaacacatatgtgcattaaaatattccaacttattttaaacaaatattttaataaactacaacttcaattatcaatttgcactcaaattatagtttattagcaaacctttttaaacaaatacttatttcccttacttacttatattctttacaaggtttttctatatttatcccttgtgcatgcaggagagttgctattagtaatattatgctctagaaaactttgtaggtattagtaatttatttagatttgaaaaataattaataaattaatattaggatgacaaaagaataattataatttttaccatcatacttttctctcaatcctctttttttttttattttttttagaaaaagagatggatgagtatcaaaagaagaccaaatattttaactatattggaacccgaggcccccaagatcctattcaacagccaggcccaaatttattaatggtattaaatattgaataaaagtattaaatatttctacctttttactatattaaatatgtttttctattatttaatatttttttataatacaataagaaaaaaaaatgttactgccagtgaaaagagaggtattatataataccccatt

SEQ ID NO: 3152 - DNA, 1100 bp, Glycine max
  Soy_ogl_2148 Gm07:3169401..3170500 Cluster 13
gtaagattaaatcattttaaaaatgtgttataaaaaatcagcttaaaaatatactttattttagtacacaaacataaattgcttagaagcatcaatttcattatataatcaatttatgcatactattatctacaaatatttgatatttgatcaataatataaataagaattttgcttttaattgaaaattgtataagaaaatttaatttgtatttgcaaaggaaaataattacagaatttagaatattaaatataaaagaataattaaaatataaaataataataagtactttttcataaagagagtatatgtttctcttaaaaaaagatggtatatgttttttttcatagaaaagttttatgataaaaagaaaaatataaaattattaatatgatgtgatatgattgataaattatttattacttaaatatgtgattatatgttcgatctataatttgtgtataaaaaaattattaatcttataaatagatctcactacctctcgaaagattaattagtctcaagacaaatactttgattaagaaaaacattataaagtccaggagtgaaacatttacatcggtataaatagtactagctgtattttaattatcttcataaaaaagctctattttaatcattgctgaaatcaaatgtgcttcggatcccgacagatttagtcaatcctttcctgctatttttttttttttgccaacactgaagtcctttttaagccactttttgggggcttcggatctagcacatataatacctcaagtcttaataaagaaatactacttatttcatctgtaaaataaattaatagaaaattcataatttaaattattagaatagaaccaccaaaatttaagatagttctaatttaactaataattttaagtttgagtctttaaaatataattcggtaaaaaaatctttaatatataataatattaaatgttagacagtttaaaataattgataatattacattactacataagttttctaaaaaaatttacataaaaatctttgaaagattaaaattaaaatgttttataaggatcaaattggtatttaagaaaaaaaaattgtttcc

SEQ ID NO: 3153 - DNA, 1122 bp, Glycine max
  Soy_ogl_2423 Gm07:38426179..38427300 Cluster 13
gaggagaagagtatttttttattcgtgaaaataaaaaataacattaaaaaatttataataactcaagcacctattaaatcaagtaatgttaaatcatcagctttataaaagaagagtatattatactgtattgagatttttttggttttttttttaattatactaatatctttcttcttcttcttctttgagaaaaaaaaattatatcctagtattataaaaaatttacacaatcatttaattacaaatcatcatttaaattattttaaaataattattttaaaattaaacatttttttatgcctcatccactgtaagcctttaattgttggaaatatattatgcttgacactttctatatattatactaatcccactattcaaaaacacattgtacaatgtactttataaggaacgtacctgtgtaaatgttaaaaaagaaaaggaatcacgaacagcataaaaaaaacgaacaatataaagaaacctaaaatgtcaatgaaatttcatctaataattatcaatctaaaaaaaaactactatccttaaatgggacagatttatttttcattaacttgtctcagtggatcttttttaatagtatttagctagtatcatatgtcattatatttattgtttagtatgccatattctcctatagatttatttcatagtttatttaaaaaatactaagtaaaaagtaaacaaatttaatattttgaaaactttaaaaatttgaacaatttttttatctaataaataataggaataataaaatattttgtaagagatttaatttttttataacaatattagtttttttttaatatgtgatctttgcactagacaggaatactattttttttatgtcaagaggggcaggataaaagatttttttatttatcgttttttggtttgagttttgctttaccacttgtcctaatattggattttaacatgttaaaaacgaaaattaaattgaaatgcttaaaataaaatttcaagagactagggggacgcatggggttaagctatataaataaaataaaaaaaaaaactctttgtaatgagctaagaagcactttacatttcttcgaatcacatttgcaaggaggataattc

SEQ ID NO: 3154 - DNA, 1438 bp, Glycine max
  Soy_ogl_2588 Gm08:10076663..10078100 Cluster 13
tttttttatcattatattcattattattataaaaataaatgcacataaataaaattaattttaaaatatttaatagtatattaaatataattacattaaaataaaattgattgattatatatttgaacaaatgttgcatattcaattttttatggttttttaaaatggttaattatatttttttaaaatgataatatttatttttaattaattatatttgatacatgaaaatattaaatatatttccaaaatgtacatacacaaattagtctttatattttaaggacaaatttgtgtagacattacatccaaaataagtatgttatttgaaagaattattggaacatctttatttaaatcaccaaatataaagaaaatatgaatttgaaatttattaaaaaatatttttcaaacgtgttcatatcattatactaataaagaaaaatgatcagttttaaacttatttaaaatcaattttaaaatattaaagaatcatcgttatttgaaattcatttaaataataccaaaaaagatattattgtgcgggatttatttgtagatattaaaaaaattattttattttaatatctgaatttggagacgatacttgtttttttttttgtgtgtgtatatttgtgtgcgtaattggaatattttaattttaaaataaaaattaattaataaacaaaaaaacaacatttttgaagaactaaacaagcaaaaaatatttcatatttcatgttgttaatgattgtaaattaagaaattaatcataaagaagtaaagagtaaaatattattttacaaatataatgcataacttttaaattaatactacattatttcttctttttttatttaatagatatatacaagataatagttataaaatagtaatatcttttaaaaaatatggtttctattaaaacaatttttcaaattcattttttaacacacctacttatgtcttatgaatttgaaattttaaaaatatataaattttgtaatgccttttactttggtttttggacgaacccaaacataaaaataatatgcagtttgttttggtttaaatgtaatatcatatctgaaataaatcaaatttattttttgcgatttggtttcaatcaatttggttgtttgttaaatttttaaaatttatttttacatgactatttgtattatatttagtttataaaataataaataaattggcacaatgtaactattgagtcatgatcctcatcccttcaaaattacataatcataaaaagcaacaaaaattcacatataataataactaaatgactaacctctcatacataaaaaaaaataaggaatgctaacaaaactctctccaacactcttccttaaagattttttttagagttggttaattttttttgaaaatcattaattttggtatatttccaataaat

SEQ ID NO: 3155 - DNA, 1076 bp, Glycine max
  Soy_ogl_2851 Gm08:41426125..41427200 Cluster 13
atttttactgaataaaaataattaatttaatgtctattatgacattatttattttagatgagatttaattacttttttagttttgaacaatttattttcagtggaataacgattaatacttgttgaaattaacactattttgtaacaattgtatggagagagaaaataatcaaatcttcttattgtatgtttagtcgttttcattatttataacactatataatgaaaaacatgtattttaattaacactattttgtaaccattgcgtgcatacataatagaataaaatcttcttatctaatatgtatttttagagaaatgttaattatattttctctcagactctctttctttctcatgttctttttgtgtttgattaaaatttatagaagaatacaaaatttggtgggtctcacttgtaaattaagaaaaattcattaaaattgatcatttttaataaatttcaaccaatcatagttaatacctaaaagaaaatttcaaccgcgtgaatggcctttctcatatttttataatactatactttctttgtccttttttataagaaaaaaaaactcatttcacacagttaatttatttcattatattttgtcattttcaattaaaaagatatatttttttaaaaaattatccttcattagaactttgagagtattttgaacataatctttattaagtacaaccatctctatagaaaaaaaaattgaatttttttcttataaaagaaaacagagaaagtatatgctaataagtaataaaactttgtgcagtaaaaaaaagtaataaattgtagacttaaattacttaataattttaaaaaaatacaattttaatgaaactaattgttgaatcgtttgttatttcatttcttatcttgtatatcaaatttcacatgcctcctctaatggaggatacatgtataaaaaaaatggatacattaaaaaaactgtcaattaaactaccagataatcaatcattcatggaaagaggataaaaataattcttatagattcataacacttaaaatttgtgcaaattcatgtaaatgttttttgtac

SEQ ID NO: 3156 - DNA, 1371 bp, Glycine max
  Soy_ogl_3250 Gm09:40960501..40961871 Cluster 13
aaatgaattgtcaaagaaaatataaaaatgtctctaattgtgaaaaaagtggcagtatcactgtccattatccaaatggtagaacacaaaacattttagaggattttttttttttttttgagaattacaactttatctaaattagaataactatattgaactagagtttttagggattattttttgagtttttttcttcaataaaaacatttaaaaaatatatttgtattttatctctttcaaataagtgttatttattggtacggaacgcacggggaacacgtttgaaaagtaatacctaacatgtcgtttgaaaaatatatttgtattttatctctttcaaatatattattgtgatgttttgccactcatgtaagtgtaataatggcttttcattttaatgtatcaaatgatcactgtattataatacacctataatcatgttcacgtgacatctaatcatgatatagattttgtgaaagtatttacgtcacaaataattcacctgcgaaagttttttttttttttgtttataaacaaaaaaaggttttgatataaatgctacatgaactttgaaaagaaaaattgttaccatatatcataatgttacttttttttcatttacaatattttttttatcaacaactataattgcaatatcattataagttattcaaaacaaaaatacttaaataaatcaattcatatccacggtaacaatttaaaccaatatactcttatattaaaattaaaatccataatttagagaataagatttaaatatttcttaaataaaactaaccaccaaacaatcaaatgaattaatgtaattaataatatttttttatactaaacttaattaatagtttaaatttgagtcttgtgaataattgtgttgataattcagaaaaataatttgccactaataatcctactcaactttgatggaattaccttaagtggagcaggatcaaaagaaaaaacagatcaatttcaatactattataaattaattagtacaaatataataaaatgtaaatattttttgaaacacttaaattaatatttttttgtacatcatatttttgtttgatacatggttaaattaatatctgattatataattttaaatcaatcaaaattttaatcattttaaaatgtatacctctctcctttaagaaaaaaagtttataaattgtactgtaattcatttctttaatttaccaaaaatattatactcattttaggttaaattacaatttttctcttcttaatttcttatggttttggtgccataaattttaattataacatttggtctctctaggtctctctagttatgtgaatcgacaattgtgattctcttgatag

SEQ ID NO: 3157 - DNA, 1228 bp, Glycine max
  Soy_ogl_3341 Gm10:3148765..3149992 Cluster 13
aagtaaaagggaaaagagatcagatgaagtgaagttgttttagattcaacattagttgttaatataacattatccaagcagagttttctatgatatagttattgcttaacaactaacttgccgtatgtgttgtactttgacttaaaatgagttgaacatccccaacttgcaatttttgatttcttgtttaggtgcagtgacagaattactagtaattaattctttagaaatacaatgctttaaatacaacaattaaaacttcaagattatatacaactaaattttaatatgtattctgtttttttattacttaaaaccatattgtgttatagactgattaattatacctctaagtactaggtccataaaaggaaattgcttttgcatcacaaatatattttcatgtcacgttacttgaacatataaaggtagttaacaaagattgatacaatcagtaaatatataagagtttaaattccatggataatgtaaagcgcttaaactttaagtatatcttgactttggtgactctcaagactcaatttatctaagttttttttttgtacccgaaaaaaattacatataaagataaattttatttttggataagcatataaagataaaacttagatataattttatgtatacttttagtattgttattcaatcaaaattaaagttttatattaataattatttacattcaatataaatttagacggattatcaaaataaaaaattaattttaattagaaaataatactaaaagaacttaaacaactacatataagttttgtcctacatataatcataatcatgtttcctcataattttcttgggctagggtaatgaaacattaattaaaaagtattcaaaactttattaaataaattttattattttaacagatttttctattgtatgcccatggtatattttaggtcaaaaaatgtttcttttaaggaaatatttattgtataaaagtataaaatcaatttagtatataagttttcaagtaatttaaaatatttaatattttcatattatatgtttagggatacacatcaaagaaatttccttctttgcaaaattaaaaagtccaatataatttttttatattttaaatataagaactaatgttttcttatattaaatgctctatttcctaatcgatcattttcccaattgatcaacataatcattttccgtttcttttgaccaatatttg

SEQ ID NO: 3158 - DNA, 1466 bp, Glycine max
  Soy_ogl_4460 Gm13:35408935..35410400 Cluster 13
atccataaaaaaaattggtataccaagtgattaatttaaaaaaaaacatgtatatgtgtacattaattaattcatttcctaaattaattaaaaaaagaatctcttgagtcataaataaaagttgaaaagggaaaatttaaaggcaaaatatgttaaagaatagaaacaatcaatgaagaacatgaatagataataaaattataatactagatattattattaaaataaattaaattattttgatgaatttagtttaatgaaatataaattatctattagagataaaaataataagttattttaaatcatcatatatattttaataaatatttgtttaatagtttgcatttaagttaattcatttttatacttttttttgtataaaacatcatttataaactttaaatgttataaaacgacgaaaataatatttagaatataatcatataacataattgattttttaacggtttacattttaaaattacaaaaataattaaatttaggagtaatgtaatctataatatattatgtttaataattttaatatctaaagtaataactattcacattggatgagaactataataatcacgagaaaatagtgatcacaatgagtaagatttatgtagtgtatttttacatccatctttatatccgtattaaaaaaaaatacccatacttatttctatatcacacgtcaactaacaactttaatctttatgtttatatttgttgagtacttttatatctaaaatcatgcctgttatctatattttacttaaatataaaatcaataaaattaatacataaatatctgcagctaaattgaaatctattcttaattccttcaagcatgatctaaattaaatcatccaaacataattcaaaaccacaactttagaaacatagccttaaaccattcatgacataactttacattaatcaagcataagtcataatcatacaacgttagaaacaaaaaaaaaccatccaaacataaatctaacaataaacttctagaagaactaatcttcaaacttggaaatcatgttttagtactctccaatatctatcaaaattgatacattaacactaattagtttatatttatataatataaagttcaaagatcataaataaatatgttattttatcccatcatatatccatttccccatttctttttctatggcccggaagatatatagaatgtctttaacattgctggagaatgaatttttaacattaattaatgtaaaaaaaactattttagcatatctagattactgtacaataaaatcacaatacatttcatataataagggcataataccttatttagtcccttatcttattttttggatttagtttattccttcatcttttaaaaaatttattttaattctttattttaattaaaaagttcaaaataatttttccatccatttaatgttaacgttatt

SEQ ID NO: 3159 - DNA, 1311 bp, Glycine max
  Soy_ogl_4856 Gm15:1565890..1567200 Cluster 13
caaataaaatatgtttttttatgaggaaacaataaatatattataaagagtttgattcttaattatatagaaagagctagaacattttgtttaaagggacaatttattctaatgatctctatacttagacaatacctttcattatatatgatattactcctaaattatatatatttttaatatataactttttctaagaaaaaaaaatcaacttacactagtgtagctataaaaaaaacttacaccaatgtaaattatctcattattacataatttaatcattgttatatttttaggaagatttcttacatgataattataccaattttttatattatgtaatatataaaaaaaagttgacttttttctcgcaaattagacaaaaataacgtgatatcagttttgaaaattacaagttaaaattttaataataaagatactaagctagtaatttaacctaattttaatttactttgtgatacagttataaatgttcaattcttcaacaacaaaaaaaaaaaaaaaaaagacaaatactcaaatggcatacacacatattgaagtattgcaaataatatttttatcttttaaaaagtaaatttaaaattaacaatgatagatcctgtattattgtaatcctaaattaaaacgcatagagattagagacagggagcagagcaggtaacaataatatgatgcgtttcctagtgaccaaccggacctgactacagcagaaacacaaaacgcgaggcgtaccatcacactcatttaatttaataataatacatataactattaccttaagccaaaggctaacaagtgcattaagggtattaattaaagaatactgattaataagattccttaaattttacttttctagacaaataatacttatacaatcaccactttaaaatgaaaatattttttagcaaataatagtttagacttaaaatggtgtgattatttttgtgtttacacaaacataaaataaaactcatattgctgtataaaatttcattatatttatagccacttcaacaacaatataattttttttaatttttgaaaaatcttcattttgtgaattgagagaagattgtgagagtagtacatttttatttatttatttatgtaataaacaacttaacaattgtaccaaaaacaaaaacaatttaatcttataatctatgtatttttagtattatatactttctccaattttatttataagattcaaattagaaataatacttatcttatttatttttttataataatatttatcttttttataaaactcaattcata

SEQ ID NO: 3160 - DNA, 1035 bp, Glycine max
  Soy_ogl_5827 Gm17:40766001..40767035 Cluster 13
gcaatttagatttcaaattatctacttttcaattgttttcttccttcatattttttccacaagtcatttacttttcaattcacattttctctctcttttttctttaaatttatgtatttactttttgggcaatttacatatgctttcaaatttattttcttatccatttatatttcaagcattttactttaatttgaattatttaccattgtagttgtttaatttcaaattactaattttaaggcatttacacttatgtatgatattttcttttaaattaataattttaatttgaaatttatgttttttgtttttatttcttttagttttatctgacctaagtttataccttcttggttaaaattttacttttatttctcttttaatcttgatacccagtttgtccttcctatttttttgcattagtctccaaatttagaaaattaatattttttgtccaattcttaattttgcatatgttgactgttttattcaaatgttgagtaataatgtgttagtattgtgatgaaatgaaaataaccactaataattaaaaaatgatataattaattaaaatgtaaaaattgatacatttattttacattaattgaaaaataaatattgatgtcatgtgattaataaaataaaattgaaattccatgttacctttaaatttgtaatttctgttaatgtatgtaactttagatacaaagttacaacctaccttcattccaaaataagttacaacctacaatatatagcaatcacatcaagccttttctttttctctataattttttctcatttgttaaaccctgtagtattttgagactttatgaactaagtataaatgggtgagtcatttggggatatttgttcagttataacctactgatcacaccaataaaagttgttatgctataataactaactatttcaaccaagtattaggagcaaaagctttgccaaaatttttaatcaatcacaaaacgcatggttgagtaattgaatatagatacaagataatttaaaaga

SEQ ID NO: 3161 - DNA, 1060 bp, Glycine max
  Soy_ogl_5870 Gm18:1598101..1599160 Cluster 13
gatatatagtatgtgataaagggaaatgaaaggcatcaatgggtgtttgtaataaggtggcgtttatgtattatggtttcaaatttattaggatccacaccgataaattcagtaaattcttcattgaaaaaaataaaataaaggatcttaattccaaaagaaaatcagttataaaaaaatttgaaaaaattaaaacaattttgaactttattttgattataaaatattgtgtttctaagcatactatttatattatttggatgaatctaactcacttaattaaacaaagtacgtgaatggattattataattttttatttctatagataaattttttattaagatttgtttagtgataggaaggggttagataatttatataaggttttaggttcaatttatcattatacaaaaaaattagcttaattatttcaacattatatatataattatttttatttttctgtatagatgcatctcaaaaacatattttaaattaaagaagataatttttgttgttgtctcgattgtgatgataaaatattttcctaaaactaaagtagtttcattttttaatagtaattttttttcatttaacctttgacctatgttaacttggaaatctatactttaaagccatgtaaaaatttctcaatttatataagtgaatatttaataagaattgaaactagataaaataaaatctaatcaaaactgtgagcaagcaaattattataccaatatttaaatattctatattggatgtttgtaacaaaataaaattcttattttactaataaaaagtagatgagatagcaaaaagattaaaaaaagtaataaattataaagtttttaatttaaactaaaattgaggggcattcacggacaaaaaggtaaagggttagttgagaaagggagaaaggtcaatagtatagtttattaacgtattaatactttaaaataagtgtatgtatcttaacaaatcctattagcatttgttaatgtatacattaaaataatccataattatatcttattaacctatttaaattttaaaaaa

SEQ ID NO: 3162 - DNA, 1098 bp, Glycine max
  Soy_ogl_6315 Gm19:1138503..1139600 Cluster 13
taatggaaatgtatgtattattttatgaaataaaggaaaaaatattatcaaaatagagacttgatcatgatttattttagaatttggtagcattttacaaatttgaacaaagaagcctttcaattaagtatttgtgccactattacaattttatatttttttaacctaacaaaactattttttttctcaaaattaataatccttctataattttaacaattaatctcacagctttataattatacttataagcacattagtttgatgcgttcataacacagcaaatatataccaaggttgctcgtgggatgggatgtatgagtcaacacatttgaataaattattctgctttaattttattatgtatgtttatgcgtaggttaaatattacttttgatgtattaatattgctgtaattttgtatatatcaaacatattattagtaaatattgcttaattctttatttcaacaaattcaatgtatttatttctctaaactctaataacatatttttagtaaactttattcaatagttcgtttctactaaataaaaggaatcacatttaagattatttttttgacagacgtttaagataaaattgtaacatttattggatacatacaataaaattcaagtgaaaatttttatactctaacaattatctatgtatattttcacacaagttaaatattcgattcaattttaatatatatatacatgttaaatactttgctaattaatgtattaactttattgtagttctatatatttaataaaagtgaatcacatttgacataaaattgtcacattaattagataaaaaaaaataaagtaaaaattatcatatattttaggaaatgtttatgtctattttcacatttaaataaaaaaatctaggtaaagatgatcgaaacctatgattatcccatgcatcgcaagagtaaaaaatataatattttttaaaaataagtagttgtaaaagtaagtatatgaaagtatattcaaatgcactccttctatcaattgaaaatttcatatgtgtgctcataaaaaacatgtaactatataacatttatgagtttatttcatgagattt

SEQ ID NO: 3163 - DNA, 1685 bp, Glycine max
  Soy_ogl_6780 Gm20:36078816..36080500 Cluster 13
cgattgatataatagtaaagtagagtctaattccttattataaaatttacaccaccatcaaacacataggatagattaatgatacagtcattttagcataattaatatttttgtagttcttttttttgggtgttaagatccgtcaaatgaagaaaaaatgaatttaaatttattcttggatattctattgtattaaatatttagaaaattaatttgattgctcgaaataatctcgtctgacagtctagtggaaaatacttataagcctaaagtaaagaagtatataatttacacgtatgccaaccaatttttaagataatttataaaattgataaatttacatttgcaattagatagatttaattatatgaattaatagtgtaaaactttatatatatcaaatgtaaagttattcttttcatttatattgaaagtgtatataaataaaataaagactaaatgtgatttttcatcttttataatttaatattttttattttcctatattaagtttaaacggtatatttgatcattttttcagttttccgttaacactatttgttgttatgttcatccacttcctctgtactgcaccttttgctactctagttcccacaaaatcagaacctcttcatcctcctcgcaaccagatcaaagaaaaaatgaaaacccgcacatggatggtgtcaccacgaacctctttgtcctccccacaactatatttaatgtaaaataataagtaaataaatagataaccaagataagtaatgtgaagtaattttttaaagaaaaaataacacaaataattactttctcttaatgcaatgtgtcacttcttaatattcggtaaaatataaaataacacaaacatgtcggtatataattagattaggtgacagaggcattgaaatcctctaaaaagaagggtactgaaagaatggcaatttttttttaaaaaaaaaaaagatttaagtactgttttcacctttatataattagaaaataaaaaacaagtaaaaaaaatattattagagtagaatgaatggtttagagtttagacgaattccacctagcaaaaaaaattacaaacaaaactaaaaaaaaaatactaaattacaaagacgaaacaagtatttaaataatttattttcaaaattaacttatttaaaataaaaacgtgtaaagtgaaaaactaaagacatattctattcaaagttaatttaagcatattatatttaaatctactttaattcaacctaacgatgaataacgtctcactttattatgctacatatctcttcattttaaatatttaaattttgtttgtgagtttatttaattaactttgaaaataatagtcaaagaataaaaaaaatattttttccttaaaaaggttttatttaataatcaatattttaaatttatttttttatcatatatttgtgaagatttttgtattcaatattatacattaaaatgattaaatacatttatgtaagtaaaatacatattatcatgttgaatgtatagcccgtggatcgaataaattttgtattagtgataaaatatattttttattaattatgatattggtacgaaatagtttgaaataatttattttatactcatgattagatttattcttgtaacacttattaaataatacaaatcgtaattatttatat

SEQ ID NO: 3164 - DNA, 1050 bp, Glycine max
  Soy_ogl_6819 Gm20:37881081..37882130 Cluster 13
atgaaaatataaaaaaaatataatttaattaaattatattgttttatgcagttacttttcttataactacaaagaaattataagtttttaaaaattataattattattcaaatatatactattataattatgcagttccttttcttataactacaaagaaattattagttcaattttttttaaaaaaatatatactatttttggtcatcatatattacaaaaaaaaagattatttttgggatgattgagatgtaatttttttttatgaaagaaactaaaaagaaaaacttttgaaattagagaactaaaaataaataaatttacaacataaaaaatgacccaaatttaaggaaacaaaacatattcaagttttttcaccttaaataaacatttgatccctataaaataagggacgtttttattttagtcttttaacaatttttgtgttgattttagcatcacatgtaatatcaatttttttaaaattaaagaacatgtctgtatcttaacaaatagtgaaatgatcttattatgctttgatgggttaaggaacctgatagtgatttattttttagatattattataatatgtgtggaatcatattaagactcttgttcataatgcacaaattgttgctattggagttgaaaatcataaaaatgattaaacttcttaaaagtcattatctaaaagatttatatgtagtatttcatacgaatatctcatgatacaacaaaaacatcttaatggaactaaaattataaacacgcaaagataaacaataaaaaagaggaggaataaataataataataataacattaaaaaaatatgatcaaaaaccaagttagtgtttgaaacaaaaatgccaaagaaatatattatgtgtacctaggaaaggtttacatatggttggttggtatatatgtggtagttgactttttggcaattaattccctagagctttcacatgcacttgcttttgcttgtttacaatgtgcagtaactgaatgaatacacggcacaggtgttgtcgttggttggtttatgg

SEQ ID NO: 3165 - DNA, 1100 bp, Glycine max
  Soy_ogl_6925 Gm20:42088401..42089500 Cluster 13
ttattatttaacctttcacgatataaatatatttattggtaaactttgaaaaatataacaatgaatctagtcattaaatatattttcaccaacgttaagtttcattttcacttaatttgctagggtatcacctcctatatttctatatgacaaaaattactcattttgctaaatattctattgaacaacttattatgataattagttttagttttcaacctattttggttttataaaaaaaaaaagccatatgtttcaatgatatgaataaaaagaaagaaaattattaggaaaaggggtgaagtattcttctcccttctttcaaataaaatatatttgatccggaataaggatataggcaggcaaagagcttagaagactgcaaataaatgacaaaaattgaatgcagactcgtgcatcctaatggatgacttttttttttttttttcctgcaaattaagtgtttgacaacgatgaaagagaaggtgatagtttacttgcaaactaggggaaaagtcagatacaaaggacagtattctaatattattttattcaaagaaatagttgggtaagaggataatatgtttttctttatttctaaacttgattatgttaaatagctattattatatgggtaatatagaataaagatttagcaaataaaaaatactaaaaataatgtatactaataattttaaatgtttattttttaacaattttttatttttataattactacccttaaaacaacagttaatgatttttaaatgacaaattttcttctaaagatttttttctgttaaatatataaaaaaaagcttgatttgatgaaataaatttattactgtctatattatgtcaagtttttcttaatatatcactacttcttcacgaatgtcatatagagtgaaatttttgtcttatcattagttacttaattattttgtctttaaagaatgtgtaggcctttgaaaaaacttttatagaacttctgtagacttaaaaaatagtttagaatttctaaaaaataatttatttcaataatattttgatggaattattaaaataaactcattgcaacttatcttaataaatttgat

SEQ ID NO: 3166 - DNA, 1000 bp, Glycine max
  Soy_ogl_18 Gm01:1329801..1330800 Cluster 13
cattacggtctgtagatatagttgtgttcccattctgtaaatagctgtgtcctttaaagcaattcttaattgtgaacatggaaaagctttgttaagataaataaaattcattaaagtgatgcctatgtgtttgggtgaatgttttaagtgtcactcgattctttaacctaaaattttagatttaagtgttatggatgaaaaaatataattgaaaaagaaattttttattaaaaataacctttcaaatttttttacgaaaattaattattaatacaattaatagatatctcataccaatagtttgatataaaaaactatcaacacaggaatattcttgatatatacaaaaaaaaaaatccttttttgtgaaaaaacaaaatccctcaaagtgaaaaattccctttagatattgggtttatttccttttaagtgaaaaaatatataaagtgaaaagtaaaaaatagatgaagtactttagaatcttaattttttaaattaatatgttaaattgaattttagaggtcgtttgaaagagcttataaaatgaatttttgaatttaaaaaaacagtttaaaactctcataagttttttaaatgttattttaattaaaaaaatggtatgattaaaacaaaattttaagtttatgatacaattcctcgtattaaactatttttcaaattcacaaatgtttataagaaagaatggctgatgtaaaaactaatttaaaaatattattttattatttatttatactgtattatttatttaaaacggcaagtttaagtacaagcttgtgaatgactatacaataatgatgaaaaaaatatattccctctttttttatatattaactaaggaaaaggtgaaaaaaagagtagaaaataaagaaagtaaaaactccagtattagttttgaacctttgaaactactactgaatctatggaaagacaagaaacaacctgatgaactgaaatattaataatcacagaaaaaaaaaaa

SEQ ID NO: 3167 - DNA, 1026 bp, Glycine max
  Soy_ogl_1119 Gm03:47012445..47013470 Cluster 13
atattctactgacaaattaattattcatgctacttttttatttgaaaaacgattttcataaaaaaaatatttttgaatgttattcatagaaaatatcatgactcataatataactaagaatcaaactattttatagtaagcatctcattttctaggataaagtaacaaatattaatgataaaccaagaccaatatttcatacatatgcaaaataaatcacgcatgtaatattaactgtagaatttttattattaatgaatgagaatgtttatattaactttaaaggagctaaatcctactatgagaacaaaaacatacaagtgaataatgtggattttattattttgataccggatttactcatacatattacataactaaagataaaaaaacaactaagagcgtggaatttatttctatattctagcttaatttaaaaatttaatctcaattgatttttatcaattcttttctttttaccaaacagaccttaaaagatgtatatattaagtaaataaataaatatttttttattctctatatttttgtttgttcttatctttagtctttgatgtttcatattatttaatttaatttttgtattttattgaagacatatttttagtccctccttatatatatatatttttcatagatgatgttaattattggaaaatgagttattattagttattgttttcgtgcaacaacaatcttttcccacatacacattccttttgtcttgattttgaagaacacgctatcgatataaatatcgatgaaaaactatacgaactcataaatatgtaacatgaattgttaaaggatgcaggtggaatgaaatacttaaaaattagggtccaatgtgtttagggaaaacattttaatgacttttaaaaaaaaatccatgtcattataattaactttaaaaataaaaaaactcactattaattctaacagataaaattaatgtcttatatgaaaattatgtaaagggactaaaaatatatatttttaagtaaaata

SEQ ID NO: 3168 - DNA, 1132 bp, Glycine max
  Soy_ogl_1152 Gm04:922069..923200 Cluster 13
ttattaacgacgtagtaatatacttgtaatcaatttattagaaagaataaaatattacctgatccagttgattgagttgattctctagtttgacccactaataaaataatagtgccactgaatcgaaagtgccgtgcagaaattagacctgcctatttgcacgtgttgttattgttgttattttaaataaataaaaaatcgagtaagctatgaaagaaattagttggttgctaaattaataaaatgctcgaagcaagatcagaaaagtggtattatgactaaagtcattcaaaggccttttaccccctctataatgacgaattatataggttataaggttgtttgttggtgaagaaaaaaaaagagagaagttatatgtttaattttttttattaataacaaattaataattaatattcattaataaaatatatatattcgcttgacatataaaggcaaaaatccacattattaaagaatgatgataaatattttatttgagattacatattttttcatattatactctagtcgtttaatattactacgaatacttttataagataaaattgtaatattaaaatattaaataatcgtagtttcataccggtttatttgtattttaaaaattgtgcctctaatccttatatatttatgtgctcttttactctccttttttattcctcgaattagaaggaatgaatttttgtgtggacctattaatttttttctttgaaatccttttcgaagcttccaagcaatgaaaagggttaaaaattgttatgtttttttttttttcactcacaatcattcattagttctttcgtcaaaccaaactaatatgaaagaaagagtactttttatataaagacaaaaatattttttaagacgtttatgttattatatatatatatataatttttacacgatcagatagtagaaaataaattttgtgtttctttccttttggtttattattatctaccaaataacttagctagttatttcacttgttacctttttttttccttctattttcactttttttctctaaattaaacatacacattattaactaattaagactattctataatgagaattgtttaacaaaaaaaatattatttttgtg

SEQ ID NO: 3169 - DNA, 1200 bp, Glycine max
  Soy_ogl_1161 Gm04:1331201..1332400 Cluster 13
aatggaaaaaataaaataagaaaattatatttattttatttaccctataaaaaaaatctatcattatgatgctataaattaaatgaagaataagttttcaaggcatgtccaatttacactatacttaatgattatattacaaaaataatatgaaaatatttattttattaataagaatattaaatttaaaattagtaataagacgagaaaaataaaaatacgtaacaccaactttttatttaaacaaattaacaacaaaaaataagagacaattttttttttgtttgaaagtgaaaaaaatatatttaaataagaagacaatcaattttctccatatttatactatatacatatatgagaaatgataattagatgtatgtgtttttttattatttaaaagatctttcaatataattagatgtattgtatgctattttgataggcccattttggccacagcttgtgcttgaaattgaattttaacaaaatttatttgcttgtaaaaaaaaaatctctcaataaaagtgcccaatagcacttacaaaagctcaaaattaagtattaattgatagttaacctacaagtaagattgttaaaaagggcttggcttttgctattttacacctcgtaatttaccaaatataccttttctcttttttatatatattttaattaccaaaatatctttttttgtataaaaataaaaaaaaaactatatttttcgatccactttcattattttttaagccttatttttgaatcccatctttattctactttgaatcctaattttacacctcaatatttattattgtttaaacattaattttctacttcatctcatgattccttaaatttttttacatgtattttgtcctctctcttctattctctaccaaaataatagaattttatcataattttattcccattgaaaacaatgtttccaatcaaactcgatattgtgtgttttccattaatgtgatactgtgcatattccatcaattctacgctcaatattgtgagttgaaagatactatgcattgtgttttcatcaataagtaattacaacaattacttcatacaaagaaattaacttgaaatgagtggtgggcaagttataataaattattcatcaatttaaataaaaaaaatcattaattgtacacaaaatattcttattaattttcttttaaaatt

SEQ ID NO: 3170 - DNA, 1000 bp, Glycine max
  Soy_ogl_1392 Gm04:44272601..44273600 Cluster 13
tgtctagatgacaaaatcaacttcaatatctatgctgaagcccgtaataaaattcccaaaacttggaaataacccatttttaattcccattttgtgattacttttagtccttcataaaaacaaaaaaagggtaataggggactataaaattatatttaaattcgagagataaaaaataacttaagcacaaatttaagagattaaaaagatatttaaatctaaaaaataattcatcatttttaataatacttatttctaaatataccaaaaaagttaatataaaaaatatttcaattccatggtttgattagtttattagaaaaaatcgaaatgattgtgataacttgaaaaaaaaagggaaaaatagagtttccacatatttaccttaaaccctgagttaaaagaaacagaaaagtagactgaaatgctaattattttaattttaaagattttaggtccaatataattatttagtcctatattgatagttgataaattttttaataattatatgaattatcgaattcatttaatgatgtaaggaagtgccgttgtcgttctatgcctagtctaaaacaattttatgaaacattatattaaaaaaaaggtaagtggtcattatttcacacacgtatgaatttaatgtttataaattatacttctaattgtttttacatcatccatcaacaaaaaataaaaagttaaaagttagtaaaatttaatatatatgataattaataattaaatgataatataaaattattatgttttaagtgaattgttttgtattatctttacatagactaattgttctttttatatttaagattaaatgtattttaagtccttgtacatataaatcagtctaatttttagttcttgcaagctgtaaaagtttttgttaccattccaaaattttgagtgttttttctccccttatcattaactctatatgatttgttggatcaaatcttaatatattaatagacaattaatatac

SEQ ID NO: 3171 - DNA, 1324 bp, Glycine max
  Soy_ogl_1760 Gm06:1292377..1293700 Cluster 13
tattttaaaaaatacaatatcactctaaataaaaagaaagatcaatgaatcccttacgtcaattcatttcttttcactaccaagacattaaaatcccttacagttaatttgttttcgggatcaaaacattgaataacaggatgattaccttttattcaagagcaaattaaataagggatttcactttttataattttcttgttacgctactttttataaattgcttgtacatttaataactttagtttctaacttataaaaaatagtttttttttgcagatttaataacttagtttgaaaatatataactattaaaaaaatatataaaaaaaatcaacatccaatcatgtacatgaaatgaattgtttacttttttatcacgtggattctattttttatcgagtagttttgaatttactatttaataaaaactggcacactttttaattgaattatgtataacgttccctaaattcttaagattatttttttaatctttttatacgtggtaatcaaagttagataatagataatttataatacctcacattatgctcaataaataaattagactttttttttctttctttcttatttttcatcacattatatactatgttaattactatttttctccttttatctttttcttctttattgaaatatatactcttttaaaaatgaaaaacatgttttcttttctaaatttatataaaatcatattttacgtcaatgataattaatatatatttatcaatttttatgataacaggaaattttttgttttaattattttttttatcattcttcctttataattaattagtactttattttgtattctaattcttttaatggattataacgatttttatagcaaaaaagtatggcgtcttgtcttttgtgtccatcttcatcaattatgacaaaattggacctaccaaaattaataacatgatatggaaatgacaaaattgaaacaatatagaatatcgaaattaaataaaagtcaaaacatggaacaaataatgctataaaacaaaagtactaaaattatctttttaactaaaaagacgtatatcattgtcactgcgtaatcagagtgattacgaaaatatataccctttccttttaaaaggtaaaattaatattttaactatcttaactttatttttatttcatcagttcctatttttaacgtcatatttggataatttttaaaaatgtgccatagttcagtttatttttcgacttgttttttttaatatcttatgtgaaagtttgaaaaagtcctctaattatcttaaatatttttttgacatgt

SEQ ID NO: 3172 - DNA, 1100 bp, Glycine max
  Soy_ogl_1835 Gm06:7514801..7515900 Cluster 13
aagattaaggataacgcgttcgtccctatgcggaaccatgcattaattctaacgatagcagtatggggaaaggagcaactacaataaatgcttaactccatgctactccacattagtactactctctctctctctctctatatatatatatcttttcatgaaaatgttaacatcaatttttaatgtattatggcttaaatctacttttcgtttatgcatttttttaaagaatgataattatattaaatcaaacaggaataaagaatcaatacatgtaagacaatgattaaggaactccgggcaaacaaagaatctagacgatctagctaatgaatgaataacttaattgacttgttggtccttcaaagatttttataacatatttagttttttatgtttttaataattttggttaattattaatccattgttaatttttaacaaaaatgattgacgtgatatacaataataatatacatagacaataatatatatctatataacattaacaatattaatgtcgcacagttgtatttatattaatttatcacacatctattattttaacatattaatatcatgtcatcgttaatatgttacgttaatcatttttgttaaaaaattaacaacaaaataataatataataaaattttaaattttgaaggactaaaattacaaatccatgaaactacatgtaacaaaaaagtatatttaagtcatatattttttaacagtcattttaaaaagatgtcctatatatttgttattttaaaattttacgataacattaaaatttattttctcaattatattaaaaaatactaaaaataatcatacggagtatataaaataccaaagtaataaatgatatcttaaaaaattataaacgacttttacgagaaggagaaattaattacttttcttagggtattctaaccttaatctatatagtagtttttattaagaaagatatttttatagactttgataattccaatagtataaatgttttcaatagttttttttttttatcattttggatgcttataaatcagttttaagaaacaatattcatcaaaacattatctttatctatcaa

SEQ ID NO: 3173 - DNA, 1090 bp, Glycine max
  Soy_ogl_1863 Gm06:8647811..8648900 Cluster 13
gattattattgtattaaatttatgttataattttctgaaattatatttgctaatatattaaaaacaaagcttattgaccaagggttggatttaaaaattatgaagacttatgtaaattttattcttattttttagaatttaaaataattaattcatcctcattttctaaaatttttgaattataatattattaattatagtttttttgaataaattattaactaaatttttataattaagtaataatgtttacatttttactctgacaattcgtccattaaatcattactattttttaataaagatattttgaaattataattttagttttgaaaaacttgttataatattgcaattagtactttataagtatcgtattcattttatatataaaaaaaatcaacattttggtatagttaatatatacttttgataagacatcaatttgttttgttaacactttttccaacacctttaattctagggaaaagttatatcaggatcttcaatattaaatcaatgctcattaaatcttaattttttttggattaatatatttttcttttcaagtcatcctcaattagaagtttcaaatgttgtggttcgaaataaaattgaatgctgttatatattctaaataaaatgttaagaaaaatatttttcaataaaagaaagcaaattaatttaatagttatataaaagatgaagcatcatattattccaaaaataattttaaaagagctaatctttatctttaacctttattttcttgtaatttaatagttaaagataagtattagattaaggagaatgaaaaatgaagataaaaaataacttgatctctttgagtcggattctctccatgtatcatgatattccagtaggagagagagaaagattttacacgtccactataattgtgagctaactaacaaaatatttgatttgtcttgaaacaaccatggtttatgctgactaacatataaatttaggtgtagtaacttctaatttattttagaaagctaaatgttaaacaatgtctttgtgacattgattaaagaaccgaaatcagaaaattttattagaatac

SEQ ID NO: 3174 - DNA, 1060 bp, Glycine max
  Soy_ogl_2184 Gm07:4441601..4442660 Cluster 13
cttttctaattttgtaatttttcaatatattttaatcaataaaaaaagtgtgtacaaagaaatattttaaagaatatgttgctattgatctcattttaataatatcaataatggttatactcaacttgttaacaaatatttttatagtatatattatctaacaatggaatagaggcaaattctgttaacgttttttcccctctaattgttaagcattacgtacacaatataaaaagcagaaaagaacaagcagggaactttttttctgtgggtgtagaggaagacgactttttttctatagacgacttttttttataatgttttaaaaggaagtatagacgacttttattgttaactaatagtgatttccttattttgtattctaaaaattttaatatatgcggaaacggatcccctagacacttcttaataactttctccatgagttgctaactaatgactatatttctcattggttattcaactttattatacgctcattattcagttaaaaattacataaattacaaattaaaacaaaaaaggaccactttagtattttatttttttaagacccaatgttcaaacattacattggacaattatttaatttaaatcaaattaagtaagattattttaagtaaaaaaaattattcatacaaattgttaatgtaaggagttataaggttaatttaatgattataaatataaatgtatggattaaagaaagaaggaggaaatacctgaatttgaatctctcactaatattttaacaaaaaattaacaaataatattaactaataaaacattaaaaaatcataatgtaactataacttaattatccccactctcatcatggcatacatgctttaatttttttatgagatgtgtagtcttgtcttgtttgaatacacattattttttagtttgatacagttaataacttaagataatgtctctaaaaaaactttaaataatgaagcggctcactttatgttttcaattttgtgtgaagcatatataatatgcccttttttacagtgaaagcaacaatatgtaa

SEQ ID NO: 3175 - DNA, 1512 bp, Glycine max
  Soy_ogl_2235 Gm07:6433289..6434800 Cluster 13
tatattttttactttttcctcttcattttttatgcaaactttttttctctttatggaaatattatttttctctctctttttttccttcattcccaaacgcttgtgtttagaagagtgaaaaacttgagaaatgagataaagctataaatattttctttcgtttttttaagccaaaggtggggggagtaggagaggataaggccataaggaaacgacaccttgttttcgttcgaaaacttatcattttaaagcgagagataaattatcattttttgatcagtaattttttttatcagtcgagaaataaattacctgtccctctcttatatattttaataaaaattttatatccttaaacagtataatgtcaatttagtctttaaaataagtactgccagttaatttttttaatatcataaaaaatattattaatttttagaattggtataatcaattaatgtaatacctggcaagtgttgtatattttgttgatattttaaaaggctaatatttctatttaattaaacttagaaaatatttttttctttttaaattagtttactgtttattaaaaacaaatatttggtttgatttggtcatttagacagtatctcatcttatcatttaacttagtttgagaatatctacaatgcataacttcttaaattggttgctaatcttaattttatgggttttataatctcatataaatttaagtattttacgtaaaaaattcactttaatattaaaagctaataaagtaagagtttaacttaattttatgtcctgcacactcatccctttcaacatgatattaaaactcaaacctttcaacatgatattaaaactcaaatgaagtagcaatccatattggaaaaaaaaacataaaaaattgttcctttgaagacggaatcatttgggtcatttatcattcttaaaattcattttattcatttatcttttaaatttgagttaatttgatatttttgaaacaatgatcgttgtttttattttgagacatgattttgattttcttttttacttatttaatttgtgaaacttgaccaattaaatttacctatataaaaactatgaaattcactaatgtttaaactaaaaattattataagcacagtaaaaatcacataaaaaatgagtctcaagaacacttgaaagaaaattatatattgaatttttaaattttttgattgctcattaaactcatctttcacataatttttactatatttttggttcaaacatttgttgagttttattattttcacacaagtgaatctaatgagatgaattttatgtcttgaattagtaaaaaaaataaattccaaatcatgtttctaaatattaaaaaatcacaattttagaaggatcaaattgatttaaatttaaaagatatgaaccaaaaaagaatctttttttgaaagataaagataatatttttttgaaagaaatgacaaagatcatcttaaaaataagataaaaaaaaaccaaaag

SEQ ID NO: 3176 - DNA, 1005 bp, Glycine max
  Soy_ogl_2252 Gm07:7518896..7519900 Cluster 13
gatgaaggatactcaggagtattttacttactagaataggacaaaaatgtgctttatttaaataaaaaatgttacaatgattataagtgggcttgattttataaataaaaaataatgctacaaggatttataaaaatataaatatatttttagttcctatatttatcaaagtcgggtgtgattttaatctcttattaaagacaaaaaaaatgtgttttttttatcaaaatgtaagaactaaaacatataaaaattttaaagggactaaaactaatattctaaaatattttgagggtttaaaaacatattttataatttattttttgtaataatttttaattattcataaataattaacttgtattttttcatatttaaagagtattttattttgatccgtagaaattaaatatatcatgattttacaacagaactaaaccccttgatttaaagagtattgtatgtcatttattcttttgtatatattttttacggtgctataaattttaaatttttgaaacaaaaaaacttttggaaattttttattatatttattatatattttattcttttatttcacatatattgttagtaaaaaaagtaaaataagaattaaacaatcaaaagaatctaaattatatattgaaatagatatgttataaatttgaatacgcaagtcaattaaaaaatagaaaactcaccctccctactcttttaattagacattttcaatttttaatattttattccatcttttttgtgaatgtattttacacactattcttagtttctcacaaaactaaccattgaattttatctttatatttgttttatatggatctttatctttataatattttcaactatatatttgaccaatcaatccatgttatctctatctctatattgaattttattttttaaaagaaattgacaatagtttaaaaaacttttgtattacaacttaaattatttatctaaatataaaatataatttatatgttt

SEQ ID NO: 3177 - DNA, 1111 bp, Glycine max
  Soy_ogl_10 Gm08:3092190..3093300 Cluster 13
gctttggatgcagacaactgcctactacggcgacaaaaataaaatataaatagtaataaattaattgagacttagagaagtaaaagtcttaacttttaagttttgctaatatgcatagaatatatttatttgtttgtttatttctaacttcataatcgatatacttttaaaatttccgcaccaaaaaaaaaatctacatttttttaagatgttttttttttcgaaaatactcggtgcatattcattataaattttatcctaatccaaatcaaacgtctttgtcgaaaatttgaccttttgacgacagtcaccgtcatagttacaaaacaaattttcttatgaaagtgacagtgtgtagataatttcattaaatctcgcggaaaaaaatctattaattaaaagcaatatttattttagtgagaaaaatcacttttattattatatttaattatttaaaaagtaagttttatattttagatacaatatttttaatagtatttaatgacatttattaatatttgttttcttcttatttattgaaataaatagaaaaatataattgaattacctattctcaactttaaaatattataatcgatatattcaaaaagatattctttggttaagtagtttttgtttgtagttggtccaagtgaaattaagattcactccttaaagtaaagtttagagtttgaattttatatataaatttttattaataataattattcatatttttcactaaaaattagttatcaactttcctgcgatgtccctgtgaaaaaaaggtgtattaaagtttttaaaaacttatcacgatggaaaattttcgtttgcatatgattaggtttttcgtaaaaaattacttttatgttttaaattttgacctttcaactttttaatacgtttgtttatttttttctctttaaaaaaatataaaaaaaatctaattactttaagggacatatacaaaattgaaaattgtttttacaccattataaaatgacctttttctttcaaaagtctaaacagataggccctaatcatttcctcaacatgtgctaattattagtttgctgattttaaagtcaaatgtatttgatccattcat

SEQ ID NO: 3178 - DNA, 1106 bp, Glycine max
  Soy_ogl_3196 Gm09:39646595..39647700 Cluster 13
atcaaataataaggatattggctgtttattgacttaccaggtcattaatgagattaatgagtttgataggataaccgtatttaacttttttaaattatgtttttttgaagaaaaaaaatatttttaaatcttcatttattcaaactagtttacaacgtcaaactagttgattataaatttaaaacacattttatccaaaaaaaattatacatgattaatctattaaacttcttgatgacatgataaattaataaaaattggttgttagtatatcatatgatgttacttaacaatatatatgaactaaaaaaatctttaaaggattaaattataaaaaaataataaaaggactagataaaaaaaatcctgttttatagggatacgaaggttatttaagcttgattaaaattacttatttcagtctctaacaaattgattattttagaggatgatcaaagtttcgtaatagaatttccttttcttagtcaacacatttgaattatatattactgttaagagtgggcaactttgaattttgtcattgttttctgattcaccactaaactggtttgcatggttatactcacttttgaaaatcacatctgaccttaattcacattttttaaaaagtagacgtggacagacttttaaatgcaagttttacgaggggtagttgatcataattacgattttttctacacgctaacgtttatctcagataaattttaagtgattagcccagtggagtaataataataccaatagttaattttgctattaataattgagatttattattttatttttaaagtgattttttgactgattttttgaagtgttttagtcactttaaaaaagcaaatccaaattttacatatatacaatagtattagaaaagttttctcaatcgcgaaataggcatcaatttctctccttaaaatacatgtataaaaaaataggttttattcatgccttgttttttcttctttcttttttttaaaatgtttattcatattttgttagtaattgtatttgaaaaaaaaagttaaatatttattaagattagtttggattagcagtaaatagtagaacgatgagatattgag

SEQ ID NO: 3179 - DNA, 1109 bp, Glycine max
  Soy_ogl_3712 Gm11:3905192..3906300 Cluster 13
atgcactgaaattatatttttttataatgtagtaaccaaaattgtgaagaaaaattaaaagatcaaaattgtaaatagaaattaaaagaccaaaaattataattaataaaatatatttttagttccaatatttttttcatatattaaaaaattctcaatcttgcatatcacacaatttaattcctaaaatttataaaaaaaaaatatatttttaatctcttctcacaacctaaagtaaacaatatataaaaattaaaaaataagtcccatgactaaaaatatattttttatataaaattcaagatataagttacacgatatgaaatatgaaatttcagaaactaaaaataagatttaataaaaatataaaaactaaaaataagccttaaagaaatattatataaattacctatgttagagtcaaagataacaaaattcggtctaaaaccggaagcgcggtacggaagggggatggctactcacgagaaaggatcacactgactcaagggattatatgcaccgttatgcttatgctattgtatgaattaaaaattaacccaattataccagtgaatagtattagaaatttatttttctctctctctttctcttttttttttacaagagtattaaaaatgactgaagttaggttatgttagattttttttaagttagtaaagttaggttcagctttattattaattaatttgatttagatttgaattaagactttttttagtcttgagatacatacaattcttttttatgtaacttatatacttatttgatatgtgctattttattatttttatctggtctaatatatttaaaacttggttaatttacaattttacttgtcaatttctttagatttgaaataaataagaaaaaaaaagagttagtgaaaagaaataaagtaaaaattgtgcattgtttagatgaaatgagataaaaattattttatattctatctcccctaaatgagagacatttgtgtaagatttactactatttattcatttcacaatcttcttacatcaacaaggtttaaaatgtgaactattttgaccttaatggaaaaaaaagtgttaaaagatctataaaataat

SEQ ID NO: 3180 - DNA, 1100 bp, Glycine max
  Soy_ogl_3781 Gm11:7059401..7060500 Cluster 13
aacttattttgatttcggccaacattcaaagagtctaacatattaatgtattctacttattggacttagaatatgacccataaataagaaattttttatagaaaataattaatgaaagagacgtcttagattgattcttaaagatagggactgagcccagtttataaattgatttttataaaaatgatgggagtactaaccgttacgtctaaattcatatttaaatgaaatatagccatttttcatattaaaaaatagataattaaggattatttataatccagaaaaggacttaatattgtgagaatattttgggatttactgaaaagttgcaaaaataaataaattaatgaacacaaaataataaatatttcctccgttctcatttataatacctaaatttaaaattgtatttatttctctttataaaattcaatatataatgtttattacattaattagttttagagtagaaatgttactaattaaaaaaaagaatatattaacaaacaattactctaagaaagagaaatattaatgacagataattttgaaaaaaaattataaatttaaaataaacatattaatatcaactacattaacttaaccatttttaaaaataagataactaggtattataaatagaaacgaagagactattatgtaagaatgccgaattcgatgtattaagataaaaaaaaattaactagttaaatttaacatttaataacatcatgttttctaaaatatttttaagacaaaaatagtttgtattgataacgtcaaataataatgttacattaccatttatttataaattattaagtttgttaatttttataataatttataaaaaaatatttttataagttgataaataatgttagaagtttttactctggtcatacatcaccattgaacttcatttttaatactgttgataaaaccctaacatcaaagaaatgttcccaagctatttttataaatgatatcaatatttaaaataattattctttattagttgtattgaatataattttaaatattataataacactagtaactaataaaaaaaattaccaacaaaacttagaatggtg

SEQ ID NO: 3181 - DNA, 1106 bp, Glycine max
  Soy_ogl_4655 Gm14:4695201..4696306 Cluster 13
ttttatttcatcttttctatttctttctttttaaaccagacatgatgtataagaaaaaatgagtatctgtatctcttaaataatttctacagtctccatagccagcaaagtgcggaagtactcctaatctcctactatcatttttctcatttcttgtccctttcgtgctttttcttcttttgtaaaattatgatatttaatttgaatatatgattcctcgtgtccatctcagatttcaatttcaaagctccaactcaaagatcgcaaaaactatcacatcttttaaaaacatttattattataaattaataaattaatattaccttcatctcaaaataagttatattattttaggttattttatggagactaaaaaaactgttaaataaataaaaaatattaataattttatataattaatcttatcaaataaatgaaagatttaaaaattatagtaatatttattaaaatgttggtgaaaaagaatatttaatattatattgaaaagtaaaatataatacctattttgtaacagatttttttatgtaatatttattttacgacggaggaaatatcatgaataaacagctagtcacgggaagctacaacattacaaaccgagtaaattctaattctgtaacagtgcgaaactgaaaactcattaattattttgcgccactacacaaattgaaaatggaatctgactggcagatttaacttttaattaacaagatattttatttttcattatagtataaaaaatttacactattaattaataagaaattataataagtataatttttaactagatcttttaaatccttacaaaaaattgattttgtaaaggtcaattaaatgcgaatagtttaatgataaaaaaattaaataaaaatgtcgattgcttattaaaggattgtactattcaagtacaatgtgagtaaattgcttaaaaggggcgtggcataataacatttatttcggactcgcttaaaaactcaaagagaaattcttaaatgaatgtaattggagatgcctatatcataaaataaaataaaaattattattcgtgacaatatataattgagtgacgcgttcaatatatt

SEQ ID NO: 3182 - DNA, 1000 bp, Glycine max
  Soy_ogl_4683 Gm14:5483101..5484100 Cluster 13
taacaaatatctttaagaaaccttttttaattaaataacttattatttgcccactttttacgtatattatctgataatagtcaaaataattccattgatatttctttttcactttactggggggccaaaaaggccacctgatttcactaattttcaaatcaaaattctatttttcaaacataatataaatgtgaggtcatatcattttaagacatgtgtagttgtgacgaagcatggaattaaaaaaaatgttctaattagcacaaacattgggtagaatacataaagtctaacaaaagaatataatcggcgtgaatatttattaaattataagtttgagtctttatttaaagtgagataaatataaattttaaaaatttaaaataaaaaaaaattatgttttagtatgggataattttcaaaaaaattattaaattctttaacatttttataactatgcttttttttcctctcttttattcacaccaatgattttttctacatttctcttttttaaagaaaatatcactaaagtaactattagtagaattaaaaatcctatcatagatatctctgcatgattggatgacaatcttttttttttacgctaatagtttttttattttgctgctcactaatattttattttaattaaacttaaaaattatatatgtataatgtctctttatttatgtttattaatcttatcgtggaaggggaaggtggaagggcaaagcattggttaaaatatataaaaatgtttttttcttaataattaagctgatatatctgatgtaatgatattataatagagttaaatgtattatagcttcctaaaatatagtaatttttgtttttaatctttgtaatttttgttgttttttatctagcaacatccacgtcacctttttgccccgtaatgtgaacttgacattgaaacatgttttgggtcattgtaaaaataaattttatgttttatgttcacatgtaatagcaaatt

SEQ ID NO: 3183 - DNA, 1090 bp, Glycine max
  Soy_ogl_5204 Gm16:485111..486200 Cluster 13
ttaaacttgaggtcagagattgaatcaaaagatataattttatttcaattcatctacgtacttaatgatatacaacaacaatttgatttgaaagttcttgtataaaaattaatgaatgcccaaaaatcaatcatgattaaaaaaataaatagttacaaacaaaatccatgaataattttgacttatatatgtttattagtattaagtcagacaataattaagtctataaaaacctcaaaatcattggttaaattagaataattttacatcatggattgattgagacacttgatggtaaaattattatatttaagttaaaatttattataaattacaattaatttatacaattactagttaagggattttttaggggagttactagttaagggttgaaattgatcatccgagaaagtataataaaatttagacataaaattggaaataggtataacattgactataaaattgttagtttaacaaaataattattttttatgagagagttaatattaattgttaatttgttagtaggatgaattttctccttccttttctctttaatcataaatcaattttataacttttaacataacaatcataataaaacatgtcacgtttaataaattattattccaacctattattttgctcaaaagtaatgacaaatattcgtcaaaaattataaacacatataaaatagatatttttctctttaacatattttattttatattcaataatcaatcaaattcaaatattgaactacttacttaaaagatacaagccgttactatttacctccaccgtcattagtaaattttggtttctttaaatgtttttaaatacttttacagtataccccaatttaatttgagagttgtgttaagctatcatttttatttttattttttataaaaaaattctaattttccattcttaaattatttaaatttttaattaattattataaaatttttatataacaaaatttaaactaaataatattaaaaaaagcagggataaatgattcgattcaataccccgagctaacatttgtccgtctaagctaagcacataatccaacatc

SEQ ID NO: 3184 - DNA, 1100 bp, Glycine max
  Soy_ogl_5824 Gm17:40643601..40644700 Cluster 13
ttttggtccttacattttttgtaaattttacttgtagtctttaattagacaaattttttcatttttggtccatgtaattttcttttattaatagttttagtttatgttgttgagtaattataataattgatgatataatcaattttgttaacaatctgtaacttgtcaattcttaagaaatttgatgcgaataatcacatgtaatttttcagtaagttgtgttcttaattcagcaaactgtgttataaaatacttcatatacttagatcaattgatgatgtgaaacaaatttacataatattaaaaatatattttattaaaataaaattacacatatttatccaacaaattttctgatgtgacaagttactatactactaatatgaatatttattattaattaacattgttacttgatataataaagactaaaacagataacagtaaaaaagtatagaaaccaaaaataccaaaaaaattgtttagaaactaaaagtgaaatttgtaaaaatttagcaaacaaaaacataattaaccttatcctattttttgtctccaccaagaatattttttggatccgccactttagtcacgtttatttctatcactcctttttataaatcaattaatttagaaaaactaaaaatcaaataatataataaatttgttttgagaagattttggtcacgtttattttttaaaatacatatcaattagttttaaaaagctaaaaatcaaataatataatttcaattaagatttgatcatgtttattaccattattagtttgaaagttattataaatatatcaattttaataattaagactaatcaacagatatatgttgtattgaaagtataatcttgtttcacaaaagtttatattattttttaaaaaaatattaaattatcatggatttgaaactttttaaaagtataatatttgcttgatttttaaattattttatgagacaatagaataaaagtaaagaaaggaaagacagttattttttttagataaagtattttattagaggaatagaagagtgtttcataatgtacgagaatgagataacatatcatcagtaatataagaaaat

SEQ ID NO: 3185 - DNA, 1162 bp, Glycine max
  Soy_ogl_6157 Gm18:53570539..53571700 Cluster 13
ttcccaacaaaaaaatattatttttaactattgataatttattttaatttttttattgaagtttagtttagaaatagaaataaaagatgatagctagatcgaaaggtataaggctataagcaattaagaaaatttaatatacatacaaaaaaataaggcaatttgatatggttgagagagaaaaataattaattgcaaaaatagtatctgaaatgtttactataaaacagaaaaaaatattgaatcagttttattttttatttaaattctaaaatttaaaaatttggatatgaatgaacttaaacagtatattctattaatcttgatttatttttaaaattaaaaaatattgcaagaattggatacaaagaaaattgtactccgccaaaagtattaaattattttttaaaaaaattgcatatcttttcaaatacctgcatcacttttaaaatattattgacaaaatttgcaacaattattattgccgaaaaatgcagtaaaaaattattgctcaaaaatagacttttaatattaaaattacacacaaaagtcaaattttatttaagattatctatgtcgacaataaattgaatgaatttgttattttagacattaaaagtgaaatgttaagaaaattattaatagactttaataaatatttttgtagacaataagaaaaattaaaagaaaagttgattaactatataaaattaaaatataaaatttgccttaaaagttaaacctaaaaatttcgagacacaaccctttcaacgcaaaagatccacatgtgtgctgtggaacaaaatgactattttagtaggttggcttgtaactagatgagtgtattaagaatatttggctatcactttcccaatcatccaaacattttattattattttattagtataaaatatttattaattttgttgataattaatcattggaaaataatttaactaacctgatttagtgaattctttccttcctatcattttttttttcatttataaaacttgaagttaacattttgtttaaaaaaattaaatcaaatattactcaaactaatcacttattgatccaaagaattgtgtttgaatattgctggttgagattttcgaagcttcatgattaaattttgcttttcttcatttggcttcgtga

SEQ ID NO: 3186 - DNA, 1100 bp, Glycine max
  Soy_ogl_6519 Gm19:42773120..42774219 Cluster 13
tggatggtaaatacaatgtttttttttttatatattgcattggttattttctctcatttaccaagactaatctttttgagaaacaatcttatttaagaaatgatcgagaattaaaattattattttaacaaagattcaaacaattatcatctttcactactagacctaatctttgttgtcatatttgtcttatttcaaactataatgttgttttcttacgaatcaaattttcaaaaaatattatatctagatataatgttctcatcaacgtatttggttaatattttgtaattataaaaaactaaaacttatttaattaattttaaaaaagtggaagaaaaaaaatgtaaaagaatgaagtataaataggtaattattattatagaaagtaactttgattctcgtaagatatccatgttaaacatgagctcttgctactaaagtgtgagacttttgaagaggacatagtaatgaagacacttaacaaatttatatgttttttcttttaaaagcatctccaatgggttttttttagaagagtttcttatgcataacaacacatctatgtgacaggaaaaatttcctaaaaataaaatttgcattttttcaagaaattatttattaataataagaaataatagttttttgacacataataaagtgaaaataaaaaaaaatataagaatgtgagtttcttgaagtttcttactattaaaactaaattatatataaatttcttaaaatgacatgacacataaaatatcataagaattataaaaagtaatttaaaaaactcacttaagaaattctcattagatattctcatagatttgtctattgatcccaaatgaaaatatgggatcaaacaatcctatctttatacataaaaaaattaaataattattttattttaaattttatcattaatgcttgactgtcacatttaatgcattgtttttaatttctctctcatgatttatgtaataaacaaaatttatgcagactaaacccaagtgatttatgcattattttaaaattaaaactttataactactaattaaaagttagtaaataaaattaaactaaaatacataaatata

SEQ ID NO: 3187 - DNA, 1050 bp, Glycine max
  Soy_ogl_6551 Gm19:44115201..44116250 Cluster 13
attaattttttgttgaatttttttttaaaaaatattactattgtatcaactatacccttattaataattattaatttgatatgggtaatatgaaaacattaaagtccaagatttttatgtaccactaacaataaaaaaacataaatatttagaatattaaataaaaaactaataaaaaaatctttcatagaaattttaaaatatcttataaaaaggatcattaattctttctaaattataccttataataaaaatcagaggtaatattttattagtgttattagttaggccataactaaatttgaaaggttaatatgctgacttaacaaaataataaaataattatcacaaatccaaaataatttataagtacataagagtgattatttataaataatctaatatcaggcatggtataggcttattatactaacaatgaaaatagattaaatctgcctaaagtttaaaaattaataagaaacaagctaattggagaaaattaatagcatataggtatgtaaagaaagttttagatttgagttgtgaattaaaaaatatagttgaaagaaaaaatttattaaaaataattaattaaatttttggatgaagattaaccattaataaaattaatggatacttaatgtaaatattatgagttattgcttaggtaattattacggaagataatgcatttattgccttgtattattgtcaacctatatgtacacatgactttactttctgactgaaaaaacaagacagggagagagaggctgtataattatcttatatatgttattcactctctcacaggtcccacatatatataacaagaaaatcttcgtctttctgtcattgtttatgagaaaattaactagatcgactgtatatttatgttaccaaaaagatcgacggtatatttattgagtttcaacgtggttatttttttagacttaaattcaaaatccctaattaaattagaataaaaccattttttacgtataatcccatacttatggacataaatccttgataataagagccggcctc

SEQ ID NO: 3188 - DNA, 1300 bp, Glycine max
  Soy_ogl_6615 Gm19:47585501..47586800 Cluster 13
tatataaataggaaacatttttcttttatgtattagctggtgcaaggggtgtgaattcgtgccaatattgtatattgggagcacacctattcttaatataaggtaacgtttaacttgagtatttattttcttttttcaatttttgaaaataatttttattttcaagattttaaaaatatttatcaaaaataaaactctaaagtgtcactatgtttttacttgttcagaaaatattaaaaacgttaattttttattttcaattttaggcctatttcttaaaatattattagagataatgtattttcaattttcaaacatattttattattattttctgttttctttaaaaataaaatcagaaaacacttaaatcaagtgtcatctaaggaatacatgtttttgttttgtgttgggagtcacaccccttaatgtcacaataaagacacgtgtaagtacaataaaaacgtatttttattatgtagttatatatatttaacctgaaacctcaaacagaccgagaaatacttgaatcattctcaattaatcatcaatcaattccattaaagtattatgataaaattgataaattgatataacaataaacaagagttaaagagttaaaatgattctgttaaaatattaaaatgcagcttattgacacataaagagttaaaatgttctatatggcctaaatattaaatttcccatgaacaaacatcatcatgatagtatctatgccactgcggtacaacaagaagcagtcgagcctcatccttcaaataaacctttccaaacaaaattagaaagctacatattacgagagtaaattacactaattattatctttgaagttttgtaaaattacatatgtttttatgtcttaacatttatagcaactttccttagggaggaacatgatttaatatttttcaaataattaaggaaatcagtataatatataataattatcgatgtaatattttttaaacaaataagagaagttagtttataagtaaaaaggtaaggaaaacttgtgtaatttttataattttacaaaattttaagagtaattaatgtaatttactccttattataagaaggctcctattttttcccctcttgttgtttaaattttgtgtaattctgtcttttaccatctttaaaatatgtataaagttgcaaagttattaccaaataaaaaactattatttattggttaaattattattttttagattcttaatttatttatcaggggtaatttgatcttttatttttaaaagtttcaattaaattaatt

SEQ ID NO: 3189 - DNA, 1305 bp, Glycine max
  Soy_ogl_6935 Gm20:42447159..42448463 Cluster 13
tatcttaaaaaatacttaataatatttaaaatgtaatataaaccatttgacatactaaattgagtattcttccagctatatataatattatctctttaattaaattgaattcttccgataatatttctctcttcactactataactctcaaatataaaataaataaaagactgaatcaggactaattttaagcaaaaaaaaataatggattaaaaaaggataatttttttaaaaagaatatgaatattcgtgaaaaattaatgaaagattaaaatttgtccaaaaaaaaattaagaaactaaatatttgaatatgaaaaacttgaagcactaaaaaaataattaatcctatttttgtatattaaaaggaaggagttaaactcttatgtatatgtgagagtttataacaactgatgagctaaactttttttatcatttcttttattaatggaacaagtttaaccagtttgatttaacttaaaatttgacaaataattacatttctttttcacataaaggttttctcaaaaaggttaaaagatattattatttcttcaaaataaaatacaataaaaatgaatatacttatttgaatatgtatactgtcttcaaaattatttaataatatttaaaaatttatataaactatttgacctctttaatcgactaaatttgttccatgtgaactataattacaatagtcagccacatcaatctctttaattttattgaattcttccatgcaagctataaatacaacaacattcctctcttcaccactataagtcctgaagtcttttcgtccagtgcaggaaacaactcacaccttcaaaccatgaccatctccaaggctctactaactccattcctcattttttcatcctaaatatcgtggaatcagatataatgatatcacttttcgttagtttattgttatagtttttttcccatttcaaacaaatcctgattatatgtttaaattatgttggcttcaatcttttatttttcttgaccaaccttcgaaatagagtattaatgtgcttttctttaaatatcaggcacctgcgaccttggcgaacaaaccaagttccaacttttccctgtcaaatattggtacaaattcctatagtaaatacggtatagattggatatttcaataaaatgaaaatttgaattttttattaatctctcggattataaaactttattcaatttggtgtttttgagaaaaataatttatatactttcatgcgatcacaaatgatatatttgatgaatttgttaatttttaaaataattattttaa

SEQ ID NO: 3190 - DNA, 1391 bp, Glycine max
  Soy_ogl_13 Gm01:928210..929600 Cluster 13
aacataaaatattttatgccaatatggtttcatcatataagtttttaagcataatttatatattttgcaaaattaccatctcaatgcaaataatatttactattttaatttcaaaactcagagaaaaaaaatataaatgcatgttaaaaaaactcaataaatcttggctaaaatatttttcttaattaaattaaactatacaattttaatgtaaataaattcaatttttgtaatgcaaataatatcgctgcaaacaatctttcttaagtttcttgcaatgaatcacaagatgtgtgttgctatgatagaaaggtgtcatttacacatgttaatgctcctcatattttttagacacttcataggaaggaacacattttaggtaacacattagaagttacaaccaaaaagagaaagaaaatagatttctaggtgcagaagaaagaaaacttcttttatagttcgaaaagggtcagataattaatttccgtaaagtgtaatgaagttgttaaaataattaacagtaaacaatcgttagttaatatgtttaaattaaagaggcaataaaatcaattaatataatatctaaaaagtcaattaaataaactataatacaatttaaattcgataataaaaaaagatcaaaatatgacattaaacccattaacacgaaaaatattccaagtttaaaacggtaactagaaaatctcgtaagtccaaataagctcaaaatatgattctgaaaatattatgataaaactgtaataaaaaaattcaaattaattgagtaaaaaggggagaatatgataatttgcactgcatcataaaatagtataacaaatatttatagtttggtaatatttatactaacgctttatttttattagaaggaaacttttgtttgttaatggagtaactaaagcccaaaagaagatggtccagttggtaaagaatgagttgatatctcattaaaacatgattgcagttgatgttacaaccccaagccttactttgaaccagaaagaaaaaagagaaaacaaacgcgtgacgattcatgcatgcatgatcactgtataaataacaaaattgtaataaaaaatttaaatattagaattatcttaaccttaaaatcaaactgctaacatccaaatataaataataagaataatatcctaatttgtatctaaaatatatcataggaattaaaaacataaacaagattaatttcagcagagacatattcttattttcttttctgcacagctacttcttttctttactatcttcattgttattttcagaagagctggattcagctagcagggcatcccattttttcatggttgccttcagggcacgagtcttctctttgatcagatcattatatctctttt

SEQ ID NO: 3191 - DNA, 1059 bp, Glycine max
  Soy_ogl_365 Gm02:3908742..3909800 Cluster 13
agataaattatcattagtctcagttcctaagcgtaattattttaatatctcataacataacttaattaaatactcatgtagcaaattccatccactatagtaatgatgaatttgggtcgtaccgttaatttaagaaattttataaatacaaaaataaaacatgattattttattaaataaattattcttccacatataaactttagtgaaatcttatattactattgaacactctaaattaaaatgaaaattatataaattagcgactgaatcaatttttttataagattaaaaattaaatttaactaatattaatttgagtgatactgaattaaaaaaaacaataattgataagaagtgaacaataattaaatataactcttcttctgacggtagtcgatgtagagccactgtccactgttttcacccatctgcaacgcttcaacttcctgcaactcttcataactacgaaatggctggttttggttatgtgtttttttatgcctttgtttcttttgtcccttcagagtgatgatctggttgtataattgtacgtgtacccgtgcgcagcaagaaacatttcctccaaaagcgaaacgttattatagtatagaataatcacacgtcatacgcaacccacccatcaacagcaaataattaaaaaactaaatatatatctctttctttaaaatcattagtttttttttatctacctttaaaaccatttagttacagtaatagtaaatatatgtacacaagaaaaagtaataaaaaatatatagtagtatgtgatacttttgatttcagtttctgaaataaccagaaatatatgcataaaaaagaattttattgataaaagtaatgttttagtgatctttattatttttcagagaagttatcaatcaaagaatattttttacacctacaaaaaaagatcaatttttgaaaataaagtgatcttttaatataatttattttacattaaaatggttcccctatataatttaatgtcaaattttgatattaaaaagtaagtttactttagagattattaaagga

SEQ ID NO: 3192 - DNA, 1509 bp, Glycine max
  Soy_ogl_1049 Gm03:42633192..42634700 Cluster 13
ttaagaaaaaaaagtaaggatagtttttttaaggactaaaaatcagtaaaaaaattaaagaactaaaaataaataagaaaaagttcaagaactaaaaataattttaaaaaaaaattaaagactaaaaaggtaatattttttttctattgtaaaagatctactcccataacttagtgcatgtttgtttgaattgaagttataaatattatatgcacgttttaatataaatttaatgaataaaaataaaataaaatcaaaagtaatgctctttatcctttaataaaattacttttgcccttaaaaatatttttttacctaaaaactaaacatgcaattactacttactaatatccaagtttactcatttttatgaatgaatggtgcaaatgaaaatattataaaaaaaattgaaaaaagaaatattataattatcatcattgaatatttcccgtcacgccaagcaaaacagcttgagcgagcctggctttactttctttctagaagttttcactattcttacgatttaggtcgaattaagaagacaaattatttttggttttggagtcaccggagtcaaagcacgttgagatacacatacacacaattagatatttctctaggcccaattacccaaagctgccattgtctgtttcctataaggatggaagcttcatcttaatcttcaccaattagcttctagaagcaattatagtttttattttatttttgacagttagaaacaattatagttgaatgtaataaattatcctttctcttcgggaaaaataaaaaaagaaagcctcccttctctttctttgcttattcatgaaggatagctaattatctatcatgtctcatttcaactatacattagagaaattttaaatacttctggtgtttcaaccgttcttagttctagtattattttgtatttaaaattaaatttttgctctaataatatatgcaataaaaaattttaagcattaactatagaaatataactttaattttcattaaagattaatactcaaaatgtctagactaaatttaaattctatttaattttaattttttttttgtcaaatcaaactctatttacaaatgatcttaaattcatacgtattaactaattacaaatcatcttaaatgcatattttaaagtaaaaattacaaaaacaaataaataaaaaatcttaccctacataccaaattataattgaataacaaagtacaaaaaaaaaaacttttacattatcagtatagttgaattaaattcatacgtatatatgaacaaatgttagtcattttaagtttcttattttcaacactacatcatgttacattttttttttttgctgaattcacatcatgttacatatctaaaagatcaaaatcctcatcttaatacacatttcaatcatgcccaggaagtgagaacttcaccttcgaagggtttatgatgttatgttgatatcacgatttcatgatattagtttagctcaagttgcc

SEQ ID NO: 3193 - DNA, 1261 bp, Glycine max
  Soy_ogl_1058 Gm03:42937440..42938700 Cluster 13
gcaaaaagaaaacatatagtctttttctcttactttcgctaacggcatcgccaatatttccgaccgattccacactgtataaaaaaatcttccattagacttgctttccactttgaaatcacttgattattatttcgtgtaagcgtcgcattccggaaacacaatgatcgatcgagtcaaatggatgagtgcaatccaaagccaatattaactaaacttttacgttatccatataatttgatcactttggtcagtttggtaattcataatttattatttgcaagctgggtgggtacgagacttatacttacgtcattactaaaaacaactttgggttaaaatataattgtggtttttttttaatatgttattttagttttttattttttaattgaaatattttatttcttattttaaaaaaatcttgtaattttagtctttttattttttaagtgagacatttttaaaaaatatgttattttaatccctttgatcaaatttttgttttttaattaggatattttgtcttttaaaagttattttgaagaaaccaagaaatacaataaattttattgattttaataaaataattgtgaagtttcaaatttcatccctttgtctttccactttatagtaaatacatgcctaaattaattaaagataagaaaataaataaggatataattgataaaagagtagttaatgttatatattaaattttgccaacaatggataaataggaacaaaagttcttccaaactttgagaattaaaaaggaatagaaggaataataaattaagcttgttagtaattaaataatttaaaaaaatattttcatatgaataataaataaatatatgtcaatcaacctttaaggagtatataaattaatacttgaaattagtcacaaaaacaaaaattacatattttttaaaaaagtgggagacaaaatatcttaattaaaaaataggaattaaaatcacaaattttttaaaaatgaggcatgaaatgtctcaattaaaaaatgaaggaaataaaattacgaattttaaaaaataggtggaggaaaaatacaatctagccgagatgctattaataaaagaaagaaaacaaagcttaattagtaaattatatttggttttaaatgcgacttcaataaagaagactccacaaaaaaaaaaaaaaaaaacaaagcttaattagtaaattatatttggttttaaatgctgcgacttcaataaatttcactcctttgttttta

SEQ ID NO: 3194 - DNA, 1343 bp, Glycine max
  Soy_ogl_1076 Gm03:43955158..43956500 Cluster 13
ttttacttcgttatttaaaaaatgttattacatgaccacagtgacgttccatatatgatcaaaagaaagcaaaaagtaatggaaataacatatttcgttgaaaaagtttaaatgcaactttgaattttttattttgtttaaactgcagttttaattttaaaatagaaatatttcatcctttattttcacaaaatcctcaattttttttatcaaactctaatttttacttacatttattttttaatttaaaaaatataaaaaatgttaatatcgacataagtctttaaaaaaaattataagggtaaaacctcaatttaattcctgaaatatgatacactgtcactttatataattcctagaattaacaaaattaaatagaatcttcaagttgtagtgtgttaattattttagtgcaaagttacatgatttaggttataatattaatatatttagagactaaaagtataataaataattaaatttaaaaagttaaaattaatgcagtaaaaaaaacttgaattaaatgatttactgttttagagacgcctttttttaattatttcatgcaatctaaagattaatggaagaacaaaacaattttcaagaattaaattggcgatttagtcatttattaatgtaatattacagttagatgtctgcacgaatatctgctgcttcaaattcaatcggccccaggcttgtctttaaaaggtcatttggagttattatctgtattttgttgaaccaattacaaaaattcttttagcaaaagctgaagaattatatgacattttatattccaaatccaaacaaaagttgtggatagcattaaccccgttcgaagttgcagatcaccaaacatccacctactaatcttctttgagcggtggttgtggcttgtttgtttgattaaccgagattatcaatttataaccacatgagtcactatttatttttacgtgacgaaagtttatttatataaaaaaaaatcattattgagcttttcaaagtcctatagtagaactttatataataaaaaaataatctgtgaacacgtaacacgtaagagaaagaatgaggtatatcaaaaggggtttgcactattatagtgtctagcatggttataaaaaaaactattatagtgtataaaaaaaatataactcttaagtgaagtttgttttaaggataatttttttaattctgaaaatattttttttctgaaaatataatataggacgaatgtgatttctcaatattattaaaaaatgtattttgttaactattaaaattgattgagattatttttatattttcaagaatgactaaaacatatgtttagttga

SEQ ID NO: 3195 - DNA, 1100 bp, Glycine max
  Soy_ogl_1396 Gm04:44359901..44361000 Cluster 13
tattcttttacataaatgagaaacataatcgttgcatatagatggagaatttggtgggtcaagtcgtcgtctaagatgactcattttattagtgtgggtttggaaattttcctacatcaacagcttgtatagaatatttggattgatgaatgttttgcttcatataactttcatttgatatttttgtaacgttggtttttatttttatttttttggtttaattttgatattgttaacaccttttatagaaattaaatgtcatatattttacgccaatataatatatttcccgaaaattaatgatgtatggttttttgcagaaattaaatgtcatatattttacgccaatataatatatttcctagaaattaaattaaatgtcatatattttacgtcaattataatgtgttgtcagcattggaatttttttgcagcataagttttataaattatatatatttattttatttgtttttaaaatagcatatttattttatttgttatttattatggtttaggactcttagatgatatcataataaataatgaatttcgattatgggtatgcttgactatacatgtatataaaatcatttatttctctccgttaattaatttatatacaacatgctataattttgaatcttcaacgaaatgacatttatgtttcttatagaaaaaatatattattttggtgttttttttttgtattttttcaacttagacatttttagttctatttatatgcctttgattaaacgttaaaaatgtacttacgctttgcttattttagtgaaaatgcaaaaagataaaatttaaagcagataaattagataaaaaaaatgtggtacttaacctctttggaagagtccttttttttaaaaaaataatctttggaagaggataaaaacgaagaaaaagaaaactttatataacattgaggccaccaaataaatatttcgtcccttgggcctcgtctgaacaagtcaacaaggtcaacagacttagatgcgaaacaatatagaaggttttgtttcccaaccctttaatttagccgtgtaatcaaatgcaaacactaaattaacatcaagaagcctgca

SEQ ID NO: 3196 - DNA, 1048 bp, Glycine max
  Soy_ogl_1461 Gm04:47264101..47265148 Cluster 13
ataaattttgatttgatcttgcttataaaaaaatgacttgatcttaaataattgaatgtgccaataaaagcatataaattttagataagataatgagctctttccgacgcatattaattcaaatgataaagatttttaatgttttttaatctttcagttcgaatcttataaataaaataaataagcattaaaagaattttatccgttttaaacaagctcatccagttcaatttaaattatttggcatttaatataacttttaaatatcacgaatctaaaaaatacaacaacggattcaatataagctgttatataaataggctttttaggtcaaatcgtgccttaaaaagagacctattgttagttaaatgaattaatttaattttttctcttaaaaaattgaatataaactttaaatttatagattatgttaaattatattgttaaagataaattcttacctattacacccttaattgttgtattaaattattagtacacattatattgaacaaagtttttggtgtatggatctttctcaatactttgtgtgtacttttcctcttactgaaaatttccaagaaaggatacatacttttgaaacttccgcttaggttttgaatgccggattataaagaagttttggcaagtttgacttccttaacactgttgaatatttcatctagttatatatgttgcaactaaggtttgtcaaattatgacttatactaatatatgtttagattcatgtgaatctaattgaaatcaagtctccatcctttcaatggaagataagaataattggctttgaaaagaatacatgtaactagaaaaatcatgactataaaattgttagcgttggagaagcttaaatatataaggacttccatcaactagttgaaagtatagttgcaataagaggacaaatgaaatcatattttcatattggagtggaaaggtgagcaagataggtattagtaggagacaaatagttatgtgtactcagactcattattgtcttcgtccctaatttaagaagtcgtataac

SEQ ID NO: 3197 - DNA, 1000 bp, Glycine max
  Soy_ogl_2264 Gm07:7912201..7913200 Cluster 13
aatgttatatggattttgccaacaacattaattgattattgtcctgatgtgtatttcaattgaaaatcctaccacatatcttagttatttgtaattttgtattacagttttggttttctataaagatcataaggtatttttgaagcttgcggtatgaaaaccccatgcagaaatatttgcatactggtaacgaagtactcataataacatctaaattcatgtttttttccttgacaacaagatatttcacaatcgaaagtcatgagattaattttttgaaaaaaaaaataccagttaagaaaaaatttctctctccacaagtgcgactgtatttgtacaatcaggaatccgcttacaggacttcatctacttgttccttgcatcacattttgcgggagcatctaaattcgtatactatactaaaatcttcttacataaagtaaaatctgcctcagtacatacgttccaactttgtctatgacattatagtttatagactaataaaagttcttgtaacgtaaatattatttatttattttggtctgacattttcagtacgtgattgaattagtttattttaaaaaataactaatttttttcatatttcataaaaataattttaaaaaattattatttcctaaaagaaagtttaaagaagtaacttttttgttgtaaaacgcgtacttatgtagtgttacttaaaatgttaacaatatattgtttaaaatatattcttagaagttaaaagttgattaggcttgcactattaataaggtgggggaggagggaaatgatttttttatttaaaaaaaagatgtgaatataggtaattcgggtattacaaaaaattcaaaacaattatggagtatgaagagtaaaaaaggaagtatgtataacaatgccctaaaacatccgcatataatatacagatgggccaattctaatgtgtatcgcgtcttaatttggctatgggtcgatccaatggtattagaaatgggtt

SEQ ID NO: 3198 - DNA, 1037 bp, Glycine max
  Soy_ogl_2507 Gm08:4820064..4821100 Cluster 13
tataaagttggtgactaatttttttaaaaaatatgactgattatttttttaaggtaatcgaattaaattccattcaaatcaacaccttattagtagaaaattatttaatttagttaaacaataaacatgtcctaatttttatttatatatataaattaaaactatcaattgctattaatatttttctattttttaattgtttgctagtataattaattaatagtattttaatctaaaagtaattaatgcatataatattacgggttgatcaccttgtgaaaaagaacatgtaccaattctaatttgcagttggtaaacatgaatgaggatagtaatttttttcttcggttgttatattaagattttacttgctatctcttaagaaaaataatttaatatatattattgagtcttttttttacaggaatattattgatccgatcttacaaataagaaaatgttctttcaatattttattttttctttattttttatacttgagagaggcttatgtataaatatttgaaggggcagaataatgccacctggacaacataaatacttatgttcttaaacacaattaaaaaatatttgatacaaaacattacaccacttgtatatgtaaaaaagattgctacttcataatctatgagatttaagattgctactttatatttttttatataaaattccttatattaggactgtattgtaattttcttattaagaaaacataacattatacattgcatataaaataaaaattaaaaaaaaaatcggggaaaggagacatggctcccttctaatacatgcgataatgaccaaaaaatcttcgtccaagttatattgaacttaatcaactcaaataagatttcaaattaaagttttatggataaaaaaaatgtaattaaaaaaaatcttactaaaagtgattaatcaaattcttcaataaagattaataatcaactttatagataaatattaagtatcaataacatcttataaaaaaaatacatgagatatgatattaacgtggg

SEQ ID NO: 3199 - DNA, 1100 bp, Glycine max
  Soy_ogl_2922 Gm09:918801..919900 Cluster 13
aatattgggttcaaccatacaaattgaatcattgaattttattttttttacacaattgagttcaattctaatcaaactaatgaaatataatctttattgtttcattcttgacatatcttttttataattgaaccaactcaaattaaacttatacttctataatatatttttatacttcttttaggatttgagaaatcctccttcatttaataaatatattctatttaatatttttaatccaataactattattaaatttttatatatgatatatttatgtattttgtatgacatattgtttttattttttcataatttttaattcggtaaagattgtcaactggtgacgtgaataaaacaatccccttttaattgaaatgatttgagtttgtttaaaaaaaaaaaaaagttttccaaatacaaatcaaattgagtttggttcaatagacaacccgaaataagcttttaggaattacccaccaatagcattaagtcttagagagagaccaaattctagccaacaaatgcacaaggccaattcatttagtcgaaattgtatttctacacaacagttgttattttatcattaaatattaggagtaatagactacaaggagttaataatcccaaatgattatatactaccttattaatgggataaatgaccgttctgtacaatcaataaaatagcaatttgataataaacacatggaaaatacaaatgctcaaaaacaaaaaggattagaatgattagatctcacaatcttgaagaatgtgattttgattaaccttaaactagaagaagaaaaaaaggttcggctcctcgtggaagttatgagaatgcaaaaacaaagaaaataaactaagagaagagagaaatagaaattaaccctacccatcaagaaataaaatgatctcttgggagtttctcaacttttatcataaataggatttctaaatcgagcctaaaatttaaaataaatataagggttcaaaagaattctaaaataaaataaaaccaagagtccctaaatgaagcctagctaaaacaaaataaaatctaaagtaaaatatcctaattagtttttttagatagtaca

SEQ ID NO: 3200 - DNA, 1144 bp, Glycine max
  Soy_ogl_3460 Gm10:39831801..39832944 Cluster 13
ttagaatatataatctcataaatattattcaaacaccttatcattatcattagaccttattttactattcatattctattaataaattataatagaaaattagttgtaaggtttatagcttcttttttttatatataaattactttttattttatctatttgtattagtaatgtaacatgtggtgggtcaattagaatttgttttctttaaagtgaagggagtgtacttaatctacataataaagtgcactcataatcattgattataaaataaatgattaacattgtaattaattttagaatttattatatatgtattaaggcttaaataaccttttgtccttatacattaattaaataagagattttttattttagtcatttaaagaatattgttttaaatttattttttaaaaaaacattttacgtaaaatttagctcaattagttgagcatcatatcaatattataatttttttgtattgtgtttaattccatgaataaaaaaatgttttcattttagttcctacaccaagtaatatcatttactttagtggtctctacatcatctatccaaaatgactaataacatgatgctaattgatgagaaatctaaaaaataaattaacaaaaaacacttaagcgtcaaacttcttaattccttaatgatgtgagaaatcaataaattagcattcttaaaattaaaagaaatagagaattaaaagaactttaaagaactaaaaaacacccaattttgtagaaataaaaggttatttaactattgaatttattatagttcttaatttttaattttctaattaaccattgtaagcacattttattccttaatgtacacattcaatttggaaattaaaattctgattaattcaaacctagtttttaattttttttacaaataaatgtaagcacatattattttaaaatataaatgtatagtttgcttctttatctttattcattttccatttaattgtaacaaaatttcatattggcaattttttttaaaaggacatatttgctatcttattcatacatttcctctgtttcttatggttagatttttggataatttttgtttttgtttatctgtcgtttacaaagcttaaaatcacatcaataactct

SEQ ID NO: 3201 - DNA, 1059 bp, Glycine max
  Soy_ogl_33 Gm11:5308601..5309659 Cluster 13
atgctgtaataatttgaacttgaatttaattgtcaaaattgattcaaatgaatgaacatgatcggcaaaataaaacctctttgtgagagaggaaagataattggttgggagtaaagattaaaaaatttaattattactttattcttcacacaatgtactttttttacacaacacaatatacttattttaagaataagataaattattatattttatatgagagcagaaacatcttaataacaaaacaacgttttattctttttattttattaattaaaaagtagaggaaaaacataattcttcttctttttttttttttgaaattttacatttttaatttgattagaaaagaaaaggcaccagtgtcttcctaggggtagagcatttctacgtgtataacagtttattgttctgtgagctgattgatcattcatcatagcaaggtatttttacaaatattttatcaaactaggggagtctggggagagatatgacaaagagagaaattcgaatctcaatagttttttttcttaaagcaatttttcttaaatgaaggaaggcaaaattcacaaatttttaaaagttgagaataatatatgtcaaactaaaaaattggaagtaaaattcattaaaaattaaaaaaaataggataaaaaaaacaattaagtcaataattttatataaaaaaatattttaacaaccatattaatgataatatctaattaattcaaaaagaaatttttacctcatctataaatattcattcaactcttatgtgtgacaataatgatatgtatctgttaattaaatgaattaagattcaaattttaatcttaagtataaaataaaataaataatgttaaataaaaaatacctttatttttagtgtgggttcattatctctgacggaaattaatcaacgcttacaactgtgaatatatacttcatactaagttattaatattaatattaataacggcagaagaaaaaaaaagttaaaccattaaattataaccatatgctcaactgtgtgaaacctaactgcagaaatccaaaccc

SEQ ID NO: 3202 - DNA, 1115 bp, Glycine max
  Soy_ogl_4814 Gm14:48109401..48110515 Cluster 13
gttctctactgttgtgggtaaggtttttgtgtctgggattttgattcatgggtagtagtttgtggttttgcatatcatgtgtttttaattttatgttgtttttaattttatgttttagatattttgcttattatgtatccttttcttttcttttttaactttcaaaccatttagacacatttacatcaccaaaagagttataacaccttagaattgttagaaaatattttagaactaacattttattatgtgactatcacgtagagggatgtaactcaattaaataaaatgagttattataaatttttttatatttatcttcaattttcatggataaaaagactcaaaatttttttataagaatttatttcatttaaaaaataacaaaatacttataaataatatatcaattcaacatttcaaattttcacccctataataaaacaaaataataaatcataaatttcataatactaaaataacaaaatctaatactacattactacttagattagataaattcacacaattatatataaaacataagtttttaaagataacacttaaataactaaaaaaggataaataccatttaaataatccataaaataacttaaatcgattaaatgaaatgctcagttgatgaacattttgagttaaattttttaatctaacaaattcaaatttaaacccatgagcctaccaagtttgctatgaatctaaaaaaagtttattgacaaattatctcaaaacgtaccaatgaactcgtaaattcatataaatttatgagttaacttaataagcataatgatattccaacaaataaaaacaagtatgtaacattgaaatatcacccatatcaaaaaatttaattagaaaaaaattagggggaccttgtacatccatccatccctggatgcgaatattaattctctctaatgcaatacgataccaaattaacacgcacgtaataactcaattctaaaatcttatttaaatagaaaaaaaaaattcaaccttataggatcttagtatattctttacaatattcaggaatgaatagcataaatttgtaaaatataaatatttatggatcaatcaacattaagattaag

SEQ ID NO: 3203 - DNA, 1398 bp, Glycine max
  Soy_ogl_5396 Gm16:31442741..31444138 Cluster 13
ctaagatggcaattataactacccgagaaagtaatatatatacatgataccaattctttcagcatttttattatttataagaataaaaaataatattaaaaaatttataataactcatgttaatacctcctttatgtatacagaaacagacaataatctcttacttaattttccactagtcattgtttaacccaatgctggaaagtgatctttctaaagactcattttatcatattgaaaagtagctttgaccgaataaagcattgtacattcttttttgtgctttgcggtaggttccattggaatgcacttcgatatgtttacatctaaatccagttttgggtcatacattcattattatgtttctaagccataaatataagataagtgttgcatatatttaagtttattggattgcacttcgtattatatatatttgacatgcatgatgaagaatccagtcattttctcaatttacaaaatggttctcagatatggttagtttattattaattaactttctgcaactaattacacagttgatatatctatacctataatataaaataaaaaatgcaaacatgcattggtatcatgctataaattaaatggtcgcggaatccttcactatagatttgataaaacatgatgatgatatatatgttcagatttaaccgaaaattccgaaggagataaacaccaacatgaaaatgattgataccatgatgaatcgatatatcatttgttagatgaataaggtgcaaaatattaaagacattatgcggagacttaattatgtggtgtagtggaattttctctatcttaaaaaaatagtacgtcgtgacaatatttttttaaaaatcggtataatacgtaacagtaggtttttttataaaaaaaatatgaaagagaaaaccaacatgtacgtagcagtgtaacaatatgagtgtgcttgttttacatgtgaatgtaatatttatatatttgttacaaattttttaaaaattattctttatacataacttattttcagaaatctgtatcacaacatttttctcatcttcctattcctatatatgtaaaagggcgagaatattctcatgggaatcaagttatttaatttccacttttttggaaatataatcaaatgcacgaaacaaacatatgtctcctaaaactgttaattgtatcagcaaagataatttggaaggtaacataatttattatgatttaatatatttctagaacatatttaatgtatcttttcgtaaaaattcatagtagtgtaaatattatttttttattataaattcacaaatattttttttataactcatgaaactgatgtttaacatatgtaattttgagcctataaaattgttgaattttcttattttc

SEQ ID NO: 3204 - DNA, 1333 bp, Glycine max
  Soy_ogl_6225 Gm18:571158..57138100 Cluster 13
aacaattaccagaatttaaaagaataaaaatatatttaaattttttattaacaataaagtggatgtacactatattcctccccgttctcatgactctaatggattgccttaagagggattagtccctgtgaaggtgacatgatcgattattgattcttgatccctattgcttttcatttttggattcttccctttgatggcgtgtagtattggtaatttggtatatagtttttcttggggccctttaccctctcatatgcaccaaaatgaaacataatccattatttttatgacattaatttctttttatgtattatcagtgttaaatttttatactagactaaaaattatatgataaatatgactttgacagtatttcattaagttgcagtaattattgttatttaacaaatttattatatataacgatttgtgatcgatgataatattaaaattatttatagtgcaagtctatatttacttaatattccactgtcgttatagcttgttcatttttaaagattttctgtatttttccatggtctttaccgcattaccattgagttatcatcactttcagtttcactgacatatcatgactatgatatcataaatattaattcagctatttgagagtttttattagtattttttaaaaatgtgagtttttattatgataattaattaatgtgagtttttattgtcataattaatttaacttctctttttatctatcaattaatctaccattcactcgaaaatagaatctattaaagattcaattttttcaacaacacgaccgtcgtataacgttgagatgttgtgatgtttccagattcgacaacgtatatactttcacgaggtgtctcactcttaaaaaggaaaaataaaaacaaaatgaaagaagacaacgattgttttggtagttttctgcataaaacacgtaagttttaaatttctttaccacacgtttttttctttaatttccatttttttatatggtagaaagtttgattggttcaaacgaacttcttaattaaaaaaaaattgttgagaagtcagtttttggaaaaatcgactattcaaagttatatttttattttattttatttttcatgcataattaagactgtgtgttcatatatgtataagcattcacgaattatagctaatccaacctagctagcctaaatgctttggtttgaaactttgagttgttttggtataacccaaaccaatcaaatcaaatttgttaatatgacaatttttattttaatttattatatatgtttcttatataacattttaaaataaagctggttgattcggtcga

SEQ ID NO: 3205 - DNA, 1175 bp, Glycine max
  Soy_ogl_6820 Gm20:37908549..37909723 Cluster 13
tatatttatattataattttatttcctataactccttttccatttattttttctttctatgtctatcttatttgtactcatatctcccattagataacaataaatcattcgatactaaattcaatctttttaggattttaagttttgagttttgggaataaaaaaatgtaattaaaaaaatcacttaaaggtaatattactttctgcaacgaaaattaatcatcaatcaaccttttgcgttgataaaaaatctcttattatatattattcattctcccactcttcttatctctcttatcactcattatgaatacaagatacacctttcaaaatagaaacaatcatttccaataatgtttaagatctctctattttttcttaaatattttataatataaaaaaataaaaaaatattgttccattgtttggatgaaagaatgtattattctttaacttatttgattaacttacaagctaattctaacaatataaataagtgggacacatgcatcaatttcgaaaactttctattatcgtcgcagtaattaatcatttcaacttttagttccggggtatttaaattttgccatatcatctacatgaaagagatattgaccacaaccttgcctcgacaagtttattgctctattaatttttggatcctacataatactcctttcttttatagggtagtgaaatccctttcggagaaaagtctaaatatatatgtttaaaacatgtctcatttatttaagtagaaaatattatattaggtcataaaaataagatcatttgcaagagaggactgcatagagtaaaagagaagaaagaaagttaacactataattactgtaaagttgcaactaaaaagttgttcagcattggatcaagtttaaatttgaacagcaaaaccacaacatctaatttgttcaaagtaaatgataaaatggcaattcatagtttttgcagtgagttattctatctattcttttacgttgaaatttgaacaaccaatccacaacgatgacatgtaatatgtttaaagtaaatgatcaaactcgtaattcatagctttggcagtgagttattctattcgaacatagttctatttttggttattttacaccttcaattatcaccattgagaatttcatggtccagcttagacttccaca

SEQ ID NO: 3206 - DNA, 1342 bp, Glycine max
  Soy_ogl_6825 Gm20:37984515..37985856 Cluster 13
tattatatcacttcaactcaaatattttttctcattttatccatccattacctctatcaaataacttaacttttcactctttcattctttttattcttttcattcttttcattcctcactttttttgtctttctcaccaaacaagccaggacgaggaaagagataacggaaagaacgaagacttcaaggatcattggctgctaaaaacggacaagaacaagaatgtaaataacagtgaatgttgggcagcgaaggctttaggaaattaaatcaaaataaattaatgtttgaaaatttactctcggatcgatatgtatatgcattaattattaaattctaactgtttaaaaaatattaaattttaatagcctcagtaaaccgctagttgtgattgtgactccaaaccatcgttgcgctccacaataggattgcttgccattttatagtgtaaattcattaatcattgttaagggtggtatgttttgcaattaagaaatattgaaaacacaactagaataaatatttaatcatgttactaatttatccccctgagaagaaactatttacccttaaccttgattcatgataagtatatagtaattaggtttaggggaaaacttgttctaacacaaaaattgaattacatatccgccataagattaagaatgtgggagtttcttatatgtactagagttgatccagtgattttgtaaaaaaaaaaaagtcgatctaatgacacaaagttcaaataatttacacagttatttacttaaactttattgtgtcgttatacataaaaagaaaatttcttgttcaaaattaatgtatataaaagagaaattatcatatttcttatgtaaaataaatgacaaaaaatgttaaaggccagagaataattcttactttcttcttggaactttacgtcaccacccaatcactaagtcttacatttagtattaatataaaacaatgtttaaatatggaatagacctttttaaaaaaattgttatgaaagttgagtttgacataattcataattacaaaggtgagtctaatttgtttttttattttacaaattaatttttaaggctttacctaacttgctcgtaggtttgactagtctgaaagtctaatgacagaatttgtactatttggaggtctaatattagtatgttatctgatagactaaacaaagttttaaaaataacaaaatcgagactaaaaagtatcccatgatagatactacttttgtaattataaatcaagacaaactcaaatatattaaagtctagcgtgcttttatcccttaaagtttattccatatttttttttttgataggtc

SEQ ID NO: 3207 - DNA, 1394 bp, Glycine max
  Soy_ogl_234 Gm01:49787801..49789194 Cluster 13
tttggactgcaaataaagcagacattctcttctttttttttccataaatatggaaaaaataaatgaacacccaaatattattagacacttaatgaaagagagagaaataaaaaagtataattattataaaatttatgatatgataaaaaagagataaaaagaaataagatatgatagaagaatgtttaaaatgaaagaatatttgtgtatcactattatttaaatatcgaagtatgttaaccttgagagatatatttatttatttattattgttatttgggaggagaggaggggatataagaactttaaaatatttttttaacttttgaacaatagcatacaaaaacaaaatgaacaagtatatttggattaacactactaatcaaattgggtctagttagctgatgagattatcagttgacaaaatgagttagttgataggcaaattattaattgattggttgtgacaagcacaagtcgaaggcgccgacggagttagcaattaattagagttgagaagtccacagcgaaattcaagaggaaaaggagattttgactatggaaaaggatatcagttatgagccaactgcataattgctttaaaattctgaatatggtatggattttttttttttttataattgagctgattttaatagttaccattatttatatttgttagccatgttcctacatgattgtaaatgtaaatgtgtggattaaagagtgaaaaatataaaagacattcttagtggtgactcgatcatcgttaacaggtaattttggcttatagatatacattgtttcgaatcagcctcacacataagaatccagtattgaaccagtctaatttacgaaataaatatgcatacacctcgtccagcaccttgtcttacgccccatatgatgtagatgtgccttgaaacgtaaaactgatctgactatgcaccaacttttacacatgatgctttgaaagagaaataccgctaatatatattttaggatcttactaatgagtgcatattatttaaagaattaaaataaaaaagtgttggtataaaaattataagaaaaaataaaaaaaaagtcatatataacataattttgtgtattttaatataaaaaatcattttaattatttaattaatgtcttaagaatgctgattagtatttatttatatttaatatactttttaaatattttttattaattaaaatttactcaaaaataaaaaattataagtttcatttcttatttaatgagtgttgcatgtaatttttgttgtttcaaataaagttaaattgaaagtgtgcttgaaattaaatgttactaacactttttccttccgcagttctcaacatatttttgaaagaaaaatttaaatgaatatccc

SEQ ID NO: 3208 - DNA, 1300 bp, Glycine max
  Soy_ogl_717 Gm02:47501101..47502400 Cluster 13
agttttcaggagaggaaattgtatcctcggtgtcggcttcatgttttaacccgatatccttcgacccgatactaaattgtgtcatgtacaggatgtttcaattcagttcattaactattcctatattttaaatttattataaattataggaattattgacttgaaagaaattatgggtgtgaaactaaacccttaaaaaaacaaagattgtaaacatttcaaaacaattagctaaaaattagtagtttatatttttagtaatcttcatctttctaaacatcagctgaactgtttggttattgaaatagaattatagggttcaatacagcatcaatacataaaaataaaaatattataaattttagaggaaaaaaatctgtaactgaaaactttaaatgcgtatgcattccatgtgaaaaactgtaaaagaaaatagaaaaattagtacgtgggcaataaaaagatattgttataactcataataccataagattgacttaattttttgttcgtcctcttaagttgtgcactaaaattttcaaattcatagagggagaaacctatataagtagttggttcatataacaaacccaataaactttgaaagtcaaacattccgagtataataagtagtaaatcagaacaaagaatcaagttaaactatacctaaatattgtcaatactttcccatagaacacattagttgtggatgtgcatactcaatactatcaagaaaaaaaaaaagcattctctgattcaattaacttttctttttgaataatgtcattatatttgctcttgcttatagtttttttcttcacgggtattacaagagatacaccacatataaagggctaaattactattcaactaataagcgttatatatatatatatatattttctacgttccctttcccaattcgctccttttctttgtttaatgggggaaacttaagaccttacagacctgggatataacgtcccaaccaagtcaaaccacaaatgaaatttacacttaggggtaaaaatatcatcatctgtaggtttaaatttcttttttgtgtggatggttctccaaaatggtcttaagcttccaccttcttagttgatccacatggcagttaacaaaattgtataaaaggatcagggaccttagtatgtaccacatgaatcaatgttacaacaggagaggaaaactacacatcaaatctattgatatataagtgaggtaaaattttatattaagtaaaaatgaaaaaaattgaacattattatataaataaagaaaaaattcataa

SEQ ID NO: 3209 - DNA, 1200 bp, Glycine max
  Soy_ogl_3565 Gm10:46190401..46191600 Cluster 13
caaaatattagttcaaatttgattattagccatgtatatagaagaagaagaaaaaaaaaggttattaagataagttatcttcattttggtaatttctagcctttaaggtcaacaaaaggatatcctttattaatgtaaaaaaaaatagttttattgtataagatttgtcgtgatgaatcctagagtttattatttttaattaataaaaatcattggtttttttttctctaacaaaatcttcccgttattaagacttggaagaaaaaaaaaagtcctgatcatatccaaaatctaataacaagcaaactaatatctctttgacgtatattttagttttcacttgccaattgatgtgactaataaaaatgacattactagtagattgagaagaacgcaacacaagggtttggcatgccatggcaagagaagaaataattataaatggcataggtatacggtataccttataccttcagatatatttataagttttactttgctgataaaaaaaaaaaaagaaagaaaaaataactataggaacaatcgtacataattaaatatagtagggctgaaagagaaaggcatgcatgtatcaatgcatggattatgttattcgttggtaagaagcattccgtttttctgtccctcttgcgctagctaataactttttttttcctttggagttgttagataatacacgtacgtacgtgtgtacgtatatatagagagaggagacatcaagtttatagagaaggagagaggagttactttaaaataattattatccatctcattttttttttaaatctaataattgtaatgaataatcaattttaactttaatcattagattttgaaaaaataaatttaaaacaactttatttttaatcctccaaaccaaaaaataatttttcgtccctaaaatttgaaaacaactctctttagcctctcgtcataaacaacattacactcattaacaacatctatgtcatcatacataatcatcgtatgccacatggaaatattaaataattttttaaaaaaaaaatccctcaattcgggttaagttttcttttgccccctaaatttaagaaaggttttttaattccctaatttggaaataactcatttttgtcgtcaaaaacacttcaaaaaaaaattattggcctggctgatttaaaagtacaatttacaacaatt

SEQ ID NO: 3210 - DNA, 1180 bp, Glycine max
  Soy_ogl_209 Gm01:48698621..48699800 Cluster 13
aaataattggatgaaaaataacactttagtgattttagttagaagaaaataaataaaaaacaaattcatctaatatatataaaaaaatagttctaaaacaaagaaagttaattaacattacaaattagttaactaaaattagttatactttgaatatatcatcaagagtataattagttggtgtgatacgagttattctaaattcgatatattactatttactacaaataaaaaaatatcaagagtataattaagtcaaaatgctaataatatatatgtatttttaaaaacttcaaaatgataaattaatatttttaattaattatttggttaaaacaatcactttaactactgtttaatattccaatagataaaaatattaaaaatggtaataatagcatttggaagaggtgtgtgagtaacatgcaaagaatgaaggtcttcccgctcctttgagatgaagaagattctcctcctatccgtcctttgtttcttcttcgtctttccctctccaacatcgaaacccgaacaattttgtctcccatcatcatctaaacaagtcaccatgcatactcgtggttgacactgtatacctactggaaagactctttggattagcaatgtttttgagtttggaaataatacatcgcaactagggttgttgccttggacaaaccaaaaaaattacaccctcataattattgaaatattatccgtattgatttattttcaacattcattaataatatattcattatcaatattatttaacgcaatgatatcataaataactaaattactctaaaagttgttattaataataacatatattgatagttaatcatatgtacaaatttatataaatcaaagcaaaattatttaatctgacttgtgacactgtagatcacaaataaaaatttaacattttcactatcgttacatctagtaaatgattttatcaaaattaaaaatattaaaataaacacacaaaagaatagtagaaggaacaaaaaataaactcaaatgttgtatataccaacaattagagttatagactaatcatgctactatttaggaaatcttacccaaaagtcaaccagtcaaaatttaattcaaaacacaagatgatgacaaataggtacaccaacacgcttaattaacaacaacttcacaactaagc

SEQ ID NO: 3211 - DNA, 1500 bp, Glycine max
  Soy_ogl_1163 Gm04:1544001..1545500 Cluster 13
tactgttatgctatgcttattttaatataatccaaccaataaaagtaaaaataagagtataattcttttacaaaagtacttttgatttaaatatatttttccatctgatttcaaatacttatgcttatctagtttgtgaaaggaatatttaaagagtatgattacatttttttttatatagtatattctaataattaagagtatgatggcatttttaatcttttttaatggtatttttaatgcagtcctttttttttttttttttacagctaatgcagttttcttttcaaactaaaggcaacaaattttggtgcaagatttatcaaaccgaagttttctttttaatccaagatatctcttggcaattcatttaaccaacatatttttttttcatacttatagattaaatttctaacaatatttttaaagaacaaggttatttgtgaattatatcacaacacgcattagacttaccaaatgaagtacaagagtatattttatctgccaatcatttattattataaaaaaaatgagaaaaacattatacgagaataattatttcaatatctagaccagaatatgttttatgctgtaaaattactttgacggtttctccggactaaaatgaagtccaaaatccaaataattaaaggaatcttttatttctttttaacacaagttcggttcgccgcctaattatcatgagagagaaaaaagccataactccgtgtcgcgcaggtaaataagtgtactatcaatataattttatctaaatatttatatatttgatttgaggttgaaaaattaattttgagttaaatttatttttttgttatataaaaaattatatgtaaatttattattaatttatttttataataaaaccatataaacataaaatacttcactttacaattaatttcatcaaaatttattttatttgaaatcaactttttaaatcctcactcaaacatacattattttcccatatttgaaatcagttgcatgcagctaaaggttttaattaataggttaaattatacttttaatgtcattatttaagaatctaattaaaatatattcatagtacacaaaatttaattataaaatgtttacttttaaaaataattatttaagaatacaaattttttatattgccatctagttataaactgttttataactattacttaaaaatatttttagactaattttaatagggtaatagtataaaattatttacactaaaagtatataaaattggctacaaaaaaaaaactcttaatttaaattgccgtatgaatattgcgtgcacaaggtttctacaaacatgatttgatcagaagtaatctttattcaaaatttgtgtaggacgaagaaaattaatgtccacccataatctttgatgaccacgattaaatgtcgatctgtttgtatttttgtttaaacgaacgcgacgctaatgctttttatttcttgaatttgttttcttgttttaaa

SEQ ID NO: 3212 - DNA, 1078 bp, Glycine max
  Soy_ogl_1442 Gm04:46605123..46606200 Cluster 13
attttcactgtacatgattattagttttttaaaaaaatctaaagcttctaatttttttaacctaacaattttagatttgaaggagcttttaagcttaataaaaacttaacaaacaacttctacacttatagtattttttaagctctttctttagctgaaaataagctaggccaattagatccgtcaatatatggagatttaaatactcattaaaattcttaattacctactttgtctaaataaagaaatcagaaaaatatgattgaatgaattaaaataactgggtttttttctttctttagatgagtggaagagaaattaaaaataaatgaattatataagttttaacttttaaatttatttaactaaaaaaatgacaattcactttttattaatattctatggtatcaataaatgtttgatgctggtcctgaaaatgtaataaattttagttttcatcctttaattttttgtattagtttggccaacaatttttaaaaacattttctattgatatatcactacacaaaacacattacattatatagtattatcttagaatagttgttaacatatttaaatacatgtcgtattatcactaaatagttattaagaaaaccttaaatgtatatgtgaatttaagagagttaaaactaataatttttaaaaatcagaaccaaaattaattatattttcagagaccaaaatacatttaagtccttttttaatatccatagtaaaaaatgggaaaatattataataatcataaaaaatattcacaccaaaaatttattaaaatatattcatccttttataacaatagatgaaatcgaaactgtatttttttcagtctttttttttcttttttaattattcaattcatcttatatctcccataaacaaattttaaacataaaaaaattgacttttttattgctccaacatgatgatgacaaagaagactatgttggtattgtatatggagaattaaagcaacttttatcaataagagtcatctatatatgggagatccaggaagttggaaggatcctatacattcgcatcaacaatgttgcat

SEQ ID NO: 3213 - DNA, 1343 bp, Glycine max
  Soy_ogl_1671 Gm05:34576101..34577443 Cluster 13
cgtcataccaatatattagcaaattaatggagagtgaatggataaggtaattgagattatcttgttttgcacgtcacatccttccacgttagatttcaaagtaattgtgtttagccactacgcaattttttaatcattaattaaaaaaaaactataactctatcttggtagtaactctttttaaactattagcattgcatattttattaactaaaaaacattaaagattgaaaaataaaaacagattaaacccctgatcaatcacacttaataattggtacttaatcacaaaattcatggcacgagtaataatttaattgcataaatacaatccataatttgtgaatttaattttggtatgacagtttttttaaaaaattataaaattatttatttattttactaattgtactaatgtgtcagtgggaccataacatttgttcatagaattaggaagtttactcatgtattttaattatgttttacatgagtaacaaattatgatattataactttaaatttagtatttttacaagtcaataaatttattatatataatttcggactaaaaatatttataaaaatacttatatttcttttattccaaagagaaaaaaacacattagagcttgaccctgaaagatatcatatgtaaaacaatgtcttatttcactctactaatcccttataattgcatcaccactttaatctttcttgcaaataaatatagctaatgactaatttgatgataaaacttgtttacttgagattttatccattaaatttaaattgtaatgcttctgaaataattatacatatttttttatagttttaagtattcagattctacgtgaaataattatgtacaaatcatttataattttacgtattttctttcaatttatcttttaaaattcatttaaatttagaattcttgtgaaatgcatggatatttgataatttaattttagaataaatatacatcaaattataataatatatgggtaattaattttaaaaacatcatgacgttttaaaggaaatattaattatacaccaaaaaataaaatattaattaaaattgaactgtttttttaatcagaaaattgaactattctaaaacatatatttttaatacgtagaaataaattacacgagcacaacacacagatgtttgtaaaataatatgtacggatggaggattttgttttaggaggaaaacagggtttgagactcttgcgtaatgaaaggctcatttttttcaaaatacaatcaaacatcaaatacatgtatttttaatttttctctctgaatttgactcctgcaaaggtaggttaaatgaa

SEQ ID NO: 3214 - DNA, 1006 bp, Glycine max
  Soy_ogl_1707 Gm05:339395..37490400 Cluster 13
ccgtacaaaattattttagtttatcacacgagaatacttatgatgtagaaaaagaaaacaccaattattcctttttacaagggaatagtaactctaacaccgctaaatggtgcaatatatttatttcggtagcatttgacttaattgattatttttattttaaaaatattttaatattcaaataaaaacaatacattgttagaaaccaaaataaagttgtttgttaatttaattttcctctctttttaaaatttttattattatttataaattctcttaaatggtgtttgataagaagaaaacacgccaaaaaaattaagaaaaatatttccttcatgctttctttttcctttttttcctttcaacaaacaggaaaatccttgtttcacgtataatagtagggcatggaatggaatcacgattggactaataaaaattatttctcccttgaatatttagtacgcctttcttattttgaaaaatattaatttaagggcatgttttgcgtcatttttagttataagttttaaaaaaattaaaaactaaccgtttttaatttttaaaaattagttttgtttttagttaaattaatttaaaagtgtgcatgcttgtataatgattttggtgacgacaacagagataaaaaaaatgtcaagtatgatgataattttttttgttgattatgatattagtatgaaataattctgattaaaaacagtgattattaaacttcgtcagaaattatggatatatataaaataaatattcttcttgtaatacaatttatttcatatttaaaagttaaaattcaaacgtaaaagcgtcataatcacagtggtgtgaataatagtagtcacaactcaactacaataataatgatgtaaaatgtagtgaaagtattttttcaaactaaaaattattcttacaaatattttttaaaaaaatctaaacttattttaaaactgaattaaaaatcatctcagatttattttaatctaacatgttt

SEQ ID NO: 3215 - DNA, 1100 bp, Glycine max
  Soy_ogl_1831 Gm06:7458801..7459900 Cluster 13
gttatcccggtattattatagcatgattggattagattcaattttttcaaaaaataattttaaaatcatgttaaaaactaaaataataaatagttgtttctgcttttcaagatttctaccatgattttgaaattcatactcaattctagtaactatccaaatatgttattagaaaattaaaagcatcatcctgatctaaagtttagtttaactagaaaatacacgcttagttgaatttattctacctttatctatatattgaatttgattttataataaaaacataaattacattagcttagaatcaattctatttaaaatcaattttattatcgttcattcagatacacacttaattaatacgaatataaattacttatatttatgttatttcttattcttataataacatattaagtgtatattttttattcctaataatattttggtgaaaggtgagtattttatattttcatcgaaatggaagtttatttctataataactatcaatctttatttcatttctccacattgtttcacttatttttacagttttttaattagatatttttcttcattttgaaattatcaatgtcaatcaaacatgtgtgtgggaataatattttcaaatatattattcttgaaaatatgactctcaaaaaatacaaattttcaacttcaaataaatgccccctaaaaagttatttaaaccttatctaaataatgagaaaaaaatattttttagtcattatgatattattgagaagtatccatcaatagtctatttcaaggatcaacttttttttttttttctatgttcctgacattgaatcaattggacaaacttccagtatcttttctactttgaaagaccttgaattatatctcttaatctcgattttttatatataaatataactaatatatcttcttcaaatattttttttccaaaagagccatgaacagttgctttaggagttgccaaataaggattagtcgatgagtaatattttttagaaacatgattaataacctttaataaaatttatctattcttttaatcatattttttgcattcattggaaacacaaatttgtgtc

SEQ ID NO: 3216 - DNA, 1100 bp, Glycine max
  Soy_ogl_2258 Gm07:7701801..7702900 Cluster 13
ggaaaacgttaaatgaaattttttatgtaaaatatgatattagacgctataatttcagtgaaaaatagtattaactatcgtactttaacttatatttaaacttcaagaaaatgatgattttcatttctcgttagagactgtattcacttttaaagtgaaaatgaaattaaaaaaaaaatcaattactttctgtaaagtttataatcaaaattgaagtttgcactaaaattaagtttcactgaaaatatattttactctttttagaaatgtaagttgacattatatgaattattggcagaatgaaatggaaattaattattgaatctatcatctcatttcatttattacaattattttttgtctagtttatataagaacggttcatccacgtgtcatcctctttttttatttaataataaacctaggttcttaactttaaaagcccacctaatatttttttttagtcaaaaaaacccacctaataattaataactatttgtcgcatgcagatactcttactaaagtttatttaaattataattggatagcagaatagtcttcgcactctaagtgaaagggaattgttatccatagcttaatttaattgcatagcatctaactctctatcatattttcgaaatcacctttctctatttttgtgttcgtgtatcattgttttttttcatttcattattgattaattcttccatatttaggccgccttaattagcatcggaaactatcatataataagcacccaaattcgattatatatttgtcaacctattagaaatcactttaaataaaaaaaattaaataataattacaaaattaaagttaataatactttcatatatataatttattataatgaagtatgtaaaaaataaaaaaaaaactttatacattcaacttaagtatgcttttatatctcggatgagtgtttgttaagtttctttaacaatataaaaactagatacaaaatcagcttcttaattaactgagttaaatttttgtggagagaacattaattatttaatcgttaaacacagaaaagaaataatcattaaaaacattgtgaacaaataagaaaattaaaa

SEQ ID NO: 3217 - DNA, 1100 bp, Glycine max
  Soy_ogl_2920 Gm09:861601..862700 Cluster 13
tttctaccaagtaaaatgataaaatattaataaagtaagagaataataaagtttaatatattcatactttttaaaagttaaaaatgcttataattaattattttaattcttgtataaaggctaaatgatatggtgactatttcaagattggttggtgaataccttaccacttcaaacatgtgtgtccgtaaaagaataataaagtttaatatattcacacttcttaaaaattaaaaatgcttacaattaattagtttaattattgtataaaggttaatatgtgtgtgtaacagaataaaaaagtttaatatattcatacttttaaatattaaaatgtgtgtgtatgtgaagctgtgaaagttttccattttcacttgattatataccatccataatacacgtaaatatggatcccatatgactcatgtaatatgtcacgatacgtaactttatgtgaacgtaattataagactaatttgtgacagaaacttttataatactattaaaagctttcaaaagcagtacgtgcatgctgatcgtaccgtcgacggaaaaaaaaagtgcacattcaaattattaattcaacatgtgatagagtcaaaataaatttctgtaaactaaaaaaaaagtcaaaataaattttgtcatccaagttaattggaaaccaaatatatattgagtaggtgaattaataatcctttaaaagaaaagtgaattaataatcctttaaaagaaaagtcttacttctcatttttatatcgatcgtttagcatgcattgatcaactgtatgttcttcatcacatgtaaattcactaatttgacatgttatatatatgtgaaggaaagaaaaatattagtgacaacttcgttgttatttataattttctttttattttttcaaaagaagtagcattttaggttttcaatataaaatattaaactttttattctaattttactcaacaaaaaaataataatggttttgagtattattgcatcaatttttcagcaaccaatatataatttagtaaaactattaagctcattaagttagtttttctttctttttgttaatttttttaaaaaaaagcttgaaggt

SEQ ID NO: 3218 - DNA, 1093 bp, Glycine max
  Soy_ogl_2923 Gm09:932201..933293 Cluster 13
tttttaaaattagtcataaaaactataattataaattttttaaaagtggaggatgaaatatttgaattaaaaatgagagattaaaattataatttttttaaaaataaagaatgaaatatcttaattaaaaaataagaagactaaacatacatatttgagaaaataggaaaataaaaaatacattttaacctaataactaataaatactcgtggtggattgaattatgagatttttaaattgtgttaatttttctattttttgttaatcaaaatactgtaaccttttctttttttatcacagtatttttttattccaatacgatttattcatgtctgagaatcaatttcgaattctaatcattttgattaagatatagaaaccttcattacttacgtcaataatactataaccttttaaagattaaaaatgataaccagtgggatcgaacccatatattcagcgctatacaaaaaacgtttgtcatccagtatgttacccacatcttacacactcaacatattcaccgttagatctttcacagataaatctaaaggcctggaaaagcttggtactgtccctaaagagttttgcttacgcacgccaaactttgacggatattttagggtttgtttggttttatgtaacaaaacttgaaatggatgttcacaccaatgaatcagttaactgctttagaatgtttcacaacagcaaatcaaacacatatttagagtatctttaatgtttggatgaaatttattttacaaactgagtttatagaagcaacttatctttcaaattgaattttaagataaaattataataaaattaaactcaactgaaaatcattaattttctttttttacatgttttttaaggggtaaatgattatttggtacttgaatgtgtaaattagtgataatttaattctttaaaaaacaaaaattctatttcagttcatgtaaaaaagataataattattgcaactaagatataattattgaatttttgacccattcataaattaaataaattagaattttcattctttcaaaaataaattatcatcaattacatattcatgaaccaaaataa

SEQ ID NO: 3219 - DNA, 1000 bp, Glycine max
  Soy_ogl_3583 Gm10:46536901..46537900 Cluster 13
ttaaattgaagaggacatggttatttcttttaaaaagtttttgtttttgttcaaaattaggttcattgtttgtttggtaccagccatagccaatttttccaaaccgagcctgatcgttctacactctacatgctaaagctaaaggcccaaagctaaaggcttcaatgaacttttaaatgaaaatttgcaaaaggtgatacaaaaagcatagtttgtgagagaagatattttcaaaggcttttttcgttaaaaaataatttatgaatttagtggggatagttgcatggttttcaattcgcaattaaatgcttagcacgatgaaactaatatatctgaatataaaaaaaaataggaataattctaatccttctacaagatttttctattaatcttcctatttgctatatgaaaaaaaaattatgtttctaagatgtcaaggtaatgttcgtatcagtattttttcttttgcattttcttcttcttaaaagtaaaggagcaggtcctttcggggacaaccgatataattaaaagagcaggtaaacttttttataagtacctatgagaaaaaattaaatatatttctctataggtttaaattggcttatatataaattaatttcatttataaatgttttctcgtattagtttactatatgaaaaaaatgtttttatgattctaagctatatgaaaaaaatgtttttatgtttctaagatgtcaaggtgatcttcatctcaatattttttttttttgcattttcttcttaaaagtaaagaagaaggtcccttcgggaacatccaataaaaataaaagagcatgtaaacatttttataagtacttatgagaaaagaaaatgaggaaaaatgaaatatgtttttctataagtttaaattagcttatatataaataatattctttatagaatttttttatattagtttatccaaaagttgattttaacttatgaataagctaattttaatttatatttttttcttttt

SEQ ID NO: 3220 - DNA, 1000 bp, Glycine max
  Soy_ogl_3941 Gm11:37150801..37151800 Cluster 13
ttacaatcaatgtgcacgctacaaagcacaagtcaaatatgtcttttaaaaatttgtcaaatttcttttaacacctttcctttttctatcttttataatattttttaattatttaaaaaataccatacagtgtaatcgttcaaaaacagggaactatgtgcagcataaaaagtttcagaatgttagtgtaattaattataattctttttgaaaaaatatattcttagttcacatattttcggtcaaatattattaaggtctttatatttagataatttttatcttcatactttaaaaaatatataaatttcgtcttttgttttaaaaatattattatgtttttcaagattaaaaaaaagattaaattcatatatttttaaaatttgaagactaaatttattaataagaaaatatgcatttaaccacatataatcaaaattataaaaactaaaaccataaattatccataatcttttgaaaaaaagtataccaagcagatcaggtgaacaatcgagttgcttcacgcaactatcacatgatgcacgagcccataacttatatcaagatagtcactagtcatgtcactagtcaatcattcagtttgcatgtgaggttccgtatttttataaggaaaaaaaggatgctcaccaaaccctagatggagaaaaataatactagagatatagattggtttacatgatataaaaacacttatatattattattttataatatataacaaagtttaaatatatttaatatcatgataaatgaatggattttatattaaacttttaatactttttttgttattttaagtttattgtattaaaaaaatttgttgtgtagtgataacattacaattataaataatattaaaaaaattaatgtataaaatgacacaataacaaaatctcaaaacaaagttttaatatatcaaagattaaaaataataatttttttatttaaaaacacataataaaatttgatcattatcaaa

SEQ ID NO: 3221 - DNA, 1134 bp, Glycine max
  Soy_ogl_4521 Gm13:37499312..37500445 Cluster 13
gaaaaccaaaattataacttgtgttgtaattatttttaattttttaaaatgtatcacacttaatgaatattatagctaaaatattattattaaaattttctgttcaaatgcattaaatacagtatttattaaaacgttactataatgtaatgtcagttagcttgtagattgaaatgacagataaaataggtaaaattatgtttttcatcacttatcctattttcaatattcattttgttttttcatcttaaaaaaacattttatgttcattatcttttaaatttgggttatattagttcctttgaaatgtttattgtttcaattttatatataatacaatttcaaacttttttagtgatttaagacataaaaattgtcttattaaactcacatacatgaaatctataaaactcaactaatatttggaaaaaaaaatgtaaacattgataaagtgaatccaacaaataactaaaagattaaaaaatttagtataatttttttatcactttttatatgatttttactatgataataatcattttttatttgcacgagttgggtctcaaagttttcatttaactggatttaattacacaaagaaatgtttaaaatcggattccaaaattaaaaatgatcaatattttagaaggaccaatttgatccaaatttaaaagataaacaactaaaattaatttgttgaaagatgaagaattaaaataattattaaaaaaaatttaagaaaaccaaaagtataatttagtcaaatatataattcaagaatttttttaataaatactgatcaagactaacttgacatacttcaaaaaagtataacttaacaaataacaacacctctcaatttcgagaatcgatatcactattgagtatttactcaaactaaaagtcaacatgaaccttcattggtaaaaattaaaatagtaaaatggaccaacatatttttaaatttttaattgtacagactttgaccccctaaaaatgcagcccagcctaaatgctttttcggcccaacaagcctattcgtaaaatgaatcgaaattgacatttactacaaatattagaatgatgctgtaaaaaaaaaagataatgattaataatactactttaagctcggcc

SEQ ID NO: 3222 - DNA, 1016 bp, Glycine max
  Soy_ogl_4682 Gm14:5475101..5476116 Cluster 13
ttaggcaagctaaaatttcatatttattaaaaataaattgaagtcaacatttatatttcaattgaataaacaaataaattaaatttgatcatttaatttctttcttttaacaaatgagtcttaaactttaaatatttaactcaagtcgttaacattcttaatgataccaaaccaacttataattttggaatttaaaaaaaaattattataaaaatggtgctttatctaaccttctcctcgaatacgaaggtgacttttataattataggaaggaaaagaaaaaaagaaaaacctttttttttacaggaaaaaagaacaatcttagacaatgcatatcaccccgtgttagtgtagtttattggaagtcgtaattatttttatttttttggccttttgggaatggtctcactcacctaacctagcccaatgtcgtagttaatattaagcaagtaaagttgttttaatcaaaggatggtatctgtacaatttttgcagaataagattaagcttcagtttagttattcaccttttttcccccttttaatttggtaatttaagggtgtttgcaattcgaaataattagggacaaagttatttgtaaagctaaattattgatttttatgcacttaaaatttattacaattagctgaaattttaaataaaaataagagacaaaaaatataatgtaaccacatttataactatatatactagggagccttgtcaatgaaaaatgcacaggaaataagacacccatatatatccatttaaatcaattatcatattttcttgtcatataagaaagtcttttttatttcttacagaattgacttataataaagtcattgcatgcgattagcggaaaataaaagtgcatcatgttaatgtaggacacataactcatgtgaacattcaattttgtccacctttttaatttatgtgaacacttaattttgtcaacagtgacaaccctcactccatgttaagcagcatatgctgctttctgagcttctagc

SEQ ID NO: 3223 - DNA, 1012 bp, Glycine max
  Soy_ogl_4697 Gm14:5902789..5903800 Cluster 13
caaaaaaactatgcaaactagctaactatatgagtataatttcccattttcacaaaaataagtatttttttagcacaatacaaaaataattacgagatttcacaaaaatgttaaagtgtgtgagtagatttcttctactcacacactttaacatttgtggtatttattatgtgaaatttatgcgactcgtgagttaggaactcgggtgttgcatttttaaatgatttttttaatcaactttactagctccctgcaaattatatttttatattaattaatataatttattttgtaattattttaattatataatctattttcttcattatcttattattagaactaatatatatttgaaatgtataattgagatccattgtaagaattttactattagtaaaagaaatattttaaaaaaactatatttgcatatatataaggattaatttaagtaagaatagtttatcttacacctgaaactcataagataaaaaaaattgaaaattaaaatttcatccaagatcgtattatgccatgtaaaaaaatttagatatgaattacagacatatttttttctattatgtaatgctcacacatcataaattccttgtaaagatcaaacaaaatcttgtttgagaaactagtattgtacaataagattttacaaaatattttacaaccacaacgcaacacagataagaagtattgaaaatataggaaaaaaggtaccaaataaaaaaaggagaatatgataagaagaatatagaaaaagaagggtatgataagatgaataatgtaacataaaaagctacaaaacaatcttgaaagaaataaaagaaaaaagtatgtgatatataaaatgaacaattaatgttaacaaaaatatatgaaaaatattatatgaataacgcaaagctcctgaaaacttttacatgtaatgctactactcgtgcatgcactaagagaaaataaattcatgtgatagaaaatttcatattacctccctcaattt

SEQ ID NO: 3224 - DNA, 1238 bp, Glycine max
  Soy_ogl_4705 Gm14:6086701..27938 Cluster 13
ggtcaactgggcgaagctttattctgatttctgaggaagaaaatgattgatgttgatttgagatgagtaaacgaccatcaacagcattttcagcaaacgtaatagataataattgttgtaaatttttttgtagaataacgggttttgggaatacagttgaagtatcttattagtatattgttaacctcaacctgtgaggcatcgattataactattggatatgttaattaagccgcccgattaaaatgcaagtttaattaccttttagtttatataattataataattttttcttttggttcttataatttaaaacattttattttagctcttatagtaataatttttaatccttttgatttttgttgtctgaatttatttaatgtgattacatttgattataaaactgaaataatgctgtaaaattactaaaaagagatttttacgatttttaaccgcaataaatgaaaaataaggcactagtgtgatgatttgtctaccatggctgagccacttgcagcggaacaagcgagagccttattggctttgagatggacctgcaacgaccgtgcttttttttttttggtacttttactttgccagtttcatgaaaaaaaaaaagtacaaagactattgtaacatttttaaaaaataagaaacaaatataagaattttaagatattttgagggaaaatatttaaaaaaaaagtgtttttattttgtaaaacggttttagttaaattgacgacattaatttaagtttgagaaataagcattaaatataggatgtatttcgaaaatgtacttaaataaactatcaattaaaaatactagacaaatattattttattcgtaagacctgtttgtcaaaaatatcattgttatatgaaattaaaaaaatggttttgttgttaatatattttttaatttcagtcttaaatccaaacgttagaatttaaaattatagtttcatgtttttattttctatatatttagattttgagcattcaaggattatattaaatcttaatcaattcgaattgaatagaatgtagtcactttgcatagatatttctcctaaaacatatttttttatttgaaagatacttatatatactccaaacctttattaaagaaattaaatttctaatcgcttaaacttgaaaatatcttaaattttacataaccaaatacaatatttatgatttaaattaacttcaagtggacatgattaaaat

SEQ ID NO: 3225 - DNA, 1138 bp, Glycine max
  Soy_ogl_5833 Gm17:41309801..41310938 Cluster 13
aatatatatgatttcaatggtctatttttaagtaagctgcataaaaagatataaaaaaaagtgaaatgtaaatcaacattaggatgactaaatcatttatatccacggactcctgtgggtaaaatctatgatggatagaaaataaatatctaaatggtaagttaaacaagttttttctttgccttttttgtaaacgagacagggcgaatatcatcatattacttatactcatgagtaagagctacttgccaatatacatttacttaattgttcttttattaatatcgatatgcctatatagaatatacattttggactttcgagtatagttttatttgaatttatactttgttttttgaactcattcgaatttataatttaaagaatgaattttatacaatttgaatatttttttccagaaatatgataaattttatacacataacgagtttctattcacctcaagaaaatgactgataattaaaagtattttgtgaaaaaaataatagaggaaatattttaaattatatcttataaaaaaattaggataaacttttaatttgtatcttataaaaagattggaaaagtgaggccatttggcttgtgtaattgttgtggtcagtatactgactctcttgtgtagtcatatctgatgtgtgtgtttatttctcttttttatatttttttaaaaatacaaatataataaaaaaaatgttatattaaaggggtgagttgtgttgagttcatgaactcacaaaaactcgatacttatctcaagtatcagtgaatttgatgggattgagttgaatttcatctgaataattttaaaaaattaaaccaaaatatttgagttggggttggatggatcaatttggatttattggtacctacaacccgaaatctaagtatgtatctttttttaaaaaaaatggaaaagtatgcgtcctatatttgatagatttttttttgtgtgtgtgtgttttgacttgaaacgagctcatttaacataacaaggggtaatattagactcaaagaggagtaaataattaatataagggtaatttatttaactctagttaaggaaaaaatatatatgtcaatcatatagtatcgagtgtaaaaatctttcaccctctac

SEQ ID NO: 3226 - DNA, 1076 bp, Glycine max
  Soy_ogl_5874 Gm18:1790637..1791712 Cluster 13
ggaggatgatgatgttgcaaatttgcttattaattaattttgtctagggtgtctttgcctagacaattcagcggaaaacaaatgatgcaactagagatatcatagaaaaaaatattataacttttacgtacggtcattataaattacttatttaaatattaattacatcaaataagatacataatatattatcttcatggtcatcatatattatatattatatattatttatttaagtattatcttaaataaagtatcttcataatatattaatgctttttaatataaatgcagttacttttttttttgttgagttataaatgcagtcactttaatactcacaagaaatgatataactattggtagtaggtaccctaacctggaggaggcatgcaaatcaatctataaatcaagttgttgatataccttatgtttgtgtcctctttggtaatataataaccactgttttttgcttgcaaagtaatattttagcttgaaaatgcagattgatatatatatttatagaattgagtcttagctaaatttaagagtgacaaaagttcaacaactaccattgatgttgttgcagaggtgttgatatttggtataggtttttgttttaaaaccatctagtttgatggaaaaagaaccttaactaatatgaaattcaactttgaaataaataaagtctgattaataattatttttttattaagaatcaaatttgaatattactcaaacttgaattatttttataaaatccgattctaccttaattttaacatatttgatatatgtgtctcttttttatttaatcataggcgagttgaccagtttctcttaatataatttgtgatttagttatgagcgaggtgatatatacatgagttttctttaatataatttgtggtttaggtgtaactaaggtgatatgtgtgtgtctatgttttttttttccatttcttctacttaatcaacccgatcatcctataatgatatataaaaggttaaaataaaattttggttttttatttacatttttttgtttaaattcagtctcttaagtttaatgtttt

SEQ ID NO: 3227 - DNA, 1021 bp, Glycine max
  Soy_ogl_29 Gm19:42835280..42836300 Cluster 13
agagaaaagattactctttacctctgtaatttctaaaaataaaaataaaaaataatagaagttaaataatagctgttaatttagtttgcaagatgtaactgcaggtacgtgttgtttgaaaaatatagttacagagattaaaaaaagatttaggaaggtaattatgagtaaaatgggataaagaaacgtgtacaccaaaacttagtattcgctttgtatatataatattactatgtatttaaattcatttttcaaatatactttaaaaactattttttaaaatcttaatgatttaacaaaactacaaaagggtgtcaaattatgtaaaaaaatatttattttatatatgtgtgtaaatattacatttttgaatattgatgaaacataactataattaatgcaatagacaattaaaaaagaatttacaaaaaaaatcaaaacaatatattataaaaaaagatggatacaagttgtaataaagtccactattaaattcaagcttaattattgttttaatcctttcttatttttttttaattccttaaatttaaatgtttttttagttcttgaattttgaaaattactcttttccgtctctccaaatggcactttgtgacgtgggtttcaaatgcaaattttaacaactaaaaattaaaactcacttaacatgatttgaaaatatatttaaccctattatttaacattaaaatacacatttaattatcaattgagccaatcttaattaacaatgcttagatttcttatcgtgaatttatctatatattcaccaattcaataaccaatccaatcaaaagatataaaattaatttcatgataaaagaatctaataaaaaaatataagattgattttgtgagaaaagaaggaagacaaagattatgagtttgattccttcattaaccaaaaaaactaataattaatcactaacacttttcgattaaaaaaaaatctaaccaaaatattcataaaccaattttatttttggtttgggaaagggaatta

SEQ ID NO: 3228 - DNA, 1092 bp, Glycine max
  Soy_ogl_6787 Gm20:36504301..36505392 Cluster 13
gaaaaatgttaaatgaaatattttttaataacattaaagtatataaattgattttatttatgaaaaaaataatttatttatatttgtatttactttttcttttataagtatacatattaaaaaaatctatccacattgagtctaactaaaaatattttataaattaacacataaggaataatatgtgggatatttaaactttttcatataaaaaaatatataggtatactactgaagagtcatatacattagaaattgactcaattaaaaattgccacctccaataatctaatgcaaatcatctaataaattttggcttgttttagcatagatattcatcattaatataaattatgagtataccaaataaaataaaattagataagatcatggtatttttttttcttttgacttaagatcatggtatatatacacaagttgttttgcaatggcaaatgggtccgactctttcaatgtataaatacatatttttaaattttttatggacaatgagagctatcggtgcgactcttcaaatacagcatcatataaatttgaaaactaaattaacgattttagattataatatatataattgtattattgagtcatgtttatttttttttttactaaaatttaagaggagcggatgatactccattcaaagacagaaaaaaccttcattcttaaagaatatttttaaacgtacttaattacatttatctcatcctaaaaaatgagtaaaaattcaaacttataatatttcatatgtgagaactcatcttatttcacttcaccacccccttggtgttaacagccttttaataagcatcattctttcctacgaaatgtttaactttactcgtatgaaaaaaaattaaaaagttatcctttagaaaccgattaggtcccccattataccttttttttaaaaaatagttattaattaaaaatgtgtttgaaaagtaattataacaatcatgtgaattttcaaaataaaaacatcaaaagttaaaaaaatagttaaaaaataaaaacttatattacaaaatcactttttaaaactcaaacaaacatatccttaatttaaaa

SEQ ID NO: 3229 - DNA, 1000 bp, Glycine max
  Soy_ogl_3316 Gm10:2242101..2243100 Cluster 13
gttgttgtaattttaccattacacttgtaacaaaactaagtcgttttatttttttctttaatattttttttaaataagtgagcagtgatgtgtgcaaaaaaatagaaaaataggtgaaaaaatttgtgaaaagaaaaattggttggtaaaatttaagaaatcatgaaaattaaatggtaaattttgtaattaaatatatattaaataaagatatcataagaattgtaaaatgtcttataaaaatgattgctaattcctttgggatggtgcattataatattaaggaccggatagagtataaaaaaaaaatacgtgtaggagaagtattttaaattttatttaagaatttacatatttttctttactgtctaatttatacaaatgaatgatataccatacctcttatatttttttgttaattattggatgaaattttgaagtaagatatttaatttaattgagaaattaggagaacaaaatgcaaacagttaaacgaggataaacttgcacataaactaaagtatgaagacaaaagatgcaattaagcattacttttgcactttattcgatgtaattaatttttttattaatcaaatgcgaaattcaagccaatatgtagtttgtattctagtttgctcatgagatttataccttcgtctcatgcagctagccctcagggtggtttggttgtgggagagaagttattatttaaggggattttttttttaaatagtgtgatgtcacatctttttttcaattttaatttaaatattttttattatttttttatgtttcatacaatcaaacctacccttagttcatctgttggctgttgaaattcagaaaaaaaaaacagcaaaaaaaaattctgttggcagtggcagccttgcaaaatctgtgcatatgcacttttttttaactatttggacactaatatattcctctaactcgtctacaacaaatatggtgattgcaggttttttttattgatgactttgaa

SEQ ID NO: 3230 - DNA, 1400 bp, Glycine max
  Soy_ogl_4479 Gm13:36214401..36215800 Cluster 13
ttcttttcctccaaaatatgctttacataaactataattgtttctaactttgacaattacacattcgacttttcaaaatcttgggaagatttggagagactagtccagggcgttctacaataggatttttttttcttaggcggaaatctaaatgagcatgttggtaattagggaagctcatacataataaataactaaattataagtggatattataattataattagtttttaaaatgaatataatttaatacaattagttattatttataaaatatgagtatataactagttatgaaaaaactagttatataaccaattatataataaattatgtataaaatcaattatataactagtcatggataaacaaaaataagttatttgaaatactcttttttataatactagttatagttatgataaaaataagttattttaaattcttataactataaaattggttgtagtttttatacctacttttatataactagttatataaaattaattatagttatagttattttttaaaatttcgtttttttagcatccctaatgttggtagtaagacagtaatttataagaacctatagtggtttgggctttggagaacaaaatgaggaaagacaaattgttcttgatttctatgacttgtgatttcaggattatgaacactcacttataagatgaaagtttaaggtcgtaaattgattttttatttttattatgcaagaaatattgataaagtttgtaaggatcgcaaaataattttgggaataagtctcacaatacactgatgttttgaaagatataaataaaaatctcgacaagatacaagtctaagtatcaagtggtgcaagttaaagaaaacaagcatttgacttttcagtagaaattattggaggaagataattaagaattacaaggtatagtgctagtctcatttgggatgatgagatgtctaagaagataaggaaggttgctaaagcaatattggatgaataataaggttttgagttggaggtgggatgaaagtgttcaagacaagctaagaaacaaaagaaatgttataaaatcttgcatgggccaataagacagaaaattgggccaggtatcataatgctagaaataagacaagaaaagttgtgagttaatcatgatctaaacattttgaattgttttacagaaatcttgggacaaataatgaaggacataagatatataggcttgtcaaaaatagaaaaaagaagacaaaatatttgaatcaagatgtattaagaaagaaataggaaaagtttcggtcacgtattattatgcatggtaacaaagagagatgggagaaatatttttaagtttttcaatgacaaataaaggtatgctcctaatatatggaagga

SEQ ID NO: 3231 - DNA, 1100 bp, Glycine max
  Soy_ogl_4972 Gm15:10326901..10328000 Cluster 13
ttactctcaaagggacttttaaggagtaattaaacataacttcaaaatgattttattttcaaatatatttttagatcttcccgtcaaaaattcaaacatatcctaaataattttttctcctttccacttaaacaaagagaccattaatgtcttggaagatttgtaggaagatttatattattctaaaaaactattagtaagaaaatattttgaatgttcttcttgttcatcaaaatttattaaaaataatagtttttgtgaatttcacttcttattaaggctatttgtggatgggttgatttataccaatatctgacttaaaagtttaatatgatcaattttatcaactcaaatatgatcgaatcaaaatccaataacatttaagacaaaattaagttaacctgacttgttgataaaatatattaatcttaacattatatataactaaaccatagttcagtatgcaatcttaacttatatttattaagttaaacaaaacattatttattaagttaaaaaattctattatcaattcataattgtttgaacaattgtgtttctttaaaagaatatatgatatgactcaaagtataacttgaaattaacctcaaaatataaaaggtctaatttcttaaacacaaacctatcaaagttcccttagtcgggttagattggagggacaaggtcatgaggatcccacttcttacctaataaatctcttataattttataatttttaataaattttaattaataataaataatataaagaacaaaagaaaagttaaaatctatgttgctaaaactcttctttccttaaagtttttgtaagtgtaaattgcaccaactctaatcataattatatttcatttttctttgatttaaaaacgattgtttttttcaatttatttaaatttttgcacttttttataaaaaaaatacacatatttttcttatttttaaatgcaagtcaaacacatttttttaataaaaaaatagagagatcaatgtactatttaatttaaaaaaaaaatatgtatagtatcactaaactcagaaaagttaaacatattttttattaaaaaattattatataaatg

SEQ ID NO: 3232 - DNA, 1000 bp, Glycine max
  Soy_ogl_5848 Gm17:41625701..41626700 Cluster 13
ctaatattgttttatttcaatgctacgttgaaaatggatctggattgcttgccgttaggtttcactttttcttttcttttattgatttgtaaagactgaaaaataaaattgagggttgagattcaagtttctttctctctatctgatgacaaagaatcctcttcccttgaaaatcacttatgataagctttcttgaaagtacttgccggctaataaatttagttttaggatttaactttgtttttttttttttttacaaaagaacttaacttattcttaccttaatggtatgttttgtttagaagaaaaaaaaaatactagtaacgtattcttcaacactcttctaataaacacatattttattgttgattaaaaattattaaaaattataaaattaagacgtaagagagactccttaaataaataaaaaatgagacccttaatattgtattttctaataaattataatcaatactagaatatataaaaaaacgtgttagtatttctcttagggaaaaaaagaatgttaataatacattctttgacatttttttaaatatagtttattactgtaagaaaagaaaataaatgaaaagtatgatgattttataggttactaacacatttacccatacaatcctacgagttgtatcagtatctacatttataccaaaatgactgttagatgtagataaaaaggctatcaaattctattctaagaaaaattaaataataattttaacatgtgaaaacaaatgaagcaattatgtatatgactaattacatgcttataatttataaatgttattagagaaaataacaaatgaattaaaaaaataagtcaagcgaaattagattcaacatatcatatcaaaaaggtaaaagtaaacaatgcagttaaaaaaggtaaaagtaaacaatacaaattatctcacatttgttgtcataaccacaaattaattattcaacctatttaatcataattaccacaggagattta

SEQ ID NO: 3233 - DNA, 1206 bp, Glycine max
  Soy_ogl_3701 Gm11:3090501..3091706 Cluster 13
tatttaaaagggtgtaaactctatatatatatattggttgcgatgcaaatttagtattattatataagaaatttgttaaatgtgcgaaattttaattactaataagtaaaaggataaccataaaaaattagattcttacttcttaaaatttgttaaatgtgcgaaattttaagaagtttgtacttaaaaaaatatcaaataaaattcataattttaaattcttatttaatttaagcttctaaaatagcatttcttattttattttatctttgatattttagaatttctataccagacaaaatcatttatccaaatagtttaacttaattaattgaataatataaataagtcattataaatatttaatatttatctactattcatacatacatatacataaacatttggttgtctagtgtgtgagatttatgatagacttaagtttaattagacaagcatgacatgtgtgagtgtaaaaagtctcttttaatcctacatttattatttaatttaaattattggttgccgacacaaatataataagggcataattatacttttacgtgtttttaaaagtgatgtatttctattttatcaaacaaaataaattactaacttattttgattatatttctcacctatttatctttaattaaatagctctacattcaactttattttgactctattccttttttttttcaaaattttttcttttatttttgcttactctatttttcctcacaatcaaacagaacctcttatacgagttcttgctttaggatgctgattaaaaaaccaataaaaattcattaataaaacgtgacagagatatgaattgatatagaacaaaaaaaattcacaatcttatttttataaaaaaataaatcatgcatcaataatataaaataattttataatgggatctaatcatactcacagtatatgatatatttattaatttttataatgaaaatataatgtgaaattgaaattattttatagtgtatgaacatttaattcttttataaatttaggtcgtgtttgataaaaaaagtatttgaaatccaaagagctaggtagctaaaatataagaatctaattgatggattaggattgatagttgaaagctgcaagtttttttttttttttttacaaaaaactacaagtttgttaagtttatttaaataataatacaaatatcac

SEQ ID NO: 3234 - DNA, 1031 bp, Glycine max
  Soy_ogl_650 Gm02:44715801..44716831 Cluster 13
attgaaatcccctgatcccttctctcttgtgatattttcttttcttgaaatttgttctcatcctttaaattttcaaatatcacaatcataatttctctgtatgatccatttgaatatcagaaattttctattcagtaatgctatatgttacgaaaccaatttgcactaagaatataattccaccggtttaatttttttatgcacaaagcatgatgcatgatccttttcctatttgcgtctttaaatttttagttggtctcttaattttttagtcacctaggccctttaaaatacataaatcatgcagtcaattgttattatataatacactacgtaggctcaatctttatttttagtgatgtatttttaaaaaataataattgattatttttccttttcgtttgtcgaggtttatatctgccagcgcataaaattcttcactgtagatttttttaagcaacctgtagaattattattgttgtaaaaataatttaaaggaaaattataaggttgacaacaaccttttcaaattgaaaaaaaaaataaactaaaaactaaaaatgaaaactgaccatttttaaaaaaataaaaacttggaaagtaaatttatcccaaatggagtcatgtatgtgtttgatattttgagtgttgacaaaattaattttaaataaaattgattttatataattaatttggattaaaactaattttaaagtaatgtgctataattttcataaaattataagaggattactaggattaaaattaattttgacaaaattgattttaaagtacaattaatcatatatatatatatatgaaacttatggtatagtaaagacccaagccaattgtaaacaattagaaataggtacaaaaagaatgacatttgtcttacagcaagaacaagtatttcagcgcaactgcgcaagacacaaccccaggagagggtaacatagacattatggaatatatgaatacatagttaatttgctcctataatattattgtcattcaaaaagaaaaccccc

SEQ ID NO: 3235 - DNA, 1000 bp, Glycine max
  Soy_ogl_1414 Gm04:45347901..45348900 Cluster 13
tttaagttctaattacattaaatatttagaaattaagaaaattttataacttataataattttatttaactcaaataaaactgttcttttacaatcatacaattttcatgatttttaaaattaaatgtcaccattaaatattgacagagctattatatattattattttgatggataacatgagaagaaacattagagaagttaaatttaagtgagtcgaagttacaaatatttttggatttaccttaacaagtgcacacgtaggcacatatatatggtcgcgaccttctaccatatataccatcccctgttttggtttcacactatatatatatatatacaaagttgacttctccaaagcaatatatactacgtatcattatcatacagattaattggaggcctttgtaggttcctcactttaacgtgtctgtaataatgcaatactagcgcaactacacgagagaacaaaaggtttctagaatgtgtagatccctcttcattgtatatctcacatttgacaagtaaattaagaataaaaagttattagatttttatcagatgataagtataatccttgacaaaaatttaatgtaaacaatatttggccgttcaatatttaattaatatctctctctctaattttacacaaaattataatagatatttttgttaaacttatcatttattagaagttagatatttaaataattatgtaaaaaaaattcaatcccctttaatacattattgaatccgtttccggtctatgatcatgttaataatgtaaattttactttaaacagtatgcaataaaatatttatgaattaaattttaaaatcttttttcttgcatgttagtacgtatagtatttacctttaacttaaacaccactccaatattgttagatcgtgattagatgttgaaagacaatattcgagacgaggttaatgggtttgattggaacctatcatgtggttgttcgggtcaaataaagaccca

SEQ ID NO: 3236 - DNA, 1027 bp, Glycine max
  Soy_ogl_3209 Gm09:39847774..39848800 Cluster 13
gaaagcactaaaaatatatgtatatacgaatcattaaaggtatgcttgaataaacttatctataaatacttataaaaaaggaaaaataaaagaaacttctctccataaatttaaattaattcaagcataagttaaaaatgagcttagagaaactaatatgaaataatttctagattatgaataagttaattttaatttttgtaaaagattattattatttttcttattttcttttttcataagtgttgagaaatttatccaatgcaaatatgctctaagtaaacaacaaaaatcttacttaaataagtatatagaattaatttgattttatcattttcagcaaaaaggaaaaccgcgaggtaaaaattttgatccctctttatcatttgcaaatatacttgtaagaaattttttctcatcatttctgtgaaataaaagatcctcaacttaaatctaaactgaaacacttcctaacacgacaaacctcaattgaaagacactagctaattaacaaaactatgctgcaccagtttccataacgtacagttgacgcaaaaagtttctatttttttcttaaaaactacgggtattctccctgcatcagctatcaattattaagtgttttctcccaatagagttatccctaccaaaaaaaaaaaaaacttccgtcattattaataatcaaaggtcgttgataatggccaaaacactctattccataaaaaaaaatcggctgccaagaaaaggccgtcaataaattggttctcaccaaacgactaaaagatgaactgtcggtataaaaggtttcaattcgaataaaaatcaaatgaaagtcatgttttgtgttgttaaatcaaataatttggatttgaattctaaccttgaaaatcaaataaatcatattaaaaataataattatttgaatgcatttataattttttgaccaagatcaattattattacttcgataataaatgcttcgtactaataattctcacaatatctagaataattttcttttaagcat

SEQ ID NO: 3237 - DNA, 1357 bp, Glycine max
  Soy_ogl_6252 Gm18:58683201..58684557 Cluster 13
tgagaaaaaggctcgactttggtccaatgattcttgcaattcaggttatcgtttgcatgtctgtacggcctcttaattaccctacactctcacacgcccatgcatatccaacccaaaccatctttctttacaaacttttctgctatctttttttttgctgttccctgtactatttctttaaaacgttttaaaaatataacttttaaaatgatatagttttaaagaaataaaaaaggatagtagatgagtcaatttcctctctttatcttctttgaaaaatctacaatagtatataaaatatgataattaaaatgataccaaaataatgtacaaaatacaagattaacatgcatgcctatcattatcaaattagaatgtaaaaacaaaatcaataatatccaacattgttgataaataattaaatttcttaaacataatataagagtttaaattttaaccgcacatataaaaaaaaaattattagaagaagcagaatttatttcaataatctctacacatgccttaagtgttaattaatcacatagcttccgactgttgaaatattatatttctagcaaaaaaatgtgaaacaaaaaataaaactatatttagtgcgtgtttgtatagattggcagtacagcaatccaacctctggttttaaaagcattttctatcttattttttcagtaaaaagtgtatatattgagcctcttgttatcacatttgaaacggtaaaacaaatatgcttttagataatttgttaatactagttgagagatatgtttattaattattaattgcatggatcaagtagtacatgatttttttttatcttaactactaattttaaatttaaatcctaaatattcagttatattaaatattaggtaaaagaaattcttacttatagtgatcataattgactcggacatagcaaaagatagttgctctggattttctaaattaatttgtgttagacacgtataacatcttaatatgtatatgatatgaagaaaagagggcagggacgtggattctctggcagctctctatactagctctcttactagtttgcatttaatatatattcttcattttttttctactttaatgattttaatttttttgtaatggggagacaacatctctgaagaaaatccaatttcagagctcatgcagctgaaaccaatcaacttaaaactcaactgcacgcctagtaaacgaaaaatatcaactcgtatgattgtcatgcacatcacatcacatgttaatatttttttaactggccttacaagattaaagaaaccaactataaattttttacagttaaattctgtatgttcatattacagtttag

SEQ ID NO: 3238 - DNA, 1200 bp, Glycine max
  Soy_ogl_6863 Gm20:39371801..39373000 Cluster 13
tcaaggtaagatataatgccaaagagtgggacccgaatagttcattatttacaagtgcattcatcaccattagtatgctttctttccttctctctttatttttaatagctttcttttaagttattattataccgccgcagtagaatatgttcatagcacatataatttaagagggaaaagagaaagtaaaaggataagataagctagaaaattaaaagggtacgttagtacttcatgttgaagagtgggggttgtagggggagaaagtaggtaaacatctatcaaatgatgcaaggtgtgacaccgtgtaaaaattattgcggtatatattatataatgaattatactactatatggttaaataattgagaagtgagagagagagatcccatttcctttgtttatgtacatttttttatacgtatgcatgttagctggtttgtttcgtattgtcgacccgattgtgcgctgtaaatacacaaaaagaaaagttccatacccaatattattccttgtggctttccctctcaatatattacaccttgttttatctttgaactacctgcattatgcatgcatatgaaacattaattgatggtaaggaatctactaaagtttcgtggcagccaaaaagaatacataaatcataataatatgaatgaaccatagaaaaaaaaaagtgggggtttaggcagagaaattaattttagtcgcaagtgtgataataacattcatcccaacacatcaaataatggcatggatggaatataaacgaaaattataatcaagaaatcaacaaaacaataaatgacataaagacattattttctgttaaaaacaaaatatcaaacataatatttaaaagaatattattttagaatttaattaaaatatactatagttaacagtttttcaccaaaacaagttatctactctcatattttagaatttaattaaaatatactatagttaaaagttttttagaattcaatcatggattgtcatataattaaaaattagttatttttataataataactttaaatttcatatttaaagttattaatttgttaacaatctttgaaaactaaactatatatgttaactaaagttgagtgtttaattttgaaaaataattttatttcaatttactcattcttaatgcgtcatgtaattaaacatatcacattttgttattgt

SEQ ID NO: 3239 - DNA, 1000 bp, Glycine max
  Soy_ogl_47 Gm01:2249201..2250200 Cluster 13
ttcataaattagttcttttctaacttaaagggataggttagcctcttgtttggtagtgcaaaaaccgagagggggagcaaggaagacaaggaaagtgaggacaataggatgatggtttagttgtatgaaaataagattaatttttgaatttttgtgatatccacgactaaaaacatatcctctaatctgagagaaattgttattgttgcaacatctttcccatcttgccctctcttatggaattcgggaggaatgaacacaactttcgttgttataaaattcacaaagtttagattccatttatgcaaaaaaaaaatgtcttgtttttgtcctaataaaattaggatgcctcatttttttaatttagtgcaagatttggatttccaaacgggtataacttatttacattagttatatgtaagtttcaaaaacaatcaaaaccttgcttgaagctaaaaaatgcatattataattttattagaacgaaatattgatgaaaaattctaaagggacgaaatattaaatttgtcaattttacaaaaacatatttcagcctatttaaaattatgaaagatatagagatataatatttgaagtgtttttcttttttatagaaagtgttagctagcataacaagtataatcagttttttaaaaataaaaaacaagacaaaacagaaatgaataaacttaccaaaaggtaaaaatgcatttttattcaatattatttttctcttttaatttttttaactagtaaataattttaattcaaatatttgtcatctatttctctccatttctcttccgctaaacaatctatttccatcatatttctcacttattttctcacatattcactaatttcattatcttcattttctttctcacaaccaaagataccctaaacctttcaatcatttagtataattggccatttttgttagagatgttaaaataggtctaccgatccaatttatctttggtctagcaaaggacgagtt

SEQ ID NO: 3240 - DNA, 1000 bp, Glycine max
  Soy_ogl_226 Gm01:49410801..49411800 Cluster 13
gggtataagaaaaaggaatattagaaaatattttaaaaaatggtttaaaaaaatgaaaaacgaacaagataaaagtagaaccaacgaaggaaatgaaagaagaaaaagcaaacgacatggaaaagtagcatcgatcgcatggtttttataaccttggaaaaatgtatggtatcaccgatttcttaaagtgccttttgcacgtcagttttttagtttttttaagaggtgatttttttagtttaatatattgaaagtctgtcattttttaaataaagttttagttctttaaatgttatattaggttttgatccttatatttttattttataaactggttatttttttttaaatgttagttctttctatttatgcattagtctctatattttttattcatttcatttatagtttttgtaaattttattgaccaaaataatatttcttattttctctttttttatggaaaaaaattattgagcacatgaataagctacataagataattttatcttaattaatgactttgaatttaaattttgagaatacaataatattaaatatttaaaagaagaattgtatagctcataacaacctcttatttaactcaataagatgatttttcataaaatctttatgcaagtagtcttttaaaaacaaatcataacaaaagatacaatattaagaaaataagtaaataacaaccaaaatgattgtaaattgtggaatttcaaacttctgttaattttttttttctgagtgacacacaaatctaatatccagtttcaaatcaattcgccaatacatcaacccaactgccgaagttaatgttgagttatttcagttctagataaaattatatgtcagcgaattatgttttaattcaactaatgccacattctgatacaaaaattatttacatataaaatatcttcttatatatgctgaaaaagtcaattagtcaaggctcccataagaatcaaacctaaggtacgctttgctg

SEQ ID NO: 3241 - DNA, 1100 bp, Glycine max
  Soy_ogl_1814 Gm06:6935801..6936900 Cluster 13
aaatgaagtggtcatttgcaagttttttaaagtgtttaacacattaggaggagtcacgtctcctcagattgctgaagtaacatgtggaaaatatgtgtatgcaagttaagccgtttaagtggtatcaactgcggctgtcaaaataaaagtggcatatatcaattctgagaattttacaaacatatagggggatatatgcaaataacattctgttaaaaaaaatatcatttgactcgtattgataaataatttatgagtatcattgttagtccttttctttttaaaacttgcgagatctcttgagataaaaataagtttgttcttctaaacttttattcataaaaagtacgtattagaactggtttaataataataacaataattgtttcttgtagtattcatttaatttaagctatatagttaaaggtatacatcggaataggattaatcaaagataaagcaaccgaaactcatatattttagatccactaataaaaaaatatttagctttagtttttgtaaagaaaaaatattatgttggcaaaaatgcgacatatattaacaaaaaagaccaaagtatagattttatttaaaataatattttttaaaaatttattttagatctctactcgactctcggtaaatcaagttaattgaaaataattaacctatttctaaaataataattccagtgtttatttagtctttttcaggcttatttattttatgaaaagagaagtatattatctcaaaaatagttttagaaaaatcatcaaaaaataaaactaactttttgaagtcaaacataaattttttaaaaaatgggtcaaatatttttttaattttcttacaacattttcttattaataattttatttaccaaatgaagaaagagttgactgcttttaaaaatttgaatgtacttagttttttatttaattgtgtaattataaagtaagtaaaagaattaataaaggtattatgaaaatctaacattactaaataaataaataagtagtttttatttgcgcattttaacggtaagctaaaaaaaagttcactttaagcgtttttatttaatcctaaatttcaacgacaat

SEQ ID NO: 3242 - DNA, 1099 bp, Glycine max
  Soy_ogl_2961 Gm09:3242002..3243100 Cluster 13
taatgtactttttctaaaaaagaagtgagcgtaggttaataaatcctacttttatttgctaatgcacaaccatttttttcttttttacataaagagtgttaacaagctataccttaattataacttttttaaaaaaaaaaaattaagtgaatgtgcattaacaaatttatttcttaaattaatttgtcttataaatttgagttatctatttttaaaattagtatttttttttttttgcagtaatttggcagatgtcttgtgtgagcttgtaatccaaattaaatcaaacatttcgtggcaaatgatatttaatggttactctcatggtaagtttccacatgctcattatgtgaaatttttctgtccatctttgtgttcttaaaaattaaataggtaggatcatattaaaatttgtgtatatttgaaaaaatacagatagacacaaaactttcatatcatgtgaaacttagtatcaagttccgtaggcaacaaatgcgataagagaccaatcaataaaaaaaccaagcttcttacatattttttttaatggaaattcagcttaacctaataattctagctaagtctaataccttatcataatcaagtaaaaaaaaaaccttcaaacaatttcatttcaatgcaaaagaatatagaactaaaagtataaaaaccgatataattaatgtacagaaactttttagtaaattttggattgttgggatccatggatgggacaaaattaaccaagttctgcaaatttcaatgttgttataagctttttgcataaagttttgatgtgacactgcataaagagaaaaccgaaatgtgcgcactaaccctatattttaaaaaaaacaattgatattcgaaaaaaaaacactaattaagcataagttgtgtaaatttttatatttttaatataaacaattgatattcattaccgaccgaagatgtagatcaactaacattttattctaacttaataagtaattttcagttactcagcatagtagatatacaattaggaaaatattaaagagaaaactttatcatccattattgctactcgtaacttaaataatattgtctttggtaaaaa

SEQ ID NO: 3243 - DNA, 1011 bp, Glycine max
  Soy_ogl_3123 Gm09:36290790..36291800 Cluster 13
tttatttttttaaaataaatcataattttattattttttagtccttttatatttttttaattagttttaccaaacatataatttaataaactagatttttagctttcaacttctaactaattttttagtttaagataacttttaattttctgccagtttttaagttaattttttaaaagataacttaaatttgtgaaggagagagagaaaaaacacaattaattctattttaaaatcagttatttaattctccaaaaaataattgttatttaataatttaaatagaaattaaatgacattaaattctaaggaaatataactatactcgatttaattaacttttcattctattgatagtttctttaggaaaagtttgtttcacgggtaaaaattttacttaatgaacacaagaaattctattgatataattatgtgcaaatatcaaaaggataaaattttaaaataataagtagattcaaaataaaatatttaaaagtaattaattcatgttgtttacttattttgatgctaccttttgttaaaataatttaaaatccaacaaatgaggagtttctgggtgaaattaaggcatagcgcgagcttgacgcacatggagtcgtcgttatcaaagttaaaataatgataaacaatagacacacgccataacctacggattcttctttccttgtcattatctaactttcacgtgattgtattggatgaaactttttaataaagttcttagtatgtgatttttttatttctaaaatattactattaattctttcaaaatatttaattatcataaagttttcacttttattaagcatttaagaaacaaaaaacaacagcacctatactttttatatttattgaacaattttggtttaggtaaatctaaaatatctctggactaataccaatattagagattaactctttcttaacttagggttggtatcctataatgtaatcgagaagaaaaaaaatgaaaaaaaattatttaataaa

SEQ ID NO: 3244 - DNA, 1000 bp, Glycine max
  Soy_ogl_3171 Gm09:38548501..38549500 Cluster 13
attcagggtatatttagttgtgaagagaaaaaatgagagaatgtgccagaaaaaattaaaaagaattgaaatagagtgaaaattaaaattatttgattaacgtaaaatagatgaaaaatatttaaattaaagtgagtggataagaaaagaataaaagtaaagaaatttataaaatattattattctaccagtacactaggtgtcgggaggactaaattggaaaagtaaataatacttatttcttttcaaatccggtcatgtcagacaaaaaaatttacttttaaaatccggtcgaagaaattttatgtaatggtacttagatttttttatatataaaaaaaaatatttctcttccttcgtatcatattattgtttatccttctcttttcttctgtctcctttttctccttcgtaccaaacaggggccatgaacggaggagggacatgcaggtgtaattttatggttcccctaaaatttataagaaaattattatgttagatgatagttaggaagataaaaagaaataaataaattgttgctaatattgagatacatacatataattatttaaaattaattattttatttatctaatttttttctcatatatcattacctttgtacttaatgtcgttatatatattctttatttatcaaaaaacattcgagatatataataatatattaacttctttaatattttttgcatgcaaaaatttaattttttttcttgatcccctgaaatcaaatttcttactccgccccttataccaaatgaatagttaagtgagaaataaaatttaatttttatgtccatcaaaattattaatttttaataaatttcaatcaattacacaagagtatttaaaagaaaatattagagaaaatattgttaacttttttctacttttaattatcatttaacctaaataatatttttttgggattagaaattacaaatatcttttaacccactagatcaactactaatcttattta

SEQ ID NO: 3245 - DNA, 1300 bp, Glycine max
  Soy_ogl_3363 Gm10:4292901..4294200 Cluster 13
ttgttgagtgttatctagcaacgcgttactattacccaagttaaaagattgagagtgatttaatgtaacatttttatgactaataattacgcatagtttttaatatctaaagttaattatttcttagggtttttaaacaattacttttatgaattgaggaagcattaacttactcaaattatttctcatcctcattattcatcaattttcttgaaatttagtaattatatttagtagttaatcttaattattaaattttaagaaaatgaatgattagaatggacccctcctcttaagagttaaatttaagataattttttttgtgtgtaggtcatgggttgctatataattaaaaaatatttattttgtaataattgttttaaaagtcatatattaagttattcttagggtttttttatgtcatgttataggtcatgtacaattgaaatttgttgacttagtttttgtcatactcagagtcagaggaagactgtgattattaatttgtttgtttgagattagcttgctacaaaagcaaaagttacatctcttatgtatattttttttattttaaaacttcatgcatttaaataatcgatcgggagtttctaaaaggtgaaaagaaaaacatagtgaataagttaattgtttttgtcggtaaaagttaacaaaaattgtatttatataacaaaaaaattacataatattgtaaaaaatcttaacctgcatgtcctcaactaaagttaaacaaattcttatcctatccgaaattagtgttaatatatgatgttctaatgttgataaatgttagtgtcattagaacactagttaaaaaactaaaggagattttttttaccggaatgcttaattaaaaatgtatttcatatgatttttaatagtaaattttttaaaaatttcttagctaatattattatagcacatcagttagcaatatctttttaaagaagaataagatattttaaatataactaaatattgaatcaagaattaaatacataatttggtccaaagcatcgaaacttgtggagagttttatcaaacaactgaagatgttaattagggaggttaaaaaaattgttggacagttataaaaaccttcttttatttatgtactgcaatgtaatgcaatgattgtatttggccaccctcaaagttcaacttgtagcaaacgattgaagaagtagtattaattaacagctgtgaatcttcattccaataattattattacaattaaggtgggtctcgtaagaccaactcaaattttgttcccttctagtc

SEQ ID NO: 3246 - DNA, 1094 bp, Glycine max
  Soy_ogl_5763 Gm17:38663701..38664794 Cluster 13
gtatcttatggaatggttgttctaaaaatactatttttcttataaaaaaaagtgttccataaaattttttcttctggaaagattattctgtaagagtttttatacccttatggaacacctgttttgaaaatagatctagacctcaaaataggaaaaagttgagtatagttgagaagaaaaattgagttagagaaaaaaagaatgaaaaaagggaagctctaaatttacacgagatgcaggagaaagaagagaaagaaagaaggtaaaggaaaaaaataaaagaaatatgttggtgttttttttaaaaaataactaagtataaattttattttccttataatattcacacatcatgttcaatttaataatatttaattaaagatctaatcaatacattaaattagatatttataacacaaaagttaataataccggccgtatgcggtcttggagagggattgtgttggatgcttgaccaagtgatttagatattcttttaattaataataaaaatttaaattagtccaaaattgtgagataatttccatctttgtcacactataatttttttaacatatgtcatccgtgttaatttccctcaccgcatacttcgttctgagatgggaaaggacccaaatgcatggctctacagttttttttttttttctttctattgacctttacgaagtggtcaatacttattggttagcatgtttttattttcttacatagatggcagcaacattatttagagaactgctaggaaaatattttctatcgtcacacttttttctttcttttttttggaagttattacaaaattttcataataaaaaggattgttgagaaagaaaggaaaatggaataaaaaatatatattattgtatttttttctttctcaacagtatgtaaactattttacgcgtctcaccaatataaaaattttacatattttaattatgaaaaatttcttaataaaaaggattttttacatgtcttgtacttgtttttaattttttatattgtaattattaaaaaatggaatatgattgaataatagagaacgtacttatctgtaaagtatttaaaagata

SEQ ID NO: 3247 - DNA, 1100 bp, Glycine max
  Soy_ogl_6570 Gm19:44721901..44723000 Cluster 13
gctaatttcttctccttttcttcctttaactataagtcaatcttataatttcccaattttggcatatggtttattgtactgtatatgcaatggactcgtgaacaaaacagttagaataggtcttccttttctttatgtttattaattaatcggatacatccttgctcttttatgtggttatactatccgtattggggatctggctgtgagtatgtacaccaatgggttcccacactaaaaatgcttggtaattaaaacttaattatgggagtcaatacacgtcattgcaccatgcacatatgcgcgcacatgtagagatgtatatactacacatgagctgaaggtcattatagctagagaattatgttttctcgagcatgaaagtcaactttgaagttcatggggaagagaccagggaaactaaggcttcagcatatatgcagtactttagagtttagatcaatgaaattaaagatcaaaagggaagagaaatataagagcatttttataagagtaattcttttaagagaatttttattttctaataaaaattattatttaaagaattaaatatgtttttacttcgtgagacttttttttgtcctttaaatttaagattatttttttagtcgttagaatacgtaaaatgttatctttttatccttctacaaagtaggaatcaaacaaaaaataagaaattcacactttttgatattttttaccatcataatttaattttctattttatattttaaagtataatttttgggtagtttgaaactatcaaaatcaactcaataaaaaaattaaaacaacttttaaagtgattaatggattttttattttttttactgatttgattattatattttttaatcaccgtaaaatataatttaaaatataaaataaaaaatcaaactatcatgctaaaaatatcaaaaatatgatttttttttgtttagttcaaagtttgcaaaacgacatggattctatatactaaaaaataacttcaaatttaaaaaattaaaaaaataaattagatttaaaaaactaaaaacatatttaagtttaatttaaactgtggaataatcttttttatt

SEQ ID NO: 3248 - DNA, 1377 bp, Glycine max
  Soy_ogl_6600 Gm19:46820401..46821777 Cluster 13
acaagaaaattctatagactttctcttggatgtcagatgttttggttactaaacaatgggcgaaaagaaaatatgaagatcaagggcacgataatacaaaaagaagtgaatttaatttcttttggcaaatatttttagtactttgcttatttttataattagaccaatttttgtgtttcaggctaacaacataatatactcattaatgtgactaatagattgtcacattattatttgtcatgtgttatttttgttctacatatataatataatagtatcacaacatagacaagtcaaacttttacattttagagataataaagtgaactttaacatattttaaaaaatcgaccttcaacttttacatatttaatctctctaatgtgacaaataatgatataatatttgtcagtgttttttttttttttgagaggagccaatctgttggccatgcataagtatatataagtagttaatctaaggtcattaagccaagggacaaaaatggagaaaaaaaacaattttaaatttgagaaataaaaaactagctttgacaaaatttgtgaaacttgtaaaatttttcaaaccttaatttaatcgttctttatttttcctttatcaccagtataagcaagaaatattgtaccgatcaatttttccaatcaaatattcattgttgataataatacaaaaattaaaatatttactgtagaatctcaattataaatttattattttttttgttgaaaatatcatagttcattagcgcttttattattttgttactgaattgttaacaataaataaacattcatatattctatttttataaataattaatattataaattattatgttaaatgggaaacaggttaaacaagtaaagtaaataatgcagccgcagtagataaatttgatatatctagcctgctaaaaaatataaactattttttctcgaactcgttatactgatatacattttcagtatattatataattttaaatttattttcaaatagtttaaattatataaaaattacgaattacactcattattccgtcataatttcattccagttcttttaaaaattattgataaagttgtaagtataaaacttgatcataacacgtaaatcattatcgtatagatgatttaaaaaatatttattgtaaaaattccaagaaaaaaatatttctttgacaacacacgtttgtgtacttcaattaaatctttctaatttaaatttctagcttatgatatggtaattgacactcataaagtattatctttgtttttaaatataagacttttttttagatttatttttctatttttataagattttttaaaagttatttttaatattatttatttt

SEQ ID NO: 3249 - DNA, 1023 bp, Glycine max
  Soy_ogl_6941 Gm20:42995101..42996123 Cluster 13
ttgtgatttacatgataaaaggagtaaaatgggggagatgtaaagttggacacacaagttctctatgcacgaaaatatctggagatactctacactctaaagtatgatttagcaattaggcaattcaattatcatttatcaagctgatacgtttaagttattctaggcagtaaaagaaagttatatgaacttgtaagatatatagcataggtgataaatcataattttgtagaacttttgcaccttcaaattttcggaagatatatgaagttatattttttccctccaactgacttttattattaaattactgaataaaataagtattgtatatagaaagttactattaaaaaaatgcgttgattaattttttttattatatagcttttggtattatttgtttttctatatgtataacactatgtatatctaataacattttatcatcggatataaacttacgtaaaaataaaaaatgtaaaataatatataaatttagatgactccatgttcaaatttaaatttaataaggtattaaatagaaatccttaaattatttgggtttgcatacttatatcttatgcgttacagtatatagaaatatattacccaaaaaattatattaccatttaacaaatcaaattgatttgattaaattattttggcttaaacataaatttatttatttaaaataaatttaacacgacgcgtgtatgttaatattagtgatcaagtcattaaagactcatgaaaattttattttggtggctggaagtggatgatttgatttaacattggtttttgaggaaaaaaataaggtccattataattttagtactttttacttcaacagtataattattttaaaataattttgtttacttttatgctaatttattgaacgttttatttttatctaataaaatttgtattttgactaaagtcattagttcatatttaatgaaattcaactcaaattgttttcagtttttttcatatgatatttaaaatttacaatcttaa

SEQ ID NO: 3250 - DNA, 1336 bp, Glycine max
  Soy_ogl_3830 Gm11:10592601..10593936 Cluster 13
ttattttgatgtgactgtgcttatttatgtgcatccagacacgcatttagtaaacgtgaaaaatcacatattggatgtgaaattaattaaattagtatattgaaaagaataaaattaaactgatatgatgaagtttaaagttggatcaataagaaagttcaaaagcgaacacttactcagtatgtcaattagttgaggtttcatctaataatgaataaaaaccttcttataaaaaagagacgatggaattactttataagctctggtagaacctgaacatatatactatctgctggaccttaattaggtagtgactatggattaaacataagaattgttaaaccataagcctactaccgtgaagaatgatcattggctaataaagtttccaggtttgaagcatcccgtgagtgagactattcatgtgtctgtaactctatcattaattaaatttgtttatctcattttttttcttatctgtttgggacagtataaacttttgtacaattttatcatatacaaaataatctctctttggttaagaggtgtttgtttcaagttattttctttcattccaaaaaaaaatgttacttctaaaaatatatgatgatgaagaagaatgcattcccgagtattttaaaatatatttttttggttaatgtagctactagactttggaagttacaccattatgcaagtaatgcatatacaaataggtaatgggaatgtttttttacatataagaattgaaatcaaaatatcataaagtttatgatactttcttgatatattatttaaccaattgaattaaaatttcttgataacatataataaatattaggtgtcaacgatggatcaagatatttttcatttatttcattactaaattcttgaagaaataaatgaaatgaacatgttacacacttaactacgattataatttattttcaaaattataggaataaaagaaaggtttaaatatattttttcttgtaatttaatatttttttgctttagtcctctagattatgtttgcttaattttttattcttaaagtgctttacatattttatttactgtttaaagttttatttataatattttaagaatgaaaaataaaataaatatatttttataatgattaaaagagattttttttcaaaaataaaaaacattaaattacataaacggataaaatatttaaaccagaagaaatggagaggatatttttctgttgagaatatgttaaaaatttcaccataagcggaaacctaaccttttcaccctctgttcacagaaataaaaaagcatatagatacgataatatattttttcg

SEQ ID NO: 3251 - DNA, 1149 bp, Glycine max
  Soy_ogl_2511 Gm08:5019720..5020868 Cluster 13
tctctaaaaaatcatgcatgtgacgttgtcaatctcatatattagtgttcgtaataaaaaaaaatactggcaaaaactaatatataatttttaattctcaaatcaattataaccaaattaaagcagtataaatggaaaactaataaaattatttaattccaaatgcaatcatttatagccataaaaataacaataacaaattataaaaggaaaatactaataaaaaacaatacacaaatactttatttgataataaaataaattctacattaaagagtataaaaagaaaatgaaatatttattccaaagaaaaaaaatcataatgttcataaattaaaaacaatttagcacttaaatactatcatctaaaatcaaactacacaagaaaacaaataatctactgcctacaaaacagtgtcacatgcactgtccatcagtttaaaaaaacaaactaatttttgtttgtttaatctaatcaacagaagcttgtgtgcacgtaataaacctttttaaaaacttgaacaattgatagcttagctgtttatgttcacatgcactaaaacttatgttctgatttgtgttcacgctagcttatttattttcctttcataaataattaactaactgtctgttgctgagacgcgcgttacatttatttaattagttaaggattgcgattaaaagaaagagttggtcagtacaaaacaagagagagagaggaaagaattgggttaacaaggccatggctaagtgtcaaacatcaacaaataatatacagttatagtcagtcaactactaaaagtcattgtaatctctctctctttttatcaatttgttataatctattatatcatattgtaataatgaaaatgcaagtttttagacacgaagaatttatacataaaaaaacgaagaatttggctccaacattgagttaacgggtaaaaaaagtataatcgttgagttaaaaaacaagcttttgaaattgtgctgaataaaaataccatcattttctctaattgctttagttaactattataattaactttataattttttctcaaaaaatctaaatgaactttaaaagagctaaatttataaataaaaatgttgcactaatgtttgaataaataatgttttgttaacaat

SEQ ID NO: 3252 - DNA, 1087 bp, Glycine max
  Soy_ogl_773 Gm03:633714..634800 Cluster 13
gataatggttttttaaaatgtatattagatggtttgctattgagtaaattttccatactattaatgcatatatttttttctcttaatattaaatgtcatatatttaatattttcttactcattttaaattaggtcttacaaagtactacaaactattattaaagcacgcacgctgttctcgttggaggctttccggttagcgatgcacgtggttttgcttttaacccgctatccacacaaagccaccaaccacaatctctaaggattggcccattaaaaataggaatagatatatttttcgtttttacaatttaatattattttttgtctttggaaaaaaaaaaattagttcctctaaattttattttgaatcggtaaatattatttaacacaaaacttttgtctctctctctttttttttattacttaaccaactttatactttatccttaattataagactctttcaattaactcatattccttaagaaaattagttattgtattaaatttatcaattatttatattatcattttaaaattattcttttattatctctttatccacctacttgtttctcattaatatttgaagaaggaattattaactaagggtatataagaaaaacataattaatacatttaaaaattataaaaaaaagtcttataaaaattaacaaataattttttgaaaaaaaaacatcttataattatgaactgaaggagtaattcctttagtctcacaatttatatttattttgtttttagtctttaacattaattttcattactaaaatattgatgtggcaaatggaatgatatcattatcatatcacatcattacttcatgacttcatccagtcacattaataaaaaaaatttcacatcatcattaatttataggatctacaatcaaaacaaatataatatatggggctaaaaaaagacatatatccaagaataataaaaatatataaatctaaatgcaatattaaaataaagtttctaattaaatttaaaattgatatatttaataatgtgatacacttaacactatcaaacttttataaatccctattgtgaaaaa

SEQ ID NO: 3253 - DNA, 1236 bp, Glycine max
  Soy_ogl_1795 Gm06:5424901..5426136 Cluster 13
gaaaaaaaaaaaaaaacaatatcgtgcatcttacattgccaaaaattgagacatgaaattaaatgtaaaaaaaaaagaaaagaaaaagaatactactctaagcgatctgagagaaaaaataacttgattcaaagaatacacaattgcacatgcttaatgaataaatggctatggaaatctttttaaaagaatgtccgcaaagaaaaaaaatatttttttctttaaatcattaaccactcaaatgcataaattaaaataaatgcagggtgtaataagagataaaactaaagcgaggagtaagcatacatgtacaatatttgttgaagtaaaccgcattatgatttttgatttttataaatgcataattgcatatcttatttcactaaatttgcgtaactgtatatgttaggtgaggtaaaataaattcaatttttgctcatatttaatttaatgaaatatactattaacttatatgagtcagtaaataagttattatacgactgatcagttaatggtgttttagtttttgaaaattttatttctagttttttttagtagttattatataacctgcagatggtaaatccatgggcctgattaatattccatattccttcgtatcgggtcagagtaagctcactataaactagtaaggaataaattgttcctaaatgttgtgtgacttcaaaggggataaagtgcttctaaaacaatttagtttataactcttaaagcatttgttttaatttctaatatatttaaaatagttaaactttaatcaatgtacactatgcaaggagaaaaaaatgttagttataagagtttaagtatttcaaaaaagaatgtaatatgtttttaatccttttattttcaataaaactttagttttaatcaatttagtcttaaactttaccaaaattataattttcttcacttttcggtgttaatgttgtctatggggacttgaaatgattacttctaaattgattaaaattagaagttaggaatcaaaataaagttttaccaaaaatacatgaactctgaaaatatatttttccatttcaaaaaatataaagacaaaaaatatcaattttgaaaattaagacaaaaataaaaatttaaatcttttcaaaagattaaaattaccattaaaccttgtatgattttactacataagattgtttgatacatattttactataaaaaattaaaactcaaaataaattttaagagact

SEQ ID NO: 3254 - DNA, 1200 bp, Glycine max
  Soy_ogl_4885 Gm15:2990501..2991700 Cluster 13
caaggatgattcatcctcacatgtaattggagtatttaatcaacgtagatcaaacgatggtgaaaacaagtcaaagtttttcatcggtcggaagaaaacacaaaactaagccactaagaggcgtactaaaatgtttacttaggtagtcatgttataacctaccttctctcctcacctctcacaacttcaattccattatcgcttttttctcaacgaaaactaaattagaagaaaaaaaaaagttcctcgtgctctctttttatcaaacaacctcaattttaaaaattctctctattttctatcatttgtctcaccttatttttcctctttgccaaacaaatcgttaaatatattatttcaaaattccctctatttcctctcatttctctcactttatttttccttttttttttgtgtcaaacaagtcattcaatatatgatattacaatatgtattttttttctaaggtcgtcgcatgccattttcttataatttattttaaaatacattattaatcataaaatcttctatcttctttcattatttttatttaaatttaatttttatatattttaaaagttttaatttttttgtcctaaataaaattaaattgaaatattttgatattttatttcaaaattataatacaaagaaatcaatattttacgttgaaattaaaaataaatataaatatgaaaggttaattgtaagactgataaaaataagttaagaactataatgagaacattggcattgaagtaagattttgttggatttttaaaatctgatgtgaaattttaaggtacataaaaatgagttaagagtttttttttttctttcaagaattcaagcattggagttgctttgaagtgtaacactttatttaaagggaaaaattctctcgaatggaaaaaaaaatgaaatggtcatgtatgatgtttcactgtttattctttcaaacttttactttataatagaaatatattatattaataaattttatttaaggattaacatctcatataaagacgagctaagtttattggaaagaatggaagtttgattttcgcataatacatcattaaaaataaataaaagatttaagtttgattaaggtttaaattaagaattaattttatagtttttccaaatgattaaagtttattttttatcatcatgacattgttgtaaaatatttat

SEQ ID NO: 3255 - DNA, 1275 bp, Glycine max
  Soy_ogl_6297 Gm18:60185201..60186475 Cluster 13
tttgtcaatttaattatgctttgcattaatgactaatgcttcattaattagtttaattattttatttgttgcgtttgtattcttaatgattttagcagcaaattgatttcctcgattcctatatatataaaggaatgacaacatgagtatttggacatacaaagatattgattctattttcttcctttatttatccttacttggttctttctttcattatattcttcctaggaaatcaattgagtctgcaaattaagtgttcagctggccttgtatgtatttactatttggtcatttggttaaccttagaggccgagtcaagtatcaagttgtattggaagttctctgaaatttgctttcaagaaagtattgattttcatggtacatgttctcttctattacacagtacacacatgcacacacaaagcctattagtaacacactcttagacattgtgagaaataagaacaggaatatcaattattagatcaatttaaatagttaaaattcaaagataaatgtgcatgaattttttaaatgatcataaccactagctaatttgaagttttagtaatttatatatggttgtatgatccatatttatcattttcacattcttaaagtgagaatagttctcactgaatatatctcatcccatatttgttatgtatttttcttttatatttagttcacttaataactttttataaaatttgtaaattcaatcattgaatcatatatatcaaacatgtcaaattttagataaattgaacaatcataagtgtgctgtaagcttatagttaacatttatttatattttgaaatgtatatgttaaaataaagttggttaatgaaatattgaataattttaaattatatatttttatatactgattttcaagaaaacagttgaagttattaaacttgatgctcataaaaagttatcaaaagagaataagtcaaacaaattttttagaatatgtggattcttctctctctctctctcttttttgctatcatctctctatatatataattcaagtagtttgagcaatcatatgtagtttagggagccattatacttgatttaatggactaacttaatgaaatattgagagactaaattttcttgaatttttggtatagggaaaatgaatagagatgggaaacttcaaattttagacttgaactttgacttttccgatcctcatttaggtcacaattctagaaatgtgattgaaataatcttaatctttatagaaagcttttacacac

SEQ ID NO: 3256 - DNA, 1048 bp, Glycine max
  Soy_ogl_949 Gm03:38702353..38703400 Cluster 13
cgaagttggaagggttacagtatatagtttaaacataccttaactactattttatatttgttaaatgaaaataatgaagacgtgacttttcaagacatgtttgaaagctaagttgtgttgtgtgattgaaacatgtttcaaaaaattcttcaaagtatgttgaaaacttaagccgatatatttatataagattttttaaaacttataaaaaagagagaaaatccaaaataatttcaaatcttagatattaagttaatcctataaaagattaaaatgattttttgaaaaaggctgaagttatttaataaatttataaatctttaacttaaatattatttctgagttaaaaaaattggattgcaattttcaaatctgtaagatttggaataaataagatataagtgaaggaaaaattcctaacgttatttttatttaacttttaaattttattcatttaaaaatttaatttaatttatttataaaattgtatttgttttgatttttttaacgagaaatatttaatttttctaatacgggctataatattttttttatcaaacaattaataactttttacattttttgagaaaaatattttaaaagttaaaattagatttttgcaagtttaaaatgaggattttatttgctttgagtttagccggccttgggaatattgttgaaggttttcaaagccttgaggttcaaatcttctttttaaaatgatgatttcataggaagttaaagtaaagaaactaataatatgattgcaacttgtgatgtgaggaataaacatttaaaaagttataaagtaaatgtaaaaatcgatgtttgaaaaaaccctgaattaataatcaacaatcaagcttaaaaattgatcagaaaaatattttttcacgttttctttttcatacatccttttattgtaaaaaaaagtaaaagaaaaattataattaattattcttttctcccccaccaaatgattttgttcaaaaagttcatgcatcatgaaaattttgcaatatttgaccaatcagaattataataatca

SEQ ID NO: 3257 - DNA, 1200 bp, Glycine max
  Soy_ogl_1670 Gm05:34572201..34573400 Cluster 13
attttaagggataaatatttgcttgtttgtattgtcgaaaaattcaaaggtcctcccattgcacaggggaggatcatactaattaattagattaacaatcagtcaaaggtggattatattatgcgagtcttgtacaccagtgagggtgtggtgtgaccggttgtaacctggtttttaacttgttaattttgcgaaagtgccccatactgtattttacatgtttagataccaattttttataggataaaatacgttttgtttgtatttttagtctcttgtgaatttttttttagtctttgatattaatttcaacaaaaagaataaccgatcgtaacatgtttttttaacttgttaattttataaaagtgtcccaaactgcattttacagttttagataccaattttttatagggtataatatgctttgatctttcgttttttcttgatttttttttagtttttcataatttttttttactatttttagttcatcataagttgcataaaaaatattcgcttgacttatccaaatttaatctataaattattggaattaaaattcaaaaattaaataactatgaagtttgggaggagaaattgaataatttgcatttcactaggccaatttgactcgatcttgtacaagcaaaaccatacatcatattgactttttttggttaatgtctttattagattttgacccctgcaaagcatgaggtaaacaaaaaatttgagtgtatttatttggattttattagtttatttaactataaaaattggtataaacctttgtcaaagaataataacttttacttattcttactttgtatcatgccataatttttatcttaaatgtgtttactttgataactaaacaattgaaaaatatttaaaatatgaaaaaccacaaaaaataattaaattgcagatgtagtatttaacttgtgcatgaacatatataattaaattaaattgtatatttaaagtttgtgttattttattcaatgtgagtacccaaaatgtgaaaataagaataaataattatcaaagattgtgatgcacttgaattttattttttatataattaatgtcacaaatttatcttaattataattacatttatttcataaaaaataaactattaagcaactcttactaaaaatacgtttaaaatatgtaaaattataataaaattaatat

SEQ ID NO: 3258 - DNA, 1314 bp, Glycine max
  Soy_ogl_2111 Gm07:1314601..1315914 Cluster 13
ttatttaagtcacacaaatcattattatttatcttgattaataatttatcctattaattaaacatatgtatgcgagaatgtgacacattctaaatatgtttttcatcgtgtgctgttcaattacttacatggatggatatttgaatattctaattgggcacgtgaaaggttcacgaacacgcgcagacatgctgtttattttagggatttgaaaagtgtgcagataggagaaagcttagcatgaaagaaaatgagttcttcctataattgggcccacatctttttccacagcttctccactttctaccacccttcaagtcccatagattttgacccaatcttgcgtataaatcacagcctcttacgtattaaatgtctattaatgttatattagagtaagacaaacaaattaaataataatcatatgcttataagaaatactacaaatttattctctaacacatttttataaatacactctttattattaattaaagcttattaaaaaatattaaattttgtagattttactgtttatttaacaaaatctactcatgatttgatagtttcaaataaattttaatcaacaatattagaaaacgtgttatatgctgagttcacatgttgtaggaaataagaatttatcctccgtgtttgaatctcattgatacatgcaacaaaggttttttcttcaagttatgatcttattaattgtttgatcgatctagagaacttaagtactcaaccgatcctcttgaatcattcaatataatatgtctttttgttaattagcatattttaaatttttaacagctttttttaaaaataaaatatgatcaaatatgctactactaattaatttgtaatatatataccttttcaaagtcatatttagaattggacaatacatataaaacaccttcaattataagcttttaggaaaaaaaatatttattttaatacccttgttaattcaatcattaagattttatttgacaatattttatgttcaatccaataatatatatgattttggaaaaaacatgtattgtcgttagtataagtagaatacagagcagtacttttagaatatataattatttttaatacttgaacatattcttagatgataaataatcaactcttgtaagtctgagtttttgttttaaacatgagaaatatttttgttgtgttatatatatattttttttttgagtgaaagaatagctttactaatatttaacatttatttttacttttttaaacaacaacactaaagtttgtcttcaaagcttaaatttagttactttaaaa

SEQ ID NO: 3259 - DNA, 1162 bp, Glycine max
  Soy_ogl_3609 Gm10:47704501..47705662 Cluster 13
caaaataaatgctactactaaatgctactactacgtctatgatttttcactcttaaaaattatgttgttcttatggcgcgtattttatcctactcccatgtcctgttatattctgattatcaaacgggtcgtaaactttaaagcctaaattcttcattgctttaataagatattgttatcttcatacctgcattaaaaatatccacaccctcctcttactcatgggaacaactttagtatatgtactcatacgtgttgggcatccatgtaccctatctagacctattttaattaaattgaataagttattcataatttgtttgacaaactagtaaaatatatttgctattagtactaatattaatatatgaaaaatcaataaaaaaaaagttagtactggtctaaaatatactatttaattgaattgaaaaatactgaaaaatgatttatttccaattataaattatttggcttaaaatttgttttgaaatatttcaaattatataaacgtaagctcaagaaaaaaatatatgcttaaagaaaaaatagaatattaaaatgattttatgcagtatgattgtctctcattctcatattatcttttagagaaaattttatttaaaatattgttgaacattaaatacgtgaacttctctctctgcaaatagttaaactttgatacctcatcatattataagagattagtctctttaacgtgatttaacttctagtggcctactctcctattatgttatatggttgaagaagatttactcatagcatttttagaggtatttatttaactaataatttttagatttttaagtaggtttgttacactacattacatttaaataactcactcattttattttaacaatacagtatttaagcaattaacatttttatatgttttatttgcagataattttatttaactattaaaataataacttctaaagtaatattattttataagaaatcatttcttatatgaataatcatgtttaaatttaagcaactcacattatatattagctccaagggagaaaaaataagaaacaaatcctttatcttaaaaaaaaaaatccttcatttaagcagctctgttaaaattacttttaaaatactcataaatgtaaactcaaaaaatgaggtgtct

SEQ ID NO: 3260 - DNA, 1070 bp, Glycine max
  Soy_ogl_202 Gm01:48488686..48489755 Cluster 13
ttacgaaaatttaaacctatgactttgatgtatttaaataaaagagaatttttttaattaaaataaaatataaaaatctcataggtcaaacataaatttttttttatttttttctttcttctgaaccaaacacatccttcatggatattatttggactcttccactagaccgatcgttgtggttcattacttttattatcctttgaaagtttgaaattttgcaatgaggaaccacttgggcacagacacatgcatgacagcataacatggtctaccaaccacaaccagaaccagaactagaactgtgtagagactgtaatgtagagtgtaaagacattcacattgatgtgacaaagatggagagaacgttaccttactgtgaccgctgggttatctaatgatcagtatgtgacaataatttccacagtatatatatatattgccatattaacccaccacgcttatatattcaatgatggtgatggttggttactgatgcatgcatgtatgctcgaggataagctgaaacgtaataaatagctggcggccaagaatatatttgttctttttcaagtggtattcatttcaaattttgactgaaatcgttttaacaaaattgttgttaagataattaatttgaaaaggttaatgtaaaaattatttgatattaaatatattttaaaataaatataaaagaattgatttatacttgaccgaatatcatcaaattgcaaattgtttaatagataaaataaaaatctactttaatataacataagtaattacttttttaacttatttataaatattgtttgctttaatcatattttaatagtttttaatggtgggaatattaatttgaatagtattttcaatttaatttttaaatgtttaattaataacatctttgaatgattctacattttttactataaaaatgaatatatagtcctttttatattttaataaatttaaatattcaattaataatatataaatgattatacaattattgtcatattattgatttttatttttttcatatggcactttttctaatttttcaaagc

SEQ ID NO: 3261 - DNA, 1237 bp, Glycine max
  Soy_ogl_4466 Gm13:35901301..35902537 Cluster 13
taaaaattaattccttgttcttatatattcttctcatattaaaaactatatcttgttttaacaaaatataaatattaattgtgtttttaaaagttgaaacatgatgttgaattataaatactatcattagatttgattacttaatctttaaaaatcaaatctcttttcttaaattgtagaatcataatcttgcttttatttaatttatataaatatcattttcataatatgtgatcaatataatgaatcttttagttattaatataatttaaataattagtttcattttaatttttgtatttttctctcataacaaaagttctagctccgcccctaggtatatataaagaaattaaacaataaaaagtaagatatttatcttctcttgatatatatgtgtctcctatttcccttaaaaaaaaattttgtctcctactaaaaattctcgtaccgaaaaaagatacacattgagaatacctgtaaattaaactggtttaaatgggtacgaattgtggggcatcgacttcgtcaattgatcggcgtcgtttcttgcttcttgtagtaaactactagtagtattattttttccattgactaaaataattatcatctgtctacgaaaattatttttaaaataaaattgacaacgcaattcataatatgcagatattaatatgtttctattgttaaataaatttgtgcaacatttattaaataatgagatttttaataataacttttatgaattaaaattaatgataaaaattatatttaaaatgtgttaaggatttttttttttacgaaatgttaaggattatgttaaaaaatatattattaattcgtaattttttattttaatatcaaattaaaatgaataaaagaatcttttccctaaagttatactgctaggaataattaatactagtatttttgtaaaataacttttttttaccaaattataaaaatgaattataagacgcaactaaacatatttttttttatcgaccttaatattagcaaacatctttccactaaagttacactcttaggaataattaatagtatttttttataaaaaatgaatttatatttttatataaaaatatattatttaatttaacatgattgaggtttcctaaaaacaaacatgaggagttagttttatttttttctaaatccgtcaacaaaaaatctttcaaaaaattcgatttagttaatcgaatcgacaaatcgtaat

SEQ ID NO: 3262 - DNA, 1171 bp, Glycine max
  Soy_ogl_6929 Gm20:42321558..42322728 Cluster 13
ctagaatgagacatattttagaaacagaagaaatatacgaataatattgacacagtagttatatcttgtttctcttaatcaagtggtctaattttaattatgattaattcttaaaaatgaaatatgttaaaaaaaaatattcaccaccttatgtctattcattctaaaataaaaagattgtctacaatttgacatcatacaagtcagtctattcatatatctctgaatgtgaatacgtagccgttttacctggcatacgatgttgggcggggaaaaatagaccggttgacagatttttttcctcaatttgaaaaaaaaaaaatactagtaacaaacaaatttgtttaagtaaaaataaatactgaatcaaaatgtaacacaaatattattttttagtattactattataataatttttataatgtattgaaataatatatttatttaccttttaaatattaagtaggtgttttagaattcttaacaaaatttttaaataactcatcattaatgttacattatactttaaaaatatatttatattatataaataagttagatttaactcttataaatcttattttttatatattcaggtctgatgtcaatagcatcagttttaattttttgtagtttacaatttattttatgtacaatattttttttcctattgatctatcagctaattagcatatttcgggataatttataagaaaattcaatatgaattaagctatagaccaggtcaaacttttttaaaaggttagattaggtaaaaaaaaaaaaaaaaaactgtaacaaataacaatctaaacatgaaccttaatttttttgtttttttaatggaatttatttttgttaagaatataactatgtttaatataatctatttctactccctatatgctatttgattaaaattaaatattacaattcttttggatattaaaattttaacttgataaattatgtaataaaaggcaatataaattactgaggcgttaattttaattgaagaataatattcaaatcgaaataggatcctattcagtttaaaaataaactgcaggatgtgcagttataaatataactcttaaaatttattaaagtaaattttaatagataaaaatactatttaataacttaaactagattaaaaaattggaggggg

SEQ ID NO: 3263 - DNA, 1249 bp, Glycine max
  Soy_ogl_5545 Gm17:6132801..6134049 Cluster 13
taaaagttattttaacttaaaattacaactatgaatctagaatcaattttatattattttcgaataagaaattgattttcaattttgaattaattctttcacgttaaattaaatacacagtaattgagtttgaaatttactgtcactcccacatttgttaattagttactaactggagaatatagttatttgtgatttccccccctctaaactcagttttatgatatgtttgataattttaaaaagtatgtttgtacattaaatttttacttaaaaattcactttttttagaaattaaattagacttatttatgtaaatttagtttgtaaagtagagtttaatacaaattaagtctacaaagtttaattcaaatatgaactatagttgctggaatataaaaggaaaacggtgtgtggaacgatgattgaaatacttggataaaatgattcatttatactattgattgacaactaaaataatagacacaaactcaacaagtgtgactcatttagcaaagtaggagatgacttaattttgatttctgtaaaatatgtttctagaaataaacgataaattttaattaagggtgactaagtttttgattgaaaattaatataattaaataaaaaacaaatctcgttaagataacttgaaattccataaaaaagttaattatcctaattatggtgataacaacttaatttattttgataaatggtgagataaatattaaaaactcataaatattctattaaaatattaatataattatcttttaattgttaatttgatatacggcttaaaaattcatactaaactctattaaaacttttttttggtacagaattaaaacacaatataattacctttttatttgttttaagaaagaaaacgaaagctgtaaaaaaagaaagaaaatagtaaaattaaaaattaaaaaagtattaattatgcattccatttcccctttttcattaggttattgagagaattaaaaatatcttacaataataactattcttttatctacctattatgaggtaagtaatctcttgtttactaaaaagaaaaaggctctggagtctggtgcatcatagagatggccagatttttattttttattttttgtgaacagatagatggagccaatgatatataaatatagtgatgtgtaaactaaacaattaattatagttaatacgcacatgtatacaacagtatttggatactactaatattaaaaaaatc

SEQ ID NO: 3264 - DNA, 1049 bp, Glycine max
  Soy_ogl_204 Gm01:48499952..48501000 Cluster 13
tgcaatggctaacgtatgttctccaagacattggtgtaaattcctcccacagaattcctaccacactaacaaatatttctaattttgacaatgcagaaaaaatgaagtcaagaaacaagaagtaaattttctatctcgaaatgactactagtaaacgttaaaaaaaatcataaaggtattaaaaaatgtttgattaaaattaatttataaacagtgggatttggaggcactatacgtgatgttcagggtcaatggaaatcgttggatatcaaggttcgtgtggcttcttatattaacaagttaattgtaagcttagctgttatgccttatctgttgcttgggcgaaaggaattaattatgaatcagataggtgagtcttattcctagttagcttagctatcaccctcatctttgacagtaacaatgatttatatccttatgatccttaattcagaagatttaatactttttttttacttggtataactactataattaagatcttagactctttaattatattcaaagtattcccacaatctttaattatattcaaggtattcaaaccgacatttctttatattatacaaaaatcaaattagatcctcctcacaacacttcctttccttctcttggctgctaaatttttatttggaaaatattaaaatgtctttgaaatcaaaattttagtttagaagttgattattcgtaaaaaaaatatcaacaacctaaaatatttgtttaaaaatggttatccataagtaattaagcttatgtttggaatagcccatttgaaatagtttttagtttttaattaagtatcaaaaccaaattttagtttgcaggattttctttttatttttaatttaaaaatttgttataagtatcttagaattttcctttaaaagattcactatataatttctcaataagtaaagaaaaaattcaagttttttttttacggattccttaaactaagcgtctaagcccatatccaatccaggaaagatagtgaaagtaaagcaaagacaatttatttgtgtaacggt

SEQ ID NO: 3265 - DNA, 1100 bp, Glycine max
  Soy_ogl_221 Gm01:49228301..49229400 Cluster 13
taatcaaaagcgtagttatttaattgtgtagttattaaatctcaatccttgtgcaaacgatagtgtacttactctttgtacgattgataaacttatcgcatccctacatatattttgcaactttatgacttatcatcattttataacatctataggtggacatatatggttagatcgattcgtttagcctaatctacaatgacttgcatttaaaaggattaaattaaactaacataggttgattcccaagactaataatgaaaatataagtttgatttaatgattggaagggaacttttatgtggaaagagaaggttgtggattcctttgaatccatctcactaacatttttaactaaactagtaaattaacagtttatgataaaaaaattaaaaagtgattaagaaaaaaaatattaaaaagtgaaagatgtctaatattaatgaaaacatatactaacaaatatgaaattaagtattaaaaaatcatattttgtaaaaaaaacaaaaattcatatttataagcaataaagcattaaaaataaaacgataatgaatattttttaaaaaaaaaaaaaaataattggtccacaagttagcccaataacttacatacgccaacttgtataatttgaaaattaacacacagactcaaacctacataattcacaaattaaatagaataagtccaataaacccacatttaaatggtttgcatattttttttaccatgtcttaacttggttattctgatagttaaacggaccatcacctctaataacatccctcacagttatcaccgatcaagagactcccacatgattgtgcgtatttcctacagttttaacaattacgtatttctaatattttaagaatattttttaacttaaataaaatttaaagcatatatcataaattgaaatatacaagtaaaaaaaaaaaaatacaccgtcaagggtatagatcaatgatacgagtttgtttcaacttaactagtatttttaaattcatacaagttctaaatatttaaccgtattaaatattcgaaaaaaaaacatatttcattcatatagtggtctaatttggctcaactgctctagt

SEQ ID NO: 3266 - DNA, 1148 bp, Glycine max
  Soy_ogl_1246 Gm04:5863873..5865020 Cluster 13
agttgtgataattttacaaacatataaaaaaatgaataatatcaaaaatatatacttatgttatgtataaagtcatactgagttggattatatcagttttcaaaattaataaaaaaaaatcgatctttaattttttgaataatttttttttcaatttttattaaatggggtggatttgtgagcatctctaaatatatatttagattttaaaataagacacattaatgaattaatttttaatgaaattcattaactgttataagatgactttaattattattacactctctaccatgaaatatcaagacccatcgatcttatatatactgatgaataagtttaatttgttagttcagtagcaaggaaagaaataaaaataaagtaaattaagatgaaattttttaattaaaataaattttattatttctttttcactgttatgcatatacggaatatttgggagacaagacaagtataacgtatttaaaacttaaaactgagaaaagtacaagttaaattagtctgtgatgtgaagacaaaatttcaatttcattccgactgacccaaaaaaaatccaagaacgaggagcaaggaagttggcacctcacatgccaccaatgccttttttttttctctccctgcatgcacacacattcagtacatgatgccaggagagataattaagcaattcctaattaagattaattttgtaacttatattatttggagagataattaagcaattcctaattaattgttaatttataaagtttagattgtgagtttagtcagattaataactagactagacatgctatctatttgttaatccaacctaacctagtaaccttatttaaggtgtgtaccggttctgccaaactgatatagcccaatgacataaaatttattgcgacttaatcttgggataaaaattgctcggttaatccgtcgcatatttataagttaatttatgtcaagtttacgtcaagtcaaataactcagctcaagattattaagaaaattaattaatcaaaaatgacacatttaaagccgcgaaacgatttacttaaaaaattaatataataataataataacgtagacgtataataataatattattatcatattaaactaatgttttaagttt

SEQ ID NO: 3267 - DNA, 1000 bp, Glycine max
  Soy_ogl_6755 Gm20:34723701..34724700 Cluster 13
ggatccaagcccataatttaagccttggctggccccaaatttgctcggttataaaattccttcccagttcccacaaaatcataactttatgctctggagagacaaaaaaaaaacattttaggtgctctagagcagtaaaacaaattttaagtcatgatatcatactttagctatttggaaattggaatgttctctttcgactatttgagtcattgttattatgtttcggtttatttgtatttttaatacttcaactgaagtgataataaatattagataataattgaagaagatttttctgactacagaaacataagtctttttctcgctacacgcttaaaagaactacgaatttataagattaaaattactcgcagttgtagtttcaaagttaacaagattgttttcctctcacactttttatcattgaaaaaaaaagaaatatgagaaaaacgtagagaaataaaatgtcaaaagttatataataacaggaaatacaaaaaaaaaaaatcctactaactaaataaataaacttatcagaattagataataagacgtaatttagaaaataagaccatgtgaaaaacaaattgatagtttcaaaatatctacttgtataaatttaggtgttgtgataattttgtaaaaaaattacatacatgcaggtgttttgatagtattatttttcctctagttatggtgaagacgtgaaatggtggtgcgtgactgtgggatatactaactaatacagacattgcattggatggattctgctactgcttctcatttcaagttttggagttttggagaagtacagtggggatgcttaaagctagctcaattataggttttagaattataagtctttaggcattttatgttttcgtaatctgtttaattgccctatactacttgtgctgcctatttgctatcttaataaaattcactttgcttttaaaaaaaaattaatggctttgcaaattgcaattatatctcaaat

SEQ ID NO: 3268 - DNA, 1141 bp, Glycine max
  Soy_ogl_694 Gm02:46283800..46284940 Cluster 13
cttatcatccatacctatgtgacatatataattactaaattattcatattttatgttatgtatattacttaactacttttgttaaatttttatacttactatttattttctattctttttattattttgaagattgaaactaaatctctaaggacaaatataagttataaaagattatgctctctctcaaatctcaagtcttaggattagtttttaggttaagaggatatgatttttataggaaaattttgactgaaatagaattttatatttaattatgataaattgattgtctcattgttgatttttttaaaaataattttttatgttttttctttcaatttatttaaaaaaattattggactgggatgaatatatcctgtacccaacggggatagaggaaaacaattcatacccaccaaataaaaaactggattttggaaagcaagtacatgaatgagggaattttatacccgtcccgcaccgtgctgtttccatgtctagtgtcatttggctgccttcaagggaatctgttgttttgctcattcattgtcgagtcatatattgatttgcttttgtttatatggaaaatctgtcatttttattctttcttttagttattttaccattttatctataaaattaattaattgatttccaaacaacattatatgttttttatcgatgttaataataatagtaatgtccttttgcaaagtttttagctttctttttttcaaacaacttatagaattatctcattctttcctttcttctccaaaccaaaagtatcagtaaaataaactacccttgacccttctcattataaaataaaggataaaatatatttttaattttaaaattttcagtaaagcttaattttagttttcatacttcaatttaatcatgaaattttagaaaaaaaataatgattttcgtcttttctcaaagtaaaaatctgtgatgaggaaccaaattattttttcaaaagtttaggattattttatcagcattaagctaggtatggaaattaataccaatttttacgaaaatacagaaattaaaaacatattttagtctaaaatgaaatgcttccatagtatcccaaatggtaattagttttctatccaaacaaatacct

SEQ ID NO: 3269 - DNA, 1081 bp, Glycine max
  Soy_ogl_724 Gm02:47760220..47761300 Cluster 13
gttaaagtcatcaattttttacgattttatatccataagttataaaaatccctatgatttactcctatttaggtattaatttaaaaattatctccttttgatcaaacaccccttggaccgcttccaacaactttcgataagcatggagttaattttaagaaaaaatagctaatgtattgatagtataaataattttatattatcatttaattataactcaatatatttgataaatttattaattttataataattattttaaaattaacgttaatttataattaaacgataatgtaattttacatttcaatgaatgcatataattaaacccttattttaaacactctgatgtatgcttaatttttcattgaaatatgaaccattaaaaaagcattttcataaatatgagaggggactgaggggtctaatcgaatttaaaaatccttctaaaagctattgtcgatcagtaatactttctgatttggtcaaggtgacatattacacggataattgagccattcagtctgaaatatttttcatgttttctatcttataagtaatgtgtattacgacactctgaaagataactaaacataccttttttatatatagattttaaaagattaaatgaaattttaaatatttttatttcattatttaaagttctaatattattaataattagttaccaatagtgttaaaagttacataataaaaaaggctttctttaaaaattgaaatttattcacattaaaataaattaaaatataaaacacattatttatcccaagttaataataataaacttcaccaaaggtatttataaagaacaaaattaagaaagtcaaataaataaagcttgtcgtaaagttaaaattaagttttgtctatctcaagttttgaaaaaaaaaaaaaacagaagttatataatctcttcaaaagtaaatgcacataaattgattttattttcttttttttctcttagatggacgtacccaactgtttatcatgttcaatgttcaatgttgaatttcttatcctctcgtctttcaattatgcttttcttccccttcttccaaac

SEQ ID NO: 3270 - DNA, 1000 bp, Glycine max
  Soy_ogl_1214 Gm04:4160301..4161300 Cluster 13
taaatttgaaaaaaatatcaaatgagaataatttttttctttttgggaattagaaccaatttaattttatcttttgcaatttgaattggttcaattattttatttagttagcaaacaaatgaaatttcattaatttaggttaagagtagaatctattatgcttttgtttagtttagaaaagaaagaaaaaagtagtaagtacgatgatttttaggttgtttagtagaaaataaaataaaacgaaacaaaagataaaagttttattctctcttgattggtttttgtagaaagtagtagaaaaggaaaaaaaatgtatataaaatgacataaaaacccaaataacaaaacataagttgtaaaaataaggataatttatggtcgttttgttttaagaaacttataatgaaatacctttcaaaggtattttttaataagcatacagataagcacattaaaaaaggaaaaaaatgcttgttttattttaaaatattttttaataaataaattaaagcgaacggccttggtattttacttacacaaaaagtagtttcttgtccttttcgcctaaattggatgcagtatcatagtgttggtctccattaattttttttttgcagttcttcccctcccgacatggtatcaactgtcaaatagaggaaggaaagggctttgaattactatattttttctttccatctccatcctttctttcatctcttcttctttccaaacatatatacactttagtgattttttatttagaaaaatatttattaaataaaaataatccaatacatattaaaatatttagaaaattcttgtttggaatattaaaaactcatcataaattacactcatttcagtttaaattgcaaatcataaatcaaaataatctcaattttatttgagagtataataggaaaacaaataaatttagtagatttatgacttggttttgttttaaacatgagaactcaaaatcgaattgaattctattaaa

SEQ ID NO: 3271 - DNA, 1000 bp, Glycine max
  Soy_ogl_1699 Gm05:37292601..37293600 Cluster 13
aactatacgcctgttaatttttctaataactatctaaaagttatactaacaattttttattgataaatgaaaaaatttataatgacaatacatagatatttattaagttaaaagttaaacgtaattttttcctacattaagagttaatttcgtgtccgggatattataggatatgataactattttatccaatttgtaagatgttatttattgcatcggtaggatataataatattattttgccgttgatccttttggtccttgctgatctatctaacatgtcattttcagattttttaaattgttacaaaattaaaactagtgatgcaatatcactaagaagatattttgataatttttaattgtcataaattaaaaaataaggctctattgggtttaacttgtggggattgtgcttttttgtttatgattttacaccgttagttttagttttatagtgattttaaaagatctagatatgaaagtattgcgtaacacaactttacacagcaaaaattaaaagggtaaaaatttaattataggaattaaaattgaatgttttaaactgtatgaaataaaaagaaaaattgttgcagttataagaaccaaaacaataattaaatcctagtttacaagtcttccttactttaaaatgcgacaccatttcttcctcctaagtttcaactgcaaaatatacacaatatattatgtataaatggctaacacattcatattgtcaacgaaaccttatatcatagataattatatccaacaaccaaatattataagtagagtagaattttattccaaaaacactagatccaaggtccaatttcttagtcatgtaacctgtaaactcaaaaagataagtgacttgaaaagtgtattcattaaataagaaaatagttttccaattatacaatatgttaattattcatagttaaaaattgaaattatgtttattttaaaatcttattaataacgaataaataatcattat

SEQ ID NO: 3272 - DNA, 1229 bp, Glycine max
  Soy_ogl_3979 Gm12:2777072..2778300 Cluster 13
ttatttttgatataagttgattcctatttttttcaatgttaattttgtttttaaaatctaattatatttcttataacgcattcacgaacttgttcaaaataaaaccattgaaataaggataaacattcatgaacactagaactgtgtagatatcccaaaataaaaaataaaaaaaggagaaaaaaattattataattgatcacgtgatgcgataagtaggaaaaaataaaaagtattaattgattgtttatactttatagtaattagatgtacaaaagcatgacacttgaaataaaatattttctctcttttatactaatcttaaagaagtactgctaagaaactagtatttttaaaataaattatttaaggaatggaaactggaaataagaaaaatagaaaacgtgcgtggtgagaaaatgaaagcagggagaaggagtggccgagaaaagaggtaatgattacgtaacagatgccaacatttaatgcatggatatgatcaggactgaggactcactctcatctgacgcccatgccgaatgtttccctcttctcctctgcaagtgccggctaatgcaataatatcctttttctgagctttttttattattttcttctatcttacatataaataaaaaatttaaactaacaaaatattatttaatatcattcatttaataaaatgaaataaaatttaggctaaagtatattttttattttcataaatatataaaattatcatatttatattaattatatatatatataactgatataaaaagttaacattacacgtttgaatttacttgcatctatactaagattaaaaaataatatattttaattttatgatgataaaatatatattaaaaattttacataaataaattttaaatatttacgaaaataaaaaaatattttggtaaaaaatttatattacttgatatttaattctaataggagataatttagattaattataagttgaagtagttgtatttataattaaattaactataagttgaatttaatcgaaagtggatcctttccggtgaaaagatatgctccccaattgaatcaattctcatactaaataaaattaaaagatcacttttttcaagctaatatactaaaattatattatcattagaataaaataaaaaataaacttatgtaattcttaataactttttatttttaataaattcttattattttaagttattact

SEQ ID NO: 3273 - DNA, 1096 bp, Glycine max
  Soy_ogl_4465 Gm13:35841501..35842596 Cluster 13
aactctcttcgttgcttccactttcacgtgaccacacacctttgcatgactttagtgggtcccactttctctctcttttctgtttcaactcgccaacgtgtgcgagactgctactttttttttttctttctttctagacgggtaaataaaatgagttgtgatattaggacatccaaaatttataaatgccccactaatatccttcattaatttctgtttatctctctcttgctatcatctcacatcattaaattttatcaattatttatctctttttactctaaattactctaaagtgagaaattgcattttagatgatagaacgtacgtataatcattgattaaaaaaaattaaagattgaaaattaactataatatcaatagttattttttaattaatatttattattgacttattgtgctttgtcttttaaaatgcatgatccacactttagaggagcagatccaattagagtatgtagtataagataaaaatatctatgaaaaaaaaattgattattttgatttttaatccatgataatgaattaataatatctaatcttttaatccatgatcaatagatcaagattacgggcaaatttgttttatattaattattgaacataactgaaatgtgtttaaaataattttaactgtttctttttttttttttttttgcatttgaatgtgtgtatggtatgaagaattgattcattgtgtaaattaagtaaatatagcttcagttatgacaaatgccaccacacagaaatatataataagtatcatgtgctttttttatacaggatagtaagtatcgtattaaataaatcaattacaacaattataatagataataacattatgaagttagtaactttattgtattattcttatactgtgataataatgaagtgactataaaacaattttcttaacgttcatcgtatattataatatcttataaagttgaattagagaatatttcagctatcaatattttaaaaaataaaaatgtcagttcaattttttaaaattattctaagattctttcggataaataatatgaataataaataaaagtgccattcataatac

SEQ ID NO: 3274 - DNA, 1001 bp, Glycine max
  Soy_ogl_21 Gm15:2622700..2623700 Cluster 13
aaaaactaaggttagaagtaataaactaataacaagataaataattgtcatgtgcttaaaaattttcatacacattaataaaaatttaacattagtatacaaatagaggaaaaataactatatatttgttgggattaagaataagaatatttgttattgaggttagtcgtttatcattggctaacaactaaattagtcaatgaccatcaactatggttcataaaaaaaaagttgaacttgttttaaaaaaatagtcaacatttttaaagttttctgaaatataaacaaataatttgtcaaaactaatcagtaaactctctatttttgtaatattgtgtggtattggaccatggttacgtgtatgcttgtgttaactaattatctaagtaattctgtcaattttatttatctaagtaatataaagaaatttccaattatactattattattaactaaatgaaaacattacatatctttttatattttaaaatattgatcatgtttttataattaaatattttttataaaaattatatatattatttataagagacaatctttcttgaattcaacgagaatgaaagactattataaataattattttttctgaatagtgtttaacaactttaagattattgagccaaaatagcttcgtaaggtttaattgacgcgctcgatagtttaatattaaataaattgaatattaacgagagattttaaagatctgtttttttatgtggtctcgaattgattgtttttgcataaataaaccaagtaaagacaaaaacagttcccgatttattgggtagacagctgtccttttatttgtttataattttattcattttttatttcagtcggttattctttaatgtaagtgtaagagtgtaaccatttcggcaatccttcgatttattgaatattttttttataactggaattattatatttatacatgtggcttttaaacatcaatcatactgcaaaatatcatagtata

SEQ ID NO: 3275 - DNA, 1000 bp, Glycine max
  Soy_ogl_6849 Gm20:38610401..38611400 Cluster 13
gttcctctagattatatatcttgcatccaaatgcttttcctcgaaacttttttcctgataaatataaggtttttagatgatagatatatattttttatttataaatgatgaattgaagttagtttatttaattgaagattcaactgcatgaacaaggctcttcagcttagcaaaccatgatggaatttacctaaaaccattatctgagtcgtagagggatttaatgtggctttgaatgaaagttcacaaaattaattttaaattaaattaattttaattaaaattcaacgtttaatagggaataaacttttttatgctcgggaatcataaatcttaagaattataatttctaagaatcaataaaatatttttggttgatcataaatatttttggtagtatttagataagttttccaaaaatctaaaaattgttaattatttattaaagtaattaatctaataagaatataatatttttactatattaaaaaaaattaacttgaaaaattaagattcccacctctttctatgaaatttttttggtgggaaactcggaaaaaagacattactaggaagccttttttctttggaatgttatttttaaaattgatactaaatataaaaaacaaagatttctaatttagcattcccattaaactaaaaatttctttcctatcaaatgtcccattattttgaaactaaaaattgtgttgaagtttactaatatcttgcttttataatatataatacaatttttttatctagcacaaaaatcattttaatttagaatcaatttttttaacatggaattaaatatatgaaaattaatttgaaatcacattaattaatattttaacatgatattagagaacttaatgtgaacctaaatacacattgaattgaagtcatgcttcataaatgccttaggacttggaccattgagcatattcattgaaagatagagattcataaggtgtaagttgccaaactctaatgaact

SEQ ID NO: 3276 - DNA, 1012 bp, Glycine max
  Soy_ogl_309 Gm02:1218961..1219972 Cluster 13
caactgtgtcagtataattgagccggttggtgattctgatttgaacctcctcgcgtaatggccaatttatgtactacttcacggttaccggctctaccagtctagtgtgatgacaaaataatatttgattgggcagggatgtgtgttggcttctgtttggtataattcttgctagtataggagtattaaattgaaaagtatttttaattattaataaaaatagttattgatattttaatatatttatgacttgttatatatgtatcagtatgataaatataaattatctgtatttttagttgttaataataattttttttaacatatttacaatttattacatgtgtatatgtaaaattgattgttgatgttttcatcaataattgagttcacttagtattcttttctcactataaagtgaaattatttattttagagctctaagtttttttaaggtactgttggttttaaagtatataatcacacttttcaagaatatcacaatagaaatatttatataacaaatttatcctttcctatatacaccttgaaaaaattggagcaacaaaaatatgaacacactactaaaattaaaaaaattataatgaattttctaaaacgaatgttctaagaactaatgtgaaaaatgatttcatatatgttatagaatttttttaggaatttcacaagtttaaaagaatgttaacaatatagattaattgtacgaataaatcaatttagaaagtaatttataaataaattgtttatatatacaaccaatctaaaagttttgagaataatttaaaaagttacaaaagacatccacattctttgtaattatactgttcttgcttatgttattgaacatggatttgtgtacatgaggttatctggattttgaacaagaactgaaattggtgtatatttcttttaaaattattaaattagtggattttttaaataaaattattgtatgtgataaatcttactccctcccgtctcgattataagc

SEQ ID NO: 3277 - DNA, 1087 bp, Glycine max
  Soy_ogl_1355 Gm04:42961763..42962849 Cluster 13
gtgatgctaaaatataatggtaactaataataagaaaagcattatagtaataatgaagtatatagagtgaattattgcacaacttttcatgtttatttttatacatttgacctttcaatagatttacgcttttcttaaaactagtatttgaattttttattgcaaatataaatatttatttaaaataattaaaactcatggcgatcaagttacattctaagttaatgaaaagaaagagtttttttttcttctttacaacaatgaaaagaaagagttaaaataaactctttcctttgctttttgctttttattagtaggtaaaattttaggaggaagagatgatacttacgcaaaaaaaaattaagttaaaaaatacctataaaaaagaattaggttcaaaaaactttattgagaaatactttaggtctaccaataaaaaattatttactattaattttataaaacaaaataggcacatattttttttaaaaaaaaacatataaatcttgtttaaagtaaaaaaaaaaaaaaaaaatcctctcaggatttgctttaagtctcacagtctcacttattgttagcttggctgtgttatttaattcattattcttatttttaatttagttaagttatacattttatattttatttttaaaaatgaggtccaataataattttgatgattatatgttaattattttattcatgaattggatctaataaaaggagttaatttctcataatacagcgaaataaagtttgaatttctgtgtaggaaatactttcaacatgattattttgaaagaagaatacttatagaaaaaaatgaattaaaatttaaagtatcaaatttaattaaaacaaaaaataaaagaagatttttctaacatgcacacagaagctagcgtcaaacaaagattgtgcaatttttatatgtattttcgggactatatgccaaagcgaaaagaaacttatcatcacaacaagcatgtaagacgaaatcgagaggaggtcacttgtgaataggcactaagtgagaaaccacgtcaataattaggaagccctgctttaaaattactaaaataat

SEQ ID NO: 3278 - DNA, 1100 bp, Glycine max
  Soy_ogl_3543 Gm10:45191801..45192900 Cluster 13
ggttgcaaatatattagagtcgacagcaacaataactttggtgaccacaaacgatggttgctgatagggtttgatggattgctatggagtggaagaacggtggtgctatgatgtgaaggggtgcaacatagtattgtgaaaatgacaacaatctaatttgtagagtataatggatcacctaatggtggtgcagtctagtcttcgtcttgaatcattaatattttgttattacttttaataaaatgaaaatactcatgttaagagacttaaagctaaatgtgcttatattagggctaaattattaaattttccttctatttatttaattgatttaatttagtttttttattatggaaaagtttaatttaatccctaatttttaaaattgatgtaatattgtcctctccgttagtgtcatttggattactaacagaggtgtcttatgtgccatttttttttattgagatatcaaattgaattttttaatgacacaaactaaattcaaccaattatataaataggaagatcaaaatagtaatttaatcttatattgaaaatgaaattgaaaaatattcaacaattttaagatgaaacgttctttaaattattgcttttaatcatcataggatagttttctttaaattgtatattctagacagaaattatcactttttaatctctataggaagtacattattacatgattatttatttaattacttatttgtcgttgttaaaattatagagttgtactttcccccagctggaataactagaaatgctatagcaacaaatatggatatacatatttcattagaggaagtaaattaaagagatctagaaagatactagagcaaaaggctaaaggtcacgtttcagggtccaaaattgttttgttgtatttatattcaagagataacaagttgtacaatgagaaattaagggcgggacactagatgcaaacgatataaataaaaagtctggtaaacatgcattatatgtatattttattggacatctaacaaatatatggcataaaaaataagggttaattgaatcagtttttttctttctaatatattttttatgtttaaaagtcc

SEQ ID NO: 3279 - DNA, 1200 bp, Glycine max
  Soy_ogl_3663 Gm11:278801..280000 Cluster 13
tactttaattgtcattaaataaattctatatcaaagtaggaaaaactacttatagcttttctatactaatactttaattgtcattaaataaattctatatcaaagtaggaaaaactacttatagccaacatttaatgtagtattaaattttgtttgtaataaatcactaggtggatctagtggtgaggttaattgtataaattttttattgctgttattataaaaaaattgtttataatgaatactagcattagccaaatatatgaagtgacactttggtcaaactttgactagagcacgaagatgagctaactactatatccaaacaatagacagcaacatcaagattgcaggatatcggtaacccgttagtgtatattgttttattttatttttaaatattattgttatattttaggcttggagaatttgtcgttacatatcctcagaactttataatggatcagtttcttcatattaaacttaaaaagtgatttttaaaaaataaatttttaaaagaatatttttttaaataatttagaaaaacaacacgtaaaaaaagtacaaaaaactacttattttattcaaacaatttttttttaaaaaaaaacttaaatagacggactgcatatttcgttataagtattatctccacatatattaaaaggtttaattttctgtaaaaaaagttttaattttaatatatgatcagtatgaaaaaatttatcctcgaattaattagaaattattctaaataattaaatgtatttttttaaaataattcttatataaataattaatactaattcagtctaccttatttgattgaatattacgtatgagatattgtaaattctcttatgttgtttttgattttaacatataaaaagaaatataagcagttgttgatgttattatacacaacaatggaatgattgtataaaagattttgttatccgtctatattctaattaaaaatattttctatggatgattcatataatagatataaaacatctctaaatttgggatgtaatatataatgtgataagaagaagaaaaatgagattaatccatttatgtcttcttctaatcttaattaatttgaatggcctcttcgtgtatgtttctcgtaaaagaggttaaaagatacactttagcaaatagctaatttatatttatattatcataaagcacgtt

SEQ ID NO: 3280 - DNA, 1192 bp, Glycine max
  Soy_ogl_3680 Gm11:1514060..1515251 Cluster 13
atttaacaatgagtgtaaaatataaaaataagatgaataataaaatataagaaaaatgatgggtccattagaaaactttgttgagctttttgtttagagaataagtgtgattaagttgcttagtgtaattttagtgggagtacgtaaaaattcttgtagtatgtgtttggtaatgaagaaataggaaagcaagggagaatttttttttaaaaaaattgtgcctgagttttacatctcaaccaaattgtcacccatgtataggaattaacttttttaggtttcgtttatcattagagtgtaaaggtgagtttgtgacacgtaagaactaagaattactactcttactaaagaatgagttcttatcaataaaaacttatcaattaaaaaattagttttatttgttaaaaataataatatacactacggtaaagggttttaaaataagtttattattgaagtaaaatttgactataatttagacgatatagtagaactcattgaaaataataactcaaataatgctttacgactatgagtgctcttaaaatatgaaagatgatgtggtaatattgaaaagtgtgaaaaattattaaatatttaacgtaagaacttaggtgagttgctccattgtaaatgctatatagtttttacgcatttatctatcttttttgtttttaaacaactcttttatatgttttatgtttttaatttcattgcttaattttccttaattatgacatttaactatttaacaaatgttcctcaatttgtttcttataaaaaaatctcatattttaatataaaaaaacgtggagatgatttctgttagcatgggcttgtttagtgtatattaaattataattaatttatacattttaagtatagcagtaatatatataaatttatattaatataatttttttcttagtaaattacgttgtaataacaatataaattttaactagataaatactactattatattaaccaggaaaaaacataatgcttgaccgttatattataatagaagctgaattataaaaatacaagaatatataacaactaatgaatatattgataaaaaaaaactgaatgatgattatcaaacttgttgaacctctccaaaaaaatcaaacttgttgaagatatgaacagatgattatactaaaatactaaatctttccttcgtttc

SEQ ID NO: 3281 - DNA, 1012 bp, Glycine max
  Soy_ogl_3758 Gm11:5819401..5820412 Cluster 13
aatagcttgattgccatatgaaacaagttgatctgaattaactcctgtcatctttcagaaataacttttttaattgatattcttcttttaaaattaatttctttaagttttaacttcttctgtcaccttccttgaaagaaaaaaaaaaaaaaaacttcttctgtcaccaacctaccgttccccctttcagtatttttatcctctttaagctaatttcattttagtttaacggtaaattttaacatttaatttttattattttgtaaattttaagttttatttttataaattttatcattcaaattttttattatgcattttattatcaccgacaaaagataaatgatttaatttttaatatcgattataattatcactatagaaaaataaattttatattaattataactataatataaaaagatatttttctacattgattgtaattacaatcaatctaaaaaaagaaagtcactttctttttatcatatcttattatattaaaatttaccgtaaagtatattaataaactctaattttaaaagaatttattcaaatgaatatttaatcaaattattagtcgaccacacacgcttactcagtttctttgaattatatcccgtgggaagcaaatgctactgcctactgcgatcacattgcaatttaggtgtgcatccttcttccgttatgaaactatagtgtaaccctaacaattgttagtcgtgcttagactcttctgtccctcacccactgttctcccttttgtacattttattttctttaagctaattgtggtagatgtgctcttcttcagttttatgttgctacgtatataaaccagttttcttttcaatgacttataagttaattttgtatcattgagttagatctaagaatactaacaacaattttaacaacaattttttttctgactttcttttggaacattctcttctaactgtcataaacatttctctaggtttatactatgatattatataaatttaagaca

SEQ ID NO: 3282 - DNA, 1000 bp, Glycine max
  Soy_ogl_3907 Gm11:35665601..35666600 Cluster 13
atttcatcatgcaactctataaaactatatatttggtactgcgttcacaacatcttgggaagataatgtaactctgttatctatcattactatttttaccattagtgttgccatttacattgctgaattattattttcttaaatcttatgggggtttaagttaacaaaattttctttctatttgacacaattatatatatatatatatatctaaaactcaaacttaaaataattaattaaactaataatctaacatcaactcactaaattaatattctaattgtttatcatacgaataaaattttgtaagaaataaataaattgtcatatttgtgcaattgtaaagaaatgtcctgaagtagttttcatatttattattagattgttgatgatcataatatcatcttgaatgattttaattaggacgataatcataagtgatgagattgtatatctttaatatatatagatgcattaatcatcaattttttattcatttaattattttacttggtatatatccattaaaattataatgtagtatatatctcaaaagattattttttgggtttataccacatgcatgtatcctccaatgcgcttgatggtatatatctcaaaagattataaacaaacattgtttttcagttttttgatatagtgaagaaaatctcaagttccattaaaaattaaatataggtcacaagtagttcataacccaatgaaaataagttagattttgtcttgacttattttacttttttatactactattctaagttagtatttttttagttctctataacatttgtatttattcttatacatatattatttgaaaagctagtttcaaatttgtaatctcccaattcacttccttcttaggcgacgattgtctcagctaacattcattccttaaatagacacgtttaactcaacctgaatcaatgaggcttcaatgtcccaacataaaaaatatgaagaaaaatgtagttaacag

SEQ ID NO: 3283 - DNA, 1118 bp, Glycine max
  Soy_ogl_3973 Gm12:1666683..1667800 Cluster 13
atttctacttatgactcttattgttaattactttttaaaattttaaataaaaataataaaaattaattattaatactttatttctaccactttcaaaaaaatacaaacaaatacgaaaatgcattattaatatttattgtttttatttctaattatgactcttattgttaattactcttaaaatttttaaagataaatattaaaaagtaattattgatactttatttctacctctttcaaaaaattaaaaataaatacggaaataaattattaatatttattgttctttatctacatttagctttgagctttacaattttgtttatatattaatattttaattttaatttttcattcttttattttctttatctcaatgaaacagaaccatgttgagtcaattcacctataatgataataatagtgctatgaaaaccacaatcagaatgaaaatgaagtctgttctggaatactagaaagaaagaaaaattcctcttaagtgttatcttgtagtataaaattaaactcgaatatgatttacgaatagtgttgatggaatgataatttcgtgctctctatttcatcatcgtactgggatgatttaattggaagaaatcaactatctttttcactttttagacttctagtttaaggtttagtctttaaatacgattgacgatataattatggggtgattaatagaaaattgcaaatggaaaaaaactagtaatttttttaacacactatttattgactaaaatttactaaaaaggtatatttttattttaaataaatttttagcctataattaaaaatatatcaaaagaagtgtgttaaaacatatttggctaatatttctctttctatctatcaactgaggcatatattataaccaattacttcccattatcaacaaaattcacacttgatggacttaaataaacttgatagacaataacaattattaaggaggtggacaagtaagtgacaaaagtgttaccaattccttctcttcgtgcgactatcgaaagtgttacaatgaatatgtgacaatatattcattatattcgcagggatgttaggccaggtatttgggttgagtaaagggtaaagctttt

SEQ ID NO: 3284 - DNA, 1199 bp, Glycine max
  Soy_ogl_4006 Gm12:5138501..5139699 Cluster 13
tttaattagttagaaatttatttatatttagtactaacacaaaaattttgtttagttatactcgagaccaaatgaagtatattataaattaaagttgacattattattcattctgttataaatgattataagtctaaattacactaatcatccctaagatttcataaaatacacaaactttccttatttttgtaacatttgttgcgatcttccttttagggaacagatgtagacttttcaaacaattaaagatgatcggaatgatataaaagagtgtcggtttaatatttttaatcaattatggaaggttggtgtagggataacaaaaaacaagaaaaacttatataatttcatgaaactttagaatggttagagtaacttaataaataaataaataatattaagagtaaaagtcaaggggaagatatattttaaactaaattttgtatttttttctaataaacattttatgtttttcaatttcctaattattatatccttaaaataatctttatatatgtaaaaggaagtaggtatggtacttttgaaaaaaaaaaagaaaactttgcaatgattacttgaaaaaaaaatccttttaaaattaatgtgcttattagtaggaacattcactttttgatctattgtgatacagtgacaacagtaaaaatatcctctgaagggaaaaattacacttgtaacctcctagatttggaagtattttttataaaatcaagattttaattttattattgtttgtaatattgtgatatttttaatgtgtgttctaattttaaattattgtgttgataaaggaatatgttggacttgccaagtatttttatccgccattgaaaaatgtcttttccaccaaagttattttcaaaggcaagattgaaacaaatattgaaattgtattggtcaaattttcacattaattaccataaaagaaataattttaaatcaaaatatccatattaaaaaaaattaaaactaatccttataataaatgttgaattgtaggaaatataaagatatgttataaaatcatattatagtttttttaaaaattgattggaaaaccctttcaaaaaatttaattaaaaaaattaatgaatccaaacaaaataaacgtgtaactgatcattacgaagaatgattttaatgagtgtgctggtgctggagattaggagatgaaaggc

SEQ ID NO: 3285 - DNA, 1083 bp, Glycine max
  Soy_ogl_4161 Gm12:38774349..38775431 Cluster 13
aaatacttatgtcattcatagtcaccaaagacgattttggcgatgggtcttgcataagcattatatgatatagaaaaaattatattgcaacttaataaaagaaggaaaaaggtgttgatgaggtaataaaaagaaacaaacatgagagagaagaagtaaaaggaagaaaaagggagaaggatgttgataaggattaaaacataaaaaaaaattattcatatagaaaccaaaatgagtagtagttttatggttaacaggatataggtcagttgattgaaaagaataggtaagttattataaatctctaacatttaacaatgttttttttataaaaaaaagatataattttttttcttataggttacttaaatgtgatgcaacttagtagggatcagttaaattattttaatacaaatatgagacaaccaaaataggtatcccagagatgctctaagaaattaattaataaaaataataaatattatcttaaactcttaatataacagataattattttcataattaaccaacttgaaaaaggaacaaaatacttcatctagttcttattataagacattttggacaaagtcatacataccaataaaaagaattaatacatttgattttattgatttttttctcaaaaattactcatgtatcaattttatccttatcaataattattaacttgatatgggtaatatgaaaatattaaagctcaacagtattatacactgttattgataaaaaaaacaaatatttaaatattaataagtacaactagtgaaaaaatagatatatgcttcataaaaattataaattgcctataaaaaaaccatcatttttttaaataacgtcttataataaagaccagagcagtaataacttctattctttaatttatcctaaattttatcctttaatatagtctaattcaataacggagattaactgtcaattataatcacgtggcttgtcaatcaatttggccttgttatttttctttctttctctatttccttgaagctatcaccggtatggcaatatatacatacaatatttactcgtgatcctaagttattt

SEQ ID NO: 3286 - DNA, 1000 bp, Glycine max
  Soy_ogl_4840 Gm15:418701..419700 Cluster 13
ttttttttactttttggcaaattttatccttaactttaatttatttattttgtgaaaattttattctcaatttttgtgtttattaatggataaatgtccatacataaaatttataaatttattaaaagttaagagtaaaatacgccacattaatttgttggagataaaattcaccaaaatttaaataaaaatacaactaaatcttaaaacaatatatttctaaaattttaaagaaacagaacaaaaaactaacatgtgaaaagtaacatgtagtagtttttttttttacacctagcatgtatgcaatagttagtaacataaaaaactcagttccctaaaaaacatgaaaaaacttataaataaataatatttataataataaaataataagatataaagtctgaaatttattaaaaaaatctgaaatacataatacaacaatatttataaatagatagcttttaaaaaataatagacaagtcttattacaatcgggagtgttcaatttattattacatagataaaaattacatttccacaaataatttatattataaaaaaattaagttttaatttttttaaaaaaaataaaaatattaattccctataaataatttgtctcgtgcatcacacccaaatatgcataaattataatataaaaaagtacattttatacttttatcctaaaaaaaaagcaaaaatagttaaaattactatataaaattactcttttataaaaaaaaaacaagaaaatgataattacttaactaccctccattctacttttatatatagatagataaataaaaaaaaaaatcactgtttgcactacccatagacataggtactagctattgctataagtagccaaacacattttagcagcattagtctcattaaataatcaacaatttattgaaattacatattacacaaaacaaatcacaaagtacaatgcaacttttacatatatatcaaaccgattagcatagttttgcaa

SEQ ID NO: 3287 - DNA, 1174 bp, Glycine max
  Soy_ogl_5511 Gm17:4632977..4634150 Cluster 13
cattaacttacggtaagttgatatctcaccctagctcccaccaggccatcaaaggtggacccaacaaaggaagttagaagctcaaatataactttgattgttttataataaaaaatttatattaactatttattttgtgaaaaaatccaaagtttataaaagtaaattttgacaaatgtttgatatagcttaatatttaatttattttttcaaagttcatataatgatatttaatttcataaatttaaaactaaactcataccgtcatcattctttcattatgtgcatatattttttaccatatattataagtgtaaatataatatttattgactttgttaaagattaaaatgtattaaaaaaattgacatcattttttgtgagatctatttttcaataatattttttcatccacaaaaaacttaatttaagaagtttaaactcaatttcacttgaataatcttaatcttggttattatgtgtatattagtgtatgttataaaaatattttgttaaatagtataaagtattttttaaaattaagcatgcattgaattatctttaaatattctccaatttaataattttaataataataaaatgattaataaacattaacttcatattttagcttatttatttttaaaaacacaaataagcctctttatttaaaaaaaaaatattttttgctctccaaaatctcacccttatcctaaaggagttattttaataaaattacgaaaagacttaccattaccaataacaagttgtgggtggatttgagaatcctttgaaagaaatcgtgacagacaattgactgtacccttcacaaaatgtttatccacgaagtcgtctgattaattcaatttgaaaattgaaggcatgattatggtaatttaatacggatgtactacactcacaagtcacaactagatacttttagttcaagtttcagatcactagttctagttgtcatattatatcaattgtataatcgtgattgcgacttcaaggtaccaattattagtgggaagaaaaagggaaaacaaaacaaaatactacaactattattcttgcttaaaattctcatcatactttttaattgcatcactcatttatctcgtatttttttctttttttactctagaaaatgttgggaaaatattaaaaaaaa

SEQ ID NO: 3288 - DNA, 1000 bp, Glycine max
  Soy_ogl_6616 Gm19:47662801..47663800 Cluster 13
tattttttagaatgggagaatttccttgtatttataaggattagaggggatctagataatcaagccaatgaactgttagataattgtaaggctttattaccatttacagtaatggaacataaatggaatataatggaacataagacaatcttcttgatataattaatttcttcaggaaatctcgatcaagttattgtaagagtaattattaaagaattattctttatttttgctattaatttataacttaaaaacagttttttatgaacaaaaaattcctattttcggtggttattctaagtttttcttcattttctaccaaagctttaccataatttgtaacattacataaaactattagaccatatatgtaaaaataaaaatacacaatataatatctttaccaattttttacgatagaatcataaagcataatcaaataaacacacatgtatccatgtccttgtcgatagtcaaatgaaatttaatacctttatgaatccaaacatttatttagttaaaattcacaagacaatcaatatcacaataaatttttcattttcacatatcacacattactttaaaacaacgttcaagtgtgagttactttgagttttggtgaaagaaacctttcccatttgctaatctgaagaggaggggcaccttacaaccatcaagttcatataatctattatacattgtaatgtattttaataatggaaaatataattgttatattttaaaacattttaattctcttaaaaaaagttcactatagattatacattttttaactttttattattatttcaaaataaaaataaaacgagtaaaaatttctaattaaaatgaaataaaaattaaatatgagttgagatttatttaatattagtttttttaagtagaatcactaaagaaaaaatgattaagttatataaagtgaagaaaataatgaatattgatagaatcgtacaaagtaaattcttggagactccaagta

SEQ ID NO: 3289 - DNA, 1000 bp, Glycine max
  Soy_ogl_31 Gm20:35883201..35884200 Cluster 13
aattcatttcagttccatcttacttctggtagcctgtggctaaattagcagaactttaaacttctatgctaactgcttttgaatatttttttagaataaattatttttaaaataaaataattgtaaaatggtttaaatgagaaattaattaattaattgaagcgcaaaatcatttttaatgactacaaaataatttctcataagaatttgcaagaaaagtgaatatagtttgtcctttttataaactcttatacgaggactatcattttcaatttcttttgagtatttaaagtcactacatatttacgttactctaaaattttaaaaaaaatgcgtgaatcaaataataatattaacattatttaatagctaaaataataattaacagttaaatttaaatatataaagaaaataattaaaattttcatgaaaacaattaattattttatttaaatctataaattaatccaaacaaattcttcagaaaaaaaatctaaaagaagatatttgaaaattaatctaaacataataagaatattgtcacaaactaattgaactttctgccacagacgtgcaatcaaataacccaagagacgttttcggttcctccattcgaaagtctccaaggtagacagcgactattggtgaaaagttttattataatttaattttaatttatatatctttatttatataatttttacttattttatagagttaatttgtataattttgaattaagataaatgttagcatatgtgttggtacatcaaaaaaatctcccatccctcaagaattaattgagggaaaaaattaatttataaacactctaactcactcaaaaccctttttaaagacaaaattgtgaagacttgagaaagtcaaaatgcacaaaatttcaaatattctaataacgtagcttcatgaggtcggaatattgacattaaaaaggatgtcttaattgcattacacacatgagccacaaagtcctgtgaccctt

SEQ ID NO: 3290 - DNA, 1014 bp, Glycine max
  Soy_ogl_403 Gm02:5525736..5526749 Cluster 13
tttaatatatcaaattctctctcttatacttaggattgtgtatatgaattttggggccataggcgaatttttaaaaagccttaggacattaattaatgtcttttatgaatggtaacagattttttaaaagtaccacattaagattaaattaattttttaacatttttttaaaaaaataaaccaaaaccatactttctatttgacatttcctattactaaaagtacaagaaaaaaaaataagaaacaccaatcaataaatattaaataatttttcatagtaaataaaaaataataaaatgatagaacctgaaaaaatgaaaagaattacatgtcgatattatctattgcaagtctataataattggatatcaattatttttttaatctttgaaaattcacttcgaatcttcaaaataattaaaatgaggagaaaatgagagataaaataagaaactaaaaaatttaagtgattttttttggatttgtatataaataataaaataatgatttatgttttgatttttttaaataattaaattcaattgttaattgtgttaattacctttatagcaattaaaacaaatgttaaataactcataaggaatattgacttatataaatgattttctttagttttaaataacttaaaataacatttgacataccaaaataaaaatttaatgtttggagtaatctctaattttttactaaattatatcttagatgcataaaaaattatgttttttaacttttaaggatgataccaatgaaaaaagatgtctgtctatgtttgtttgaacaaaatactagctagtttttgaataacaccaataatccggtagtaagtttgtaggaggggtcaaatttcagtagttaaattaaaagtcattgatcatgattaacctttagcaagggatagtgatacttttgtataaaataagtataataaatattactattaatttataagaaagacaaaataaataaatgaaatatataatgtcacaaagcaaa

SEQ ID NO: 3291 - DNA, 1014 bp, Glycine max
  Soy_ogl_3721 Gm11:4141287..4142300 Cluster 13
gtacattggtcgcataaatatatattgagtaaaaacacgtgttcgtcttgttaatgattctaaaaaaatcaaaatacttcttgtaattatgctataaaatcatggattgaaaaatacatacacatcaactgttaatgaaattagagtaagataaaaatattagattgtttaggtgattaagaaagaagataatgaaagaaaggtcacgttcaatttgtactgctaataataattaaataattaataattaataaaaaaaataaaatgagagtaagacaaatatatataaagttactctatatttaaatatttcttcattatactttacagaacttaactcattaagatgagtatctagttaacactattcacctctgacaaagttatctagaatttaatccttgataattgaattgagagaaaataaacttacagtcaagcaaatgataaatactacttaagaacaaaaaccagctcttgccaaattaatcagaaatattttatgcggattaattctcttatttattttttagcttaattaagattttagtattttaaatttttttgttttagtaactgaataaatatttgacttttcaaagttcgtaaaagttgtaataaaaggaaactttagaaactttgatcagtaaaatatttattcaagaattaaaatcctgaaatttaaaaaagtttaagaagtaaaaacttaattaattttttttttaggaatgcgggccaagttctcttgaaaaaaaagttttttatcctgtgtttgaggtagaataaaattatagagaaattataaccctcaaaattaccctccatattttgcgcaaataaggaatgaagccattaataatggtgttcacactctcgaaactcagtagttgatacttgaccggtaaagaaagaactcaaagaagtgcgtgtttaactttttattaggaaaattaatttataaaattaattgtatttaaaattgttttttgaaaataattaatttatgtttgaata

SEQ ID NO: 3292 - DNA, 1109 bp, Glycine max
  Soy_ogl_401 Gm02:5460201..5461309 Cluster 13
ttacatatggaccaaaagaaaaatggaaacatattttcattttgcatcaacacaaaacgcatgtttctagtccaaatgcaaaacgaaaatgtaattttatttgcattagtttttctttttaaaatataaatagttttatttatgtgtttaaattgtgatattataagttgtaatattattatcattaaatcagttttaattaaaaaaaacaaaaaagttttaatatttgtattataaagtgataaaaaataagatatatactgtaaatattgaaaacgcacaccctaatacaaaacagaaacgtctttttgttttgcattggtgatcaacagaaacacatttccaagaggagtattttcgtaaaaataattaaagaaaaggaggggtgcacttaggtaaaaaggttatgtaaataataatgaacttttactaaacaagacctgtccatttaataatggctacaactgattttaatgggccatttcttgaagcaaaaaggaggtcaacgtctcaccttctacaaaaccagactcctataagcaaaccaaaggagtatatcaattgaaccatgctccgtaaatgcactacgtcattttatttctgtgatgactgattgtcttgcatttcgcacttcttcttagttcttagagtaaattatttttctcattctcgaaaaatatatcttcccttataaaattaaggcttaattatcaatttgtttcctaaactatttaaaataatttaatttgatatctaaatttttaaaagatttaatttgatccccaaattcttaaaaatgaataaatttagtcttcaaatttttaaaaatgaaggtctccaaattatttaaaatgattcaatttaatcatcaagtttttaaaaatttggggattaaattaattcatttttaataatttgatgactaaattaattcatttttaaaaacttgagaccaaattgatttttttttaaaatttggggaccaaattaaataatttaaaataacttaaggaccaaactaataattaagcctaaaattaatatattatgtttttcctttttaataatgatatatgccattatctttatcatatttgtaacattaatta

SEQ ID NO: 3293 - DNA, 1000 bp, Glycine max
  Soy_ogl_2210 Gm07:5370301..5371300 Cluster 13
agtaaaatatatttatttttatttttttcattttataacatgttactttttcctataattttaaaagtaaaaataacctagcatcgcggggtggaattatagtattaattaatgcatctcgatctttgttatattaaatgtaaaagatgtaatatttaaaacattatccgttcagaccaaaattttcaacgaaatatttaatatttagattattagtagtaattttaaaaggcaaaggctaaccagaaaccttaagatatttattaaaaaactaaaagtaaaaatatttttactagaatctgtaaaattatgtgactaatgatttttttttacatttatttataatttctacaataaatatttcatttttttatttctttaactactgttccaaggagactgatatctctattctaaaatccacttaaaataagctaaatgatcatctaatttatttaaagggaaaaaacaataaaaaagatgtgcatttaataaagttttaattttatgagagtatttagtgtagtaagaggattagtatatctttttaatgcttgcagacaaaaaacattcaagaataaatatataaaattatgtagattttattaatatgcagagatccacaatcgaacggtaatggtccaccatccttgaataatgttattaaatatataaaaacatttattagctgtaagtgaatacacaatattaaaaaagatattactgactactatagttaagatataagctaaagcactaaaacgataaaatatttattccgaagattatagaaaaacataaaaaaataaaaacattataattttgtgtatttcaataaaataaatttctcttaattccttaattaatgtcctacaactctagttaacatttctctattaaaaaagttaatattataaaagttaatactataacgttaaatgattcttaaatttttttgacagaattaaatgattcttaatttttttttgacagaattaaa

SEQ ID NO: 3294 - DNA, 1000 bp, Glycine max
  Soy_ogl_2422 Gm07:38421601..38422600 Cluster 13
attattaaaaagtgtgaaatcttattaaaaatatactggagaaacttatgtgagtttgtcccattgtaggtgctctaaatttcttatagatatcttaattgcttaggttgaaaatgacattactagtctttctattatagagctaagtattgatgattttgactctaaaaagtatcattgagtttaatttttcatgacaattgtaggtcttttctttttcttttttgctctaatttacattttatataaacattaataactatgacttgtctagttatcaatgaagtttaatatattaaccattaaattcattctctctttttttacatccagccctatcccccttatttaatttaatatatttcttgtatgttatattttaaagttatgaatggcaagtgtgaatatagattttatttgttagagatgtatttttaaaaaaaatatttgttagagatgttaaactaagtaaattaaacttaaggtgccaaaaaatgagttggggtgagttaaactcattttgtcttttggttgaaaatctcaactcaatccaattctaactagtgagctacatgttgggttggcccatcaattataataataataataagatatttaaaaaagacaactcatagattaatattgctaaacaaataaaaatataaaaaaaacgattactatatacatcaacaataaatcaagcataaatagatcatattggaatagtggtagtataataaactattcaaatatttcaattttagaattttttttataaatgaactaaggtttctatatatacaacctaacccaccaagtttcttttattaacaaatgttactttgttaattttgctagttaatgggcaaaacggaggttagtcatataacttaactccactcatttagacggattgtataggttgatatgttcgaaatgaactcattttggcattcttaatatgttttgatttattaggaatgaaaaaaagaaaatgaaa

SEQ ID NO: 3295 - DNA, 1100 bp, Glycine max
  Soy_ogl_3650 Gm10:49390201..49391300 Cluster 13
aattcggcctagtgttatatctcgattgaaaagggacaatatttggagtgtattttcttttttcttcttttaccttttattgaatacagttcattccaagaaaagcacgaatgcacgatataatagatctaaaacaaatattttcctaagaaaaaaagatgtaaaacaaaaagaaatacttattattacaattacaatgaaattgtatgatattttttgtaacaagtttttcagtgtttttttttattatatcaactatcctatcttgcacattctcatttttcctccaaattatttttgttatataatatttgttatatcaatatactttccatcatataaaatgagtaaaataatttaagctaacattattgtattattttgtaattagatttataacgttttataaaataactttgaggagtattttaattaaatcttaattggattattaatcaatattttcttattattttttcataattaattaacgcttggacaagtactcaatgaataaagttatagatactaaagttaccgctactcacacaaatgaaatagagtacaatttttttttctttcttaaatacaagtgtatcgactatcgacctcgtgtcctaacattttgtatcggaacaacaagtatagctgtatagaaataaatactatattaccttatcctgattctacatttctacttttattatttcacagggagtatttatactttctttcattagtgacttagtgtattaacctatagcatcatacactttagaacaagtacatgggatgccacagcttcggcttgggctccaaattcctactttttgcatgaaaaataaaatgtaactaaaaccattatttacagaataaaattaaataaataaaccatattgaaaagaagtaaattagattgacaaaaaaaaaggtagattaataaattgatcatgcaaaaccacgtagtaagttcctatttttatttttattttagaaaacctcatatatattctatagttgacaaatttattataataggataggactactattcatctttcggtttaaattaatatttgactatttttttaaatgtcaaa

SEQ ID NO: 3296 - DNA, 1009 bp, Glycine max
  Soy_ogl_3965 Gm12:1363563..1364571 Cluster 13
ttaaactaatgtaaacttttttttttacggtaacttaaaacacgtatcacaatgcgtggaattaatttgaatagtaaactaaaataaaattataaagtaagttgtgtgaaatgaggcatggtccaacctaaagtttttttttactagtaagttttgctgatcaatacccttacctcaatattttgtttggtacttctaaaagaaaaagaaaaaaacaaaatataaagaatacaaaagaaagtacaattattactcctgtattttgtaccaccgagaaaataatgaaaatgtatcctgttggataaaaaaaattaaaaatacgtgggaactcatgtcattttttttttcttcctaatcattcatataactatacacgccattatatatttgatctttttattcacattgtattaaaaaaaacttaaaatcttagactatctattttttatcacacgaactctagtatggtaggttaaaaattaaatatgtttagttattagtatttaattttcaagaacatcatgtttactattaattgctataacgtatttataattacctaaaagaatattttaaaataaattttcttaatttatgaatcaatattttcaaaactattttgaagaaaaatatattttttgtttctctaaaattattaaaattcaatttaagttattttatatcattttgtctgtattttgttcattcaattttaaaatgtatgttttctgttgtttaaaaatatatgacatttgattttagatagcattttatcagaggtaaaaatagtttagataaaacttaaaataaatatgtacattttaaaataagaaaagctagaaatgaaaaaaaaaatcaaccgatcaaaatcaaactttaataattgtatccaatattttattgctgagcataaaatatttatttttgaaaattttaaaaaattgttttatatctatgtacctgattaaagaaaagagttattatttgacatttgaatccccaaccgtgt

SEQ ID NO: 3297 - DNA, 1075 bp, Glycine max
  Soy_ogl_5178 Gm15:49595926..49597000 Cluster 13
ttcatccttacttttaatctttctaaggtactaaaagtaagaacaggaaaaaattaaagagcttaaagttaagatgaaataaaagttaaaagattaaaaatcaataaaaaagtttcagaaactaaaaatataaattttgaaaattaaagtttaatgactaaaaattaataaacccttataattaatattttgtgtgatctttttatttttcatttaaatttgtttatatgcgaagaaaattgagtccctttattgatgaattcacaatccattgccttaatctagttgactacatctgcctctcatatattgtaaaaattatagttcaatttctatccttttctatttcttttatgaaaggataaaataataaaaactgggaagataaaactattgagccttttttttcttctatgttaggataaaataataaaaacatgagagggagaagagggaacattttctttttctttttacttttctttacattgcggcacagtccttgaatccgtaagactattgatcttataacatgatttaatagttggttaatctaacttggatttttaaattttgcattttataaaaatttatcaaatagagtaaatgtaaaaaaataatttaatttgttgggtaagttgattctatttctcatacatcaatattgatattaattattaagagtcaaacttctatacttacatcacttaatccatgcaattaatcgtggaatcatttaattaatgtgatctttctatttatttatatatcatcaaaattcatataaattggacgtttttgtatattatttcgtaatggatcatttgtttatatttttttatctataaaaaagcatattattcgtttgcagtaaaaaaaaattattcgtttagataacatagtgtggcaaagtctctatcaatttttttaatttgcatagaattttataaacttaattcatttataaactttcaattcaacagttgatacttagtgttagtttaatatcttaatatattaagtcttagcaaatttagtccataaaaatatcattactatttttttatcaacaaat

SEQ ID NO: 3298 - DNA, 1116 bp, Glycine max
  Soy_ogl_5391 Gm16:31283285..31284400 Cluster 13
ttaaatcatttcactcattaatgttccacttttgggtctccattgtggacccttaaacaagctatgcttttcttctatgtgttttttttattttttttattttaaccactcaagaggaaaatgctacgtaactttttaaacacttacgcgtatagaattcttaatttttttattatagaattaacacctttttttttcttctaaaaagcagtttcattaacttggtttgtttttctatagagatacattacatgtatatttcaaagagacaatctgagttagataaaattatctataaaccacaaaaaaaaattccaagtatttagtgcagttgtattccaggattctaacattatctatatattatataaattgataactatattatatataaaatattttatataattcataattcagcatattttaaacatcggagtattttttttgtattgatggcacttctatttttcagaggattaaaataaatttcttttactggaaaaaaattattttgaattttttttatagaatgtttggttcttatattttacttatttagctagattttccataaaatattatcattatgcagtcatatatatattggtattgctaggtttgctcattttttcacgtaactgaattttgacacgtaagaacattcatttatatttatattttaaaaaatatcttcaaatgaaaaagaatgttatatttgcgaatttttattctacttaaaaatgtattcaacttattaaatgagatatttaccgaaaattatttatagtttaattattaaaaatagttatattatatcccaatgttttttttcttgaataaaacattttttcataaattattatgaataaatttaaataatttaatattatctacaattatataaaaactgtccagcaattgaataggtatcgctattttaagtcaacttttttacatcatatactttctcactgcattttatgttttattttattaaaatatattggatgttttgttccctgagtgtgctttgcatgggttagtgttctagtttaacataattagttgatactgataacttttttatgtacattgtaactgtgttcatgctaa

SEQ ID NO: 3299 - DNA, 1000 bp, Glycine max
  Soy_ogl_99 Gm01:4001101..4002100 Cluster 13
ttttcattaaataaactttatttgtgattttataatttttaataaattataataataatataaaaacattaagaaaagaatatataattagtacgttactcctcttaatcatataaaggagataaggtaaaaaaaaaaaagacactttctttgtgaagaatttgcaagattcgaaaaagcaaaagttaaataaaatagagtcttacgagcctaatttttatttgtaggtcgggtgaaggatttaccaattattagggtctttagcccctagctaagtaatttatggtaaattctccttcacaatacttacctcatacgtgactaaaatttccaggacatggctaatagactactcaaaagaaagtcatagtcatagatatagccgattgagtgggtatcaaaattcatagacttagttgagtgagcatcaaaatccatcgacgtgtttttgccgtaagggtttgctacttttctccattctttgtgcaacgtctttatgccgttatacactattaatattaataacaataaaatcagtaaaaatgaatactaattaaaaataaaatgttttcagataaaaatatatatataaagataattctttttttaccaacgactcaattggttaaaggagtgtcggagtcgattttcttaaacaaagtcttgattcgcatgcctgcaattctctttgtgggtatattatctgtgtatacattcctatatgtgcaagttggtcaatctatatattttcatgataaaaattaataaatctcataagaattattaaagcagttaatagcttattaaaaatcacattttttatataatgattgagttatgaatccaattgtatgtctataatactcccttgtcccaattataaatttttttttagaaatttgtttgtccttttttataagatttttttttaatttctagatgcattaattattatttttccacttcatatctttatttaattactctctctccaaatatc

SEQ ID NO: 3300 - DNA, 1000 bp, Glycine max
  Soy_ogl_315 Gm02:1560401..1561400 Cluster 13
ttttgaatttgtagaggttaaggcaataatacaagatttattgggtcaaagattaataataatagaatatcacaaatgtcttaaggaaactcaagtctggctaaaaaagagaaaggtaactttgaaagaatttgatatccttataaagaacacatctaggacaacaaagacacaactttaaaatcacaacaaattaaattacaattttaaaataatagtatttgttcacgtcacattcatttcacaatttggttaaatcatacttaatatattatagcttaacattccataattttttttatttaaatatgcttattttaatttaaaaaatattcgtataaaaaaacacttaaaaggagtaaaaagcaatttggtatatagattttggagtgatatcgaagctctttgcatgacttaaaatacaacttccacttgcgaaaatttatgtacgcaagtaaagagaaaattttaatcattaattattaagtatccctttgactatagtatactcatgaaaagagttcattgttttcacgccaaaacccactttgcgttataagctaacatcagtaacatgccgttttctccaatgaacaggacacatccacggttctctttccggaaaacaagtgtgtgttttggtcagtatttataaaattgattttaaataaaatcaaggtatttagtgaatcaaggtatgcaaccttaaaataatttccgcctttcatgttattaagttaatgaaaatcggttaagagcaagtaaattttggctattaagtacttactttcttttaattaacattttaaatttgatcatttcttttttatttaaaaaataaatcaaggaaataaaataaacaagtaaaactcaggtgtcattagtataataggaatatttactaaagtttaatttatatatttttatcaatttaaagaattgttcacataagtattcaataggaattcactttgttatcacatcatagtaatcattaaaa

SEQ ID NO: 3301 - DNA, 1100 bp, Glycine max
  Soy_ogl_790 Gm03:1495601..1496700 Cluster 13
taaatattctaaggatactagaaagttttgtatttggggcgcaattttggaacaaaattgtacttttcataaatttttttaactcatatgatttattaaaaactttttttaattttttttttaactaatattcttaaaacattgattaatttgccttatttttgttttacagttaaggttcattaattatatattttttaacaaataattatgaccaactagttaattatgattccttggacaaatgattttctctctcttatgttacaaaacttttttttttgttttttcttaagtatcataataaatattttttttcttttaatttattaactaatgcactagtgtctattagtaagatctttttttactaaaaagactcacctttttaatttatctttcaaccaataaaataatactgtaattagttgataaaattatttagttttattttttcactaattctcaattgagaagaaacactagtgtctaaagatctagcattactctttgttatcaaatgggtgaaacaattatcttttcagaacgtaatttttgataatatcgaaaaaaaaggtaattttttagattgattataaaccagtaatagatcaattacacaaccaacataacttttaagtctctatcttttttcttttctcttttctttttatcttaagtctttatttacaatcatcaagacaatcttagaaaaactaatatggtagcacatgctttagcaagatcatttatagagaatcctataagccatattatctattgtatcccaacttttgtaaaccatattattgaaatggaaattgattctctgttgtaaaagaagaagaagaagcactaaagtctttaagttgtctgcattttcaaccattgcaaaatcaatgtcttttgagttaagtttcaaaaaaaataaatagagttgacattgttctcagatcaaaagctaacttaattaatgagctaaatcctgtgcttctatattgccttctccaactaattaactgagatgaatcaacaatgatgctcgagaaataatatctgcatgagaacaagttacggttcctgtgaagcaaaagtcacct

SEQ ID NO: 3302 - DNA, 1031 bp, Glycine max
  Soy_ogl_1453 Gm04:47007901..47008931 Cluster 13
ttcgttacaatgttgggaagcttcaaaatattgtatacgaattataagataaatttaataatcaacaaattctgttttagaaaaagaaagatccaaaagtttttgtaaatctcattttgccccaaaattccatctgcaacaataaagtaagcatgcaccaagtaatctccttatttaatttgctagctgaacatactgagaatgatttacaatatgtaaagttcatgtagaattggatttggcaagtggctaaatccaaatatatggtttttttttccttttccacatccctaaaaatattatttgattttaattcattcttaagataaaacaaaaatttatgtcatccaaaaaaactaaacactgaaaccgatcgggtataaaatggttacaaatttaagaaaatataagataggttcagtggttaaaaaaatataaatttaagtcctcctattaataaaaatcaataaacttataattaaaattgagccataaaaaaattgattagaaacacttggtttgacaaaagacttggcatttgggagcttccaatattgagtgagtgtgatgtgtgaatgttgattattgtaggcgagtcacatgggttgcaagttggtttcatttttctctttccatttgattatagtaggcacgggggtggttgcatctggttttctgtataagaattaaatagcagccactttgtaagcatttattggaagtctaatttgttcaagttgatcacattatgcacatattggtgagtaggctcaattgtaatttgaaatattttcctaagctgcctttttgtgcatattatttagcaatcaaaatgatttattctaagacaatttctctttgtttcactcttaaagtatctataacgtatggttgtttatgcttaaaaataaaatgtattgcttaataaaaattgtcgttaaaatatttgatgtgacatttcttataaaaaaaatcaacagaaaaaatgagaaaaattaaattaaacacttattctaataattttagtatta

SEQ ID NO: 3303 - DNA, 1000 bp, Glycine max
  Soy_ogl_2189 Gm07:4560401..4561400 Cluster 13
ataaaaaagtatgcttgcatatatagttccacgcatttttaatgtttttattgccttaaatatcgggaaattaacaaagcttttcgtaaataaatttatttaaggatatattctatactttatcttagcttgaaaccaataaatacacgggccatactttttattcattgaataatgttagttcttttatttatttttatggaaacaaatttgtaaataagtaatatagatggagccaccctcgttaaaaaatgaaaactaaaactttatgattaaaaaatgaaaactgacaatcaactataattgcaccaagcttatatgtcttccgttggttttttttttttttctcactatcgtcttacgatatctcaaactaaacatttcccaagccaatagtacgtaacagaaaaatcaagagctgattaaaagcctaaagcttcaccttctataatcgaaagacatggggtgcgccattcaatccttgacaccacataattctcatgttcatctcgtagattctttagtcactatgaaataaaattatttttaaacatggacgttgaaatttaattcgttttctagattacttaatggtaaggtcttagagttagttctgagacaaattaacagaagaaaagtgctataataaagagaaaagttattcctaattaattaagggagagattaattcttatctttcttttaaaaattgtcagcatttgattaaggttaaaggaaatagacaattgcacgattaaaggtgtagatcaaaaaggcatagttcaattagttgaacagttgttaaatttcttgtattagtttttaattttgaatccaactaataaataaaaaaggagtcggaaaatatcaggtttcacgataaacaacatttgactccattgttatgtcaacgagaaaaataaaaacgatttacattaatataaatcccaagtttttaaatcttaggtttatgattatagcaagtttattttcttggatg

SEQ ID NO: 3304 - DNA, 1042 bp, Glycine max
  Soy_ogl_2196 Gm07:4890001..4891042 Cluster 13
atataaataaaaaaacgagattttttaagaaaaataaataaatagttttaattattaagaggccaacttcgtcaatttcaactccctttaaaagggggggaaagaagtatattttggatgtaattgattaggaaaaacaaatcaattaaattagtattataaacttcagaattttatggatgaagaaatttaatggcaagctttcgctgtcttttttttttctattttcgaaatcatttttattttcataatttacttggtgcatagttttcgcaataattaatcgatatatattgatcctaaaaattaagaaaaccaaattttccagtctgatccttttgtttctatctggagttttgtaaaacacagttgataagtctcatggggttttcgggatacgtcatataccatttattcatgcaattattatatatttaaatgctagcaaagattattgatttagttgttatggataaatttcatataaggtgagtttgaattctgttgtcaaaaagacttggttattatgtaatctgtaaacgtttttcaaactgtgaagttagttggtaagttctcaaataccaattcacctaatttgtttaaaataaaaaaatgataaatatgcaaatgaagttgatatgccatatgtttgttgtgtgtatatcgtgtgtttttatgagtgttgctttcttccacgataatgttgcttgcattagttgtataagtgtttttctgtccattttggcatttttcggtagttacaaaagagaaatacatatttttccattggtttacattttctgcgttttcagtctctgtcttatattttctatcacgtctattagaacataaaaaaagaagaaggaacaagtatgttctaattatataaagaataaaaattagactaggctcttatatgggcttagcccaaaaaaaacttataaattagactttcaaagtttgaactttattttagaagttcaaattgaatttggatcctttaatctaattcattatagtttgtaattcacattaagcttac

SEQ ID NO: 3305 - DNA, 1038 bp, Glycine max
  Soy_ogl_2447 Gm08:1113563..1114600 Cluster 13
cttgtaatattttatttatttacttttatataattttacttgatcaaattaaataaatatttatttatttatgcacacattgcataatatttatgcacatgctaaaatataatatcatgtgcatgtttatttatagaatttaattttcattgattattagtattaaaaaatttatattgttagttaattaaaaattattataaatatgattataaaaatagttaattagttaatataaaaatcgaaaatttgactttatagtactatataaatttatgattaggtgaaagtattttttttacaatacatttaaattcttgtttataagaagaaaaaaatgacctcttacgataaatttatgatatcagaatgtttaccttaaaaaaaatcccaagtacagtctctctaatttggacatacttaatcttatcccgcaaacactgacttgcatgtaaaaaatcctacaagtattccattgaatttttgtctatgctaatcatcaaagattcctttcaaatattcaatcgtcttatattgacacagaacaaattctttatttcttttcctagtgttaatttaaacgtcaagttattttagttctctaattctaatatttgtttcaatctagtcttttatttcacttcatttctatttattttcttagttttaatttaatcatcaagttattaatttcacctagataaaaaaaaattgttgtagttaaagaaaaaggctactacatttttaacgataaaatagatgaaatgaaatataaaaaaatagtaagaacacgcctaaaacaaaaaataaaactaaatgagcaaaatggtaattttactaaaaacatttatagattggtctagaatgtaagtgcacatgaaagccatcgcagatcaattcgtttaataacttcaataacttcgaatggtggagattgagtggggtcaatccatatatccgttgttgacctttagaaaatgagtgcctctaaccctctatcacattttggtttgtcagcttttgtgcgagttgcctcta

SEQ ID NO: 3306 - DNA, 1100 bp, Glycine max
  Soy_ogl_2489 Gm08:3319301..3320400 Cluster 13
ttttcctctctcccacctttctcccccgtaccccttcctccttcttcaaacattttcacacccgctccccccttacctcattttcacatcactgtagttttcttgttaattccctcttcttttctgatattgttccatggctattttttttgcatgccactattggacgaaaattagtttcctttatatatctgaaaatgaaaactaatttccatccaatcagccaaaaaaaaaaaactcctccattctgaaatgacatattttcttgtttgtcttttaatagacttatattccatcaatgagaaaaaaaaacattatacttgttttagtttttctattaaaaaaaatacttggtttaaagttcacaaattgaaagtagaaagcctaataatatatattttatatatgaatgttaacaatgtattttgttaatatcggttaaaatttaataaaaattcattaaattatgtataaaaattattaaataaaaattaagagttgtaatttttcttaatttcaaaaaaatttaataaataaaaaagtgttatcaagaatatattattaacattccacttaatattgtaaccgttctacgcaactagcacgtgtgaatcacatatgacttcatttctggtccaacactcaaagagtcaaaatgatagcatttttgttatttttattgtaaaataaaggacaacaattgtagtattttttttgtcttttccaccatttttttccgtgaaactttattattatgtctgtgtaaaacatgttaatctatcatgaattaaaaaaaatgttaatctatctataagttattatataattcacaaattacataagtcgagttgaattgtttttatattataattaattccaaaatcataagttcccaaaaatttaaatctgttttcactattttttaccttttttattcttatgaaaacaatattatacaccaatattataagacaattttacactatcatataataatttaaataatataagataattttacattatcatataataatttaaacttatcatgcttaatttttatgataatattttatataaaattattttatactatgaca

SEQ ID NO: 3307 - DNA, 1000 bp, Glycine max
  Soy_ogl_2493 Gm08:3707601..3708600 Cluster 13
ccttattgccagagctttgagtatgtttgttgggtttcaattttataagttgatgttttgaacatgggtgaccttttgtgttcaagtccagaaaaatgaagtttaatgggttgtggctggttgcgcgtcttgtttttaatcattttaaatatcacagttaaaaaattgtcactattaattacacgtataaaaatatttttgaaaacaaaatgtaataacttttagacgctaatatcttaaaacaattaacggcgttgattttaaatgaaggaaacgaccattttgaattacgttaaaatcaaaggattaaaaatagaataaaaaaatcaagagccaaaagtaaaattcaaccaatattttaaagtgacaattattttaaaagatcttattgttaattgttttaaagacactcattaaaatgataaatattataaataacatcttttagtagtattttaatgtatttaaaaggattatccttttgggtattttgacttttttcttccttaaatggatggtattcaccttatttaaaatcgattttatgtgtttcggtgtttagtatcattataacattttaatttgatatataaaagtgaaatagttgataattggatgagaaaaaaagaattttagtgtaaataaaactggaaaaatctaattttaaagtacaagaaaaaacgcagaagcgaaaataaatgttcagtgaaatttaaaagaaaaaatattaatataaaaaataattgttgtaagaatatcaacagttaatatctaaaacaacaaataaaatactatgaaaaaataaacaatttgaaaatgtttgataaggtaaaaagtcaaataattaagaactatacatttaataaaaatgaagaatataatgattgtatttctttatatatagcgtgaagccattgttgccacttaaaatgataaagaatatttataattaataatacaacaattagttgttaatactattttttatcatataatattg

SEQ ID NO: 3308 - DNA, 1153 bp, Glycine max
  Soy_ogl_2926 Gm09:1148070..1149222 Cluster 13
atcttcaacctcaatgaatcaaactttaattttgttcaaaatttttttctttatgaaatgatatctcttctgtctttatacacaaatgacaaaacgctctctcttcacaagaaaaacactcatcttgtctcgttgtcagtttcttgcatgtcttctctcttttgttatgatatgtccccatgtattttataacatctcatacattatattcaatcaacttatctaaatctctttcgttaaatacctatgtttaagtataagaaatccgatagatttatacatgttataggcaaattaatttaatatctttccataacagtagctacacataagtgaagatatccggtggagtatgtaagagtagtatttttcaaaccttgttgtaaattgaatggtcgctcgttctccaacaactgcatgcatacgcaggttccacagaacaaacaagtgattacgtgatcatgctccactcaattaagtgactgctagaagtcatgcaccttattaattattaattatcgaattaagaaaattgaatacgatataaaaggttgcacttttttttgtccaaaaagaaagttgcactaaaaaggaacatatctcacataaataaaaagcagcacgtatcgagataactctcgaccatctaatctaatgcaacttttacttttaataaaggatcttactaaaagaaattaataatattttttaagaaaattacattgaaaattcacgataaattacattattaatatttctaatggaaaaaattacctttaattctttaactagtgtccttaactatatatatgaagagaaaacaataaaaggcttttcgtctcttatcagtattattcatgacacgggacatgagtaagttacggaagttaggttttataaaaattaaagtttatttgtttatgagatataaatctattttaattcatatttagtgttatattcataataacttatttaaaagcatattttgaaatcaaatttttaaataagataaaaaattatcttttaaataagcttatatatagaattttttatgtaggttaacatgtttgatatatatttgaaaaaataaataaatacatgatattgatacattataaaagattaaaatagtaaaaaaatattatttata

SEQ ID NO: 3309 - DNA, 1100 bp, Glycine max
  Soy_ogl_2942 Gm09:1994901..1996000 Cluster 13
agtgtgagtgtgacgttttcacaaatttataatattgtaagaaattcttccaccagctgaatacaaacagtgaaagtctgatcacatgatgaaacccacgtcaagccttatttattaggagagataaaaagttaagtgtcctctgaaaccagtttgacttatttttagaatataaggttttaaatttaatttattcattttatctagatatttctttttacagaatttagacttagtcaaatcttttttatattttttacttgacttggatatctaagatctttaaattggtcaatttgtgtattaaataaagttttatataagtcaaagggtttgagtttttagataaattttaaaatatgcataacaataacagtattatatattttcaacaagttatctgattaaacctaaagaaaaattttaaaatatcaacttttactaacttcatttttttttaatttttttacctaatttattaaacaaattaatcaagctaaccaacttcatttaaattaagttatagcccatagtacttattttcacctatttaatttatgatatatttttttatacgtaaaaatccaacacatgtattagaacacattaaatttatggtctatttggcaagaagaaaaaataaagtatataaaaataattaaaaaaaggatagatggagataagtaaaaaagtgacaaaatttaggagtatttgatctgagagaaatatgaaaaagaataaagaaagtttttttttcataagggtatatttcaggttgttttaaatagtagaaaatgtttaaaaccatctaaaaatgtgctatatttacccgtttctaattgacagagcatggcacaaatgtgtgctatacattgtcacttttcattttcatcaagttttgtacaaaaataaaaaaggtatgaaagtcgtaacttgcaatttatctttctgtctatttttattctatcaaatactctgtattttccatctcttatttatttcctctccctcctccctattttgtctccattattatttctaccaaacacacccttcgactcttagaggaagtaatataggaaagaatccatctactcttg

SEQ ID NO: 3310 - DNA, 1089 bp, Glycine max
  Soy_ogl_3990 Gm12:4232428..4233516 Cluster 13
cgccaaataaatgaaagcacatattttctttaaagctgtcggataaaaaatataaggagacaattatttttcactttaagagttttagttttttttttattatcatttgttacaactttaaaaaagctatgtaatattcaattcaacaacaacaacaacaaaaaaaggtatgtaatattcatactgataagcaaaaatggttttactaatcgttagtctaaaaagattcaaattcaacaaagcaattattaacaagcttttttttaataatttttctttttaattcattgaccgtgattttaaccataacaaacattaaccattatccttaaggtaataattaacaaaagaaaatgaaaacaataaaataattaaataaatgatgattaataataacacaataattttttcaagagaggattgctcgattctttttatgttaaaaatcttataccaagttagttactattgtgttacaaaccaatagataccaaccagggaaaagaaaaagataatctccattccaaaatcataacgtacagatcaaattgctggctgttgaaaaaaattccatcatgatcaatcaattacaccacaaaagcaagagcaactaccacaaacattcaattgtaagctacgataataacaaactgtattgtgcaaattaatagcatacatttatttgaatatataacgtgtctaaattatttaatgaaattaacataaacttattccttaattagtaaacaacaatagcaacacaaaaaattaattactaccatttccatcacatgtactcaaatataagagagagaaaaccctattttcttggtcttgaatataaaaaaacaactgactttactttatttaatgatattatcttaaaaatattcttcatgtaattaagatgttattaagatgttagttatgttaattttaatgactttttttttatttttatgcaaaattccaacaaataaaaggtaagtttaattttttttaattgaaactgatataatttcataatgattaacattcttaattattttttcttatatttgagaaatcaaaagaaagaagtaactaata

SEQ ID NO: 3311 - DNA, 1100 bp, Glycine max
  Soy_ogl_4585 Gm14:351501..352600 Cluster 13
agattaataacaatgaattaacatccaaatatttataaattcaaattaaaatctaatataaccattctgtataaaattcttttaataatgggtcttagttgaatgctaacagagtgattgaaaatttggcaatttacaatgtatttagggattcacatctcaactacaatacaaattaaaccagatcatatataggttattatatatatatagagagagatttattttaaagccaacaatttttttaattataatcatgtctcagttttagcacaagaagtgccataaaccaagccaaaaacttgctctacctctcctctttcaaaaagagacatcctcccgaaaatgaaatctgctcacaacagcacaaacatctattttccctccatttacaaataaaaataaaaataaatctaaacgagactatgctcccccaacaaaacaaaagatattcagcgtttttttacatctaacttttctttcatcgtattttttatctcatttttatatttctttatttatttttaatcatattatttgtcacgtcaatcatttctctctctcacttatacattccaaaaatggaatatacattaaacttttacacgcatacaaatatatcaaacaaaactcttcttactatacaaaataagaattataaatatagattatcgagtcatatttcaattttaatgattaaaagaaatatatatatacgactttttaaaatgattatgcgtgatcgctaactaatttttaattataataattaattttatcatatttaatttgtttttcatataaatgtatttttttgtttgttcttagattatttcaaaatggacataattatgaatattttgaatgaaacttggtgtttctatatttattggatgaactttaatttttatgattagctttcttatcatctatttcatgacatatcacacataaataaagttgaattttttcactcttttcccttcaatctttaaatcatttttttcagtatcaaattaacattataactctttttaaagttgaactttttccccaactttgataataccataggcataaaacattattatgtaattaat

SEQ ID NO: 3312 - DNA, 1166 bp, Glycine max
  Soy_ogl_6314 Gm19:1080701..1081866 Cluster 13
tgagatgaaaattttaaatcaaaatagagtgtaaaaagatgaatctcatagcattttaatgttatttcttccatttttcacttttttttttctacaaatgaacacaccattacacttttatctagcaaagcaacaggtcaaaatgattctaagagcacctgattctcagatcttgcttttatttacatcatatggaaatgactgttttctgtaatagaaaaaccaaaaactagtgtgaattaggtcgaaggtgggctgtaacagccttgtttatcttcgttatagaaatttaatcgactattgaccattttttataatcggtcaaattatttttttaaagaaaaaacaattaaattatgttaataataggctaatagcatatcaggatcactcatatatgattatttgacaatcttaatcgattaaatatactagtattcgtttaatcgattgaataaagtaaaaaaaaaaaagtcaatatcttgcattaaagatgtcaggaatattatagtatttttatctttctttttttattgaggaagtatttatatatctttattaaatacatttctctcatttcgtttaaaccatacaactttagcattttatttttactttctttctttcaaatgatacaaatcaaccttcttttgtatttctattttcactaattatttctcttcactttatttctttcctctgccaaatggacagttagtctatgggttaaagttgtacaggtttcttttaatacttgtattgagattgataattttcgaattaattatagatgaatcaatattttttttaatgttattttctattatttttcttttctttctcgtaagtaagtttttggctagtcaattctctattttattaccagtttctaatgaccaacccaccctacttaaggcacgtcaaggtgggttagctcgctttaccacctctatacatttgaatttatcaatgttaattttatttatttatttcatttttagcaaaatgaaccttcaaaacaaatttccatgaagtaaaaaaaacataagatgaagttaaaaattggtattaagaaatcacaagaaattagttattttatttgcttattataaataaaaatggaggtagcataaagctaatttatgtttttgaatatattattaatg

SEQ ID NO: 3313 - DNA, 1077 bp, Glycine max
  Soy_ogl_1425 Gm04:45990901..45991977 Cluster 13
ggaaggaaataaaaattaattcttaggttttctcctaggacatattatcactttgacataagtaccaacagtccaaggccatgagcttgaatttatcttcacattttcttctgttagaaaatttgatgaaagaaattaagccaagtttgtctaagctgcggcttgttctcgtcgttttgtttaagccaagtttcttcaattttgaaatgatcaaaattccaccaaaacttctattggtttagttatcatggctctaaatagatacgagacatgtatctgatgcatacttatccatacaattataataaaagctgacaaaaaaatacaattataataaaatatttagaacactttatatataataattttttaaaagtaaaaaattaagtgaattaagtctcagatttaacaatgcatataatatagatgtattatgcataaataatcacaaaacataataaatgtataattctaaaaatagaaattaagaacatacttcttaaaattactaaaaacaaaaattataaattagtcacataatatcaatttcattcttttctttaaatcatccatagagaggacaaggtctagttatagttcatcaataaatagtgtttctatgtttctatattataaatacttttactctttgtttggtgctacggaggttgcaacgatgggcgacgatggattgatgtctcacggtttggttcaagtgattttgcagtgatggcttgtttggtttgcgttgaaaaatagattttaagttcataattaattttaaatatatttttagatttttaatttcaaaatttagaattaattttaaattgaaataattttgaataatttttatattagaagatatatcagatgacttcaaaattaatattaaccaaaaatcaattctatttgttaacatttatccaaactcaaattaatggagtgtatcccacaaaataatcattccttgtcaagtgggttccacaacaaccaaagtgttaaaggaaaatgctttactccttgttggatttgtctttatatactataaaaaggataatatgatattcttacaac

SEQ ID NO: 3314 - DNA, 1115 bp, Glycine max
  Soy_ogl_2635 Gm08:12452101..12453215 Cluster 13
agttagttttatcaaacataatcataatttaaaataaacccaattgttataagaaaatatactaaaaatatatattaaatgcatgatatccttatccctcattgtaaatggaaaaatatttttacaaatataatttggttaagatagtacctcgcactaatgaaaaaaaatatttttatcatttttttaaaattggtcatattacaagtaataaaaaaatgtgataatatttttgcaattattaaaagtgttttgaaatattttttatagccaatttaaaaacaactttttacataaattgtaaatcaaatcgattttaaaaagtgtcttttcgaatcaattcaatttataatatatttttaaatatgttatcgcttatatctcattccgcttctatttcttgcaattgacccatgaggttcaggtcatcaacatagaagaagtgatgtatatgtgtggcaatgctgcgtcgtttttctttgccatttgttggcagttattaggaattgcatgtttgcagtcaactacaacttctaattttgagtttggctctttatcgtataaaaatcaataataataatattgataatttatttgtgcagtccatattttgtttttactctagataattgtcaaatttctccattgagaaaaccaataaatatcaatggcacgcggttccatcaataagcaaacaaacaacatgtacaaacaagaattaattaattgtcatgcgatacaaaactaagaagctactaattcatgaatcacttcccactcagaattagaacataaacttgtttaagtgccacaaattttctttattaaaaaaaactagagagagtctcaatgtaaaacatgcgaacaatagattaaagagaaccatatgcaatcaaccacgatatttattcaaatgaatccacttgttgtaaagaggaacttatgatacgtatatttatcttttgcggagaaaatcatgaactttaatgtctataagaaaaaaatattttcaaattaaaattttccctctatttttttcaccctaataaacatatggctaaaatagtattgcattagattttttttccaaatattttcaactattatattagttt

SEQ ID NO: 3315 - DNA, 1061 bp, Glycine max
  Soy_ogl_4108 Gm12:36049101..36050161 Cluster 13
tataaaaaaatgtcagtacagtaacctcacaaataagttattcgaaacatgcaaattaaaatggaaggactcaacttttctttggccattttctaccaattttaattatcaatgtcaatgtgataacttcttagcggtttggtactaaacattacgacaatttttgcaagtactatcattattgatggtcaaagccattgataaatggcaattgcacttaccaacaattaaaccattgataagtttggtacatgctgtggaagattaagagaccaaagttaccaacaaattgtaaaactactaatgatatagctgtcataattttaagggaaaatgtcctaaagctacaggatgatatataacaaataataaataaattaaattgtcttattgagataatcatatcattatcaaaataaaaatcaaatctaacattgtttatattcagaatatattagatttctaaaaacactttggaaggaatttatttttattcatgggtaggaaaatcttctacatataagtataacatataagagaaatcatatgcaatttactattctaaagtttaggtcatgtgtgtaattttcacacaaaaaaagtcatctgtgtattttcggccctctaattaatgttttaaaagcaaatataactcttctgtaataataaattagttgcaaaggagttgtttaattgattagcattttttataataattagaataatttataaacattagaaatctgttgtaaaaaaaatagaaatacgaatacctcttttataattgtctggggttaaaagagatgcaacctatattttaaagtactaatttacatttttcttgtaatacagttctagcttttttgtcgattactgttacacttattaggaaattgatgttgattcaagatcatctaatagttttttcctggagtgatactttcatttatttattttgttatagatttaggattatgtataatttcttaataaactcagctacaataaattttcttttaggctattcgaattggtggtacaaaatagaatgaaatggattg

SEQ ID NO: 3316 - DNA, 1192 bp, Glycine max
  Soy_ogl_4443 Gm13:34042501..34043692 Cluster 13
gttttgaccttttcaacatgagttgtctattgtgagcttacaaatacattaaatattaaaggatgttaatgcgtgcctaaagtacctgttaagaaaataaaaatgaaaagattttacaaaaatatcatcaataaactacatggttttcaaattgaatacccgaaaatcatattaaaatatcagttaacataatttcagataaattttcatatgtttacttttatgttgaaaaaattaatttcaagtccaaaattaactatagatgacttcacatttaataaataaattatatcaaattttactattaatttgtttgtataataaaaatcaaaacattaattacatcatttcaaaaacaattataaccaaaatcaatttttttaatgctcatatccaaacacatgtacatatatattcttaccaggatttttaatccaactctattgtagtttttaataattttttatttattaatttcttatcttgttttcataaaaaaacttatctttaaagtactaataagtaagacatataaacaatttaaattatttttaaaaataaatgttatattctttaatataataaataccttttttctcaatttttttttcaattccttacatacagcagaaaatctcttcaaagtgccagtgaaacttgtacatgtttgttgggcatagagtgagtacatctccgatgatctgaatcactaatagttctatttttgggtcgacaatgatacaattgttaatataggttggagtataaaaaatattggatcaaacaattaactgcaccaaaaaaggaactgtttgatacgtgggcctaacagaacttaaaattggaaatgcaacaatgcagggctgtgatccaatcccacaccagcacagaaggggacaacataattgctgggagacctagtacaacagcacaagtccagtattgcctaaagctgataaggaggccaatctgtaaaagactttactgaacaatccaatcagatttacggattgactaatcagcaagtgacccaaatgattttttcaaaaaaaaaaattcaaaaatataaagttaatggtcagaaatcaaacatgcaaggggacgaagtatttcaattaagaaaaatactaaaattgtgaattttttaaaaataaagatgaaatgttctaactaaaaaaataagactaaaaac

SEQ ID NO: 3317 - DNA, 1000 bp, Glycine max
  Soy_ogl_6175 Gm18:54743401..54744400 Cluster 13
actaaaatatctttaaaattttataagaattgaattatttctttttacctacctgtgtgttgttttccttgaaagatatttgtctcatcaaaaaattctaaaaattatctttcccactatagtttttcaaacaaacctcaagtttgcttgatcaacccatacatataggataacaattattttgaattggaaaaaaaaatcaaaatgaaattataacgattataattgtgatatccactttttctctccacaatttttggattattttacccctcaacaaacattataaactaaaccattattatgttttaacatcatataaaaaaccacccccactaacagcatataaagtccaatttcaaaataattacacactttcatttcctttttaaccaccatcatctctttttttttttttttcaatatagagtggaatagagtctatcttcctctagtttatgaacattttgaatgactatgagtgcttttttaaatttgatttaaatatgtatttaatttcttaaatttgattcacttttttttttgtttcaaatatttaaatttttttagtcccttaattttagtaaatatttcttttagtctctctccctaaaaaaaatatcaaattgattttggtgtaactgggatgttaatttttttatttatgaaaaatgactaaaaagaatatttttttaaaatcaagggactaaaagaaaaaatttaaatttaagggaccaaaaataaagtgattcatatttgaggaaacatatttaagccttatttcttaaaatagttacactttaaaaaaatgtaaggtgtttagaaaactttttttttagaattagaataggaaaagcaattttctgggtttttttttaagaaattaatgatttgtacctacttctttaaataaccatgaggtaaaagagagagaaattagataggaaaaaacaaagcctattatttgtacaaaaccaatcatccttttaaaataatttga

SEQ ID NO: 3318 - DNA, 1100 bp, Glycine max
  Soy_ogl_6230 Gm18:57371301..57372400 Cluster 13
accactatttttcttaatctttgataacattgattgataataattacaatgtgaatataatttaaattttaaattttaactaaaaatgatttttctttgaacttttgtgtatgattcaacaatttatttaattaaatcttagattgtgctatgaaataaatagtaaaaagtatctatttttaatgaacaaactgtcaaatgtttcttaaagttaatatgattactcaatagtaatcacaattaatcttatgtgaaattttggattaattccagcactttagaataaaatattattattttatgtagtatctaatacacattttacgacaaaattttaaaccgtaagaaaaatatccatgaccaaccctcatacacgtttaatgattaattagttcttttatgtcatcaatatcctaactagaccattagaaatattaatttcaattaattaacttttattaaaattgaatctttccccatttatcattatttagttagcattgcataagatcatgacgttacatttatgacatctttgtttatccagtcttttgggaatgcacctataggaaatatgttcgttgtgtttcttagtgtatgcttgttaagttatttttgtaaggaaatgactattatttgatagcattgttgttgttatttacttttctttgatttgtttggcttcataggaaagcaataatatatccacgaattgagaacctcaacttttctcaaatgacatgcactatgatggcttgggttactgctatggcagaagaagctaaagtgatcaattaatatgacactacgaaaacttaagctacacttgaatattagagattagccatgtttaggcgtaatgatctacttcaattttgaaaggaacattttccttaaaagaatttagctctaaatttaggagctggataagatcttcaaggtgataggatgtagtgaggatagaaaagttacatacgggtcctaattaccttaattaactcaaattaaaatatattgggcaatcaattaattataattttaattaattgtccctttatatttgtttaaaatattaaaataaattatgatgaatttaaaat

SEQ ID NO: 3319 - DNA, 1000 bp, Glycine max
  Soy_ogl_65 Gm01:2771601..2772600 Cluster 13
tagtttttaaaatttcacaatcttcgtttctgtaacagaataaaaccaactatcacaactaatttcacaaacccttttctttttgtaattttactataaaaaaaagattcttttagattatctaaataaaataagattatctcaaaacaactttagcttcaccacttaacctaacataaacatacccaaatataaattattcagatcgaacaaagtcttaacaatcatattagcagtgtgaaagtaacatttggcatgctactagtattctgattacgaaatagtagcttttgacaacataagacgactctagcacagttgatgtagttaattgacgtgattaattagtatgattttttcaaaactttgtcctttacgcagtgtaaacgacagattcttctgtctttcaaaaaaaaaacgacagattcttccatcattatttcagtcctcacatttaagtaattttgttggtgcataggagttaattaattacaacgatgtgataaataatgagttgttggtcatcactttcaagcaattatattaatgcgtgaaagttacaactattaagaacatgagaaataataattttaattatcaataactgtcacctgttactttgctctcactcttgggataagttacatttctttattacctcttcatgttcttaatataagacaccatttaaaaataatcgataatccttaatataaggaattcatttttttttcactaattgtctttattaaacacactaagtatatgtgttttttgattgataatgatacatgatacttttaaactttatgttttcacattctccataacaaattattaataaggataatattggcacattactaatatttttttaaaaataaatcaataaaatcaattcaattaattgttatatttttacgtcgagtgagaggaattttatagtatatatgaattttattgagtttttttttgtgtgaaaatttttactgacttaatt

SEQ ID NO: 3320 - DNA, 1065 bp, Glycine max
  Soy_ogl_1051 Gm03:42738843..42739907 Cluster 13
cttcttctaatttgaacgcgacaaagcaaagccttaaagtatcaacgaaatgcaatagtaattcaacggcacattgaatttataggtttttagagctagctatcgtccaaattgtttgtttttgcttcagtacgcacacacgttaattaacatatttgagatggtgtatttaatgaaaagtaatgttatgtttttttatactgcaaaagtaatgttttgttatcccacaaattctcctattggtccttttattacttcataaaataaatattaaatgggtaagtaacacatattctaatatttttgaacgaacacattttctaatatagtatacttcctataatacatgttttataattgagtaaaatttattaaagatattactccatgcatcccaaaaatgattggtgttcaaattcaaagtttttttatttttttacatagattaagaatgacaataaattagttacttgttgaaacaattttattaaaatatctttactttccaataatctaatacttgtaattattggataattagtggtgaaagttaaaaaaattgatagacatggtttaacaatcattaaactagtgtaatttatttgagataaatttagaataaaaaatttaatatctcattaaaaaatacgtgcaaacgtcaatcaatatttttttaaaagatattaaaacatcagtcgtttaaaaatgtagaggaagtattaataaaaggaaaaatcacgacaccatacaaatgcgcatgtaattggcagccagaaaataataaagagcagtgattcatcaaaacttcctaattttaaatatctcacaaatatttttttattttctttttttatcacattataaatcttattatatctatatttttctctttctcactaggtgttggataacaatattaactatatttaacaagttattttaattaatttttaaattttttatcagctgaaaataattattttactattcaataaataagtttttaaagtaactttcaagatgttttaaaacataaagtaatatttttaaaacgttaagtttgaa

SEQ ID NO: 3321 - DNA, 1126 bp, Glycine max
  Soy_ogl_2149 Gm07:3176623..31773 Cluster 13
ctcactcaatattatattaaaaaattaaaatgtcaatcattttataacttattttttatataataattattattggacggaaaaaagtaatatttcaatccataataaccagaaaaagaagataaaacatttcaatccataattgcatagatcatagtgccttttattttccccatacaagtcgtatgttccttttttattttttgcgccaataattgctgcatcatttgttttctttacaaagtgatgggactacataactactcgagataaaaatatgatttcattatattttttaccctcaatttattgtttttattttgcaaattttgtcctttatttttttaatgtattttacctcattttttaaatgctacgaattctttctttttgttatatatctgttggatcatgaacgatattaacactttttttttttggctgtttaaattatcatgaacacaaatattgaaaataactattttttaacataatgatactttttaactgtgactagtaatatatttagtttcttttatttccaacaactccgtatatttactgtttcgatgcttattttctttaatgaatcactatggagatgttggactatagagttgtcgggcgtaaaagaaattagaacttattaataatgtcaattaaaaattgtcattttgcatgttaaaatatatatataattctaactttccaagtgcttatgtttaggcgctgttcaaaatcatcagaattcgaaagtgttgcatataaaagttatgacattttgaaacgtgggagacaaaatatgtgaaaaaaagttggcagataaaattaatcagaaaataattaattggagggggaaattgtaattaagctcaaaaatatgtaaagttaggccacaacgtcaaaatttctgcaacatatttagtattccgaaattttatttaggcataacagtgattagagatcaatgaggtcgaattcagagtgtaaaaaagggtaggccggatttttaatttttatataattatttaaatatttaacttttaacaaatagttatttaataaataataagtttaaaaaatatttattattaattttgtgaataaaattagagatatgatctac

SEQ ID NO: 3322 - DNA, 1000 bp, Glycine max
  Soy_ogl_3761 Gm11:5955101..5956100 Cluster 13
atgtcaatgaaaaaaatcgagttgaagataatcctgaccaacaacttgttaatagacgttaactttttaaattttgtattccttttttatttttgaagcataaaaaatgaataagtttatcatttgaagaaaaaaattatctttaattgtatcaattataaataatgtgcatttatgataatgattttaaataattaaacagtcacagcaatcttattttaatttgattaaatttaattatgattgtaaatttatattttgtcccgttcatttaaaggtaatattgtcatattattggaaaaaatgcatttaattgcataaattataattaatgtgcatttatgataataattttaaataaaaaacacagtcacaccaatttattttagtttgattaaatgaattattatgattgcaatttttatttcaaaataacgtaatcacggaaactatttaagtttgaattatatagcattatatatagcgtaatcatggtttaatattaattatttaattgattatttgatttggagtggaataaaagaaaagtcagtatctactaaatataaatttatagaaattaagggggtatctactaaataatactccaacatcatttggctttttaatcgataaatactaattattgtctttcttcttttcatattttttttaattatcacgacaatcttatatcttctcctgtgccatcaaaataaatgtctgatacactcctgtctcctgcaagttcgcatgttatttaataggtactctctatctctctctacgtgaaaggagaagaagggagtgaaaatatgacagcatgttatagggtgctataactcaattttgaccatgggtaaaaagttatttatttatttagattttattttgacagaaatttatttatttagatttttttgctgaatatttatttagatagtgaatgcttaataaagggaattatttgttaccgttagcttttatttctttggtccaa

SEQ ID NO: 3323 - DNA, 1000 bp, Glycine max
  Soy_ogl_5826 Gm17:40709101..40710100 Cluster 13
ttggtctacgaaattgatttcttgacccttagaaaataaaattagcatatcgggggtaggaatatattgttttgtgtgcatccagcttagtacttagctcggagtatatgcctatactaattttgtggttaaattactctataagtctttcaattatgtgacaatatttaattagattttataacttttttttaattgaatctttacgcttgtatttactttttaaattagatcattttatctaattactgttacgtaaaattaagcaaaaagactccattaattcatgaatccaacattgtcattctatacgtttaaattaagtatttttacctctacaaagaccaatattaattctcatatttacaggttctaaatccaataacttcaacttcaatctttaagtggtattctcatttatatgtaagttcacttaaatcaagtattcttttacaaatttttgtattctagacttcaccataaaacaattttttttgtaaacttacacaattaactcgagtaattaaacttttataacgatagttagatagaaaaaattaattaaaaaaacaaatacaattttaaagacccacttaaaatacatattcaagttcaagaagcaaattgataaaaaaaaattcaaagacttaattaaaatctattaaataattcaaagatatgcataataatttaacctaactttaattagtaattaatattggaactccgagcaatagattgcacattctaagtattaacgataatttaaaaactaattaaattctaatatctttttaaggaactaatttgattaggatgtaaataaacttctgtccatcgtaaatatagtcaaatcaaccttaagataattgtatccagtttagtatggtttaattttagaagtgtcaaactttatccatgtcatgtcaagagttaagtctccaagttaaaaataaaaaagtatcaatcaacacaatttatccaacttgacccatctttg

SEQ ID NO: 3324 - DNA, 1040 bp, Glycine max
  Soy_ogl_947 Gm03:38178101..38179140 Cluster 13
actaacataagttgattttagctactattatataagaggagttttataatttcaaaatgtacattttttaataaataaacatcaaaacctaaaaaaactccaaattaatcataaaatataagatatttgagaaatttctaatctttaaagagattaagatacgtctgagtcactccctaactaataccaacacggagttgtattgtaaaaaaatgagcaaagcctaaaactttaaactcacaagaaagaattaaagaaaataaagaaacgaaggaatttaagaaaatcattgatgacacaagaaaatcaagaagattagagatcatttttatttatttttaacatgtaacttagagcaagttaattaaagtgtttgtaaatttaagagtaaattacgcctctttcccctaaaagatgtgagcattgttttctctagtaacaaatttgagtacatgacactttattccactttatattcttcttgaattttttttaaaattttatgaaaaaattaccctttacattattctccctttttatattaagatacatacttctttcccttgatagatgcaaatataatacattttactatatttttattttttggttatatgacaaactatatttcacactctcctaccttgagatatttaaatcttatatttttgtcattttttaagagatataattttctcttttaataatatgaaaatattcaacacattttcttacaactttttattataaaatattacaatttatatcaaagaataattatattcgggcatcgagtgaatgaataactgggtaaattaaaaatattttagtataattttaatttaaaatatagtttaaattttcttaaagaatattctttaacggtaagttaaatgaagtatatcatagatttcaattttcaacaatgatgccaataagaggaaaaacactataataaactcacggagagtgtaatttacacgatgttaagttaaacaaattcaaccatttattttgtcacaaaaagaaagaatagggta

SEQ ID NO: 3325 - DNA, 1100 bp, Glycine max
  Soy_ogl_1430 Gm04:46046401..46047500 Cluster 13
ttactataaatgtcacttaaattttttaggacataaattaattgattagttatccgtaaaaaattaataaacattctagccaatatcatgttaataaaataatactatttactactattacttatccttctggtttttaatttgtcttataaggtttttaagcggaaatgaaaaatacaaaaaaaattctaaatcttaataaatttgttatgaatttgttttttaatttttatttcaaaataaatgtatatgtatcaattaattaaaatttagaaataaaataagagtgtaattaacgtaaataatattatcttaaacttaaaaaagataaataaatagaaaacaaatttaaattcgacaattgaaatgaaatggaaggggatatgcagcaaggggatatgcaccaaactattgaactcatacattaactgaagtagagttgttcataatgatcctaaattattcaaatataattactttttataaaagatacatcttatttgcttaaaaaaaagtaggtgccaaaaatagtatcacatcaaatgacaaaagaatgaaaaaaaaataatattcaccggcttaaccatttaccatgtatttggtttgtgagaaattagtggagagagtggatggaaataataggagttcaagagtataaatatttttgaaaatgctactaggatttattgtattatttttcacctgttttattcacctacttattttctttttatttattttcaatcaaacatttttaatttctacttttttaggttttatattctaaaataaagtgtacaagaatgactttaagtttaaggtcaataaaatggaatgataatgatgagaaaaaacaattcaaaatttaaataagagagacttgaagagaaaaagaacataatgtgtgaaacttcgtcaaaaagtggatcattattcaacaggaagaaactaattacaagaaagaggcattaattaggtggaatctcgacagaaaattaagaaatatagtaagagcaaatttggtttataagggttgatatcagcctagcccctacataaggaggtacaagatgggagataataacaacacttcatggaaa

SEQ ID NO: 3326 - DNA, 1013 bp, Glycine max
  Soy_ogl_1845 Gm06:8097688..8098700 Cluster 13
aaatacccaaaaaataataacaaataaatttaaacaatcttattatctatcattattgttatcttatgtaatagaaaatcctatcttacctaaagaaaaaggtaaaaataataaaaccttatcttatgagtggaagaagataaataaaataaaataaagccggccttatatatatataaaagaagttaagaaaataaaggcaaaggagaataaaaataaaaaactaaaagttagaagttaatatgttaaaaaaaattactaaaatagtgtctcaaaaaatactactagctatttaaaaaaattgtgtgccaaacactattaataagttcaataaacctttgctttaaaaaaaaaaaagttaataaaactttttggttagtaaaaaaagttggataatggcttatcaaacatgaaacataatcagaagtatcataagtatattcttatatttaattaagggttgtctacctgtcccaaataaaaatgaagatagataatttcatattagatgatcgaaaaaaattagatgaacaattttgtgcataaaaaaatctaaacaaatgaatgtaattttattgtaccacataaaataaagttatacaatcatatttttagttaaagttagttagacaaactcatttaactatatacattttatttgagataataaaaaaaaatattttttttatgtggagactaaataatagataaatactaatcaggtatcctaaattatacactaaaaaatgatgatagaatagaagttagtttgtttttacacactaaagttacgatgatcaaagtcttaagtaagactataaatttcaaccctatggatgaaaagaatatgcttacaagaagagattaattattggcggctggaaaaactttgcatctattaaggatatagatttatttgtaagtcaaccaaaatgaagacacaacacactttgtaagcaaaatattcaatactcaattaagtctctttattttaacaagaagatccgtttaga

SEQ ID NO: 3327 - DNA, 1000 bp, Glycine max
  Soy_ogl_1907 Gm06:11694401..11695400 Cluster 13
ctcatcacttgcggaagatatatttactcattctggtggattgtgataacatatataattgtaataatatattttggtcatgaaaattcctgattgatttgaacaattttttcccgcgatatatgacataattttcgatgtaaaatattattaaaattaattcaaacatatattttagttatatttaataatatttttacttaacttcaaaataaataatctttttgtcgttagtaaaaaggtaaaatagaagatgtaggaggcatttctgaatccctccgcctccaccgacacgctaatgaatagtaattaaaaaaaaaaaaacaacttttgaaaagtatagattggcatacattagcattacatggtggacggctatttatgtttcacccatgtccaatcaaagggatgggttgaattcaattactcttttcacacattccttttccaatcaacctctgtggggttaacccatttgtcatttatcttataaatttataattgaagttttccattagattattttaatttatttttcttaaagtgtactctatgttatattatatcttatcttttataaattgttgtattattttattatatgtttcaatgtaataaaaaatttaaaattgatgattaaaatatttgttattattttataaataaattatgttgatttttctcgtatttttttctttatttgtattatttttttcttgtcaattcaaatgatctctttgtttatttatatgatattttcgctaatttaaaacattttttgccttattttctttctcatttgtatagtttttctctgttaatctcaatagttttcatattttcattcatttgcatagtttcgtactcatttaaatggctattctctagtttttcttatctacataatttttctcactcgtttttatgtatttttccttttttatgtatttgaatagtctctcactttcatttgcccggttatttgtgactcatttgaatg

SEQ ID NO: 3328 - DNA, 1189 bp, Glycine max
  Soy_ogl_6604 Gm19:47085419..47086607 Cluster 13
tattcaaaattataaaatcacaagctagtaaagtttattaaataaaaagtaagacttaaaagaaaattgtaattatcaatatattttaattaataataaagagaaaagaatctgaaacaaaatagatgtaagcctaagaaggcgtacctccataaattattactaacaccctaatacattttgaaaaatcaattcaaaatgtaaaaaattacattttggattttttacattttggattgaggtttccaaaatgtaatgtgttgtggatagcaatatatagaggtacagaagaaatgtgagaaggctttttgtgagtataaataggtgtatgggcttgacctacaaataaaattgtggtccatttaaatataaacttatttagcctggtaacccttaaccttgtaggctaaatggttgggatccacagattaccaagccagtctacaaaccattttttaaaacctaatattgctcttaaggttttattatttaatgttttatcataatttagaatagaatcttaacacgtaagattttattatttgaataattcatgcttttattggatttttactatttgaattttattgttcattacaatcttattcgacccgaataaaattgctttatgtgaaaaatatttatgatctcttaccataaaaatacttttttttccttaacacataatttcaccaaattaaataataatgatatttttcttctagatatattttatttttttaatttttatttgaactttagaacaattgtgcagtaatgtgattaacttgccagtaacttaattgataatattattttaaataaataaattcttgaattttttatataagagactacgattaagattacttaatcattaaaaagtaattttacaagttaaaatgagagttctcattttttttatccataaataaaaaataatgttaaaattttataaaaactcacatatttttactcaatcaattgaattaaacttattgggagagtttttatgtaggtaaagaaataaaatcaaacttgctaagaataagttttgaattttttttcattaattggattaaaagttattaagtattcttgaatatgatatgatagcataagacctacactcaaataaagaagtcaaattgaattcatacaccggttatagtaacccgaatagcatgcg

SEQ ID NO: 3329 - DNA, 1200 bp, Glycine max
  Soy_ogl_3772 Gm11:6572701..6573900 Cluster 13
attaatatatatgatctttacaaaatatcaagtgaccttacctaatggtaaatcttttctagccatatgctataaagccacctaataaggcatgtgcaacttttggttgatatgcacttggtgtaaatgctaaggaaaacgttattcctatgatatcatgatatatttattaccttcacgaatcacgatcacgtggttacccttcaggttcgtgtgattatcactaccccatggataaatcatcatcatcataaagttacatctacatccacactgttatatatatgcacctcgtaaaggttccaagttgcaaattttagtcaaagaaacacagcgcgcgggaggtgtaatgtacagtcagggcaatgcattttgatgtgaggtttctttatataaaattttttaaaaatatctatagtgataatcccctatatcccttccagatttttttatattaatcattagtaatacttcttgagcgaagtagaatcataataaaattcttatttcaaatatttaatgtgttaaaagatttaaacataaaaaatttaagtaaattaaaacaatttcatattaattgattggtactttcaatgatttatcttagaaaatgtttgagtcatgatgcatttgtaatctttaacttgtcataattataaattctagttaaaatcattttggacatagtacttgtttgttcattgtgggaattacgcacctttatttttttcatttgagaatacatacgaggatatggaagtgaaacactcttaagcttaaaaaaatcaatatattttttttattcatttatttcataattcaaattctgaatcactcgattaaagatgcaggccactatcactcggttcgtgaaaaaagataactttgcttattgttgaatatatttcccttttattatcagttgtatattggttgctttttttttttttacacgaataagtttagcagggaaagttcattaattatattaaatattttacccaaaacttactattcatgcattaatttaagtgttgttttattatctgtaaggactttttccaagagttgatttttttttaattgttttttggtttcaagagttgaatttcggtatttaccaaatcggtatcaatttaaatttttatccgaaacctaatcatccattaatggagtgttattttattctttttggaagaa

SEQ ID NO: 3330 - DNA, 1100 bp, Glycine max
  Soy_ogl_1001 Gm03:40644401..40645500 Cluster 13
ccatatgagaacgaagtcatttttttaattatgttattcatacgaaatatttattgattaatctctattaaaaaatttaattaattatttttaataagatttttttctatcaataacatttttttatacataaaactcgaatcaaaattttatttaaagagataaattcatactaaccacttggttgggaaggaagtcatttactgctatacttcaatgtgtcaattcaaggtgagaaaaccatttattagattggtcttaagtcattttcaaagactcatcctaacttgtttcatttttattgacttctcccattaggatctgctttgcaatgagatttggaaagtttgattttgcatgagattctaagtttaaatcttattatcaatacagtacacataaagaacatcttcattgatttccaacattttttttatattttgatggcagtaattttgttttccttttttttcacaaatttccaaagagtttaaataaatgagctttattttctgaagactacatattttcataatatcttctaaatattaaaagaatagataaatatatttaatattttaaaatgattttactaactattatctttaagataatgataaggaattgaaaagaaaaataaaaaataaaatttgaatttaatattactaatagttcctccattccaaaacttttttccttacaaatgctaactaatgtctacaagactcctgttaaagaattaaaagtaagaattttattagaaaatattatttctacacccctctataattttaatatatctccaactttatttttaataggctcttttattgttgattccttaagtgttctagagacgctagttgtcatgatccttatttttttaaggttgttgtatacagattaaaaaaacatttgagtaatatacactaatataccttgactgaaatatctttaattaatctccttttaactcacttgagtcacaagctggcttaactcagcttggctaattattcattggagatgtttggattattgattataaattatggtttgagtccgcgaaaagtattttttttctcatttttattcaaatt

SEQ ID NO: 3331 - DNA, 1324 bp, Glycine max
  Soy_ogl_1092 Gm03:45009901..45011224 Cluster 13
agtggctcaaaacatctactaggtggatcttcaggaccattgaggtaagagaaatttcagggaataataattgtcccatcccaacaagtatctatcttgaagaaataaaattatacagtaagcatgagcaaaaacaaacataaataattataagagtcaataataaatgttgccaagatagacagaatgcgactgagaacgcgtgggactaagaggggctgttggtagaatctgaatgaatgtgcaggaaagggtaattttggaaagatattaatttattgttttactgtaaaaccatggacagagatgtctatcttttattgggtagaaggtttctctttttttttttttatatatatatatttccctcactgttataaaaagtagcataaaataagtaaaaaagtagtcactctcagaacaaacgtcagcatggtcaaaattttacgattaataatagcaaatacggccccgcacctgctgctttctgttctgttggcaaatgcgtatcaaatttggctttccatattttattaaaagaaaaactttttcattgatcctttaaaattacagatattattattactaaaatcattttaaaaatgtagtcaataagacatttttaaacatttttcattgcaattttaatcttataaatttttattgaccaattaatttaaattttatttttcattaaattagttttttaattttttatcgttgtttaatattccgtaaagaataataatagttttaatatgtaaataatttatctgatagagaaaaaaagtgttacacacaaataaacttgagtatggatattgttaggaagactatttgactttattttttcaaccgctaataaattcgaatattatggttatgatactgtttttttttcagatttcatttttttataatagagagttctattatagaaattttgattgtaaaatataataaaattggataaatttttacactttcatctaattagtaattcaaaaatatttttaattataaatatataactcttttttctaaaataattaaaaaaaataatttatgattagatgatactataaaattattttacatcatcaatatataaccattaaactcattaatttaatgcttaaaatttttaagcatttcatatggtagaatataaatatttagggggaaaccttgaagttttgttataaaatattttttttaaaaatgttctcgagagaatgttaataatgttaaagggagacaaaaacatgttgaataatgacacaattgtattaaaaatgagtttaatgttgatggactagtaatg

SEQ ID NO: 3332 - DNA, 1439 bp, Glycine max
  Soy_ogl_2451 Gm08:1468462..1469900 Cluster 13
ttcttttaacgatattaattcaaataaaattttgtagtttatacttcacaaaaaataagtattatttttatattatcatataaactgtgtgtatttattatagaataagattcattaagtcatttaagtgtggagttaaaaagtcgtgttttaattcattagaaataaacataatattgttaaagtatgccatctgttcaagctttgaaggaccgcacgcaagttggttagtctttttttagcggatatttttcagcctcatgaattagagattaattataatcgggacatggattgttccgtttcagtatatatatccgcaaataaaaattcattaatccaaatttatcttctatttatcatatttatatgattaattatatttatatctatctatatagatagatacataacataacataaataaagacatgacattaatattaattcactataccttagataaaaaaagaatccacaaaattatgtttttttaagtatattattttttattgtgaatctataaaaacagtttcctttatatctatttaaattgcatggattccattcattagttcaattttttttcacataataagaattgaacattttatttttttttgctaaataggctatctacgtaacaacacgcggatccacttgttagggtgttggaacaatgctcacacaagattttatttatttatttgtatttctaataaaacgtttttttgtccccataaaatagtttttaaaatgaatataaaaaataaaaaaaaattgatactaattttattattttatcttttatttttttaatatttccatttcatacttagagagggatattttttagtgtaaacaatgaaaattgtaggacattttcaaaatataaaagtaagcagagaatagttgttattcataaagtttaagtattttatatttttttgttatgatattatgtaatttgtaaaagtttctgacagttcattttaagaaaaaagattatgactaacagagtaaaataatttacagtcatataatcacaagtttgatagtagtataaaatagtttttcacttaccgcataatcattaagctctttttcatttgtaaaataattataaatatttttttcctcactaaaaatctagatccgctactacataacatgtacacgtgtctaaccactataacaaacaataggggttaagcaagttgaacactaatatatattacaaactaagattcgatgagtttggaattagaaaagtcgtgtttgaattcattataaataagcatagtatgtttaggttatggcctcaagaaagttggtttaatcttgatcttaatgtaccatttaatatattcagtactattattaattttagtatgagtatatatgatcgacccctctggtaagtaaaaataaagtaaata

SEQ ID NO: 3333 - DNA, 1600 bp, Glycine max
  Soy_ogl_3752 Gm11:5522401..5524000 Cluster 13
ttctttagcgttttattacttcattttactgcacaattgctgcaatctgttgctgcgtcttttttttctctgctgaatgtaattttctgcataaatttcaattctggtttgtattcatttatgcgtttgctttactgttttggttctgtttatgtgtagggaattttggctctacctaatccgtttaggaccaacatctttatacaaaaaataaatataactattataaagaaaaaacgtactctgtcccaatattgattgtgcacaaatcaattgtgatgttactgataaaggaagagataagaaaagaaaataaaaatagatgacttaatgatatattgtgtgtttgtacacatgtaatttatcacataagtttgactgtaaaaatcatgttaaatggtgcaataaatgcagatttgtggtttccgctgtggcatagatcaaatgaaggaaggtgtgattctaaaccaaacacgtaaggataatgtacttgtaatttgaaaaaaaaaaaaaaaaaaggctctgtgacacagctagtaaccaagtatagtaatatagcatttatacatttcttgaaaacacattaaaagtgaagaattccttaccaaaagtgtgacactacaggagacatggtcaagcgtcacttatttcagcaaagaaaatagtacaaaaacagcatcgcttatttcacttgatgtgccgtatcatttatgatttagttgcagattgaaaatcatgatttaattgcaaatgaaatcatgcacctagtggcatgaaatacaaaacgtacctaattaaacccagtaaatgtgtatgtcaatttgagttatttgtcgcgtttaggttgaggctccggcctgaagggcgaattgctcggtgcaaagcaaattaattcatttgtaatgaattgccgacgcaacaagttctacggggttaggtaggccaatgatttttttaagaataattttatgtggttcaacttctaattattacgtaaaaaaagctattttcttgttttattgtatttttcttcttcatagtttaaatatcccaaaaataaacattaggtgttttgtgacaataatattaaatttataaaaaagaacgtagacaaacctattaacacatcatatgatacataagcttgttgagttggcttggttctcagttctgaaacgagtttttatcaagcaaaaaaaataaagataaaatacatttaaatttaatcaatattttttattagactattcagactcattacacaggtccaagtattaactcattttttaaatattaagtttaagtattataaatataaataaaaaacatgattcagaatagataatctattaaatatggtcaatttaattctctatagagactagtcaatgacaaaaattagtagatactttccctctataacatgataaaaaaaattaacatacccatctattaattaaattcagctcacttttgcaccaaataagtacttaatacattatggattcttacgagcgtatttggttaattttaatgttagtgtacttttcaaaacagttaaacgtgaaagtaagaaattgttaaattcatgttaaactta

SEQ ID NO: 3334 - DNA, 1300 bp, Glycine max
  Soy_ogl_2116 Gm07:1392001..1393300 Cluster 13
atatatgaaagcgtattccatttcactaaaatatgaataataagtttaggtttaaatatgtaagtatttattgagtatcatcataaaacaataataaattattgttgatataagtctgaatatgattttttgaaaaaataaacaaaaatactctaatgttcaactcaacctatgaaatattccattcttagccaggcccaaatcttaatttccaatgttaataaaaaaatatataaaatctgactactaatgccgtttaaactttaaagatcaaagtggaaaaagttaatgcgtattaattccatcttttcaaaatttatttaattagaattcaaaattcatatattaccagtgtaagtatttgattttatattattatttaattaaaaattattcaaaacattatttttaaaatgtttatttaacaatttgatcataccttactatccataaggataaaatggtaatgtaaaagaatcattacattgtcactacaaaaaaataaaataaaaaggaaacttcatctgccacctactcttttgtttttaagaaggacacatgaatcgtgtggcggcaacttgtcatcacaaataaatcatgtattgaatatattgcaatggtttctctatgctaagaatagaacttttaattatcaaaaaataatcaaatttcctttgtaaagtttaaggtaacctgtcgtacattgagaatgcttgctactttattccactcactacagctgcatactttttctaggatctttctgccagtttccaggatcttaattgacaaagaaagagagaaaatataattattaaatgaaaaataaaaatgttttttcttttaattattttgtatttgagatagaaaattgttctataatttatcaagtataaaaaattgcgtttttatcctattaatttttatttaatttatgctattcataatattttgtttaaattaaacatgaaaattttatatttgtagttttatactatctaataccaccatactttttagtaaatcagatgcactctaaatataagtcttaatgattactcctccaaaataagtaaattctgttgtagttgtggagtatgcaatcattaagaaatccaatagccttcctaacattgtacatttcaatctactgtattcatatcatatctatgacattttaattttttaaaattatagttggtatcttattaatataacgcaactaaaaacaaatcagtaacaggaaaacctattgaaattgagcatgcgtaaaaataattacttagtgagataggggcat

SEQ ID NO: 3335 - DNA, 1030 bp, Glycine max
  Soy_ogl_6837 Gm20:38249771..38250800 Cluster 13
ctccatctcattgcatctaaaatctttatttttgttatgttgtttttctagggacttgatatggaagaaatgcaagacaaacagtcaagagtatgtttagagtaagtgatatatactgccaagtgccaatatttaaaaaatgtcaaatctacaaaattgcgtaacaaaaattggtaatataaattaaacatataaaagtctcatttactcataagacttatgatgggccgcgggaccacaaatgtctcatttgactattcaatgtgttttccttgttggaagaagagtataggtcataggaagatacttgctgagatatattttttaattattttatattattaattaaattttactgaaatttaggaatgaaacttattaaataaggaataatatttagaagattttaaattttttaataaatttaagtcaataataaagagtatatgtaaaaactatgttaataaatatattactagctaatttttctaatactagaattaaggggatttaagacacattctattcctcaactgaacttaggtctgggtactttgagttaaatttaatttaaataattaaatatgcttttattccttaactttttttaaatatatacttttagtttctaaacaattttttttatgatgtttgttttctatatgttttctctaataataatagttttagtatctacggttaagtatgaaaaaagaaacataaactactaacatatatgattatcttaaaagttttaaacacatttttaattaaaactaattttcttttataaaaatacaatcagacattaaataatgtaaatacacatgcaaaattttcgacacgaaataaaaaatcttggcactaagagtattatatatactatagcctataggctatggcattgttgagagcttcaataaatcagtttcacactatcaaatgtatctttcaacagacaatagtaatattttagaggaaactccccttttattaatcttgtttcactgctctcccagcctcacaattt

SEQ ID NO: 3336 - DNA, 1000 bp, Glycine max
  Soy_ogl_4568 Gm13:39348401..39349400 Cluster 13
cactaattataaacaaaaaaagtggccactaaatcactaatgacaccagtgaaaattgggttcaactcaccaataaggggtgcatatgacgaggaccacgtcctgaagatacttctaaaaatttgagttgaaaaaattgtgtctaattatatttttaaaaacaagaagtatgaagtgatcaattattttaaataaatgaaaatttaaaaatataatttaacaaaagtgttatatgttaatgttctgtcagttccttaatgatgtgacttacctatcaatatgtggtatacaaaattcaaaaattctaaattattaaattttcgcagttaaataaaagcttaaatatatatttaatttttctgcaatgaaagaattttaattttgatccatataacatctttggttttcatccttcaaaaatataaaatcattattttttgtttgcatgttacattcgttaactatttattttttttaacgaaaggtcaacctctcaaaaagaaaatgaaaggttaagtgaccattctaggtgatatatactaacatttttgttaccatgtcaacatatgacacctataaaaaaaaattgatatccctaaattaaattgaatgtatttatctaccttaataggaatagtagagaccaattcttttttgggaggtgaatagacaaaacatatgtattttttattttagacggataaaaaaaatgtaggaccaaaatcaaaattcattgattttatagggactatacataatgatttaaaatttaaaagaataaaaaaacaaataaattttataggccaaaataaaaaattattttattttataagaattaaaatcatatttaagctttcactaaataaaaaaatcatgagttttttattactacaaaaatgaaattcaaaagtaattttaacactctcaataaaattctgtatactttcacaatgcatatatgaataacaaatatcagcaaaactctcatcatcaatttaag

SEQ ID NO: 3337 - DNA, 1304 bp, Glycine max
  Soy_ogl_2445 Gm08:1001097..1002400 Cluster 13
atgattttgttaactatttatttaaaattgatagtcaaaagaatacaataaatcatttaaaattatatttaatattaaaaaattcatccttatatgtggtataaaaaaatccttatcaattaatgtttttaacaaaaagtatataccaaatataataaaatattaatgatattattgatataaagcataaagaaaaacattaaagtaataccctctgttaatattcaagattttaattttctttttggcatcatatgtttgtcaagatttatatatatatattttttggtgaatgtccaaggggctaaaacactccaagaagacaactttattaataaccaggacgaaataaaataccagacaaatatgtcataataagacaatgcaaaaaggacagtaaaacatgaaaaatatagttttctccatgaatggataactcatgcttaaaaagtgcatctgcaacttgatttgtttctccatatataaatgtgagaccacgagatcatcccattcattcccgccaattctcttatagcttccactaacgacctgacataatgtattacaggacaaactctccttattaagttgatgatagtaatagaatcgtatttcacctgaagacttcaaaagttcagttttcaactattaccctcagaaggggtatttttgtaaagatttatattcaatacatataataccttcaattaattcaaaataaaatattttcaattaattagaaataataaataatttgcaaaaaagatgattgtgtaaaaataaattaaataaatgaaaattattaattaatttatgtatttcttaaaaaaacattgtattatttaattcatcttcggagaccaagtgaaatattatttagtttttaagtcaaattattttttatgaacttttgttaaaatgttagtaacgtacacagtttttgttatacattgtttattattgtctgaaatttatttaaattttttcttacttttttttttttacaaagttcatcaaatgtaggttggttcaaaaccaaataatattttactcagagatatctggagattaatttaagagttaataataaaatatgttattggaaataactaaattaattaacattttctgtttaggttttaattttttattcagtcaactaactagaattttttaaaaatttagtaaaggtattcaatgtataatattgaatataaatgttgacaaatatacgacaccaaaagaggaatttaaaagtttgagtattgaacgaggcaatgtagtaatgattttttttcttatca

SEQ ID NO: 3338 - DNA, 1000 bp, Glycine max
  Soy_ogl_2882 Gm08:44271401..44272400 Cluster 13
tgaggagtaatgatgtttaaaaaaaaagtgaagctgaaaaaagtttgtcattttatattactagagagaaaacaggcatcattgtgccttcttttattcttttttagtaaataaaaaatgactgagatgtaaacaaatattatggttgagaaatttttatagcaagtgttgtgatgattaagaaaattttatagcacttacaagataaataggtctaaaaaaagtagaaactagacatgactattccctttattatatatgtctagatgtatagattatgcagtaaaaaaaaaatgtctagattatagattaatgtctgatttgttgtctcaggaatattttctcaatgttagtctctctcattttttatttatagaatcaaatccttcagtcactttttatttccctaaaattcttaattaaattcttatcattttttactcaaataattaaatatttcagattgattttaacctcggaagtttggtggaatttaaaaggttttataacatgtgagtttaaggttttgaaaatgaaaaaaaaaagtttgaaatataacattttttaggggcttgaaatataacattttgattgatgggttttaaatagaaaattattttaaatatttcattggattcattccataaagattttgagagaaaaaaagaatttaaatgttttaaatgaaaaagtgatggaaattaagaactaattttgataactaagaaaactaaagaactcaattgcatattaagcgttgatatatagacaaaaaaaattgcaaccaagtctcttttctagttttttcttacatttaattaaagaaaaacaatatggtgtttttttaatagaaacagtatggtgttgatccatcacagatactaaaaaaacatgatatttgtaacttttaaatatttaaactaaataaaaaatttattatatttacaagactgtgaaacatatttaagctttaattaatgtatatcttttatgctaaatt

SEQ ID NO: 3339 - DNA, 1189 bp, Glycine max
  Soy_ogl_3716 Gm11:3917833..3919021 Cluster 13
tgaagattgttattatgatagtaatttaataaaatttcaatttatacaaaaaaaaaattaaatattgaagggatgcaaatgcacccccaagagaaaagtaagaatatatgtagtgctgttattttttgcacctctatatttataatttgacccgtttgccttcaacttttatattttattaaatagtttttttcttatattttgtttctattatgtgttatttggttagacattttatatttttttcatatatatggtaataaatattttaatttttttaaaaaaatgttgccactaatttcgggtcttagatcctccactatttgtatgtattattttttatttgtatgaatttataagtagagaaagtattttgtatgaaaacatgtatcaatttttttgtcaaattatgtgtccatttttttaataaaatatatgtttatacataaacgacctccttctataatttggctttgagcacaaaacatatcaagatcaactctgcatgaacaagcttgggtttggtcagtagttaactttttgagctagactaggtttgggttggaaaaatgtttgaaagacacccatatgctattttacacctaaatagagaaagaaaaaaaaatgagaagaaaatataaatataaatataatatgatttatgatgtgatagaaatgaaaaagaaagaaatgaaaaatgttagcaacatgtttaaaatgaagaataattcacatatcattattctttgggttaaatcaaaatatataattttgaatctagattttactagttcagccatattttatattgggttaatcaaagttgaacgattttaacactcatatgcaaaacagtataatatacaatcaatgttaagagttataacttttcttatgtttgacacacagctcaactaattctttttttttagaaagctcaactaattcttttttgatagaaagctcaactaattctagacgtgatgaaacacgatattagactggtacgtactcaatttggctcgctgtttctttttgtttttaatagatgtagatgggattatgctaaattgataaatatattgatttttacatagtgttgtaggttagacaaaaaattgttctataattgttgagtaaaaaatatttatacttttattctataatgatacacagtaaatacgtactt

SEQ ID NO: 3340 - DNA, 1130 bp, Glycine max
  Soy_ogl_2564 Gm08:8613871..8615000 Cluster 13
taactttggttaaaagataatctcattctcgaaagtctaaaattcataagactaaccttaagatgtagaaaatataataatttttaaggactgtttttatttaagaacatattttaataaatatttacatattactaattgtaataaatttattttaataatgtttttaatgtttagtatatattattatattatatttaataatattgtaatcaatagtcaatacaatataagaaaaaatctatttatttatatgtctatgtaagttatacattaatagcatttaatgttatattaatgtatattttcaagttgattttacttgtggatataaatataaataaaggtagtaaattagcatcattggcttaaaatgttttattcatagagactacaggtattttgtagaaaacaattctattttctatgaagaaaaaaaacaattctatatgatttgagaacaattgttatgagctacacgacttctccaattatttaaggaatttatatatttagtattgaaattggagaggaattgaaaacaatagtaaaaaatttataatactaacacactttattctatcattgaattagattttaacttaatatcactcattaaactgaaaaaattctccactaactgatccatgcttcttttttttttttttttataaagctaatccatgcatttaatagttgacttaaagcatttgcattaattgaatggattttgttgccacagttaaacaaaaatctgattttatcccaaagtaggcgtttaaagttaatgaattgccatatgcagcctttctttgtgtgaaagcttgatgacatcacggcttataaaagcagaagtacagaaacaaaaaagataaaagtaaaataaaagtagaagttcttgactaaccttggctaaaattgtttgtcctcgccatagtttctgtgttccaaatcgtttgggtgagtttcttacgctttcctgcgtcatataattatatatttctcgccccttataattaactattctttttacattgcatacaattatctttgttctttatatatatacacgcacgtacgtataaataatgttgacccctggattcatcattttgatatcaatttaatcc

SEQ ID NO: 3341 - DNA, 1167 bp, Glycine max
  Soy_ogl_8 Gm01:686501..687667 Cluster 13
aattttgtaaaattgaaatgcattattgtttaacttagtgatatattttaattttaccggaaactaaaaatgttctaaatattttacaaaaataaaaaaatgaatatttctaattttatagaaaaaaaatatatattttaacctcgacaatttatatcatcttgtgaaattttatgtgcttgtctttattcatgtacctgtaaagttgagttgtctctcatttgtacaataccaacactttcggaaagattttaaaattcggctggacatggactcacgaaaaaagcgggagccaattttgaccattaaaagggaaatcaatccaactatccaagccaagttgaaatatttacgaagtgtcactacaacacactcatcactatagaatatttgtaaatatcaaatatatgtaatatgtgtgacttatcttaggaatatcatggaatatttatttaatttaaaaaatgggatatttgtttaggatatcatggaatatttatttaatttaaaaaatgggatatttgtttaggatatcatgggatgtgtttttatttcatttttttcttattttcttcttttataaatattttatgaaaaaaattatccaaacctaccctaaatcttaacaaaatcccatttttaaactaacttcttttaagcaatgaaaattcatatacttaggaagaaggacaaaaccaggaaattttatcaaggggcaaaaatttaacaaatgccatgaatttactttaataataaatatattccatatatcttataagaataaatataacaataaatcaaactagtttacctttttcttcttaaaaagtcattcatcaagtttacatgcttgtggtgaaattttcaaagtttatggtataagaggagtctaaaatatatcaaaattattgacttatttattctccaggaatcaataaagagttttcttaattgtcatactttaactatgttacaagaattaatttatatataagaaatttttaagttgtttaggtgcatatttaatttcacgttcaagaattaattctgattacataattgatttcaaataaaaaatttatatgttttatttcacatttagaattaattataggtctaaaaataattatgagttaaaacaactttttcacataacttgtgtgttag

SEQ ID NO: 3342 - DNA, 1155 bp, Glycine max
  Soy_ogl_3279 Gm10:477946..479100 Cluster 13
ttttcaaatcttattaaacatgtgtttttgtcttaaaaatgttttagaatagattttaaaaatggaaaataatggttcaaattggttcttgacaccacttttgtactaattttcaccagttatggactactttgattgaacaataatttttcaagttaacaaaccaaacgccagtcggattctcagtcaaacctattgaattggtccgtctgatttggttttcaaaactatggtatagattttagaacgtgaattagtactacaccaatgaatacatccaaaataacgaaatacacaaattaatcatttttttttcagcaacaatttttttaaaaaaaacaaacataattattcaacttcaatcaacctttacgtaacaacatgaatatagtgcagaatataaaggattagaaatgaaaaaaaatatacatacatttagaatataaattgaataaacatagttaatgaagttaatatattaataattatgtaaatattaaatttattaaataatatagtaatgcataataagataacaacatacattttcttaagaccaattttctgcaattacaattgcatgaagtgaaaatcaagtttaaaagatacaaaattggaaaatagaattttcatttttttattgtaaaaatactaaaatgaaattgttgtttttgtccgtgagacatgttatttggagttttcgtctagatccaatgtcttgttgatagagacatgcgattggctttttttgttgttgtaatttctgacttattaactctttgttagtggttagttaataaactgcgagttttttttgttatagttagttcatgctattatctttagattcttttacgtatttatgatatgattattttaatttataatatttaactatttaccaaaataataaaattgagtttgataaaaattattggatttgaatatttgaaatgttggttaaaatgtaaattttattttaaaatatttaaagaagatagaagcaaactttttttttttatgtacaatgattgcattgtggtttgaacatatggaaaaaaattactgcagattagcggaatagagaaaagaataaacaaaaatgtagaattttgtattattaaagagttgtgtgtttcacaataacaaattagt

SEQ ID NO: 3343 - DNA, 1040 bp, Glycine max
  Soy_ogl_665 Gm02:45010201..45011240 Cluster 13
aataatatttatcaaaggacaaaattagaatagatgtttaaacatctcattgaagagtaagaatattagttaatttgaattttttttcaaagattaaaagtacaggtatttagggatggagagggtaccttcattcttatttacaatactcaaattagagataatatttgtttctttttataagaatcaattcattatgtcttttgttttaattatttttagtttaaaatactcctaattaaataagagagaaattgtattaacaaacatttttgaagaaaagaataattattaattacagtaattttcttgaaaaaaaatatatactagtataaatttagaacaaatttatatctactaactaaattaatcattttctttaatcctaataaattatgtaattagatcttataaacggaagtaataaattttacataaactgcatctaataataataaaaagtatattaaaaataatatttcttttgtcaaaaccattcaatactattttttttaaaaaaaaagataaattcaagactaaaatattgaaaaataacatgaaaaaaaaaatctactcctatgttctttcaattttaaaatagtctcaatatgaataaataccatcaaatttaagaaaaatataaatagatttggttttaatccattaatactctgtagtgtgtctcaaccttaaggcgattgatttctctcccttgataaagttgttaacttgttatagctctcctatgccgtccaatttccatagatttagaatgcatgaaaaaattaataatgtctagtcttgtttgaagcgacaagctagcatggtaaataaatactaaatgaatcttgcatgtataacatatatctgtttttcagctgataggcgacaactcataaatatttcactttatatactacactatataaatatactatataaataaggcatttatttcgttatattttacagggtagtgtggcaattaatagaaagagaaatgataatttatttcttcacctaattttgttacaatctag

SEQ ID NO: 3344 - DNA, 1430 bp, Glycine max
  Soy_ogl_1084 Gm03:44400871..44402300 Cluster 13
ccctcttaatatatattttttactaacatgaaagagtgatcttacattttttttactcctcatatttagtgggatataacgggataacaaaaaggaatcatgtacactcatacttaattttcatattaataataatctttgaggtagtctttgagaggagtcaaagctttctgtctgataacaaaaaaatcatattaataatctagtgggtaaattactgttttgattaattacaacaatgaacaataaaagacatcttttcgttgtgagcaacttttttataataacattgtaaatcttctatttttaatttttatagataaaaaaatataaatattgaatgaaatcattatatatggacttgattgtaaataacaaaaaaaattgagggactaaatactgcaagtgcaatataggaaatcaaaattgtagaattgtgatatgcggatgctaaaaatgtaattaaacttaataattatataaaattactgcataaataatataatttaattatataaagttgataaataataccactattatctataagttttcatcacttacttggaaaaaaagtaaaatttagtaggaagagtaatatttaatttctttttacagtaataaattgttattcgaatttgtgctaagaaaaacatttacatataatgttcgaccgacgcattggaattatcttatatacagagaatacttatgaaaaatgaaagagaattacacaattcaaaagctaagtagttaaaattattgtggagtttatcgcaaggtaaaatatgtatatacgtatttatcgtgtgtatgacgtatgtagttatgtacatttttttttacattattacttacaatataacacagatatatagagtaatcagattggataactcgcggaactggagaccccctatgatatgtagtagtcctagataaagttggcaagatgtcaatgttttttaggtttatcaaccttactaaatgatgtgcctaattaacacccagggttggctcatttaagttaaataataattattcaaacatgcattgagaataaattttttttataacaattttaagatggtagaattcttttttattttaaatgggttaaatatatttttcataactcttaaatttaagggtttttttagttctctaaattaagattgatattttttaatttctgaaatttgtaaaatatttttttttattttgaccgattttttaggatttagatgatgcttttttactacataaaaataaaaaaaatacatttttatttataaaactaaaaaaaaacagatcttaaatttgagagatttaaaatatatttaagtctttcaaattcaaagaaatcatttataaatcacacataaatgcagaatttaaaagttgaattcaaattatacaggttctcatga

SEQ ID NO: 3345 - DNA, 1000 bp, Glycine max
  Soy_ogl_1382 Gm04:44072001..44073000 Cluster 13
agttgggctgttgggactagtagtatataaattgacacactttcaacaagataggacaacatgatcttgtttaatcatccaagaaattataagattgatttggtaggaaaaaaaaaagagaaaaaaagattgtaagtttgattttctattaaaaaatgatgtttaatttaatccaaaaaaaattatagattaattctattaaaaatattgataggaaagcaataatcctatattcactacacgtctaggttctgtgattcgaattggaagtggaatttacaaaaaagcaaaaccattgatagttgatggggactttgataattcagtaagattcctctctaaacttatgtcattaaccgaaggaagagtgagaaagacaggaggcattgcattgggctgaagttgttggatcgtaaggaattcattggcccatacagagtctccaaaagataatcaaattttacgtaattttttaaaaatatttcatgatgaaattaaatagcactttctttttttacttcataaaattaaatagcactactcaataaataaaaattttatcctataaaaaaacaagaagtttagaaattataaggaaaatgttgagctgtttgctgatatctccagccttaagtgaactgtgaacctactactgtttactgagtccttgagagtgatgtttgttaggtgttactgttactagtctttcttttttcttttcataaattttttttattaggatttttcttttcatatgttaaaaaagaaaatgtaaaatttgcattcttttttttgttttttaggaatgcgtcctttgttcttaagatgtctggtacgtagacattttttttatgtttattgaataatgtttttaattaagaattgtgattttcttaaaatgttataaatacatttaacgcgtttaaaaatattcatgaaaatgacagataaaaaagtgagtagattaaaaaagaagaatggaaatttcacttagtctttt

SEQ ID NO: 3346 - DNA, 1256 bp, Glycine max
  Soy_ogl_2700 Gm08:15235901..15237156 Cluster 13
agttcagagtaccagtgctacgaccggtgagagggaatttaatatttttattattaaaatatattcttcgttcttatcttataaatatttaaaatttattcttatgaaaattttaatatattttttatcctcacaacaaaatgtaaacatgtaatattttaattcaaagttgaattcaagatatttaatcttatgtgtgaatgtcactataaattcttaaactctaattaaaacgacatgatattgatacttaagataggattttttaattcatatcaaagttaaaatatcatacatttacattttatgatgatgaaaaatataagaaaattttataaaataaattttgaatatttcgatattaaaggaaaaatatatattttaatttatttttatgaatattttatatttttttatagatacttactgatcttgtttgatatattttttcagattttttatattccactatttatcatcaattcatcccatttaaaaatttaatccttggtttgaccgaataattttaaaaaaattgaataaattttgtatattaaatagaagtttatttttttttaaaagatacattctattttttttcttattcgatgtgtttttaaaaattttaatatatgttttctaatatttttatctgaatttattttatgtattttataaaattttgctcttaaatattttgtcttttacattttatttaccttttgaaaataatacgttttttttttaaaatattctgtaagacaactacatcaataagtgacatgtgacatacagttttcttaacaaccttaaaataataattaagaaattaattaatgtattatcaattacagtaaaaatgtttttttaagagactaaaaatgttacaaaatatgcttgtgcaattattactcttaaaataatgattaacaaaaggcttaaatataattaggttcctctattttgtttgattgaccattatgatttttttattttaaaattaaaatatttaatcttctaatttaaaaaatatatgtaattttagttttctcattttaaaataaagatatttaatcctcctattttaaaaaatttataattttgatcaaattctcaattttatctatattctatttcttttcttttggtataattaaactttaaacctaactttttcatttaagttatcataaaaaatgatttaattaattacaaagtaagaaattaaaaaaataaaaataggtaaagattgaacc

SEQ ID NO: 3347 - DNA, 1432 bp, Glycine max
  Soy_ogl_3923 Gm11:36421701..36423132 Cluster 13
tcccaaccctttttctaagtctagattccttaattatcagcctaaagtgtaatcaataatataaactacctacgttatcatagaaactacatccataattattttaaggtcacggccggcctgagggaagccctacatttaaagggaaataaaattgtcaagtggaataagggctctaattaacaacacttattgctgcatctcctctgttaaatgtattcttaataatgaaattagaggaatctaagaagagattatatgataaagttttaccaatgtggttcacacttaatattctattctcgaattagtacttaattataatgactttcttatcataatgttggccaattccaacctcgccttctcggatatgattaactaagggctctaattaacaaattattcgaatgggttttttttttaagaggtttacaattattttgcggctatacttacgtacttgaatattcgtaaatatataatgttttagattgacatttcatagagccatatctaccaatggattggattcttccaaattattgaatgttaattatattttagttattattttatggttctagacaaaaggagctggtatggtatcattcttgatactttattagaaaaagagaacccatattgtgaaaacatctgctacggtgattatttatttttaagttctatggcatatattcaaagtgttcacacaaatcctcctcagtacaaaaaaaaaaaaaagtgttgagaaaaacactgatagtatagtagattattccacgcctggacagtttttttatggtacgagatccacatatttttttacataaaacctctttgtagctgtttgacagaacgtgtttcacacgaatcggaacaattcaagaatagtaattccaagatgaaaaaaaaatatgtttatctaagcctacccaaaaaaaaaatgtgtttgataactcaagttttatttttcgtctcaaaaaattttggttacttttcatcttaaaattttattaaaacctaccaaatttataaaaaaaagtattattaatattattaaaaagcatatatttaataaattatataatttctaacgaaattatataattttttttatcaaaacatttactataaatctaatccctattgcaaaacaatattatgtcatttctttttcattttttctcctaaaattcatgcttaaaatattaatttcaaagaaaaatgctacccagaaaatccacctttgtaacttttttttttttgtcgtttataacttatatatatgtctcgcattaattgaactttattgggccttcatttctcaacccataagaaattaattaggagtgatgctagcccagttagcttttttttttttttacacaactagcccggttagcttgttacacgaaagatcaacaatttg

SEQ ID NO: 3348 - DNA, 1300 bp, Glycine max
  Soy_ogl_710 Gm02:47253501..47254800 Cluster 13
aatatatatttttttacttggtgattttttgattgatactcttaaaatactcattgatagactcataaaatattttattattaaaataaaaagtcaatattgatgaccaaatataaggataaaatacatgtccaaatcatgttttggcattctatttagattgcgctagacaaatgagatttttaagctcggatattaattaaactttaaggtatatttagtctttaaatatgcactaaaattatttgatcaagttgagccttaactttgtgttcaaaaggtccacaaaatcaaattctttctataagcgaagggattgtttggtatatatgataagcaagtgatgatgaaagtaggttatttgcaaactctaacactcaatctagtatcaattaatttatagagtaacagtatgtggaagaagagtttatctggtcatataagtggtgtctttttttatagagttcaagtacaaacaagttacgactcagttaatggattgttcccttattgtaaatctaacgtgacaaatactctttatagttgttaaatatttttaaacagattggcatgaatgatgtgtgtattgtaactttgattctttgtatattttagggggtaagaagtttataagtttaaagtagggtggtttttgtgggtcttgaatgattgttcaacccaacaaagacttacacatatggggggagtcataccaggttaggctttgctagcttaggtgtgtctctataaacctattacattacattgaatcaacttttttagtttgatttttcaagcaatatataatgtaaataggctttattaaatgatgtaatgtttttttagaaaatacgttgaaaattcattgaaaattatggcgaccgcacattaataatattttttgattaaaaaaatactttactactatacgtggctccctaacattagttactagttaacattgtcttactaaaaaaacaagtattaatttttttatataactactactttcatttgaaacaaaaacgtttatttttttactttttatctatatccaactataaattgtcatccgtttgttatcttgtccatggtagaaaattcctttaatgttttcatttttagtattagctaggtttatctaattaaagatgtgccaacaaattaaaatcatgaagaatttattataaaagcaattacttgatgctttcaaaaattatgatgaattcaactcaccccaattcaaacattaacagatactcaagttaaattttaatatagattctcgaagtgaaattct

SEQ ID NO: 3349 - DNA, 1604 bp, Glycine max
  Soy_ogl_4350 Gm13:293375..29749978 Cluster 13
cttaactatttaatttgttttttgctatatcttagctatttaatttaagcttacgtataatattttcaagccaataattaatcccgtttaagtgaatttgagtcatgaaaataacatttgagggacacagttggaattttttatggccttttgtttcctttactcaagtttctttactcatgttggatcagtttttttttcttttccttttttgttacatggatcagctttgacaatgagttgtgttgattaaacacaatttaaagcataaattatacggtaatacaaacacatttgacacattattattattatttttatttttgacatcggtacattacataattaataacaactaaatagttatcaaaggataataagtgacttttcaactaccacaacatgataaattaatatggcttcatataattaaaaaagtatctcgatacatttaatatagtagtattaggatagggagggtctatcggaaaataagttgatcctcacctaatattcattcagcctgtgatattgagcttagccatagcataatctaatttttaaaatgaatttcaagttcaacctatatgtactcgaattatagtatcggattaatggattgtgagcacctttgttttatatgcaccgatcgagatagtaaattagcttgttaatatgatgtggttaaaattaatatacttatgtatttgtaattagaaatagcaattaagaaaatcttattgatttgattaaataaaatgtataaatataataaatctttgatattatattcaattcttataaataaataaaaagttagggtgacagtgtgatttgagaaaatcatcataccatgattttaaagatattcaaacatgttataagaaagagacacaaagtctgagagtaactctagaatgatattgttatcattttttttttcaaatctaataattttaaagagtaattaattttaaacattaaattccaagtaaataaatgatgaaaatgaaatgtaacatttttgaaaatttattttttaaataacttaatctcttatgatatttcaattcatattttatcgtcatagtgtatttttattaaatatttactaattgatatttttttgtcctatgttaaaaattgcaggtgtccctaacttattaggtctgaaattaatacagcagctcattattgttgattcaaaagaattttacatataatgaaaatcaaacacaaattatttttcttaatagatattcacactcatataaatacaacaaaaccttacattatttcattaaccctttaagtttttctaaccaatataacaatatttatatgatttttaatccatccaaaaattacttcaaacaccctctaataaaaacaattaatctttaccttttattattttagcattatatttatatctaatggttataaaaaaactgatccatcttttataacatgactacttgatgcacttctctacaatggaatccatcttttataacatgacattttatttttcttccaatgcaggacatctaaaaaattatttttctttctcgttattttccttatatattttttcaattatc

SEQ ID NO: 3350 - DNA, 1321 bp, Glycine max
  Soy_ogl_20 Gm14:3711601..3712921 Cluster 13
gatagatgctgcttgctgctgctatatataacgactttgttcccgtgtctccaataattaacacaaagctctgtaaaaagcaatcgagggcatgcatgaatgcatgtgcgcatttgtagcggtggtctattatggattcaaagtaggttgcgagaggaatagaattgaaaaagcatctttgcttccattggctttatcaatgaattgaagcttgtgagtggtgacagccagtgttcatgcaccgactctatctgttgtctgagtatcttataactacagttaaaggtgttattgatgagtttaaaggcaattaaagtaacccataataaggaataataaatttagtgaaatgactaaaaacataaggggtttcattaggtatacaaatagacatgtatagaaagtaagttaaaagaaaataaagttacaaggaagtaaaatataatttatttttggaattatgtttttttttaattatatctagaagttattttaaacttggattaatcttcgttgagttaattaaaaaatgtattggatgaaatgaactaaaatattttgttataatctaatattaactatgtttttagtcctataatatgaacatgttttttttttgtttttttttattttcatctccgtaaaatataaaataattgttttttttttcacttaaaaataagcaattttttttggccctggtaataaaaattagtttttatccctccaaattttaaaaccattatttgtgcctaacatatatctatttttaggaagataggtaacactcattttggacattattttgctaaactagatgatttggtaaaattacatatcaaattaggtgttttgaaaagttaattactcaagacagatgatttttactaaaaaattattgacaatctagaagtgtgagtctatcaacccttatttagaaagatctagaaatatatgaaaagaaaaggaaacgagcaaaaggctagaaatgatccttttctgaataaaatggagaagaataaaagtatatattcttcccaaaccttacattttcaagccttagccctttacccttgttctgggttttctacgtatgtccctctcagttcattataaaaaaaaacgtatttatcgggttaaatatttttttggtattcataatttagtatttttttcatatttgtctttgtatttttttattttaattcttaaaaaatatgtttgctttatttttttttatctttaaaacactttggattatattttgaacaacaaaagaaatattttgaacaatacaaaaatagtatttaaagcatttaag

SEQ ID NO: 3351 - DNA, 1482 bp, Glycine max
  Soy_ogl_4329 Gm13:28621193..28622674 Cluster 13
caagaaaaactgtaaaaaatactaaaacaaaaaatacaaatgtagtatttatttgagagagagaaaaattatacacccacaatgtaagaagtttttacatttttatttaattataacttatcattgtataataaattttttatttttataatgattattttaaaaattatattaatagcaaattataattcgacaattatacactatcaatgttttttcatctgataaaaacatatcatgataatattttttacttttataataaatattataaattcatattaacgacgaattataattagataatttacactatcaatacatcaacattaaatttttgtaagattttattattctttacaacaatttaattttgccgagatattctgaaaaatgataaatttcaactttttttcgcaataagactttgaaataattatttccaaattattcaccatgatcagttgtgctagttaaagtacaaattgtgaagaaaaaaaaagatagttaaaatacaaatactttttcaaatttaattcatttgcataatatctaaagacattgaatgataccaattcttacagcaaaagaaatatacccacatactcgtgcatgtaaagaaaagttatcaatgatgactagtccatatttttgaccaattaaacttaaaattctagtaagaccaactaaattcatttgcaataggttaatgtgtttagaaatgaaaacaataaaaaaaaaaacaaatcaaagagatttcaacttgtttcccttcaaacaaacttaaaaaaaaaagataaattttactaggaacctcagctcatacaatctttttacaatatacttctttcaataaaaagcatgttacacactcatcatttagcccttgcatatcaatcttataaatattattatatcttttgataataataataataactgaatgattaaattgatcttttgtttattcatgagtctttatgaaaagaaacacaatattcattgtaatagtttaatgagtgtagctcgatttacaatatatatagagtttgtgaaaaaaaatattatttgataagatatttcagtttttaactttttttattagttgagaaattcatttgattgtttaataaataagttttttttaatagtttttagtatttttttaaacgctacttgaattagttttttaaaatactagtttctacctttttgtattctttttccacttttatcctctatatttattcatttctcttattactttttttaagtaaattataattttttatttttttatcattttacaacttttagttatttcaactattagttttatcaaatacttttaatataatatttcctgttaataactttcaacttttaacttttaactgttaactaacttttgaacttttagttaatttttccgctaattttatcccaaacgaaatgaagaggatgatttttaataataaaaaa

SEQ ID NO: 3352 - DNA, 1600 bp, Glycine max
  Soy_ogl_5700 Gm17:15780301..15781900 Cluster 13
taaatcacttgagctttgttctttattttgtttaggatgggaagcaaaagaaaaggacagggaggattaagtatatccctttaggctttagcaaagaaaaaggaaaaaaaaaatggaacgacaaagtatttatggacttcactatttccttatattttacctcctgaaagaaagaaaaaaaaagtgatatgacaagatatttatgattttttattttattttatgaatctcgtcactcttttacaccttctaaagtcattcttgtaaaaaaaaaatgttgtttgaaagttgctctaaaatatatttattaacttgatcatagctttatatttctagtgtctggaatttatgggctgtgattttaattcctataattttaattgttttaattttgtctgcataattttttaattgttaaaatttaatccttcctttcaaaattaatcaaataaaatttctttggtttatactgagaatatcttctaaccaacaactcgaagattaatttctaaggtgtaaagttcattgaaatgagtactattttttttcaataaagtatttttttataatatgatcataaattaaacctttgagaatatacttaaaacaaattcaattatctacttattatgttcgactttttttggtaaatttcgtcttgtaaataaccaaaatataataagagtttgatatgacatatattttttaatttataataaaaataaaatatttaaataaaattgagaaaagcaaaattatgtctatatttgatagatttttatttcttattttttattttaaatattttatacatactaaaattataactaaacattaatgaacatgtgaatcaaattgccttaaaattattttaactaattaataatttcaaacaaacttcaaatatataactatattgaaatttcagaagaaattttttaactgcaagctcaatcacaactgcgatatgattcacctttaccaaaaaaattagcacaaaactttatttacataactttataaagttgaaagtcctttgtgtttggtccaagacaagatcaatttaaagtaagaaaaaaaaagttaaaactataattttgattctttatatttaaatcaatatatttaatttccttattttttttataatattaaaaaaagtgaaaaataaaaaatatcttaatatgaatttaaccaataaccttttttacaataatagaataataaggtaataaaagattatgtcatttgctttattttgtttactttataaataatatattctgtgtatcattactagaatgtattgatttgtatcatgtacggctaaatattattactaaataattattaaaaaataagaatataaattttatattaaaatttatatcagtaattaattttaattattatcattctatttattttaaccaatggattataaatgtttcaaaatattgattataattgagtcgcaacttaaaaatcatttgagtagactataatgacaaaaaaagagcaaattagaagaatacactctgtagtttgttttaattacacatacatcccttccatctgaagacatttctttggtacccct

SEQ ID NO: 3353 - DNA, 1305 bp, Glycine max
  Soy_ogl_5921 Gm18:3258601..3259905 Cluster 13
aaatgaaattagcaatagaaaaatgattgatatgtcacatccttttaatctttaaaattcttaggacacaagtttgataaattgatagttttaagacttttttgaaataaaaatattgtgcaattttgattaaaaaaacaattattgaaatcaaactttttaatttaactagcactaaaaaaattatgatgagatcttaaatagagaaatgaattaattggatgtgtcattttcttaatccttagattttaagacaagccacaacaacttggtgttttaaacaattaaactcttttttaaaacaaaaatgttgtaacaaaattaatttgataaaaaaaatatattaatttcaaggtaaaacgtctaattgattgacttaggtgtacccttttgctaatagtgatcttacattttagggtgcatgagttatgatagttcagaaattctaaatttaatataaaaaagtaaaattaaaaatactaacacagataatttttataaaagaattatgtaactttggtttttttattgtatctatagataaataggagaagcataaagcacatgttaaataatataataaggggagattttaatataataataactcattttttcaaaaatataaaaatttaataagcaccaaaataaaataaatgcacatattaaataaataaaaatatatttgtcatagtttttaattactttagggtaagataaatattttaaaggttatacaaaaattaattaatcagaggtaatcatttttataaaatagattttctaggtgttactatatctcttgcacttaattatctcccgaacacaaaatttagtttgagaatatcatttcttttttttaagagatttttctgttactttacctaaaaaattaaaattgggtgacaactccttatttttataacaatatctttgtcgtcctatcaagattttggttgcgacaatatgtacaaatagttcaaataagtatgaattaataaagccatcgagaattaaatgatataataatgagtttaatgtacattataaaatacttttacacaaatattcaaaaaaaaaattactgtcttattatattgacctattaattaataaagtggcagtaagataaattcttgttaaatgtatgtgtcaaaatattttatactgatagtataaatgaattaaactttatattgaagtattaggtattatatatacataaatttaatacaatcaaatgtctagctagaaaagattatccctttttatggttttagatatgtggtcaaaatgtaacgagag

SEQ ID NO: 3354 - DNA, 1200 bp, Glycine max
  Soy_ogl_6513 Gm19:42419401..42420600 Cluster 13
ctaaatttgaaatttaaaggaacaaaacaaaactaatagacttttatgtaaaattttattctattatgaaatataaaaagtctcttccacaattaatttctaaagtctcctccacgtacaattaatggtcgatcatccgatcatattttataacataactttcacttaagcaaaacattatatctagaaaaataaaatttaaaacaaaaatatatatcaaatatgtgaaaaatcatataattttttttttaattttattattatttaacaaaaaattaactattcatttggcttattgacactttaaaattaaatcaccacaaaatgtaaaatactaatgatgttactttcaaattaactgaaagatcaaaatgacttaaatttgaaagttaaagaatgaatcatttaaaagataaaatacgtaaatgaatcttaaaaataaaataaaggagcataagtatattttagcctaattccataataaaaataaattattttggtcataaacaatgaactatgtcagatttgaaataatttttatttttaaattaatttgaataagttacgaagattctagttcatttaattaagcctatggacaaaattatatttaaaaaaaatgattttagataatttcttgaaattttcccaaaacaataatgaatatgtaagacccatgaaaatatcaaatcagaatgacttaaaatatctaaaaaaatcttgaagttaaattaattatgttgaatttaggggtattttgtgtagaaggctagcggatatcacttagactaaacattaaggatatgcagagcacggatctacaaagggcaaattccacattgtggtgacaactacctcatacaaatattttgatgaagccatggttgttccaagatcatatttgattgtccaccaaatggtttttggcatatgtcattttgacctaatggtcgatgttgatatcatagtatgttagggaatgttatttggctaatcgctcgatgattagagatagatctccatagaatcaagcatgtcacatgcattgttgttaaacatgttgcatattgttttatgtacatgttgttgcggatatttttatgacgtggcatgttatcttatttgaaaatacttctagcttggttattagttattatttgaagtatgtcgtcgcgcatatatttatgtccatcgttaatt

SEQ ID NO: 3355 - DNA, 1153 bp, Glycine max
  Soy_ogl_3151 Gm09:37231651..37232803 Cluster 13
ggttgaaaaactaaaaactattacagtatacaaaatttaacgtcttatatctaaaaaattaaaaatttcacattttcttaaaaataataaatgcggatagactcagacatatatgacattgtctatcattatgctagtatttatctaactagggtagactttactgaaatatcgtgtactttattgtgataaaattatatatatatatatgctattttatgtatgtctattgttaaagctagtatttaagagaaatattacactagctttttaactttatgtctttatatattcttcttaatttactatttcttcttatacgtaacaaaaaaaaggtagttttattttttaaaataaaagtggtctcaattataattaataccaatatatatagaaaaggtgagtttgattactttaaagagaaagaaagttattttttccttttcttttggcacaaagaattgctttttctttgtcttctgtgcttttactttatatatatcgcatctggacccaaagtaaacaaaaaacggttatactcaaaatagattcttggtaaaatggtaaaaaaagtatgttgatatttctccaagtatgctgaaattatctttatttttgcaattgtttttgaaatttttataatattttatttaaatgttatttttttcttcatatttttacattcagatacatatgcaattatttcatacatttttttgtactgataaaaaatgtataacaaagaaaatatagtatttaaaattaatggaaacttcgacgtaagtttttaaaattcaatggaaatcaatttacacttgtgagagataaactgacagaactcaaaactacagtatttatgataaggagtaaaacaaaagttaaaagtagtcgcgcgggtatatataaaatataagttatttaaaaaacataaggacaactccatttaaataatttttatgagttgaagtatttttcacgattacatcatttaaactattttaagaaattaaattatttttatgagttttatttttataattgtcaatataaaaaaacacacaattaattagttagaaaacattttaaatacattttttaaaaaattaataatttgtaatttaacataaattatcattaaatgctcgtataattt

SEQ ID NO: 3356 - DNA, 1500 bp, Glycine max
  Soy_ogl_4440 Gm13:33904501..33906000 Cluster 13
ggataaatgtactttgaacgatataaatattttaaggataacattaaatggtaattaccttatctaattcaagcgcatacttaactagttttttcaaccaaggaactaattgatcacaaataattaatttattgaaattaagattagatcatttgactattattcaagttcaattttaataaaaataatttttaatcatattttacttatcttttaattgaattttaaattaattaaaattctttttttcctactgaaccatgaaccaaaatgttaagaaaaaaaattaatttttcaactaatagtatcaaatataacctaaagtgaataaataattataaatagtaaaattattttttaaagtattttaatgtattgtatatgtaaaatctaaaatctgaattccaaaatttgaattaaatataacaatctcatgtcaattcatccatttggtgataaatattttttaacaaatactagtatttcatacacatttttttttatcaacaatgaatttttttctaacattaatgtactttcattttttattgtaaattttaataaaatttatatttcatttattattttcttaattaatgtttttaggatagtcctctagctaatgtagtctggaaccatttatatttcatttagtattatttttttaattgttgaaatttaacatttaatttagagtacgttataaatagtactaagtgtacaattttaaactgtagtaaaaaaatcatcacaacatctatcaaattaacacaaacctttgttttataaatatcttttccttttatatatcttatatcattcaacattttatcttttatctgagtggatgactcaacttatgattgctctgatatgacaggttgtgatgacatttttagggatcacataggctcttttcaaggtttttttgctgaatttctggacacttagagcccttcttttgctgaagtcatgggagtggtcagaccattttgagttggctaacagacttatttggtctaatctctggttggaatatgattcaactttagaggtccaagcttttgctgatgtttctttgattccttattctcttaggaatagatggctgaattgaatagttttaactaaatatttcaatttttgtagttggatatatttataggaaagacaatacttgtgcagatatgcttgggttctactggtgggattctaacccctttttctttggcagcagagctcaataggaacaagataggtttacctaattacaggttttcttagttttgctcatgagtttggtttttatgtcccccatgattttggttatgttgctcttgttccttttcttttgttaatgaatttcttggtttgctgcattagtcctttagtagttggggtgtcaacctggttgaaatctcaacagctttagtgtggttagcattccttggctgaaaaaacctttataattttatttgttgtctttcttttgtaactttt

SEQ ID NO: 3357 - DNA, 1100 bp, Glycine max
  Soy_ogl_1817 Gm06:7090401..7091500 Cluster 13
aaaaatattaacaacatcaatgtatatatttttttattctttaaaaaataaagacacattctctttataaaaaccagcagtagatttaattggagctttatatcgttttggaaagggaaaaaaaaaacacaattcacgtgcgcaaaacttatgaatgtgtaatgcctaaacaaaaaattatgggaatgcatcaaacattatacctttcacttcttaaccgcgatactataaaattttcaataaaaatgagaatatttaaatctcaagtgcctatttgtactagtattacctgaattgatgtagttatagtaatttcttcactgaaacctttttgtttaaaacaatgccttttatattacatcaagtcttgataagttcatataaataaatacaaatgaaaaaaaaaaatcaatcaaataaaagcataatagaaaagaaagagtatccgtcaaattggagcggtggttcatgaatcatgatgggctaaaatagtatccaccaaataggagcccaggtaaaatgggcctatctaatttacatgtttctccccccacccactcattttatgtgtaagatcgattgcatgaaacatctattttggcaaaaagacttttttattttggtgtcaggctttttttgatttgatgcttggattatttattctggcatgtattattctgcttttatttatttttgacctaattatatttattatctctaatttttaatttttaacgaattttatttcaaactttttaatttcacacattttatttctaatttttaagaaacttgtaatttttatctccatcattttccattaataatttctaaaattagggatagaatttgtcaaaaaaaaaaattggtgtaaaattgtcaaaaaaaaccttgggggtaaaaaaatataattatgttaacagtaaaatagtaaaatgatagatgataaaaaatataattatgttaacagaaaaaatacgttaaattaatttattgagagtaaaattcattaaaaattaaaaaattaagaataaaaaatacaattaaatctttatttttctaagataagacacttgaacgattgttattttgcgtggaca

SEQ ID NO: 3358 - DNA, 1000 bp, Glycine max
  Soy_ogl_2219 Gm07:5466401..5467400 Cluster 13
tgaatttggtttaaaggaatgaaataggtatataagttaaatttaaaaaaaaaatgaagtaaaatgtagatatatgatccacatcaatttttaaaatcttcatctcaaatacactcaactgtaaattaatgaaacgccaccttaacaactacttatataattctattacttactcaacaaataaaaggattagtaaataatatatgttgcatcaaataattgattacaataaaataaaataatcatctcaattatgctatattttttaaaccatcttatgctacagtgtcttatcatatcatataaataaaacttgttagtgataatattagtagaaactaaatctaacatagtcaacatagtagttattatgattatttaagtacatacataaatgcgttagatatttgtttttaattttttttgttataacatttataagaattatatattagtacttgtttagggaaatgtcgttattagttagacaattgctcttttcattctatcgtccatgttttttctccaaataaaggatgtcatttcactggttttataacattggaaatgttttcgaagttaatttctgaaaataataagtaaattcttaaaactaaattggtaagagtggtgtcatccacaggacatataacaaatgtaaatttgccattattattttaatataaaaaataaaagattcacaaaaaaaaaaatactattcacatttgcatataagttcgtgatcgtatcattaaggcattcgaaactcgttattatatgagaaaatacataataaatatgggacaaaaagatatatttaaaactttacaataaacatacaccccctattattttatataaaccaaagtaaagatttagatctttaaattttataaaacgatatatgcacacagacatccaatagagttgtttcaatgtgcataagtgttatgtacatacattttgtcaataatatataaacatggtaggaaaatgataa

SEQ ID NO: 3359 - DNA, 1000 bp, Glycine max
  Soy_ogl_4582 Gm13:39767401..39768400 Cluster 13
aatgatatcttgtgtatgaaaaacatatttccaaatcaatggaaatttttttcatccataaaatttgaagataaatattaaaatttttattaatttataataagtcatatattttatttaactaaccaatttagactcacttagtgtagaataacatgattgtatttgatttatcttttaagaaattatatagttttttttttaataaggttgttcaaataattggtagaggataatgcaaggcatcctgcacgatgtggaattaagagaggttgaataacaaaaatagaagaagaagaaaaaaagtatatctgtttctatttttaagttttcaaaatcccactttagaaaaaatatacagaatttaataaaaaggaaatcttatttttaaatcaaatttttaaccaaataaaaaatgaatatttctatttttttatttttgctttctttttaagtactaaacctatacttataatataaattcgaatacacaacttaatttactctctcaattagatattctcaatatattttctcctttcttctttaaatgtgcatttgacatactatctgaacagctaatcataaaaattctctcaatcgtctcaaaatacaatcttctcatctttatatgttttctcgatcttattaattgtctatctattttaattcaccattttatttctatttctaaattgaattttaataatttcttaaataatatttttgtaattataaataaccctataccacaaattaaaccatttattgtaaaatttaaatataattgatatatttaaagattgtagacttagaatactagtatatatagatggattgatgtatataaatagatgtttttgttgagagtgaataaaaattagtgattttattatgccggaataaaattacaatagaaatgtttttttttatataaaaatcactcaaattaaaaaaaaacatgataccgtattttacggaagcatggtaattcctagtt

SEQ ID NO: 3360 - DNA, 1033 bp, Glycine max
  Soy_ogl_4813 Gm14:47956101..47957133 Cluster 13
ataaaaagtaaaattattattttattaaacactcttattaataaaaaatttatcaaaaatttaaaaataaaatttgttaatttatcgtgaaaaaacaaggtttagcttaaaaattattataattgtttttttcataaaattttaaaatattttctaaaactgtataatatcccttatcaaacatggcttttttaacgtctggttgaaaatctgaattgtgaagaaaagctgtgttacatgttgatctcttgtttggtgaagtgagaaatgaagtactgtagatccgtggtaggtgagtcatctcattttaaatgttggacaattctaggtaccctaatctgatgcttcatgtttttctccgccggactattcagtgacttcaaatcctccatatgtatacggctatggccaccaatgtacagcactccacatgcacaagctctttgtatgtacaaaaagtagacccaaaattgttgcagatcactgtataaaaggagataaaaagtattaattaataaaacatttaagtttgcattttagtagaacttacatataattagtagttaatttgttaataaaaatatattatttgcattagttaaaactttactgtttaggatttatttgcataaataatttaatcaaatattttattgaataagtgtttatatataaatagtaatgtaaacgttatctaattttttaatgaaagaaaagttaagattaatttctttatataaattttaaactgtttttataagttaacttaaacaaattattgtaacaataaggtgagaatttttttttgtgtgtgaaaagaaaaaaaaaaatcattagcagtattgtgaactatagcataaggcatgctataaagtccaacaaatataagttgaaaataactttaaaaataccataagttattttcataacatacgtgataaatccttaaaaaaataagtgataaattaaaataaaccacaaataatttatttcaaaatacactcttaagtaattgttgacaacatgttttttc

SEQ ID NO: 3361 - DNA, 1300 bp, Glycine max
  Soy_ogl_6302 Gm19:204501..205800 Cluster 13
atttatcttgtgtaaattttgattttaaatattttgatttgaaaaacctagtgataaaatatttttatttttatatttttttttgtattcaaaataggttgaaacaacatgtaattgatggttttaataaaaaaccgataaaccacaacttattaaacttgatttatttagtgtctaatgtaaaaatgccaaactccaatagtgtattgtgtattctataatggatgaagtttgtggctcaatccatgttatatataaaaaagtttaaatattttttttataaatatcctcttaaccaaaacacatgaatttataagattagttatattagcttctgttggttcttataatttacatgtgatgttgtgtttctttttttatttgatgcatgaatttatatttacaatcatttaccaatttttaaaatacattaattaacttttttatttaacttattttatttattattcttgtgctaatatttaaaacttattatatgctcgcaaaaacatctaaactgatatatttacataaatcaaaattggaaatgcttagactttaatttatctaaatttaataagcttagaattttttttaggcatacaataagcttagataacatatcgaaataataaatcaaagaagttaaatgaaaaattaatgatgatccgtaaataaaaaatggcaattaatatgttttcaaacttaacaataattgattgaaaatgtaaacttatgcactttgattcaaaggtcaaggtaaaaaagaaaaagaatattacatttaaatttcatgaaaaataatttaatttataaatacatgtgttgtgttaagataatgagtgaaatatttaaataccttttaatataaaaatatttgaggatgttaaaagaatctttttaaaatatttttatttgaatgttattaaaatattttttattgaaaaataggagtagctgccaagctatagggtaaaaaataatataactataagaaactaaatgagatattttaaactacatggactaaaatgaaaaattgttgcaactatatggataaattctaattaaacctaaaaagtaacctaatatcatttttcacaaaaaaaaaatataattgtgagactttattttagctcaatcttatcaaggaaaattttgcactctttgaccacttgtttccaactttattatgggatttgattaatattgtgtcttcctataaaataaagatgagcataaattacttttgaattttttttgttcaaaattgatttaaaataaatccaaattagcattt

SEQ ID NO: 3362 - DNA, 1031 bp, Glycine max
  Soy_ogl_89 Gm01:3713701..3714731 Cluster 13
tgccaaactccaggaaaaaaaataaaatagaggcgtcacataagtattgattaagcaaattacatgaaatttggaaatccaaatgacaaatgacagtgtgatcaaattaaagatataatgttgcaacagtttgtattaggcatttttcttcttctgcagggacgaagatgattatggtgaatgcgagaataatatgtttttatgtttatattttaattggaaaagttattttgttaaatttaaaaatctgatgtgacaattttaattgaaaattttcaatttaaatcatttattattataaaggattgagatttatgcaagtacaggttgcactttagaaaagcccgccatatatatatgtatgcatgcatgcatgatatttttaaggtttctattcaacatattatctggtatatatttataaaatctttgacatttaaaattaaaatatgttattaattaaattgttaaatattatttttaaatatttttcacattatttttggagcgtatgtatattgagagagagaaaattaataaatgtaataagcaatatggtcaaaagaaaacaataaacaaactttaagaaaaatccaagatagtgataaaaagtcattagtataggaaatatcctttaactaaattagagtttggtgaatctaattaaaaattatttttgtcaaagataaatctaaatttatctgaacgattcaatgttaatcttaatacattaattacttgtatcaattacttaatttgttgagaatttaaaataacattaataatacatttaaaaagtgtgttagttattaccaaatgatccgatcataatttatatgacacggcaaaaggtttcaaggatagagttgacagcaaataaatatgctttactaatgccttcttctatatttttttagtgaagtcaaggtatcctttattgagagcttaagactaattaatttttttgaaatgaaaaaatttatttgaggttgatatcttctaatagatatactttcattgtcctcttttac

SEQ ID NO: 3363 - DNA, 1000 bp, Glycine max
  Soy_ogl_358 Gm02:3713301..3714300 Cluster 13
ctctgtgatgacgatatcagttcagagtcatatgcattatgattcttaacttctgagtgtatttctagtttgcttgcagacatatgtgtatatgctatacaaaacccgatttcgtgaaaaagattcagagggggaaagggaaagaacatgtgtgaccaggactgtgtatgcgtttcgtggtagtaagctcactcactatataagttgaagaatcatatctgagtttaattcaaacattcatatattcatatatatgaagtaattaaacccaatcaagattgttatattttactgaaagcaaagtattgttatactttaaaattatgaaattaatcttttgagacgtaaacattattgaagtagattttattttttaataatctttttcatacatatgataaaaaatcaaatatctattaacatatttaaaaaagccaattatctactacctatatgttgaactatgttcttttaaaaaaatgttaggactatgttatcaatgttattatcttttatgttatatatatatacgaattaaaatctcaaaattattatattttattgaaagaaaagtatccttgaacttagaagttataaaaccaatctctgagaaatagagatgactgaaataagtcttttttaaaataaaatctgtttcaaacatacaaacagaaatttgaaaatctgtcaatatacttaaaaactcaattttttactcactgtgttagattatatatgttggtcaatattattatattttatgttatgaagtaatgatacataaatatttttaaaatttaaacattttattaatatatgtcttttttggtcaaattacaaattttataatgtctatgtttttttctaggtgttgaatatattaacaggtgttcatcaaacttttttttatgttatgatataattgcacagtggaaacggcagggaaaagtgcagaaaagagagtgaattgttggcgaatgaatggatggaggtgatggtg

SEQ ID NO: 3364 - DNA, 1121 bp, Glycine max
  Soy_ogl_698 Gm02:46361180..46362300 Cluster 13
attaaatttgaattcaaaatatattttacataacatatattgtcccatgcaatacatgtttttacatatttttaaatacttgtagatttttttttattacttggagattttttcatattttatatattataaattataaatatttaatataacttttttaccataattaccgcaagtattaaaaaaaattattactataatattaaatacaattatttaatttttattttcagaataatcaaataacaaaaactttaagcaattaatcactattattttctaatttattttaattaaactaattaattatttataattaccttaattgtgtaaaagtgaaaacatcatattagttgcggacaaacagatttcatttttaattaaaatatcttatgttttgttaattaagttgttgctaaataagattttgtattgataatctaatcaaagactttttgttcttaaattatttatttatttttgaatatttttctttttactcatattttagataggaaaatgttatctttaagagaattttaatgtttttagtttttctccaacttttagcccaattaaaagcaatctacacaactgattagaaaatattaaaatgagaaactgataaaaaaaaaaagtgtttgtaatgtgtgtgtttctaatatttaaagaagacattatagacttaattcaaagttattctcccaatagttattatgaattgagatcatataatatatagtatccaaatcatagaccatcaatcaaaccaaaaactatgaaactcattacacattaaagcatgggttctcgtatagtctttacattttattttttattttttgttatctttttgagggtgttggagtgttcctcccttttcgtaattgcttctagtcttttctaaaaacaccacaaacattacaaactatacaacctaatttggtgtagataatgatatcatgtttcacacaaataatatgtacacatttccactacaatttatagatttttgatagacttgtgtttgcgtggatgataaattattttaacgcatttattcttactcatcaaatacctatattatatttataactggtgatattactaggtctttagtt

SEQ ID NO: 3365 - DNA, 1243 bp, Glycine max
  Soy_ogl_1200 Gm04:3747258..33500 Cluster 13
cattgtcaaattatcacaaccactaattgtgcttcgtacacaccctattacataaagcccacaactttcagaaaaatcaccaccaacaaaagagaagatatcggttttaaaattattgtaaaagagaatctgtaatttttttttgaagaagatcacaaacaaaatggaaaagaatgaaatcgttacttaatgaatgtataacaacacactctcctacacccctaaaacaaaaacaaaatatagatataatacggctatacaataatacagagagagataaatataagatgaaacaggcaaaacaaagtgagaaaaaaagttcgcagagcagaaagaggcaaggaggcacataaaatgatggagaaagaatgaatttgaaatattacatttttttattaaaatattaaatttccaaattcagactgtatttgatttgatgttaaaacagtaagaattgacaatgattatgttttcaaatttataatttcaatttcataataaaaaaattgagaatttcaatcggaattagtctcagaaatatataattatttcagtttatattatgtattatatatctttcggatgtgtaccaaaaaaaaattatatctttctataattatcaattttattaaatcaattattaattatttataataattatacatataatgtcatttattattttatggagacattttaaatttaaataatatcatttaatattttatgaaaagaattaatataagattaacacgtgcccataaaatcaaacattcttgtatatatatagtaactggccaactggccagtggtaacatcttagcatggcctaataaatagacaatatttttaatagttagtattaatttgaaaattatctacttatattatgaattaaaatatataatttaaaaagtaaggttatttttttaattagatttttctcaatatctttttcttatttcttttaaatgtatatttcatatgaaggaatgtaactcaattggttaaatcctaagcatgaattgttaaaaaaatatagtatattaagttcgattccttgtaaacaaaaataaattacatttcatacactctttggtaattagtcaaaaaaattctctcaaccatcttagattatcattatatgtatatttttaactatttatctctttcgatctaacatttttttttacataaacttataacataatgtccattacaaaatttagtaatagtcaattca

SEQ ID NO: 3366 - DNA, 1300 bp, Glycine max
  Soy_ogl_1799 Gm06:5733801..5735100 Cluster 13
ctagaaaattcggtagtaagcgcctaatgtcgatgatcttgcacgtgagtcttgagagtccacattatctttatcattatatataaaaaaaatgtgagataattatgaaaatatatttttggtgagtaaataaaaaaatcatatttaattctttttagtggtttaaatatttttgaatttataaaatcagacttttaatcatcatcattatatcattataatagtaataactattaaatgtattcttatggtataaaccataatgtttatagagtgtccacaaataatacactaccttaattttatttttattttgatatagaaatattgatcatttattttaatttattaacaaatgattaatttttaattttaaaaatcttaaatattattaatttttgttattaaaaaattattttgaacctaaatatatttaatgtttattatttaattgttcaaatcttaaatgtaataataaaaaaccgcatcctctcgtaactttcaattataaaacatcatataattttaaacattgttttttgttttttgcactatttccttcttaataaatattatgttttgcactatttccttcttaataaataattattgtagttttttgttttttgcactatttccttcttaataaatattatgttttgcactgtatctttgatggtttctccatttctctctgcattagtacacgatttcaaccttagcggtatcttgggtacaagtgaataattttatcatcattttggttttaaaaaaattatttactcgtgttatattcttacattttctttctttttttctcttttaattgtgtttgaaaaaaatattacatttctcataattcaagtgtgttgcttttttctttcaattaaaatttttaagtttgattttcgttttggtaatgaatttacttcgtgtttcacatacatcagttttttttttatttcattttacgtttttatagtgttttattcaaataatctcatattatttctatttcttatatacactaaaatcacttttatttattctacaatcccacttcatttcaaaagtattaacgtcttttactcaatagggttgatagtttttgttggggaaaaaaattagataaaaaatcacatactaacaaatatttttagttacatgtatattactaatacaatattgatttatttttatttttattttctttgataaaatgtttgagacatgtgaaaaaagtatttgttttaacaatttacatatatttataactctttgtaacaacaataattatttt

SEQ ID NO: 3367 - DNA, 1000 bp, Glycine max
  Soy_ogl_2128 Gm07:2227501..2228500 Cluster 13
ttcttttaaatatattaattagggcttgattcataattatgggcatgaaaaaactttattttcactattttatgagtaaatcttttaaaatagatcaacaaaagttaggtgtagtaaaataaattaatacttcttcattaactatttttcaaatccttattagaagagacattaacatttaatgctagtgatgcctcaaataaatttgatgatatttgtgacaataaaataaaatatatttttgtatctttcaaaatatttatctaaaaagaaattttaaaaaatagtatttcaacatattgattttaacccctataaaaaaatttacattgttttaatcaattatatgttaacaaaatcatgtttgtttagtgtttgacaaaaaactaaagtcacatcacttttgttggtgaatattagaactaaacatataaaattttatcctaactaaaattaatattttgaaatttgtatgacaaatagtaaaaaaaaatcatttttatttttcataaataattttttattttcaaaattcatatacaaactttttaaaataggaaataaattaaaatataaaacggtttcttaaataaatcacgatgttcatcttattatatttcttacccttttgtcccttttcaacttcaattaagaacaataataaattagcataaacgacgagcaaatattttatttattttcataaacattataatttttttaatttaaacaacattgtccaccttttcatttttttcaaaaacatcacccttgaacagagtaaaatacatcatcttttacctttagttgtgtatatattcatatacttttgaccaaaaacaaataaaattaaaatgttatttatataaacctttatttatctttatattttataagataaaataaaataaatgtgtttcaattttcaacacagtgatacactttcaactcgaatacttattaaaaatataaaatataaaatataaaataaaaacaatat

SEQ ID NO: 3368 - DNA, 1000 bp, Glycine max
  Soy_ogl_2166 Gm07:3672501..3673500 Cluster 13
ttattttctttacaggattttaaaagccatctacatatggagaaaatattttttttttaccattattgatgaaaataaaagtatttttcaaagcaaaaaacataattaagaaacggttcttgcatatactgataaaaaaaaaaggtctttcatttaagaacatgcattaaagttggtctacctaaataataaagtttaagctagcttataattttttttatacgagatttttttttctgagatttgagtccctacattctaaaaaatctttaattttgatcaatttttcaatcttacatgtatttttttaattgaattctatatctaatatatacctttaagatatatcaataaataatttattaattaaaatataaaactaaaataaatatatatataaaatgaaaaaatttctaaaatataaaagttgaaattgtgaaagaaaaaaaattgcaaattataaaataaccgagtccaaaattacaatttaacgtaaaatttactacaaaaagttattttgggtggatggagcccatgcatcacgagtactaataatatatgtatgggataccgtataagaacttgtgtggggttaagctgatacactctaccgtataagaaatacatgcattcgttgagtgtcacgtagtttacttcatagtatcacgtgacatccaatgatatgtcggcttcttacaattgtttagatttttttttttttttacaaagataaatgaatttaagagcatatcgtatataaatattgttttagagtaaataattagtccaaagatgcaattcactctaacttttgtctttaggtttaacaaaaaatgtcttaagcaattcatttcatctaaaaataattaaatttaatcacttactatagttttaatcttttagtctttaaacatatatttatatcaatacttaatttatttttgttttagttacactttatatataacttagaacaaaaataagtaacaaatcacaaatt

SEQ ID NO: 3369 - DNA, 1000 bp, Glycine max
  Soy_ogl_2872 Gm08:43492801..43493800 Cluster 13
ttttttggaagagttaaataaagtgagatattaactctgatgtgttatataaaaacattttgagaaatttgcagtcttttttataagaatttctttaaaccgtctctttcatgaattaattttattttactaaaatattattaattattttatattttttattctcaataaacgataaatactataaattaatcagattatttttttttcttttatgaggatccaagaagatgactagaaaaaattgatatgacgagttttaataaaaaaaactaaaaaaacattaattaattaagtgaaaaagtaaattcatgaatttgaataatttttagagtaatttaaagattaacaaatttaatattattaaataaattaataatttttccaatttatgtgaatttgtgctaggggttttatataaaataatggaggtagtaataagaagacttaaataacattttagtctctataaaataatttttttctagtccactaaatatttatgttttgattttagtcctttaaataatgatgttttaattaatctaaaaataacttaatattttatttttaaaaaatatttcttaatctaggttcattaacctcgtaaacaactacaaatatagaaagaagttagtactattttgactgttttttttgtaacatactttttcgattgctgattgtagagagaaagaaaaaaaaaggataagataaattattttaaaaataattcaaactaagtattaacctaaccacctttaaactagtaagtagattttaatgagttatatttatattgggcattaaattatatcatttgaagatagtcaaagtctactaatgagtgattatgctaaatgtccatatttaattttcttttaagttaactgtcgactttaaaccttatgaagagaataaaagaactaattcccttatattatagatgttcttttgtgaaaaataactattgtgtaatacataaaaaatagtcaaaatc

SEQ ID NO: 3370 - DNA, 1091 bp, Glycine max
  Soy_ogl_2887 Gm08:44593201..44594291 Cluster 13
ttttgtactttttaaaaaatcttttattatacgatattttctaatatcatcacaaaatttttttataaaaaaatattttaaaatccttttaaaaaatatttattttctattatttcttaactgtaatttcatagaatttgaaaaaagaatgtaaatatatttcatatttaatgagacagaaatataattttaagacttcatttttaacattaataattaatattcaatgttaaatgaaagtactattatcatattaatttgaatatattttctattattaatttcttagttatactttaatagaacttccgaaaagaatgttagagtctttcatattaatgagacagaattgtaattttacgacttcaataaattttagtaattaatagggttgagaaaaatatgtttttgagaggagaagaagagaaatggaagtaaaatatacataaaatttatttgatggatattaaagccaaccgaatagaacaaaacccacctcagttggtgacggaaatgttttattttatttagtaggctactgaatagggttttgttttattcggtaggctttaatatttatctaataaattttatgtatattttattccaaaaaaaatactttctaacatatttgaattaacatttgtacaaattaaaagtataagtcaggcggtatttgaattaacatagagtacatttatttagtattaaaatttgaaaaaattatttttgcagagatggttttcgtacccattgctcttcaagtgttgcatagtgcacacttactttaggccattgcactaaggacttcaaattagaatattacgacaaatttaatattataccatatccaacatataaacatatgtatttttatatgacaatgctttaatttggaatatggaattgtttttgttttgaactttatttttttgttaaaaaaatatatttattatttgttataataattttaaatttagaagatgtattaatcaaattattgacgcacctgacacactgatcggatcgattttaacacattgtttatgtgtttgaaaataactttcttagagtataaatgttttttattt

SEQ ID NO: 3371 - DNA, 1641 bp, Glycine max
  Soy_ogl_3159 Gm09:37756401..37758041 Cluster 13
tactaaagcttataataatttttataaacatttttaacttttaatttttttttaaataatatgtgcaccgacaatgtaaaggtctttaactctacaatttcattacaaattgttatgcccggttgatttttatatataataactattgtagctattcaaggatacggtagtaattttttcttgttgtgttgagttttatccgtccttcaaacgttatccattgtgttagagggtaaagacactctaatgctcaggaggttaagcatcacaccaaatataataatgtaataaatgagaatgaataattatttaatctcgaaaatttcaccctttatatatgcatattaatggatcttgtcttattgctaatacaatgctaatcattcattatatgataatattgtcttaatctaatcaaggatatgattatgcttctaatgaaattattgtcgatttcctgagtagaggtgtcgaacaatcctcaagtgatcgagtactcttaggttatataataagtttctaggttgggttgacaactaccactctccattcttaaatataaaacacatttattaaaaaagttagtaaatctagctagtaatattaaatttgttgataatttctattatttttttaaagctacctttaaaattattgagacttatggatcatctcaccttttctctctttattactctttacttaattaatgtgcttagtttaatgttttaaaaatcagactagtggttaacttggttgaggcactaaattgatggtgattgatcgaaccattagatcattagttgaaccaaactagtttaagtaacataaaatattataagtatatgtatatgtattaattgtcataagtttaataattaatcttgatggcattgtgataagttgatcaacaattttcaggattcactacttcaatgagaagaaatactattttaataagttatcataaaattagttaaatgatatgaaatatattttattaaataagtctaatattttaaaatataagcattaaataatttctttattttgtaatataatagttttcattaaaaaaaattatagtttttcattaaccaatgtttatacacattaagaagaatttaaataaactatattactagtgccacaatttgtatattatcatttaattaaaaaatttaattaattttttaaatttttttataataagtactttgaatgttatatctaaaatataaaaaataaactttggtgtagctaccctatagtagtattaattaaactattaatgtggttggactttccgtatcaggattgcattttttcttaattgttatctaattaattattggaacattgccctgtataaagttattgatagtataataatgggtaaaaattatactttttttattgagtaaaaaagatactggtataatatgattcatttctatatttttacaggagaaatgataaaattatttcaagagtaactctaaatgaattatttttattttaattgtttattttattttaatttaattgtaaaaatgagttacccattagaaaaatttagattaaaaataaaatgtttaaatgtaatcttggttcctatattttaaaaattatgtaattttg

SEQ ID NO: 3372 - DNA, 1021 bp, Glycine max
  Soy_ogl_3185 Gm09:39075813..39076833 Cluster 13
tatatcccaaaatcaatatatatcacaattcttaattatatattagacttaactattttttccctaaaattagggtttttttagtcctttaaatgaaaatttatattttattatccatcaaatttgaaaaaaaaaattagtcccttcgattccagtagaatttgaaggactaaaaatataaatttttatttgaatagatgaactaaaaagagtattttttttaaaaaaattgaaaagtaaaaatgttttattatttgagaaactaaaaaaataccttaatttgaaaaattaaaaaataattaaacctgtatattattatcactattattgtagatttactttttcttccatttctttttttactcatttttttaatttctttcttaattgtcttgtccataacattatttatcatacctttccctttctcttttccttctattcgtatattaaaaaaatgaagtgtaagttactcatttttcatcaattttcactgtagaaaatccctctactttagagtgtatttggtttaagagaaaaagtgaaatgaaaaaaaataaaaaataaacaaaagatgagagtataaagtgaaaattaatgttaattctgtaaagatttttttttaatttttaatctttattgtcaagtaacaacgttaaataattttataacaatgcgttataaaaaaaaatgtgataaaacagtttacaaacataattacatctgattgttctattaaattctttaatgatgtatgaagttaataaattatcaacgtcataattacacgttatttgatgacgataactaaaataaaaaaacatctctttaaaaactaaaacaaaaaaagtaaaggattaaaataaaaataaattaaaaactcattacaaaatggttatttaaagcatttgaaaaacattttgagttttttctagtacaaaccatctcatatcacatatcttatataggagaagtattttttcttggatcagctgctaagattatcataaatagtaaagct

SEQ ID NO: 3373 - DNA, 1100 bp, Glycine max
  Soy_ogl_3671 Gm11:972501..973600 Cluster 13
ttgtttcacgttcaacagtgagcacaatcaaccccccactaattaaagttttttttaaaaaaaaaatctttctattgacattttttttcttttctgttggtatacaggattttttttctcttcagtttaagctgacgtgaactcggcaaagataaatttggtttgcaaaaagtttttaaaataatatttaataaacaaatgctcccaattgtatacttatatttcgtcctattctttattttctctttgtaagtatctgtttgatcgtgttttacttttattttattttaaaaattattctgtttaatgttttaaagaagtaatttttataacaaaataaaaaaaaaacgtttggtaaatattaattttaaaaaaataatttagagatgataaaaaatatacttgataaatatattttaaaattatgtttccttacttccttatctgcatgttttcttattttcgttttttaaaagcgaaagtgaaaacaaaaataatctatatagccatttctacttttcaatttttttaaaattaatatagaaatagttttttaacataattaaaagaagttattccaaaaacaaattgcattatagtttatgtaaaaatataaaaaaagtaaaaaaattaaaaacagctatcaaacagaacttaaatcgttactcttttgccactctaaaagttatgagtattgttatatcattttaaatacatttttatgtaaagcatctcaaataatttttaacattaaaaatttgcatcaaatttgattgtaccattaatgtagtataatgtgatacaaatataagcaataatttgttatatgacaaatggcttaaaaaatgttacttatttattaacaaaataaaataaattttctaattattgtaactatatttgcgaggaaaacaaaaacaatttgagtaatgaatttctaaacaagacaaaagttataaataaggagtttatttctttggatatattcaaaaactgaattcaattgtgtaattgtgaaacaaatataaaatatttaactaaaatatatcatccttttgttagggcttcttagcttcctttgtttttgtttcttttaattt

SEQ ID NO: 3374 - DNA, 1000 bp, Glycine max
  Soy_ogl_3911 Gm11:358171..35841500 Cluster 13
gttataaaaataaaatcaagtaaaatttatcataattttttacaattccctatgtttgttttcatacttaagattaatatcttaatcacatgaaaaaataataaatgtatcaattttatgtatatttatccacaggttaaataccatgtcaaatatattaattttgttttggttttatatatttcaaatatatttttagtgaatattgttcaattatttagttgcactaaacaaaaacaaatcacaattaagataattttttttatcataagttaaattttaaaaaaatcaaataatgagtgtcatattctttagtggacgtctataatcatttttcacagttaaataaaaaaaaagattcaaataaatatacacaaatcctgtttatcccatatttcacacggatcaaaacctacttttatagaaagacgaaatagaagataatcaagacaagaaagatacatggtgataagatgaggttacataaggggtttgtgagggaacatcacaaaagaaagtgcgagatgttcgaaaagacctttgaacttacaacaactccgattcgggtggtgctaacttgatacgaggtaagtgttatgcctcctacggtgataaatggtttattaattttatgacatctttcattttattttattcaaattttaaatattgttatacatcatataataataatagttattattattataattgttgtaagtcatataataaaattttaaattactaatttaatcccaatcattctttttcaaaagggtgtttacaaaattattcaattttttaaaaatttattaattaaattagtagtagtaatattaattagtttttatttaaaaatataatagtttaaaatctagttagaaattatgaaagcgtactaatgttatttgataaaataagatagagtaatgataaggtatacccaattttttgaaactacaagaaaaattaatatcagtgacgaaacaattcacatgta

SEQ ID NO: 3375 - DNA, 1000 bp, Glycine max
  Soy_ogl_4603 Gm14:1800101..1801100 Cluster 13
attttatcaattaacttcatccccttttcttttacctttttcatatttcataaattaaaatataatttttatttacatttaaaaaattacataatcttttattatcaagcaaaacatggttttacaatatatttcaaaatatttacatattcttttaccaattaaatttcaatgatattttttattagttacagtttccaaatgcaaatgattgctcttattatgacatttgttaaggaaaaaaagaaaagaaaagtacttattatatttagaacaatttttgttcaatacttaattttttatgaaaaaaaaaatattcagagctgtgggaatgataagacatttcaatttttctataatttattttgatagcttataaacttatttatccaaaattaaaacgttttgcataaaaacaacgacttgaaaaactttatgtaaagagaaagtgatcgaagatctaaatgtattaattaaaaaaataaattcaagtaaaaaaattgattgtaaaaaaattacatattagttataataaagaaataaaatgctgttaagcaaaaaaaatgaggtcatactaaaaataacaatcctctttaaatttcaatgtaaacgtgaattgtgcaatgtttatttgttttttaaaattttgaagtgaccaatattccaacctttagcgtttggccttcgagccttgtttaattatattagaaaagctacttacacaagcaattagtaaatttggataaacaatttaatttattaattgcttattattttttattatgtaagagattttgtctaaattttatcataaaagttattttcattaacttcgtcaagaaagttttttttataaaaaactagttaaaaatatttcttttctttactatcccaaattcattttttctagcatccaattgaattgaaatatggaatatcataataatagaaatatgatttgttttttttttttatatttcttaaaatgaaaaaaaaatct

SEQ ID NO: 3376 - DNA, 1462 bp, Glycine max
  Soy_ogl_4891 Gm15:3559807..3561268 Cluster 13
cacatgacgtaattgttatattttaaatttttatgccttcaagtattaaattaaaatttttattgtttcaaaagactaaataatcacgattaataaattcttagtgaccccaatattaaaaataaaaaattcttactaaatttggtcactttgattttttttttatagggaatattaatctatcatttatttgataaaagaaaacaagggaaaaatataacgagtgaatgttgcaattgagtcccacaacaatttgatgttctttccaacattggacagaaaagggaagggaatgagttatttcctactaaaaagataaaaataaaatactatcatttatatcattttatttaatgtatttatgtcattttatagattttttcaccttatatgcataaccaagatagtgaaaaagattttttttctttctcttacccaagcaacctaaaaataaatcttgctttctattcctttttttttttttacctttcactttcttaactaaattattgatacccttaagtgttatagttgcagtgaaagcggacaagaacttcaaagaaatttcgtttggaatgcttcttttcactagaacctactaaataaggaaacattcacattattcaatacaataaatagttgtataatcatattcttatagacattgactattttagtgtaatatcgacctatactccagaacagcaagaagttaattggtaggttttactgcatcttatttaattcacattattgcattcaataatggtatttttttttaaatgtttcattatttctataaaaaaaaaactacctttatgcaaatgaagttttaatttgggtttttcactctttctttatatggtgtaagtggaatataaatggagtgttttctttggttttgtgacatacctcaaaaggctgtaaaaattagtcaagactagaatatagtttgtgttagtactagatattcaagaaaaataataatttatcatttaaattttcaagtagaatttaaatattcgtaatgtatataaagttggaggttactcatttttttttctatttgtatgatatcaaaaattaaaaacatgcaaatgccaccatcatatattcatgccttcatacaaatattgattatttctctcacaaatttcattttcatgcatatgaccagatcagacctaacatacatatgtaaatgacctaattattctttataagtaataaggacaaaagtgttacataaaattaaaactaaaaattaactaaagcagcttgaaattatttaaaaaaatacaaattcacagatctctcaattatgtaataagtattaaatatctttatatttccaacttttttttaatactctcaagtttcaacacattaaatatatttatatttttattcactattttttataaaatgttaaggaaatttgtagaaaagaattataggagga

SEQ ID NO: 3377 - DNA, 1036 bp, Glycine max
  Soy_ogl_5327 Gm16:5719465..5720500 Cluster 13
aacattcaaacttacaacttataattaaattaaaataatttatcgttagttaattcacacattcagttatatctcatttaataaattgttttttgtacagaatagtttgattttatataaatgaattaaacttttatttgcgagtatgggtgcatatttatttattataatattgaaattagtttatagtcaccgtacaataattaaattaatgacgaatatcacatttaaaaatatcatacttttattcttgcatgtaatattaactttcattatgaataagaaattattttttatttgtttttattcttcaataatttatgattttaaaaaatactgctactataacatatcaacggtgaaagttaagttgaaaataatatagaagtatggcaattaaatggaaaataaatatcatgtatataataaagaaatatggtagccataattttaacacttttaaacaaatttaataatttttattattcataaacattaaatatttttgctaataatgtaaaatatttttaattttttcagccaatatatttaaatttttattcagttatttcattaaatagtaaaaaatatacatcattattggtcgatttatgaatgcatgaattatgattaccattttgaagtgacaaggatagtcggcatgcaaatcagccactacttttttagttactttgcgataaaacacgtcttcaatcaatccattcattcgatttctctttaaaaatatctgagcgtgccacctaaatcctatgatacaaatacatgattattttaaaaaaaacaaataacagttcttaaataattttagaaagttaacaaaaaaatatcatttatttaaaataaattaaaacaaatacacaattagtgacaattggtccagtggtgaaaggttggaataattggtaaatacttaaagacttactttagatttttcattaccaccattgtaaaaaaaaaaaatagtgaatgaaaaaatcttttatgaaattaataaaaaatatttagcaacaataag

SEQ ID NO: 3378 - DNA, 1203 bp, Glycine max
  Soy_ogl_5395 Gm16:31434398..31435600 Cluster 13
ggtgattaacaagatttatttttctctttaaacaaattcttgaatttaaatttcatgaataaaaaataataatccagaaaaaatattttctaaacaatattaatgattaatcattaacaaagtcattaatacttcatataaataagaaaaatgctaaaaacataatttctaaaacattcttttaaacacactcttgcaggatttaaattcattagaaaatacaaattttgatatttgataagtctctattttatttgataaatctcttctaattttataatttaaaataaattttaaccaataaaaatatttaaaagaatgtgttaaaatatgtgcggataacattccttggtaatgacattgaaattttctctcaaaagtaaaagcataaccattttttttattcataaaagcataacaatttatgtctggataatttgtacgttttcttatttaatacgctagagtaatactactaataaagttttttttttttcattttaaaggtatttctactttgggcactccaaacataagtgtttctatattctggccaaaattatgtttcaacttttaattggataaaaaattgttatttttcaaaagaatactttctgtctttgctgaaagcattttagagcaacacgattgatttgcttgtacattcggaatacgttattgataaggatctttgttgatgcatcaatctttcaattatccataataaggcttcagtgtccaagaagtgaagaatcattgttttttttaggatgtgaagaatatcgtttgttgtttgttatttacaataatgttacggaaaattacaattctttttttaactcaatcataagaatattaagaaatagcaagtgaattattataaatttttttatattatctttgattcctataaataaaaaaatattatgaaaaattacaattcttttttttagctcaatcacaagaattttgacaaagacatatactttatcgatcaacataaactgtcaattttaaaatagttgaacaattttaaacttcataatataaaagagcttgtatgctattacattatttaatattcaaatatttttcttcaaatataattttatttgagacacaatcatatgttaaatataaataactctaccaataaattttgaaacttaattcattacattacgagattaacatattgtacta

SEQ ID NO: 3379 - DNA, 1012 bp, Glycine max
  Soy_ogl_5937 Gm18:5701..5167212 Cluster 13
ctgtgattgagaatgtgatttaaaaagataaaatttaagtttaagaagagaattaatgacaatttttttaatatatattttttaacaccctctcattattgacaaaattttgtgtttttcattttttatttaatgaatttgtaatttttgtaacttcacttatgattttgtaagctttactgattttgtattttttaataaatcaaattaataaaaaagtatatttcaaaaagaatatgttgctgacagttcctcttccatatattaattaatggcaaaatgtaaattaaacacttaaatttttagaaagtaaatcaactattgatagttggctcagttggttttctttaatctttacattaaattttcattcacatctcatatatttctttcgatacatatctttctctcttttttttgtccatacactaatggtttgaaacattttttcttcttctttggatctaatcctattaagatactattagacattaattaaatataaatatttctttttaacaaagatttgaatcttgatttatgatattataggaggatattagtctcttcgacaaacctaacccttcttgattgtttgtatgggtatagatatgtgtatttttcttaatccaatcatcctcattttcaaacttgctaaaattaaaatataaaaaaattatgtgtgataatctttttgttataaaactttattacacacgcataaaaaactttatcttagtttcgtacgctgtaaaatcagattatctaaatcagagcttgttacttcttcttttttgagggaattattacttaacttctatttaattaggcgttcaacgattccttggagatatgtttctgtggtttattagataacatcctaaatctgtactaaaaaaacatatcatattttatagctttaatggtaaaattcgtctttttattttatctgattcactaaataaattttcttatttttttaattcactgttgaatctcttaaaatgaatgt

SEQ ID NO: 3380 - DNA, 1030 bp, Glycine max
  Soy_ogl_6535 Gm19:43544201..43545230 Cluster 13
gtgttcggaaatgctgagacttacccaggacttaccgttaaccctactttcttcttaccaaactattatataagattttccaataacttagtactttagaataacttttacatttttatgtaatttatatgagaaaaagactaatatacttctaataaaaaaatttataagatgattcaatcacaatttattatatataataatttattaaattattataataattattttaaaaatcatattaaaaataaattataattagaggacataatacgtaactattaaactcaatttatatatataacaacaaaatttgttaatatgtaaacaataatttatgtttttacagtacttttgaaaaaatatgtctttaaatttaaatataattctttaataattatctaaaactattttcataaaatttcttgaacaaatttgtacaaaatttcccttttaatatacacgtatctatctatttatgattttttttttactatctatgattactttggtgtataatgcactttaatatattttttttattgttagagcaaatccaacggaagttgctacttttgacgcccacattagtaaaaaaaatcggtgtagtttctctttctattggagagcaacttgataggtcccatttaaaaaattactttggtgtataatttccctttaatttgcattatattttattaaatacatgaagagatcgatgtgactttaaaaatatattgtggggttattttaagaaattttagtaagtttttttggttggatttttaaagtaaaagaaatatgatgtgtcattttaggaaaatgtggaatattattaaaaaaaatagaagagaaattttaatggatttgttagtaaaaaatactcttaattttgttaggggaatgattgaatacttgatattttattttttcctcctccgatccaactcatcttatatttctacaatccactttgatgtgattacatgccataaataaaaaaaatgactaccataaaaatacttaaata

SEQ ID NO: 3381 - DNA, 1157 bp, Glycine max
  Soy_ogl_6593 Gm19:45344044..45345200 Cluster 13
tcttttaaaaaatcaacaggtaaaaattcttaaacgttttttaaaattagaattttaatttctgaataaaaatttgaattttattatttaaattatttaatgaatttttaggaactaaaaattgaaattttaaaaaatttaacaattttaactagttaaaattttgtttatagattataaaacttaacagaaaaaagtcaaaaaatatttacccataaattttttattcatggattaaaaattaaattttaaaaaaattaagaactaaaaacttaattaaccctttaatatattattagctttaaaatattcacattatcaattaataataatcatcttccatataacttttgaaataactattacaaaagttaacaacttttaattatataattgttcatgattgaataacaaaataatttttttaacattgtctctttatttcaattatattctgaaaataaattaattactacatttatgttgttattggtcactagtttaataggcatagtaatatacattcgtaaacgtttttatattttcaattaatcacaaatcttatttttggaataatttttaacataattattataaaaattaaaaaatctactatatatataatgatttataattatctgactgtatatttttttacattattatttattatatatttgtatttctcttatttattactataatatgttatcttattattatttttctctttcttgatatggataaggacaatgatataattgagataataataattaatgttttttaaaattttaaaacaacaaataagtagaaatgtacattttttataacataaatatcgtataagtattttaaaatattgaaactaaattcttaaattttagaatatcaaataagtgtttttttttaaatatcttatctctcttctttaattaatactttatgtatgtgttagtaaatttctttacataataggaattatttatttatctatactaatattagttgtaaatgtctatttgttagggtcgagtatcggtcagatttgggtgtatatatatatatatttcattcgacttaaaccgagccctgttatttctgaattgattccgatcgtgtgacatggcgggttaatcgggtttaatgtgagtgtg

SEQ ID NO: 3382 - DNA, 1156 bp, Glycine max
  Soy_ogl_6612 Gm19:47366245..47367400 Cluster 13
catatttttttttattttttaattaaatataaagttgagaaaattggtttattattttttttttctgtttttaatagttatccatttaattttttcttctatggttgtatgtaattttcattttcctttttccattgactaatttcaaatgtctattttgagaattgttaatatgtaaaaaaaatgaagcataaagaagttaagaaatattacattatatttaaaatattatacatttgcaatattacataatacattaaaataatatatttcaaatataagtatgaatatttttattagtattataatattttaaatataacaacaatcaaggtcacgcaattttttattcactttatataaatttcaaagtccacaaaataattttatgttcaacattaaattaatggttttctatcattgaaaagtctacaaacatttgaaattcattagtgttaaataatttaatattgaatataaaatatattaattaatacaataacgaagacttttcaatgaatcactaataataaattgtaggttgtgaaaaagtatcccatttgccaaacacattaaataattatctaaaatgaatacattaattacaataacgatttttttaatgatttattaaacagtaaaattgagaaagtgaaaagggcttcaaagcatttttattttattttaaataaacatataataaatgtttttttaatttattttatttttaacaatttttatattaaacaaagttatgatttttattttatttcaaaccgtgattgttttattttttgtttttaacaatacctttcaacaatatttattttatcttattttaaacaataacaaatatttttattttatttttttcttctaatattatttttaaaaaaatttaataaatataataaatgaattcacatattcaaacatttttaattatagcaaatttattttaatttgatatattatttaaagttttaaatattttaagaataactagggttggctgtaaagtttaaatagtttatacaaaatcttaaattctatacttgcggtcactattatacataaataaaagttttaagcatgtaatatttactgattatccacgtttaataattaacgaagtgtataactcgtaactacaaaa

SEQ ID NO: 3383 - DNA, 1235 bp, Glycine max
  Soy_ogl_6741 Gm20:34324001..34325235 Cluster 13
tttattgggaattatcttaattgctttccttttaacttcaggtaataaacttaggatgtgtttaatttttattttgtttaaaagttaatttacaaatgagaacttttatttttcattaacttacataaatgattgagagaaaatataaaggaaaagtgtgggtgcaaagagataaatgaaagggcgagagtgggaacttatccagaaggagatgaaagtgaaaagaggaagataaacaaaattgatatttttctaaaagttcattcacttaatttttttaaaaaatatttagaaagtatccctttaattttatcctaacacgttctctattaaataaaatgatatacaatatcaacaaagggtccgtttgatgcaaatttttttaagaatcacttcttttgaaaaaaaaaaaagaaagttattcaaacgttttcttttcagctattcaaaattttcagaaatagaaaaaatctaaaatcttattaaaatcagaatttttttctttaaatattttctcataaaattatatacttttttatataaaaaacgtatgattgtaaacaaaataaactagcttctgctttttttagaatctctgaaaaataattattagattattttacatttgaatcactttttttttttttacaacatttaatattttaaattttgtgaaagaatgattttttataagtgagaggataaaataatcctatttaataaaattattaatccatgcatttatttacattaaacaaataatatagttgttctaaattaactgcataatcgatggtactcaataaatgatactacgattttatttattaaatacaagacattgtagtattaaattctcacatatgagttcattaaaaataaaactttgatgcgcatacaatttctaattacaattttcattaatttcaggaccaacgactgcttcaatggtttgctaggaaggaggatactgtccaaatcaaagagcttgcaagagcaactgcgtatatttcggctttaaaaagggtggtctttgcgttcctcctaaaaatcaatgctgctggaaaaaaaaaatggccctagttagatacttttaaaactagtgttttctcacggtatttgtaacataagtttccatacaaaattagtggaaatacaaataaagtatttcaatttaaactaatgtcatttatataattttcatgattaagagaagtgatacagtactttgtaca

SEQ ID NO: 3384 - DNA, 1000 bp, Glycine max
  Soy_ogl_6860 Gm20:39168901..39169900 Cluster 13
tcgatcatctgttttcatcccgattatctaattagaaaaaaagcatattttacatttaatttctataaatacaacagtttttgtatgtattatttttaggccatacaaatatagtggtttcaacttgccgtcatgttagagattaaaataaacatattgtaaggatgaaaaattcaaaaaattataggaattcaaaaacaaaagttgctagtattttataagggtgtaaatcatacttaacctttaatttaatttccacaaaactgttaaagagatcttccatttatcatcttttttagttttaaaactaaatttatccttatatgtgactataatattcaaaccggtgttagtaattgcttctgtgtcatcatcaggttccaaacttgcattttttacctagaacctacacaaaattagcttttgcatagacgtggaaattggacacacctatgacttgaattgatgagtaaccaaacaagctatacataagcctataagtcaaaaataaacatagcgcactcaaaactaattgtcttaaaatacggtgctaattgtatagtctgttaatacattcatattaaaaaaagtatgtatacattgacaaacacatacatatatatatgagtgaatttaagacttttaccaaaagagaaatgatcacaaaattgattgaatatcataaaattcaataaatcttatattttatttaatgattttttttctcttaattttataattttcaatatatttcaatcaataacaaaaaatatatatagatgagcgtgttaaaaagtatattattagccgttattcataccaaaaatataacctacttcgcatgaatcaaccaattatgcatttcttattatatttttatagtaagcagtgttatgaattttttccttgtattttagttttatggattataaaatggaaatatttctttattttaaatatttttccataaaattcccatcatattatcttaaaaaaatta

SEQ ID NO: 3385 - DNA, 1039 bp, Glycine max
  Soy_ogl_2996 Gm09:4605201..4606239 Cluster 13
tgctttaatttattcaacagaaaccttttctaatatatattttccttgtaaagagaaataattttacttttgaggtctttgctttataaaagttatattggacttggattaatttctgttgagtaggatggtagtcattaatttaatgacaaaacgctttcttaggtttaactatattcatttggtcagaataattgcaacaacatttgtttttaggttttattatttaaataattttattttgatccttataatagttacaattttttttaactattttagttcttgttctttaaagttgtttagcgttatttgagatgaacacgaattaaataagtcatgttacaacgaggactaaaagaataaaagattataattatacaaaccaaaaggagatattttaaattatagtgactaaaaagaaaagttgttgcaatcatagggttaagctaaaagaaaaaaataaataatttatccttttgatttgtaacaagggaaggctcgaacatgagtatttgttttcttgattactcctctagatatttgtctctccatgagtagaatgcgattttggtaactacgcatataacttactgatcatgaatctagattttttttttaaaaaaatgaatctaaaaaattatatactagtacaaattgcattaacaatcatgagtctattgcatttttctatatttttttgaggcaaaagagggggcaagcaaagtagaagattggctaaggccatcctacaactataggtcgacaccacccaacctaaagtcacaaaccgttcacccataaatatattgaaaatgttataggtttgtgacttacaacattaaatctactttgatagaatactatgattataattaatggataaaatcatatgtttgaaccttagtataactattgtaaaaaaatgtaatagatatgaattgtgaaaatttataaattttaaaaatatttgactaaaattattctatttataataaaatactataaattaaaatacaaaagtacttgcattcctctg

SEQ ID NO: 3386 - DNA, 1400 bp, Glycine max
  Soy_ogl_3654 Gm10:49633301..49634700 Cluster 13
gttcagttttttttttctttcaccacgttcctattaaaacaatcaaaggcttaagatagtgtttgtgacggataaaattgttgctaaagtgacacgagaataaaagagaatacaaagttttttatgtttgataaatacaataaaaatgttataagatctaattgttgaacatatgttaagaaaatagtgtttcatctttaaagatgagaataattttttagcaagaataaattataaagttttttttcttctaaaaataagatatttatatcgtccaaagtcataaaattaattctcaaaaattagaaatcatcaaaagtgaattttatttttttcaacaaaatcttttctatatgtattattagactcaaatcccttaaatatgtttcaaaagttcaatcacctatttattataatagactttcttgatgttaaattgtaaagttagcattgcattcatttttttaagttacttaatttttatttttaaatttaaattatcctaacgctcattaattcaaggctcatttgttttcttaatttcacaccattgtaacttttactttttttttttttgcacagccttttacttccattattgttatcattaatttagttatgattattgtagccacatgattatgaatagtaaattttgttcaagtatttaagaatctatgttagacaatgttaaaagatgaagtccaatattaagttatatttatttagataagatgttatgctgcgaaataactaagacaaatatcaattactcacgtttctaacctttacaccaaaattaatttttataaaatgtttagttgaaaggaaaaaaagtgaaatataaatatgagagtttcacgtcttttatattatattttaatttaaatatttcttttatatttttatctttgaagtttcaaccaaacacaacatttatattgataaaaaaacaacctaacagcaaattatctaatattggtagaagtcttctcttaacctcatttaagaagtttcattctgaacaaaccattcttttacactcttttcttcacttgggggatgattattttgcttgtaaagtttcgatactactggtaccaacatgaatatataattatctttgcttattaagttcacctatataaataaagagcacactaccttatatgaccagcatacaaaaattggattattggtttaatttaaataaatggtttaattcaagaaaacggtttaaatggactcacataagtctttcgttttagcgttttcttacgtttaattttcatcgtcttttttttttgggatttgagtcccttataatttttagtttatataactagatcctaattccccctaaattttagcaccttcttattttagtctttgtcaacttt

SEQ ID NO: 3387 - DNA, 1400 bp, Glycine max
  Soy_ogl_4304 Gm13:27368401..27369800 Cluster 13
ggataatatttttcatcatatatgtgttataaaaatcaaggatagaatgttattttctatttttaataatttgcttttcgatcaaaacaactgtggagatttttgagagctacgtggcgaaaccgaagagtcttaagtgaaacaatattataatattaagtgacatatacagaggaaggaagtgagtgaatgattttttcattaatgtgtttgtatctatcactactatgtcctcttaaaaaacatctatcactacgatataagcagtcaaacaaaatctatcattaatataaaacttttatttgtgtgtacgaaacatatatatcatgtgaattttgtcaaataattgtatatcagctttagaagttttgtatatatataatttatatgaaaataatttttaatctagattttgattcaattaaaaattattaaatagtgtaatcattaatgtaagttataatctgatcatttcatatatgaaatccttattttaccctaaccctgaaaaataaattgcttttatacattataacaaaccttgtatagtgatattaaaaattatgtcgtctttggttttgtttttataaaacaacagcgctttgagactatcgtctagtgacggtctactctttctttttaagtttctctttaaaatagcttgacagacgatatataagatgtgattgtgaaaaagatttgcaaaaaaattataaatcacaattcaatctctttatagtgatttttgcctttacagattgttaagggacgtttctgctatgagaatttactttttttaaaaaaaaaaattgacgccatgaataattatttgcattggcaaagcaaattcttccatttgtaatggaaaagaatttcaaacaaacaaataatttatcactcaaaaaattaaattttctagcttataaaaagagaaattaatttttctaaactcacttttaaaataagattttcaaactcaattcttttaaaattaattatactaagtttgaaacaaagggacataaacattttggtaaacaggtgcagatatgatccaacataaaatgataaaggttaattgctatgaagcagagaaattataagattgaaagattccttagtgacgaagaaaaaagaaaaatgagaaagatcatgcatttgaattttctactaacaattaaaaactaatatttgtcaataaaaaaatttgcaatggagtagtgtcttggtggagttattatcaggcagttgatacatggatgtgttcataaaaatatatcacggaaactaatttttgtatgattttgtaataaatttttaaataaaaaatatgaaaaaaaattctaaacagtgcaaagaacaaaaagaatgtacgaatagtaaccccatggaagaactga

SEQ ID NO: 3388 - DNA, 1300 bp, Glycine max
  Soy_ogl_4358 Gm13:30048701..30050000 Cluster 13
aagatcttgagttgaagttttataaatataaaaatatgattgaaaaggaaaaatttattaaagataataaatcaattattcaataaatatatatattattttttgcacgataaatgtgcagtggtgcacttgatgagatttacaacttcttttgttattttattgagcaaaatatttttactacttcaaaatttgtcaaatttacactaaactttaaattcatcatacattagacttggaccagtctaagcttattacagatggctcacgttgtcttgatcaaagctttatggtagtgtgttcggaaatatttttcacacactgaatcacttctaaaatgcaaaagctaccgcaggtaacttcaatttagacgaagaaaattatattttaacgtgtaattaactaaataattcaaaagcttaagatttttttttatctacaatggcgatgataaaaattgaatctaagtttttactcacatgctccaatctcatcactaggttgatcccggtgaatttatttcaacgcttaagttagcaaatgttatagtagaatgataataattttcgtaaatgagcatagtagtgtgtgtttgcatttcgtgtataactatactttttatattattttggttaaaatatatttttagttgtttatatgtttttatatttagtttgttttcttatcttttaaaaaaattaatttaatcctttatattttttaagtgagacaaagtagttatttcgaaatcatgttatttttttattttggaacatgatttgaactcttttattaattcaatatataaaatttgtctcattaaattcacataatcacaattacataattcagctgatattaaacttaaaaagttcataaacatgatgaaaattctgtgaaaaataaatccaattagaaataaaaaatgaatccaatgaaaaattagaaaattaaaaaatctaatattaaattcttttctaattatttttgaaactcgttattcacatgattttcatcatatttatgattcttttttgtttgaatattagttatgtttcaaagtattcatttaaataaatataatggacaaatttcacgtgttagattagtaaaaaaagttagaagaatcatgccccaaaaaaaaaaaatcatttgaactcagtttaaaaatacactacattaaactttacaaattataaaagagtataattgaaatataaaagattaaaagtgtgctttatcttattattttcgtgaaacattttaaaatatatttaagtttttaaatatattttaaaat

SEQ ID NO: 3389 - DNA, 1300 bp, Glycine max
  Soy_ogl_6143 Gm18:52645301..52646600 Cluster 13
cattaataaaattgattatttatcctaaatttttttagtacgtgtcatatataaattaattagaacaatagataaatgatgattctaacttctaaaccactcaataatttctctcctgtataacttctcaaaactgacttgagagatatcgtgttatatataactagctagttggaaagttttataattattcaagtttatcactttaatttaattaaaggggttacgaacatcaaaccgattaataagtatactaaatctatgctattaagggtagataggtagtaattttttttttcatcatatgggtacataaggatacatgctttatgtttacttaaactgtttatactcataaatgatacagttttttaaaactaaagtgttttaatcgagaattaaagatttttttttaaaaaaaaagtttaaatgtgttttttcctcaaatttaggtcacggttgtttttgtcctcctaaattaaattttttatacttcaattttgatttttttttctttttagtccctctggactgattttaaacaatttgaatatacaacttattgttttgagggattaaaattgtgtatccagattgcaaaacatcatcaaactcaacagggactaaagtagtatttttaaaaaaaaattgggagactaaaaaaaaattaaggagataaaaaataatagtgacttgggaccaaaattatgtttaactcttttcaaaatatgaaaatccacttaaaggattaacaacttttaacaaatattttttatccgcacatacctagagatcaactcttgaccaagagataaatttcaggtgatttaaagtggtttttcttaataatagatagtttttaattaattatttattaaattaaaagctccattaattaaattaataattaaaaacccaatattatagtgacacgatttagaaatcaatatttttttattaagtaaaatgatggttaaaagtacaatccttgatttgaaaaaaataataaaggaatgaaatatttttattttaattggagatcgaaattgaaaattaattaaaatagagactgatttcttaaatgtatcacaatatttttaccacaacgaattaaaaaaaaacagtatttttgttcacatgcacatgcaaaagatataaattcctctcactcgaattgacgccttttgataaacataatataattttatttttgtaaataatatttgttagtttttttattcagaattccctacagtcaccgcatgatcttgtatttaacatccagtgttttaattatttt

SEQ ID NO: 3390 - DNA, 1200 bp, Glycine max
  Soy_ogl_2858 Gm08:41860901..41862100 Cluster 13
tttagactaacatcatatgtcaaaaataaaatatcagataataaaatattttgagtaatcaactgaaaaaagcatatatgaaaaataaagaagtcttaataatattattaaggtcactcgggttaggacacccttcagggtgatgggctaggccctaaaattttcccagtccagtatccagtaaatgctgcaatattctattctttatgtctaaatatcatcaggtggttacttcctgcacctccaagttgttttctgtatcctttttttaacgttttggattgatagttgtgataaaagaaagaatgcattctaaatgtaaaattacattttggattaatcattttaaaagccataaaggaattgcagcaagcatcttggaggtgcaggcaataacctaaaatcgaatgacattattttgtaacaaaaaagtgacaacattctatattatcaatgactcaatgctcctgagcattaaaataatatattttaaaaaaactagctacatagctatactaaaaattattaaactaatttattaaattatataatattccataaagttacattttaaattttattttatggataaaaatatattttgaagtgatgcaattttagtttttcaattaatcttaactcttgtaattttttatatatagataaattgcttttattacatttttagttttaattattacattcttttcatatttagtattctacatactattaatcttatagtatatcttaaaatatttttaattaaggttaaaataaagaaaaaatataaacaatatacctttgttatattaatagcataatagttaaaataaatgtctaatgtaaaattattttaaaaaataataaaaatataataaatttaacatttatcatcgtgaacttcataaattataatgttgaaataataaattaaatattataaatagtataatagttaaaaaagatagtgtaacataaaaaaatatttaccaaacaattaaacaatttttttatctaatgaaaaaactaaaaaaccaactaaaataatttatcaaacataatttatagcacataaaaagttgtaatgagaacaatttatgtataacctgtttgttttagcgttctgggctctccaaacccacattcaaccaaaagtaagaaatccttgcttctcataaaatgacgtttaggagcccc

SEQ ID NO: 3391 - DNA, 1400 bp, Glycine max
  Soy_ogl_4780 Gm14:45620701..45622100 Cluster 13
tagaaaaaattggtaggagtaaaaaatttcatcacgtgactaatataaaatcatttcaacctctcatattcgaatcttgaatatacagattttaaatacttagagaaaaatttttacagtacacgttaatcctattcatattaaacataatcgtctctaataaaaagaatactaatggtctaaatcaaaaaattatttaaaattatgtctaataaaaaataaaatatcatatactctacaaaagtaaatatagttacttttgatacaaagtaagtatttaaaacttattaataggtttaataatttatttggtctatgtagttataaaagattttctttttagtcttgatctatacttaaaaatatttttttaatctctacgtatactctttttaatcgtctttaatccctcacatagaatcaatttaatccattttagtctctatcatgactattaaaatgaattaaaaaaatatatgtaaggattaaaagagaatgattttatgtatagaaatttttttaaaaattaagcaactataaaaaggacaaaatgaataattaaagctaattaatattttgttgactgaaaaataaatagaaatagtttcaatgattttattcaccacttatttcaattatatatatcaaccacaaatataaaaacgataaaaagtaatatccattcataaagattttctactatttatctgatgccaagaataactaatctcataaatattcttcatgcttagggggtgggggccaatttctttttttaaaaaaaaaaaattgatgtcataggctaataggaagttttcattttctaggggggcggttgcccctgggtttaataattaatagtataacttttattagaattttcctaagaacattttttttaattcagaataaaaaactaaaaaatactttttaaaatattttatgtttccaaagaagaatacaattaatatatttacttgaaactatttgagtatttctaactaaaaaagttgttttcttaaaaagttacaaacaaacacattactacactctttatcatatttttccaaacacactttttccgattggttaaagctattaaaaatcatgaaactttatgggtcacgcttctgatgatctatcgttcttgtcttcttgatcattttcagaataatattaaagagtattttaaaaagtatattaaaaagtgggttataacactctcaaaagaaaaaaatgttaataaaatgttcttttgaatatattctatacagtttataaaagaatacactttttttagtacacactctgttattaactaaaatctattaaaaattataattttggatgagtcttatttcatatttaataagtttctaccttgattttatattttatat

SEQ ID NO: 3392 - DNA, 1102 bp, Glycine max
  Soy_ogl_664 Gm02:45007501..45008602 Cluster 13
acaagtgataatcatatttggataaaatcaaaatcactataagtgataaaattctctccaaatacttcaagacttaaacttgagatccatcatcattaattcaactttacatcaatttaatccacatacgtgatagtatatattcaccattaatatatatgaattgaattacttgataaatttttaacttattttcaattaacagcaaatatgtgtataggttcttactttaaaaggtcaaatccacattttaatatgataaatttagtgatcacatgtcaaggcatatatttctcttcattccttataaaaaaaaaaagcatgtatttctcttaaaaataagcacaagacatatatatttaaatatatgtaactcacgataaatatagctcaccatatttttcaggttgattgagaaggttgaatgccgagtaatatatgtcagcataaacaattgtgcttcctggaagcatagcttgaatttgaggtaggcgctgaataaaaattctcagactctgcatgtttctgacgcattctaaactttaatttattgtcatctgataaggtatgcagctagccaatggaagcaagcccaccaacaccaaattttcgacatccaaggtcatataaatccaacaattttacgcatagaatgtgttcaattaactgtaaatatgtttgaattaatttatttttgtgaatatttatttttattaatttcttaagaaaaaacattaaaagtaatttttaaattaatatttaccaaacaatcaataatattagtcgttgcatgtgtataggtgcatactatgaaaaatggagactaagacaatgaatcaacaaaaaatacaaaatgatgagacctcgataaaattacgagttgctttttttttgacaaaattggattaaatttccttcactatcttaatttttttcatccttatattctattcatcgttaaaaatttctccctctttgaaatagtaacatccttttctttaattaatagttgagattttttgttattaagtattgttttgtagtaattaaaatgaagatacacagaaggagatcatctacaaaaggaacatgtcatttgatt

SEQ ID NO: 3393 - DNA, 1000 bp, Glycine max
  Soy_ogl_780 Gm03:851901..852900 Cluster 13
atttaaaggtctttttgttgttttcgctaaaaacatcgaagttctgaactcgtcacacactcatgtcttggcatttgccctactacagtacaactggttctgattgatttagatcgaaatcaaacttaactttcagaagtagctgtcaaaactgtaactcagaaagatttttcttatttttcattcaacgtaggaagagatattgttgcatggcgcacttcttgccgtacaaaaagagatattaatgccaaaaaataaatatggaaaatttgtcttattatactgcactagataaaaagagacattttgtgactctatatttcttaaataataaaaataaatgataatggagattaaataaaaatgagaatgtgtataattatatattttcaaattaaattttatatgcaatgatttttatatgtagttaagacataataattcctctaaaaaaagacaaaataatagtgtagtttataatgttagttaaaaaaataaatcagtcaaaaaaatagagatatataaaaattaggccattatattattataataactaggggaagatagatacactccgtccgtgcctctaatttttttaaaataataagtaaaaaaaattaaaaatcataagttaaatacagttaataaaaaaagtgatagaataaaaaaaacttacaaaagtagtggaaagttactataggttagaaaaaaattaaaattttaagaagtaatttaaatatcaataaaaatataaaactgtccaatgaaatatcaacatcaaataagagatatttcctttattaatagtacctaagggtacttatagaataaaaattttgagaaataaaaaaattattgagtaatttttgagatgtgagtgaaatgtggactacttgaaaagagtacttatagaataaaaaagaaatttgaaaagatgatttaaggatgaaataagaaaataaatatgtacaccaaaataccatatttttttattaacagt

SEQ ID NO: 3394 - DNA, 1200 bp, Glycine max
  Soy_ogl_833 Gm03:3663901..3665100 Cluster 13
atttgtaaatcatatagaaggccatgtttcatctgtctttctcaaaattaaaaatactagctatttcaataactttcaaatattggattgtatgtaacaaccatagtagaagcattactaatttattattggattatacattctcattactatttgttattagatttcagaacttaaaactaaaagttgtttaataaatatataaattacattctaaaaattgagatgtgagattttttaacatttattaccttgcacacatttccaactctgacaaatctttaaaagttggatttaattaaataccttgactgtgcaatctagacctatatatcaagataaatgatacctaaatgtgtaatctagacctaaatgtgtaaatgatacctaaaaatgctcacgtaagaacactttttatttttattcttgataacccgcgtaagaacgcttttgtagaacaaaaagttttggaaagtaagtagaaagtgtcctatttcaagatcaatgaggtatgccataagtattaataaataaaaagtgataacgtcgtccgtgaatgtgtttttccagatcagtggatgtttttttttgaatatttattaaaaataaaaaataataataacattcatataaaaataatttttaagttattaatttcttagtaattaaatattttttttagcttttaaaaacaggtacttacggaaccgaacaagcagaagtgctaataacaaatttcttctaacacttctttatgacacattccttgtttattatttttaattattcagttaacaataaaaagtatgcgtaatacatatgtatcaaagagtaaaaaaaacttccataaaaattctataggtgttgtacttgtatgtgttattctctaattaaaattaaattttcatattggtagtacacaaaaaactatttgcattaaagaattatgtatactattgatgtgaaacactaattctaattgaacaatagctcataaaacacctatatgtgtaagacaaaaattttatgtaaccaattaaacttttatatggagacaactaaaatcaattaaatattcattaatattaagaagattaattaatagatatatatgtgagttattgtaaattttttggatttttatctttataaataaaaaatattcattaataacatggatgacaaatatccttaaaaaaa

SEQ ID NO: 3395 - DNA, 1050 bp, Glycine max
  Soy_ogl_957 Gm03:39003751..39004800 Cluster 13
aaagaagatattagttattctaagactaactcttttagtagttaatcttcatctttattatttattttcttaaaatataataattataataagtaattaatcttaatcattaaatatcaagaaaatgaataataagatgagaagtaatggtaaaaaagagttattcttgaagtatttgagtttattttctctttgtataactcatttgtttcttaaatatacctatatttatttattataaattttaattataataaaactttatacacttttagtctatcacatgtaatatttatagacaagtttttatcatgttttctgacataaaattgtcttattatttttaatgattttttttaccttattaaagaaaagaaagaataaatatgaatggagcacatctaattttgagcaacatgtaaatctttatttcatactctaatattttaatgcatattttttacaattttaatttaaaataaactaacatgtaaaatcaaacttgtatataaatgttaactttaaacctaaaaaaataagttcatgacagacaatatgacccaaaacttgtcaactaagtcagaccaaagtaagtttggccttgtacatcctatttctactcctaattcaattgcataaattttatttgagctcatatttatatttaggttattatatgaattaaattcgaccgaccaattcgataagttaatcattcatgctaagattggtaaaaacaaacaatcagattaattgaataaattgaataaaatgtagtataaattattatcagatcttacatcaagctatacattttcaaatgatgaatccaacctaatctggtgcttcgatttttttttattatattggcttcattacatgttttcctttttaattaacaatttcacgaattttgtcactgtaatatttattttttgcattttacacttaatttttaaatttttaaaaaagctgaaacaattatttgttccctataaaattgagatttttttaatattatagatctttaaagttttatttatttatttt

SEQ ID NO: 3396 - DNA, 1244 bp, Glycine max
  Soy_ogl_1083 Gm03:44398701..44399944 Cluster 13
gaggagacgatgacgtttcataacaagacaattagacaaaacaagatttcctttttttatgggagaaagaaaggttgcctaattaacatgaaactcttccattttaaactcagaagaaatttccctaaaaaaaaaaaactcagaagaaattataaattttaatggtaattaaaaaatacgagttaccagtaaattatacggttttgttaacataattcttaacaattaaaactatatttattaaaaatacttattaaattaaaaacgtaaaagtataacaaatattttattttcatgaaaaaatatacctttaaatacttaacatcaaccataaattccttcaaaaaaaaaaacatcaaccttaaagataaacattaattaaagaacacgatagctatgcactgtaataaaaagtttttatgttgtcaataaaaaaaaccatctttattatgacttttatgctacttttttttttactagatgttacttatttattaaaaccaattaatttattatacatgataatatgctaattagacatttagcttagtttcattgatggtaaaaaatttaataacattgcttaaaaaatataaattaatatcatatatagtatattcgtttagagtatgtttcattaagaagattgaaatataaaaaaaaattaaaaaaatatttaaattaaagtataacatgagatgaatgaaacacaccggcgattcatctttttttttttttctaccaaacacactctaattaaagtcttggagactaatgagaaattcaggtcactcacgctgcaccagtggcaaattcaatttttaaaattaccaatgatatatattaaataacgttttcgtctaaatgatattagatttaattttttctaaaataaatataagatttgaatcttgtaaataaaacagaaagtaattgaaataaaagactcgactaaagattgataaataagtttttcattatacgcactttattaaaaatcactagtttagtgggtcatactactaaattaagagagatcataaataaataaaaagttgacagattgaatatgatgatttttaataaatgtgataatcatgaagggacacttaaaaggcaagtatgtgaggaagtgtcattaccatttttctatatgcacacacaacttacaaagagaaaaaatatataattttgaagacgaataagtaaatgagaagtgagattcattaaaattaatgtattat

SEQ ID NO: 3397 - DNA, 1040 bp, Glycine max
  Soy_ogl_1115 Gm03:46814927..46815966 Cluster 13
aattgtacacataagatcaattgaatgtattttcttgttaatttcagcctcccctgaaaaaaatggataaacatttgttgacttcttactatttaagattcttgatatatggttttttccttagcataagtgaataaaatattttgttatcaaggataataaataaagagaaaaaatgtttaaattttttaattaaattttaaagttatttcaaattattgtaattttttaacaatagtttgtaaatacatttttttcattattaacctgagaaatttgagcattaattaaaaatataaataaaataaaagatagtttaaatgaataaaatattaaagaagaaaatattaatttaatcactacaagaagaaagagaatatcataatacgttttcacgtttataatttacaataaaaagttaccaactcatttataactcaaactttataaaagatatgatccattcataacaaacttaggtatttttatttttcacatcaaggtgaaaactcattttttattaatgacgaaaatgaaagaacagacttataagcgcacaaagattatgtcaaatgcataagtagttataaaagataaaatatcatcaaaataaagttatagtgtgcctaatgatgaataaaaattttcttcttcgtaagaatattagtgcaaacatttgcttcttacagagaatgaatgatatgaattttccattgaagaatcaagagtgacttaacatatgcaattatcatctgaaactaataaaatgaagataattgatactcaatcagattgatagaaattgaaaaagtttgtctttgtaatgatatctttaaactcattatttcatgcatgacacattgcatcgaggataacaaaaagctcaacatacatgtttgaaggtgaaacaaatttaaaaatttggtttgatgatcatttatctttcaaaatacacaaactctttcatctactcctacaaataatctctcttaatttttgaaaaatatagattcacaaataatgatgaattatgattgaac

SEQ ID NO: 3398 - DNA, 1100 bp, Glycine max
  Soy_ogl_1244 Gm04:5783801..5784900 Cluster 13
ttatttcgaatctccctcacttgtttctacctatctacgtagcgactagcgggggacctttaattaattaaccacagtagacatgcacaatgtaatatttgaggtgaaactaagcggataagagagaaatttgttaattttttaggaattatatgttaggaaacttattttctcatatttaatatgtatttaaaaaaattatatttatggaaaatggtattttttggaaatattttttaatcagttttttcataattttttttttatgaaaatgtgataatcttatttttttcaagtttaattttattataataaaaatattttattattttttattataatgtgataaataatctataaaaatatgtgtaactcttttgatttctaaaaaattcattttaaaattttttaatcgtcaatcaaataaatttaattcatttacggaaaacataattgatagatttatgatttttaggaatcataatttttaaagatgaaaaaacttcttttctaccaaacaaacattgagtggttttgtttcttatttggtggactgccgcaaaaaaattctttactaatcgcacctaattaacaagacatatatatatggtatttagcattttaaatgataacttatgatccttttgtacttctttatattttctttctaagttgtaaatgtgttttagagatctgattttggttacgactttaacttgtgaaaaaacacatcgcatgtaactgccccaaaaccatcccttttaataaaaaaaacaaacttaataggaaacaattacaagtcacctaataatgatttattcagaatcaaactcaaatctgtagtatatgtagaaagttgatttattaatactcattaaataataaaatcgacataaagaatttaaaaagtaactgcacagaactttctttgcttccataatttcactgaatcattatgagtacattcaagatcgaaacacatgccttatgattgttgatttaatattttatatttttattcaacaacatggctcgaatatgtaatttggcccctacattacatggggccaaactcgttatgaagcaaacacctgtatcgc

SEQ ID NO: 3399 - DNA, 1000 bp, Glycine max
  Soy_ogl_2104 Gm07:790801..791800 Cluster 13
ccgattaatatgcctgaaaagtttaaataatcaaatccaaacatgagtttaaaagaaaatgtattaacacgtacaaaccaattgatatagaattattttaacagtaattttgagtttgagtcttaaagtatataattggattagatatttagaataaaaattttattatttataataatcttatttgaatgagaggattgtatccagcaaatgataagcgtggcttagacaaaaaaatagtaacttatttagaatttttattattttttaaaatgaatagaaaatatattttaaatttttttggattattttgtttctttgaaaatatataaactagatttatataaaaaaaattaacaaccatttcttcaaaaacattaattaaaaggaataaaataaaagaacttgaaaataatattccatcggcccttcgtataagaaataaattagaatttttttgcttagtattttttttttctaaaactaatgagccatttcttttagcccagtacataacaagtaaaattcattaaatctcggacttaatttttgagagtctaactttattttatgttcaaattattttgaaaattcataagcataactaataaaaattatgataataaatatatcaccagtgactaaattattaaaggtaaaacatattaacttggtagttgtgttaaatattttttaaaaattattatctataataaatctattcaacttaaacaagattatcttattagatgatatttatatttttatataaaaaatagagctaataaaatattaaaaaatgtttcattaatattataaatatttaaaaatacgtgtaaatttaagataagtttaatattattaattaaattaaataatgttgtaaatcttaataacttagataattttataaaaaaaataaaaacaatctcaggaaataacatttaatgttagtagcttcacaaaccctgaaacccaattgactcgtccgtgaatatcg

SEQ ID NO: 3400 - DNA, 1064 bp, Glycine max
  Soy_ogl_2650 Gm08:13315901..13316964 Cluster 13
tagtccacgtatttagtgcttaatgttttgaacagaatttgactaattggacgtaagtagttaaaactataagaattaaactcgtaaactaatcaaattcatatataatcaaagtccaaaatggattaattttagaattaataatatcattgccttttcgatctctctctttgtgcatgttaaagacccagtttttatttatttatttatctgtatctaaatcttcccgacaattttttttaaaatatttcatcaataattaccaacagagaggattctagtttattcgaggtttaattcataagagatatatttcagttggcatcaattatttttattgaacattaatggctttaatagtattaatgagtaaaaaaaatgggccaactagccaacccaaatagtaaatttatattttaaaatggattttttaaaatacaataaaatatactgaatttaatattgaaaatgtaagaaataaatatctatttttgcacaactcataagtctcattgtctgaatagggctgactagccacaattgacaccccaaagtgacagtgatcgatcaggagtttacttgacagtgataagactaaaacttcttgtatcctattatattttgaaaattttatttcaaaatggaaatttgtatttcatttgggttttttggaatggaagggagcgcatgaagcaataattgcaggaatcaacagcccaatggtaagcatgaatcaagtatatggttcaaaaagataacgttgacagtaaaatttgatgttataaaaatcaatattatctaaatatttatttttcaaaaaaatatattaaatttttatattctaaatttataaatcaaatgtgtgtcaataaaatatatatttttaaaaattaataaactatacatttaaaatattaaaattaaattttgatagttatatttagttaactagaatataatttctcattacatatttgttatacataaatctattataattttaatattaattatgaatacccaacaaaaatttctaattaaaagtaaaatatgtaccttaatta

SEQ ID NO: 3401 - DNA, 1471 bp, Glycine max
  Soy_ogl_2678 Gm08:14217901..14219371 Cluster 13
tttttctttaaagcgctaaaatacatgcatgcaaaatagtcgtcttctttgtttaaaaaagcgcacttacattcaactactgcatcgtttaaataattatggaaaacccatgactcataatctctgccttttatcatgaattaattaaccactgtgatgtcatgcaaaagaaattaaatactgaaatcagtgtgtcagcaacaacttgtcttcttgtgtgttctagattaattgactgctcccatgaagaatgaaaagacagatccagaaaattatcagcgtgataaacatagtatttcttttagtatttttcctagccttcttcctctttcatgccattaattatacgtaattttgtaaaaatgagtaaccttatcacatgcggtacttaatgcataagtttaaatttttctgtctcgtaagtatagagcaagtatgatttttatctcctaaattaaaatataaatataattttcattcttgaaaaatttagaaacaaattcttttagtcactcgtcgtctagacagtggcggatccaggtatgtagttagtgagggtaaattattatttttaaataatatttaccatcaaacatatgaataaaatataaaataaaatcaaatgtccaaccaattataatataaaaggaacaaaatataaaataaaaaattaatcattaaaagataaaaattagcaataagtaaaaaaactgaaagtagtgaggtcaaattataaaaacaagggtgaaaaaataacaacacatgtacactagtatactccaccacgtggacaatgctaattctttggataaatccataaatctattaaagaggctaattttttttcctcctttatcattttttaaatgcctaacttctaataaataataaaatttaaaatttatttactatttttacacatagaattaaaactaatttttatctaaaatgataatagcatgaactgaactgttatcataacaacaaacacaactaattatacattaactaacttaataatatacatgaaaaatttcaagggaagggggcagggggctaggtccgctctagacacacacatcttaagaaagaaagaggatgatgagtaaattgatcaatttattaaaaaaataatttttgtataattatttttcattctgaccatttattttcttaaaatttaatataattaatattaaattttaagaaaataaatgataaagacaacaatctcatataattttcaaattttcaatagcccttggctataatttataacattcaattataagctagttttggcaaagaccctaagcatgaattatattacatgccatatatatgccttttgttaaggcctaatctcatatttttataagtttgattaaagtgaaatattatttaaaaaattgtttttgaataaactaataaatctaaacgatctattagggtcagtctaacagtagtaaat

SEQ ID NO: 3402 - DNA, 1543 bp, Glycine max
  Soy_ogl_2698 Gm08:15104858..15106400 Cluster 13
gcagttttataccttttaatgtgtttgtttaaacttttttcttcttattttaagaagtaaattttgagcctgtttgtttaagcttatatttttttaaaatgttttttaataaagaaaacactttttttttatttgtttgtctaaattattttctctaagaagcaaattctatttttttaaaagtgatttattaaaaaaatgttttttttatagtttaaacaaactaatttcttgtttgcttcttaaaaaaatatttttaaaagaatattttttataatttaaagaaactgtcccctaactaattaagttgaaaattttcatccaaaataattttcgtgtaacatgaaaatttttgttccataataatcattgtgtatgaagaaaaaatttgtttcaaaataattatattttaatttttcaatacattaattattttttgtcacttatactccttaaaatattaatgatatgggcaacaaaaaataaaaatgaattaatgatgtttatgttaattttgtaaaaatgactatttttttaaccatttattaatttttgttgctttatgtattattacgacaattataatgaaatggaagaagtaatagttaattataccattttttatagaaaattaaggatcaattttctcaaatttaaaagaatgtaattttaaaataagagattttttaaaaaaatttaaaaaaaatagaatttacttcttaaaaaaaacaagcaactattttttttaaacagaaatagtttagataaacgcatcaaaaaaaaaaaaaacaacagaaaattacttattttattaaaacaattttcttaacaaataaatttaaacaaaatgaatcctatacatgaataaacagttgtttatttgacaatataattaaattagtttttatcattaagtgtgccaatcatcagttcaagtttaaccaatagttcttatctggaaaagtaatggggtccaatttggttttcaggaaaatagggcagcaagcaactgtatgtgactttttggcctttccaactgtatgtaaagttggtggttggtgtcacatatctaattatctttttctttctttctgcttaaacacccctaatatatatattcagcaaaatttcaatattgaagtaaaaaagaatgatgcactaattagcaatggggacgtctgtcaggggagggtatggttgtatgcaatgagtactcttttgacattatgaaccggaaatgaaaatggaaatgccccacccaccctttatcgtatcttgttcataacattagtgctaagattttaacaagtggtttggttgctcagaaggcacaattgccattatttttgtttcaaatttaaatcattcatagtgaaaatagcaatgaacaataataattaagtagccagccaatatggagaaatgaatcaattaagtgcaacattggttctttcttctactggctcaatcaattaagttccttgatgtgaacaaagaatacagaattaccttgagtgcaaaagagatgccgcagaggggaaca

SEQ ID NO: 3403 - DNA, 1000 bp, Glycine max
  Soy_ogl_2968 Gm09:3444301..3445300 Cluster 13
tgttactaaaaaacattatttatcaaataattaaacaaatttttgagctagtaataaaaaaaacataaaagttagcttaagtaacatgtttaacataaccataatataattcttttaaaaactatttttgaaaccttttttagcaaacacttttattattgttttatttttaaaaaatatattggaaacaattttaaaaagttgtattgaaaattagttttgaaaataaaaaaaatatcaaaatttcaaacgaaccctaactatttaatttgctcaatttttcttaatttatctaaaacaacatataacaacaattataataaaacacacaaggagtaagtaaaaagtgaagcaaaattgcaggtaagttggggatagcacaattattggtggaatggatttgaaacataattaaatatcaagtaacaagtgaagcaaaattgcaggtaagttggggatagcacaattattggtggaatggatttgaaacataattaaatatcaagtaacaagtgaagcaactatgtattttttttttctaattataagatttttttaaaaaaaattgtttgttttttataagatcattttctgatttttaaatttattaataattttttctcttaaatatttttacttaattattctcttttaaaaaattaatgagaaataaataaagagataggaagataataattttaaaataataatacaagtaattgaaaattttgatgtagttatttaaattattttatttaagaacgtaaattaatttaaaaagattagtaattattagcatttgaaaaaaaaagaagaaaaaacagaaatcaatatacccacgttcacattccgaacccaggaagcactcctcctcttgttattgcattgaatgaaggaatatgaataggggagatagtaatcaagctttgaaaagaggaatatcattttgcaatgtattttatattaatatatggattcatgtagatcataatgcaaggtt

SEQ ID NO: 3404 - DNA, 1300 bp, Glycine max
  Soy_ogl_2978 Gm09:3973401..3974700 Cluster 13
ttcttgtacgcattaaagccttaattatatgttgagaataaatttgtaagaatttttttagatgtgtattatagattatagatgtgttataatttatctaaaattaaaaaaaaaagtttattttttagaaaaataacaaatcaaattagttacaatggtttaagtcgggacttaacacacacaagttttatcaactctaatcattattgatctatgtcttttttttataaaagtataggtgagttgagtattaaaagcttgtttttgagggttaaaacatgtctcaaggttcaataaatacttatataaatacttacattaaatattattagcaatatggaaaaaaaaaaccatatactatttggataatttttttcttccctccatatcattgttgagattaagctgggcttagtggaatcgatgcatgggtttgtaaatccaaatttaggttatacataaatattaaaggtcaccatcaactatcatatttaagcaatagtgacaaattgatgtttgaaaatgtaaatatgtaaatatttgaatattttttaaggaggctgatactttagtcaataaaaacataaaagttaaattcaaatggcagcctaaaacacataattataattatagctaattataataaatatagccaatgaaaacgatcccatagcactcttgattaatgtatgtttcattcttcaatttctttgtcattccaaggtttgtatttattctcttatcatcaatcaagatacatttagtaaaaaaaaaatcaatcatcaatcaacatacctcaaatcatagttttcatgatgatgcaataatatctgacaatattttgagggtaactaatttgcttataatttatgtaatattatgtagtgcactacataatattaagaaaagatttatcgatttaaatgagaaagcaatatgttagatctttctttacaaacatgtttcacctttttcattttataaaaactaataaaaaatataatttttgctgataggtctaaaacttaagttttaattgtttaacccatagccgaccttggtatcatggcatattatgtacaatatatttttaaggttcaaagtttgtgatatattgtttattacctaaaaaaacagtcatgtattattatgtattaacaccaatttatgctattagttatttttttttcatgactactttaaaatgattatgccctactaaaaaaaactggttttagccaagaaattgatattgcctattgtggttaaacattttcaaaaaatcatgaagtcatagatg

SEQ ID NO: 3405 - DNA, 1000 bp, Glycine max
  Soy_ogl_2992 Gm09:4524501..4525500 Cluster 13
tacttatagctaggtatggaatatcatatatcatattagaataaagtgctaataacatgcataattaggttaaattaattgttatataacaaaaaatattattaattaaatatatcattaatgttgttactatatcgtattgttaatttatttatactcataaatatttaattttcgtcgaagaaagtttattatacaaaggagcttgatccaacaccaaactggtgtggaatatgatacttttgttttatattgtaaaagataaagattgatagacactaatatctagtaaacacttagagaaggacatttgaagtaattttattgtttttcttttttattaacttgctggatatggttctttttctgtttttttggcatttctggtgcctttaatttcttttatttatatatatttatctggccgataaaattaaaaaacacttagagaaggaaaaaaagaagaaaaaaacataagtataaaacatgttataatgtgttcacaaacaaaaggtgatataatgtatcaatgtgtgatataattaacggataatcatatgtattaaacatgtgaaataaagtttctagaaatagaataatttcttaaataaatatcagtccctcttattcttcactagaagatatatcctacagataaagataaataataactattgattaagtatatggtttttttaactgcaaattaagtgtatgatatgtgaagatgtatagttatatataattactctacggtaaaaggtatatatgttgaaaaaaatgttgtccactggtatttctcatgaaagcgagttaatgcaagcgaattgtagccacttccttacatcttcaacctatatttttttcaaagaaagatatccacatacttaaaaatcatgagactaatttttgagatatataaatcattgaactaaattttatctttcttaattaagtcttatccatacatatagatgagaaatcaaacctctatttattt

SEQ ID NO: 3406 - DNA, 1087 bp, Glycine max
  Soy_ogl_3007 Gm09:5178552..5179638 Cluster 13
gtgacgcccaacgcccactcatggaaggtatgtttttttccttcttcctctactgttcttgcattttcattcttgttttttttcttctcgtgcgctggttgttggttgttctgtttgtaatttgttatttttttaaaacattgtgtagagatcttcagggtgtgttaaatagtcgaagaggatttttaccgcccataatggtgttaaacaagcttgtctctagtaaaaaatatctttggttcataccaaagatgaattttaaagatcaattgaattgtaataaaagttcaaggccactattttaaaaaaaaatagtttagacttcattcataataaattaaaaatttatggtgtctatttataaaagataagaagtttaggagagttcaatactcttttccctttttatatgttaaaattttcaaatattttaaagcattttctcacaaataaacatatatgtcatgcatgactagcgtcacttgaatttaagtttgaatttaaaaatatatagttaaaatatcatttcataagaatatctagtgtgcatatcaactattgtgtcaaatactcggaggaaaagttttgaatttaaagatatatagttaaaatgtcatttcctaaaaatattttgttttcattttttttatagtaactagaaacttttaaattatcatttcacaacaattatttaaattaataccttatctaatatgattaatttttatttctctcatttttatattttaaaaatatagtctactagatatataataaactatatatctataatttgtaccaaaaaactcatatatctataatggaaaaggataattaataattaaacaatttatactaattacaattaattccaaatacaaattaaaaaatatatatttaaaatatttttaaacaatgttacgggtcatacatcctagtttattagatagaaataggaaaaactaataaaataagaattaatgcattgttaatttaaaaattaaaagttatattttaaaaatatttcttttactttcttataattaatttttaaaataattgtggtgtaaaattcatttaatttctc

SEQ ID NO: 3407 - DNA, 1118 bp, Glycine max
  Soy_ogl_4321 Gm13:28182601..28183718 Cluster 13
aatcaaagaagattaggttaatttacttctatatatttttttatttaagttacaaatttgggtttagtataccatatatgttacacaataacataagtataataatataaaatttactaaaatatattttttaacattagttatctttctataatttagattatgatcacaagaacggaagatacaaaaagacatacaaacgagctaactagtagatgatttaaatttgaaatacatgatatgatgagattgatgcatttaatagatcatgtagttaataaatggcgtgaatccgaaatacatgacttaagttgttataactaattgataatgtgaatttgaaatacatgacataaattgttataactaattgataatgtgacaacaacatttcaatttgaatttaacttaacttcacacaactaatttgtaacgaattgctcccttctattgtccctttgtgttaatatttaaccaaaaaaatttctcaatcattttaaatcatcattctttatttgtatagttgatcattgttcctcgtccatttcaataaaacatttaaagaattcaatgaaaacaaattataccatcacatcatttgttattaacacaaatatagttgtatacaaaaataaaataaacatgtattgtacataatataaccacacagactaccttcctaccacacattttcattaaaatgtcatataaatctaataaatgcattattcaataaaacacaaagtttgtttaattgttaatcattgtaataaacattaaactacataagtcaattaaacatgtaaatacataatcattgtcatataaatttgtttaattattaatcattaataaattaattttttagcaatctaatgttagttttatcaatttttaaaagtttaaccaatctaatgttatttaattattaatcattagcattttttgtatcattctagatactgaatacctttttttatatcattgtaaaataatatcaccaaatcaaattttttgaaattactaaaactagtacaaaaaaattacactacaaaaaaaattaaatataaaattaacaatatttaaatttcaatttaataaataaaatttaaaacaaa

SEQ ID NO: 3408 - DNA, 1100 bp, Glycine max
  Soy_ogl_4401 Gm13:31964901..31966000 Cluster 13
tttttattaaatgcccaaaaataacattctcatattttattcccaaaaataatatttttcaaactaaaaaatttattcgcgaaacaaatgtcccttaaatatttataatcaaatattcgtttccatcttttacataagaaataaataaattgagaccaattgaaaatgactaacttgattaattttaattaatattatgataaacttatttttattctgtaatattcataaaattaaattatctaagttacggctatatttaattatacatttatactactataagtttaaggcctattttttcaccaatgacttatattattaatagaccaatgaactcacttgcatgaagaattaatgagtgagtgtcttattaacaggtttcacaataaattatgaatataaaaatttagctattaatatatctgaaaatgagtcgatgtttcttataattataacccaaaaaatatactcacttgtttctcatattactaaaaaaaactgaaactactataattttaggtaaaattaagttaagaattaatttcgctaaaaactaaaatcatgataaaattaagaattaaaatctcaaaaataatcacctagaagtttatcttaaatctagctatcaaaataagtttcctttttatgaacttgcattattaattgtgttattaaattagtatcatacctaacgagcgaacgaaacctttgtaatatgcatttttatgctatatctactatctagagtttaatttctatccatcagtgtaaatcaataaaaaaatcatggtagataactatgaaatttaaattaattattattttaacaaacttatactatacatgattatttgtaattgattttgacaatgtaaaaaaatatatatatcataacatagattattactctatatttttatccatattttgtcatacttattattttattcaatttttattgtaaatatgatggtttccgcttgctttaatttagactttccacgtccaaaaatcatttgcttgttgactaatccgagttaagtggcaaatattaaatctcaaaacttcctttctgtcttgtccaatggatattaggt

SEQ ID NO: 3409 - DNA, 1000 bp, Glycine max
  Soy_ogl_5399 Gm16:31888501..31889500 Cluster 13
caacccttctccacaagctgaatagctacttctgagtcacattccacaattagtcttctaatgcctcattgtcaagctctaactccatacaagagattaattccatttgactcttctaaaactaaataactcactttagagccaaaaaaaaagtaatctcagttattgaggagaaaataaataattaaatttatatgctcatacacaagtaataacaaattactgaaatattaactattgatttttttttcataaacgacttatatatattacttattttacttttacttaattttgaggagtcaaatccaatcgttttaggatgaacttgcatgaatactcaaaaaaagaaagtgttcttgaaaaaacatttcagatgtgtttggataatgttttaaaaaagtgttttataatatatttaaattttcataaatcactttctatatttggagaaaaatgttacaatattttttctctttgaatttttctatttaaaatgaaaaatatctaattattataaaatattcaaagatggtttaaatttaaacaatacttcctcgattctagattatataacattttagagaaaaaaaattgttctaaaaaaatatatgtcgttttacaaaattaatattgtatcatatttttttccataactattcttaattaatacttagtgggaatagtgtgtagaaagaataaaataatcactaattagagaaataaagggtatattaaaatgttacctaatattttttttttgaaatcaacaaattaaattacattctttaataattgtgttaaaagtttaaacgtcgtataatctgaaatggataaagtgttttttttataaaaaaatatttaaatattaaaaatttctctagagaaacaatcttatattataattgttatcaaatggttctatagattatatatataagcaaaatctttatgttagtgattctaaggactttaaaacttcaataatcctcggaaggct

SEQ ID NO: 3410 - DNA, 1100 bp, Glycine max
  Soy_ogl_6310 Gm19:910201..911300 Cluster 13
aacagtaaagttatgcttttgagtatttatataataattatatataaaattccaactcaaagtcacttactcatgagtcagaattattcaatatcagttaatttgtacgctcgttaattactcatcattaatgcatgaaaattttaaatattatcaatcaaaatatataattaaaacacacattgcttatacagaatgtttatattaatattaatggagtttagtcttttttcttctaataataattaaactaataatataaggtttaattgtatttttttatcctcaactttttattatttcttttgacaaattttaccttcaaaaattaatttaacacattttaactttaacttttaaagttttgtaaattttatcttccgttgttgagttgacgttgtactatccctaatttttttaccttttagtaaattttacctaatttttcactttttaataaattttatccctaatcttttacttttcaaatgtcaacatgtcatgtcaacttaatgataaaagaaggtaaaaatatacaagtttgttaaaaaattgagaataattaaatgtgtcaaattaatttattaagaataaaattttgtcaaaaagtaaaaaaaaaaattaagccttaatataacattaatagtagactaaattacactgatacactttttaaacacgggttaatgtaatgtaaaatgtgtgtcaatgttatgttaatttttaaaacatctaaagtatggttctttaagtctttaacagtaacccaaacatcctttcaaaagaaaaaaaaaaacagtaacccaaacataagctaaattgttgcaacgaccgttacaacaaaaatgttttgctattttatttttttacagtagcaaactaattcaattccattgcaacatagttggaaatacaggtgtggaatacaagagaacatatatgatgatggtccactaaaataaacacagaacatatatgatggctaggattattaacagatgtcctagctagagtttagagaatgagacacctaatttagcaaacgtactgaattttaaagcgtggataaattccaagaatatctctaatatatgataaat

SEQ ID NO: 3411 - DNA, 1100 bp, Glycine max
  Soy_ogl_6449 Gm19:39210801..39211900 Cluster 13
attattttaattaaatccttaacttatttatttcatcttttgtgaataaaaaaatataattagaacaggagaattagttaaagaaaaaacactttaaccatctattctttggctaaaaagaaaaaaactaaccattcttaagacatttcctgattttttgggtgtaaatacaattcctgattttcaaatagaaaacgccaccagtggcaatgaaatatatattttcatgattttaattaaaattaaaatgaagtgtttatataagaaaatcatcgtttaattattataataacttattttaaaacttatctatagaatatttgaattgtttaacaatataaaacaattttttacttacacaattatgttcaaacgaattaggtagaaatataaaattattatgaatattgaagttctttttttaagtattcaatataattttagatttttaattaaattagaacaatttcacatgagtttattaacgcgttcaacgatgacaaattgacaatatataaatttttacatcaactatatttcaaaattgaacactatgttcgtcactttcattctaaaaaagaagggaaaaaaatgctagaaagaaaccaagaactagtgcacaaatagtccacaaattcggcaacttggattgggttaagcgccgaccgtgaacatcacgcggaaatttgttgagtacacggaaaattctctaagaaaatcgccacacccaaacacagcatacagattcaaattttttgaagaatagagcaagaaatattctcaacacattctctaatatatttttgacagtcacgtatatttcttttataaactgtatttttgaattctcattgtttagatcaataaataacaacaaatagttaataaaaagttttaaaacaaaattcataaaaaatgttacaagtgctgtcgtataatttttttatgaaagttaataaattattaatattattgttatataattatttaatgtttttcttaaatcatcagcatcatttaaaattattacttaaaaacagaaatgaaaaaatatgtttaaagaactaaaatcaaaacaaaaaatttaaataactaaaata

SEQ ID NO: 3412 - DNA, 1209 bp, Glycine max
  Soy_ogl_6499 Gm19:42216001..42217209 Cluster 13
atatacaaatatagaaaagtcatatcctcatgcaaggagaccttatagttagccagagaattcgccacttgatagacttaactttaaagtaacatgagttttcgaaaaagttaagtctctcatccccttattatccatactgaagcatgcatgtgtgaattgacgcggattcaggtatagtatcgtgggtgcaccgcgactttcaggaaatataccatgaaatagcatttattactctcctatttcatattatataacgttttagaaaataaaaattattctaaaatatatatcgttttataaaatcaatgaaatattttttttaattatccttaattaatactcagtaagaataatatataaaaagaagaaatgagttattaattaaaaaataagtaatatattaaaaagttatctattttttttaaaatttaacaaattgattaccttccttaatacttgtgccaaaatcttaaacgtaatattatctttttgttctactacttttataattaaacgtcatatggaataaaggaaataacattatgtttttgttctactatttttataatttgaatccatcgcttccaatttccagtcttgtcgtcacattttgcattttattgactagatttttacttatgttttattcttttttaacctagctactatgtatttttacgttttattcaacgtgacatttcatttccttttaatttcaattcattgcacttgatttaaaaaaaatggttataattgacaatcattttgtatcttcttatttgatcattgtgagaactacctacctttcatttttttttctatttcagtcaagaatacattggagcaagaaaacacccttagcaaggttttttttttttttttttacagacacccttagcaagtttaaaagttattttcatgaatttttccttatttcaaaaataataaattttctgtgactcataagaaaacacaataaggaagttaaattgaaaaatatatattttattctctcaaatctcaaaaaatacattttattttttgaagccagacaaagttaacaaaaatgactattaacatgacactaagttgatatgtattttcaaatgttgacactgagacgtcacgatttttcaccattaatgttgatttttttatttaatgtagaatttcatgacatgtattataagatgagagaaacatgac

SEQ ID NO: 3413 - DNA, 1098 bp, Glycine max
  Soy_ogl_6507 Gm19:42315303..42316400 Cluster 13
ccctgccatgggggtttcggggctgggtcgaaaaattgttaattaattgaaggtaattaaggggaaaataattaatgcaatagacaattagaaaaatgattaatttaagtattaatattaaatttgtctttaattgaaatattttttcaaatttatgcttgacagaagtctattcatttaaacagatattctctaattcattattatttattaaaaacttaaaaaatcaaaatagaatcatgtgagatttactaaattttattattctcaataaatttttacaaaaagaaaatatatctaaaaatatgttaaaaaatatattactactatttgtcgaaaggcaattcaaagtatcattcaattatggatcaaatagataaaagaattttagttaaaaaataattaatatacaaaataattaaaatcaaatcttataaaaaaagataaaaaaatttcaaaccatgttgataggaacggagaaaatataatgataaagatcatggtgtaaaattattttgtacggctggtacatattttttaatcaaaataaatataaaatatttttattagtctctatttttaatcaaaataaatataaaagcataacgcacatttcaaaactaccaaataggcaaatacgtcatattcattggccttccttttttctaaaaaaaaagttacgtcacattcattcaaatcttcaatataccaaaggttcaccatgacccaaacagtggtggggaactttatgatcatctcaaattttctatctcttttctctgtgcaagtgtatgtgaatatgtgtaaacacactgcaggtcacccattttgacgaatttcgtgttacactaactttattttctctcctacgaaaaaaattaaaattaaagttaaaattataaaagattatgtagatttacgtaatttcaaatgaatttccatgaaagattagtatataatgaactaatataacaaatcttaattttaatatttctaccgttaatattctcctccaatcaatatcaacattatgttaattattacactctttcttatgatttttaataaaatatttaacctttatttattaaaaaaaaa

SEQ ID NO: 3414 - DNA, 1000 bp, Glycine max
  Soy_ogl_6592 Gm19:45342801..45343800 Cluster 13
acctaaaatcaatgcattaagtttacaaatctttcttatttatatattattcaatttattcatttctatttaatgtaaaatttcatattcacatttatactacaataaaaatgacaaattaagaaaaagagatccaactaattaaaatcatcaattacattcattatcactttcttgttatcatgtaaaaatgtattatgtaaaaactcaactaagaacgaagctatgacaaacacaccctctatatgaaatgatcgaatgatcatttttttttaatgttaagttacttttggtttctcaaattaaaaaaaaaataaatagtccctataagttgagaagttacttttggtttctcaacttatgtggatttgaaaataacacctcagtgtcattaaatattcttttcccgaaagattatatcattttatgcaatccaattcaaaaaaaaaagtatattgctttagaaaatttgttttctcttaattattttatccctttagaaaattaagaaagcaatagagctattttctaactttttccactttttgtatttttactcgatgacataagaacattatgggaggtgatattttcagtattttaataaaagataaaaaaattacaaaaataaaaaataatttaattaaatgtagttccgtttttactttattcgtgtcaaattatgtatagttgttaggagttttaatttcaaaatatttgctactttaaactattaaaatagtcttaattttttctttattaaaaatactttcatttattattatcacacttaaaaattaattaatttataagctttttttaataaatagtacattttactcaaagaagagagtataatttcaatttcaatacaatgacgcgtgttttttttttttggaaaaattgttttcaaaaaaacttgtttacattatcggcaagttatgtttactacttcgtctaataaatttgaccacgataacaaatactataatgacatctc

SEQ ID NO: 3415 - DNA, 1097 bp, Glycine max
  Soy_ogl_672 Gm02:45285404..45286500 Cluster 13
aatgtaaaaatgggatgacactataataatctataaaaattttgattatgtatctcagttgatagttcatcatgtcttaagtttgttatcacaagtcattctgttggccatatggattcataaaaactaaataaatcactttaaagatgttgaggaccaataattaatagagaatatatattgcctagacaaaatttgcaggaaacaaaatatttgtttttttttaaattctagtattccccatgtatataattgagaacttagcaactcttttctaattaaagtcagtaacttgttttaaaagtcagtcaagcgaactttacattggacagtcttttgtgagtttatattgtttctaaacaagataagtgaggaaaaaaatcatatttttttaaagataaataacttattttgataaataaaacttaaaaaagagctttaattaagttagtaggaaaaaaaatcacaacgtatatgacacttattcatgcatttccttcaatttctaattaactcattctgaaataccatttttttttaattttcgtcaactttcatatttgaatgcttcaccagcttctctaataaatattctttttatatatttgaattattttaaattatgtttatttattgtaaagtattattttatttgtaaacattaattacttttaatgttctaatttcttacatgaaataaaaaaaattaatgaaacgagtaaataatatttttttctgaaaagacaatatggaatatataaataaaatttgattctcatgtgtaagaattttattgatgagtaatctataaatacttttgtacctatctccttgaaccttagatctgactccgatgaattttcataatccaacttacttaaacttttttggtatgaaaaaattatataaataattaaagtttgctggtacaagaagtcgcaggtaaaaaaacaaaaaaacagcatcaaccaaataaaagacttaaaatcattggcagatccataaaacatttttagcggaaaaaaatagtctataatatttttactgaaaaaacaaatattataaatttttacaaatacacaatgtcaggacaaaaa

SEQ ID NO: 3416 - DNA, 1000 bp, Glycine max
  Soy_ogl_800 Gm03:1926301..1927300 Cluster 13
tttttaaatgactactgctatttattatcgtcaaattaaaatttaaattaaatcattttattttaaattataataattgatattattttaaagttaagtctaatcgtataattagccctgttaaagtcgacctagtagtagtgacaatgtcttatatagtattgtttggttgtaggaaatggagggaaggtgaagggagatatttttttttataaacttttgctgttttgtttaatttttaagaaggggtcgaatattagggatgcaatatcaaacatggtcacaaatccaactctactcgaagttgatttggaagggtttggttttgaaaatacatctggtgtaatttttaagacagctttgggttgtttaatccggtttgatttcctatattattttcaaaaatatttttttgaaaaattatgaattaataatataacagtttatttaatagaaaatgttttgtataaccatggtattatacttataatgatagtaaaatatgtattgtaaaatttactttaatttgggttttatacttcttttattctacaatttagctatgcacaaagttaatattggcatattatattaaaacattgggttaaaaattataagcttaactccactgtcagtgcacaagttcaccttattaatatctcatatgaataaatgggaaaatattgaaaataattcaatctcatttaatgtttgttttaaaaaaaatagagtaaattagacttttcattatttttttttttagagatgtgagtattactctcattttctcttatattgaaatatataattcaatttatttaacataacactattaaagtaaattacactattctcttttgagaaatgtaagttcccttcttctccattaaaattccttctctccttttcacttttcctctcttaaagatatgtgaatattacattattcttctccacttatattaaaatatatataatttagcccatttagtttaataac

SEQ ID NO: 3417 - DNA, 1012 bp, Glycine max
  Soy_ogl_1271 Gm04:7131318..7132329 Cluster 13
agtattgcttctgataatatattagtatagatattgtaggtctacattaataataggatatgttatgctaacatttgatatcttaatagcatatatagtatagaatgtaatgtttatgctaacaattttatttttgttacacaaaaaattataccaacaaaatttgaccttagaacttaagggatgaagatttaatctcaaattattaagtaacgcttaatttcctatggctcgtgctatgcaaagggaaatattgttatatttaatttatttttgtcctgtaggtcagaaatcacgagtttattaagtcataaattaatgttatccatgaacatgattattattgattcgataaaaataataaaaattaaacacaaatttttgtgttaagtaaatttattctcttacatttaaatcaatatattttaaaaatttataaatgtaatgagtaataaacttatgacaagacttacttgattaacaataacactcaaaatgaatatgaaaaaaaaactcttcacacgtgtatatcttgcttgattatacatatgaagatttcaataaataaggcaaataattaacgacaatattatcagtaaacggtcatttcacataaattaaaagacattttaaagttcataatttaaataagaaatttacaaaataatgtaaaagtgtggaaaattgtataatgtaggtaagaaatgtatgagaactcatgaacattgacactaagtctgtatcaaacgtctaacgtcaccatgagaaatgacgggcttattatgagttaaatttctaaaataaaaaggatttaattgtattttttagttctcatacattttagtatatgtgtaacttttatctttttaattattcacgttcatctttctttttattaaataattaataaaatataaaaaatgtgatatttcattaatttgtataaattataaattaaaaataaaaatgcccttttggcatttctttatttttatttaaatatttttttttc

SEQ ID NO: 3418 - DNA, 1400 bp, Glycine max
  Soy_ogl_1666 Gm05:32840701..32842100 Cluster 13
agtaggtgttatttaaatatttaattagtcacacatatatattaagctttaaaaaaaacttatagggaaacttatttcaataataactcttataatttttcaaaattatttcaataaattttgtagtgtactatctcttgtctcaaatataagaaaaaaaatgtgtcactaattaagaaagttagctaatcctatttaatttacaaattttaattaatttttttttcaacttatttttcattgaaacttgatatcaagaataaaaaataatcattaaaactagcacattaaatagatattttacatagtattaaataaaataaagttaattaaaattttcttatatttgaatcaagaaaatgatgttttttttatatttaagattagagggagtagcttatcaaaatgattttttcttagcttatttcaataaattccatgctcaaattaatagcaaacccttatgtgatatgtgatgaagatttaatgaataaatatttagttgagtattttgccagaatgcattattaattaaaaataatttgagatgcaataatttaatagtaattagtaatgcataatacaagaaagaaagaaagagaaaattttgattgttacctttatcttacatcgtatccgcttgtacttcatacctacccgcggaattgactatgcagaactaagcaacatattttttattcattatatgatatgaatgatgtctttcaaattttttaatgctttgacgaaaatatttcttttgttacattaaaaaaaaatctgcttacgaaacttttatatggtgttaatgaagacacgttgaggttgtgtcagagttatgtttcctattcagtatactatataatttaaggttagatttatcaaataacaaaacatgcactcaagtcacaattaaaatctttatccaaaaaaaaatagtcaaaattaaaatggtcggttcagaatttcggttcggtttgtcgtctttcggtaattattagattctctcccaataataaattcatacgacttaaatactaccaaatcaagtggattgataaattggtattggactgtttctagtaattttttagtttgaatttaaatatattattatattaaatattttaaaaaaatgattataataattttatccaacttaatcaaaattattttaaataaaaaatatttgaggtctttacaaaagtataatgcaaaagcttgcatgtaagtgaacatgagttttgtcgattaccgaggctaatgagttagtattttttctagaaggatatttaattgtttaagcataggtaaatactaaccagtagtatcgtaagaatattgattaaaaaatttaaagtaaaaatatttttagtaggaagtgaaaaattatgttgttc

SEQ ID NO: 3419 - DNA, 1100 bp, Glycine max
  Soy_ogl_1972 Gm06:15789601..15790700 Cluster 13
caaatcaatatatcaactattgaatacggctaatattgataattaaaattttctttgggtgtcacttacgggagactttcacactttttgtagacaaatactaatcagtgctttgaatattgaattaaaaaattttaaataaaaatatatttattaaaatgtaatataatattatgatatttatgatttttctatactcttttaatattttcataataaatatatatttttaattttttaaccaatattcttaaatactggttaacctgaggttgagaaactttggcactttaaaaagttaataatggcatctatagtaataaagctccaaacttgatagcatctttatactttgtttgtagtaaatgattgaattttatctattctgtactatggtttccactccaaacgctaatcgtttggttagcaataattgaagtccatatattatactgttaatatataattaagggcataagaatattagctagaataataataacacagataggtctaggaccagccttgtgctcaccaaacattagtctatatgcaacgcacctagttgtccatagccatactaattgtggaagaaaagggagtagtgcagaaaaaataaatttaaaatagtgctaatgcttgacaaagtttcatatgatggaaactaaaattcgtataaaataccaaaaatatattaaattgattttgaagaaaaaaaaaactttgagccgaataaagacaagccacatgtctgaaactaattgtttggtgcaacatacagacaaaaatatgaaagataagagaaaattttagaatttaaatttaataaaaatatatttttccttattcttttttttactctattttctttcctttgattgatacacacagataatgttgtaattatattagatattttatactagataatgttgtcattcttattatctaatgcaattttaaaattgagatatgttgtaagttagttccttcgaactgcatttcctcgaacatgatcaatatttttattatctttattaaatttaatagatatactagatttcataaatattgtatatgataatatttagttatatatt

SEQ ID NO: 3420 - DNA, 1084 bp, Glycine max
  Soy_ogl_2298 Gm07:8699801..8700884 Cluster 13
aaaatctgtgtttgcgagtctaatgtacattataaaaataagtcaactttttttatttcggtatttcacaatcaagaacaggttaaatcagtttatatgtatattagacctaaagaaatgtgtaaagaaataaaaagttaagagaaaaaaaatcttaaaatccatctcattaattattttttaaacactcttgttaaaaatacttttaatattgaaaaaaaatcaccttaattgtgaaaccaactcgtaagacgaaaattattttttacttatatagtttatctcaatattatttttaattaatgtgacatttttttccatttattcacgactattcatctttctagggataaccataatttagattacttttccaacacctaaaaacactattatttaagataatcattttaatttttatacaaagaagattatattaatttcaagcttttaagaatggacttatgagaccaatggacttacaacaaagtaaactaattaaagtgacacttgaataagcatatatataagcccttataaaaaaagaaaataaataaatttatacttaagttagaataagctttttgaagaatttaaaaggtttaagttttttcataaaatttattgtaacttatgtataaactaattttaattaaagataaactttctttaatttcctaccctataagttttcataaattcttcttatcgaaacaaaaccttaagcttacaacaaaagaaaagtttaaatagattttttagttaatttagactttaaaatacttaagggataaaacatataggataaatagactaaactcaaaactttgataaaaaagagagtcaaatttaaaccttacaaagccttattaatttaatctacacatgttttacccctattcaaactactttaaattagactcaatttgaatttaaaacaacagtaaaataaaaattaatagaaattattcaaataactaaaataaaatacgttataatatagataatcgatataattaatcaattaaaaatatcataaatacatctttcaatataagttattacaaaacttaataatcttatc

SEQ ID NO: 3421 - DNA, 1100 bp, Glycine max
  Soy_ogl_3548 Gm10:45365901..45367000 Cluster 13
tcttgttcgtacgtgtcgtgcactttgcatttctattttttgttttcaggatctctttttttggggtgaatttcgaaatcttttacacacatatattctcttaaatattactattcttcgtagtgattctatatttaaaaacattttttttaattcgactaaatgtttatatttcctcaacagtaaatattttatatctgtattctttttatagaacttcttttacatcataattttttgtcttttaattttttttattataaaaaagtagctttattgtatcttattttcatgttgggtgtttatgtcatttcacagatatatctttttctttctttctttctattttatatacaataatatcaagaaaacaatatttatatttttttttcatttttctcctactaaataacctaaaaatttgtcttattttatactttccttttgtttacttatatctcgagttctttcttaaactaaataaatccttaaactttaaaattagatagaaattaatgaattaagaagatgttcatctatccaacattaggtgtaatatgtaaaacctggaaaaatgtcaacaactttatataaaaaatattagtataaattatatgtatcttttactaaaaaaaataattatcatacgtgatataagtcatctcgttccaatcatattcatcatacattaaataagaatgaaatagattaacatgtttcgagagtgttcatgaaatataactcatcttaattagaagtgagtcagtgctgagttatatcaagttaacttgttaatattttaaaaaatattaaaatagagaaaataaaaaaataaccattataataagaagatagacaaacagagtgaaaaaaaaaaacacacacacacacaaaatcacgtacgccttaaaaagtgatttctgtaatcctttcccgctttaatttagcactaaaaatgaataatgctgataaccatacatattattttctgtttcttttttcacagtgttttattttcttatggtattagttactttttttttaattcagcaactttttattttcatacctctttttctttctacttatgtcgacccgat

SEQ ID NO: 3422 - DNA, 1000 bp, Glycine max
  Soy_ogl_3905 Gm11:35550401..35551400 Cluster 13
ttgatataatttttttatattctaaaatttaaatagttaatatagacattatgaatttgtatattatcattagacattacattgatatgaaaatttgatatatataccatcagcacgtcttatctttagtgtaatgaattgtattgtcagtataaatttaaaatagagaaaaatgtgtttttttctctcaacttttgataatttatattattattctctaaataaaattttgattaatcttagtctttatattttttctcgtttacgtttttaatgattgttgttaagtatcgcctaagtcatgccatgacaactacttattttaatgatacttctgacttgtttgtgttgataggtttgccaacctattaggttaataggcttgtgaacttttataggcccttaaaaatgcttttaaggtttttttaaagggaaattctttcaagttaggttagacttttaaatatattaagtagggtaaaaataaataaatataaaggtaagactcatatatattaattaagagttaattcaaattgtttttgtgaatcttgaaaagtctaattagcctagcttgatctgtctctagtcgttcttggagacaatcatattgattttttttgaacgagagtttattaatgctttaacttatagtgatatgcagaatctaagttttgttagtactcatttataagatcatttttaaaaatattgtttgtgtttttttataagattttttgtttaatttttagatgcattaactatttttttttgtaaaatattcttaattaattattatctctccaaatattaattattggatgagaaacaattaattggaaaatgaatgatttttttaaaaaaaaaataagggtacttttgaaagaataatacgtattattaataaatttaatgtaattaactatttttttttaatggagtgtgaatgagctgaatgggtctttaaataaagacagggcagtacatgtttacatggttt

SEQ ID NO: 3423 - DNA, 1572 bp, Glycine max
  Soy_ogl_4330 Gm13:28623901..28625472 Cluster 13
gggtaaaagactccatcctcggcaacctctgcaacattgcccatgtccccggcaacaaccgtgaccctaacccatattcgccgcataaccctcgagccccctaaacctagctcaaattccaccggtttctaagaagatccttcgaatgatagagggagagaatggaatatcaaaaatacataaatatatttcaaagttttattagttttattatattctgttaagtaatggttgttaataaaattattaaagtaactgtcaaactagaagggaggtcttcaaatcacagaacatgtttatgtaatttagtctatgagttaatatttgtgcattgttattgcaggaattttatatgatcaactaataagagttaataactttaaaaataattattataaaattaatataatacttcattcctttcaaataatatttgaaattttgacacatttattaagaaatataattaatattttaaatttcctaaaaattttcatgtaacttattaatatatcattgatttttttaattaattgcttagtaacaattacttccattaaagatataccatagaaaataataattaatacttcatttgttttgtaaagtgataattaactttgaatattgtagaaaaaaataattagctttgaataatatttttggctaaaacttgaaaagaggaaatatatgataatttgtgatgaataatagggtgaaagatctttatatcattaatgcatatattatttgctcatttaataaaaatgtcttatgtttgtaatgacctttcacgaaactaattatttgagtttttctgttttctttcataaaactagtaataaaaacgagaatttattttttaaaattaaattgaattaaatcaaatacacattatttaaagcttattggatatgaaatcttaattatgtagatgtcaaacaaaataaaatcttcaagcaactttcaatgtttttaaactattatttgtaacaaacactttaaaatagattttaagcctacaaaattgagaaatcattacttgtttctattaaattatatttttttaaagtaagccaatattttctcaaaaataattccactaaagtgttattaattatttacacacataaaaattttatgaacataaaagtgtgtaaatctcatttactcgtgtgctccaacacgtgaaatgaaaaaaaaaaaaaaaaacagcccagacgtgatgatgcaaataaaaagagaaacacaggaaccacacgaccctggcctaaattgagaaaaaataaatgtacaaaaatgaaaatagtattttttttgtatgaaaaaaatatagtattattgttctttcttacaaattttcttagtattttatgaagaaattattcaaaacaagtaaatataatttaatgtatttaattaaaagattaaatgcatatatatattcttaaaggggtattaaatgcatttaatattgatgagataagggcaatagatcaaaagagggtattttttaaaaaatttatcaaataggagtaaaatttaaattaatatcctaaaagaaaataattt

SEQ ID NO: 3424 - DNA, 1100 bp, Glycine max
  Soy_ogl_4970 Gm15:10230101..10231200 Cluster 13
aaaatattgaagtataaattgatacaattacagtgtctttatatattatttgtttatatatatactgtgagatgagtattatattagtattcaaatttgggtcaaactaagccttgttaaaatttcagataatgcatatagattaaattaaacatgcatgtttctaacttgtcctagcaccaatcctaagtaggatagtgggagtgattgtatcacccttagcttttagatattttgtgtatgaatgggaatgtaaactgtttatacatatgcacaatgacaactaattgatgtatacttgacgtagcgagttaagcttggatatatattctggagtacttaactatataaatccgaaagataattaataagtacttttttttgaaagggtaataagtaattttatacttaagaaaaaattacaattttatttcattcatgtcaaaacatttttacaaaatcatctatagggtttatcaactaataataatgaaatcctagtaatcaagttcgtattgaattaatagtttgtaagataaataacacactgaaaataagacctaaaacaaaacactgaaaacaaaataagatccccaaaataacgaaattatcacacaatcagtcattcttttcattttatgacataattttttacgagtttttctattaaattaatattttgttcttgaattaattatttaattggcatttttattttatgttttaccaatatttaaattttgtaatcagtgataaaaacaaaatttataaatcattagtaagtaattcctaccgattaaatgaattgttaacattttaaaattaaaatttttaagcacatgaacttttatattttaatttatgttgtattatcataaaaataacaatgaacgtatcaatcaaattaatcctttttaatttatattttttcatgttttttacatttacactagtttaaagttaattgtataattgatatattattatgacgattgacaaactaatttttgttttatagttaaaggtacgtatgataaactggaagacagagtaacatcaacatgtgacattaacatggcgtgtgatgtttgagataatgg

SEQ ID NO: 3425 - DNA, 1018 bp, Glycine max
  Soy_ogl_5643 Gm17:12011601..12012618 Cluster 13
ccagtggtattatggagaaggttaattagtatcctagggtattttttaaaaaaacttaaataattttttttattgaaaaataaaaaattatgttgttggtaatttttttttattcttctataattctctatattaaatatttcttttctttttaattcgttaattaatgtccattaattagtgagacacttcaattattttctatggttttagtgtttcacatacaaattatgacctaatgaaccgtttaatttattatgtcaaatttattttcatatagattttaagtcaggatttatttttatagaatcatattttaaaaaatgtccattttaataaattaagtcacgattaattcacttattaatatatttagagctcagaattaatttttttaatattcaatatatgccttatatctatgcgtgtcttatttatatatttcttgcttttaatgataattatctcacaggttaaaatataaacaaatatttttaaatactataagaataaatcttagtctcggtagtcttatctaacaagattgtcttctgcaaaagaagatatggtttatatatataaaaaaaatcttgataatattttattaactaaaatacacttttactcttttatgtttttattatatttaatttaatctcttttttttttaaaaaaaaaagttcaacttaatttttttatatttttatagttggtcaaaatagtcattttaaaataatgattatttttaaatttgggacacaattttgattttttttacatatttaatatgtaaaatttgtctcattaaatttacatgcataaaaattatagaacctaatatttgaacaaaaaaggtcacaaacacaataaaattcacgtgaaaagtgaatcttagagcaaccaaaaattttaaaaaaataatgacatattctttttattgtttgtgagacacatttttttatgcattttttatcatatttatggtccattttgattggaacatcacttgagtttaata

SEQ ID NO: 3426 - DNA, 1400 bp, Glycine max
  Soy_ogl_6137 Gm18:52509801..52511200 Cluster 13
ataacggactattaataaggctatgtttagtagataatctttttttatctcaaaagatactcattaattaaattaattcgtaagtttttaattatttaacaaattttaattggtttctttaggtttcatccttgattaaccttactgcaaactcacacaacttagacaattaacatttcataatgacaacatggaaaaatctaattaaaaaataaatacaaattcaaaaactcaattaaaaaaatatttagtgacctaattaaaaattatacatcaaattatacagattaatttaatgataatcattttatctataaggataacatgagataattcaccaactattgtataaatacctcatactagctcaaataacatatagagtctctctaatcatatctaggggtattcgaaattaaattaatccaaaataaaaactaaaaactactaaataaaattaaaaaccaaatcaaactgatattgttttagatttgtttgaacaattttatgtataaaccgatttttttggttcagtattctgtttatatttctagaaccaaactaaaccacatataattgtaaacttatgctttccaattattagtgagtagcgaccgtacgatactgagtatgcgttttagtattattatccttttataattttattttttcaataaaagaaaactaaagtaacgaaatctatagagtgctaaacaattttttacaaaattgtagtttgttgtgcataaaaaattatgtgttctcattcttaaatgctcaaacgcattatgattttctcaatcttatttgcttaattatgcgttatgcgaaagtaaatatattatgcatgaaccattgtgaggtcgactcttttattgaacaatagctattgttaaatagataaatttaaaatatttaattttctttttatttaattcatttttaaattttttatattttaacaaatattcaaagttattaatatgtgttcgtaaaatttgtaaatatccgcttaacgaatagccacgtgaataggagatcgatataaaacaaattttcatgtaacaatatgtagtgggaagctaatacttactattttttttatccgactactatttctacatctttagtagttttataaaaaaaattgttattaccattatttgttcaattttcaagcattttaatccttttttttttacaataacccatgaaatatcatgttagacatgacatgtaaattttaaaataactattataaaaattaaaaaaattatcaccataataattcctaattgaataagtgtgaaaaaatgcatttaaattattattatgattattagctacgttcccaacagaatggatagaaattatatttttttgccgacacctcatcaaac

SEQ ID NO: 3427 - DNA, 1100 bp, Glycine max
  Soy_ogl_653 Gm02:44741501..44742600 Cluster 13
aaaataaaagatacataacttaatagtttagcacttataggaaaatatgcaagatgtaatgaaaaccggtagaggaaggagattctttgagaaagagatccagttctggtagcaaagtatagataatgatatttcttttattagaaaatattaattatttgtttgttaatttagattagcagaaaggatgagatattaagataatagtatcttgatagagaggggataagggaggattatctttaaaaaatgggtgggtcttttgatggaagggactttgaaaaattatatatatgaaggttcagtgtatcgtggaaagatatttggatacgtacgtgaccaagggtaagaaaaggagagaaaatggaatggactttatttcgacacaatatttgtgaaaagaagctatgccaatcatatgataagtttaatattattttccttctttatgaaaatataaggaagaggataggagtatgtgacttaaaaagtgaccttgaattcaaattatgagtatgaaaatgtgttaaatatatttttttgacaaaaaaaatatgttaaatatttaaagaaagaattttatcaatcaattaattaatagtgatcttatttaattctattaaaattattactttttgaagaatacacatgtgttttgtacttaaaaaataaaaagggaaacagaatacggctcttaaaaaaataaggaagaggaggatgaggggatagggatcggagaatttagggaggggaaaagatagaaccatggaaaaacaaaaatctatcaatatacctaattaaaatttaatacaagtttctttagatgaaggtaattataaatgagtcaaccaaacttaaaactcaattggagtaatgattaaatttataaaacttaattatcattttatagaaaaatcatttcttttatcagctatagaaaagttattaaagagtgtaaatttgtaaaacataccactaatatcaatggatcttaatttttttttcaatggggtgggttaagttgagttgatttatgagtcacaatccatttgatgattctatagaatattttaaatctatgtaattatttattttaaact

SEQ ID NO: 3428 - DNA, 1297 bp, Glycine max
  Soy_ogl_909 Gm03:36588604..36589900 Cluster 13
ctctgtaatattaaaatctgttttttattgttttgtctttaccatcaggtgtcaatacaaaaatacttcggtcactttatttgatgttgtcatgcaaacattttttgtaatgttacattctaaaggagtcatgtagacgtatttgtaacaaataaagaaaacagaaagatttaatttaaatattacaaggataataaaaataaaaataaaacattcccaagaactaaaagcaaaaaattatataacttagggatggttatagtagaattgggctcaaagactttaagtaaaaaatttcattcatcaaaaagtttcaatatcacttaagaatgagattaaggtagtttataaactccctcatctcttggttcactaagacatatttcaataaaaataaaatcctgatggatcaccaaatatcaaaatagataataccacaataatataactctaatgatgtttgaatatttaaggtcaaaacatggtaaaagaaaaatctatatcattcttatctcttaacctcaactaaggctttattatgataaactcaagattttcaaatcgctttaatgatacagtgataaaagaaaggattgaatatttattgagacaatcctcgatcacagacctttaattgaatggatgaaatttgttggtccatcatttcatcttatacactcttaattgaaaaatataggaaatagtaacaccgaattttgattttaaacaattattatttaaaaaatgcgaaagtataactttatagcgactcaactaggtgacgttaacgaaaccaaaagaactttatgccatcaatttgaattcccggcgtgggctctgtacacagttttctgcaaaagtatcacccagaaatgacaaattaaagaatccccttagagggtgcaatttaggagaatataaaggaaaacaatgattgcagttctgatcaccatctttgtcctagatatcaagttaattgaatttggctaaagaggatgaaaaaacatgtgtatacatgtaatttagaacgcggtgcattgcatgcatttcaatagtaccatgatgattcgtaaaataaaaaattcattgatacacctccattttcaaaaaaaaaaaaaaaaaaacattccattaatcaattggccatgagatatataaaccacccttattgatttagggtgaacctaaaattaaagatttaatcgtcctatgttcggcctatttagccgaacgagaattgttattatgatacaattttttttaatatattttctctcatggattaaaacttataaaa

SEQ ID NO: 3429 - DNA, 1000 bp, Glycine max
  Soy_ogl_3488 Gm10:40897901..40898900 Cluster 13
taaattactaaatgatttaaaatcattacaaaatatatattttctaaaataatttgatcattaagtataaattataaaaaatcacacctgtgagttatgatagtttaaaattattaataagtgatttaaaattatcacaaaatgaatattttcttaaaaaaatgatttgtttttaaaaattaaataactaaatttaacataaaaaaatagatgactaaattgaattggttttaagaattagaggaataaattggaaaaaaaaattaaaggatcaaattgaattaaaaaataaattaaagaaataaaaaaattaatttaactttttttttatttctatgcaaaatgcaattctactggtcaaatgagataatttgaactagtaaggggaaggaaattttgaagggggaaataatgtcgagaagaattttttttgtggactcttactctctttattgtattctcatttcatgctccttgtaattgaaaaaagaaaaacttcaataaaaaaaaatctaatgaccaagacaagagagagataagggtagaagtaatttaataaattttctttttgaagaataaaagagatgaaattagtttccacaattaaaaataatataataaatagataaatttttgtaataatattcttgacatgtaaatacatacacattttagaagaattttttttaaaacaacttaaactaaatgtgtatttaaaacaaataatgtcacctcatctgaactttttataaaatgggtctaaaatagtactaaactttttttatgtaataatacacaactttaaaataataaagctccgcactcagtcatgattcctggaaagaaagtttttttgtacaaaattaatgcatttgtggcgcacacgggctaagtctttgtagtttaatttcctgaaaccttcctagtcaaaagctgctgcatattgtgcttgctcccagtcattgatgctgataattatttttccaaaataagtcttccc

SEQ ID NO: 3430 - DNA, 1200 bp, Glycine max
  Soy_ogl_4434 Gm13:33679501..33680700 Cluster 13
cattatgaaataaaaatataaaatatcactaaaaactacttattatgtctagaaaaaaaaaactcattccataagtaattggaaatatctagtagaatgtattaatttttcttcaatatccatataaatacatcagaaaaaatgttatttttaatattcttttgccaattcaattctttaacttttgttttttaaatcaggttatttacgactctttcatttaagtactaataataaataaataaaaattatatatacatgtgacatgataatttgttaaattcttgtcttaacagccaaatacttgcggtcatcaatgactttcaagtatgatggctttaatttatgtgatcaacttatcatattagttatcttgcggtcatcaatgacttgtatcctttaacacattatattcaacttttaattgagacttgcctccaacgcattagattagacagaacaagcaacccatctaattatcttttgtcgggacaaatatctagtgtattgaagtgttagccttgttgaaatcacttacatgaaaattttatggccttgtttttttttaaaaaaaatatatatacatgagttattgaagtggtgatagctcatattgtggtggtcctaacaatagcaataataaggaccccaatagtagttgtgaattatgatgattgtgagttgtgaccgtggttcacagtatagcggaactaaaaatagacaatttatagaattaaaaaaatgtaagtaatttagaagatttacaaattatttacacggactttttctatttatttctgtctatgaaagtaggaataaatcttttttaacttttattctcacataaatattctaaaaattcttttcgatcgaatgaatgatttcattttttattaaatatgaaaaaaatgttatttttttattggcaagcgtgatttttttatgctgtggaaatacaataacagaaagaaagcaactaagaacctagttgtacctgataaataaggttcttagaacatcagctattaacataagtttcagtcagtctagcaggacatgcatgatttttgaatcatatttgagactataacaaggcagtttgatcattaatctagttatgaaactaaatcaagtgccataatcggtattgattgtccgatttatagttatggagagattagtctgacaaattacccatat

SEQ ID NO: 3431 - DNA, 1329 bp, Glycine max
  Soy_ogl_4789 Gm14:46609672..46611000 Cluster 13
gcatattctactagtaattaagtatttctttgaaataatactaattgcataatgaattttcaaatcattgaataaataaattatctaaaattattgaaaatttaaaaaccatatagtgttaatgtttaagctgtacctagtaaaaaaattattaaaattgtaagatttgcgatgctttaataattgaaaatctaaaaaaaaaaaaacatgtgttgttaatgcaagacttaacaaccaaatcaattttaagatgccaacaaaaggcccaaagtcgcaaaacccatttcaaaaggcaaaaccccagttatgcacaataaattgaaaaagaaagacacttgcgttgtcaaaccaagttatcttgagatggttttatcttgtgtagtgtatttctcctgcactcactaatacatgttaacagggatcgaaggttttcaaggtagatattagtattacttttctaacaattatcattcttccacctgcacttgttagttaattagaatattttgtgttttccctaatttttttaataaataaggttttttgcttgtcaattatactaaataatacactattcttttagttatatcctatctccaatttctctttttggtttatattcattgatgtgatccttgctcagataagtgtgaaatttcctatttaattattccaccattcaaaagttcaatatagataatggcttatgttgacatataactcatttcgtttactcttgcaaaatctatacttaacgtcattccagttttcacttttgtactcactctcattttcaagttgtgcattttctgtgttgattgagaattcaaaataatctacaaatcattagacattaggactttgtggatgtttgtttcttaaataatttggagtgtggtgcttaacctttaactaaaccaaaataaaatatttttcttcgtaaagtcttataaatatgatatgattttgtctgagagagatagaattttaactagtcgatcctacaatcattcatggcgtggccttatttgataaaattgtgttttcctccttccatttggattctagatcatgtgttattcaaaactaggaatgcaatcaaatgcccttgagcagacactttttcccttataatgaaggctgcttaaacatgactactttattatatattaaattcttttaatatatacattttggtgctttggtttgatacaatattatttatattcaaataggagacctagtcatggacaataccaatcaactaaggaaaatagtggtagaaaatataggtggttgttgtttccacatatgtccaacatctatttt

SEQ ID NO: 3432 - DNA, 1200 bp, Glycine max
  Soy_ogl_912 Gm03:36725701..36726900 Cluster 13
ttttaattttttaaatgattatatataactaaggtgtaaattcacttttgattcatcaattaaacaattttgatatctaaaaaattttataacacatttgtcaaaaaatttggttcatgtaatttggcttaaatttcttacaaaaaaaattgttttacttttaataattttttcaaaaaagacattcttaccataaattaatgaacgtgtgtgaaagtaaaaagagtaaattgcattgatactttctataaaaaaatagattgcacgcgacatttttttttttgttatactaacctcttaattttttgaaaaatattaatgttaaccctttcattcgttatactttaatctttcttaattgtttgaaaagcgttgcatcgtatatctcaacgattgagattgctgtaaatgtaaaaatggaaagaaaagaatatcatgtacaatttagaaaaaattcaagaaatttcattataaatttaatcagagtaaacttattagcgaaaaaataacatgataggctgaaatctaactcaattaaggaatcccttaaaaaacctcaataaaggaataacacgtgttagtaggggacattgttttgaataaaaaatagaaaatagtagaaaagtgacaagtgaagcattaagcaatgataagtgcaataacagtacgttgcttaatgttttttttaatagaaaatccatgacaaattccatgtttcatgtgatgatgtgctgcttctggggacaaacattagtgactgagctttttttggcttctttatcccacctgtgcattgacaccattgttatctttatcctcagactgaccagtatttaaactattattctttaagaaattatcgtttaatttaaacacttttaatacagtttaacttttgacaacaaaatcagggcaacgaatgatacattataattataatcgaaaaagcggtataggaaatattattaagagtttgtttgattggttattgtagttaattttttttaattatttgaatattttacaaatatatttaattaaaaatgtttaataaataaatttatttcatcaatttatagttttcttttattttacttgaagagttcaagtaatatattggtatactaacattatgtggttctgagtagaattaaatctgatttttttttctcgtaaagtttatagtatattcatattttt

SEQ ID NO: 3433 - DNA, 1000 bp, Glycine max
  Soy_ogl_1550 Gm05:2369801..2370800 Cluster 13
gagacttatattctcgtatcagcagatgctttttttttccttgtcatcttccgtctattaggacagagactaatattatttgtaatattatgatcagaggtgaaggcaggattatgaggggagcccaaaaaaaattattttacaaagcatatttaaatttcccatgtatgacaaatactatatgtaagaaattttttttgttggtagagaaaaatttagagtaaaaataatgtttcagtcaaaagtaggaaaagtttctcacagagcatttacaaatgtactcatttataattgtattcggtataagggatatactaacaaacaagtattattaatacaaaaacacccgataaccaataaaaatataaaattatagaaaataacaacaataataattaaacttcaattaagtttaatgaaaagaaaatttcattatatatatagtcaaagtatattgttttggaattttaaaaaaagataaatgagtcacacaagaaaaaaaattacttgaataaattaactacacataagcatgttattaataaaacattagcaagaaaacaaattattaataaatacaaagctcgtgtaaaaataaataaatataaagctataaacctaacaaattaatttatcattaactaacttttctattaataaaaataggagacagaatgttctaattgatttactcaatgttctcatgattaagaatgcaaaacttttttttttggtaagagtgagccttgcattttctttttttgtatttgtaatgggtggggaaaagcagaaagcataaataagatagaaggtcaagccttctaagtgaagggtgagaaaaggatgatcgtaaactatttaattttaagaggtggccataaactaataaattttatgtataacagtaatccttgacgagatttacatttaaaaaaaaaaaaggatttacttaaaggccacgtcacaactcaacaataccacattatcttgggttaaattc

SEQ ID NO: 3434 - DNA, 1161 bp, Glycine max
  Soy_ogl_5194 Gm15:50433540..50434700 Cluster 13
atcagtctattatacgcatgaagatataagattggtttagtagtgaaaaagaaggaaaaagaaaaaatttatcgattcaaattctctcaataacaaaaattaacaataataataattaacccaaatgaatgtaagaattaatcataacttgatcattattgaaatgaaaatcccatagtgacataaatatgtggttcagttacaaagaccaacaacaacaaaaaattaattaagtaatatatgttatataaaataggattaatttagttattacacacgaaatacacgtacatgtacctatcctcaatccatcaaactcaaggcggaggcgaggtgatacccccatgtgggaatttgtttgtcacgcatgcttacttataaaactcttcaaattattcggacttatcatttcaatttttctacttgtttgctttccacctaattaatgtgcccttgttacttctcaaattctcataagagaaagcatgaatttatcttattaatttataatatctattatttattgactgcaaaaactaaagtaattaagagtatttttaaaaaataatacaagagttgatttaaaagaaatcttatagaaaagacaaatcaatttcaaaaaataatattatatataggaaccaacataataatattattttataattctttttataatgttatttttatctcttctaattaatcatatcatacatcgttttcttctctttttgtttccgtcttcagtgtacaaggaaattatacacgtactatttttaattccttgaatgttcccatcttcaagttttatattttatttttgcaataattaaggttttacaatttaatttgttttaaaatatatatataacattaagttaattattgtaagtttttattttaaactcattgatcaaaatcatcaccttgaatttcagaaatttaagatataattattaaatcatgttcaagaactagagacggaccaactcatttatattaatttttctctatataagaatttagtacatagtgtggggaaactagggaagagatcgaatgatagaaagcaagatataatgaagataaccaggcatgtttataatctaaagttacatgaaaaatagggcatgtgcctcattaccatgatctataacgaag

SEQ ID NO: 3435 - DNA, 1400 bp, Glycine max
  Soy_ogl_5257 Gm16:2450201..2451600 Cluster 13
ttatttttcgtgaaagatatatgtgatttaatttgtgaagaagaaaaaaaatacattatataataatatgtaatagcatctgaaacattaagcgagtgtttcatagcagtttatttttcataaataattacttttctttttcaaaaattctttcaaaaagttaataaaaattagtagttatttctttaaaataaactaaccaaacatacactaagaactttaaagattaaagaataaacttttttcaatgtcatggaatgaagatgaaacatgaaaattctcgttattgagaatgagtattatattacattataagtgggtgtttggatacccatccttcaacaaatatatccataatggatgctgaaaagtgaaataacttttcaagattgctatacatatacaagaatgtgaaataattgaatactgagaaggcaaatgtaaaaagatcgaatacctatgtaaccgagtttgaagaagcttgaatcaaatgaatacttttaacaattttgaaccattagtgaaattcttggtgagtgatgcagtcttggttcaagatgaatcaatataaatttcttttgttatctttccatcttattttttatttggtattgaataccaaagaaagaagaaaactgatgtgaacttattttgagaaaaatctttttatagaggccagacgatttattcgtcctgtgtgaatacatttttgaaatgaatttacttaaaaaaataattaaaacgcaattcaacttcttgtgttttgacctatatatgtcttacattaatccttaagcctatggagatgaagaaactgaattgctgttagttagttagtcagtcaattatatatagccatttcaacaaattagttacgcttacaccttgtagatcgaaaagaactttgatgaaccattttaataagaataacttattatcagattcttatttctctgctttttctctaattaagttcatcaagttcttgacaaaccaagtctcatttgccaagcacacgcactttcgagtgttgattcaatttcaaaaaacaaagctaactcgatatgtcatgcatataactgtcaaatactaacaaaataagtggattctttcattatatatatatagatatcccaatgcactcaaactgtattccaacatatacaaaatatataattgcaaaaaacacgtccaattattcaaaatgttcttactatctttcgtctgttctttgaacacgtacataattgactgtaattagtcattaaagtacttaattactaaagcttaaaaaaagttataaataaataacacatgaaaggacaacaattttaagtgagagaatgagggagtatggggtctgtccactcattacccctcaggtgccactgaccacagcc

SEQ ID NO: 3436 - DNA, 1263 bp, Glycine max
  Soy_ogl_487 Gm02:11007438..11008700 Cluster 13
ttattttaaaacaaaatatgaagatattcaattaaaggaaaaagtgtttaaaattcttaattcaaacactaccaaactagtgtgaagttattttgacttaaccaataattttgaattcaactcctgtacatgtgtgataagtactcaaagacaaaataataatacttgtaggtcataccaaacaaattcttaattcaaacttccaaggtgatatattaaattttaattacataaaaaatttacacgaaataaataatcaatattgtctctaaaatattatcatctctcttaaatagtccataaaataataaactatttaagtaattctcaaaagtattaaacctccatcactatcatttctaagttaatatatttcaataagaacaaaagtcaaataaatttttatagttatttttggtcgtgttctccaattaggaatattagagttaatctccatagtctatgttaaacctttattaagaatatattattaaggaaacactctagttcattggaaaacagcaaagtactcataattaaaattatctgcatttaagtttgatctttttaagtaaaattcaatgagcaatttgaatgattttttttttaaaaaaaatgtatgattcatacaaaaattaaaaacaatttatacaatcatttttcgtctttacgtctctccatcatattttatagtttcctttttttctctttctcttagtcatataaaatttactatgcaaataacatttctcttaagatttagaggactactcataatttttcatttattattagtatctttcaaaaggacaaataacaaatgaaaaaatttattgacaaataatattaaattttttaggaactaaaaaatatcatggatcatacaaaaattattttatcaaagagaaaaaaattactaaaaaataaatataaaatttggacatttattaattaaatatgaaaaacatattatactcttttcacttttagataggtttatatactaaatactatttacatacttatgagaaccctaacttttctaatatatttttcttcattaggatgtttcttaattgcatctgaaatttatgcctgttcaacgaaaagaaaaatgcatgtgatccctgaattctgtacttattatttttttttcttgaattctttaatcttgtaattggcaagatcatgtaccagttccttcaaattgagaccctaaaccttataaacacaaaatccaatcctaagaaatagtgaagcttc

SEQ ID NO: 3437 - DNA, 1400 bp, Glycine max
  Soy_ogl_1291 Gm04:8068201..8069600 Cluster 13
gtgcttttgcgattgtagaatgtgaatcctgttagtggaaaattgaagggtagagatgcggcattgcaaagctatgctttctcatattgtataatttgttgtttattatattaaaaagcacaagcagtgcagatataaaaaaacaaatcagcccattaaaaaataccgtgttttaacaaatacatgtacccattcttgtactcattcccatgactatgtggataatccacatcctatgcgcatacatataaaatataaaaaaaaaattatgcaaaatgtatttgaaattttagtttagtaaaaatataaattaatatacaaaatgtataatcatccaaaacttttaaaatacaaggattaaaaattaaatttaattgatgaaagatataattacaattttaacatatatctatacatttaacgttgataaaaaagtttgagtgttaactaaaataattttaaaaataaaagaaatttgactgaataatcaattaaaatcttactatactaatctttattctaatttatagtttgtagtaaattaattttttttatttggataatcaattaaaaaatctaaaaagaagggaaatatagttcgcaacaaatcgtacgggtctaaattaaggctaatatgacgatttaatttattcacaaaaaaattgtaatttaatttttatataattaagacagttaagtttaacataattagagccttataagtagttgaatgaccatttgttaattaattatgatatgtaatttgttcattaattattataagtaccaaaaaaaatgtttaatatcatatattagtaaaaaaactatacatttacaagtatttaagaatacatataaaacatggaaaatacatatttaattgatgagcaaggtaacaattatgaatgtaaaatttgtaagagaagagcacggaaaacaaatgaacattctcagtataggttggtatgagtttctcgtcacaataactataaatcattcttaacatataattaagaaaatatttatatatttaaaatgtcttataaaaatattagtaaataatgtttacttaagcatgacatatgacacaggtggtacactttaatttaatacaggagcattttgacggacaaaaaataaattcagaagaatattatctatttagggtgttgaaaacctatcaaagccaaaatgcttgtccgtaagaaagacatgacaatacttgaatatttaccttttgtagatttcactcttcactggatgctaatcatctccaaatacactctaagtattaaacataaaatagtcctgacaaaccataattatctcctgttttttcatgagttcacaacctagattaacaagtctctcaagtttttcggacttgacttcaataatat

SEQ ID NO: 3438 - DNA, 1180 bp, Glycine max
  Soy_ogl_2542 Gm08:7529301..7530480 Cluster 13
gatatttgtagtctttgttattattgatatttatagtctttgctacttttgaggccatttattgacattttatgttatttatagtctttgttattatttaagtcttacaaacaaaaaggactttccgaatttgtgtgtggattgctttcaatatttgaagttaggttaaaataaaattttaatcttttaatatattttaggttttaatttggtatctaaagtttataaagttttactttaatttcttagtttctcagtttgatgaaagtgatcttttcattagcttaattatgatattaatttgatcaatttggtgacacttaccaaaatgtgagatatgtcacgttagttaaatttgacactgttaatttgatcttacaatacaacatttgttctaattgaaatactataagtagaaaagtaaattttttaaatattagatactaaattaattgaaacttagaatatagataaggatcaaaattttattttagtcttaaatttatttctaatagcatatcattttaaaaatcattaggatgataatattatttaaattttatataaaaaatgaagatttgatgattttgcttgatctttcctaagtacatgactatagtaaaaagtatttctaaagtaaaaaaaaaagtaaattagtgaggatataaatgaaaaaaaaaattataagttataaagtagttataagttactgcatgcaataatttagcataaagagttattcttctgtacgtaaaaacatcgaatataatcatctaatttgagtttttgttaaaagaaatatatgttgagacttagcgaagttaattttgtaaatagatttcatcatcgattgtatgaaacattgtgttcaattttttcaacaatcaatttggcaaggagccatggatgttgagttactgaatcacatcatcgattcaatactcatcgaatatattgaactgaatttatattaaatatgaaatgaatatatttaaaatgaaattgaatgagcaaaaatgtgacttctaatttcattccgcgcaagctgaattaaactgaaggttataaaaaaaactgccatgacaaatgtatcaaaaaatatttatttttatatgattataattataattagtaataaaaaatatttttagttttataaaataaattataattaatattt

SEQ ID NO: 3439 - DNA, 1420 bp, Glycine max
  Soy_ogl_3456 Gm10:39440694..39442113 Cluster 13
cccacatagcctaaaactcagaaataagtctcgaatagtaagataataaagaaaatgaaaaaaaaaaactaggaagaatatatatcgaaaattctatgacataataaaaaaatgaatttacaaataaatcccaagtggttagtagagataggccgaactttgaaaatatattagtatgttatattttatcttttgaattgtaaccttgagttaaaagctaaaatgtcttcttagtggaactttttaagagatgtaagtaaaattcttcaccagcgattttctttatgctatttctctataacataaagttatgtgtggatcagttaaaaataatttgttaaaaatataatactaaacaggaaaagaagaataacacaaaacaaaaatacaaatgaaaaaaataattctttatcatttattttgtttttgacaaataatgaataacataagtaaaataacataaaatttattaaaatacttaatattaattatcttaatacaacttatattaagtttaatatgtttattgaaataaaaagagagaggttataatatataaaaaatccaatattttccttttaaaatgattactttagttactatttttttggttattaaagaaataaaaatagagatacatgtgtttttttagtattctttttaatattttgtacctaggacaaaaaattatccaatgattttctgagtaactaaaattagagattttatcatatcctcatctacttgatttttttatcttctattttctttttttaaatcaaatataaaataaaaatatttattatatctaatatcataattttaacaaatcaaacagactttccatgtatcaaatttgatactagcaagcttaacatctgcaaaaccgtcaaatctaggtaattaataatacaatactaaatcaagttttttctttaagtgaacaatactaaatcaagttaggtaataacaatatcattttcctttttaagtatttaacattgtatactcaaaacttaaatttaaaaaaatattgattaagttaaaatagttttgtgctagttaattcatgcccctcaagaacttaattcaatttgacaagtatattttcactcaatgaggttatttatcttgttttcaaatccaataaatcacaatataattgtactattaatttactttttaatgtttgtgacttatgatgatgaatttcacggggggcagaataggatgtgccgtgggctctgatccgatccataccgaatgatcttggtctatattacatatcaacctaaagtcttcctctttcatactatatatcaatgttgttttttttttgtcaaaattactgaaaattacatacattttcttttactttcggtctttccccaaatttggtaacttctatgaagtttcccct

SEQ ID NO: 3440 - DNA, 1189 bp, Glycine max
  Soy_ogl_4388 Gm13:31494112..31495300 Cluster 13
cacttgttgaataaatacttgattaagctatttactcaaacccacctaacaccttattaggtttagagatactcatttttcttgtggcaacgtaatcaatgaatttggttaaatggctagagctgaaaagtgaacatgcatgaaaatgattggcagtggctatttgctatttcgggactttattcaactaggtcatcatccgcaggtaatattttaacgataatcaattatgatcactgagaaatgatagcttctttcaaaagttatagatcatataatttctacctggcgctcgatttgattttttttcttcttctgtttttatttttaaataaaacagaaaataaaaatgaaatacatgttgtttcaaatttagattttttttttaaaaaatatactcaaaactaaaaatagcaaatcatcattgtttctaatcttttctataaaggtaaaaacgccatcatatctgaaatattttctactcgatacacgtttttaaatattaacaattttaaaataaaaaaataaaaaaataaaataaacatatagaccaagtaatttgataactttttagtttgatatgtgtgcctttaaagtaataaggtgatattcaaattaaatgagattattgatacaattacaatttcggatctcaaaagaattatatcatagacttggatttctacaaaagttgcatatgcttttctttgtaaattgtatatcatcttttctttaatttatcatgtaagttagcttgtaagaaataattctgtatcaagactgagttttaaaaaagtacctattcatcttcaatatcacacaattgtgtttgtctaattaaaagttatgcttttttttaagcaattaaaaaaatataggaacaaacctttgatgaaataaaataataggaacaaaccactctaccaaagtccataacgattatcgagtatgttattgttacgtgacagattttggcaaaagtttattttaatttttttttcttttctacttttctacactaagaaaacatcactgtcatcatcttaatatacaataaaacattacaatcttgtgttatataacatatccaaattaatgtggccggggttgcttaacacgtacttgctttatcgttttttacgtgcactgagtccaattttcgtgttagaatttttttataagacataga

SEQ ID NO: 3441 - DNA, 1082 bp, Glycine max
  Soy_ogl_2651 Gm08:13325319..13326400 Cluster 13
tttataagtttcttaaagttaaaagtaaaataggtcaaattaatttattgagaataaaatttatcaaaaattaaaaaattgagagtaaaaaataccattaaatcaaacttatataaatttaataaagttgtttaatgggaaacaattttttatatagtcacgagagcaggcatgtatttttaaggagacatgtgtggctcagcaaatcacatgagtcatctaacaacagctgaatggtgtgtttgataactgaatcttgtgtttgattgagagaaaagaaataatattgaaaaaaaattggaattataatttttatattttaattttaaaaaaattatgtgatttcatcctttaaatcaaacataagtaagtttttttttaaagaaaaaaagagtaagtgttgtgagttgctcaaaataattttatagtggattttaaattcgttccttgtacgaggtgtttaaattatatatttttatatttatatttatttaatttttaaaaatatatctatagtgtacaattattaatttttaaataatattatagtaaattgagcaagatgattaattatatttttaaataaataaatattaattttatgaattttttaataatttattcttctactaactaaataatgatgatgcaatacttacataaaaatataaatgtaaaaaattataaacataaaaaataagaatatataatacaccattatttaaatttaggtgctatatttttttattgtggatattatgataacatgtatttgattttttttgtttataattaataattttaagtttatagtagaaggaaaaatttattttaaatttgttgaaattatgtgattttggcttaaatatgtttttaatggaggtaaaataacttttttaaaattactatctaaactgattgcagtccctgaaaccagcctgggaggaatgcaaggttccctggggcttcatgggaggcagatggcactttttccgaacaactcacttgctacgacgagctgtaccaaaaaactaagtttcagggaagaaatttcaatcactggttcttgtgctcttgggata

SEQ ID NO: 3442 - DNA, 1025 bp, Glycine max
  Soy_ogl_3022 Gm09:5824233..5825257 Cluster 13
ccattaagtgatgatataacaaattaacagaagattacatcattcattaagtaattatgtaataaactaacaaaatattatatcattatttaacatatttatactaacgataaatatgaaaaataaaaatataaaaatatgatgtagtaaaaaacaaaaggtagtaaattgaaaaaaaatgaaaaaattattattaattggatgtagtaggtgaaagacaaacttactttcaagtgccttgtcccttgggaatatatgacaggtcaggtcactctctgtactctgcactgacaacttcccaagaagcataaattaggcccatggaaccaatgcctatgctccattaagcccgtgatactatataaagtggatttaatccccctgcgaaagtttatatacgcttttttttttttatactcagaatattgattatttaaagataattaattatagtgtcttgatttttaatatagggttttttaaaaaaattgtttttttaatttttagatgtattaattattttttcatgcattctcttaattattttttcttcaaatattaatgaaaaataattaaataaatataaatctaagaaaatgataattttaaaacaataatataaataattgctaaatttaatatgattaactaaactaattatttttaaaaaaaagattaaattagttaaaaagtcttataactaaagacaaaaaagaataatacaatattaattaagttaatattatttaaattattatatatataaaacttatcattttatacttacgatattaattactaaatgttttgaaatttaaaggtcagaacacattaaaaagcaaaagaataaacagtctaaggttatatgaagaatataagcacaattaccttgacattcaaacaacataaaataaagaatttatcacgtttttgcctcagatgaagaaaagttaagagaatataataatagcaggtttatatgatgttaattaaaaaatagaaaataataatacatgtattatcta

SEQ ID NO: 3443 - DNA, 1276 bp, Glycine max
  Soy_ogl_1959 Gm06:15446301..15447576 Cluster 13
gatcaagttattatcaaaggacacgaaaataaaagccaccactaactaacaacatttgagataagttattaaccgaacatatacgaaaaagcttttaagggactgtgaacacatgattgtggtttgtgaaaataatagccattgtgcttgctaaacatattatttatgatttgagtagggacgtctaacaatcacataaaactaaagctcattattaattaacgtgccacattctttgttaaaatgtttagagaatttttttccatctaatttttcaaaataccgttaatgttttgtatgaattttctcatttccttgttcacttgattataaagtcattaatcatttaattttcttgcaaaactatttttatgattttgaaaactttctatttaatgtaataactctaatggttattataattgtttacatgacttacatgattgatgcttgataatgatgattagacattcacttttagtttatctattcagaaaatagctctaaaataaatctaaaccattaatatcataaaagttaccacagatatttattatgctcttttcatcactaaataaagtactaataaagatgggatttttaggcaagtgaaaagaaaaacaaatttaccagcttattattttttttaagaagcaaatttaccagctagtcactatcaaagtgagaagatatataaatagttattttcagttatctatgcgttaagtatatttttaatataaatttcaaattaaataaatagttgagattaatagaaatacaaaaatttaaagattaaaacatattattcacttaatacggtgaatatatacgtagatacacttaacttttatacgtctaatacaaataataactattatattataataaaattacgaagtcaccaaaagtaataataagattacgaggaaaaaagataatggagccaaaaacacattttttttaaaaaaataaattttttggaaaactttactttcagcatccctcggtttcatggagccttagacggacggacctttgaaaggccttccggcaacatcacccattaaattctaaggcccaaacttttcaatttttgaataacttgttcatgtaatttttttcataagttgtatcaattgcaatttttccggtatcataaattttaagggttacttttgtttatccatctttttccctctttattttaaattttaaccacgtacaagttttggtatttcatctatcttgaggaaggagagggatggatttttgt

SEQ ID NO: 3444 - DNA, 1300 bp, Glycine max
  Soy_ogl_493 Gm02:11510501..11511800 Cluster 13
ttttctctaattataaaaaatagtagtatttatttaagtttgattgcatttttcttccagtttctcttcttgtatttccttttcttctgtttttacttaaactgaagggtagaagcttaagagaaggaaacattgtctcaactcattaagcaatacatattaaaagcgtgagaaagcatcaaccaattgcacttttaaatcggtcacataaaaaactttattactatctccctctccctgtgttcctttataattatcttttaagattattatgtaaaaattaagaaatacaatattcgttttattcaaataaaataattataggattttatattttatttcttttttacactctacaataatacatgtataaattaattacaaattataacaaaaaagtaaaaatataattattctgatctttaactttacaaatgacatgttaataaacttttaaacataaaaataaaaatttatacaaaatttatgttttatactcaggtatataaaaaagttattattcaaataatgaagatatatatttctattaaaagaaaataaaatattataattttagtatgtaagtcttaaacattatttaacattcatatttttatgtattattcaaaatttaataatcaattcatccgtggatgcacgggtaacaaactttagttgtgttcattcatggttttgtgatgtgaagtaaagtaaaatattgtgtttaattcttgcaagacacaagtactcatttgtatatttgtcagtacatgatttggataggtgtttggtttgtctttcatgaccaagcctccctccctttctttctttcatttttttccccttttcttcatgcatgtataattgatattaccaaaaaaagaatgctcatgtataattgtcaaaatacaaaatattgttaattaatttattatatgcattaattttacacgatgggttagatcttaccacgtaaatttatctccctcttttggaaaaccacgacatctgtattcgtatgttattccttaatttcattttttatttttaaaaattgtgcatatatttttttaattggcgatcgagtctcacaatatttttataaatgacaaagcaaagaatgaattcttttgaaaaaaaagtgtttatataaaaaatattagttaaaaatgtcaatgtaattatatcaaaattttactccattttgtcttatttgacaacaaaatatgctttataacatgcatatagatggataggtgctttgctttggtaggtaaaaaaataatagcatcacattaca

SEQ ID NO: 3445 - DNA, 1274 bp, Glycine max
  Soy_ogl_6188 Gm18:55681127..55682400 Cluster 13
ttacaaacttataagctactcgtataaaaactagttgaaatattacaaatttaacgtaaaaaggtaatttaagatttataaaatataaattagtgaaataaattgatttatcaaacactttcatttacccgtatgtatgtactaaataatcaaataactaattcataaattaatcaaatagatcaaaagttaacttatttctcatgtaaaagtttttggcacaacaaggcttcaaagttgaccacaatgtagggtaatattttgacttcaactaaaagtacatgatgatctgatctgattggaggagcttgaagagccgaatattggaacttggaagacgttaagatcatgtatttcatcaacgtacctacccaaaagagtttatattttccctttctccaattgtttttttttattgttgcaaaacattccgtggcgtagttttaaaatattttcttaaaatattctttttgtaaattgatcaactcgccctatgggtctgtcgttggtagtaaaactgtgaaaattgttatatttccacaaaatattatttaattttctccttaaatttgataaataaatattaaatttaagacacaaaatgaatttaacagcatcaaaaggattaaaaatgtagtgattttttttatttaacaaatatgtaaattatacattatgatgacttagaattattgaaagaaacaaacggtttatgttttgtttgaagattttttttcctcctaaaagtaaaatatcttcatagccataaattataaggttaatctcctaagaggtggagtcatcgaagtgaattttatttctttaaacaaagtcggccaatatgttttagaaatttcactatctactaattaattacattataccatgttggtatggtgaggaaatatctttttaatttcatgttttcacacataatcataaaaaaaacatttttttttattttattttgtatttttgaaatatttgtaaaggaaaaaaagtcctatatctccagcgaaaagtgaattcttctgagtattaattatgtcttactatcaacccatataattggcattaaggagtattattttaaaaataaatttcaaatgactattttatatatttttttagagatcaaattaaattagaatttttatgaataacaatttttttgttgtaaatattccagtacatgttaaagacttgaattccatactgttaagttaaaataatttgtgtgtgatttaatttatgttattgactattgcacattc

SEQ ID NO: 3446 - DNA, 1258 bp, Glycine max
  Soy_ogl_1790 Gm06:5129843..5131100 Cluster 13
catttacaaaaaaaacctaaaaatcaatcattaacaaaataaaatcaaaaaatattccacactaataacatgattaataaaaaaatctatcaattatatcacatagaaaaatttaatgtttatagactgataatcataaatcaatgtttgatgaattactactaaaaataagtaatcttctaaaaaaataaaaaataaatgataataaaactataaagattataataaatgtcacaatatttaatgcattgataacattatcggcttgtttgtataagaggaaacagaatcaagagataaaatgcaaaattgtcttttatgctctacttggattaaaaatgacaaaagaaaaggcaaaatagagtataaaagtatgtaatcttgatatataaaaataagaaagaaaaagtatcttttaagtattcgaatgagtggaaaaattggtgaaaaataaatagattgtatctaaaaaaattctcatgctaattacaataaattaactcaaaaaatattaaaaaaaattactgtattattttaacgtaacataaagtaatttattgtttttacgttataaaaactgttctttttttttttcacaaagaaaagcagaaaaatgtcatacttctatccccctgccaccttcgtggctcaataaagaggaaaaaattacatgcacgagacaacaacatcacttatttccttcctgtttttcttctaaagaaaaacttaaaattagatatttctgtcatatttccctcttctcgagtctttctcccctaaacacacccaagcatatacattgttacggttacggtaatgcacaatactcaatattatttacacaaattatcacgacagaaatatttttctttgataaaattaccctaattagaagagttgaaatgtaattgtgaattcatttttatttagtagagataccaataaataagttgtcattgaaaacaaaattaatattttttaattgtttgaattggtaaatattcgttataaattaaaaatctaaaagtcatataatatggggtggaaggaaaatatattttagtagaattttctattttaatttttaattccaacaaaaaatatattttgagaattttttagtttttctttttattcatgaactatgcaagtatctttctttggtgacttgaagaattcgagctttatttcccacaacaatgaatgacacccttacaagaattcattaactagtacatgatctaaaattaaatgcgcc

SEQ ID NO: 3447 - DNA, 1003 bp, Glycine max
  Soy_ogl_1970 Gm06:15744098..15745100 Cluster 13
gtcaatcacggatccaggaagaactcttcattaaattttattattgtattggagcttggccagaagaatccttttgacatgatgaatcctgaagcctagggtatagacactaatacatcatgaagttctttttacacacactcaaatattcatgtatgtatgttatgtaaccttggaggaaccttcttttttttgtttcttaagatttagtaaatgggcacttcacaaatggctgaaagttttggtcttttgctttaatcattattattaggaaaaccgtcttgacagtaaactatatatgctttactttcaaatctttcatgatggttccaggaatattggcaattaattaatttggtttggtggtaaaaatcacgaagcaagtactttgaagaatattgaagacattggaagaagagtaactgtcaagtacttatctagaactaattaacattttttctttgacagatgttcatattttttattatatgttaaattaataaaaccatgcgagataagctcttaatcagtttattataaggattttaagattaatttaagttggtaatcaactctatctcttaaaactatagttgttaatattggatcgatgaaggcttacaaataacttcattttatctctcaatattatagtatgagtaattagctggaaaaactaaaagaacgaacaaaatgaactcgatcgccatgatcacagtagatatcaatcaaagccaaaaaaatttgtgaagtattgtgaaactattttttatttttttttgtttaattattagtgactgaccagtggcggatttacttgaaggctaaccagggtaattgtctccataaattatttttttcttatattagttgaatatattgagtaaatatttttatacaaccataaaaaagtagacgttgcctttacaacaagacatttaaaaaaaaaagatgaatataaggggatatatttaattagaattttaaaatattttttttaaaa

SEQ ID NO: 3448 - DNA, 1156 bp, Glycine max
  Soy_ogl_511 Gm02:12082701..12083856 Cluster 13
gatgctcggagacttctggatcaataattccatgtgttaaaacttatttctttccaaaagtcattttcggcaagagacccaagattaagtatccgatgcacgataatatactacgtaaaatacagtatcctcattttaagaaatatttaaattgtatagttagaaaatgaacaacctgctgtgtaaaattcttgttatggcggcccattatctgaatctattatagactattccatgagccaaaatagttacctcctagacaaacggcagcaatttttttattttttattttttaatatgttattagcatggagtaatcctcgtcacgaattttattttttattttaagatgaatatttttcttccaacataattcatttcatacacaataataggatttaatagttatcattcatgtcaactatttgttaatagaaattacaattattataccctttactttaatacttcttttctatttaaattatattatatatttttaatttagataaaatatattttcaattctcatactaccgataaaacttgattttatttagtgaactttaactttaattaatttgatccttaaaactttacaaaagtaatgatttttgtcccttttcacaagtaacatcaacaccaaaaaggacgaaaactattatttttgtagtgtttagagatcaaattttgattaaaattaattttcatcgaaaagtataaagattaaaaatagattttacctttttaattttaaaagtatatatatttttaaaaagaaatatgtgttaagttttgatttattttattgtaaatgggttttccaagattatttttactttgcaattcttagtacggaaatcagtttttttttaaaaaaatttatttggtttggaaacattagaagatgggatgaattttttttatcaaactctaaagtcgataataaggatgtttacaatttcatttcgtcaccctttataggcctaaaataaataatagaatactcaagtttaattgtaaatatagtaaaaggacttataaaaaaatatgctaaaaaatgtaaagaaacgggaaatgtttatagaagacttttttttatataagtcaaatgaaatttattaagcacaaaccaagcttagcaaaagatgtgccg

SEQ ID NO: 3449 - DNA, 1100 bp, Glycine max
  Soy_ogl_2753 Gm08:18060701..18061800 Cluster 13
gttaatgtgtttgccatttttgtcacgataaggcgtatatcaaatttaattataattttatgaagggtttagcatgtgtaattgatgactaacaattgtaatattgagtctttaaaaatatatttagtttgttgtctatataaactatttttcaaacatgttcttgagttgttttgaaaaataacaattataaatattttgtaccaaaaatgatgtttatataatttgtgaatgaaatttattttttattggtggttggttggctcttctaaagtgtgagatgttagaatatatatattttatatgatttctttgggtacatgcttaaatcacaaataaatccctattagattttagttataacttctcaaataatgttaacaaatgttgcattgcatgagtaatttttaatttaagtagaaaaataataaattaattaaatataaagtttagattttcaaaagattgaaagaaatcaactttaccaattgttttatttttcaggttttaaaattttcaactgtcaaatttatgcattttattaataataatcaattgaaagcaaatatataaaaaaaaattcaccacattatgttgaagattgagacaaccactcatagacaaaaatataagtaattaaaatttgacataaaatattaatatagagaaataaaaaaaagttttagataagagaattttgtattttaaaaaagttaattgtaacacgccgataatttaaaattaattagctatcatttaattataaattacgttacaaaaaaaattataagtaaggtggcacattaaaataaaagatcatataagattttagtggccctgcgtaggcacaaggggtaccagtggggacgcttgattaatatttatagggcgttaaaaaatgaaaaataaataattattgtgagagagaatgaatttacctttgttttttgaacggataagaaagaaattaccctggggaagaaatgaatgatatgatatgtgtttcaaatgagcgtgtcctggtgtggcgaaaattcagatagtgatgatttagtttgaattgagtattgtgtcaaaaatccatccaaaaccatggttag

SEQ ID NO: 3450 - DNA, 1180 bp, Glycine max
  Soy_ogl_1598 Gm05:5110121..5111300 Cluster 13
gactaatgtgtgaatcagttgctactttgtttacaatatatggtttacaagcattttaagttactttctaacttgttgaaaatctttttttttatattattagtgttttttggtaaaaaatatattttaatagcttgtatcatttattgagacactactttaagtagaatttgagcttctaatttctaattcttatattttttttacttttaaaatatttattaaatttattatttaccattttacatgaggtaatgttttataatttattttctcaaacatatttaatatactcatttttcaatgtactacctaattttttatttatttattttactgcttaatattttcaaacttttacttttgatatttacagttagtctatatttattaagttttgtgttagcttattatattatcacattacatcaattataacaaaattaaaatttgctcataatcacatagccaatgttaatttatcatcttaacacttagctgatccggcaagtatcaaaagcaaacttttggaaatatcaagtaattaaatcaaaaaatattttttaggtgataaactgaaaactagatatatgacatatgtatgaaaaatatatttaaacattttttctattttcattcatctagacgttttgacgttgtgacccacttcagctgatcgtcttccttcttgctcgacatttttgctattgctccagttaattttagtttttgggtaatgttaaattctcctattatatccttctataaatctttttactattatggtaagtattgaacgagaaataaaaatatttattatcttgaaagcataaaacacattaaaaacttaccataaaatattgtaggagtaattatgggaggatataataagataacttagcattattttttattcttccatatttgtatttcttggtctctgtcgtacattcccaatataatgttaaaaataatttaaagtaaaaaatgtaatcaaagtaattgatctttaaatattgtaagagttaaaaattaattaaaaactataattataattactcaaaaatatatttttatccataaaatttatattaaacaagtttatttttgtcataaatttattatctacttcaaaaaataattttattaaatacttataatttaataaattagcttaaca

SEQ ID NO: 3451 - DNA, 1000 bp, Glycine max
  Soy_ogl_5839 Gm17:41363201..41364200 Cluster 13
ctggcttgtatattggtattcgtctgaaaaaaaaaacttaagagtggatgataaatttataataggttactaaaatataatccaattggaaaaggaattttatattcgcaacccataatatgttttctggtatgcatgtttgttagacctaatctccaactactaatctcacagttgtttcggaaggttttaagaatatcatgtcatatggaaatgtttgacttagtctcacacaaatcaacggttgtattaacaaattgttgattcaaatgataatgaaatcgttcatttttcgtaaagtctcaaattcatgttttaagaatgaaatagaaagaaaaaattataatatgtacatgtccaaacattattatttttttaaaaaaaagtcttcgttcccacagcaatctgtttggtaatcactacattatcaacaacatgtaattaaaaaacgtattcgacctgacgattaccattggaccaacgagctatttatttacttgacatacagcaaaaaatcaatgtcgttatatttcttttatgacaaaaattaaaccgctatgaaattatttaacgaattgaataaaacttgatgtgatttggtaaagtctcgttttcaatttcaacacgtattgaggggggaaaaacttcagaggacagatacatctaattacaggtaaatttcttgtaaaaaaaaagttacaggcaaattttgtactgactcatacgtattagcaagttctaaagctcatttgaaattagacttatttattgcaatcaaattttttatgtgtgtgtgtaatcacaaggttaggttcaatttaactactcccaagcttgatacgcgtgtatttttttaagggatgcgtgtgtatttaattttcattggatttaccttagagttaactataaagaaaattctcaaatttacttttattatactcgtcattcttttcttttttgatatcacttttaatctcatctgttaattttagaaaattta

SEQ ID NO: 3452 - DNA, 1179 bp, Glycine max
  Soy_ogl_556 Gm02:14960322..14961500 Cluster 13
cttgtcaactaagttcatatcttctcattaattgtttatgagtaaatgatacacaaaaataatattgttattatatcacttattttatcttatcgtacttctcaaactcaaataaccaaatattaagcattcaagcaatattagctttttccttaaaaaaacaataatagtttgtattccaccacaactaagaaattcataaaaatatacatcatatgatgataataaactcatctaataacatataccacaaaatatcaaaactcaattcatggaaagaaccaaacactattagtaaaaaaattacacctttttgctagaacaaacattttaaagggaaaaccttttgtacaaaatttagcataacacaacaacatcaatcacaatagtatattgttgagttaattaagtttctagcctctaatctttttgaaattctattttttagtctcttaattttttttaataatttttagtcctctgttaatttttcattggcattttagtctttctaatttttttccatttttagtctattatttatttttattgttcaaaattagtccaaattataaaataaatgagagagtaaaaatgagcaaagcaatgaccaattttgagcaatcaaaatcaacaaattaatggaagactaaaaattgtttaaatttttttttaaggactaaaaattataatctgaaaaaattgagggactaaaagcttgactaaccttatattgttttagaaattttttttgttaaaaataataaatttttatttgattattttcctgatattttaaaattttataaaaattgaaaaacaaagcaaacagattttcaaatggcttcccattaagaattaatttttaaagcgcaattatatttgtaatttacttacaggactagatctgctctctaacatttatgttgaattttcaaaccttcttatgtgcataaaaaaaaaaaaaacttcttataagagcttgaacgtaaataaaaggattaatttttatttttttttgtctttttaaagctcagccactttgtttataaaaatgtatatatattaattaattaactcaaaatgtaaaacacctatttatttcatataaaatgtctttcattagaccgcatcttacgttttctataatttatttgtcacatgtggcaaagtctgtcc

SEQ ID NO: 3453 - DNA, 1195 bp, Glycine max
  Soy_ogl_1107 Gm03:45870101..45871295 Cluster 13
ttataatttttaactgtaatatatgttttacttagtgtagtattagagttagcatggaacagactactgttaaatgcatcgatattaaattaattaccggctaacattaaatgtaagcaaacacaagtattaatctttattattgttgtcatttaaaccttttacattttttttaaagaaacattttaatttacataaaacctaattaacatcaacctgatcctcaaaaaaaaaattaacattaacctaatattaatattggtatccacttaactgatgcaaaacactactctacaaccatttagcgttcacattttggtgttgatttggcttaaaaaaattattttgaagtataaaaataatttaattgacattatgttttttataagcatttaactgacactatgttaacaaaaatagtgacgatggcatactgatgctaaattttacaatcatttcactactttcttgtaatgtatattactcacttcatctcattttgtttgacatttaaggttttgatactagaattaagaaataaatttaaagttttatattaacttcataaaagttatatcaagcaaattcgtaatatatttcttacctttcatattaattaggttaattttctcattaacatttacgtttttcttttattttatcactccacaataaatagttaggactacaataagaaaaaaataatatttcatcgatattttaaaaatgagaataacaataaaactttcttttcgttataaagtcaaaaaaataaaatagagcaactaaatgcttagataatagtcataatattctcggaacataagcactagctctctcacgtgtaaataaacacaaatacatgtattttttactggtcaactacgaatactaaaaacaacaaaacttttctttcaaataacacaactggaattcctttttttttttaaaaaaaaaaactatcacaacggatttctaggattaatagaactctgttccaatgaatatatatgagtaattttttagaattatgaggagtaattttttagaattattttttatctccactgttgatttatttaagatttaatacttataataaataattaatcttaatcgatttcaaaaaaaaagtaaatgataaggatgagaaataaatttaagaaaattactcttaaaataaataaatcttctt

SEQ ID NO: 3454 - DNA, 1000 bp, Glycine max
  Soy_ogl_266 Gm01:51450301..51451300 Cluster 13
actctactagatgttggactagatgggttcctgagtaaactcaagtcaaagattcttcgatgactgagtttttcaacaagactaaaaaaagttggctagtgagttaaatttgtttaattttctaaataaacaaactcaattactttttaaaaattgagtgactaaaataaaagaattcaatttataaataaaaaaaacaaatattctttcgaaagtttttagaatacgaagagtaaatggaccagaaaaaggataaaaaatgatatagtctcagtaatccatgagtaaattattgatttcctttctttccaatacagcaattcatacgggtattcttatctcaaattagaggaaatgtaagaaagttgaaattgcaaaatgaattttatgataataaaggaataactaaactatgagttgaaccagaagggttaagctaatagtgagggatttaaaaagttatataaggttctaggttttttttttattatagatgaaagatgtttttattgtaaaatagtctaataattattttagggattaaaaaaacataagctaattctatttaattaataagaaatcaagaatcacttttttaacaaagaaaaactagttgattttataaaaagctattaaattttttattttaattatattttcgatttttgtttccagtttctgattacttgtaaaagcaaaaacaaaaacaaaatatatgaatttttttaaaagtgattattttttaaaaatttgtttttaatgaaaaaacaaaacacctagcctcgatataattaattattttaaattatctaattacatactaatgatctgagtttatcagtttatgaaaaaaattatctctttaattatctgtatatctagacagattttaagtaatatcttcaaattttgtgagggtgtgggtgtgtgttttttatctttccaatggggcttcatggccggtttgggcctaggtagacttcggggcctcatttacatt

SEQ ID NO: 3455 - DNA, 1001 bp, Glycine max
  Soy_ogl_2891 Gm08:44667201..44668201 Cluster 13
cacgctaacaactcgaaccttttctttcttctacttgggcccacccaactttgctatgcaggcaaatttggcccagcatgtttgaccccacccttaccatttttgacggctaaaaaataaagccagtttatgtatgcatcatggttctctgatccgatgcagatcaaaacaacagtacatttggtgatatatgaaaagtaataacatactatagtccaaactccaaagtctaaaataggaatattatctaccctgtgattcaactacgtggctggtttcaatttaataagtaaatctcgacccttattttaagtatgtaattatattaattattcagtttttaaaaaattattgttcataataattctatttaattcaagcataaagacatcagttgtgatatctttaactttaagtatatgatagatgttcaattttaggaattgatattctatacgaattaatcttatgaaattaaaaaaatttcgcaatcttattttcacattattgaacaaagttgcatgaaattaaaaaattaaatttaaattgagattaactaaattaagtttataatacaagagcaaaaatcttcaatttattatggcatatcaagattaatttttttaaaatttaatgaaagtttaaaatgaaattaaataaatccaagtaataatattttagaaaattaaagtatcataaacacctgagatgcctcaacacccaaaaaaaatgagatgcctagcacgtgacttaaaaaacaaaaaacaattcataaaattatcatgtaatactagtgactcagatttataataaacgaaaaaattgttggaagtttttaatttttgtttttgtttttaatttgttccgcatatataatatgaatatgcaccttttttttttcgtgcgtgcgcgcgcaaactagatgtcatattttattattctatcggagtaaataatatacataacatagctatcacttgaactgataatttttttaattt

SEQ ID NO: 3456 - DNA, 1195 bp, Glycine max
  Soy_ogl_3160 Gm09:37766037..37767231 Cluster 13
tatccttttaatctttgtaagctaattttctcaataatatcctgatatgtaattaagaaaataaaatcatttttgcaaatgaataagacaacaataaaaaaagttagtggaaagcataatgtatttattattgatggataatacgatcatttatgacaataataatttaaaaattaatgatatttttgtttaaatttatattaattaaatctttttttaatcaatgtccatattaaaggactattattttagaatggatagaatattttggtactttgtgttcaatcaggataatttactgtgcaaaacatgtgaagtgtgtaagaaaagttttggatttgattgtcaaaaacacatattttatccggataaaaagtatgtagaatatcacatctcatcagaaagtcaaaattctgaattacaggaattaattactaaaaagtattaaaagagttgaatagttaaaaaatttgtacatacaaagataagataaaggtggtttaaaatggttgagagaaagatttagtttattgtactatagtgtgtgaaatgcacgtctaaataaaaaatagtaattaagaatattaaaaatatttaattgaaagtatgaaaacaatgaggctaaaaataaatttatgaaaaatactcgtaatgattcttattcactgtatgctaaattctaaagacaattataactatgcatgtaatatgtggatccatttttttatatcagtggatccgttattgtcttttattgtgaagaatgaccaagaataaaatacgtacactttacttcttttgtgacaaaacgtacactttacttgaattttttaaaatttacataactttttttacagaaaaatttacataacttgttgaaatgaataagtgactttatttctctatttctctctctatatatatataacatttgcaatccattacacaaaaattttatactattaatatttttttattggacaaaagtatcattttaaaatttaacattagattaaatttttttatcatatatttcctttcgactgaaatataaacaactaaaaataatatacgtttatctaaaatataattttttttaatattaaatgatgttaactaattttattgatgaatgtgagttaatttttttccttcttatatttcaatttcaatccgaaaggagtaaattatctag

SEQ ID NO: 3457 - DNA, 1207 bp, Glycine max
  Soy_ogl_4007 Gm12:5139794..5141000 Cluster 13
aagaaatcaagaaattaaatgtggttttgtatcatttctagaaattttcgaaggatgaaataaagtgacactcataatgaataatgaattttcaaattaaatgtttaatattcaatttttaataacttaattgttgtgtaacgtattgcaccatttaatatgcctaaatatttaatgaataaattgaatgtacccgaccatacaatatattaaattatttaattttaaaatagaatattttaacaacggttaaaatatttagagccataatttttatttttagagtcacaaggttcatccttctataaatgagatagtgtaagatgatttggttattgtttttctactgtaacgattaaaatatttacaaaccataattaatttatttcctggagttacaagattcatccttctataaataagatagtgcatgcaagatgatttggttattatttattttttctattattttgttatttagcatcattactacctctaaagaatttcattgtaagttttatgtaagattttttacatttgttttatatttttccgatttggatttattatcaattgtatttattattaactatatgtgtgttttaaccctttttaggatggtgttttcttcaaggaaaaaattcaccgatttgtttaggagttttacaacaaagttaactcctaaagtggtatatttataattgtaaatttgtaattaccttaaattttaaaatatttcattcttaaattattctttgattttataggacaaaatgaaaattccaactacttttttctactggggagatcaactgcagtctggattagcatacgaaactaatcccaacagaattgtaattactctatatgttttttcaccagatgatatattataaacaattggtttgaaatgaggattttttacatgaatttggtaaagtttattaccgaatttctatcaagaaaaatctgtctctgtttttcaataactttatgatgactgttaaaactacattgaatgcttttgaggtatattagttttatttacaataatcaatttacttttttaaataccattttcctgtataataataaaaatgtcattacaatactaactgtcatgctatatttgcaggacattgtgaaatttagtagtacttttttatttcttttggaagaaatttttggttgatggcgatgaaaatct

SEQ ID NO: 3458 - DNA, 1000 bp, Glycine max
  Soy_ogl_1003 Gm03:40739901..40740900 Cluster 13
acatctaattatatattttaaaaaaattataatcatatcacgtcatattaattttgtcatatacatcatgataacaaattacagtataataactatttgcctcaatgcattgctcgggtctagacaaagataaaagaaaaacagatttaattataattctttttcatccatcattcatgtttttgcaaattgtcactaaattataaaatttatatattttgtcactcaaattttaaaaagctacataatttgtcactcaacttttttcttttgcactttttctatctcctatttttaaaaatttgtacattttgtcacttaatttgcaaaattttactcatcttgctccttataatataattaagcatttttattttagaatttaagtgataaaatacacaaaattttaaagttggatggtaaatgtttcaaaaaatgttggatgataaaatgtacaaaattcaaatgttgaaaaataaaatgtacaaatttcatagtttaattgcaacatttgcaaaaatgtgaaagatgggtagaaaaaagtgcaattaagaaaaaaatagtatcgcagtgattctttaataatataataccttattttttgtatatatatatatattttttactttgttgggctatttatcttaacaatattgtttttatcaatatactgtttgtatgtatttaggaaaattagcttgttggttaataggactttttaatattaatggtaaaaaaattaaccttttcaaactaaatggacttaaaaaaataatttggtttaattagaaaacaaataagatttagtttaagtatgatttatacataataaatcataaagttccggataaataacttgacttaattatttcctcatacattcgcatgaaatgatgaaataatctcccagatttaaagtgagaggataatttagaaaataaaagttatcagttataaaattatgtatattatgataactcacgtacgtagttaagtgata

SEQ ID NO: 3459 - DNA, 1137 bp, Glycine max
  Soy_ogl_1588 Gm05:3862564..3863700 Cluster 13
aacaatattgttagtataagaaattaatgcaatggttatttctaagtttgtttgaaggtaataaaaaaatatttttacgtatcttttattttttaaaaagagagacattcatgtttatgttgatattttattgagataattctgataaaaagaggataagaatatggattcttataggattggaatcatattattaattatgtaaaaattctattatattcttaatattaattaattttttagattgtgcacttcaactttgataacagtgcgtgtgaacttaaagacagaagacaaaatatgttgcatttattttttaaatttaattattgatatgaaaacagtttatcgattttatttttttgtttacttggggatgtggttaaagttaggttggtgtctttatgtgttgtttgtcctttacaaggctgtaggaggtattttgatgatgcgtttctataatagtaaaatgtagttaaaaaatttattgaaaagatttgtaagattctttaatgttatttgcaaactacatgtctagtcttgtgtgttgctgcttaggagaatataatgtaaaccaaatacatttttaaaatattgttggaaatataaaaaacactcccaactaatatccttaggattagcattctcagaaattaaaaaagagaaacgttcctaataatatataatatatatttaaaagattcgctgaaacaaatgttcctattagtatataatatatatatatttaataatagttcatttccattagaaaaaagttatattattgaaaataagcctaacaattaagattttatttatttattagagtatgatgttttctttaataaattaaagaaaactaaatgctattgatatctattatgattcgtgtgatgagaaatttaattttccttaaacaatatattgaatttaaatcttgtgtatagaagaaataagcattggttaattaagagagatttcatccgtctacgtagtacaactcaaattaatcatagtctaatatgtctttcaaagtttaagagaaaaatagttaaatactaattaattccacagaaatagaactaaatatcaatatctttttatattaaaatgtaatagatatgaaatatctctctt

SEQ ID NO: 3460 - DNA, 1000 bp, Glycine max
  Soy_ogl_2623 Gm08:11994101..11995100 Cluster 13
aaccaggcatagatagcaatggacaaattaaaactatatactatgatttactaactagtactagtactagtaagagactaattaattaatatcatgaaagatttaagagaaattaacttttttttcctacaaaagtttatccagttaataaaaaatgagacttgatgaaccctaaatctaatttacttaaacttttagttatatatatatagaaaaatctgtttaaactagaactcttctaagtaacacgtagaagccatattcatgccatagagcatctcagacgtggcagttgctataaccactttaattcaagtcatgccattacaaccagtgacggagcccgaaccgatgagaaggaccaatataaaacttaaattgcatgtaataaatacatatttttttttatacaaatattagtaattatataattataattgaattttttaaaataattaaataaccttattgaatcttttaataattgaggaaaatattttaattaataaatcatgtaatatttatttaattagtggatcaatcaattatatattttaggggaaaatcatttaatcagtttaaatttcgtataattattttgaaatttttatgattgtttaaaaaaatctgaatttgaggtagaaaatgaatatatttttagggtaaaatcaaatcgccagtctcattttcctataataaaaaaatgtgaatttgatttattttaagaactaatttattttatgattctttataattgtctcccattttcttattactgattagggaaaaatcatttttccagtcccaatttcctatattaaaaaatgtgaatttggtttattttatgatctagttaattttatgattatttataattgtctcccatttttcgtataattaattagggaaaaatcatttcttcagtcccaattccgtgtaattatttttaatttttttgaagcaatttttaattttttatgattgtttacaaaaactgtat

SEQ ID NO: 3461 - DNA, 1134 bp, Glycine max
  Soy_ogl_2866 Gm08:43134067..43135200 Cluster 13
cttcaaacaaaacatgtatcatggagaatttagcgacattgttattgagtttggacattgatcaacatgctaaaattattaagattaaaaaaaaccattttgtcaattgtcataatacaataattttaagtttgcgctgaaaatgtagttatatttttttcacgtgtttttataattttaaaaatagaccaatgcatcagcgtgggcttgcggaggatccacactaaaactcgaagttagcgaggacaattataaaaaatactaaatttattagcatacatataaaaataaaatataaaatagagtaaagtatattttttattttactaatttttttgaagtttaattttagtatttataaacttttatttatttttctctctctagttttgatatgcactcctaaaagtattatttgaatcatttttcatcattttataaagtgttacctaaatcattttagtttgaagagcaaaagtgatacaatacaaagttaaaaaaaaaacaaaaaaaaatgaacatttttttaggagaactaaaactaaactttaaaaatctaattccccatttattttatttatttagtttgaacttttcaaaatttgaaagaggaaaaacattgctgctatttaattttttatttattaacttaatatttacaattcttaataaaaaaggaaaaatttgataataattttatattgtaatcatttattaacttaagttaaaaaaagattaagttcttaataagattttcttttttcgtcaattaagttcttaagatatgacgaaaaaaaaattaagttaataaatgattataatatgacgaaaaaagaaaatcttattataaataatcaattaagttcttaagatattagtaattgagaaagttaatatatacttcatactaatttgtagtaatccaaataaaaagtttgcttgcttattaaccgtggtgcatgcaaacttacggtacatttagctaaagaaattagaattgtaattcaaaattaaaattagtttagaattataaatttatttttagtttgtgtcaaaaatttaaagtgtaaaattatagttttaagttgtattttagttccaatttggtacgcacctttaattaaggggagttct

SEQ ID NO: 3462 - DNA, 1000 bp, Glycine max
  Soy_ogl_2977 Gm09:3971101..3972100 Cluster 13
gaaggcaaattaattaaaagagtgttgtaattaaaaatagaaagaaaaaaagtaacacttaaatcattattaatttaagtctttttcacaccttacattaaatattctttaaaaaatgataagtaaatactcttagcaaaatgaccaaaagacaaaatattcattatatatacaattagacaattattctatctcggtatcactttttagattattagacatagtttattttaaatatgatatcaaagtctcatagattcttgtgttgactataattaatttttatgttaagtcactcataataaacatgtagttttacaattttatgtctcagtgtttaattctaggcataagttacagatgttaagacatcacattaattatgaatataggtataatttctataaggtaaaaaaatgttctccataaattagaaactatgttaagtataatttttaagaaaataactctataagataacaaatttatgttccacccacatgggcatataatgtaagaggttaaattattgattatatgataccttaactttattttaggtcgtaaattagtttaagtattacaagtggcaaaagcacgttcgtacgtagtttaaaatgcgcagaagctatggtgattagcttctcgttctcgtgaatcgattttgtagaaacaggaaaacaaatatgttattagtgatttcgttaggcaattttcttgggggaaggtttttgttccttaataagttaatatagattataagtcaactctaaaaagcttattggtattagcatagtatattaaagttgtattatgttggtctgagcgaaaaacaaaaaaaaatattatagtaaatgattgcaatgtaaagaaaaaattgtaaacattgaatttaaaagaaagggtgtaaacaactgaaatgtaaataaagccataaaagaaaatgaatgattggaaaaatatattggtcagggacctattttaaatatgaatttctaat

SEQ ID NO: 3463 - DNA, 1028 bp, Glycine max
  Soy_ogl_3023 Gm09:5826573..5827600 Cluster 13
tctaaactcatttttgtaacatttaattttactctttatttacttcattttttttattcgcctgcttttttatcttgataaatattattgttgttggtgtacgtattctcactttgatcacattttttccttaaatatctactattattttttttaacagtttcaaaatcaattcgttgtgccaatttgaaaaattccttaagcccataagacaaagatagtcgtttaaagaacataaattaggagccaatagatacgatgaaggtgcaaaaaatcagtttctattgatttggacgtgaatttcacgtgtggtcaacaaaggcactaaccatgacaaagtgactttgatccaaagagagataaaacaagcaccagatagtaagagaaaatctctgcactttttatgtgtttctttttcatgtgtttctatcttttcctatgttttagatcttttacattcttttctttttcatcttatttacaggcttaagtaatttggttggtctcactttaaaatatgaattttagttctcatataaaaattataatgaattaaattaattactttattatttttatgttttatttctgaataaaaaatagatttatgaacattcttgtcatattacatataatttatttattttttatatttgttttgtatttttacctttcattgatttttagtcaatttattgtgttaaaagcatattgacacgtacacaattcatatttagactattatttttgtatatatattattgttaaaaaaataacaagtcaacttgatgtaatgcaaaatcacagaagagtttaattcacaatattttttagaagtgaaagtcattttacaagtattattttgtgtttataaattgatatttatttttttatgaaatatcacaacaagaatttcacaatcacaatatttttagataggttttgaaaattaagtgaagagttatatcaaatggtaagataaaaattgttggagttataatcatgctaatgattatattagacttcac

SEQ ID NO: 3464 - DNA, 1143 bp, Glycine max
  Soy_ogl_6770 Gm20:35272801..35273943 Cluster 13
aactacatactagtcgtattttcctatgtgaattaaaggattaaaaaatacttattgtacaaataaaaacaaaaaaaataattatatttattgcatttgacacatataattagggttagactacaaattagtaatgatttatttctctcgaagaattggaagattaaaaaatatcaggatacttatttatcaaataaaaacaaaaaaaatagttaaatttattgtatttgacacatgaaaggagaaaaaaattgcacttgtattattacatttgaaatgtagcatatataaataatgatatgaaattgttttatgtttgttctatatctatttataattttgtatttgtagtttttgaattgaaatatattgaaagaggtgtaatgtagctgcattgctttttttttaaaaaaaaaaaaaagaagaaaaaatagactactgcattggttgtttctacaagtgatgtaaaaaatggaattttatatttatcatttagtacattcattgtatcgtccattgacgcagaaaatgaacttttatatacaagttgtaacctcaatttattgtgaaaagtaaagttttcatattggttttacatctactcatgaaagcaatctaaaatatcaaaactcatagatgttaaatatcttttatgtattagtgttagtggctatttcgattgattcgaaaccaacaccaacattagctaaaatactcaagatgtcaatttaatttcatagttattaattttttgtgaaatactaattattctaatttttattggtagaaaaaaaatgaaatgaatgttatgcattttaaagaagtagaatcgctaatttcatgctatgtgttgttgtacatgtctttttgtttatcttacaatttgatattagttttgacaaactggattaagcatttgttaacacaagtttattactatatcatggatttgttaacatgagttgaaatttagaagaaaaaaaacatattaaaatagatgtgatatacatacaaccattcataataatttatgtaacattattttatgtctctactcttcaccttcttattttacatttcaatttttaacttcttttacaacattctttattcttttaattattaaataaatgtattatttgc

SEQ ID NO: 3465 - DNA, 1010 bp, Glycine max
  Soy_ogl_771 Gm03:536691..537700 Cluster 13
ctaacaaacacaataaatcacaagtactgttaaccctatttatggtactctatttaccgttataggtagattttttatgactatatatctcgcagcttcctccaataaactctcccaaagtactgtagcccgtagaaccttcgtcaccgcggtacatacccacttgcccaacaggttttcagaattgaagtcacaatttttttaatcataataattaagatttttggtttttaggtagaatctctatatatttcctcaaattttaatctttcagatctattataaaattaattataaaaaatgttctgtaaaaagagggccttctttaaaagtttatgtgacaaagtgtcactatgatttatagataatcgaatttctcaaatatgatgatgacgtgaatttgattctatgatcacgtaaaaagaaaaattattgaaagaaataaaacttaattaatttgatgatctttacctctagatttaatctcatgattttttgatatgaagataaccttgttaaaaaaaatattgtatagaatcttcaagaagagataaattatttttttagttatgtttgataaaactaactaaaaattgaaaagttagttgaaatttagaaaattagttaataattaaaagttaaaaaattattttatcaaattacaagtggttggtaagattattgaaacagcggaacaatataaaattatataataaatatatttatgtaatgattttatacaaattttaatttaatttttttgataaaaaataatatattttgtagtataaaatatattttggaaatattttgtgtcaaattttggaggagatagagtaaaacggttttatcatttttctttctttctcacacctcatcaatctcattcataactaccgtccatacttcgttccgtgattccctctctcaatcatgcatgcattcacaagtcacacagccatcacaagtcacacagccattcacatatttctctcacgtaacagatgcaa

SEQ ID NO: 3466 - DNA, 1116 bp, Glycine max
  Soy_ogl_1897 Gm06:10672493..10673608 Cluster 13
ttaaagaaataaatttaaacaagattggttgtattaaatttactttataaaattgttagcacagctaatttgagattttagattctttagccaaaatttaggatttgattcacggtttggaattgtagttacaatataatgtattgatttaccttaaaattaactgaataagtatgggaattgttttgaataaatttcttttaaaaaaattaagataagaaaaaaatacaagttaaaattagttctttattttttattgataaatattaattatttatttttattagaatatttatgagatagatttgaatttgtgactttttttttattttttgttgttgttaaaattgaattagttaagatagaatatttataataataacttttcattaactaataattgaattagtttagtaaaaatactcttagctaatcatttagttacatgccaaataaaaacatcatatacctgaccgattaagtaggagtggaatcaaatgcgcattgattgtttaggcgtacaagaaaaaaatgaaatttgcgagaagcaaatgatgaggaatgtgatggagaggttcattgattgaaacttcaattgttgggagttttgggccatttttgttgtctgcttcacgacaagacgtttttcccatgcgccaccctctcatcagcaccttacgcctccacgccccaacgccttgtcttatcttttctattttctattttctattttctaactcaactacttttcattttttttacaaaagtaaatcattttaaatttttataaaaattttcccatattttttatcaaaaaaatttagttagtgagtgtttttattaaaaatattaataaagtataatgataatactaaatattattttgtatataaaatcttttactgttaatgtcttaaaaatacttattaaaactctatctctttctttctttttttgtttaggataagtttatctctttcttcttttttttttttttaagtctatcactttctgtgtgtgcttttataagctcaataatggagatttattagtgtactagcatgtgaattacattccaaaaaaaaaagtacgtgaattacatctaaaaaatgtttg

SEQ ID NO: 3467 - DNA, 1063 bp, Glycine max
  Soy_ogl_2306 Gm07:9451943..9453005 Cluster 13
caatcataatatgagtatttttcatagtctcattattttcatgctttcaattaaatattcttactcttttctttttttatttagatttagatgtgcttttcactcactatactacaattaactaaaactttctctcaactgtttcaaattctctttgttttatctttatgcatatccaactcttttaatactttttggtaattaattattgtaattaagatttttgagtttcttgtgaaacttaatatacttaaaattcttcatcatgccaaatatgtgttttgtgagaatgaaaactaaaatattttcttacatattggacgtattttggcaattaaattatcctaattgagtataaagtacaaaataagatattcccttcattctaaaataatcctttaattaaagttatgacacactaattaaaaatattcaagtgatataaatttaaagaaaaatatccttaatttttcaactactattttcataaatgaccctattaattatatctatccatcaatgataaatacattatgcttttcagtaacttttttttttgtctcatttcaatgcaagctaagtatcaatttatattgttaatcatatctcagaatattattgaggaaaatagcttaaaaatattaaaaggagaatttatttagaataaaattaagaggttaaaataactattattttagaataaaaagtattaatttacatataccagtattgtctccacaacttaaaacttttagttccagcactgatactgataaaagactacgtcaattgtgtgtggtggtgggttgggggaggggctatttgccaaaactctatgcacattaatactatggctgttacagcagagttcattattactaccatttctcagttttttttaatactctggtagtattttaagacattattaatttatgtaaacatttaatattattgattaactaaaaatcattttaaatatgaatttcaaaataaataataattacaaaatttattagtcttatcgtatatattacaatatatagttgaatagtagtaaaat

SEQ ID NO: 3468 - DNA, 1051 bp, Glycine max
  Soy_ogl_2641 Gm08:12844450..12845500 Cluster 13
gtgttttacattagagttaatgtgattataaacattccaatttttattatttacggtcgtgttgaaagtgtctccactaaagaataaagtataatatttttttttcttaaaaaataatattttgtcttaaccctaataatttttaattttttattctcaaattttattaaaacctttcactttaatttctaataagggactacaatcacattaattttattaaatgtagagattaaaaataaacaaaattttgacaatagctaaaccgaaataatatcctattttaattagagagaaattgtataaattaacaaattcaaacttcttaataaatatatcattctatatttctattggaattcatttgcagatattttttttttcaatgacttattgaaggttttctgagaagaaaaaagttaaataaccaaaatgtagaaggagggcttaaaccttcaaccttgtagttaagggccacacgctctaattataaccagccaattgagctattctagctgtgacattaatttttagcacatttttaaatataaattatctaaagaacgtactctatgtcaagcaatttctttctttcgttttctatccatccccttttttttattctgttttcccttttacacactcaagggggacggggttctaagtcttaattgactctcattactttggggttgaaaactatattagtctagttattttttttattgttataaaaaagaataaaatatatttttagtctcttttttttttagtattttaaataaaatttgactgttcttgattttcacactattttttttgtttgattttttgtttttgttgttgagtttctctgataaattatgaggtaacaaacattttgtgacagatttattatctaaaagttaaatggcgttacaaattactttgtgaaaatatttaaaatgcatcaattaaaccattcaaccgctagaaattgcttccaaaacaccacccgaagtacaaaacggttgaacctcaattctctccacaaaacagccaatatttgagt

SEQ ID NO: 3469 - DNA, 1041 bp, Glycine max
  Soy_ogl_2953 Gm09:2682601..2683641 Cluster 13
aagcctaaagatagtaagaaatagaattaaagaaattgacttctgccttgtttttggatcatacaataattcaattttatgagagaaaatagaaataaggaaaaacctttttgattaaacgctattaacccataaatttaagtatagtgagaagtagcataaatgaaaatgatttttttttttgtcttgtttgcatcacatacccaattcggtttgcacaagggaaaagggaaatgatgttttagttttgatatcataaaatgtttcaaactctaagttcaagttgaagctaaagtttaatttaaaagtgaagtgagttgtcttcttaagtaagtatatagttgaacaacgataatattctagcaagatcaaatttacctaaatagcctgttgaaccaagcctccttgttaataaaaatgaaatttttagtgtgttataggtatttgaggcttgaggcctctcaggaaaaaaggtgagtttttacccaaaatgattcttgaagccttaatccaataaataaacatgtttttagatgataaagaaaaattaaaatgaggtgttttgcataagactcgcgacctttttggaaaaacactatttttattttatcaagtagacaagtattctttaaattgacttaaattttttataggaataaattgacttaaattaaaaattgctaacaattcatttggctttagctcaatctaatttaataaaaaaaaaactatatggagctttcttgtaatttttcaattagtgtttaagttttaataatatgcatatataaaacttgttttgggttcatgattgaatacattaacatgtttcaaataaatgggcccaaaagacccaaaggcagtttaaaataaaatggaccagattaagagaactaatttttttcctaacctaataattcagttttaaaataagatggaaactaattttgtaaacttaattaattgaggattagcatataatccctttccaagaataaaattctttattagttaaaataaaaaaaattaagtatccaattt

SEQ ID NO: 3470 - DNA, 1011 bp, Glycine max
  Soy_ogl_3661 Gm11:247590..248600 Cluster 13
caaaaaataaaattttaaaaaatcagaggagacaaggcccttttcactataagttggtccgcccctggtcactgtgaaatacaggcattaattacaccttgtcactctagtgagattattactgacttgaaggtgaaaatatctttgtaggtaatgtcaacaatgcttgtgcatataagcacaccaaagtctcaattgaaatcaataaatttaagcagtaaaaaaatcagtttactcaactatcaatttaagtcaaatagcaacctaattcaaattcataacctcatccatttcatacagaaaaataataaaacaaagatatgataaaaaaaaattattacgattttgataaagtttattttttttaatcattctaattagaacttttgattccttgatgatgcctgagatataattttgatcatttacattaactataagattaattcttaattcagatttattcatacttaagacttcttgtttgttttcattcttttatcatatttaacttaaatcaacaatacttcgcaaaagtaatatgcttaagagtttaagccaatttatttggatttgattaatatctcatgcgttatgatatgcttcatttataaaataataaatcttagtacttgaaaaaaaaagatgatattgggtgtacgccgtacatatataataagttatgaatatattaaaataacagttattcatatttttccggtaaaaacaattatttatattttattaacaactgtggttatttatcttactcaataattattttagagaatttaaattccttaataataagctcattttaaagagtaaattaggagttacttctatttataaaaaagtaacattattttttacaaagataaatttattgcatttcattttaaatgagtgagtcaatacacgtttaataagataaaaaacaatatgattgttaacatataatcttaacatttttataagagaataagcgacgaaatttacttgtcttgagag

SEQ ID NO: 3471 - DNA, 1024 bp, Glycine max
  Soy_ogl_4458 Gm13:35382377..35383400 Cluster 13
taaagggacatttagtacaagaaaaaaatagttttccaagaatttaaaattaataatgtttgtttctcatatctaaatttttattcgaaaataatattcttgaaaaacattattttccaccttcaggtttttacttgtactcattttccgcaaaattattctcatggaagaaagtaggaaactttcttgagttggaaaataattattacattaaaaatattgggttactcttattatataatatatcatttattatgataaataattacatttttttgagaaagttttattaaaactaaatataaaaatattttattaccaagaaatatatatgaatatttttaagaatgtttattatcatccaaatagatttatccattcttaaacatttaaaaaatcttcaatcaaacacactctaacaatatatgtctattaaaatcttaataagcttttagattgtgattcaatctttatttatttatcatgcattataattgacacaatcaatcaatcaatcacagatgacaaaatgtgagttaccctagtcggtttggtccatcagtcaccgacttgttaaaaataggatgacgtaagctaatctatttttgaaatatgaattacaaaaatctaatttttcttgtttaaggaattagtctctgaaaaaaaatgatcaaaaagcccctaaaaaatgaaagaaaaatcataattaaagattaacttctaacttaaaatattgaatcttaaacacaattttttttcgtaactaaataaaatagaaattcaaaatcttacactatttttgctaattttatctttaaaaaaaaatattagtttaacggtgcaatacgctccgtcttgttaaaagcattttttcttacggcgaaaaatgagattggtccaaacaagttggcatattaataatattgtcccaacctgcctaaaaaaatgaattaaatagactaacgaaatcaaattcataaaatcaatagagccaaatatattgacttctgaagagtaaagtgtc

SEQ ID NO: 3472 - DNA, 1028 bp, Glycine max
  Soy_ogl_5169 Gm15:49114273..49115300 Cluster 13
tggtaatcatacttggattgcttagtaggaaaaaaatatagaaagttaaattttgtatgtcttcttgtcagattatatagtaagttaaaagaagaaaaaacaaatatataaaatggcataaatatactttaaaatgaaacaaatatggacaataagaataagaagaaaaaaaactcattcctttacttttcttcccacttttagagttgtgaaattttaatataggtcctaatgatcctcccttctactttattgaataaactaaaccaataaaaagattttaaaaaacatggtgtccttctttcttttcaaaattcatataaccaactaaagagtctagtttaatttattgaataagatgtatgagtattataaactttttataaatagaaaaaaaaatcattcaatcaaacaaaacattaaatgcaattcgtttcatattaaataacaaagataattatttttttatattaagtaaaataattactgtaaaattatgtgcacctggaacttttttaacacaccaaatagtgactaccttattatacagatgaagtgtactcataacgaattatctagagatgaggagagaaaaaaagtgaatagaaaggatagtgatgttggagaaataaaaggacaaatgggcagcactatggtccagttatttattgtttgtgtttcaattaagctttcattgtcatcatccagacaatgatgagaccaagatctgcatgtgatcccattttcgaacaacaactaagttcccctgtccaaactatatcacagttattatgaacatcttataaaaatggtccagtaacagatcatattttacttcacattgtcattatccttatgtttttatttgcgattttaaatgaatttaatttaatgaaataattgtataaatatttattttattctgttaatcattagatatgatagcattattgattttcacaatagttattataaaaccttgtctttctcttaataattaaggaattatgggtgtttcttatttttgt

SEQ ID NO: 3473 - DNA, 1015 bp, Glycine max
  Soy_ogl_5385 Gm16:30973286..30974300 Cluster 13
gtttcttaatcaatgttcttaatgcactggttagtatttattattttttaaatgtgtttaattatttttaagaaagtaatttaaaagtctcaaattgaagtattatggaggaaaaaaacttgattaggagaggaaacactgtcaaaggtgataagttagattttttaataagaattgattttggaaatcgatgaatactctatattaataatgtggtaataaaaaaataatttgtaactttttaataagttttttttacttagttcaatatgttctattatgaacattaatgaagttactaaattagggacatttgaagattaattttctgcaaagtttattatgacccttgaaaaaaattatcaacaaaccttgagaaaaaaagaagaagatagaatgaattaacatataaaataaaactaacgtatacatacattaagatcaatttttgcaaaagttagatgagatatgttttgcaaattagtttatacacaaactaattttaacttaggagagaaaattacatttttgtctttttttttcttctataaatatttaataagaaatttatgcatacagaatttatgtttggtatattcattgttagttaaaaattataataaaagtaaaatggaaattatttgttgattttagcccattggcatgcgttgtagtcaaaagctccgttttattatcccattgtttaggatgagagggggagggggttaaggaacgtaacttttttcaaaaactactttagttttctttcttttttttttaaaatgccacttccctattttcttttacaaaaaaataagctctttttttttcgggtgaatttttaactgacttttttttaagatcacatgcatcattcacataaacacaagtgtgtaacctacatcttgaacttaaagaccactagttatattgaaacaaactatgctagttgatatacatggtcaatggtaatctaaatgtattatatttaaattctccttttaaggaaaagaaa

SEQ ID NO: 3474 - DNA, 1084 bp, Glycine max
  Soy_ogl_6472 Gm19:40421017..40422100 Cluster 13
cacgtcgaaataatttaaaacatttcataagatatatttattacgttcacactatgtatttaaggagacatattaaataccccattatatatttaagtataaacaagtttttttgttgcaaaatacaaatgagttttgttaggatgtttcgtaagggtgtaaatgcgtcacatactcacaatcaactggcaaaccccaccaattcaatccaattatcttttaccaagataactcatcaagttggtttgggttcattttagttgtttcaattataattagattaggtattaggttaacaagtttcaaattcgatgaatctaccctaacccaatatacatataatattaataataaaataactattattctaattctattactatattatgtggttatgtacaacgtaatgatatacagtgtaatatcaataaaatgttaagtatagtgataaaaaaatctctatctagcaacaattgtcaattaatattcaattatttattcatattcatttggcaccgcatagacaagcaaaacttaacgttagtaagtaattatgtacaaaacattgagaaagtccctagcaagactgcaagaacatattagatgccattgaaattaagaagtggtttcatccttcttggaaaagatatcaaaaaatgaagtacctaattatacataaaagaattagtttttttaaaaaaaatttacaaaatatattattatttaattagtcaactcaattacgtaactcaacccatctttgtgtaaaaaaaaaaaaacttaaaccaacctagttaagattgagttgattcgaattggattaattaagaaaaaaaatacaaaagtcaatccaattattttttattggtttgaatcttaaattagatataattcaatttaatcaaatcacttataccatattttgtaaggattacttaaaagaataataactaaaatgattttactaaaatatacagtagggtaattaaaacctgttttcttgtttgattcacaaactttttctatatacaatactttaactcaaagcttacttaaaaaaaaataattaattatctataactta

SEQ ID NO: 3475 - DNA, 1200 bp, Glycine max
  Soy_ogl_1636 Gm05:31169601..31170800 Cluster 13
gtttcaatttttgttttatcatattaaaggtataataattataataaaatcaaagcatcagaaatatataaacaaattaatcatgctcaaataattaaccaatttataaaaaatttactttttcaagtgaaattaattacattcaaattgcattatatattaaaactattaataatattttttactctttattgtaacaaccacgtagtcacgtagatcacacggatttatatagttttctatttaaaattagggtttataccatacatgacgccttagtcaaggtgcatggcacgcgaagaatcaactttttttttttttactaaagaagttaacacgtgaagaatcatttattgtttaatttaaaatagtattattaaagaagttgtttggtgttaattattactattttaatatattttaacttttattattggtcgtgcttaaaactattgtcgaaacgtaactaataatttgaacagaaaaaatgagttaatttcaataacttaaatgaaatcttaaaaaaattcaagggcttatttaaattattgttagttttaaagactaatatgttagtaagatacaaatttagagactaatataactatttatcattttaattaattaaatcagtcgacaagcatattattctattttcattttggttggaaagagtacgctatgaattataaaattaatagatcgatagcctatgaaaaaggtgaacggaggctccagtcaaaaaagagaaagaaaaagtgaacagagagtctggatacactaatggtgtatatagtataaagaaagctttattctatccgatcgagaatcatggttctcatgaatatataataattattcataagaataaataaaatttgtttactacttagttataaatatttttaaaaacatttatataattttttttggtaatcaaagaattacttagtatttttattagttactttaattatttatataccatattaaataatttaacaagaataatatgatattttatgtaatgaattttttaacttgagaaagttatagtttcacttcttcatgaaaataattttttgaaaaatctaactaaaacacatttctggtaaaacattctttcttgggctgacaatattattttttaaatagataccaaacataaaaaattaagattctcaatttctctcccattaa

SEQ ID NO: 3476 - DNA, 1015 bp, Glycine max
  Soy_ogl_3267 Gm09:43334301..43335315 Cluster 13
cccacacttattggagcgcatactaaatataggttaatgtcctacacttattggagcatatactaaaattgaggttaatatcattgcttttatattaaaattgagtgccttcacctaaaccaacatgagataattaatcctgaaaagggttcaaatatcttaaatttgtagccttgataatataatctataatataaagagatatgtaattagataataatataaattattttatattattaatataatttattttttatcaattaatattaatcgttaattttttttaataaaggaaaaagtcgaatccaccacatatttttctctcctttctcttttcatcatcaaactaacttataattttagactggtttctcatttatcgtcaagatggtattagccaaagaaagaaagaaaaaaacgagttttttaaacagtaattttctcccgtgtatcctgatcatgtttgatcatgttacattagctaggatataaattacccacgtgtttattatatgtatacagtatttttctttcatctaaaaaatatcacttaaaatctgcataaaattttaagatttaaatatgagtaagtttttcatacagtgatcgaacatttttgtagttaagtaaacttaaaaaataagaataaaagtatctaagagatatatagaaatatcactattattatataatgataaaatcaagagataatatttttgaaattgaagataaagttatgaaaataaaatatttgaattaaggcatcatctctgttttttagactaaattactattctagtcccccttaatttcttatctgctagtctctctattttgaaaattgtataactttgacccagtactcaattttgcatacgattgttacttttattttttttacattttagttaattaaaataatttttatgatgccttaattgaatatgtcaagtataaggttcaatttgatcaaaataaaacaaatataacatgcaaaattcaggattattga

SEQ ID NO: 3477 - DNA, 1100 bp, Glycine max
  Soy_ogl_3520 Gm10:43695801..43696900 Cluster 13
gaactcattacccctgaccctgaaaatttattacatgtgtttccttgaatttcttgttttcactgaaaatttattgaaagatgaaatgattagaatattatttgcatttaattgtgaataataaattctacattatctataatgtaaatttaaatttacttataatttgaatttaaattataataacttctaattaattgttttatcatatatatcaatagtcttctaaccatatgatcgatgcgataagaatcacatctgcttggcacattgactagtaattaattcttaaagtgcatgtgaaactcattgttcagaagtaaaaatattctcctaattattagctcttaaataaataaataaaaattacgttggagatatgaaacaaacacaccaataataactgtaccatttccttctagttagttttttttggtattgggtcgatagttatatttatataatgtattttcaattctatttttaaatcctctaatttccgatttcttttagaggatatatatatagttttgtaagatagaaaaagggacaaagtataatcaataggttatataaataatcatatagtaagtctctgtgtactaagaattgtgtttttctttgtctcataacattttcctcctttttattttcttaatgtctaaaaaagtatacaagtataatttcactaaatttaatgtatgactgtactttttaatattatttaatgaagtgatcacaagtcgttaaaaaagttgtactttatccataattgttacagaagtcaagtttttctattattaatttaaaattatataattaaataataatataagtgtgttttattcattttttaaaaatccaatttggtagcttttgaaaaaaaaaatatagtcagtttttttcaaatttaatcaatttccagataggcactatcaagattatataaaattagatttattataccgattaattaacgacctcatcctgtaatctagtctaacactccttaatattttaggaatgtcactatcttcacgaacgtgttttacttttagaaacatatatgctttcaagtctcatcattatattagcttgct

SEQ ID NO: 3478 - DNA, 1161 bp, Glycine max
  Soy_ogl_3526 Gm10:43846901..43848061 Cluster 13
ttttttctctccaaaataacatgtaatttaaaaaaatttctctcctgaaaagtaatactattattctttttcccaagattattaatttgcttgatgaagtgtcatatttttattggaaatatatgaaaagggacaaacaaaagaagaagaaaaaagagtttgtctaacataaagtttaatcaaatataaaattttgttagaaattaatgtacctaagcttttagctaggcaatccaacgcgtacaaatactccaacaataacacgtatgtatgtatatataaaacagaataatatagttatatttgtttaaatagaccaaccgttaaaaaatttaaatcactacaaaaatgatttttaaataggttaaaatatattattttaaatcagacgggttttcaaaaagatctttcacttagtatttcttttttcttttatctattttcatccgtatttcatgtatcctatttggtttgagaaaatacttttttttctacaaataataataaaactgataaaagtatcatcatatcttttttcaaatagttatacaaattaaaaacactaaaaacgcttcttagaagataaaaaaaatacagtatttctcaaaccctaagatgacacaaccttccccggcccgtatgtacatctaaagataattagttttcttaattaattgggtttactaaatatttttaaaaataataacagggaccgtatgaataacattaaaagagaataacgttatcgtaaccttagagtttgtaaatctcttggcggttttgttcatttgatcgtctgtttgcgtgaaaaaagaaaaggaaagaatctcgaagagtcttataccatttagctagcaacatactcccttcgttattatatatattaaactcaaatacctaattctcaaaattaaaaaactgattaatttaatttatagttataaatttttcttaaatttataatttttaaaattatccttaccattaatacttatttttcttccagtgatttatcaatatattctcttttttcttttaataagaatgatttctggtataaaattattaatataagaaatattataaattaagtcttataaaaataattaaacattattttaaatttaaattttataaataaaaataaaagaaataataata

SEQ ID NO: 3479 - DNA, 1034 bp, Glycine max
  Soy_ogl_3812 Gm11:9541601..9542634 Cluster 13
ctaactttttatttttttaggaaaattttatccaaacgtttatgtttattaatggataaatgataggagataaattcataatgtttttaaaagtttaaaataaaatacgttaaatttaaattgttgagataaaattagtcaaaagctaaaaatttgagcgtaaaaaattgaattaagtttttcttttctttacaaactacaataaactctatcgtacgaacattaccacatatgtattaattaattaactgcatcatattatacaaattcgtaaatatgtaaacacttataaatagcagtttgctgaattaaacacatgatatataaacttaatagattgtaaagtgatatgtgttaattttgaaggggaaataatttatttatttctctgagacttttttaagagctagtagtagttgtctcaaaaaatattaaaagaaaagggaaagaggaagaaagaatatttaaacaaaaaacaaaaataagatttaattgcacttttaaatttaaattgcgtccaaggtaggtctctcactttttttttcttaagtcaattaagttattctatttttaaaattaaaaaaatatatatagttttatggcattcttccccccaaaattttaatttttaatttttagtttcgcctcaagattattacaagatcaattaaatcatctattaatctgttaaaatattatctatcaaaacattaagttgcaataaaatttaaaaaaaaaatcaaaatttcctattcaaacatttatatcattctcattttattagaagatgcaagaaaaagttgatcatatattgaaaataaatttccaaattagttgtttcttcttaattttagtgtctgcttattttaaattttgataaaattattttttacaattgtaaactttttttttggataaatacaattgtaaactattgaatgttattaaaatttgtcattgtataaaaataattttgaatgacaaacgaacaagcacttaacattcctgacatggtagtaaacgttgacaaagaa

SEQ ID NO: 3480 - DNA, 1109 bp, Glycine max
  Soy_ogl_5136 Gm15:47194901..47196009 Cluster 13
ggttgatttgattaaatgatgtaattgcttacattgcaccttagctgaattaaattaaacgaaaagtgtcctatgttaaaataaaaaaaatgaaaaaaatataatattttcatgtagtaaaaagtgaaaaaaatagaataaaaaaaatcttaaaagctttttagttcctataaaatagaatttttatttttattttaatctatattgtcaaatagtatcataaacgaattatgaaattgataatattaatagtctattaacttatcttattttcaataaatatgacagataatatcaactatttacaatatataggaacttaaaaaaaataatttataaaaaaattacacatgactacatatcagattccttgaaaacgtagaagttaattaaagataaatattcttgttatgttatcactcaacattatctttgaacaagaattactaaataaaaaattaaaacaaaaatctttaaaagattaaaaaaatcttattttaattataaaaagtcaaaaagttatttaatagaagataaaattttaatatttttttggtaaaccaaaatatatatgtgtgtgaatacaaagttagtttaaaataactgagtgcacaagcattgcagctactacaaaaccatcgttccctcccacaccccagatcaaggaagcgcccctcacacacccacctgctccatccaaccatataaaaaccaaagtttgtatatagccagagggagcaagcttagccatccaagtctataatacaagattctggccacagaactcccacacatcacactttagtttaatttaactttaaaaagtttctaaggaaaaaaattctaaaataattattgttttagtttttaaatataatattaataattttttatttaaatcttttatgatattaatagtttaataaaatttataaattaattaattttataaatttatttatttatttttatcaatgtaaaataacttaaaacaattattatttaagatggaggaagtaatatttaacataattaagtacttacaattaaacttctttaattaagaggaaacaactttgtgcttgataattcctgatgatataaaaata

SEQ ID NO: 3481 - DNA, 1146 bp, Glycine max
  Soy_ogl_5383 Gm16:30916901..30918046 Cluster 13
ttaccctatactaattgacaacataataaattaatgtattatcaacatcattattatattattgtttaacattgttattaaacaacaaaaactaaaaaaaaaaactttaaaagacttaaatcaaaacaaaatttttaaacgactaaattaaaaatttcttattttataggtacaaacacatatttaatccattagatatttacacgaactgaccaaaattatcactatcagaagttctcgtgctgcgccccctctttttataccacttgacattgacaccaattttgcttaattatttttgcagctctttttatctacatgccggcaaattattcaggaattatgctttagcacttatcaaatcttttggaaattcttcctaacgacaatatcaattaaatctgaattgatcttctatatatagattattgtttcctttaaaacatcattggaattgaaatgattaatttatagcaatgaatcttatttatagcatcattggagataatttattttaggctacgtccaggtaggagaagcttttgaaacgaacttgattaagatatctctttactaacacttcattacaaacatggtgtggtacggtaacatttcgtagtatataagattcattggacatttttgggtcttatatcctgttttgaaaaactttttaatttttaaaaatcgaaaataaaaaaaaaacttgttttataggtgtagtttttgtataataaaaaaaactcaaaagtagtatctcatttataggttttaaacctagaaaagcaaaacattttttaagttattttgatttttattttccatttcctgttaatcgtaattttccttacacttgcactcccacctttacttctactttctgaaaatccatttttgaaaattattatacaagataatttttaaaaaggcttaattgcatttttctgttaactttttacttttttatgaattttatcccaacaaattaatttagcgtattttatctcttactctttaaagaacttgcaaattttaccttttgtgtttagttcacgtggcattctaacataagtgtaaaagttggaaataaatttgtcaaaaaaataaaaaagttgaaaataaaatttaccaaaaactgaaaaagtt

SEQ ID NO: 3482 - DNA, 1098 bp, Glycine max
  Soy_ogl_6486 Gm19:41248503..41249600 Cluster 13
gtagaagaacatatgctgagatagactaacctcttaaataaattttctttccgtaagagattagttcctaactctttaactcgtgtctaacacttttaaatatgatgtatgtttctagatgcccacaagataacacaacttgtgtttcatctcaggacttttattatattaataacatatacttttgcttgtcaaaaaaactaaaagagttagacgtaagagtaaaatttaagaacgcataaaataaagctgctttatctaacataagatttttttaaaaatgtaacataagattagtccccaacacaattatcaaacagcgtaaagtaacactacttctacatttcattaaaaaaaaaaaactacttctacttcgacgtatcttaattataatttttttaggaaaatacaagaagtggacaaaagaataattttaacttttgaagtatacatcttcagtataatttttttttttttacgattgtgactgattatatattttcctatcattaataaacaacgagtttagcagattatataattgttaacatatttaactttatggataacctagcacactgtcattaaatataaagagaaataaggtatatatatcgaaattaaactttagtttgaagtatattgtaggatctttctatctaactctttaactttcttattagatagtatttaaatgattatgctagataatttactaaatatcattcttgtatatatgctatggaaggtaaaattttgtaatgatattttgttatttttgaaaaattgtaaagttattcaaaagacaataagtatccatcgacatgcaatgattgccataaacggtataaatatcttgaatgattaaaaaaaacaaaatcctattgtcgtttcagaatacttaagtttgctaaaccatacttgttttttcccgtaacattacaaaagcctcttaattatttaactcaatatcgctttaccactagagcatcgatcatctccttattatattcttgtatctaactctttattttcttgcctaaaaaaagaatttattttcttaatcgatactatacaaatttattactcagcgaaaat

SEQ ID NO: 3483 - DNA, 1000 bp, Glycine max
  Soy_ogl_475 Gm02:10424901..10425900 Cluster 13
ctttaaaggttttttagtcatttaaagatttaatttttttattttaatttttgttatcaaataatactagctaaagatgtaacaattatgttcacaactcgttaacttgttatattatcaaagaatttaacaagataattatatataatttttctttggtaaattatatttctaaattcttcatcaattagtttaaggtcatcaagcatttaaaaatataatttaccatatatatatataattatcttgataatgtaacaatctaatgggttgtcaaaatgattatcatatcatcatttaatgttattatttgataacaaagactataacaaaaataattttttaaaggattaaatcaaaacaatttctttaaagaattaaataaaaaatatatatttataagaaccaaaaggattttttttataatcaaaagttatttaagcttttaatttttttaaaagaaaaaaaagtattgagtgaagtcatacggtctccaaaatatccttactaaaaataaataaataaaaatctatttcattattcggagatggataatggatctaaaagtcttttttttttcttttttaggattggatataaaagtcttagtagctaggtagatcacaaaaattcaatatcctgacaacttttattatattttgttgttaatatatagctagccgaaacccaaaaacattgttatcctcttctgttttgtacgagtgcatatcatttgattgtcccatgctcttcttcttaaataattgttgttcttggttagtttcatatatgaacataaaaattaaagttaaaaatttgtagatcgatgagttttcaatagagtacttcgtaattagtaaattaagtcacaactatatcaaattaaatattctgatgaataaaataagcctccgtgcacggcacaagttattagtttctattaattatgccgcactagattaagctaaggcaggttcattatttaattaattgtttaata

SEQ ID NO: 3484 - DNA, 1100 bp, Glycine max
  Soy_ogl_2620 Gm08:11901401..11902500 Cluster 13
tagttatcgaacaaagttaaatgattattataaacattatttatccatattattaatataatatattattctaacaaattcttttattggtataaaaactaatatataataataaaaatgtcatattattaatataagtccgcaaatatataataatgatttgaattttattacgcaaaagtcatataatagatagaattataacttctaacatatttttctcttagcctaatgtataacattatttttatagtataaattagtgatagtctaaaaatatttttagactaacaacacattaaaattaaatccgtaaatgttttaatcatttatataaaaatttgtttaaaatatgtttcgatgtattataaagaaaaaaaatcatacttttcaatagttatcgtctttctaaatattttgttccaacatttaataacagtattaatattatttttttgctgaggaaaacaatattaatatgataattaaaaagatttaacacttcagagtaaataaaaagtaatttctctatatttatatgcatgaatcttatgtatatatttatattgtgtattttgcagaaatcacacatatttttcaaaggaaataactgtacttgaactcaaaattattggctaaattgaatattttcatactagttaatttatatagtcgattatgtatgttattttgtgttgggtataattcgttttttgaaaaaaaaatcatttattttaattacctaattagtcaaaagaatttttaaaagataagtaattatttttctacatttaagttctattaattaaatagaaattaaaaatgtcaacaatttattagacacaggtgtaatatatagtttttgtcattgatatcaaatattaatcactgcgcgcctttagttaattaggaacttacatagtttacaaaaatttgtatatcaaatttaatatggtttagtggaaactaaacgttttcaagtggtcagtgatgaaatataagttctccactgttgagttgggcataccaccatatgtttttatatttttattttctcttttgtgaaactttgatttcttttcatgagtggttttctaatg

SEQ ID NO: 3485 - DNA, 1096 bp, Glycine max
  Soy_ogl_3788 Gm11:7356369..7357464 Cluster 13
ttcgtaaatagtattatttattcattacatctaaaaaataatagtataaattatcataaaaattattgcatatgtatgtattactcatatataaacaaattataacttctactttcataagatctctaaaatatatatcactttgttatgtttatgtcaagacttaatgatattagcaggttctatgtctacaaattttttatgtttagggggaacttgttgcttttaattattattatttttttactgctgggtgcttataaagaatgtagactttagtatctttattcattgataaacatgcattctttgagaaggaaacttcattttacattcttaaaaccacttttttaattaaaagcccaaaaaaataatcccttaaataatatatacaattttctaatattaaatactaaaaattcttgtaagttagtttttaatttatagtcttagtgcatatgggtgtttagttttaccatacatagaaagcccagagccagatgcaataagcataatatatggtggagaaaaaaatatatcgcaattgacgagaacaaacaaagtatgttgttattttttcttttctttgagtgtccttttctcaatctttttttttttttttggtgcttcaacgcgtcattgtaatatctatatgtgtgattagattggacaaaggcccgttaattgtggaatacattgatgagctagtttttttttttttgttaatgattcttttaaaaaaatgttatgggtaatttatattttttataatcttattcaatgtatgtgatattatatataattatttttatttttccttttttatctttttaatattatatatgctaatatgtatcacaaatataaatcatgaaaatccaaatgattgatacagtcataataatttagttagtaacaaaatttattttattttttattatgtgtaaaattttattgagataataacaattatatattgggagtacaattaatgtctaacacagacacagtattaaaaaaataagcataatttctgatttaagaaaaaaatataaaccacgaaatcaatacgacaactctttactatcccctcagt

SEQ ID NO: 3486 - DNA, 1000 bp, Glycine max
  Soy_ogl_6510 Gm19:42403201..42404200 Cluster 13
tttccaattcactttaatttaaatatttatcccttattttactctatttcacctcaaccaaattattttaattttcactctatatttctattatatttctcttctcacctattttcttcaatctattctcttattttctctcttaacaaccaaacacatccttaaattttatcaactttaatcgaaatatatactaataattattttttattgtttaaccgtgtaaattttttatactaacaatgtactagtcaataaactttagaaaatttaaggtcactattttggacggttaaaaccttagaagagttttattcggttgattttcaattaattgtagtttatatacggatcaaaattgcaatttaaaatgtatattaaatcatacattataatttgatggcctaatatgattgtttttcttgtcgctaatcctaatagagaaataaagttacagataactttaaatgtagctattgaactttcatattaactatggtgagttttcgttcaataatttgccacaaaaaatgttcctataaaaaaattaattttaatacgttatcgatctgtctaaaaattttatatagataatgagttagatagaatcttaagtatgatataagaaattttttatattataaatataattctgttaaattcatgtggataatatctatataacaactttagcaaagaaaaaaaaaggttaatatctataataactacaatctctttgaactgagtatgttctttctaaattagcattacttgatagttcgttttaaagagtggaagtgtacctgcacaatggtagtagagtaattttttctttggtatgttgtagacttctcgttcttctttggtgaactctttttttttttttttttatggtgggatacatacttatgtgttatctcgagaatctcatttcttgtatatgtttacaggtcttagacccctgggccttacctttgagattagcgaggatgttattccg

SEQ ID NO: 3487 - DNA, 1000 bp, Glycine max
  Soy_ogl_3129 Gm09:36507701..36508700 Cluster 13
attatctcgtacgtcttgcaatatttatactcttatgtatgaaaaattccacgcaataaaattttctagtcaacttttaatatttaatatgatttattttttaacagtacatttaataagtgtaaaacacgccgtatgtcaatcctgtatcgtcaatcacatattaatattataaaaaaaaaatagaatagcattataaacagattgtaataatattaaaactgcttaaaataagaagctctaataaaaaattatgtttcatacagatttataagtatattcgaaagttaatagtggcataacgttctataaaaatgaaaaacgaaaagttataatatattaaaaagttactatattaatagttttgaaaaatactaataaaatgacaaaggcacatatctaaaacaaaagtactagcaacatatgaaggtatacaggtttgtttaagtaaattatagttttttggtgaaaaaggagacataagaaaattatcagtaatggataactatttttgatatagaagttattgaaaaaaaatactataacaaccaataattatataaaaaaaaacaggtaatatattttgaaagtattgcacttgtcatttcattaattgttgttataagtatatgagagttacaatgaatttgggagaaaaaaaacacttcatatgattggttctaatatgaatcagaggattttttttttcataagcttttcatacgttatttttataagttactagttaccttagaaaaaaactttatggaaatgaattagtaggctataatggactagtatataatactactatgatttatggtggtcatctatataataaccgttagatttatcattgggatattgaaaggtgtatagatgaatcccaatccacgtatgaagcataattgcatgaaaacagactcaaaagcaactattttttgcttctgtgatgcgtgctgatgggaatgatgatgagaatccaaaaacatgctattat

SEQ ID NO: 3488 - DNA, 1083 bp, Glycine max
  Soy_ogl_4089 Gm12:35205501..35206583 Cluster 13
tcctctactaagattaaatgcacgtttgattttgtcatgttttaagaaaaaatgtttttgattttatttattattttttatttaattttttttattctgatatattgaaaatagtttattaaaaacaaccttttttaatgattaatttaatccaaacactccctaagcttttgacattatccttcctttaattttcaatagaatttaatgttttaggtcaacattaaattattggaaacaaatagtcaacatgttgacaactctacataattaatatgttccaagtttttcacccaaaaaaataatgtacatttactttcttatttttggagtcaaaataccggttatatactatatcatgcaatagaaaataacataattatagtgatataattgataaataattttattttttaaatatatttaggtaatcaattatagataagtgtctatagaaaaaaatttagttaaaatgtattggtcatttaaatgaatctatttcaagacattaatcattaacttttaatttttttaatcatcaataattaaaaattctggctccttgatgagatatcaagatattctctcaaggtctaggcttttagaccaactataggactaaaattaatatcataaatttgatgtttaattacatttaaaaattttcattctatcaaagaaattaatgagatattcagattactaaaatatcatataatataatagtggcattggtaaaataaaaaaactcaggtagtcatgaactaattataataccattttggttgtttaatttcattggtgtttttgttttttgttgtaagcacggtgtcattacaatttcgtttggttttacaaattcaaatttgttcatgacatgtgctagatcaaatgctgtctcattgaaaaaagaaaaaaaaaaactggtacaacaaacatcataaagtgttttcctatcgataacacttttaactacttaacaaaaaaacacattttcatttatgcagaaaacacacttttaaatatacctttttttgagcaaacacttttaagtacttaaagacaaccacattttaaaaaaag

SEQ ID NO: 3489 - DNA, 1078 bp, Glycine max
  Soy_ogl_1650 Gm05:31980001..31981078 Cluster 13
gcagctagcatttcatatttggaatctaccgaaagatgaagcgtatacaatatgtttttttttattctatacgtaattattgttcattgacattgttttcttgaagaacttgtaatagagactaatgtaattattaattaatacaatcatgagtagtagtactacgcattgagctaataacggaaatagagaataaaactttattctagtttttaaaaattattttcacattttaaaagtaaaaaaataaaaagcatatgttttagtaattgtttttcataaatttattttcgaaattaaagttttcaaagtaattactttcatttttttatttttttatttctatgtataatattctcataatgaataaggtgatttatttattcacatataagacataattcacatatattcttctttgatgtataatttttttaaaagaaaaatagtttttgaaactttcttaatttaaccaaaaaattgttttgttttcagaaactatactgaaaacaaattttaaaaattgtattgaaaacaagttttgaaaataaaagtgagaaacatttcaaataagttcttaaagtaataaaaaaaagggaaagaaaagaaacatgatgaaaccagtatacaaaaaaatgtcatacctaatagaaaaaaaaaaaaacagtctgtaagtttatctctattgatatagtctttatttaacacaaactaaattgttgatgatatatagattttgcaagtctacacgaattatgaataatcttctaagttttccgtcaatgttagcgtctgtgtcgatgttaactgtgagatgtgattcaaagactgaatcaatgaaaaagaaaaaagacctaaaaaattaggagatcttgttaaaaaagaaaaaagaaaaagaagaataaaagataagttgagttgagaaggttcttctaatgccatgccaccttatcacgaaagtccacgccaaccactgcgcgtcaatactcaatatatagaaacgcgtactataatgtgtccacaaatagggatacaagtccttcaaccgcaagggatgctgtggatgtttttagagacc

SEQ ID NO: 3490 - DNA, 1041 bp, Glycine max
  Soy_ogl_1886 Gm06:10113701..10114741 Cluster 13
caatgagattaaagtaaaatttaaccaaaatattttactttaaatgtgatagagatttagtaggctttttgtcaacatacatgaattttttatgatgagactttttattttataaaactaatagtatttttttatagacctaaaatttaaattttagttgttttatttttagactgatcttcatgtaaccaatataatatccgatgccaacctaattgagatcctacataggtggtatattatgatgcaatagcttacctagccttcaatcaaataaaattatgtgtttttgtcaattttaaattgtaataaaattgttatacttgtcatttgtcaaatgcatttaattaaacaatttgtagagatttttaactaataaaaataaattaaatcaccaacaaagtctctcagatgtactgttactattgaattttcactcgaatgaaaaattataaacatatgaaatccacatcttttttatttatctcttcccatcataccaaacacccttcattccgcatcttccctcactcctctccattttcctactatttgttctctacaaaaaggactctttaggttatgatttaccctttacttaaagcctttccttcccctcttgcttataatttttcatttaaatatccttttaaaaatataaaaaaataagagttaaaacaaacaacaagaaatttcccaagggcctatttgtttattttaagaattaaaaatttttgaatgatttttttgaaacaagaaaaaaaaactaaatatattttgaaagttctttttaaggtatgacatacttgtcaaaatattaatatcatgttcttcttttatgtattaatgacataatttttaatagtatttaaatgtcatatacgaatttaatttcatatttaatatgtttccattcttattcggtggatttcatataaagtacatacaataataaataatacattaaacaaagcaactaagtaaatctaaaccaccccaagcaagtgaattaactattgggattgttttagcttaataggc

SEQ ID NO: 3491 - DNA, 1000 bp, Glycine max
  Soy_ogl_2554 Gm08:8016801..8017800 Cluster 13
tggtgggccatgtgagacattttttattaaagcaaagtggcaaatataaatttcttaacctggaacatatattttatatatatttttatccatataaattaaatatggcatgagaagtttctaacatgcacacactttatttaactagctaatacaaatttaaacgtttgaattttaacattgtttttcacattaaatatattaaatatcagtattatcatgtatataaatatgagtaacatttttttacacatccattcttctcaaaatcgctctttcacttaaatttcaatgtcatccaatttttttactcacgtatcccaaatcctcaacttcctcttattttagttcaatatatttctacatgtgtctttactagtgtgttggaaaactaacaaaattgtctatgacatccaaaatcatggtgaaaatttgaaaaagtggaagcaattatttattgttttggcttttaacgtgaaattggaattgattatggaaaaattaaatctaatccaaatacactatacaacaaatccatataattttacaaaaaattaattgtcttgattttaataacaattttcgtcatcaactgaatgtgtaacatatcattcccatattattggttaagactaaaaaaaaatattttattttaaaaaaataaattaacaagatacaattaatgagttttttaaaaataaattacacccaaatgcactaatacaaaaatattgattaaattatagttgacaaattatgatttgatacaaaaaaaaaccattttatttttgtttaaataataatttgagcgtattaaaaaacaactgaatagtaattttgttaatatatcctctatatagatggaactgaatttatatgttctaaatgaagtattttggcaagtgtatttcccctaaaaatagatgtttaaccttatatatatatggttaatgattcttggatggaaacgtggcttatggggaacctcccgtaggaccat

SEQ ID NO: 3492 - DNA, 1100 bp, Glycine max
  Soy_ogl_2666 Gm08:13664401..13665500 Cluster 13
actctttaataaaatctttaccaaactgcgtatccaaagagacctaaatcttataaaaatattagtagcaagatcctatcattattctgcccggtcatatcattaattttttaaaataaatatcaattaaaaaatatgtaataggaaaattcaaaaaatcacttgtcgtgcgcttatgacaaaagctgcttacaaataggattttcctttttcaatactaggcacgtcacacaaagtcaaaagggtggatgcttccttttgaaggaagaaatgtcttctcgggtaaggaaggttctctttgaacttattgtattcaaagttcaacacaatttaaaatgacgtgcgtcaactacacacaaaaaatattttacgcacattatcaagtgttatattaccacagaaagaaaaaagaaataaaacgaaggcatcttctttttattataatggtattaatatcgataagctagtgctaattattattttttattttattaaagaatctgagttcagtttcatttaaaacaacaatatattggttaaacaagttttaatttatggtttcacatgaattatttacgttacatttttttactggaataatttaagtaacttgtcactaacccaacgataataacttgtttttaaaagttaaagcttttagtgtatatatttaagaaataaaaaaatattactactctattaacttatcaacacgtggggtccccgttaacaactttcctaagacactacctaattaacaagaagatttggatagaccttatccataagtctctttcaaaaatgtgttataactattaataactaaaatataagatatatttcaaaagatgcatgttttacaagactggttttgttaacagaagaatttattatgttttcattaaattaattattaataactaaaaaaagaaagtatgaatgatctgtttaatactttgattttatacgatattaactgttttttatttttcatttcactttatttttcttttgtgggtgaatcatactatcatagttttcattttaattgttttcatttcctaagacataattgccaaattggcacttatcatatgcgc

SEQ ID NO: 3493 - DNA, 1041 bp, Glycine max
  Soy_ogl_2979 Gm09:3980860..3981900 Cluster 13
ggcaagctgaagaatcatgaccatgattaattttgtacttaacatacaattttatatacaaagtcaagattgtgtacgacaacagatttcatcatgattatgatattgtgatattttcatcatggttggctccaaacttttatcatggtcatattaatctattcgaatctgatcttatttgattcagggtaatcatttttattattatttgtcaataatatatatagttatgtttttgaataattatatatacgaaaaaatgtgacgtacaaatagtgaagcagtaatagacacctctcaagttgttttacctcacactcaagaataattatatgcagagaaagatgtgacgtacaagcacatttagacaaatgttgaaaggaaagttaaatattgtttgtttaaatagagttgcttgtttgtttagatagagttaaataatgtttttgtggacaacactattttccttactagtcatgcaattgctcaaggagcttaacatctgagtaatctttgcaccattattttctagaccttacatttgtttactgattgttctatgtaaaatagatatttaattaatgtttggctgataactttttaattcaatggtttacattaatcacattatgtttgagttggtcaggttggtgctagttcccttcgttaagtcaatcgattattggctattaatgttattctatgtgtgacattatatttagtaaccttttgtactgttttgagcttctaatgttttctttggacttgtatttaagcttcatacggatggtaccaattaatttatatataaaatattttttaccattgttagtttattatcaatgtatagaataaaaattactcaaaatttcttttgccgtaggaatatcaatatattatgagagaacttcaaaatcccaattcctcatggtgcaccgaatgggttcacaatcagatttaatgggaagaaatcaattgccgagaaaatgtggcaacgtcaagcgactatttttttgtgtaagagaacaatctcatagtgta

SEQ ID NO: 3494 - DNA, 1084 bp, Glycine max
  Soy_ogl_3371 Gm10:4983901..4984984 Cluster 13
aggggaaaaacttaattagttaatttaacagatggcttaataaacaatctgggtgacagagagcgtaaaaaatgaactgtttaaattaaagttgttagatggataagaaaagtaaaaaacaaaaattaagcactgatggattcccattttaaccccaactatttttttttgtaagaatttttttttaaatgaatagccatataattgaagaccaactgtatgcatgtggaagatttatttttaatagaagacacataatcgattatgcatttatgtgcctttttaaaataatttatttttgttaaatgatggtgagatacttttctcctttagttatgcttcttacctctcttcactcaattttaatgctccgtatgatgtttgtttgaagggaaaaatacctataaaaaatactttcacacttaaataaaatcttaattttaaacaataaataagataacaaatacaaatgaatcatgatccttattagaagatcttaactctctacataaattttttttttaggcattggacctttgaccttcatgaacgtattaccgtttaagtgatttgtttctaaacatgattaagggacctaattccttgttacctttgattaaggttatttttgtcttatatagaagcgggtaggaggtatttcattatcctgtctgaatacctatccaaaatacctacccaatatacacttgattttgtttgacatgcataatcaattatatgccccaaccaatatataggagggatcattaaaagaagaaactatattcactgatctttactgtgcattacataagttttttcctcatttttgtgatgaaggtatagtcactgacatcacttaattattaaaattttcatctataattcagctcaaacaagcaacattaaaaatctactttcatcggcattcacttctcttattttcatctcttaactttctactgaaacaaacacagattaataaataaccaggagtgactttctccatttgagtttaccatattcaattcccataatatctgtggcttacctatcatattcacatgtacataattcccatatt

SEQ ID NO: 3495 - DNA, 1100 bp, Glycine max
  Soy_ogl_3440 Gm10:38052101..38053200 Cluster 13
ataattatttattaatgttaagatgtttttatattgataatataatgaaatataattcatattcatctaccttaagaaggaaatatatttgaaaaaaaaacgaaaaagatgaatgtaattcgacacaattaattatataccgaatagtttggtactttgttcatggaaaacaccattattgaacaatcaattaactaacacttatttttggtggaactaataattattaaaagaaaattgtttgtactctagtgattacttggatgattgcaactaaatttctaccctcgatcctttcgacttgcggttaccgccaaagcaaacaacgatttccatgcaaataagagatccccattgtaaatggtttaaaaacatactcacataaaaagtttctaaatgaaacctgttacgtaaatttgtccacacgttggtgtactttagttccatctttttgtgcagcctaatagtatggtcatatctggtcctttttaatcgtttatgtttgaatttatagaaatcaaataaataggaaagaattttttttctcgtttgaaggaaaactaaaaaaagaaaattaaacctctcatttcacaatactaacctgaatttagttagaggacctcaaataataataaactaaccaaaatttgaatataactataaattttcttattagaggatttaattttacaaaataaactaacaaaaataacaattaacaaatgtgtaccttaaaaaacattaaaaacttaaataaataaattggtgccaaccatatttactcacaaaaaattatacatgaacataataagtaaataaaaaaataatacatttgaaaaaaagaagagtcaaacatatatctatctatatatatatatacaagatggttaaatataatctaactcgtcattttttgtttactaggtgagttgatgcgtagactcaacatgttttatcactccaaaacataaagaatgatatgtttttttttttatttcaaaatatgcaatttagttatattttttcaacttagtggaatcaaacttaattttgatatacagtatttatctaactttttttatcactaggctgatcttagt

SEQ ID NO: 3496 - DNA, 1000 bp, Glycine max
  Soy_ogl_4770 Gm14:44220901..44221900 Cluster 13
ttgctgctgaggatccaaacgccgatctaagtactacccatttgcaatgttgtttctggctcatgaaaaatgatatatttatttactgcagagtccaacacaattattcttaaaaatattcccttttttttattattatgaaaggaaagcttaaaaatattccttgcatgatcatagcgttaaggcaggtagcaatgagtaattagactaaaattaaaactttactccattgaagaagatcaccaaattgtgatttgtgacgagtaattgaatgattttgaagaaagatatattttcccacaaagaaagaggctatatataaccaaagtcttttttcaatatgaaaaatcaactccataaatcaattgacgtcattctattttgtcataactttaaatcgttgtaatgttcatttagatttaagtccttttcaattgtgttatgtatttttttcttaagttcgccctataaagaattgaatcaattcatcttattcatatggatatggccaaaccgttcttctcacagaagaaagaaacaaataaaatcgttaattatcttttcattacaaaacaaaaaaaacttcgaaataaaaataaaaaataatttaggtggtgcccgacaattaataaaagggtaagatcgattctcaataagattattgtaatttgtgaatctaaccactgaaaaatattataactgaagaggcatataatggtcgatagaaatagaaactaataaaattgagagagaaatgtccttaacgtactactatcacttttaagtatgtattcataatcaaattaattggaaactactacttttgtttagatttatcaattatctaattgattaagatgtaaaaaataattaacttaattaataaccataaatatgttctaaatttaaattaagaaaaagtatcgaaatttgtaaggccagataaaaaatgatataaatttaatgctaatattttaaaaaacattatatataaaagtgg

SEQ ID NO: 3497 - DNA, 1000 bp, Glycine max
  Soy_ogl_4996 Gm15:11413301..11414300 Cluster 13
atcatatttggagtcatctattggactacataagagttgttcctcctcctagtgaacggagagggtctgatagtgtgaagtggcagggatcaaatgatgggtgcttctctatatagctgctgcgtatgagagcataaggagccagaatgttggtgtgcaggatcctttgtatgacgacatttgaaaatggccaggtcctgagagaatttgtgccttactaaatcatgacatgtctctctctgagaatatcagagtgtatgacactattcttccttttatttctgcagctattctagcttaagtaatttcaactgattttcccgcatgggttttaattgatcagctatttcaacaaaaaaatatatatatataagttttttaaaattaaattaagattgaacaatagtatcatataaatattcataaaactcctctttaggtgttttaatataggcatgtctcattaaaaaaaattgagaaaaaaataatctttgtgcaagaaaacaaaatacataactcaagtaaaatcaaagtaaatacttatttattataaaccttgtcaagaaaattagtaagtcaaactcatagagatgggtaaagaataaggttgaattagttaatctattatgaaatatcatagactttactcacatttcaaacttataaattagtttatgaaatataaatgctagtaataatttgcatgaacagttctaccaaattttcatttgcccaaacttattgattattttcaatactatcgttgttttatgctaaattactatttaatttttattatttaatttgttccttccattattgaaaagtttaacctacgtgacaagtacatgtcttttttttttttttttaattgtattatatatatacaataacttaacgtcgttttttttacaattgcatgaaaatgacagcattacattaattttaaaaattgactttaaaaaaacattaatattaaaaattaaattattacattgaa

SEQ ID NO: 3498 - DNA, 1000 bp, Glycine max
  Soy_ogl_565 Gm02:15311101..15312100 Cluster 13
atgttgttctttgtaatgatatgagataaccatcttgcagtaaaaaaaatgacttgagatatttactttttattgtcaatttcatttgcacttgcagattttttttcatatttaatgtaaaaactttgggggaaaaaccctcagttttgcaattataaaatttaaaataaatttcaactcatttatgatataattttgaaaagatacaaataatgtacatatagttgtttttttattaattattttagaataaaatgatttcgacatcctcttaattttaaggtgccaaagcagtcaccattaaattaaacgagttaagtcagtatctcacaattagggagggatactcattgatctatcttgaataatattatttgtgaaaaagagtataagaaacaaaaagaaaagtatttttttaacttaaattttgatattgttatttatgtgtcattttttaattttggcatgaatgaagtttatttagaaatttaataacaaaatattctttaaagacaacaaaataatttttttttcctgtaggaatcaaagacaaatattcttagatttataataactcaaatattatgttcaattgaaataaaccttctaaataataacaattaaccaaatttgggagtccaaaaacaatagttattcaaatttgagagactaaataaacatataagtctttttacatataaaattaaagagataaaatatgttacctcctggtggtggggctgaggtattacatgtaagatcataggttcaaacctcaattcaacagttatataaaaaaatattaaaaataaacatgcactaatttagaggcatgattcaatgagtttcttggcaggtatatacataattttcacactaattaataatacatttattaattggcaagtatataattggttgataaacaaataataagttttcagattatattaacagattatgaaattgttagttaatatattaaatgagtttctctaac

SEQ ID NO: 3499 - DNA, 1170 bp, Glycine max
  Soy_ogl_5585 Gm17:8338906..8340075 Cluster 13
agtataaatttgatatacattagtaaatcattatttattttatattaatataatattttataaatataatttaaaaagatttataaaatatttgtgcaataaaaatgattaaataaattgaatgactttaacttttgtctatatgctgaaatttgtaatttcttttcacatcgatagattttttccttttgcacttattttattttcatgtaaagccttccacacgtgaatgcaaaaggcccctttttttaaaaaaaattgttttgtttttccggtgcagtctcttttgcttgtttgatagactatattatagtacgagacatcaatttattcacaaggaagggagtcagggttgtggtccaacatatggctgttaatgtcaataatctggcctctggtgactgatagggattatcgatcgatgataaaaagtgcagatgcatcaatggccttttttatatggagaacctaaccacggagcaagatataaaatgaaactctggtattcaattctcagacattttgttttggtagggcacggctatatattttattcgagcaatatgattattatgaatatatagttaaaaaaaaattcaagtattcaacacaattagatctcaaatttaagactcctcgaacaacaatcctaatagttgataatttataatgttagttaaaggataaaaataatccaaaaactatggaaacaaaaataagacattaccgtgataatatagacatagattatagaattataaattagagatcaatctaactaaacgttttaaaattatgaaaacttaattagataaaaatagccataaataaacacataaatgaaaatagacattctctcataaaattactaaaagtgcaaatctaatcctcgatgaaatctcaaaatggtaaatactatttgtttaactaaagtagtgatttcatgaaatttgttcttatatgtgttttcaatttcttacttctttacatgattcttacattcaagaagatagaaaatttcaaataaatttaaccatgtattaaaagaggtacacgagtagtgtaaaaaattgaaatgtcaaaaaaatactactaacattttttacatacattttttttaatttattgatttggttatgtgattatggatggtgtgtttttcatggaagg

SEQ ID NO: 3500 - DNA, 1000 bp, Glycine max
  Soy_ogl_5929 Gm18:48291..4866200 Cluster 13
tgtttatactgtttcatcattaatataacttttcttgtatatggtggccaattcttgtgagtccctttttatatcaatcgaaattgagcttatgtaatcaactttttttttaattattagttataaaatagatataagagcaaactaagcagtaatggaatattggaactactgaaattaaacactactatgtatagagtttaattattttctatagcatttaaaataatttttacggacattaatttgatatttctttaaaaaaaatgaatagtagtttaaatatttcatataaaaatcaatttcttatcttggtgaaacaattttttaaacaaaacacaggaggacatatgtattaagtgcctgatgcagcaaataaaaaaaaaatctttcatccctttaaatctttatataaattaaaaacaatttatgtcaattaactaccttttctccctctccctctataactcctaacaatgccgttttacaagcgctttgtggtctgagaatgtaattacatcaaatatttagaagaataaatttatagcttaaaatagtcttatttatttagctcgagtaaaatcacttttagtaaaatatacatgcgatttatatattagaaaaaaaaacatcttgagctaggtaggcttcaaagaattcaacaatgaaattagtttctaaaattattttactctcacctctttttgtttttttttttctttcacacgttttttgtttattttttacatatataaaaaaaagtagaagggtgtgaaaagagcaaaaaaaatgatataaatagaattactcaatataatgtccttgaagcaaatctacctggtcaaacccagactttcgttcttcatgatctcctccctgaacttattgaatggttttggtccattaagacttaaagatgttgttgaatggggattgctattggcccctattatctttcaaaaattttaaaaacatcatttcccacaatgcacaatggaaa

SEQ ID NO: 3501 - DNA, 1000 bp, Glycine max
  Soy_ogl_6349 Gm19:2531601..2532600 Cluster 13
aaggagaaaaacatatcatatgtatataaaaaagtcttatgtaaaaacagattaaagggtcattagaaactacaacagctgttaaatcacttaaatggttatgcattttttcccacaacatccaatacaactgatagttgactgttattttaaatccgtgataacttgtagacataaataaaaaatatttatctcacataaagagcatagcagatttttttttaaaaaaaatcttaaaatttttttagaccttaaatataaaagtatttttattttaatccccaaatcaaaaattattttttaatctttcaaattcataaaatattttttttaacccctctccatatatgttataagtgtatcaaacaggaaatattaaatttggcattaagtataggatctttattaatcttatctttcaaaaaaatatataattacataagaagaagcacgaaatcaataacaataatattatttttaataattttttcttcaccaatgtttgttttattgaaactattagtcatgattggaccaacatctgagagtcaatttcattcgtttcgcatcttgataggaacctgcggatcacataactaaaaaaacaaaaaagaaaaaaaaagtcatgtttttttttttcctattaagaatctacatataattcaaaatattgctcaaagaaccaaattaagtgaaaaagtccacttcaagccttataacttttagatccccagattctgtatattatttccaaaccttttaccttttacctgccttatcacttaatgcagcagcagccaccatatatagcagaacacatatatctcttaagtttaccaagaaacaagataaatttcttgtttctgatatgaataatagctacatgtttaaataaatacgtattctcactccaaatttaataaactctaggcaagtaggcaagaaaatctgataacgaaattcaattttagttaaagagaaatcagccaatctgatgttt

SEQ ID NO: 3502 - DNA, 1235 bp, Glycine max
  Soy_ogl_6918 Gm20:41904668..41905902 Cluster 13
tattccattgaataaaaaagagatttggttgattaagaatcataaaaattagttcagaaatattttggtgctttcgaatattgtgaatgatagtctatgatgagaagcaaaactttcatacagttgcaaagacactctcacaccaagtaagtgtaagagatgtataaaattaaattaaattcatatttataaataaaatgtcttatataatattatttatgatcctatatataagaaataagctatgatataataatagataatacggacaaatccaaaggagatccagaagtaaatgtatatatcttccaaaacaatatctatccatcaaactttaaattaaccaatgattaacatctaactaaccaatagccgcaaaagacaaaacattgttacggggatgaatgggaaaagaaagaccaaatgggaggtaacttgtaaaaaggatgaaatagaatggcgtggaagccgaaggacttacaaattaataatgaatgcttctaaaaatagtatatattattattacagaaaaaatatcaaactgtaataaaaacaggataaacttattaaaaaaaattcttattatttttggggtaatgttaacctgtgatttttttacgtaacttttctgattagctccatttttttcttgctaaaactgttatttttaacctttttttattcggttgaaaaccaaaataggcaaaaaggagaagtgaatattgagaaaaaaaatatatgttaacttccattgtcaggaagaggataaaaaattaaagcaaaaaaacaaaatgtactttgatcctaggaaaatttttctttggctcaaatgtgaaggaaagaggaaaaaaaactcataactctccccttcaaaatacttgtttgtccctccaaaaatgcctctcatctcatcctcagcttccaaccttctctttcttcttcttgtttttgtgtgtgttgtcatgatcggccaccctcctatcatatcattttattacgaaattcgcaaatagcctcaacacaactatatatatagttcctaggaccaccacccaccatttttattcttcatgttgcttgaataagtaattaagcatctcgtgtggatctttttcctttcatagctaactaatatttaactctgttttagcattatacttccatcgatgctcttcataatagtcatgtttgatttggatttctagtattctcaaaacaaaggatacactactaca

SEQ ID NO: 3503 - DNA, 1488 bp, Glycine max
  Soy_ogl_2090 Gm06:46287613..46289100 Cluster 13
agtactttttttaaaaataaagtattaatatattactcatttatgtgttgaaccattttttttatttttatattaatttcttttgtaaaattaatgtcttcaaaacaggtatattataacattaattttttaaaagtcattaaaatatcaacatatttgctatcattaaaacactaaaacaataacaagataatgggaaaaccttttaaataactacttaaagcttagttttttttagatacataagttttgttttttttttaaaatatgatttgatttttttaacaaatatgtatagcatagcttggacctgaacctgatataagttgggtcacaagtgcttgagaaattacctaatcacgtggatacggaaaatggtgcttaaagatggctacgttcacttctttttcttttaagaaaataaaataaaaataggcactctagtttgcactggctaatgcttgcttgttttcttctttgataaatatgattaggcaactgcttgtgtatttttttattttttatgtattataactgagctagtggatgttgtatggagcgatagtgacattgtgtagattatagagattgattaggctgggttaaaagcaatgaatgattttggatgttttctcttcatttttttcctcttcaatttttgcgtataatacaacacaatagaaatttcaaacataaaatataatttaaatacccatataacacaaaaaacgatttttgtttttctatttataataaatattaaattaatttatgatattctttgttttgtaactgagatgcttaattttcttttgtatgttacaaaaagagggcaccaatatcttaacaaatatccacaaattctcataaatatctattatgaatacccacttaacaaaaactcaccacttatataaacgaataacaaaagaccactggtagtactatccctacccgattcattgcaatccctactagtattaaaaattaaattaattaagaggcagggtctatttttaaaaggtcatttttctcaagtcctattcatgagtcaagttttaaaaacattagttaagaaattaataaataataaatattcgtatgaaatatattaaaaaattaataaacaaaaaatgttcgttataatttaaaattaatagaaatttaattttacattattaaattgcataaaaaatcatctataaaaccgttattcaataaatataaaaacatatcatatgacatataatattttaaaaataaaacattcacacacacacatacaatacaataaaacataaaattagatccgtgttcagttaaccacttaaaaaagctacatatatatggatcaaaccatctgcatttcactaatttggtaaatgaaacccagtaagcaaataagccatctaggacccaaacatcatacattccaagtgagtacataaaaccagcaggtccagcacaccatacaaaccccaagacaaa

SEQ ID NO: 3504 - DNA, 1200 bp, Glycine max
  Soy_ogl_4725 Gm14:6737201..6738400 Cluster 13
aacaaattacaagttttttaaatgtaataagtttcctgtaaaaaaaagtgtaataagttggattggacaaaaaaattgtaatctcattatattaatcttgaattttggataaaattagctttcaaaacacatttaaaaaatattccaatccccacccccgccctcctttcttatttaatatatttatagagggatatgcctctcctgcccggcctaatttttttatatataaggtaaaacctttatcaaaatttatgagaggatgtcaaaattcacttaattttacaatcttatattaacaaaaaaattacattataataacaatatgaataggaaattaaacttaattgaatactacaatatataattttatggctccaatttgttggcttctaaggtaataatttttccacatatacatgtagtgaggtttcctaactatgttgataatattattccaacgccaattagtcttcttaattattaagtaaatttgcttcaatatgtcaaacagtcaaagttgcatatacgtaaaaatttaaaaaattatgatttttgatttttttttataaaaaaacaaacactacatataaaattgtcatacatacgtgaccttacatataaaatgagtattgtccaatatatagtaaaattttaaactaaaaaaatagaatgaaacgtttttatgtagttggtcattccaactaaattaaagtaatatgactccatcacctactaatgtatttgttaaataagataaaagttaataagcatgccaatttcatataataggtgcaatttgaaactgaatttataaaccattaaataccttctaaaacattctaattgatattgatcgatctttacccaaagatccaatctggtcatgttaccgatgaatcttatgccctggcctgcaatttttcatcaatccaagaacacacataaaattttgcaaggtaagtatttgagaaaaaaaaataaagagaaaagtaaaaagatgatcattaagatatggtaaagttccactcggagtatagtgaaaggaggttattgcaaataataaaatatattccactaaacaatcaacaaatgatatcatcctttaatcttaagcttatagaacaggaacgactatgatagtgaccagtgaggcgtgcataatcaaaattattcactgtacgaatgatatgtatagtt

SEQ ID NO: 3505 - DNA, 1018 bp, Glycine max
  Soy_ogl_235 Gm01:49789283..49790300 Cluster 13
gttaatatacgtctagaaaaaaaatagatataatagatatttaatatgacaaaaagagagagcgagagatagtcacacataaaaaatgtcagtgagttgttcaaaatatttggctaggtcaagttcttctttctagttttctattttttttcttgtactttcatgactcccatcaagatctcaactctattttaagtttgagataaccaatgtgtaattttcgtgggatcttaacgttgtttattacttttcttactttgggaatttattctaccattcttcacaccaaaaactattttgtgagttgtacgaaatgaaaatttgctaaatttgtgaaattgtattaaatcaattaggattgtagatttgtaattgtctattagttctaatatttagggataaacaatggttgtcgttatgtagaaacttaatttaacttaaataaaagtgtacgcatctatttattcgattagaattaacttcctctaaaatccgatgtcattagtaggttaaattcttaattaagagattgtttaggggttatttatcaattagtaaagtgatcaaatagtgattcgttattagagtcgattattagtaactataataatttatctagagaggatatatagcgtgataaatttatcaaggacttaactctaagtaaatatcaattataaaattttaattaattttttatgtatgaaaacattacataaggcaaaagcatctgtaaataataaatattgatggtactaagccctcgataagtaattagggttaagtccattgtaaattactaaatattattatatatatatatataaacaatttcacgtgagacattctccatatatagagactccacttatatcttcaaccagtggtgagttatatcttcctttatatctgtcttctgcatacccattgcttgccaatgtagtatacttctctactgggcactattaatttggggagttttgatagtgttgatttttcaattaataatgatcaagtt

SEQ ID NO: 3506 - DNA, 1234 bp, Glycine max
  Soy_ogl_1000 Gm03:40531704..40532937 Cluster 13
tgtatcaaactactttaatttaaatattttttatttttcacatatttctcttttaccaaataattttcatttctttcatttgttacctatttctcttcttatctacttacttctcctccctctttcaaacacatcttgcacctaaaagtatttttaaaattgttaatgaagcatttttttgtttttgtttttgaagtaatcaagcatgccctaactcagcacgataactcattttatatcaacttcaattatatggactgatttgtagtgacaatttgacaatctgacctgttcatagtaatagtactaattaagcactaagaagaagatactttttcctagttcagcacaatcaaccacaagacctgtcctccgattctatgatttttcgttgaaaaaataatgaccgagttggcttgacatattcttcatttaatggttgagatgaaagtcccttttgaagtaaaaggttcatcaaacttttacactactatgattggagtggaagagaaaagaggagaggacatccttataccttagacatcacatccactaaatagaaatcaattcatttactttttaaatacaattaagtttataaaaagttttgttcaccgattatgtatatatcttgccaattttttatttaatgagagattaatctttaattattaactattaaattaagaaattctcaatattagagtatgtagtatgcattattgttggagttgcgtcaacacaaaatctaatacacctttaatttaaaaataaagaatatgtttttgcaaatcgaggttggagttatcgaaacgataatccgaaaacacaaaacataataaagtgaacatattataaaataatagtacatagtatcattttaattgattttgtttataatatattttaataaggaatatttattattaaattttagtaaaataacattacaatgtgttttactttcaaatataaataaatatgcatttaattatgcactgtgcaaataaattattttcaagagtttttcaaaatacaataaagatattaaataatgattatctttttgaaacaatgactttgaaaggtcacattgtaggcacctattggatttgacagtagagtcatcctaatctttttataagtattcgtgcaccgtttatattatgtggtgaggaattatggataaaaagagagagagaatttaattctatacagtataatatgaatacag

SEQ ID NO: 3507 - DNA, 1087 bp, Glycine max
  Soy_ogl_6488 Gm19:41263714..41264800 Cluster 13
tagaaatattaaattttaaccaaacactttaagtgaaaaattcagaatatatttctatttattttattctcaacattttcgacaatacatttttagagctcgacacaaacattccctgaatttgtgagaattgtcaaacctcgcatagtaatattttttccattaaaataatagtccaagaaacataaaaatgctttggctgatattattctatgatttcatttttctctcgaggataataaatcagagaggaacgcctgaattattgaacttggattctcttgtcttagtagtaggatttttttaccaaaattttcggccatgagtgacattctctttcttccttaagttttgttgttataactaatcaattattgagattttgtgatgcgatggtagaagaggagttcggtcggagaggaatcaaactgagtgtgaacattttacttatttaactttataagattactttagttgttaactttacaacattttttttagtttccataatatatatatataactaaaatgaatgacattttataaaattaagaaaataaagaaagagtttattccttataatatgttgctatgtactttatgtaagcatggcaatgtgatgggtaagacttcagagaggaatttttacatccttacttttgtccttatagaggattgggtggatttaggtttagttagtggctgatgatcatgaaaaatctataattaatctcatcttaaaaaatttgttgaatctttctagtctgttttatttcttttaaattcaacttttatatatactttaatgaaatgggtaatttaaacttacttttaaaatataaattatttaactactataattaatttatatttttaataattataaaaataaaaatacatgaataaattcttaactctagtataatacacacacaacacataacatataattcgattcctaccaataaaaaaaacttcattaatgtggaattggactaagatggatatccagaagtttggattgtgatgcttaactttatgtatcatcaccccaatttaaaagcttttttttttaaaagaaatatga

SEQ ID NO: 3508 - DNA, 1010 bp, Glycine max
  Soy_ogl_4665 Gm14:5050547..5051556 Cluster 14
gctatataatgcatggtgtgtgagttttcttttctgtgcgcctcaattctctacaggggacgtatatcaagtgagcagggcggcccaacattattttagttgaggtgagatttaaaacaaaaatagtaaaagtaatacaaaattagggtccttactaaacataaaagtattttttcctctaataggtttgagcctcttctgtaaaaaaaaaaaaaaggttcgagcctcactcacaacaaagacacctaaattatagtagtactgattaataaaaaaattgtataaataattaaatattaatactgatttatttttttatgagaccaaaagcaagggtttacatcgtctcatgcttgggccgatcctacaagtgagaggagtttttttttttttataatgacagtgagaaaaataaatatggactatacaattatatgaataattaggattaaaagttatttattgatcatatgactatatatgcaataaaaaaaaactgttttatattttaaaataaagaacatttaattaggacacgtgggaggaggagaaggataagaagttaaagttgatgcaaaaccctttgataagatttgatctcgaaactaagttcatatcactcaaattgaattttgtttccttttaaataagattaatatgttttaagaatatcaaaccatattaaaattttgttttacattatgtttacttgtactttatttttttgttgttattattttagtctctatataaaatagagattgcacacaatagagattaaaatgtttttctccaacaattggaaagcatactaaaaaaagtttccgaaaacaaaaatttctgatagatttgaatattttatgggtaagtcacaagacagtttcacgtgaagattttgataaagttgaacttgttgattttacccaataaaggaagacaaacttagtcctcaaactttacgaatgataggaacaattgacaagcatgtacgatgaggccatttgttaaag

SEQ ID NO: 3509 - DNA, 1192 bp, Glycine max
  Soy_ogl_6934 Gm20:42360784..42361975 Cluster 14
aattaaattaaaaaaaacatcttaattagaatagttgtatctagttaagataaattggtacaagtaatagtcattatgataaattgatacagatcaatcattattcgacaaaaaaaagatcaatcatattttattatagtaaatcaataaaattaatactctgcccaattgatacaaatttaaagtattttttttatatttttttagctttactaaaatgaaaatttggattgcataaatccctattaaattttacctaaatgacggtaatattattgaaataaaatagactaaaatgaaaataaaaatcttaaaatagaatgatagtatgtaaatgtattatttattattcgttatatatttacatatattatattatatatgagtgctatttttttatagtaggtcaaggattagtggattactaattcaattagtgagttattaattagttaattctttttattttttttcatagtcttcctttgaaattgaaaatgaggctgtggattttatttatagaatccggatcatgcgattcaatcaatgtttgatttttaaaactatgtggttgtgagtgcgatcaattatgaatatttgacaacatttcaattaggaattttgattagtgtgatcttaagcaagtgtggtattagaccatacaataatttttctctgggtcaaagaccaaaatgatacaacgacaactagctagaaccgttaaccagcttcacaccaaaacgagaatccttgcaccccctcaaatagggaaaagaagaagcaaaatctttgaggggcattccattgcagcaatgcttgggaggatgatgataacaaggctctgatgagaaatcccattgacatgcggtaaatgggtcttgttactgactagcttgtaaagaagccaaggcttcaagtttcccaatccttgagcaacatagccaaaagatctccatccaagctttcatattgtgtttatatcattaaacttttgattcccttcatgacttggctgataaacttctaccaattcccctgtaacagttggtttcttcatatacttcaggatataaagatgccacaagaacagcctttacagtgtggtttaagttctttccaactgaactttgcaaatccacttgtggaagtatcttatgctttaatatgcagcttaaaactagatccattattg

SEQ ID NO: 3510 - DNA, 1010 bp, Glycine max
  Soy_ogl_638 Gm02:44073101..44074110 Cluster 14
atgtacccatcaattaaaaacgagtttggtattatatcaaatactttgtagttgaacttgacatatagtcgtgactcgtgcgtggatagaaaactagtgacaaaatattcgtcacttatatgtacaagaaacaaacttttttagcaaagtggaaaaattcgccttaagtttacaagttgccttgaaagagtaactacgaaatgcctaatgggtagtaaaacttttaaaatgagttgtcaacttgtcattcgcacacatttggtgataattttcactcctaatttacactttattttaagagtgcattgggttgttcaaattggctaactaaagttaaggggcatattgttctacttaattcacgaattgagaagttttaagcctagttcaacttttttttttcctgatcagattattaaactaaattaatacaagtaaatcttaataaaaggataataatatggtgtggtgagtacttgatgaacccattttatatgattatgcaattctaatatttctttttattagatttcattcctgattcttattattcatgccttttcttaaattttggtgagccaattaatttgacccactaatccaagtgaattgagtcagttgattattttttggctcaccattaaaacgagtcaggttagattaattcacttcaaactcaacctatcacgaatgaaccattctaatagcacttggcatgcaaacaaaacaaaatacctcttttttgataatgtgttttcttttatttataaaatgaaacacatatagtagtttcatcttgttataacacggttatcaaatcttacatatgaaatgctcatttgattcaatttgattttataaaaaaaactatttatttttgtcaaatttattttcttaaattaagttgaaccagtcattttttttaatggaactagttgtgttaacataactaagtttctctaacagaagcccatgaagcagtgcacgtctttatgtcccaaaatttatgc

SEQ ID NO: 3511 - DNA, 1032 bp, Glycine max
  Soy_ogl_409 Gm02:5911601..5912632 Cluster 14
taagcacaccccttatataggtttagtatatttttatgttgacctaaagtaatactatcaatagttaacttttatgaaaaactaaaataagatatttattttattaattagatccaatgtagttgataaatgattaaattctttaaatatttggtcagaatttcaatttttttatcatgcaaataaaaaagattttattgaaagaaataaaacttactttagtgatttttcacctgaaagggtagttttaggaatattttgcttttaaaaaaaagtatttttaaactaatatcttaaaaatgattgagtggcgttcttatttggtggatgcgtgactaagatgctttaggacacgcaaaactacaagccattgaagaaaacaaaagttgaccttgttgcattcggatacctaaaatagcgagttgaacagaatcagacccaattaatccaaatccccatgtaagtatcacttattcacttaccctttttttcatcaacttggttacgcaaaaagtagaatagattatcttaacttgtctcctcttcaggctctgtagattctttgacctatatgtatcttggacaaatcagaatttcatagccatatgccagtcaccttggatatcctttacttcctcagtatcctaattcctacaccttctttgtttttctgtttttgtttttagaataaattcctctaatattttgtaaaattatacaaactttttttttaaacatttatagcaatcttctttattgaaaaatatggtgtaatatttttcaaatcattaattaagaagggttagcgtcagtgttagatgaaaaaaatataactgaaagaaaaaaatataattgaagtgattaataaaattttctgataaacatcaattatcaataaaattgatggatactctcaattaataatatggcaacaacaaaattttatcattttaaaaagtatgacaatgtttttttttattaattttatattattaaagaatgataaagatttgataatttttactcgtattg

SEQ ID NO: 3512 - DNA, 1100 bp, Glycine max
  Soy_ogl_4794 Gm14:46890601..46891700 Cluster 14
gcctaataatgcaactggacacaaacctaaaggacttaataaaggacacatatgaatgttgtcctttgttttggtgcataaacaaggccaaattgcaaagaagaggaaactacacgtggttgacatgaatggggtttaagtggcccttgcttgtagaagatggctcatgctcatgcagctgaaatcatcataaggctccaattatcggttcagtcttgtttggtgtttgttgggagagataaagacagtgtatgtaattgtcaataggtacaattcaatattaattaaaggacataaattaaacatctgtctcccatggcattatcgccatgaatcaactagtgctaagtcatgcatcctttatttactctttcttaattcttactttgcattacctcaacaattaaatcacaataacatttttgcatgtcaagttaattgatgcaattctatgataaatagaaattaattagtgcaatatttttttttggtgaataatgcaataaaattgaatcgctaattaactattgatgatgtgggtttaagtggtgaagtgcttaattttatttaaataactatttgaatataaatgttgggaatataaaaatgttaagaatttcttctctctttaaaattaatttactaacaccgcttaaattagttaaaatttaatgtaacccatcattgtcgctttttgtcctttttaaacaaagtaacgcttgagcctttgtgtcgatttcaacaaaattatcgaatttaatttatatatattatttaaaatatttaatcagatttatgattttaacacataatattgtaccaacgaaatttttaacacaatataatatggcgataaaataaattcttattagatagttgtataaaaatgtagataatgttgcgtctctgaggaaaagactagagaatttactttctatatcaattataatcacaagtaatataaaaaagtgaatttcacgtcacgttgttataaaaaatgactttctatatctataatataatagtttgaaagtgtcaaaacaattttaactttaacgggttgacatacataatttattcaaataggtttggttatacgt

SEQ ID NO: 3513 - DNA, 1200 bp, Glycine max
  Soy_ogl_6231 Gm18:57393701..57394900 Cluster 14
gaaatatgtgatgatatatatgggtaccaatgatgacaagaaaaatgtaagtaacattttttaaaatttttgttagttaaattttattaaaaattaaattttttaatggtatcatttaagtctcatttacaattcttttaattttcaataacttttagttaataatataaaatatattaaattaaatatgtcagggagtgtattattgtatttacgttcgagaggtgctaaccatatgctgggtaattttgcgtttttatttatttatttccttaaaattaaatttttatatatatttttcttttttgccataggcaactgagacaagcagttgttgctgttgcatggacaataggaacattaggggaaaaaacatggtgtttagcacagaagtactcatccttaagccaacacaaaacatcatggggtgggaaaaaaaaccaagaagagcatgctatgcaagcaattacatacaacaaaacaaggtagaaaatagccaaatcctcttcatacacaattttacctacaaactctatttgaaggtgtagaccccacaaaaaggaaaataaaaaagcattcaaattccattctctgaacctgaaaaattaaaagaaattgacaactttgtttctgcttatagatttacttttttttttttcaggtaacactttgtgcttttggaatttggtgccggctgcgacctgattttgagttaatttaagggaaattgtaatcccagatccatccctttttgggacggtgaaaagagagtgcaagagaaaaaaataaatagaaaagaaagtggtacatatgaaatgtggtgtgagaaaagatataaatacaaagaaaatataatcaaaatgaaatgaaagagaatagaatatatgtttataattaaccttgatttaacttcatgtgaggaattgagtctatgacccatattaatgcgaaaaaccatcaagttgaggtcttgagggttacagaacgcaattacgaatatgaacaaattcgaataaagtattatattagtcctttgaaattatctctattacaaggagtaaatcattgatttaattcctgaaattgtcataattttaatccttaaatttaataaaattctaaaaatgtctctaatattatatttagttttatcaaaattcataaatttaattatttattatattttagttcctaaaaata

SEQ ID NO: 3514 - DNA, 1000 bp, Glycine max
  Soy_ogl_4392 Gm13:31798501..31799500 Cluster 14
gcagatgcaaacatttgtggagcttctccctcgggctcatatagcactaattctgccttcaagtgattaatccgtgaaccagacattatgagcacttgcattgagagctttggggtttgggttctcttaaaagtttagtgattttggactcttgtcaagatgtattaagagcctcctttcaagcttatgctttagggactgtcttccttatacttagttgtttatttaagccttttgattaaaaggagattttttttttaatttaacaaatggaggtgatttttaaattaattctcatttaggaataaggcataaagatgtttgattatgattttttttttaatttgttttcattgaagtcgtaagaaatgatacacgacctttgacattttatatgatttatgactcatgaaatctcatgaatttaagtaaaatataagttttgtctcttccaaaatcattattgaccatacgacttcaaagtcctaatttcatgggcatcttcataagttatgtgataaaacaataaaaatcaaagaagttgtaatatgcttaaaaaaagaaaccctaatatgctttattacttatgtgttagaagaattaaaaaattaaaaactaatataatcatcaatcaacctataattttttagaaatttctgacaaatcaaactagtgttcacgataataataaaaagatgaaataaaaatttagaagttgaataaatatttatgatttctaaggacaaagtcgtgttacaacttattctaaatgaaacccatttgataaattcaaaaaaagttactctcttagtcaaaaagttgtttctttgctattactttttgtagaaggatataataagaggatttagcattactgtttgaaatttccttgtacataaaaaaatagcaaacacaaccatggagcttgagttagaaaatacgctgacgttccattccattcattcaggatccactccaaaactcaaagcaaaagcatcaa

SEQ ID NO: 3515 - DNA, 1249 bp, Glycine max
  Soy_ogl_237 Gm01:49918252..49919500 Cluster 14
aggaaggaagaaatatgttaattccattttatagttacagtcaaaagagaaagtgtgaatatgagttttctacaagctagcttatagagtataacttatatttcatttatgtagatattcgattcactcgagtaaaaaaataatcatttacacttgtatcttctttgcaattcttccatgcacctctagctcccatgtccactttctttactttatatatatatatatacacccgaattatgtagcaagagatgaaattccgttgttgaggatacggcaaaattattgtcgactaatgggaaattcagctaatttcagcgttagttgaataaagataaaggtcaatttggctaatatcaatattagatgaatggcaaaatttggtttatttgctgcgttaataaaaataacttaattaagtttgatttagtttaataaagataagaaaatattttctaggactatttgatattcaaatagttatcataagtaagttgaatttcaatttctattagtcaaattcaaatgcaagaattagttagttgaattgaatgactcccaaatcactttcaggacattgtcaagtagaaaaatgtgattcattagaggatttgagtttttagtttataaataggttaatttcagaggacactcaattcaaaaaccaagcttattttatccaattatttatcatttttctttactacattactttacagtttaaatttatagctttcaaccgttatttttacgcaactcttctccttctccttctcattagaacgtatttcatctaactctaaattttcaccggacaacaaaatatataggctcaaatacctttttgatgaaattgttgaactccgatagtcggaaatgacttcacttggttgtattatttagttattgaactctcaatattccgtcatttactttgattccaacttgtcgtctaccacaattttttatatagtacttaatttagatctttataaccttagtatatttttttacatttatatcttacatttatatctttttatacgtattactattatattattttatattgattcgtcgtgtgttatatatttgaataatttttttcataagtcaaatgtattataagcgaaaatcaattaatacatttgagtttttggagaaattcaaatgaaatcaatgtatgcatcttatctccaataacattttattactatattgattttctattttgtggaaatattaggcg

SEQ ID NO: 3516 - DNA, 1200 bp, Glycine max
  Soy_ogl_738 Gm02:48871301..48872500 Cluster 14
ttttatgcacatctattatgttatgaaatatttttgaaaaaatattgatattatagaatttatgttataataaaaaaatagagagaaaaaaatgagaaacacattaaatgtttagaataaatggatatttgtacatattgttttttttggtaagtgacgtattctgtgtgataatgataagtttgtgcaactgtaaccaccattactgacactacctaaagtggttgggagaatccaaattgattaattatttatggctgtggtgctgcatcgtgacttttgtcaacgattccatttatcttataataatcctatttttattagaaggatcctcatctttctatctcaaatgtattgtaagtgaataaaagtataatattgcgtaacaagtattttataatgttagaaacatacaaatcattttaagtaattgaaaattgttaaaaacggtgtctttatgaaccaatatatcaggagtgaaaaaaataatctaaataatcatttaaagctagttaatattagattttataaaagctaaatttttacaaaattgttttgtataatatgatgttttcatgagaaaaaataattatataccgactgacaatttaaaagatttcacataattatttaattacaacggcaaattaaagtgattataataataatttataattaaataataatataaaatgatcttatagcaatagatgatagatattaaacttcattttcatattcgatgagtatttttacggggcatcatacatttacacaactacaatatagactctaagcatatggatttgtgcctactgtggtattctctcacgtaatgaacaaaattaatttggtaacagaatttatgacgaggaaaaacttcaagggttaggaattcttactaggactttctattcatgtaatcttcttatcttaatgttcatcttcgttctcttcgaagataaatgaacctaaagcattattaattcatttttggaatgcgaagatatattgtgtagttgaattaaaaatcaactcatattttataatcatgttagacttattcttataaaacctagtcctcttatttttaaatttgtgtcaagctttgagcagcagtcatttaaaatttcaaagatcttaggcttttttacacacagttttctcccgttagactattagcctattaactcatgtaga

SEQ ID NO: 3517 - DNA, 1619 bp, Glycine max
  Soy_ogl_1708 Gm05:37512982..37514600 Cluster 14
atataaaaggccaaatatgtaatttaagttttaacctattttgtatagtttagtgtctcattttttaagaactttaatttagttctacgcgtttctaaagtaattcaaaataactttttcattgatatatatatttaatgttattaataattttaaaatattaacggttaatagtcattacaaaatatatatttttttaatatcatcataaacaatttttaaccgtcgctttaatatttaaaaattaaaaaacacaagcacaaacaagaagaaacgcaacctcacaatcactcacgtccgagaatattaagatattcacgttcaaacaaaatccaaacacaaaaacaagaaagcaaggagctaattaaagggggggaaagtgcatctataactaattattattaggaacaacatgagctataaataatatttgataaaatatcgtaaaaacatattaacaatatttattcatatttaatgacatttttttaaatgttgtcaaaatgtttaacagttaggaaaaaaatgttattaaaggttatgggccgggtgtggttgtgaattattattaaaaaaaacttgcataagtttttttgtttgttacaaaaaccttgtataagttcctaattacatataaatccataaaagaattcacgcactcccatctgaacattagaaagtgtaaaaatagtagtgattaatgtatctaaaaactagaaatatacacgtaaattaaatgttttatagtagtgaatgtatctaaaaactagaaatatacacgtacacaacgtatattatacatttatacacacacacgtacagttgtacatgaaattaccataaataagtatcagaaagttaaacagctagcaaactacaatggttaagaaagcactatttattataaatgcaaatgcatgtgattacacaataaagtagcaatggaaagagttgggacacgtaagaaggcatgcatgcaagatctgaacatagctatatatttggagtgatttttctattctaggtgcacaagttagtcttattaatttgcatttgcattgactattggtgtgcgacatgtgaagaaatagagaattttttggatgatatcagaaaaaacttggcgcttgatgcggcctcttctcacctgacatctgccaccacactttttgttcttcattttctctattttctgcaccctagattcttatatacaatatttattcagagaaatttgtgactatcaacaatgttgtttctaattggcatatatatagtggctaataattccaagtcgggtgagatatttttcagcacatgcaatagttgctacagaagtgttcatttaagcaggactacttgtgttgttatcttgaccctaatgtgcgttcaaagttagactattatgaaaattgataagtcatctacaaatgcatctcccaaggccgatacacatcaccgtacggctaatacacataaaaaaaatgagcctaaatgtggtcatataacaaaagtaggaaatgtaaatatgatatatgcgatagagaaaagatatagaaaagaacaataagtgttaattaagtgtttgatatatcattattattctgataaaaaattat

SEQ ID NO: 3518 - DNA, 1245 bp, Glycine max
  Soy_ogl_2981 Gm09:4079556..4080800 Cluster 14
tccttgatagtacaagttgaattgggtataaatttttgtgcaaaagtcaatctgacttcgtgtgtgtttggattagtttcaattgtaccaaaatcaatttcaagataagttgaaggttaaagcaacaaatagttgttttaactttttcaaatttttaattttaatatttataatgatttccggatcaaaattgattatgggaggtatccaattttgaattatttttgtttctaaatctcacccaacaggggccaggaacccctaggccctaacaacatttgttatttcaagttttaaaggaattttatcctattcacagctttattttactcttcacaccacctacctatttttgttgtaattcttttttttacaaaagtactctatgaaaattagttttcatactctattaaaacataactacattacaaaaacttgattttgtaaaatctgaagaaaaaaataggggggctgaaggtgaaaagaaagagtaatattttgagaatataaaataatgaaggtgtgaagagcaaaaaaaaaagcataaaaagcatgggccttcgaagaaatcctcaaatggacttctttaatagtccaaacttcagtattatagtgcaaatccaggcctcaattctaacttggacactataagtagaccctaaatacaaacaagtatgaccccaatataaagcttgaataaaaaataaaaataaaaaaataaaaggaagctacctaagaaattcaaagtctagtagtgtagactagtaatatttctgtattttacattagaaggtaaaatttcaacaaggtataaaaactaaggcaattgaccgatatctttaaagtattagttaaaaaattaaaaaataaatatttttattaaaatatataaagttatattatttatgatttttttaggcttttgtatgatttagtaaaaaaaaaaaaaaatactactataagacttcaatggcacatgtcatgatccattgactcctttaccacttacgaggtacatacacagatgacaaattttattggagtttgcatcatattcatatgtacatatcttcttgagctctgtaacagtactagtactaccaggttcacacgtcatgcattatctgcaacgtgccctatcgtaaaaatagatgactccaaatacaaaattcaacactttttatgcacctaaagctataaacaagtgctaagcatgttggaaaatcctaatcccctgtatttcat

SEQ ID NO: 3519 - DNA, 1470 bp, Glycine max
  Soy_ogl_5420 Gm16:36588331..36589800 Cluster 14
gttaatgtctcatgatttgaaacataaatttgattatttatgctaaatcatttatatataaaattctattgaaagagaatcaaataacatgatttttgggaggataatacaaaaggggaaaaaatcatatattaaccgtccaaaaaatggtcccagtatggatggcagcatcaactttgagaaaaggtccacataatcaatagggtaaccaatgcaggtttttgttttggaccacaggcactgacctacttaactaaaataataactgcactacctatcttgttatgataatggaacatggggattagtctgcctttttgtcatccaatcagtcctggattgcgtgaagataagtttcttcctaatactcatctgtcaaatggaagattatattttcaattttaaaactactattcaattgaatcttaataactcatattaagtttgcaataaatgtatcattacatagcttaattttgtttctagtctttaaaattttaggtgaatctaatttaaaaaaaaaaagagttgtaccgcgacaaatgctttcaaaattaaaccaatcattaaattgataaaggaacaaattcataattttttggtaaagacattgaattttaaatgagatacttgttggtgaacttcttgttgactgaaaatataaattttaaatgataaaattatttatatattaatagcttaaaattttccaatatcatcaaattataaattatcacgtataatagatctattaattcttataataattgatatcatcataaaagttatataagttatattaatgataattttttattttttaattgattgatttgaattctcaaccaagagtgaagtttagagttcttgaatttgtgttatttaaactatcttactatatttcccatatttcaaattcttataacaaactatccaaacacaataatttgtgacagataattttaaatacctttcaagtttatttttccgactgcaaatctcttatccaaacacattgttaatgactttaaaaaattaaattatgttttaatctttaattttttattttaattattttttaataacatcagtcatttgataaataggaagatttgataaatattaataactctcaaatagaatatcaaaaccaaaaaatccattaaataatcaactattgattctaagttatcttttgatcctactttttaaggaaaaaaattaatactggcttaaatggtttagattgacacatttcaaataaaattagcacgtcagatttttacttttaacataatattatttttcaattaaaatataaaacacaaaaacaaattagacttacattcacgtacacattcatcttcgtcactgcactagaggaaaaaaaaccctaatataagttgtaccataattatgtctttaatttgttcacattgtatgtctaatcatttttcgttttcttgattc

SEQ ID NO: 3520 - DNA, 1600 bp, Glycine max
  Soy_ogl_5480 Gm17:14801..3510400 Cluster 14
taattgtaaactctaataatatttaattatagtttgcatttaaaaattattttttcacctttcaactaactcattatctttttttttttattatttccaataagataaccctcaagctagctaaacactttatattaaactctcaatagcaagtaaagttcatctaaaattatactagtagtttcacttgtattattgtcaacaacttattgattcttttttaaaaacaacaccgtcacttaaaaaattgttactttttaaaagaattacaataaataaaaaagtatatcgatcaaataaagactctcttggtactataataagaattataaaaatgaactactagctcatattttaattgttaaatattcaaaatgtttaatatataaaacattgtacactattctgtcattgttaaacagtctctattcaatttaatattttactgacttttggtggcaatggctatggtcgccgtccctctaacccccgtccatgaaaacgtaagaaaaaggaggacagagaatcttcgggtgttataacaaccaatgacaaatttgacgataccaaccaaacaacaataataagaatagtttaatataaattaacatacgtgtaggagtgtagctgagagggaattgggttatgtactcatgtcgcctgtatagttttcacgtgaagaaatagaaaaaatcatttcgtgtctagtgttcaacaaatgagacaatgatatagtaccatactataatttaagacaaactttttggttttaagcagtgatgtcactactctcacaatccaccacaaaaggaatgagtggctcaacattcaatggtacatgtatgaagcactggcttatggctcatcctcacgacaaacatgcattattctttatgtttttattttatgttgtgtatatttatgtggcactgtctctctacgacaaaagcatgcatggtaaaaggggacctgctagagcttatgcttaatgcgatttttcaccaagccaggcatgggaccaatttggttctcgatctaattagatttatctgatatataggatttgattttgaaggtaggtttaatttggtttggttcgttgatgtgaaagcggaacggaactatcattgtgtacattttttggtttaaagaacaagtcaattatgtaaaaattaaaatgtcaagaggaaaggtttaagggttgggtgagctagcaagttctctaaaactagatgtccatgaagcaacaattctaatctatttaagaaatccatatccatgttcatataaattaaaaattggaatttctgccaatattatatagtggacattaaatgtatgcacttcaactagttacaagaataagctgcaagagtcacttgtatgcagcaacgttgttaatcattgccgatcgaactaggagaacttcatttgactatgcaatcaataacatgcatttggccacagtcacttctcttactgttctcggtagatttcttaaagttaccagaaatgataatctagtaaaaaaatctctcttaatttgaccatataccattttataaaatgcatgcagtttgatgcacaatgtagaatgtct

SEQ ID NO: 3521 - DNA, 1100 bp, Glycine max
  Soy_ogl_6298 Gm18:60188301..60189400 Cluster 14
tttttttccccattgaaattgtcgacccaaaattaatatctataacataattgcaaatgatctgctttcctttgtcatttattttctacaaattaaatctttttgttcattagtaacgatctctataattcagcacaaaaaagcttattcttagtaatatatcgatttaagaataatttaatccaaaatctaaagtccaaacgcattagtgttttcatttagctttcgaaataacaattttttgaaagagtcacaaaaagtaagtcgaataagttctgcacacccaccggaaacaatttaatacactataatataaaatgaatgactttttaagcttaaaataccagtttaaatttcagaaagttttcataaaaattaaatactctaataagtatattttttaaaaatattaagaatgtttgtttattttttaacacaaatttaggtttgaatcttatttattgaaaaaaatttctaaatgaattcactctaatcataatttaatgttattagcttgaataaaattatgtttcatgaaatattcatataatttgaaataaactaacatgggtgtataaaaaaagaaccccaagtataatactataatagacaaataatcttatcttgagtgaatgtaaatatctcatgaaattagtttttagtttctggttgaaaatattatagattcacaaaagaatataatgtttttttgttttaattcttaatcttctattcatcaaaagtaagggatcctaataaatatggaatttgactaaaagataaataaaatttgatgaaaaaatatttcaactaaagatatttaataacaaatatatctataattaaggcaatattagatgaagggacatgaaatctatggtgagtgaattttgggtttgtgttgggtacgaaatggacagtggttaaatcaagtaccctcccgatccagatccaggacacaattttattgtttaggtcaatttctcctttacaagatgcgtatttcctcagtgaacgtgcatgtggacaaacaccaatattgttatcaagatacgggaaatgattcagagcagccacgcatctcagatatatgtcattaa

SEQ ID NO: 3522 - DNA, 1032 bp, Glycine max
  Soy_ogl_3338 Gm10:3043269..3044300 Cluster 14
atttcatttaaagcaatgcacttattttagaaaattattcaaaacttttacttaccattttacaagatatataatattattcacatttttacctagcattagtttaatgttcttgtcaaccgtttttcacaaaatctgaaataagccttccaattaatagtaaaagtatttgtatttgcattactataaaccattttaaaaggcatttgaattaattagtattgggggaagataacaacttttaaattataataaaacaacaaattaaaagagtacggaccaccattgagtagaagctgaaaccaatgaaaagtgaatcccaatatatttgataatcatggagagagacagactcaagtttcttggtgaaaaaacaaacatttttctatatattcctctcaaacatgcgatgcactaatccactagcacaaaagaaaataaaaccaatgcaagcgagataaattaaattgcacatcccgagaggctgagactatactataactggagcaagccttgtgattaagcaagtgaataaattaaattccatgattataatactatatattaaaccattttcatttttttttctgccaaaaaacaacaacttttaaacgatttcaaatagtcattattcatgcaaatcatgccattatatatcagcatgttcaagtattcattattcagcttgcttcttgtctctgtgtgattgctgttcgggagctggctggcgtttattcaaaacttaggatatacgtagtggagacttaattaaattacactcaaaatcaaaccattaaatacacacacggatagtcagatacatgcatgggttaggaaggacagatacaatgatgcttgacaatatcaaactatttgtgcatcaactttagatactatataaaatttcatatactaattaacgattagacttgtcttgttggtaaagattttgtttaacgaaaaaagaaactagctagatatgttcctatggatattataattttatgcaaacaatatgttatattatactaa

SEQ ID NO: 3523 - DNA, 1736 bp, Glycine max
  Soy_ogl_1685 Gm05:35417065..35418800 Cluster 14
tgatctgtatttttagtcaattttatctacatccttatttcttaaaattaatgaatttgattctcacatttttaaatagtttttttgatgtacatggtagctatgttatgcgtgacaaccatgtgcctgtcatgtcatgttaattgtagctagccaataaataattttaatgacattatgagtgaaagtttaatttcacaatttttcagaaatggaaggatcacttttattaattttgaaatacaaatagtaagattaaaaatataaggacggcaaggatcacttttactaattttgaaatacaaagagtaagatctgaattaaaatataaggaattaaaatatatttattttctaataatgaatgactaaattaatcaactattggaatgaattttgtccatctcaacataatattttttattttcatttttcatcgttagagctcctcacatgagttttcttcttcttctctctctttttttatattcacctgagcttcctttatgacccacccatgaaaaatggataaataaatctaagcaaataccaaagtcttatttgtgatattcgttaaaaaattaaaaagaaaaatatttttattgaaaggtataaaattatgttatttataacttttttatactcttttatggtttttataataaatattttttattttaattttgtaattaatattctaaaggtactgattagtaatatctataaatgtaaaagaatgaatcaatttatgcaggttgaattcctgatacaagacagccaagttgggaacttaattgttaatcgatattatgtcgggtaaataaacacatccgagtataacttgccatttaaattcacagtatttaatttgttaaataccgcaactaaccatgacaataataaatgatatcttgttataattaattgcagtgacattacataaacaaccaatatataatcgcggggcttccttttattgtcaacatggagctatgatttttcagactcataactgtcgacataccctttcacacttctttccatctttatatttccttccaattaagtatctcatcataggctttccaatccaagcttctaatataggtgcaatgtcacacaaaaagagagtaaaaaactctatccaatttctctgtatatcaaccttacatgtttcttctcttgcatggatccctttgacacctcaagaacaagagtgagattcaggaaaagtttaaaatgaaagtaaagacactctagattaattgagaaagttggtgggaggggtcttgtaaagaaaatagatcatcactcatcacccaaaagtctaggacactcttttggtgcatgtcaagaaatagatcatcacccatcgtccaccaaggaacaaaaaacccttaggtcccccccttgggacttgaaggggatctctaccttaatttatatttgtttttctgttaagaaattaatgtattatactatatatgaaaaggagatttcagtggacccaacacccactctgtcctaaaactcctcctcttccaagaagttataggcgcaaattgatttatccagaaggatgcaatcatgcaaagccatgcatctattcaattacaaattattacataagataattttattgatttttataataattattcttaaaattatatttattactacaattttttatttacagtgtaacttttttttttaacttttgtcctgttattctct

SEQ ID NO: 3524 - DNA, 1063 bp, Glycine max
  Soy_ogl_3997 Gm12:4554212..4555274 Cluster 14
atcagtttttcatggtattactaatttaataatcatcatatgatttcttaacctacataaaaaaaaattaatttaatagataggaatctatgtaatgattgtagatgaaagacagtgataacatgcaatgcaaattatgcaatccaattcaaaggcaaagcccatagcatacatgtggtgaggtgatgctaaagatcgtagaggtgcccttgttactttaatttctaatctccactcattatcacgtgtcactgtcaatttggcgtttacaaaacttaaagaccaataagaggaattgtaaaagataacggcgtttgtggaatctccgtcaatacgtcattacagtgtaatcctccatttatatatctaaactatagtcacaaaaattgaatatagatgccacatgtggacatgtgtcagtcacaagagaagacttgggtttatcgttacacgtggcgttgtgacagtggatcaaccacgttcattgggaatgtatctctttgagtttaaccatagttgaaaaattcataatatattagtacattactactcactttcgttttaagtgtcaaatttttcaaaaataaaaaataaaaatgttgtacgtactattgtaaacatttttttaaaaaaatatttgtgaaactactaaatttaattacacagaatctaaataaaaaaaatattacgaaaatgtaacaaatggtttttaatgaaaaaagtatacgtacatataaagtatttattcaacttaataaaaatatgtagtattttcttgtataaactacatttatatatatatatatatacactttttacttgtatatactccttgcatatcattttacacatttattcaatgaaatagtatcagaactattttttataagacattttaaaataagtaaggctatgtataacttattttaagttatgaattatgatctttactaactaaaatttaaatctagaaacaaattttacttacttatatttaaagacagacccacaggagtttttttatatataaaagatgggatggtctagtcattaaaaggatgtg

SEQ ID NO: 3525 - DNA, 1291 bp, Glycine max
  Soy_ogl_1762 Gm06:1331701..1332991 Cluster 14
ccatcacacaacttgtaggggactccaaaaatggccacttctgctgtcattcttgttgttattttccaactcctaacgtactacgtcgtttattagatcattactcctgcctatcaaaacacaaccatataatcctcatcaatgcaaccaactttgttgcattaaacgactaagacatgttctttttgtaaacaggaggcccgaccggaaaaggacccgaaggaacagttgtctttctatgaatggaggaaagatataccaaagaaaaaaaagattttgtaaggatggaaagaggtgcctccttttacattttaattgaaatattgaatgatatatacatctttaaaaaattgtaatgattaagattctattttagtattatgcgaaattaaattatagagatatgattttcttaaattaaagaaaatttatatagaaaaaaattatatgaatttatatatataatttctctgtctcttaatttaatagtttagtgtatcaaaattcaatttaaattcagattatctgaattaaaaaaataatacttatttaaaagcataaaaataaattaaaatactgaatgggaagaaaatcgaatgtcttaataagaaaataattcttaaaagttatttcaagagtaatgaccaattataaaattcaaaccgatcataaatatatatcaaatagacaatagtctacaaataacaaataaacgagaaaaaggaagtaattcataaagttccaaataagatatttactctatttaggtaatgcagttactcttattacaatgcatcagagagaaggatttcatgtgaagactggtgcaacatatattagacacagcacatatatgattatatcattagagtggaagagaaatcctttgcaagttgcatcttcttaattctttttccttttctcttctctttcacagttttattttctcgtagccggcaatggcatcgttggacagcgaatttggtgtcttcgacagcatcatagctcttgtcagttgtgtgtgcgaattggaacgaatgagaactcccagcagtcagaatgagaaataatcttgaactttaattttaacccaattttattgttaaaaattagccattagatcatgactgcattgttgactatgagaattgcaatgaatccaggtccatccacgactcactgccaaatggcaaaagagaaaaaacaatggatggcgtcctatttcttggtatagcgttcattttttatgttttcacgtcaactttttattatcaaagcaaaaagttattct

SEQ ID NO: 3526 - DNA, 1100 bp, Glycine max
  Soy_ogl_3308 Gm10:8001..1870100 Cluster 14
agataaataaaaagacaaaatttaaagtactgtacttaaagacagttgaagaattaattaaaagtagaaaaaaatatcatattttaaatataaattctaatatactattgtttatcaaaaaactactattaccttcttaacttgaagaattaaatgtcgatcacagactatcttaacttttttattacatattataaatattttctgtgagagacaattttgtttgagtttaatatggtggttatgaataatagaattttcttttaagaaataattttattcaagttaagaatgatccgtaaacgaaaaagttcttattcaaatctttaataaacggttgcatatcaggaatttaattaacaactggccactagttgaggcacgtgttgggtggaaaaaaaatattttttaaaacattcttttatcttttttaaattaaagaaaagcataattgtccttgttattatttgtgtggtgatggaaatagatataataaatgctggaggaaggtgtagaagcaacttagaatatccatgggggatagaatagatcatagatcatagatcatagatctgaatgcatggcggcactggtgctgatatatatggatggcaaccacacaggtttagcttagcaagattgatacggaatagtaattgaacaggaaatgggtgctgtaaccagctcaatcctgttaacatcgctctaccgacaaattctatttaattacgcctcataattcactacccttaattgggttcatgtacatctatgcacaggtttcctccccaaacgtcatttcacacaaaaacaactctttcaaacaaaaataaaattcctgtttttttagtgaactgttttattagaaaatataatgtatataattttatcatgatttttataaaagtattatctattcgtaatttcttaatctgcatttttgtataacatgaatggacaatccacatctgcgctaaggaagttgcatggaagcaaccaatgaatttatagaacgtttcatcatcctcttacccacatcattcccattttacgataaatacaccatgctaacatctcttcctaatgtgtttttttttttt

SEQ ID NO: 3527 - DNA, 1097 bp, Glycine max
  Soy_ogl_230 Gm01:49588004..49589100 Cluster 14
tattcagattaaaatatactaaagtaaatacttgttaatttcttaggaaagagtatagttttttaaacaagagaaatggcgatttaaaattatttgttgatattaaaaaaacaagtatatgaaatatatattaagttaaaaaagtctaacataaaataaaaatttattttgtatttgtaagttcaataaagcagtacataaaatcaaaaagatatattttaattttattagaatattaaatatgctatttattctgttatacctttgtacatattaggaatgataattggattcaaactcacacacaaacaaaaatacctatatatgttgacaaaaacaattacctgctaaaataggtttagtttcaaagtgtaggttttatttgcaaattcttttgaaatggatacagttttggatacgttaattattttacaatctagctttacatttacatatattatttaatgtacttgatttaaaataaaaaatacctatatatgttgagaaaagcatttacccgctaaaataggtttattttaggttctgttatcaccacacacactaacacatcggaagcaaattaagagagataataataaaataaaattgcacacaccacacacacacgagagacgagaccaacagaggaagaaacttctctttactcacttgatttgatttcactcacaacttgatacatcaagcgtacaactagtggccttttataggcatattacatgtaatataatatattaaaaacttattaagttgcaccggacaaacataacaataaacaaaccgtggagttactacttatcaccacataataaccaagtaacaaaatcttgacacctatatccatttctaactcagccaccgaattggaaattaaagattgagatgtcaatacaagggtacagtaagaaagattcttgcttgatttaaataaaattaaccgacaagttcaaacttcaaagtgtaagcaaattgttctgaagtggatacagttttggatacgttaattatttaacaatcttttttttttgttgaataattatttattactatacaatctagctttacacttacatatatta

SEQ ID NO: 3528 - DNA, 1121 bp, Glycine max
  Soy_ogl_1470 Gm04:47523401..47524521 Cluster 14
gctgggggagaattagaagacaaacaagcccaagaggacaatggatcaacttgacacaatccaaagaaataaagtagaacaagatatcttcaagctaaggcttttcgtagggtacaggtaagtatgcaggagaatgggtttaatttccacaaatattattgaaccttttaattcatgattcatcaaccacaccaatattgtgggatacattgcaacaacaacagtggcagagtccatgcatgagcaaatacaatgctaatacacactaatccttttaattaagtttcatttgattttatctaaaataatgcttatctataggctagctataatattattaatctgtatcttatagttgatgttaccaaaaaggactctcttgcaggtttaatgcttaaagttcaagcacgtactataagccaaaatgaggtaataatttttgaaataaaacatctactttctaattatggagaatccaataatcttcttgactcttttagatccaccatcttgtatttcaattttgtttcttccctaaaggagacagatcatttcattttgtttttgtatgatttgttgtgtttgcattccaaacattgattttttaaattcgatccgacgtcactacaaacttcttagtaactaaatacatcgtgaccaccttgtttccttcgctaacatgcatgtttagtaacttaaattcttcttttgatcactaaaaaatgtataaaattaaaatgaaataatattaagatttgaaaaaaaaaattatcactcaaaatctaaattgcaaaaacctttaagttagtttgagaattaaagaaaattcttaaaaaataaaaatataaaaatgatgagagagacagatgttgggttctttttatctttcgttttcctaattgaaaaatgagacaacattaaaaaatttctctctatgttctaaaatgaggtgttctctctcatagttgttagttttccaattctaattagaggaacaaagaataggatatccaaaagaaacgagtgatttaagtccttgaacgaaatgattaaaatgaagcaaatgacaaacaggtatttttaagttattattataagaaagaatatatatttattaatga

SEQ ID NO: 3529 - DNA, 1084 bp, Glycine max
  Soy_ogl_2980 Gm09:40131..4030784 Cluster 14
atttatttattatattattttaaatacaaaattctaggagaaaaatatacaaagttttaaaagggaggaacattgttggatgatgaaatatgcaaattttataaagtacgcatactaaaattgtaattttgtttccttaccaggtcagtagctcatgttagtgactaactgattatgcactgccaagtcatcataagactaccatatcagtagtccatgtcaacagtactacttgccaagttggtggttaaagtgccacttcatctaatcgctcctattgtgtgcaataaatgaggtagcgaattggcttgcaaaccatgctcattcatatgtcttggggtctaaatatcttaacctaactttttagtaggtgtgtatcatttattctaatggaccttttcactgttcttggtacttagccttaggtcttatgtttgttgccttaggtgtgtatcccgtttattctactgtatcctattcatatgtcttaggttgtcttaggcttggcacttccttgttgagaaattactgaatggtctaggactatcacacttgtatatgattctagtcaatctttacatcatgcatattttaagttttttaatatatgtgaaaagtcaatatcactcagtgtcatattaagattagtgaggaacataataatttcaaatcatatgatatttttttattataaaaaaatattatttgaggtacttattataaggtctaattaattaattcatcaatactaaaaaaattgtttaatttaattgagtatattaaatttgtcctaaattaatatttattttcaaaattacgcctgtgaacaaaaatacaaacggttaatggattttgtttctttcactcatttaatgctagaaaactgtaagagaaaatttcaactcaaacttatttttgatcgaaaagttaagtactttcaatatagaaaattagaaactatacaaggcaaatttttagtttttcaagaattttaagttgagaatgttaatttctcatgtttggtttgattttaaaaaaatattattttcaagtcgtggattgttagaaatgtcagtagagtata

SEQ ID NO: 3530 - DNA, 1297 bp, Glycine max
  Soy_ogl_3442 Gm10:38095701..38096997 Cluster 14
atgtcttacaataaacattttttacttcaacctttcatcaagcatgggagtaaaaaaaattatttgcaagtttataaaacaagtttatttttagactcaatttaatgtaccagtttttatcattaatttaaagttaataaagaaaatacaaaaataattatttattatattttttcttatttaattttttttaattcaccttaattccatgatctgaattttagttaacaatcaaattaaaattttaaatttacttatttgagatgagttaagttaaaaattattaaattactaatttgatccttttgtcataatcattataaattttttaaaattataataattagttagaatctattattaacatccgaatatatttatcgtactttttgcattttcaggaactatattttgtattttcatctttcaatgacacatgtgtgaggaaaatgaaaaatcaaaaaaatattatataaacagatgaatatatttgacacttttaaagactaaattttatatttttatttattaataaaatacacatttaaaaataaaagtgactatttacccgaaattgaaatgtgaaaaaacaagaaaaagaacgcaagtcatcgctaccaatgcagaagaaccttaaaacataagcaaatggaataatgaatatagggtcaatttaacacgcaatgcacaaatgtccaagttattgcaagtaactgtggagtggactatgattatgtcatatagttggagccggccgcccggagaatacgaatggcaaaatactggagaaaaattgcaggaaaatgacgtaactaacaaaatgaacagtgaattgctgattactgatgcgaaaagaaatagtgaagcacaaaattgacgttaactgtttaaaaaaataatgagtctctgtttttttttttaatgcatgtttgaaataaaacttacaaacttaagtttgaaagaattttattttgtaaattaaggaaaactgaattttaaaataacattgagacaaaacataatttattttcagatccaacagaaaattaaacaagaaccattttcattttactttttgaatgtgctttgaaagctaaacataagctaaataggtgaaaagaagagaaaaatatatgaaattaactagtactattattttgtacaaattcctatttgaccaagcaggaaagcacaaccatacacagtcttaccgaaagtaaaaatgaaatctaatcaaatttctgcatctagcatccgtataatgttaactattgtttttaggatgtatctttgctcg

SEQ ID NO: 3531 - DNA, 1200 bp, Glycine max
  Soy_ogl_3556 Gm10:45951201..45952400 Cluster 14
ctgacaattttttttttaattttttaactaaaaatacctaccgttcacaaacactaggtattagatactactatatacataatgaaactaattttcgatatacacaacaaaacatagttttcggtagatatatacatgtacccagcggtataagattttttattcattcacatgtgtgagtaaactctatctaataacttgtgtttgactttcactatgcaacaaaattttggattaacgacaattacaatccccaagctgagaaacatcattgatctcaggaaaaaaaaaacccaaaattaaccaatatgcgatcctgtacgtgccacgttggtttctcccccatgcactacattttgcagttgcacaccgtagaaccatcctttttataagctaaacacattcacgtgcagcctcatctgttccaactgaagcacgataattttgacattcctaagtcctaattaatgtttctcggttcaccacaattactacagggatctcacctaacacacaaacgcaaattaaggagagactagattgacttgctggggcttccagttcaggtaacgaggatgccggatctgtcaagaagcattggaaattaattttagttgttaataacttactaatatgttctatcgtaaaaaaaaaaaaaaaatcgttcatacgtaaaaaatcttcgtaattggtaattacattgaaatataagttaatatgattttagataaaggttacttatgctttttgttgttaattttttttcaattttttcttttagtatctagataaaaaaattagcgttttttttttatttttagacttttttgttatgaatcttactttcaaattgtgtttggttataatgaaagaaagggaaaaaatgtgacaaaaagaaatgaacatgaaagagggagactaaagagaacgaaaaagaagattattaggtagatattaaaaagagataaaaggatttgatgtcataaataataaaataaaaaaatataaataaaatatttgtaaaattttaattttatctatggttttttttctttaatatttttctctaaagtggttttttttaaaacaaactgtatcctttttttattacattttattataataactaacattatatatataatcaattttactgccatcaaatttgatactctacgaaaattcaattttattaggcat

SEQ ID NO: 3532 - DNA, 1122 bp, Glycine max
  Soy_ogl_3598 Gm10:47012301..47013422 Cluster 14
ttttgaatttgttttttttgtcaatttgaaccaaatgttcgattaagattaagttggattggtttgaattattgagttatgagaaaaacaaacaaattatcatattttcaagttttgcctttaattatgtctattttgtattcaattttttaattttatgttaatgtatggtaaaaatatttcctatttttagttattaaatatttatttgatttaatatttaattttttctatagttatcattttattattttttactcaaaatatgattaaaaagttcataataaatacgaaaaaattaagacccttaataatactagataagattataagagaaacaaattgaatgaagatgaaaataagacgcttaataatatattaatataaagttttaaataaattcaatctaatttgattaaatcgtcaaacacatggtaaactgaagatatgaatgagttaaatgattaaagaaaaaaaaatataagaggaatagatcgcatgttttgtttatcccacaaacaaaactaatattctaatctatcattaaggtttattgataaaaaaaaaaaaaaaaaactcatcgtgagtaaatccgatctgttaacccccatatgccagactgccagtgcatcaaacaaagctacgttattttctgaccactactagtgaaacatgatattggaagtggtaaaagtgcttttgtcctcttcttaatatcctgttttctcttacatgttttgtaacctcgggaatgggtactctctccatgtccgtttgaacagcattttcttcttttgttaggctatatagacttgtaggcattgttcttgtttgcatgcataaggacaacgtcatttgcatgtttgatgcttctagctataagctatatccgtatatattctttatttatcttgttacggttgatttatttagagggtgattatatttataacctctttttccttttttctttttttttgaaacagacctctactgcagttctgcattttatatcctctcaaatttctttttatttcagtgtttttttaattttgtttgttatatataagcaaacgaatttgattaaaacattgagtacaagcaatactcaataccataaat

SEQ ID NO: 3533 - DNA, 1368 bp, Glycine max
  Soy_ogl_3969 Gm12:1419211..1420578 Cluster 14
cattttaaaaacaccattcttaaaaacgtcattcatgagaatcttgtatagtgaatgaaatttaataccctgaaataaacattacataactttaagaatatcattatttttaaggtaggaatatcattcttaaaaacatcattcatgagaatttggtacaatgaatggaaaatcattccccaactaaacataaaataatctcaacaatatctttccaaaaaataatatagttccataaatgaaaattttccccataacaatcgtagtttaagttataaatttatgaatgaataatgcatgtgtatattttttttgatattatcatatgatcacaaattttaatgtataattaatttattgaattttattataattatcttaaaaaccatatttctgattgttggatactgtaatttttttacgccaataataaaaagaaattaaaatattgtttaattttatatgtattatgaatgatttttcctgtctactttgtcttttttttctttctaataaggcatattaagaaagaaataaataaataatacattatcatctgccatcaaacagtatattctgctacttaatatgatgcctcataactttatataatttatgaataaattaaaaaagatcataatctaagaaaactaagaagaactgaatactgcacgcgcaatttttttttttttaaaatcaagcatattattaaaattaacattgtaaaaaaaaatccacactaccattaaatcataataaaagttattatgtataatattatctcaaacaaaaattatgaagtacagtagttttttgtatgtgattaaatgaaactctaaaattatttaagatatatagacattgaattctttttcttttatattggcatcttgactttgtctcttacttttgaaagaagaaaaaagtggccggtacgcgcaaacgcaatccacgatgaagtcaatcaaagcaaagcaagtacctaccaactacccgcgcacgccacaaccaaatcaaaccaagtaggaatgtgtttattttattttttggtagttggtgttaaataaacaaatcttcaattaatattattttttcttaaaaaacttgtttgcttggtcgacttaacaattactaacatattaatgaactcaaacaactagatggtggaataagtgggggaaaattccacgtaccagtaccacagatacgtatacctatatatgagtacgttgggaaaattaagcctttaataaataaacgtttcctgttataacttctctcaatctttccatcaaaaaattgttagtttgtggcaaaatataaagttgcatgaccataaatatgagctcggtaatcacccaatgggtg

SEQ ID NO: 3534 - DNA, 1100 bp, Glycine max
  Soy_ogl_1711 Gm05:37628001..37629100 Cluster 14
tggagttgttctggagaatcttaaacaaatagtactgggaaccagaattttcacttgatatttttattttttgggttgattgtgagagtgcaatgttcaacatgttcatgattgatgattgtacatgaaataagtgaaaggaaggaagaaccgctgaaagtgggtatatagaggaggatttgacctccaaattgggtatagtggtgggtcatgctaattaattcctaagtctatctattgcattaatttgggctctgaacacaagatgatttaattaacttgctagagtctcaaaacaaaatgtaattaattaggtgactcttcttatagacgtaaaccataacactagtcatgggtatgggcatggaagttcatcacgttctactttataaagtagctagtggtgatctcagatataagcactgaatggctagccaaacctcaaaaggtcacatgtaaggttttcaattctttttcatctctatagatgttggtcagagacatgctataattcccctccaaacactaaagtacttacactcaattatgagatggtttgaagaatatatgttatatacaaataaatataaaagaattaaatctatacaaataataggtatataaaaattaattaatacagatcatgctggatattaactggtcatttattacaatatttcaagattatgaaagatttttcttttgagatttctaattataatgctaagcagcctaagctgtctgcaaagaacaactttgtcagatatgcacataaatataacaagcgtgccaataggatacaatatagtcacccatccaatggttatctttattttcttttcggcgtatcgcttttgaagtgattctttgtagttgtttttcctctcaattaagtagaccattaataagataaatatgacgatagttgagcaacaagttgtaaaaatcgtgcccataacaaaagtgcgaaaagaaaagtgctctgaacatcgattttatagttgatttcgtagtcaaacaaataattttatcggttcaattggttaactgattcgattggttattgttcttccactacatattctgataactatatgtta

SEQ ID NO: 3535 - DNA, 1098 bp, Glycine max
  Soy_ogl_1207 Gm04:3970001..3971098 Cluster 14
gattttgataaggctttacttaaatatgtttattatgttaaaaaaattgaagacctgacatgaaaatatgttaataagtcggtcaaggatttaactttcgaataagttatgttaggccttaaaaattgaccgataacaagtaaataaataaagttcaaactttctaatcacaaattatatatgtgaggctctagcctatcaaatcctacgttttttttactcctaaatgtttattccatattaaagtttttaattaggcttgattcatatttaaacatttatttatcttaatttttaatttaagatttagatattttttcatccttataaatgtgacttacttgttgatagatattaattgttgatgaaattaataagtaacataaaaattcaaaaacatttcgaacatgagcatgaacatgtgcacatatttagattaaagttaaaagaattaatttaaaacactttcactctcaaaataaaaaataaatctcattttatatgttagaacacgtatttttacgttgaaattagaaaatacatggtgaagtaaaaattcaccaaacatagctcacattgtgtattaaagtaaaaatttatttttgctttatgatttccttggtgaagcagcacaggaccgatgatggaaagtaaaatgaaggtgcaaggtatgcagaatggtgaaaacaggtgggtgagcgtaggtcagaatgtttttccttttaaggcttccactctcagataaatagatcgatacctccctgtgagggccttggacatatatacttttcagtttcctttttaaatactattttttctctgagacagattggacatctgaatgaatgaattgagtgaggtttccttctcttctttttcttccccactctccagtactgttcgtgttcgtggggattcattaatcattagtcattcaacaacactatccttcgccacttctcatcccttcctaaagccacaaagaaaggaaagagagattaagaaaagaataataaaaaaaacaaacttaatggtagattttgattctttagctaagttgatatattttttatatgtttatatgggcattgaaaatga

SEQ ID NO: 3536 - DNA, 1100 bp, Glycine max
  Soy_ogl_312 Gm02:1405601..1406700 Cluster 14
atatatagttgtacaacagatcgatgagggaaatgaaacacaaataaacttaatggtataattaaaaaagccattgttttattcacttcactagattttgaattgaactaaatgggaaactctaacgatcgatctatcagatcttgatttaagttttagaaggagtagtggtttgtgatcccagaggccgaaactgatgaaagagacagaatggagacaggagaaataagcaaagtccatatgataattgattgctgataagtggttgcaacgtagggatgataaattggcagaacaagaaaataaagtagatggaataagtctatttggtaatatacagtatgagagtgataagtgcagtgtaggggccccatcaataatgcttctgcaaatgcttatgtaaggcataaaagtgaagctttgggggaaaaataacgtgaatagaaggctcatcatttaaagcaaacggcaagtagctagcgatgagttgtaagagtacttgaaatcaatcgtgctattgggttttggatacgagtgtccattaagtgcatgcagattgcagacaagtaaagcatgtgagtgaatcaaaattgtcttgactaactctatataatagaatcctatacaagcaaaagacaattcatactttcataggaataggtatttgcttgattccgtgctaattattagttgagtacttttaacttttaacctttaactgagaacaatatttatttacgatttatgcttctacactaatttttttaggtgacatattttttttctaaccgtctcaacatgtcatcattaaggtttgtttcggttcgggtaatgtattcccattttaccatttttttcttgataaaaaaaagataaataactattttgatatttaaatatgtaaacaagtgataatttaattattgaaagaataatttttttatttaattccttgtgtaaatttagcatcaagatgtaattattatattttttacatattccgttcttgctgtatttttaattaaattattatcagtttaagaactaaaatattgtttatacataaaaaaaaagacaacgactaggccaagacaaaatat

SEQ ID NO: 3537 - DNA, 1034 bp, Glycine max
  Soy_ogl_432 Gm02:7159340..7160373 Cluster 14
aagtgatattatgttgaggataaccctcaacatctctaggattgttccataccaaccttgcgttggattgatggagctctctcctagtctaaagaagaagagggaggaagaatatgttggtggaagggggtgtgcgaataggtggaggagataagggtaagaaggaaataaacaaaaaaaaaaaaaaagtacaaacggcaggtatatgtatatgtttaacaatttcctttttacaatcctaattagtcttaagcgccatgcatttttttttgtcttctatttcattttactttattccaacttattctctccatttcaaatggggctatgttcttcccacctaaattttcactaatttcaccctatattttgtttgttatttttttgagaaaaaaaaccatttcaaaaatgtgttttcttgtgcaatagacatagtagcttaattacaaaggcaaaataacatatgaaaattaaatttttcttttatataaagtgacttgatgacaatgacgtacgtaatgaaactcaatccatattaaagttgttgacaaaatcaatcacaccgtcatcgacaacctgaacaactttattctctcactctcttcaacttcaacatcgcgtaaaagaaaaaagaaagaaagaaaatatttaaaacaaaacaaattactttattttcaattttttgatgatggactgaaagtcatatacttttcatcctgtcaaatagtttattataactaaaaaataaaaccaataagtagtaattgtttatttcgtattattaaagaaactcacttaatcaaaatgactaaatggaccccattacctcgatagatcacttaaaagatattgagaaattaaatttatcaaagacttcactccatctttttcctaaatgctttccttttttctttttttctgtcatagaatgcacgaactatgcctattaaccttctttcttctttgtctttttgtctctatatctcagaagtttctaacttgacaatggtttcttgaaacattactttagttcc

SEQ ID NO: 3538 - DNA, 1249 bp, Glycine max
  Soy_ogl_943 Gm03:37919601..37920849 Cluster 14
gtagaaacctgaatccatcctcgtggattaaaaagttcatctctcactgttagacagctcggatacaacattcatgaactcacagcttctttcagtactggaatgtaataatttgatcaacctaagaatcagtgttatatgaaacctaaaaaagttaatttcaccaaattgcagtccaccaacaccaattgcaatacaactttctaggaattctataacaaatatgtttcttaaacttgaaaagcaatactcaacacaaataggttacacgagaaaaaaaaaaaaaagtttaatacgtgcacatactatacaattttttttctaaaacaatgtaaatcttctaataaaaatgaacttaaaaagactcaaatagactaaaagacttaaagattttctttaaattattattttattttatcttaatagaaatattagtcacttgtatgattgatattctttgtaaatatctatttaatatgatatgtactgtgtaataaattattaaataaaaaaattgaatttaatgtttatttcttagttgtagaatgtaaaaatagtggtagaatagtctctttgagcctatcatcttcttatagatgactcaagtatttttcacatagtcaagaaattaaactccagttagtaaacatatttaaaattttgttatctatcaattaagttggacggcattggttgcatagactatacaatataatacaatgtatatgtattataatttgaattattatattttaaaaatgcatatataaaaagtaatatggtattgaatgactatatatctatccgccacttttgaatagtatgcagcaatgaatataagatgccaaagtaattaagtattatacatcgtggcagattttggaaccacccacattttctgcaatttctatctaccaccaaatatcgcacttactttccaatagacaagatatgagcctgcagaggatctcattaataacgacgcaacgagaaccaactagcgttaccacttatcttaccaccatgaggcctgagcatcagtaacttattcaagccaatattctgcggtaaaaatttagattataagtgttaccaactttaataactgaaatggtacactgaactcaataagagagtacgtgtgtattaatttgtaatatacactttaacttgtcttaacttgtttttatttatccaatgtcggcaatgtggaacttcacttttctgactctcaagttcaacttgtttc

SEQ ID NO: 3539 - DNA, 1100 bp, Glycine max
  Soy_ogl_3710 Gm11:3858001..3859100 Cluster 14
ctttgcaatggacgaaaaaaaaactgcagagcgtgcagtgtgtttaatcaggtaaatgtcaaatattattactcaatgtatatttcgtattgcagcaagcaagggagagaaaaatattaacaacatgtaacactgtatgcaatgctttgagcatgattggccgttaaataaaatttgtcaatgtcattgtcattagttttatttaaaagaataaaaactaattaagatcactttcaagaaagaattttaattatcattgcccttggttttatcaaatatccataagagattccgtgaagaatcaaatccatgtgcttagttaggtccagcaaaacatttcgtaaagctaataaaaaattggagctagagaattgtacgttgaggagataatcactttgaaaagtaagctctatctgttgcgttttttcaatgtcatttggtataatcatgtgttttttattggagccgcagttacttctttctttccaaagtgtggtccacaccgcgaatgacgctcactaatttaaaatcataagccatgttttatatatactatatattctaacataaaatttatctttaaaattgatttaaatccacatatgaattacgtttaattagtaatttaaaatatcctaaaaaaattaatttaaattgatttaattccactcaactttaaaacaaccatatctttaaatgcttcacatgcagcacaatacacacacaggaattataggggggcttgttattcccgtgaccgtgagatttcacttgccaatgcctcatctagtcatctacatgcattgcttaataattgtgtcatgatttctacaaaaatattaattatagtttttgataattaaatagaaatcaaagccagacaggtgaaatatttattattacatgtcaacatgcaacaaatatctttctattatattttttaaaaatctatattccccattaaatgcatgctctcccaaccagaacaaattaaatttatatatggtcagtcttgcaattttattcttgtggatcatatgggcatttctttactttccatcaatcaaaaaacactcctatcatgcatatgagctgatgta

SEQ ID NO: 3540 - DNA, 1100 bp, Glycine max
  Soy_ogl_3942 Gm11:37163501..37164600 Cluster 14
aaaactcaattactgtaaatgacaagctaataggagtattaatttcttgcactgcaatttatttaccaaatacactgcaattaatcacgatccacctattgttgacaagtttcaaaattaaaaccatgatttcagaaatgatacacatttcaaattaaataatccaatatgcatttataggagtattaatttcttgcactaattccaattgtagaaaaaaggctgaataaaatcttatcactggaatattaaaaaaataggaaatatcagttataaatccccaattatgaaattgtcaaattggaaacgcggtatgaaagttttgaaagaacatgttctggatcaatttaaggatgtgcttggtttaaaggaaataaataaagtagataaaaaaataagataacttaaaaaatatatatattatgttatttggtttaagaaaaatacttgagaaataatattttttagacaaagaaaattgatttttttgtctagaaaatcaatttttccctaaaaattaaaggaaattgattctgcatgttggtccaaaaaattggttttttttttaaccttaaaaatcaattaggaaagagagaaattttaaactttagacccgccacttgtaactttactctcttataccaaaatccaccacttcatttccatcttcttcgatcttttatttctatccgcccaactgaacacagcctaataaaaacattggtatatgaaaatgaaaaatgtttcttcaagtcttggctatgaaaatgaattcttttgggcaaccttttcttcaagtcctgaccatgacaatattgagcttccatcagtcacggaaaccctagacattcattcattgctcggaggcaacctcgatcattatatgttaactaaaacttgataatcatcaaggcaaacgattgtacctcgaagtctcgaacttttctgtttgacattaccacagaattgaaaaagatgatgagacatatagcaggctgcattatattgttgattacttgccaaagaaacaccaaactgcattaatctgctaaattatcccccaatcacgaccccccacaggtgatcaatttcattcttgt

SEQ ID NO: 3541 - DNA, 1004 bp, Glycine max
  Soy_ogl_24 Gm01:1497821..1498824 Cluster 14
ctggttggaacagtgggggtacgaagcttaagcagctaggtgtccaagattttcagcttccaaagccacttaaagggagctagctgtttggcatggagagtataatcattggaagcaagccatttataggccaaattcgcagtataagaagaaggggcctaaacccatttatcagtcaaacttgggtgggtgaaaggatccaccttattgagaagatcattgaaattcaaaggcaaaatggtagaaatacgagcagtactctacaagtcatgttgaatgagatatttcaagcaaagatcagtttcagtgaaatgaatgaaaggtacttggttacaaataaatctcgaatgagaccaattattgaaccaaatagagttctcaccctggtctatcctaaagcgtagcccctgcacgatttcatcccgagcaacaatactacccttccaaacataagaatccccaacattccaatcaatactcaaaaagtgaccatccttaatatagtttcttattaaaactatataaaaaaagttttggatgaattatgttttttcctttaattcagagatttgtctttttagtctttcaaataaaaatttacatttttttagtttccaaattcaaaacatgtcttttttgtcattttcttcaaataaaactttataattttttagtctcatattattattattatttactttaatttatttctaagcttttaaccatgaatacctatgggttatgagttatgacccaaacgtggacgaacttctacaagttatcttctttattaacgatgtaaggtatgatattgagaccccaattcactattaaaacctctcactttttcataaatgtgtttttgtaaaatattttggacctttgacacttcataacataatggaaacttgctttattgtatattttgttgagatacatcatgaaaatatattttttattgttttttaaataacacgacgtaaaaaaattattacgtatttcaa

SEQ ID NO: 3542 - DNA, 1200 bp, Glycine max
  Soy_ogl_4795 Gm14:46897001..46898200 Cluster 14
tgggtattgttacaaataattgttgcgtatatacagggaaattttatattgagcaagcttttatcatactaaaatgttcagtcaattttttttaagattagttctcaataaaactaatagattctctacactaatgttttggtgatccaatatggagcaactttttttatcagttaaaacctgagtttctaatgtccaaaattacctccatagaatgtgttcataagttaaatatttattttgtcattttggaaattctttattattttttgggagaataccattgtagaacaccatctctattctctaaccataataaatattggccttcatgctgcaaaaatttgaccaaactctatgtagcaagcagggcatacactgaatcgtgtgtatccaacacaatgagttggttatgatttctaattcaagcttgtacgatttgtattaactcatgggtttgttcttacttattacaccacaatcatggacttaaattataggtgatgacaacatatgttagcaagtgtagagtatccacatgcatactgaaaactactaattcagtcgttttcttttggcaatgtagttgtcacttcacttgggagattcaaaaactgcaattactatatgcttttattcttattaatgtaccatcgtaggttgaacattaaaactctaatatgatcgtttaattgccatataatgataaccagcttggcaaacgataagacttcgcaccaaacatataatgatattgtcataaatgtcactttatttaagttggacgacgaagctgacatgcaacttggttgtgcgttcaatactagtagagcctagaggatgacaaatgtgttgtcttgtcccttaattttagctagaaaccctttatactgttgataaaaaaaaatcctttaatgacccaaattatcaaattctgatttaaaaagttaaaaaaaaaaaactacacccttcgtttctttttatttgcctccttttgaaaaaagattaaaattttatttctgtcctttaaaaggtttataactattgattgttatctttccggttacactttgatcttaatttttaaatactattgattgttatctttccggttacactttgatcttaatttttaaaaactttacaaacttgtcataaacgagagaaaacgttaatggaagtcctactaacaaataacaa

SEQ ID NO: 3543 - DNA, 1341 bp, Glycine max
  Soy_ogl_6866 Gm20:39404060..39405400 Cluster 14
tattgctggcagtgggtagagatggtggaggttgtgggtcttatgtgctttgatggatgttgaaaaaataccaattggagatatctgagggcatagttggttcttttgagttagaaatttagaataattatcatacattacttctgtctcacaaacaatcaagctatgtggttcgcatgttcttatttatgctttttttttttgctaacttgattgttcttgtgtttcatgatgtcttgtcactaatgtgttatggtgcttcttctgccttccctccctttttctgtgttatgtttgatgcccgttcatgtttaggtgtaatgattgatgaggagggtatagaaggtttcagtgtttgtaacctgacactggcttcagccctcgttttttttttttttttacttattctgctatttaagttatttttaaatttctattcaatcccctatatagaggcaataaaatttgatcattgcggttctttaaaaaactgctaaagtaaatttgttgagacggacagaaaagtggtttcgatattaaacttgagcagcaggtccgattattgcttattgtggttgttgctaaagatgttggctcggaaatactcttgatctgtaattttttcttgttctgtcttccatttggatagagttttatagaggagacgtcatgtttatgggaaaaatgtgcactgctcggttttgaaattatttgcttaaattcaggcgaaatacggtcgtcagattgggaaaaatgagataaataattagattgactcacttccattccatcaagcaaaaacttagatccctaccaaaaaaaggcattatcactgatgctgtatagtctttttaactagaattatgctaatttattttattctaatttttactatcatccaacgcaaggttctgagattattcaatgttttttagtaatctcaatttgaagtcttggatttgcaactgcaaatacttaaaagagaaagttttatcacctgtaataataatttctggctgaacaagtatattttccataaaaaatacctgttgtacattaaaaagaaaaactttcattacagtacttaagaaaatttaacaagtatcaaaagtcataactagaaaaaaaaacttgtacaaaaagtagtgctatgtcattactacttaaatgggatggtacaaaataaattgcgggaaatacagtattcaaatgatacttgtacaataatttgtataacaaaatagacaattaagagagataaaaggaaaaaaattgaacttaaattataataaatgatatgattgaggggagatataaacaaaatatgatatgatgatgtat

SEQ ID NO: 3544 - DNA, 1053 bp, Glycine max
  Soy_ogl_4704 Gm14:5973401..5974453 Cluster 14
aagttgctaattagtgagtgtttgaagctgctgtgtgtaattaatttatttagatcgagcgagtgagacatcttgagtgtcaggtgccaacactcctctttttggtgcatacatctcctctcattacttccaccaacattcttgcctcctctatagttttatattatttattgattcatctaacataagtctaattttatctctcaaatcattataaaaaatatatttgtagttgttttaagtcagcaaagtcatcatcttcttaaaatatctctcgcgtatacttatcatataatgactcattaaaagagtataattaagttgattaaacaagatatataaatattataaattctcaaaaattatgttcaatttctacctaaaaaaaatcatatggtgactctctaaatctctatctctctcataaattaaatcatgtaatttcacttaatattgaagtatttcgaattgggaaagaacttatgtataaacttgacttctctgtcatgccacgtgttgatacttccgctcgagttcgattataaccaagcttttgttttgtctcgagttagattataaccaagcttttgttttggcttcaaccttgcaaatggagtattgatcagtagctctcagaacaaattattgtaccaaaaaatcataaaaggcacctcaaaggtcaaagcctgcgtaactccttaccgacaaatatcaatatattacgcgctccttgtactttttattagaaaaatattactggctaattattagttgttttagtgagaagattaacttttgacttttccttccgttatcaaacactacatctggtcaagaacaacgtaaacttaacacaatcttataatccctaatttttttttatgatagaaaccactttttaaacagcactccgttcaactggaaaatggtgctccaaaggaagaactttactacacatatcactatcaattaccaagttaccatccattatctaatggacttccaactataaggatatattaatgattttagtcacgatatttgtagaggaat

SEQ ID NO: 3545 - DNA, 1069 bp, Glycine max
  Soy_ogl_5830 Gm17:40993301..40994369 Cluster 14
ttgatgagtgttgcctaaaaatcaagggatatagactgatattagatgggggatcagaaaggttgcacgatgtgcctaaaaataggattaaaagttgggcatgataatgtgttgaaaacagccgaattgaagttagtggttagcttagcactcttataaacggttacttcagtggatagcttgttagattagtatgaatagccatgagaaagtagtgtaaagcaccttcaacgattcaatcaaaccatttactaaaattgtatatcatatgaatagtataataaactgtatttgtaacttcaatttaaattattgtaactgattgctgtatatcatatgaatagtataataaattgtatatcctaactgaaaactcttttatatatagaaagagaggtaagtttgattataatcttcataatagtcttattttaatagaaaaaacttattttaattaggctagcccagtggccaggataacaaaagaatgggcctattgagcatgccctaattaatgtacttctctatatcagcatacaaatataattataaccctgtaaaggctagtacttccagcatctcaggtttgcttcctgcacccccaaaataatatattaaaattggagtgcattaagcagaaagggagtgaaggaagtataatccttttgtaaactctgcaacatgttttggacaaaaaaaaatctccaccatgtatatataatttaaacacttaaattcctcacgcatgcatttagctcttcttttggctcttcaattttaatcatactatcaaatttttaatatccatataacaaaactgtccttctcaagggtagaactcatcgaaatttttatttctctttccattaagcttccaaggactgaatcttaaactttagaaagaaatattgggagaaacggctcaaatttgaggagacgacctgaattgtgatttatttgtagatttgcgtaactaatctactcttctattctctcaaagaaaaaatatactcttatatcatacattagaatttttaatttggagggtaaaaaatttattctccatttc

SEQ ID NO: 3546 - DNA, 1000 bp, Glycine max
  Soy_ogl_2212 Gm07:5377301..5378300 Cluster 14
tggttttgcaaaagatctttgtgtaattgtatgggaaggtttcaatcaccaagcaaaaaccaaaataatgaaaaaaggtctaatatgaggaaagaatgcttgacaaagtaactcgccatctccagaacatattagagcaactttaacctattgctccataaacatacgagttttgtaagtaactttatttaataaacattgttcattacacacgcattagttacttttctctttaaacacggattgtttaatataacaccgatgttatttgctttcaagatattaaaaaataaaaaataaacactttaagcacataaaaaataagttaataataaaataatttttgtggactgcatttgaagggttcaaagagaattattctattatgaaaatcgagtgttcaaggatgtttgtattgggaagagtaaaagtgaatatatatatatatatatgaatcacattttaaggcctcaagtgagttgttgggttggagatgagctctgaaaggtgtggtgggaatcctagacccacgctaaaccaaactctttcaatgcactttttgccgatacgactatttctcaattaactttgaagcagctgtactttgacgattttagctttttggtaggaattgagattttgaatttgacattggatatattgatatatttgacaatggttagtgtaattttattcttttaattttttttgtttgaaacaattgttttaatgcattgcatggtgtaaatatataattaattatttggcagaagaaaaatcaacaacaaccaatggcaacaaggactttatagacacaaatgtgaagacaggatattgtttattatatatataaactaactttgcacaaatgtagttgtatatacaaggtacataaactgaaatatagagagagacccccgaagaccccttcagttcaatacccaaaataaagataatcccttttcctagtacctttgacttagaacgcatgttgttgcga

SEQ ID NO: 3547 - DNA, 1200 bp, Glycine max
  Soy_ogl_106 Gm01:4390701..4391900 Cluster 14
gaatatacattttaatttatttaattttatattaaaacatgcatgcataagaagtgcaaaagaaatatttgatcattttcttcttcatattaatcatgtgaagtcagtcacattcttattatgattatatgttttaaaactagagttatatttccaatcattgtaaagttagattaattattttttatttttctctattttttaaatgttaataaacatagtaaagggatctaactcaatttaagtgcactctaataattgtgtgctcaattagtctagatggatttctccaaatcttactcctaactttactccaaatcataccatgtagtaaaacacaagctgatcacaaaaaaagatgttgtcatggcaagttttttcgtagaccttggccgtttcaataagcttgaacatcatttgttgacttgattcacttgtctcttaacaccacttgacaccaatcataaacaaagggagttatgtttgcaccaaaaacactgttaaataatactgggaactggactgctaataatacagtagaaaaatctgttatacagcatattttgttaaattcttgaaatcggctaagtatatcaaatagcatgtaaagtttgagacaagaagacatggaattgggggatataggagagttacattattttttttctaattgaattgctttttggttacaacatacatgtaacttgtgaatgacaactctggtgattttaagtttgaagcggtcataattttttgcaggccgtaaaggttgtaaccatgcagcatgatgatgaactttgggaacaattaatcaagcaatgcattcagaaacctgacatggtataatcataactaaattttattcaaataaaatgcttgcatgactgcacatgtatgacgtgttgcatttaagcttttgtataatgactaggattacttattactctttaaccatgtaaagattacctcctttttgtatttaatgctttatatagttttttagataaaaggataagctaatgcaaggaaaaaattatggactggacctcctttttttatttttattcaaaagttgtaaaccttgtgcactaaaatttatttgtattcatctaatttttacaactgtgttttacaaaccgaaaaaggaagagacaaataactggccccgtattctattatttacatattcctgctcttttt

SEQ ID NO: 3548 - DNA, 1200 bp, Glycine max
  Soy_ogl_2498 Gm08:4497901..4499100 Cluster 14
cgctaaatttttaaattttcttacgtttttctcttttgccaagccttagaagggtcctcgattccaacgctcccctccctttctgttctattctttgttattttgaccgtatcaaacacaccgttaggaaatatagcgatgatcaccaaataaatacaatatggctatgtaaagtcacctaatttgaataagagaataaaatggaattattaaaagaaaagataactcataataaatgataactgtgagaaatttcatgtctattagtgatatatttaaattaaaatatataaacgatgtataattctcaagttataaactgattttgtgacattaaattaagactaattaaagatttcattaagatcatttttcatcttttcctctttgatctatagatctcgaaggtcaagtcaattctctgcaatccatcgtttctataaaaatcatcctttatcttggacttctcaagtatacttttttgggctcaaacaagtgagaacataataattttttgtgaccctcgtcgcaatctatgaccacaggaagattcacgaacactgcccagatctcattatgtaactttctaggatctgaatcccaaacttcattaactatttatgctcctttagttaagttttacatgcaaatgcaaaaaggagaagtaattaattgaagaaaaaaaaacaaataaagacataaaaatctacaaaacgacataaagtcttatggcatttgatactaaatgatatccgttatgtttctttttataagaaataaataatagtgtaaaatatgttttcatttatttttttttaaaggattgaagaagaaagatgatataaaaattgtattcgtattttgcacacatcatatgttgatataagtttattttataattgatatattttatttaatctttcatttaatccttttattttaatgaattcttttatttagattacaaaagtttttcaattttttgaagaagtcgccggttgaattaaaaacattcatgtggaataactttttgaaattagatcgtgtcccaaatttaacattttttttttaagattagactatgtgtgctacattatatacatcgtggtgcatagttcagattttctttatatccatagaaattaaactggttagttttatttaaagaaatatttttttcttgttgaataaaaatttagg

SEQ ID NO: 3549 - DNA, 1237 bp, Glycine max
  Soy_ogl_4101 Gm12:35798401..35799637 Cluster 14
tatgtacatttaaattattagggataaaatggtctaaaaaagtgaagatgaagaaatagatagtgcaatgatatcctttttatctagtgttataaattatagatatgtaggtaatattgaatattatcaaaggtaaaatggtcttaaaaaaatgaaaactaaaaagtagttagtgcaaatggtattccttttatatatctagtgttatgttataaattatagataaaatattaaattggagtttgtaaaacataaaaaaccgaactaaacaaaaattaaaacataaaaaaaactaaacatatagtttagccaataaaataatcagcatcaaacaacctaactcacagtttgaaattttgactcccaaaccataaaaaaagattggataaatgagtgggagattaagtgttgttccctcatttagtcattttcctattttaagcaaccaacaaaagttactagcaagtgcatgtatatatgtttcattgtaatttttttttttctagacatgttttattataaagtgacaaggttgaatcctcactacatgattttgttccaagactgatataaccgcctggtcctataaatagagttccatatgtaccgataaaactactactcactcaaacaacctaatttacattccaaattttccaaggaacatgatgaagtgtttttctccattacgatcccgcacgagttgccgtgtcaatctagcttcgttgtccaacgacgacaaccaccgcactatggttcattcctccgcagattcacggcctttcaaatgcggcaaatcacggtggcaatcggccctttcaatcatcaaggaggatcatgtttgcatggctgaagatcaccaaaacatcattgatcggaaattagacaagaaatctttggttgcaattctccctcccatcgacgattacttaacgtgagtttttatttctcaaataacattatcataagggtaaataaatattgagtattatgatattactctatcacaattcttcatatgattttcataagagaaatagttaagatacaatagagttttatcttattcaatttttttttatctattttaaaaaatactcgatatttatttaagattataataattatttaaaatcatattaacgagaatttctaattaattattattagtgttgttgttatatttttttatatacttttcaggaacaggcccgaaaagcccaagcgggttctaatg

SEQ ID NO: 3550 - DNA, 1036 bp, Glycine max
  Soy_ogl_4976 Gm15:10680765..10681800 Cluster 14
atttagagaaggggtttaatttgttggaaaacataacgataaatggacactttttttataataaacacttattggccatgtgacatccctcttctctgtgtctgatctcttctttttttttttttttgttacatcttatttcttataagtccactatttttcttttttatttcttcatctctctagatgttagtgagtatgcatctgtctatcaaatattttatttcaaaaaaaaaaaaactacagttggagagaattaatgcgtgaaatcagctcaattttttctttataaaaaaaaaaaaaaagctttttgcgaatatgaattatgctagtacttgaagtaaataacatgcatgctagcatgagatcctgattaacgtaaaattagtttgtattcaattaaaataatttctcctttcacaaaaaaaaatgaaataaaataatttaccttatttgttaggattaattttgttagttactataattattatcttattctattctattcttctctgtttccttttcttacaaagcacatgagccgttgcaggctttcagccttgccctctcttgtcattcttctctagattcatattttttttggtcgaaccggaaacctttttcaagtttcagcatgttactgatacaggaaaaattattagatagtacgaagattttaaatttttaactaatatttgtaaaatatatatttgagttttttaatttaaaaataataatacaagagacttaataattagtctactaataatttctcctgatacgggattagctaattctgtctttttgtgtttcacctttccttcaacgatttgcttgacgccaatagttccaaaaggcactatctctagtttttgccatacatattcttggtggtccatgctatctccaagtccagctcatctctcttgttctgcccttcttaaaaaatattagcctaagatacatacgtttttttattaaatgggtgtaaattttttatgatttttttatatgagagttgattttgaattattat

SEQ ID NO: 3551 - DNA, 1100 bp, Glycine max
  Soy_ogl_5582 Gm17:8232001..8233100 Cluster 14
atttagatttcatgaaaatatattaaaatattgtaaattattcattttcaacagaaatataaagagagaaagagaaatcggataatttaattaataaaaaacattttattttataatatctaaataagaaagaaatatgtttaaagaaacacacacatgaaagggtcatgacatcaatctatctgcaaaccattacatccctgttttttctctggcaattaagtagtgacacttttctagaattccaaacaattacgtgccacggtgctagtaccttgtcacgattattcgctttcaagttgattgtccacaaaaattggtaaatcaagctactgttgtggacaattacaaaatatttggcaaattaaaaagcacgtttgtatctgttgacagcatattagtaacattatgagttagtgtattatacgcaccttgccaataaatgtcacaaacaaagctcatcgagaactaacattctgagagtcgtcatcgtcgttatcaaaataaatgtacgtaaatattgtcagatgactcatgtatattcataacgggacacttgtatgtcttgcaacatttgaactcttgtcaataattgttacatatatgatagctatgacaagtgaatcagcccgtaacataaattatttttaataaacattatgtttggaacaatgtgataataaataaagtatgtttctaacctcctcaattttataaggtgtgattgtgtgaaagcaagagaactgaccgataatatttttttcttttttggagataaaagatagactttaattttagaattttgttaaacaatatccttaaagcattgattaaagaactaaaagaaaaaaaaattatcgtaaagattaaagggaagtataaaaaaaaattcattaataacattattttatgtattccaataaaaatattttttcttttaattttttaagcaatgtcataaatactcggataagaattcgtcttaattttaaagcgatggacctaatgctaatggtgacagtgtgagcgtaccctttcgtcaaattcagagatgggcttgcatttatttgcaatttatttctggcaactacttcttgcat

SEQ ID NO: 3552 - DNA, 1100 bp, Glycine max
  Soy_ogl_6778 Gm20:36004001..36005100 Cluster 14
aactaactctaaattgagtaaaaatatatttattaatttagtcattaaacatatattttgatcgacgctaaataaaaaaataacacgtgatatcgtataacataaaattgaaaaaagaaaaaaaaaaagaggtgagaaattggttcggaggaaattatttctcacatgtgaacattaatttatatgattgatgtaaataatggttaacttgtatcatttggataaatatataatttatttatattattggtgtaaaaaattcgtaaataatgactcaaatataacttttgtaaatctatcccactacttagtgcatcggcgagcattaggtcgacaaggaacgagaacgaatggaattgacggagaaaaacgtacaagagattacacgatcgatgtgggttgaaaatggaggggggcacttgattttttttactttgttgcgttactagtcactaatcactaatcagcaaagaaaaagcctttcctttgagctaatagcagttaggcttcgttgctttctaccagactttagttcattcttaaataaataaatgcccattagctatgcatagtgtttttattttttattttcattttttaattacaaaattgtttgtttattttcaatttatttcttatttttaaatatttgtactggaaatacagaaaatgttgtttttttttctttgtttcctatataaatctttaaaaataggaaacatattaaaataatgtgacaagtttgtaattaaaagtaaaacaaacaaaaaaacaataaaaacactaagtaaacgagtccttagtgttcaatatagcagtgacaaaaaaaaaacgcaagagttttcaaaatgatcagtaattaatttcataaatatataaagaggttatgtttacatataaacaacaaattattaacactattgtaatttattttatctgatttttttaaatatctcttaagttttgaagaagtcaaaaaacctccaacttacatctacatcgtagatgcaaaatcttttttttttttagacagtctgcttcaccccattaatccaataacaaattaagaattgggtaaaagggttcctctaccaatttct

SEQ ID NO: 3553 - DNA, 1000 bp, Glycine max
  Soy_ogl_6872 Gm20:39580601..39581600 Cluster 14
aataaaaaatcgaattttaaagatgaaaagttgtcatagattgtaaattttttattccatagctagcttgtgcagcaaaaaaggactacaagtaaatattttatgaaaaaaaaagaggactaaatttcttttactcaactttaaaggacaaaaaatatatgtaagaaaaaaaattatgagacaaaggaaacactgtttaaaaatagattagtaagttaagaaaaccgatcaacataacagtgtagttattgcacccaccaattctcacgcacaaccacagatagaaatatctttttttttttaaaataaaataaaataatggttgatattagtccgtacttttttaaaaaataatcagagcctatgctgtacttttcgaatttggattctctcaattacttgtccagttctccatttattgttttggttaacaggagggccaaagccccaaaataaacctaaagtatgctagaaaaggaacgtgacagatacatgccacgaaataaaccaaaactaagctagaaaggaacgtgacagtcacgaaataaaatagatgaaaaaaatgctaaggcagcctgggaacaatattgctgtaatagtatcttatcaaaataatattattatcgtattataaggtccatcaatgtgaaatccatttaaatattttaagattttcgagataaaatttaattactgtattaaataacatctgatttggacttttgaggaaaatatcggacgttggaaaaaaaaaattataagtgtacccggacaggtgcattgattaatgattatgacagccattaattattaatagctgcaagctaaaagggaatgaaatcacactcgtttcagccaagcagtgagaatactccagactccagagttcaaccatattcctttagaaaccactcatctcattaattacttctctgcccacctctttatatctctcttttcatatcatttacccaaaatatttttatcatcaccacgatat

SEQ ID NO: 3554 - DNA, 1100 bp, Glycine max
  Soy_ogl_26 Gm01:1588501..1589600 Cluster 14
tttacttccgggttcttttttcacaacattttatgtgacaaaatgtgttcagtccttacattagtcgcccaaaatatttgcctccgaagcccaatatacgccagccttgcactgcacaatggtccatacttgggttgggtgttcgcttgacatacacaccatgactctaattcataaactcaaaacctatttaaataaatttcttcatatataagtaattaaaaaagaagaaaatgaaaatacaaatgaaataagtttctagtaagttaaaactagtttatgcagaaattaaattgtaaaagttttctcatattagcttttgcgaaaacttacttttaacttatagataaacttattttattttattttctcattttcttcttttacaagtgattatatagaaatttattcagatagactgttttttttatcatgttgtttattactttgtatttcgttgagtagagttgaataaacaaattatattgtggtttcctagctcaatttggggggtaggcatacatagaacaaacaaaccatttgtaataattgtaaatttagatattaccattgatatattaatggcagtaccatccaagtaaaattgcagtggccaaatttgtaactccaacaaagataaacaaatttgaaagggtcaaaagcaaattagattacttgagcataatttacttttgagtgttgaactattcaacttcttttggtatatcaaacctaccatatctatctaaatttccactcacccataaccaccgtagaacgcctatgtaatgtggccaaataatccaactttaagaacactaccgtacgtactctgatatataagttactatcttttgattcacttattcattcatattcacttatttcatattcccatggttaaataatctcaatcgatggcaagttctaaacttccatgtcctgaaacattctatatttccatgatttgtttgactttccttttttcctgtttcagcatgattttctaataaaacaagagaaaaagtaaagaactctcacaaaaacttctagctcaacaaaattatataatcgtcagtacagaaaatttcatatgctaa

SEQ ID NO: 3555 - DNA, 1053 bp, Glycine max
  Soy_ogl_104 Gm01:4291442..4292494 Cluster 14
catctcaaaaggatgatatcaccaggatcgatagatatcctctcacccataaccaaacacctttaattataattgatgaacaccctttagccagaatagaacaccctcttgttcaaggttgaacgctcctcaattatagcaatgcagggagcttattagggattaagaggaaaaaattacttaaaagtaatataatcaccattaagacctcatcagtagataatcatggattaacatccacactaaccttaaaagtaaggcccatggatccaagtcccattaatatgtatataataaagagtgaaattccagaggtaatacacattattcattcttattttttactcacatttaatatatttagggatatgactaacttaagtgttgatgtgttttttcatatatccacctttgtcacattaaaaaaggagttcacataatagaaagaggaagcgacactacatcggagaggaagaacttaccttagtacctgtgtaggtacaagacaattaccttcaatttgacatatattgagggactctatcatgtaatttcaatctttttatatttaattttgtcaagagttaatatgataatttgagttcacaactaaataggagaacttacaacttttcatatttaactttaaactttttgaaaaagtttcatacacatgcaaactatacaaacatattatgtagacacatttattaaacttcaaaataaaataaaataaaggaaactaatgtacataacgaattacaatcttaagaaaccaatttttatctcttaaaaaaattatttttatcgttaaattcatagattaaaattacagtgttgataaaatccaaaaatcaaaattaatgatattttaataaaaaaaatattcttaaaatttattttaaatctcattgacccgtcaatattaggttgatcttaacttttcctaattcgtaaatgagataggaataataggtttggagacatgctttgatgtaccaataggtatagatggtacaaacctgaacgtgagctataataaatccatacgcg

SEQ ID NO: 3556 - DNA, 1367 bp, Glycine max
  Soy_ogl_303 Gm01:53134306..53135672 Cluster 14
gcatgacaatagataactaatagtgtaatacaacttgaagtcgtgaaaacatgacagaagtagaggcgcaaaatggtaggagaagtaaaaagaaataatatcctgtgagcaaaaaagtaagcaaaaaataaataaacaataggaatgatggttagatttaagcggataatatctattagtgggattgcgaagctctcttgagtaattcccctaacaaataaaaaaatattaaagaaataaacaacaaatcgaacaaataaaatgaagagtgaagaatgaaaaattagacaacaaatgaaccaataggagagacataccttttcagtgttcgctgagaggcgggaatgccgtcggcgatgtggcctgcgattaggaatgacgacctagcgtggacgagtagaagagagatgagatttaaggcagcgcaagattaaagtataaaacatgtaattcactttaaggagtggttccattagtattaattaattaatgtgtaaaaatatattttttctccctttacactttcaatctctttaaaagaaaatatcactaaaaaatattgcatattattgtcaaatatttttttgattaattaggatcttcaaccaaaatcatagattaatcatttgagatatagagatcgagttgatcatgattatatatttaaatgataagattatttattaatcatatcacattaattattgatgttaatgaaaattaaaaaaaaaaaccttaaaaatttttaattatattatttgatagttctcataaaacaaaataaaagtttgatattagttttttagaatatttttaataaaatataagaagtaacaattattggtagggatgagcataagacgaattaccatagatttaagtttattcctattcaactcagaatgttgttagaatcatttatatgatcatgacctaataaatatatgggacgagactagataaacttaatttattaataaaaaattattgtatgcaccaaaggaaattgtttgttacctgtatggtaatttgacttattttacccgaaaaccaaattgaaaactgccacaaaacaaatttttattttactgcattcgaacttggtggcgcgtttgccccaaccctcatttctagagctgatgttgcagttcatgattaatatgtgcatgtgatacttatttttagtatcgactcaccttacttttaaatcataaaatataatttatattggttatttgtatgtttaattatataattttgattaaattctaacattgttcctaaaataaatgaatggaaataaataaatgattgttttcttgtttgacatattttggtgtgtaatataaaattattaatttttaagt

SEQ ID NO: 3557 - DNA, 1185 bp, Glycine max
  Soy_ogl_691 Gm02:209501..46230685 Cluster 14
acacgcaatcacaagagcacccaaaacgatagccagcatggcgcaaataatgccaattataacatatgcagaatcatggttttcaccttcttgaagaagtctacgagaatggaggaggagggaagggttgttggagtgtgtgtcttcttcttccgaggtggtcgtagctgaaaatactgttcttgctgctgctaccaagaggatcatgataatggacatgctatttgtgagtgtctttgtccacattattgtgttgcatataacaataatgtgtgcatgcttgctcaatttatatatatatatttgaacgagtgatagaagaacggaaataaaatgcatgcatgcttgctcaatttatgtatatatttgaacgaccaagggatggataatatttaaagattaattatgtccacattcagttgcattctaaccattgtaaagtaggaaagattctgcccccgattgcgcatgttgaccattaattgtaattttaatgataatttaatgatgaaagattgagaacagggtgtgtgattaattatattgcgcttacaatatactctgcgtttgtgaggaaattaaacgagaacatctattgagatagttcatgcatcttttttttttttatcttgagataaaattgtattagaaattatgttaatcacaaaaaaaattagagattacgataaaagtatattaataatattaagtattttatttttaattctttaattaactaattgccaattatattatatatatataaaaaattgtcacgtaagaatatgccatgtagaaacactaaatttattttttcccattgaaatttccctattttttatttaatttttaatttataaaataatatatttatagtaattaagcttattgcaacagttatattttgattagagcaatcaattacaccattaaatcttacatggattttgattttatattagaagcgattaatttatttaattttctggaataattttttataactacagtaattaattaattaccaagtaatcaaaataataaataaaataatgtattagctaagttatattgaattacggtaatgaacagtgattttgacaacggtaaaaagttgttatatgctactttatttttgcatatatcaaattggtacagttcaacagtaattaatagagcaaaata

SEQ ID NO: 3558 - DNA, 1067 bp, Glycine max
  Soy_ogl_1030 Gm03:41939901..41940967 Cluster 14
tttcaattgcttttgtgattgggtgaaagcctttgtggttgtttcttatggcatgtgcaaaaacaaattaagaactaaatctatgaatttatctgtggaaaaaataaagattttgctggtttgagtgagcataaaacagaacttttattcaaaaagaaagtcaaaaccgatttttaatatctaaatatgattgcagcttgatcatattatattaggtaattctctaaacgctgctcaatcagtgtactgcaatttgctataatattgataaatgaaaaatatgcatgtagttatttatttatttattttaatgaaaacaacaatttagaaaaattatattattatttgattcaaatatccaggaccagtaagaattttcagtggtttattctttaccacttgtataaatggcaatgcttcctgttgttgattcatgcttgatatatgcattctcgattatgttactgaaatatacaaaaaatgatacaaagataaaatttaaaatattaaaatccgtaaaaattgatccaaattaaattgcaaaagattgagtcggatttaatattatattcaaatcaagctgcctataacttttaagtttgtttcagatgatttctgttttaaaagtcaaaccaaaccgcactgtcaacattcctaccgccaatagatgcacgctactgccaccagttcaaatctcctggttctgtaaagaaagaagaagagaagtgagaaagatgagggtatttttgagttttactatgctttaaaattaacgggggtgtaggatgagattgatagtgtgcaggaagaaagatccattttctcacactgaaatattattaggatcggcccaatccaaatagctcaaactggattttgatacttagtgactaattatataacaattgtttaaaatttaataaaaaaaaaaaaaaacaaaagtaggtattgagggacacagttaagaaaatgggcagaaaattaatcccaatttttttataagtttcgtttcttaattaattatctcattgaagttgagttgttccaaaaccctttttctcttcatc

SEQ ID NO: 3559 - DNA, 1000 bp, Glycine max
  Soy_ogl_1080 Gm03:44053501..44054500 Cluster 14
atttattttagtgaaattgtaaaataatttatgatttctgttatttttttattttttaattgaatgcattaaagtcgtataagtctacatgactttaaaattattaatcatcatatgattttaaagttgtgaattgtcctctaacttctttattattaattaattttgacaattaatacaattatcctaaaaaaataaacatacttattaaaataatttaaacctacaaataataattcccttgcaaataaataacctacaaataataatttataacatgcaaaaaataagttacaaaagcataaaataagtgcacaactttaaagtcgcaaacaacacatgactttgaagtcgtagggttacacacggctacaaagtcggaaggaattttatacaaaagtgcacaactttaaagtcgcaaacaacacatgactttgaagtcgtagggttacacatggctacaaagtcggaaggaattttatacaaaaaataataaaagtcatcatgatttatacaagttcgttaaaaaaattaaagtatacaatttcaatacttaaaaattgcaatcattcataccatttatcctcgtttaatagataattcaaaaactattctcatttggtaaattcttaaaaaattgatcattgtcaagatgaactgacctgactcattagacacgacccacctcttaaacagatcaatccaactcgactcatttaaaattaattatataaaaaagtaatttggcccagcccatcatgtgttgtgagttaaaaaggttggctcaccagcccacctaaaatataaaatatttaaaaaaaaaaatcaacaaaaaatcaatttttttatattttttaataaaatagaaaaatactagttaaattaaatttttcattattcacacaccacaacaacacatatcatcacaagttagaaatctagaattataataacgaaatttttaaaaatagtcttaaacaaaaaactaaataaaataata

SEQ ID NO: 3560 - DNA, 1343 bp, Glycine max
  Soy_ogl_3153 Gm09:37317421..37318763 Cluster 14
cctcaataattgttgattttcaaatatgttttgttgatcaagagcgagacacatacacgtgacaggactacatgtattgctactctattttcaaaacgaacataaaaacgtgcacgttttatggaatagcatttgttcctcaaatgagaggacataataaaggagcattgattctgtatatcagttgaagttgttggttctttctagtttagattatgttctacccttatgtatggatggtaatgcatcaaggaagcgttttagaaaaaaattcttgtccaaaatccacatgggtaacgacgggcaattttgaagcaaaagacgtgtagttgtgcacttcaaaagcttatttcttgttttatatgctgacattttatgatgcttatccttttaagggactaaaaggcaagtcctttataccaaagtgcattgtaattattgatcctcctttttgtatgagtacatgactagattatttcactcctctaaagtgagtaaagactaaacataaaataatttcatttgttgataaaggaatcagttattgatattctaacacatccataattttattatgtagatgtaatattgataattaatgaataaattaataattaatgtttgttgaaaaaaaatattaattcaatttttggcattggcaactgactttacctcctcactttagacttttagaggacccaaaatctacgcaaattgaaaaatggtgtagtatacacaagtgtgcattcatagttagatgtattagtatcttaatataatgacttgtaattgacttagaaaactgcaatttatcattcttcttcaaaacaaattaaacaacactacccaaaaccaaaaattacaactcccatggcaaagcattgccatttatcgaactattcctcttctctctccataagataaatgttgaaagaaagatttatgtacagctctattctaataatcgtcttaggtttgatttaattttgaagaaaaagaaaaaaatgttttagtccctatatttttaattaaattttagttttagtttttgtactttaaagttaatgaaatcagtccttcaatagcttttggaaatatgtaattttcatcttttcaatatgcaattcaatcaccaataaagttagtgaggaggaacaaaaatcaaatattttaaaaaatgatttcattgatttgaaactacaaaagacaaaaccaagtataacaaaatagagggacttgaaacacattcccaaaaaatatattgagagacaagtttacttttaattagagaaccaaaccagattggtatttgtgtatgatttggcttgttttctttaatcaga

SEQ ID NO: 3561 - DNA, 1000 bp, Glycine max
  Soy_ogl_3345 Gm10:3199001..3200000 Cluster 14
ataaattgcttggtgcggttgtgaaagaaagtttataatctcgcatattatctatatataccctgtattttggtagggctgatatgtggatcatatagatcagtttcttatttgataacctttaagtagtatagagataagataatcgtacgacaattaaaaattaataataaaattttaataatttaacaatttattatacttactatcatttttagggagtttaaaagtgtttaaacatgattgaccccaaccccaaaaaaatatcacaaaaaaatcgtaattggatttggattgggttacacaataaaatttcacaaacctaatctaaccaaactcatacaattctaattggattaggtaataggtttaatcaaatctaacacaatttgatctgtaaatactcctatacatgtgagcatgtattatggattgtagtaatttgtaaattgcacggaaggtgaccaaatctctctttatttgtgtagattgcatatgagcattgatatttaatttgttcaccctatgggtggattgagattgaaagaagaaagacatatagagagagaagagaaagaaagacaattgagagagaaactaattgatgagataagtgatatgatgagagagataaaaaaaaatggggtggaaatgagatgagaaaaagtaaatacatgataagtttttttcattgcatatatatatacaaaacaaatgaataaccaacatctaacaaggatgatcgttatcaccgcccatacattgggttcatagcatatactttaaaaagtgaggtgtcaatactcattcttcaaagagttcaacaaacatggaggaaatggctttgggtgaataagattatcttgagagttagcttttaacttcttgacctgaattccttaaaagaaaataggatatagttttagtaataaaaactattgaaccttcttttttatagattttttgaagcaaagaataccttgaattaattaccttcact

SEQ ID NO: 3562 - DNA, 1067 bp, Glycine max
  Soy_ogl_3750 Gm11:5337334..5338400 Cluster 14
cttacctttaatattttttttgaaataataagattaaaactaaaatcaaatccaatctaaactgttttaaattgaatcagatggcataagattaggattttgagttaaatggaccggatgataaattaagaaaaatgaagtgattagatcgaataatttaaaaaaaaaaagttgatctaatccaaacgatgaacaatcttaagcgaatgaatatagaatcctatgtatagaaaatcataattgactgttggttacttattggaagcaatattaaatttaagctatcttttgttgaaagagctcgcaaatcgcaatatgtgttaattgataaaattaggtactatctatttgggaatctatttttttgttataattagttatttttctgattcttataaaatagactatctatttttttcaccatgtactatctatatttgatgtgtaagatactttaatttcatcttaacaaaatagtcattttttgtttttgtaaccaacccaaaatatccaacttaattaaagtgaagttggattagattagattgcttaaaaaatgatgaatccaacccaattcaattcttttaaatataataaattaaatttaaacttaatctaacctaaactgtttacaccctagttacatggacatcaaacacttttcctcaaataatttattatatttatcattttctctttcttttgttttttctctctttaaaaaatgcataactttgctctaattgtacggactcttcaatatcctttttcgtttgtctgtttcatttttcttctaatctgttttgaaaggggtgttgtagccctgttccagtttcctttcgtagattaggtagggaaaaacgactttgcttctaaagaaagaagctttacatggatgccccgaaagaaaagtcttccttatggggactattgtaacatctaacatgggagaaattttgatttaccaaaagaaaaaataaatactaatgtccgtagtccaccgaggcggcacggcagagtcgaagaaccgaaggacattaatgacatgtatttttttttataataaa

SEQ ID NO: 3563 - DNA, 1100 bp, Glycine max
  Soy_ogl_4099 Gm12:35710201..35711300 Cluster 14
aaattcaggactaaaaatataattatatttaaacatttgaatattgaagttgccttcttcgtgagtttttttttttacaggtacaaactcctcattagtcatttacttaactattgaactcaaacttgacaaaaaaatcaaccaattttataaagacatcctcatatgataaacttataatgtagtcatttttaaagtaaatcactggtagaaattatcaataacaaaataaaaggtttcttaatattgaaagcactataagactatacaaaaaagaaaaaagaaaaaagagcacggcgccatccaaattaagctacgcaacccctcatcaagatgtagttaaatttaatttgagtttgtgtagtatccgagttttcttggacgaaacgctcttctaagcgaggattatatttcgcaaagaatatatatacgtgcatggtcatcctaaaaaatttatactcctattattctgagttgtattaatatctatcttagttggaggacaatcctttatgttccatccaacactttggctgtcaaagtgacccttgtcagactttacagccagaatcagtttgagaaaatcatgcaagtaagcacaaaaatatcagacttattgggcaagacggagcaaaatatatggattttatttcatagttgatgaattttgaagatgaaacagaataaagaaaaaagagtgtactaaaaaacgatttgttgatctgctcataagtacttaatcgccacttaagtgtctaaagttgctgtttgccaaaggagtaagttttattttatcctgttggtaaatagaaaattattctaaatatgcaatttgttaatttatacatagtttaagtattgattttttaatcaattaaattatgataaaatagttaacatggtgtgatataattaacaaataatcttatcctttaaaaatataattaagatttcaatctttgatatacacatatgaaaaaaatatttatttaaaaatatcaatttcttaaaaggatttatgtatctcgagagattagtttcaactctcgaatgagaaatattcccgttcacccaagttatgataaaataaaagtacaact

SEQ ID NO: 3564 - DNA, 1173 bp, Glycine max
  Soy_ogl_4136 Gm12:37825501..37826673 Cluster 14
taataaaccggaaagtcttgcactaaaaaaattaaacatgaaaatctttaattttatgattttttttttcaaaaaactttaaatcattatctatcctaaacagtgcatgaaagaaagaagtgagacaaaacaagtttcacaagccaacgaacatagtttaattagcacgtgaaacatgcagctagcagggccaggtgtcaacagctctcataagctccaatgctttataaacgtggaaactattcatatacactattttagcttgctttttataatttcacgttaaaaatctgattttaaatttaaaattaattataaaatcaatttttaaaaattaatttaatcaatatatattcatctaaacactattaagttataatattttattttgaaagcataggatagcgatgtacagtagaatgctgatcacatgcatttccgtggtgacaatgctggaatagccgtaggcatgcatgcagtaacaagtggtcaaacactttgaacgacaaatagatacgtagacggaactttggtgtattgcacataaacctttcccattcactgttctgttcaaccctagctatctccatcctttctagctctcaatttctccctcacttctcaaatatggaatgagacagaaaagacaaccccacccaaaaagaaaaagtctcatgttgagaaattgaaaggataatgtagacaaatttgtgttttataaaagcttaaggaggacgcttttcactctttcttcaaattatttataaaagactgaaagtatttataattttgtaagaaagaaaaaactaattctaactgttaatgagcttcatagttcacaccaccaaagcttttaaaacttcattggtcattaaattgattcgttaacaattacaattagaaactaattaaatcaatataattaaaataaatatcgactaatataatattatactattatatctataatttgaataaggttttttaattaaaaaaaaatcaataattttttaaaggaaccaattcgaaccaattttgattggtttgcttaattttaaactagtttaaccaattttataccgatttttttgttagaccaatattgaggttgttgaggtaattcaaaccggcttggtgatgatcaatttaactggccagtttgatgcaactggc

SEQ ID NO: 3565 - DNA, 1100 bp, Glycine max
  Soy_ogl_4519 Gm13:37437901..37439000 Cluster 14
gcaaaaatagcattgatcagttttaaaatataggaatgagaaccctacagcttctttgacacattgcaccaccctgctcgattttcctgcagtctccgcagtagtcaactttacttcatcgaacagttctacaattctatgcaactttttgagtgaagtttccttggttgttattgaatttgttaaatatatctattagaacccacccacacatatgagctatatgagattttaatgggaatattaagaatccggatatgtatataatatgattaatggatcatagatttcttggtaacaaaaatattgtgggcaaagttcgatctacatacctctgatgaaattaaatatgatatcctctttgtttaagcaagtgaaatagtaaggcaagacaatgaagggaaccttcttctttgatggcattgtcatttgtaaatatattatggatttgttctaattcttcatcaatttcatgttgaaaatgatatatacccaaacgttgcaatgagccaacgaaatttagattttgtaagatactactgcttgaagatagaaacatcttcttcacttcctctttatgcatttgaacctgttgcttcatattgtcattgatttcctgcaaatagttggaaggaataaaatgtttgcaatgtagatatgattgaaaaaagaattgaagaatgcagatgtaattgaaaatttttaatgtagtaaaaaaaacatttaggaggattttctatatttcttgaaaattttgcaagatcttgattaatcacaagtagactctaatgattaaaaatttatttgaccatgcattcacatttaaaaaaatgtttttaaagcctgaatatgtttatgattaattttaagaactttgatagtcaagtatttgattctccactcaattaagtagttgactatcagtaaaactagtatatatatacttctttgttcatagaaacgcaaaaaacgtttaaatcaagttatcgattatcatcaagatatatttactacatttgactatcaaagatatcttgaggttttcgtataccagaatataaactatgaccacaaaaaatattcagctagttttagtttgt

SEQ ID NO: 3566 - DNA, 1100 bp, Glycine max
  Soy_ogl_4793 Gm14:46888501..46889600 Cluster 14
tttggtgtaacacattgagaaaaaaatgtcaaaaaattggtgaagataatttggacatatataaaaaaaattcacagaggtgttggtcaaaagaatagattgcataatttttattgttataaaaagtaggagagatacaaagagatcggaggtaggaatgaagagaaatataattatttttgaaactttaatttttaatcatattcattgatatcgtgtaattcatgtaagtaatatcatctgatcgacaagattttgttgaatcttataattatattttaattttttacatgaatattctattcccagggataattaaacttattagttatgtaagttattttaatgaatcttatcctctagctatatatatacatctttaatgaattgggttttctgttctactgtgaaaaaaaaaggtttctatacatcaaataataaaagcactaaaatcaaatgttgaatatatggtcggatccatatgacaactgcacgatgacccagcattctgtaaaattcatacatttctggcaggaaaatatgttagattatcattaatgttctgttgcttacctgttattattttaccaactaaggatatgatctggggcctgtctgcaatacaaaccataacgtggtgccaaacatattttagtgttcaggagttctgaccctgattctgtagtatcgtttatttaattgcattagcatgtgtgagcaataagaacaattaagttagtcaacattggaaatgcactctttttatgtgaaatttttatatatggttaggggattttttttttctcttcaccttctggttcgtaagagaaaaagaataaataaaacttaattaataattgttttcatcaacaatgatcaggaaatgagaaaagaaaaatagtaaatatagaagttttatatataatttaatgattgttgacaagattacttatgtaatatttctcgacctatttatcatttgtaaaaaagatacatttcggcgggtattacttgagatccgtctttgaaccacgatattctaaaacggttgaataattgatgtaaaaagatgtgcgtgtctcaacgatatcgattacaat

SEQ ID NO: 3567 - DNA, 1138 bp, Glycine max
  Soy_ogl_1437 Gm04:46500563..46501700 Cluster 14
ggggaagcaaggttggtccattatgactaactctcattctctagctacaaggctactcaagtctcgatatttccctagttgtgatttaattttatgcaggcggagttggggaatgaccctagctatatatatatacgtggagaagcttatagtctgcaaagatccttgtcaaagagagaaggagtgcacagccaagtattatgatgattgatcttattaaaaaccacgaggagggacaatatatggaagataaatatcaatgaagctttatttgatgaagaggattcccatgaaattcttagaattcctctagttgatagcacacaagggataaactgacattgaaggagtcaaatgttgacttgtgttggagtacgtgatgatctaattttgaactaagctcgccaattctacccacaatcagagaggaggaggcattggctcttctctttattttagaataccttagaaataaaggtttccatgataccatatatagtggagatagacagccaggataattctaagtttgggtaacattaattattatcaaatgtggtagctaggcttcttctggatttaacaaatgttaatggttggtttgttaaaagacgagccaataaaattgctcataagtcaacttattctcatggtagtccctatttgtttgaagttttgccaaattgtattgctacctatattaatagtgaaataatataaaccagttttatacataaaaatatattaataaggcatttaaaatgaaaaaagtgccgatccatgattgctcatcttgtttttttttatatatataaaaaaaacaagtaaaaacaatactcatcttgcttgttacatcatatcaaatactaattattagatattttacacggatttgtttattgagtaatacgatatggtgtcctagctagtaaagtgttttaaatgtctatttggtttagaagatgaaagtaggaaaaaaaattgaattaaagtaataggtaaaacacgtaggtcttaaaaaagaaacataaaatttgtcttaagtattatttttctccactctaccaaacacacctaaaaaaagatattcgttgacattcgcatgattcatttcaatgcacaatagaatttgacgatg

SEQ ID NO: 3568 - DNA, 1202 bp, Glycine max
  Soy_ogl_3760 Gm11:5952899..5954100 Cluster 14
ttttgtatttaatgagattttttattattataaattgatcattttgatacgtgtgagagaacaaagggatcttattctaatgggccaaccttttgggttagattacaatgaatataaaagataataaattaatcctctattattacaaaaaaagtttaattacaattttaatctttaaattaatattataattgtaaaattttgatttcttgagtttcaattgctcaaattaagttcttctagaattataatagtataattttgatcatttcatcatttttttcaatgaatatttaataaattttatttatgtgataacaaacgggttagttaatacgtatgttaatgtaaattaattatatttttagtcatttacaattgcaatatcagagatactaattataattaattgtcatatcaacgtaattagaacttgatagactacactaaaattagacaattgtaatatttgaaataaaaaaagtgaaactaagtatataaaatataacataattatatatatattcttcaaatatcgtatgatctgatattatattgtatatgctaaataataaaaataaaagatagcaaactaaccttctctgttattatgaaataatgatacaataattataaatgatacaaaatcaattttaataataataaaaaatgggcagaatctcaatgaatataaactgcatgcatgcttgatctactcaaatcctttcttctcagtattagagaattcattcttccctaccacactttctgaggtgcatcagcacaccatacgtatgtaatttgttgctttcaaatccattttttgttatgacaataatccaatatttgtttattaactgcaccagctttaattttgtgcaaaataacaacagagctttaatagagaattctttgtaagtatatgtatatttacttactaaattagagtgtgatgattctagagaatggaggcgagagtggagataaaggtgcgaatgcaatgcgaatgcacagggtgcgatagaaaggtggagaaaatgaagaaatcagtgcaaggcatggagggtgtggcgcaggtgcaagtggatcgagaggagcaaggcaactgcaagctcactgtcattggccgcgtcgatccaaaccatgttttgaaggctctgagacgcctcacgcacaagaaggttgaactgttgccagtgccc

SEQ ID NO: 3569 - DNA, 1000 bp, Glycine max
  Soy_ogl_1153 Gm04:923401..924400 Cluster 14
attgaagatgctctaacatgcttctagcttattaattattatattcaaggcccatgtgcttagttattttcagataaaaagataagaataaaataaataactataactaggaaaaagtgagaaataaaaaaaaaacaagaataagtgttgacacgaagttgtaaattatttttagttattttatttctcagtttttcctagttatagttttttgttttattcttatattttaatttctcacttttcccccttagcagtaaatcagccatgtagttattgtgcttgccgtgtctttggtgggcaaaggattgttaagaaatagatatcttaggttgcaagactataaagcaaaaaatttagaataattgtaatcttcttccgatctcctctggccgaagccaaaacaaagtaccgtcgtaccacagtctgtctttatcacaaaaactaacaataccttcccgtgagacaaaagtcaaaacaaggcacgcgctgtaaactgtgctcttttatttacaaaacataattcaatttcaaagctctaccatcaaacttggaagggaagacttagctacagcccctatgactatcagatccgcaactagcaagctagtacctacctttcattcacaaaaccaatcagatcaaattcaaatatacaattaacttttactgtttattttagagaaaataaataaaataacaagtttttttctcttcctgatcgattcacatgtctaaaaaaacattttctccataaaatggtataaaatatttgttgcatttaatttcttttttgttttactttcttaaaaaattaatgtttttttttttttttataggagtgtagagactgtacggccacttgcagacttgctacgtaaacaagcctctttctctttcgcatttgtgaatgttatttattttcagttttgaacatggaagatacaacgacagatcaactgcaaaaacttgatttgactttttaatggcgttgacactg

SEQ ID NO: 3570 - DNA, 1277 bp, Glycine max
  Soy_ogl_1658 Gm05:32217101..32218377 Cluster 14
aacagaataaccttataactaaatttaaatctttatggtccatgtatatgtatttaagcttgactctatactttagcgattaagatagactctttgtgtgaaaagatatttaagattgaatatatatgattcatgttattttaaattgatccctagcagttcatgcacaaactagatcttccttgagttgactgttgtgagaaatggactggaggtcctctttataacggttataaaaaaaatagtacaaagagaactgggcagggcactacttgtccatttcctcaacgtcaatgcccacgtacttgggtcagatactacactcatcacttgaaagagaaaaaaaagttgaaggaatagcatagatgacatgaagagcatctttgtgtatgggtttcatgcggacttttgtaacaaaatgacgtttgcaaaactatttacaccttttcttttgcgttaaaccaaacatgcacggtgcagacgtgcactaacgaggattgatttattatggttcaaacaattttgacaccaaattcgaattattagaataatacttgattagaagattttaatgaaaatctaaatagtggaattcctccaaaaattttaagtcactttaaattggactcttttaaattaagtctttcaggtcaaattttagtcaccaataaattaattaaaaaactatgcctatgagataatttaatatttctcagagactaactcctcctctatataaaaaaaaaattcctgctaagattttgatagtattaatttcaaaatttgttaaaacatttataacccaattattgctggtgataagttaatatttaaacttataatgtcttaacaaaaactaataaactatcgattaatatttatcaataaaaagaacccttcaaattacatatttttcttattcatgaaaatggccagaatgttcacgagctttagctcatgttcagagttgctttatggtgtgttggaaattagattttaaaagaaaaagaaggacagcatttttatgtttaataagcattccctaatttaatattttttcaacaaaaaaggatagattaacataacttaatatcttaatatttggtttatatatatatatataacttatataatttaaaaatgaaaattttacccaccccggcccacccttttcctttgaaactctactcccaaacataccatacacctcaaaaaaagggaatttaatatatttgtccctttaactttagtcttccattcacttgttcacatcatgt

SEQ ID NO: 3571 - DNA, 1019 bp, Glycine max
  Soy_ogl_3931 Gm11:36867250..36868268 Cluster 14
atgaaaaaaacaaataatgaaaataaccgtatgtagagcgaaaaataacagctattcaaagttactcttaccgggcaatgcattgacaaatagaatagagtgaatgaaagatgagtaatagatgcatatatggtggatgaaacaacagaaggaaaacgtcaaaaaacaatgaataattaatgacagtagccgattgtggcgtaactaattgcatgcatgtgaagctgttccccgttctacccaccgttttataattaaactgcaagacataatggatggacatggacatatatatgtggattattacatcaaatataagaaccacctaaaatttggaaaatgaaaactgaaaaatatggggcgcacgtgcgaggactgacatatcacataaccaatattcgtgggaagaaggaaagcaggcagacatgggaaagtcttaagatgagaagacacgtgtggataaagataagatctcgtgtctcatggctgaccactgacaatctttgtgttcacttgtgacatcattgtctcatggaactgacatgtgcttgtcagactgctcacaatggcaattgggaagggaattaggaaaagaaaatttatagatggacaccccatgtcaatggacacacagatagtgaaataaagataaaaatgaaaaaaatataagttttataactaacataatttgatataaatagagagataaatcaaaaggaaatgtttgtaaggtatataaaaaatatgagtgttcatgaattatcatttctagaaaaaaacatagatatatgaatatgttataataatatttattgtaccatgaatgatcattgactactcgaatgtgattcaattaattttatttcatcctgattgcaaaatttgtatcaaaccatttgaatgtgaaaaaatttatatattttagtatccaaatcaaaatctatattttttaattccttaaattctttaaatattttaagtccaataacaaagataactttcctactattcattaattc

SEQ ID NO: 3572 - DNA, 1123 bp, Glycine max
  Soy_ogl_4403 Gm13:32037301..32038423 Cluster 14
aaagaaaagatattttagattagaatgttttttgtctttattttttaataaataaatacaattttttattattttcaattcattttctttttttatgaactaagtatttctccatcgaaagtcatgattagatagataatgttatctatcaattatgtctaatcattttctatattcaaatatttatataaataagaaacaatgaatgcatgaaaataaagtaaaaaaatattttttattatttatgaaaacagaaataaataataacaacaaattctaaaaccaaacaggtttaaatttctaatcattccatgctatagtgagttacccgttttgatacctagcttgaccttatttcaataccaaggagattagtattagatgagattaaacaataaacaagtaacatgataattttaaaataatgcatatcaaatcttaaaccaattaaattcgcgttccatcaatgaattcagctaaattgattaagtatgtgtgtgagttataaaagaactcgttttaactataattaaattataacaataatacttattactacggagtaataattgatcatgaacttaatgtgccctctggttggtgcggatatcttctgaagctagatcgtggggagttgaaggtatatgacttagtgctgggcatgggatcgtagggtatggtgggaggggatatgatatgggtggttattttatatttcgcaggtctctaaatatatattaattaactaaccatttgtaggattctttctggggtctacattggtttcattttgttttgtatttgtaagaaatgaggtacatcttgtatccgtcttaatgatgtttttcatttgctgataaataaataaaaaaactaagaaggaggacaagacaagttttcctaaccccaatggaatgggacaagatgcagataagataatggtgggttcggggaggtaaggaggaggacaaaacccgtcccttcttcactctattctcacatccaatataatcttaacttacaaatcatatatacagggagatctattttattatgtgttcatttaacagtacttatgaattatcatgaacaaaacacgtaagcaattatattgaacctggtg

SEQ ID NO: 3573 - DNA, 1041 bp, Glycine max
  Soy_ogl_2898 Gm08:45039601..45040641 Cluster 14
ccttttacgcccaacacccttgttatcacccactaaaacccctatcattttttaacacatcctcgttaagttatgtttcctaagcaagtcatagggtctatgaaccaagaacaattggataatcaatccctccctttatccacaacaatagctctttggattttattttgattataaaatattgtgtttctatgcatgttatttatattatttggatttaaacgttattctcacttgcttttttttttatcatatcaattaaataattaagttctctatctttttcatgtttttgttctaataagaaataatgtaatagacaccctccaccaccggacagcgaaacaaaacaaagaaaaaaaaaatatacagaattacatcaatactggaagtagtgaccttcattttccctcaactaggaataaaagatgcagaatttatgtaatagacaccctccacccaccccggcaaacaaaacaaagaaaaaaaatatatacagaattctggaagaggtgaccttcattttccctcaactggaactaaaagatgcagaatttcaacagaaggtccctatatatataggggtgcaaggatagttgttattttctattattttttgaatgtgaactttgacattgtaccgaaattcttagactttttttttagacatagttggatctaaaatagaagaacacggctagagttaggttatatagctagagtgagttttgcaaaagtcataaccaatgcaacactacttttttatcttttatttttagagtaacagtagttccctttccttgaaacataacataggtatggacaacttgttggagtattttgtattgtattaaaaaatataaaagctttatagattaaaaaaaacataagaaaataaataaaatacataaaaatattatctaacatcttgtaggacaaatatgtcatatcatgctttcaaacatgaaagaaacaaagttattctctaagtaatagtatcatatcttttgtatatccttttaattattttaaatcatatat

SEQ ID NO: 3574 - DNA, 1000 bp, Glycine max
  Soy_ogl_423 Gm02:6761501..6762500 Cluster 14
ttacaaaatggtttcatgctttgaattttttctttcaatgaactttggcaaaaaggcaaagcgtctcctttggactgataaacctcgtgctcagcttcgtgagcctcagcctcgtaagctgaatatcccttttcctactttcatgtcatggattttgtcgtagttgctttttaatgtctcagccatttcccattcataagaattatttgctaaaatccttgaatatctttttatcatgcatgctcaaataagaaaaatagcgtccaaacaaaactggaaaagtagaaattaattgttcttataacgataattaagatcataatccatggatcctttttgagatatttagggtaagtgatcagtatctgagatttccaaaataatatggtgagatctacaaataagtgaaataacagttcaaaacaccatcaatacatgtaatcgagtgtattaactcttcattttaaattgaaaaactcaattatatgacgtgaaaattaactaaaatcatagacacatggtgatcttaaattacatgtaataatttctccattgatacatatgtatttttatttataaggatcgaatttaaatataaattttttacaatgattcactcaaattcaactataactaaactaaattccgttaatccattgatacataattacaaaaagaagaattccaaagcctttaattataagtataagccaacattctgaattctgaatttaattacaaattgaaatatgtatttgttcctttgaagctgtttcaattaaagtacgagacttaccatgggatcggtcggggcacaatttttaaaggaaatgatatgcagcgtgagttcaaaccataatgatatagtttatgtgatcgtttaggtgtcatatagtaacaaaaatttggtttcgttttctttggttaagttttagtttctatgtagcagaaaatttaactcatcgatattcaagtgaagttgtattttgttttatgtttt

SEQ ID NO: 3575 - DNA, 1244 bp, Glycine max
  Soy_ogl_1918 Gm06:13391997..13393240 Cluster 14
ttccatttccatcattccaatattaggttgagcttgactcaagacttaatccgaaacactattattttaatttttctccttcacgaggtggacaagaaactttatttttggagcaatatattatagaccacatataaaatgaatttatatatataaaaaaagtaccccttatgaggattaaggaccagtaatgggctaattatagtcaaataccatgattgcaacggaggtaaaagtaaaagcacttatacttatttttaatttatatacttcacccatatccttatccagagtggaagctacttaagaagttattatgcagcaaatagacttgtatgcacccactcttgagatgacaagttcaagaagcctaccagctagcgcagcagaaaataccaacaccctatgggcgttatggttgacggtatattatattcgtgtctctccttttcgtcgaacggaccaaacttcttaaaaaacgcattaacaacaatcaagttccttgtatggattcctaatcccttgcatatatagtattttttgtttcaaccagcataatataattaagacttttgggtttttttgacccggagatgtaagtccttaataatctgattactttctttatttcctaaaaaaaactcagattggaaaggatcttgtctatttactcatcaccactgagcattcaaaaaaacaaaaacagcagtcaatattaaccaaaagcgatcccataaaattaatattgagaactagaaccaatatatatataatctcgcttcatgtgatacccaagatatactacatagaactcgagccaacatctatagcataggatcaagttaaccaaatatgaatttacttttttttatcctgtaacatatatatgcttcttaaaatcagagggatgcaccagtcattataagtatttttatttcttgggctagtagtatacatatgatctctgactaggattttctactacgtttcaggaaaaaaaaagtatgcactatgtttttatttattattattattttgttagttttttatggacaagtgttttattatcatttagttaaaactccatatctttacaattgattatatgtagtattggacaactaatttcccgcctaaaatagggcaaacttttttatttactaattagtgaaattacaaaaatatagaatctggcattaatttgcatttaaatatttgtaaaataattaatttaaaatagtgct

SEQ ID NO: 3576 - DNA, 1000 bp, Glycine max
  Soy_ogl_5517 Gm17:5076601..5077600 Cluster 14
aatctataaaaacaaaaggtagattattattggggggagaagaataacgaatggaaatgattgatggtaatgaagattctctttcctcaatagttttctatagagtctcattttacctttaaagttagtatgtgttgaagtttagagtgtgtaatgaatgagtgtttatctttctttctttattttcttttactcaccgcctcattctattagttgtgtaattcccatatgtgtatgttggatttatctgtatcctgagattggggagttatgttatcatagttctcaaaacttctttatatattttacacattattgatattgtttagtagtttatttagacggattggacttcatggattattggctaagtgtctacattggagaaatttagatcgcccagatcagagctgttaaatataattgagacgactgttaaagttagtgagaaatagattttataaggaaattgattttgaatgttttcaaacgatacgtaattatattatcattttataaggaaattaattttgaatgattattttttttatcggtcaatattattgttagtttatcaatggaaagaatttaaacccacaacatgtctctcttttctttttccttcaacccccaaacaaatcttaaaactataaatttatggctattggaaatgttttgactgagcttcatagctagatgtcaacccctatttcaccgttggtcctcatgaataaggtgtgacgcctaaagtctattcatttatgtgttttcacttcatctttgattaagtcaacccctttttttattatcatctttgatttattttgaaatatatgataaattaagtcgttgatattcaagaattgatacactatgctagttcatttcagagatcagtttgttttaaaggagcttttatttcctcttgacaatttcctttggtgctgaatatacgttgctttcaccttagcattgaaataaatggtatataatatttacc

SEQ ID NO: 3577 - DNA, 1300 bp, Glycine max
  Soy_ogl_1410 Gm04:45050701..45052000 Cluster 14
ttatgatttctgaaaatgcaattctattgattgacatacgcaacaaaaatgcatttccaattgtgtaagaggggctcaaactaattacattattgttctgttgtgtatttcatcaacatagtaatgttttcattgtgattgagtcttaacataaagaaaatgtattttcgatgattgaaatacacaaaaaatgcaatttagttgtgtgtttttgaaacccgtacaacaaaaatacgtattttgcatttataaaccgctgtgttttcatgaattacttgtttgcttttttgaaattaaaattattttttatcaacagaacatttaatgattcactaacaatcagtagaggtcgtaatgctttactgatgtgtgaacaatacagacatatgaaaatatagacacaaacttcatgcgtcccatgatgaatacgaaacataaaaaaatattattaaaacttaatttaaataaaatactcctaacacaattaaattaaatactaataaaatattttgataaaagctaattaaattactattaaaatattttaataaaacttgctaaaacaaacaattaataacatattgctatttttttaaaaaaaaataaccaaataattagtaatcacattattaaataaatacaggtaaagcaatattgatcattgtttttactttagcacgtgacaatgcttgtaatatttgactgacgattaaacaattgatgcactgatataaaacaacgatggtggtttgaagcagctcattgtttgtcttcatattcactattttcctaacaagatgaaaggattccttattgttatgtattacaatggtgatatgatatcaaactaaatatgccttgctatgtgatccttatatgacctaaaagaagagtcaagtctataggacctccaccaaatgacagtccaatgatctgcataagaaaaaagggaaccacaaaggtgcagtggaaataagatttagaaggtgaggagagaaagaggatgggaaatgagagagagagagagagagggggtaacaaggcgtgcaaggatgagtgtgagaagctccttaaatcaaaagaaattaaattaaatacttaaaagtgtaaatccacgattacaataatctaaaattttaaaaaatatgtgattgatgaagtgataatattaacatgagttaaaaattaaaatgacaagtaattaaattctatggacttatttaacatttaaggattagatatatattttaaatatttattcaatattttattagcttcaaccattaatattagagaaatg

SEQ ID NO: 3578 - DNA, 1556 bp, Glycine max
  Soy_ogl_2139 Gm07:2775001..2776556 Cluster 14
catttcatataaatttgcaatttcaaaatcaaatacatttttttttacaaattacaagttcatttttagtccattaaattaatgcatcatcgtccatttaataatcacacttataagtttttttcattaacaataaaagtaaattagttgttatatataactaatatgatgagattatcaaatatatgttacggtttggttaagttgcattgaagaagaatttaccagtagagaacattagtcagagcaaaaacaataaaatgattaatgaatgacaatgggccctaaaagatcaaacatgagagtctagattgacaaataaaatacaaaacctttctgagcccttgtatatttttgtagctcgaccaaaacaaaccaagaaagaaagaaagcaaaaaaacacaagtaaaccagacaaaagcatcctaagattaagcaaggaaaatcttaatagtgttgtttggatgcacttgttataaggaaacaatcattcggttttgaaaatttcccttaattaaaaagttgatgatatcataaatacttatttttttccaattaaatgaaacagcatgcattcggtgagattattttatgacaagtatgatgtcacagttttaggcagttgtgggtatgttttctagattaatgtttcgggtggtgagtgtctttgtgaatgtgatttacctgagatttggtagttgtaccatttaatgcaagtttgcaagatatacccctgctgagataacgatgcatgtggtttcctatgttgtacatgttttttttataggttgtcatttgtcaattggatggcttgaatttttttaattggataataattaatgaatggagaaaaatagatcattaatttatttattgtgcatctttgaaaatgtttttaaaaaatatagtttattaatgatctatttaaataaatcatcaaaactcgttagttattcattttttgtgttttggtgaaatattttaattaattgatgtgaataagattttcaaaattataattttaaaaatggtaattttaagtatttatcaagttgaagtttggtgttttcatgatttaagaacttaatttaaaaaatagataaaaataggtttcaattttttaaaatcttaatttattcaatatttattacgcgaatcattttcttgaaaacaaattattgcgaaaactcaattttgcctgtaattttccattctttttgaatttcttttaaaaaagctagaagttcactctctttgtttattgtattttcctgaattcttccctttttatatcaataatatataagaaaaaaattattgtttttagggaaaccaaaagggatggtacgtgcctctttaattttcacaaaagtgaacagataattaacagcattctagagaagtaaatatagaagcattgcctattttcataagaaaggaggaaaaaaattaatgtttggacacaagaaaaatccacaattggctatatacatatttattggtgaatgctggaaatcaaagaaatagacaagacaaccacatcaaaatcatccacc

SEQ ID NO: 3579 - DNA, 1049 bp, Glycine max
  Soy_ogl_2284 Gm07:8200365..8201413 Cluster 14
cttccataaaatataatctttccgcccttgaaaatgaaagaagagtaaatgtgattcgtcttcagataaggccaaaatattcaactttcattacgggttataatttattacacaagaatatggaataatattgttcataagattgagaagacaaagtgggaagaataaaattcaagaatcttttgcaaacgttaaaagtcatgtgcagtagctatatataacatctgacttctctattattcttttcttagttgtattgtaccgctccttcaaaatcatataattttaaaattaaatcataaaattaaatattaacgtacatgaacaataatgaaatatttaagaaaaggataatagagaagtcaatctcgactacatgcccacaacaaaaaaaaaataatcatatcagtccattattattgttattattgctaccaaaaaacataataatatctaggatgaaaccaacattaagttcagcgtgaagcagacactaaaatctatctttacactcaatcaacgcctgggtggtacatgcatgattactatcccgatatcaccaaccctcattgcagcgtgcgaacttgctgttgttcctttctccttgtaaaaactaaaaacagctagtaacttaatttacatttaaacaagttattcctttcaaaattattgtgaacaaatgtttttatttatgtcactagctatccagtgaattgtttttggtacatagctatgcaatcaattttttttaaaaaagctatccaatgaattaaagctctataagtgagtttaataataataataaaagctctataagtgtgggaattttttttgagggaagtgtgggtaattgttagctctactttttttagttatattttgttatataagtgtgggtaataaaaaataatattaattatatgttcttatatttaaatccaatatataatgtaacatttttcattatcgatttttaggcgactcaccctacgataattcacacgacttcttttcaggatcattgattatgttcacaaaccaacataaga

SEQ ID NO: 3580 - DNA, 1300 bp, Glycine max
  Soy_ogl_5519 Gm17:5150201..5151500 Cluster 14
atttaaaaatcttgaccgaatactttaagacttttctttttttagaaaaaaattattttaaaattctttgaaatcctaatccacctcccttagttaattattttaattggttggaattattttttatactctcatgaatgattaaagcatgtgcttaattgagttatttttttccaaagaatatatattattattaaaatctttattacaaaacccttgttacacccctcgtctcctcgttgtgtgtttgacgattaggattattgaatgaggagtaaaaattacctattaaaaaggagcattggagggaaaggaaaaaattaacgtaaaatgtaggaatgaaattgacaacaaatcaaattgcaaaaacattaattggacaagaaaaattttaaacatatcatgaaagaacaatgagagagtagtaaaataatgactagtaagagacatatattgatttttactcatgaagaagtatttgtatttcatggtaataatttttcctcccttctttctgttgaaactaaatattaatattaatagaatgtgagatgatgtcttctttagaaataaaatatacctgtaattaatttttgtgagataattttttcaatcttgtattatgagaaataataaaattgtatgtgaaacaaacaatcctaaatattattggattaaccaaacggtgttactaattttaagggccttttttcaccctccaatgtcaatctccccgtttttttaattatccacaaattattaattatataattcattcatcgttctacttgtcattttgtctccccttctacttaacatagatgatttaattattgggtacacaatgaacattccttgttgacgcaaataaactttacattaaatattttaattgttaaaaattattaaattagtcctttcttatagtataatagtttttattagatttaaacttaatatatcaaatattttatttttttcctgtttagtttttttttttgtcgattgacatagtagtggtttacgactacataattacaacattttttactgttactaaaatcaataatgtaacaaaataaacaaattaaaaaagtttaaataaaaatattaaagaactaaactgaaataaataaagtttaaaggctaaaatactaatatcgccttattttttccctaagtatttctctaaaaacacttttttcacattctccattaaattatgagccaattgcttaagcattacaaagttttcaagactaggccacccagctcctagtggaaaaagaagaacctgatt

SEQ ID NO: 3581 - DNA, 1800 bp, Glycine max
  Soy_ogl_6869 Gm20:39505601..39507400 Cluster 14
gtcacattgctttttaataaatcatgtcattagcaaagagagaggattgtccttacgtgtttggtttagttttgattacacgtaatactcacaatctaagattgataagtgctctcttcattgattaaagtgaaccttggaaatttttgcttcctctagtggttgtcacactcatttgatttgtttgattgcttttgacataagctagaacgggacaaaaactcaaggttcattcttctttcacaactccttttgagggagcagaatattgagttatacattttgttcaattagtaaagatgcactcaggtgagctttcatctttgagctatcataaggccgcataatgcatttaacggtattgaatctaccaagtgttagcccaaagtttacagatagaataatgatagccgaagtaggaaacatagatctttaaccattataagtcaacccacccattttggttgtgatgagttatatttggtggatttatatatatttttaatccttgaaaatatagatgtttagtttctataacataaattttatcattttttttgtaaatttagttttatataataatttctatcatcatttagtatgtataaatatggtgtggtaatgattatcttgaagtgatatatatcatgacatgcatgtattacttagtgataacatgacatgtatatacatatgttgcattaacattcactttgaaatgacatataatatgacatgtatagatacgtgttataagaaatatcattttcaaaacttttattgcaaaaactaaaataaaattcttacatttattcgaactaaccaacacatgaaacctatttgattaaatagacttccttggttccatgtagttcctcactacctacctacgtatccttccatttccattttttctgtaggtttgattcagttttcttcacttaaatttgtttctgtttcttttttcctgttttaaaaatgttgaccgaaagagttaaaaattttgaatcttaattaataacaataacgaattgtacaattgctcattttgtccattcaacacctactaggagattgtctggtgtatattacaaccacttaggttttttttttccaattatagttgccaaagtcaaatcagacttggatactaggaccattaatataaacctttaaacattttcttctttgtgagttcaagatagaatgttcttcaagtgttacaaattattattattacatttttttcacacattaaaaaaatattccattttttttctaacttttcctttgttaattagttattgttattacctaactatttcctttttctctacatgtttgagagttggcgctaacaaaaaaactcaacacacacagtttgataaaatctgctctaatttgaaattgccaaatgaatcatcgtttctaattgactcagttggcagtaattaaaaatcaagtttattaaatattgatcctccgtgtgttaagtagtgtttagagtgccaggtcgatcttgccaaagtgatgatcgaatcatgttactgtcggcatgcaagttccacttgtggtttcaaatttcattggaagtagctagaagtacttgtgattagggttacgcagtaagctaaactcacaagtttgattaaacgtgaagttatcgaaagggagaaagttgcaaaactcctccttatcgtttggctttttgatgtggattcatgatgttgaagtgtttaaatttgaacttcaaagtttttcagttcatgctattgtccttcttttcggttgcggatatat

SEQ ID NO: 3582 - DNA, 1100 bp, Glycine max
  Soy_ogl_5303 Gm16:4864801..4865900 Cluster 14
ttggctttttatatttgttttttaagaaaaaaaatccttttgtaaattgtaacacacaagttaaaaaaaacaaaaaacaaaataaaatttgatcgctttatgactattggtaattcagccgttgtgctgcacctccttccttattcaaccgtgttaggctcttcatttctaaattgggtatgccctttgctggattatatcctctatcccattcccatgacatgagcatgaaagaggtgatgaaagctaatttgtcaatatttcattttttgtgttatccttgaaactgtttaaatttcattcttttaatttttccacctaattaaataatacgaagaaaagaaaataatgtggtagcaatagataatttagaaagagttctatatattttaaaaaaaataaaaacttcataaaatattcctataaaaaggtggtactagattagatgttaaattagaaatatgactagattaacctagctagtaacaagtgatgcaatcaaacttaattcgttaaacatttaatgacccgaacttctcaactaccaagatcaatcaataatataaagggggagtggaccatttgattgttgtccatactattaattaaactcaataatccttttgttttaattaatcaatgaacgtagtctaactatttaataattatgggaagtaggcaaatagcagtatcaaataatactagtaacgtattaagttgattttttttcttatttgatttttaatagctaagatttataatctctcaaactcaaatcctgaaagtagcaaaatatttttctgtcttcattttcttttgtcaaagtgcccacaacactcttacactttagttgacgtgtgatttatctcaaacagttaaaaagtcaacaaaatttataatatgtgctgaaaaacaaaaccccaccgtctgtcaatcagttaacatttgctttgttaatgttgaattaaaaatcgatcaatatcaataaaatggactgaaccaaaaatttgatgaatgggtggacaagatagtttagggaggctattcgcttcatcgggcttgtggaataattttaaatcttcatgtaacctttttttaaa

SEQ ID NO: 3583 - DNA, 1200 bp, Glycine max
  Soy_ogl_3353 Gm10:3768201..3769400 Cluster 14
aataaaacacaaaaaatttcctaatacattttaaaaaatcaagaattaatctcatcatcctttcaaaagacaaaatgtcatggatcccccccttttaatggggctgaatttaaatcatacaattacttttcaaaagcttatttacaaagtgcaataaaaagcgaagctactttgagtacagtgtgttgggacatttttcagaggagaattgattggccgcaaagatcgttgggatatgattggcatggaatgggaagttcgcctgaattaataatgtgaactgagaataatagtgctttcctttccctccatttgtttcttttggtaatcaatgattcaacccttgaaatttattatcaagagtaaaataaacgattgtatagttaaatagaaataacaattaaattttaccataataaaaaaacaaataaattttaaataactatatattttaccatacatttcttctaaaaaaacccaagttcagagatatcattctgcacttttttttaaaataccttcacatgaaatatcgagtagtgatttaggcttgccatcactgtttcacaagcgtggctatcaaaagttaatccctaagaactcgttcatagaatgaaaagaaatggaaacaaataaattaagataaatttttttaattaaagtaaaatataaaaaatatgagttccatgttattttactattcatttctctaattttttatttttttctctacaaataaacacagcctaacattatcgtgcttggaatttcaaaataaaagtgcatcttaaataaccgtctaataatatttattcctaacgaaaagtatttagtcatcacattacctacatgagtgccgtgaatgagagaaaactatttatttacactatgggagtgccacaattttctttttttaaaagagtgacctccaagcaaaattattgagaagagggacccaaaacctgtaagagtatatactcttattcttccgtttttatttttaagatttaaatttgaaatgataattgttgtttttttataagatttaatatataatatttcttgtattaattatttttagactaagaatattcttattaaaaagaaaaaaattattgacaaatcattaaaagagagaagtattaaaaataatgataatattgaaaaaaaattataaatttaagacaaatttattattat

SEQ ID NO: 3584 - DNA, 1440 bp, Glycine max
  Soy_ogl_107 Gm01:4396101..4397540 Cluster 14
ttggctaacatgtcaaattgctatttgaaatcttctataaagaaaaattctcataataaatctgctatagacattcttcatccttcctcccaaagttacaaactcagcccttattatcataaaatgaagtgcatcaagctgccttcactattttgtgctgcatttgttttcagcttttttaaatgtctaatcatctcacccagcaaggttgcctgtccaaccgagttcacaagtatacaaagaaaaactcatatttataacctatgaatgaatacttcaacagtgagtttgtaatgacatgagtttcactattgaaagcatgaggaaaacagagttggatagttaatgcctagtaaaaagtcatgcaaaaagagtgttatgtctatgctttattttatatcaatgatagatgttcaattatattgtcctcatgaccctagtaatccacgacatttgcacaattaattgcaaactgaataatatctgcactggtacgtgctccgattcatgttttgaatcgattgcaattttcagccaaggctcagacaccgatatatcaagcatgaagatcatgggtaatttgcttcatcttcaccaacaaattcacgaaaaaagtatccgtaaggatagaacccaaaattagcatagtcgtcttcatagcgacgcataaaagggtatgcagttaaattgcaaattattatgtgttctacttggttcatcagacagcaaacaaaataaagagttattcagtaccttgggtcattgtctaccacaatgtgcatcaaacgtagcctacgtttttttgacagcagtcttgaactttatattagttaataataaaatctaattaaatttaacaaacttagttacgtttagtaaagaattaaatcgttcgcattgatcatatttattagatcattttgataaatgtaagttagtaatatattttaaaatcaaaagattattgtttttttaatttgttactttaaaatatatttcattaacaacagtatttaaaaataataattttataaatatgtattaaattaaaatgattcataacattttatttaatagttatggacagacattaaaataaataaaaatgaacgattagtctataaaaaaaattcaaaaaaagtgacaaagttatccaccgtatatttaatgtaattgcattgtttatacttgaaacctaaattagtagttatgctaaaataattccacacactaattgacctacatctttaaatggttgttgatttcttgtgtaacattgtttgtttatcctcattggtgagtattgagtagcttttgtttcttatatttaaaagtaaggtaaaataattttatattatcatttaatttaaaaaatgataaatttattaatttttataataatttttttaaaagacagtgatactaataattatttttgat

SEQ ID NO: 3585 - DNA, 1349 bp, Glycine max
  Soy_ogl_1709 Gm05:37587216..37588564 Cluster 14
atgaagaaattaaattatcgattgaaaaaaaaaacatttacgaaggaaaagaaagaaattcattcctttttcttaacaaaaaaaggatttctatttttctataattttatttacagaacaatttttctataattaaatttaggtagattcactatttttatttttaacccaccgtgatttgtttcaagttctgatagaagtgactgtactttaagcactttttttcttatagagagtcagatattcaaattttgaagtcaagcagttgcgaaacgattttacttaattattaccttttgacttgactgtcgtctcatttcaactttttttaatttaaatatttgtataccaatatttattcactcattaatttattattttgtatagattagaattattttcaagtctcggtaaaattattatagatcacaaatttttcttcaattatttaacataattgtacgctaaaactcgaatttaaaatcacttagctggaagagtttcatattaattgattcaaatactcaataacattttgtcttaattataaaaattaattttattttttttaatttctaaaaaataatttatctctttcatcgtctctttccttctaattacctcttaaaactgtaatctgttgcacccaaaaccgtattatagtggtaaagttgctcgcaccaattcgattaggaaacttgttctaatgttccaatggttgattgattgattctaagtttagatcgatttacgctgactgattctttcttcaatacacatttcttttaaccgatcaatgtatgcttactctaatctaatctatgtgatttcaagatttaagctattctttttgtttcagtgcattcttttacgtattattaattgattctgtttcatgcattcgattaacagattaataaaaaatagttgaaaatttagtttggtggtggttgccttatgtgatactatgtgtgttgcgttaatctcaaatgtaaaggttacaacttcctttgtggattaattttgcagacttgcagagtctgctatgatcttctgtagatgaaatggaaataaaatgcatactatgaattgcaagaaaataacttgcagatagagagagagggagagggaggtttcaagaaattaaggtgaagtgcaaaacgcgatctagtcttatatgtggtgatggtcaaacttgagctcctataaaagcacattgagtgtttagaggtgaagtttgttttaaaatctatattatttcaagttttgagcaactcatgatcacctctgcacacactcagatatattcataatctatatatgtatggcttctctttgatttgcagaca

SEQ ID NO: 3586 - DNA, 1328 bp, Glycine max
  Soy_ogl_1710 Gm05:37626473..37627800 Cluster 14
taactgaggccagttttacttagttacatctaatcaattaatccctgactatcaaagtatttttgaggagagttgttcaataagaaagattttaggaaccgaattctttgaccacttatatcatcctagttggctacttttgttaatttaattaaagcttacaaatataatccagaaaaggggagaacgttagaaagttactaattaacgggatcctagttttcttttaaaaatacaaaataaaaaagtagagctctgtattcctctccttcacccctatactgttaatatataacataggaatctattccacttcccacgtttgatttgtcatctgtatcttccctattacacatttgatttgtcatctgtatcttccctattacacataaaggctaatcgcaggaataaaacaccacatcgtattcctttttcttcttttcctgcttttgaaaggaacaaaagtaatttctcaccttgtttttgttgaattgagttgtgcaataatttgctttgatttgtattcctgatttatgcggagatatagtaggtaaattttaaggtcaaataatttgagaactaatttttaaataagttgttataatttgaaaattaataattaaattattaaatctataaaatatttataattagatatctagagtaagactccattaataaactgtgaaataaatattcttaattttgattacgaatgagagtatataatttattttaaaaaaaattatgtagtttaataactaggttgttaagtgtagtgtatttgtagaataagaaagattttatgcaaactttacaaattaaagttttatatacataaaataaagaaatgataatttattcttttttttttgtaactaagttttttttttatatcatcatcatcaaggaatgaagacgtccgaagtttttttttatatcatcatcatcaaggaatgaagacgtccgaaaatgcattcttgatttgttcaccatctttgacttcattgaaaatggtctatctaatcattcttttagattttacttgaaatttttttagtaagtatatttatatattcaatttttcttctatcttattctgactcttttatttttattttttctaaccatttctcaacatatcatttgttatacaagttatctctctttctttttcttctctctgtaattttttttttctttcagtcgtaccccaaaaatgaggtgtacgattgagattttccgaaactctacaaaagatatcaaattagtgcgacttattcaaggccaaaagcaagcgagaacaaggttagcagcacctaagtata

SEQ ID NO: 3587 - DNA, 1189 bp, Glycine max
  Soy_ogl_3304 Gm10:1499801..1500989 Cluster 14
ctctcaatgaaaagggtgtgttagagattatatattagttaatgatataactaatattatataaattatttgtcaaacttaaactttaagttagtaaacaccataaaatatgcttctaattctagcatactagataaacttgttttcaaagtttcatatgacaaattttgtctctcaatttttctttctctcaggaatttgcccccaaatttttgcaacattgtgaattttgcttttacgtaaaaaaaattgccataatcaagacattttgtgatgatttttcttttaaacaaccacaattaattaagacaattttgtggtatgttgtcattaattgtgacattttttctacttggggaaagaattgtgatgttttataaattgagagcaaattttgaaaaaaaaatagggcaaaattcatgacattgtaaaactatagagacaaaagcgtgcaattaaatctattgttttctaaaaactggtttcagagatcatttttgaaactattttttttttaaaacagaattcaagcatgactttaatttttatcacagacgctataaatatatattttatacattttattttgtctaccatcttaataataaataagtctttatagaaacagacaacacaaacataatcaagaatattgctataaattttgttttcaagttaaatttttttataatttaaataccttttaactttaaaaataaatttaatatccactctaaacctttaaacacatacttagtatcacattaatcttttagttattagcaaaattaatataaataatatattttaaattttattaaattgatttttccggtaaacaagactaatagcaccaattgtaattaatatttatatcatagaaaaaaaataatgtaaagtatatgtttaatctgacttaataatagaattaaaatgcatcaaacaaagagcatagatgatcatatactgaaaaaacaaagaagagaacttggaaggatcaaagaattggaattttcttattatagataaagggattacccactttgatgatatttctattttgaaagaaatcaatcatgttaacttagggatatttttgtactgaaaaaaatatagataatggaacgggcctccaaccaaataacaagacgctggtcaagaagctaacgaacaaaactggtaaaattat

SEQ ID NO: 3588 - DNA, 1000 bp, Glycine max
  Soy_ogl_4920 Gm15:8565801..8566800 Cluster 14
atgtgttaagaagagagataaaaagaaatgaaaaatattggagaagtatttgaaatgatgaaatgtttttgtattattatggtacatattgattactttgtttaatttttgtgtgtgtaaagcattgtattttttatggtatagcggttaactgagaagcagaatgaattggaggaaattctaataaatattttatgttccgatatatcgtttcactttctggtgttatgatttatgaattttcctttcaatagttacctatatttctaaaggaaggatcatatgcatattaacgttcatcaacgggggcagaaggggttggtcctcccataacatatataaccaaccaagatttaaatatcgagttagagaattattaacatttaatgttcaacagtagtgctgtaaaacatgattgtctgaaaataaaatatacatgtaaagagctaaacaaaaatcatattcacatatattaacattcttttctttttataggacaaaaaataataaagataaaaaggaaatcataaaaatatagttacctagctacaaagactaattacctaggctttggttggagagatatggagaggaacggagaaggatgatttttatgaaattttattatttggtttaattttgaggagtggaatagaggaaaagcaaaatcaccccttatttaatttttactcctctcaaatattgaaggatttggaagagagaattcaaaatattttaagtgtattaattaaaatatttctgcttagtattgaaatctaaaattataagtgggccataaaagtaagttaatttttaaaatttctttctttttcttgttaataaaacaacaaaaggactattatttttcctctccttctttacaattccatccccttctttaaatcaaatagtaacaccattttttattcttgaaaacattttattttaaaaataaaataaactaaaatatatttttaatccctataagactagctccttt

SEQ ID NO: 3589 - DNA, 1000 bp, Glycine max
  Soy_ogl_5228 Gm16:1322701..1323700 Cluster 14
caatttaaaataaaaaataaaaacaaatttaagaaaataggaaatagaaattatattttaggctaagaagaaatatgttaaactaaggatattttggtctatgagagagagattgtaccttttaatcaattaattattcctaacattataaatgtatgtgatttataaatgtgatttaacttgtatataacaatgattacatattgaaattctctacttaagaagattcacaagcttttgatgcatcttaaaaaaataaaatacacttacaataattcttgattaagtaattaaaacttgagtttgtaataaaaaaaattatatatgtggcaatctttaaagataattatacagatttttttttaagaaataactataccttgtcaaattcacgtatctttcatgattatattgtaatggagtaacccactatgtttgctacgaaagattgagaacggaaaaatagtggaaggaatgaaaaattagattggtctcttctttcctctgtttaaatcaatagaaaagggtggaatgaaaccctaaagtgtgaagatacacaagttttagcaattaatctaaatttgaaaggaaagatgaaggttgttttaaaatcaccaatttatccttatttctgtacacttctcttttgttagaaatatttatatcatttaatatatatttttttctttattctattttctatacaattaaactaaacaaaaggaacgttttaacttttatttgtttattttttccaatcaaataacctataaaatcatctcacttttttctttcttttctttcactttctaaatgtgcaatggaaagggttgaattttaatatagttaagatttggctaggaaaaggctgaattattttgttttcgtcatcaataagtattgctttttttaatcaacaaatacgatgttaaaagtcaaaactgtgtcgggcctaatggcttcttactgcacactgagccgaaacccgaaccaaatttat

SEQ ID NO: 3590 - DNA, 1218 bp, Glycine max
  Soy_ogl_5876 Gm18:1897183..1898400 Cluster 14
ggatgatgacaatccatatcaactttacaaaaggacaatattggaattgtgtatcttatactggttgcgcaaaacaatacccgacagattaagaaggaaaagcccgaatgatgtgagtgtgtcatccatcacacagttaaccgggtgtactgggcttgggctctttttggaaactaaaatgggaatacacattttgtttgaacccaaataaagaagtcatttggattctcatagtaactatatgaactcaggttgttattaggtgagttgaatttcgagagtttatttgaattaaatcaacataggttttaaagactcaaaaagtgcttacaagatactttagtatctaattctttttaaaataactggaaacagttatatatatgaattcacttttcatgttttttagtgtaaatttttttaattattaattaattacaaaacatcttaaacaataccaaagctaacttaatttttgtaaagaggacaaatgtaaagagtaaataaaatatattttcaaaattgatatattaaatttaaccaataataaaacggttcacattgcctttcacttatacaaaatgtaaagtttaaaaggaaagaaaaagttacgaacgatagtcgttagaaaaatttgagttcaacatgcctcaaggagtcacctttaattattaatattgactttgtactaaagagattagtaatatccttttcaatgttaaaaactaagctatttgcaagaaattaatcgttcatttcatttgtaggtttgtcatgacaatttttattgctgtaaaggctctctttttagttgttgtaaatactagaagtttcaaaacaagataattcaatctatcaatgaagtcatacttttttaactttcttgattctactaatttgtggtacaaaaattagagagtgatgttatatcttggaaagttggatggtaaggtatattaaatgtgtaatatctcaattgtaatatcaaatgaaatgagatgagatagaatgatacatgatcatgccgtgtggattgatgtgagaaaattacaaatatattattgaagtgaaattctaattttaataagataatatacctgtgatattgcatttaagttttgcccaataaaatacatcaatcttattacttccactgtttccaaactatagttgtataaggggtatgcaagaaattattaattgatatacttttagact

SEQ ID NO: 3591 - DNA, 1200 bp, Glycine max
  Soy_ogl_6546 Gm19:43994101..43995300 Cluster 14
gcagctgttctcatcggaccaaaaaaaccatatttgccggatcataataagcaccatagtacttgtttggtaatttgtcaaaattgttgagtaaactttttgttgagaaaacttgtagaacaattaatttaaataaattttattttaaaataaataattggttttagtatttttagttcatcaggtattgtaattatatgatttaggtcttacagtttcttttcatttataattaaacttcttcatcccagtttcattcaatatataatgaacttgattaatatgagaaattaagcatgatatcataataagtaaatacattatactagctatatttatattgacttgaagaggtatttggattatattgacttatttataatgttgatgatacttgtagctaaattatttttttatgacagcaatgaaaaacaagagaagtgtcttttccttttaagtaataacataaacattggacgaaattagaataaaggaacttgtttggaaatgagagaaaatttgaggatctaatcagcgcaatctgaatctaaaagaacaaaataacataattgcgaagttttagaaactaaaaatgcaattaagtccagttttattgcaaatgttactcaaaattaattgtgtacagatgaatgtggtgtatttggaaatttatgtaagatttaatggtgtttggtttagcattacctaaatatgaacactgctacttgaaacatatagaagtaacttttgcatctttttcagctatatgatatgcaattattgatattgagtaaaagaaaacacaccatagcatcatagtaagaggggatgcaatgccgagacaaataagtaaattgcctccaaaatagtactttttctaaaagaaggtttggagggaaaaaaaaaagaaaaacacaaaaacaaaatgagaaagcacggtaacacgattcttacaatttaaagaaaaaagaaacaacacaagttgcgatgaatgtgtgtttatccgggacaagcatttataaaatcaaccaagttttttgccttgaatattttctgcgatcattagtcaacaagtttgtaacagaccaaaattcattttcagaatcataattggaaaaggaaaaaaagaagctgtcgcaatagtacacgagtaagcctatacttggttgatttttataaaaaaaaaaaaacggttagttt

SEQ ID NO: 3592 - DNA, 1311 bp, Glycine max
  Soy_ogl_1432 Gm04:46091659..46092969 Cluster 14
ttagattatattaaaaatacacattataataattttaatcagacacacataatagtagttggtgttgttgtgttgtacacttgtgtgtgtttttgtaaactttttagttctttaacacaaggcgtgatttcttttgattctcatgactaattaatatgctcctatgacttcttcattgcctatttaattaaggtcatccagatgtcaactactcttcaaaaacagagagtaaaaaaatcttaaaaacttttactttcgtcagttattgatagcaatgcattcatctatccgcgtaagtggtaatggagattaactgaggcagggttttttcttcttctttcaattaaggctaaataacattcttgcatcattatctattttaaatatatgacgtaatgtgcccttatatgaatttgagtgttaattgacactatgtttgtttaaagaaagggatgacaaagaggaattttaatggaagataaatgaaaagaggaagtaaaagaaaggaaagcatcttgtttggtttaatttaaaaaaaggtggaaaaagtcttttttatctaaatagcaaagaaagaaaagagagagaataatactactaatactttttgtcgggtaaaaaaaaaacatttttgtcttgtaatcttttaagttaatgtatatattttcttttaaaaaattctaattatatggagtaagtcactttgataaaaaaaattaccacccacaaacatttattattaaaaaataattatcaacacataataaactgtcaactgtcaagctttataaactatagtgtaatttttaagataattattataaaaattaacaaaattatcatgtataatagtttgtattaagatgtcattatacatttatttttactttttcaatgaatcgataatttattcttaagtatttaattttgttagcacactataaaaatgataaattactttctttttcaaatattagaggagagatgaaagcaaattgaaaggggaagaaattaagctctaccattttccctctttttcaaatttttaaatcaattatcaatataacttttttttgggccaagttcaacatttataaattataaactaatgtacttcaatacgttttcatttaaatattacccttcaaaaaatataatgaacagaaaatgattcgctccattctatctgctcattttgaattatgattttattcctttgctaggaaacgaattcatcacatagaacttatatattttatgaaaaatataaaaattaaaaaatcagattttttggtggagggtatgtcaaat

SEQ ID NO: 3593 - DNA, 1100 bp, Glycine max
  Soy_ogl_1447 Gm04:46853301..46854400 Cluster 14
gttttgtatataattttaagtttgagtttcttaatctggattttgatttgtattttatctggtttttaatttgtatttgtagatcgaatttgatttgcgctgtagatcggatttatctttttctggaaagaacaatttctgggaattctttaaccgtcataatttggttagcatatgaaacaggtattcattttattaaaaaatgttatattttctctttttaaaagataaaaattgttaatcaatcatttgtcaaacacaaaagttcgtgcaaaacttatttttattccataatagaattagaaatatttttatgtgtgtgtatgtatcggtgcgtgaattaaatgacaattttgcattttgtaacgttttacttttcatctgcttagttggtctttggttgataaataaatgaaaaatgtgtgaaagtgaaaattaataaaaaaaaattgaactaaagtaaagtaaaatatagaggtatgagatctaaacccatttttaaaactttcatatcaaattcatgcaagagggatttaaaccaaacactactaaactcttccttttatggtacacatcgtgctaaactaacttccttggttcctctataatttgatttgtattttttctataattttttttttgttagagttaattttttatatttataatccttaagttcatccaattgtaattcttttttcttatattttttttgttatttgtaatggcgtttgtttgtgattgttagttggtatatctatctatctatatgtaaaaaaaaaaattgaacttttatgaaccattgaattgagattttaacttcataacaggcgttgatttgaaattgataacttgaaactattacaatcattcattaaagtttttacttcataatagctgttctttttttttttttttataggtgagatccattattttttttctatgaccatccgggcattctagcaagtaggaagcacttatgttatttgaaaaaaggaaaaaaaggcaaatacaacaaaaacaaaatgccggcaaccttgttttaatcaccccggaaccaaatcctgctgcactaccaaagttagatgaattattaa

SEQ ID NO: 3594 - DNA, 1143 bp, Glycine max
  Soy_ogl_1728 Gm05:38204901..38206043 Cluster 14
aaaaatatttgaaggagtgtgtaacttctcttataaacattaatagtcaaaatgaccagccaaaacttgatagatcacggccaaaagaaagaaaacattacatataattaaaagggaaattctagagatttttttctttcattcatgtctctattcttatttctttctcctgaatgtaataattagtgtgttcatcaataacaaattagtgtgtttctaaaacgcaaaatttagatgaaaaaaactagttttgatgtattttagaatatcatatttttaatttctgtatgattaataaaaaatgatcatttatgatgattgatgacttttttccccgcgttatgttactgcatacaatgttaatttttattaagatacgtagtctggttgagcggtgtgcgttaattttttcttctgtctcacttttagtttttttttatctatcatattattaaaacattattttctttctttgttttgtcttttgatctgtcttttctttttaccctaaaacgttgataattttctttttttgaatatttagatcactcaatactatcttcttttttgttgacaggtcaatctcgtaataatgatgttttctagtagaaatttctactactttattagcagtgggcctttatgcattgggaagctagtttctactccatttaatagtaatctttttagctttttgttttttttttctaaaataacagtacttttagtttttttgagttactttttccaacatacccctaaatataatttgaaagatcaataaatatttacattaaaaagagacatttctcataaaaataagttaatggagaatagaatgtgtagtatttactattgatgaattgtaggataattaatgacaaaaagtagttgaaaaattaaaattacttttgtttaaatttacattaattgaatattttataatcagtcgtgcataaccttaaaaaactattccctttattataagacactatacatcaattagacagatgaattaaaataattaattcagttgattaaatgtttttaaaaaatgtttttaatgtactaattgtaaccttattaattatcattaacttgttatgaatgatgtgaaagtattaaagtttaaaagtattatgc

SEQ ID NO: 3595 - DNA, 1052 bp, Glycine max
  Soy_ogl_4953 Gm15:9515849..9516900 Cluster 14
ttatattatttcgttaatgagtagattaataaattataactaaacttacttaagcattgaagaaatttatacatgactaaaggaggagggaggactcaagagagatggaggaagaagaatggagaaaaaaagaagatgaagagaaaaaattatatttgtgataatttttagtcgcatatatctttatttcgtttatgatatcaattttagatgaacattttgaatgaaccaaaaaaacaagtgaaatgaccaaataaatcatttggtcatatttgtattattgatgcttttgaatttagcttttataaagcaaataattttaaaaaaaaactaagacatcttaatcattgaaaaaatcaaatgaatatattttaacaaatttataatttcttatgcatgtcttaaagtatcatggtttgttaacatattcacacttgtttctaatgagtagattaataaattataactaatgttgtgtagtttgctaatatattcgttactaaaaaaacaagtacacattaacaagtatgtgtaagatttgttatttttttttagtataaatgtattagctgaatattatcttaaaatatattaattatatagctcactaacccgctcaaactaaaaaaaattaagtgtgtagatcagtcttccaaataagtattacatatttgactcaaaatattaaccgaatatgtaaaagggagaggttcttatatctcccttgtattcctttaacgtgattgcgtaacatgcattcgcattgatcaaagtcttgcatagtctacaagtccttctatcatatattaaacttttcggttcttatttccccttctgccagccgaattttcatcgtaaaatgtttcagaaaaaatggtatatccttatagacttgaggaataatgaacagatttcccttcctacatgtggggatcaagggatggttcagtgtacgtctttcttattatatattcgagaccactttgcaagctttttgaagaattgtaaaagtaaacatgtcgtttttcaagacccgggtaaacaaagacact

SEQ ID NO: 3596 - DNA, 1100 bp, Glycine max
  Soy_ogl_5775 Gm17:39234201..39235300 Cluster 14
catcataaatacatgccaaaattgttctaattttccttctattttatatttattaaacaaaaaaacttttatcattaaaataacatgctagaattcaaaatctttatttttgtataaatatacaaaaatatctttattatagattttgtctcattctacaaaccctctcgatttgttaaaaattacacaaaactctttctatgttataaatacagttaaatttgtagagattttgtcaatttttttttaaaataaaggttttgagtgtaattaagcgtatcatatttataaattacaacgagattttgagattttaaacataaaatgttatacatgcaagaaaagtaaaatcaaagaaatatatgttggaataatttgctctaaataaatgtatcatgtcagattatgaacttctataccaaagaaatttagctcatttgattgagtaagcatataaatgttataaatattttgtatttatttttaatttttatgaataaaaaaaattatgaatttcttccgaaaaatttataatattagatttttttttatgtgtaaactctatgcaatgatggttatgctacatatcggcagaggtgtggcctacctatatttagttaagctattactccacgttgagtaattaattatgttaataataattaacttgttattgtccctcgtgagaatagtcaatatatagctttgttttgatgttgtgccaaataaaatgaaacttttttcgagccaaataacttgatttgatgttactctaccttcagaagaacttttagcttttgtaggttttaatgcaactatatgaccattcacatgatttttttatagaccacgggatatttccacaagatgtaatattatttgggacaggtagaactattttattattcctgaaaaaataacacgaaaataaaagtttatatttgatacaaataaaataaaagtatttttgataaaaaggggtttttggaatagttaatttgtgaaataagtgagggtaattttgtgtgtgtgtgataattaagattaaactctcgttttaattcctaaatttgtgagaaaatgtcataaaattagaaaaa

SEQ ID NO: 3597 - DNA, 1070 bp, Glycine max
  Soy_ogl_5777 Gm17:39332416..39333485 Cluster 14
tcaactcattttatgttttcacaatcacttatgtagaaaaatacaaaagagtgtaacattaatttgagactcatttgaaattattcacattaattgttgcataaaaattgtcacttttatcttttaaaaataaaatgttaattaatatcgttatttttagcattttgaaaccattatatatctgacttcaaaataaaattttacttaatgttaagattactaagattttagaaaaatgagatattggagttttttagtataaaataatgcttaatttttttatatgtttaagccagaatgccatttagtataaaataatgcttaatgttcccaaatcacatgtactctgaattttgttctctgtttgaatacttattgtcctcctgaaattaacaatttcatttgcttattgaaaaaatagacagcgagaaaaatatagtaaaataattagaggatttttttaggataacttgtatttcttttatctcaaaagtggtattgtggagatgaaatcccaatagtactaggtaaggcaccaatgtaatcatagcatataatatgtaacacatttttttttattacgtgctgattctactaaacaattggatgcactcatactaatggaatcaacataagattatattttagttaaattaaaacaaattaaagttattaatattttctaatgaaaatattatatgccgattctactaaatagttggatgccacgattactactggaatcaacaatatgagagtttattaatcaccaaaaaaagtatttaaagtttctataaaaaagaattaaagttgttaatattttccaaattccaataataaaatattaaaaacatctgtttaaagaacaatgtcataaacaaaacacttgtgcgagcatcaatgttgagataattactacaccaaaaaaaaatgttgaggcaattacttaagattcttgtctcccctatctcccgaaaaaaaaaaagctatgaattaacatagactgaaagcgcaactatacaagatcggtaagaagctaacttcttaataaattaactttttaatgcata

SEQ ID NO: 3598 - DNA, 1002 bp, Glycine max
  Soy_ogl_5802 Gm17:39749199..39750200 Cluster 14
tttgaaattcctttactttactgaaattaattatttttttacgttgaattaattatgttctttctgcttgtaattcaaaaaaatcttagacatttttttttggttacaaactaaactttaggtctaattcgaataatgggttacctcggcccaagtgtgtctcaacacaaatagtaggttaagatgaaagtcagcaaccatatacaaaattcttttttgaagacgtatacaagattcttaaaatatatatgaacatacttggatccagaataaagttattttattgtttttttttacaaaaagttattttattgacacgtcaagataaagtaatatagttcaatttatttcaaactcttataaatacgatcaataataatatatagtagtaaatatttattacgcattattattttggtggtataattattatcaacttcaacatggtagtacctttcataaataaccactcatttttcatggtgtcttgatcgaactagagagttttacgttataaaaaaaaatcttatcttagactttatttcatatgtaaagatacttcaattaactttaattaaaattcggtcaaagttaataatctatctacaatgcatgattattaatatttattggcttagataacaatgtggtccttataaaatattctattttgttccaatccttaaaagatttttttagtcctagtaaaattaaaaacatttggttttagtgcctccggtaagtaacaacataaataaatgacgtaataataatactgataacctactgatttgttacaccatcaaggagccattaaggagactgacatgtagtcacatgtaattttttttaaaattgtgttttcaaatcctttcaatggttaagaacaattgatgaaggattaaaatagattatgacaaaaaattatatgtaactattatgtcagacttattaataatatgacaaattaataaattaataatgtgttatgcttaagttatc

SEQ ID NO: 3599 - DNA, 1000 bp, Glycine max
  Soy_ogl_5296 Gm16:4461201..42000 Cluster 14
aggctaaaatgatagtttactcaaaattataagtgtttggtgattttaatttctaaaagtaaattgaattacaattgttgacctttttttataatattaaagcctaaatcaccagtacttataacttttggaataaatttagtatactattaaaaaaagaaaaattccttttccgtcaatacgaacccacgcatgacacatcacaggtaggaaggagtgagccgaattgaatgtcctcatcatatttttaccaactttccctcaaatttaagataaacgcaattttgttttggaaaaaaataataatatgtttccattttcattattttgagaaatcatatattgccacatttcttgctagggtttggtgggatgtagctgtgttggtggatgacaacgaccacagtttgaaattctgagttgccatagattttgaatgggacttggcgctgcttgaaaaattgatcactccacaacatgagaagcaacagagtttgagaaaaaaaaattgaggatttaaataattaaaatattactttttttataatattacattttgtggtgattttaagtatttaatggtattagttactttataattaattatatttatattaaatattttttctttataaataatatttttcaggtttttttctacttttctactttttcctcctattgaataaaaaaatgaagaatttatctgtaatttttttgcatggaaatttacaagaaacataaatttttataaaaaaaaaaacaaaatttgtattagaatacgtataaaaatatttttttctattgattttcaacaaacacaaataaataagcttggttttgctaaatcacagaaaattttgcaaaataaaagaacttgaagaaaaaaaccgtaaaaaaaatcaaagcactcataaaaaactacaataataattcacttgcaagaaaaatctacaaactcatgtcatactatgcaagctttcctataataatgaggata

SEQ ID NO: 3600 - DNA, 1001 bp, Glycine max
  Soy_ogl_2287 Gm07:8242901..8243901 Cluster 14
ttagtggaagtaaattattgagcaatgttcactaaaaatacatttgaaatgtgtaaaactatagcatatcaagcgtcatatttaacccgtgttattcatgaaataagatttgtctaagtgtaaaaatatacatagacaattgtcaacgcatgtaacaaattttagtgaatttatttttgcattcaattaacaccacaattttatcttaaatattattggctttattcaccaaaatataatttgtttaaatataaaaatagatatagacaaattaccaaatagtgtgacaaaaaataaataaaaaaatttatctaatataacatcgtgggataaaaaaaaagttgtgagtgaggatgaggggagagagagagtatcaaagtggaaaaataaaggttcttatttatattttcactacttttatgattttcatctaagcatcatttccaataacaaacttcttctgttattttgactcgtaagcttaagtgattctacgcttaaattgtactctcacttaaacttagattcaccttcacttaagctccaaaatcaacaatcccatttcctctgtcactcaactctcgttagggtttgactttaaagaataaaaagacaaacttaaaccgctccataggtcactcacattctcacaaatcttattaattaaaggtgtcctttttctctcctcttgctctttttgttatattaaattcccagcccttttgtttttcttttatttttataggcaaaaccaccaatttgttgacctcttttctctcacttgctttcataagttttattctttttttatcttgcctatcttggttaaatgaccatgactacacaatacaaagaaaaagaggttttagactcactcggtagatttaagtatatctatttaaaaaaagagttaaagaaaatagtaaaataacttttctaacatatttgcctatgtcctgctgcaaatttgatgcacatgtgtctatcccctcaacgaaggc

SEQ ID NO: 3601 - DNA, 1391 bp, Glycine max
  Soy_ogl_4834 Gm14:49099510..49100900 Cluster 14
atttctgtcatcacaaacaaacaaagccttaatctttaaactcatcattacaacctctttggtttgtgaatacaagaaacagagaaactatcattgggccaatgagcctccaaatgaatgagtatctgttcgaatttgacactataaaattaattttaaataaaattaattttatataattaattattataaaattgattttgataaagataaaaacagaagttgcttttacttgttttatctctatcaagattttcgtgtatcattatataaaatttgatcaaaatcaaaattgatccaccttatcatgattttagagattatatgaacacaataaaagttacggtggtatacacacgagtgagggaatatctgcatttttttttaatggaatatctgcatctgattctgatatttctttggatttaaattagaaaaagaataactataatcattttcttactttcttttacattatattttcatctattttctattacatcacttaccaatactcttggaaaaacgagattaaggtggggttaggttacaaacggatgtctttcgtcccgcctgaaaagcaaaactgcaaaaggtattcttgtttctattatttcttctgctagccgtgctacggatccaccttgtggatttttttttttttattacgattgtttgaaaatactttctaacatacaattttgttattagttaaaattagtaaatgtgaaattatgaataagatttataatttttgataattttcaataatatttattttttatatactgtcaatataaattttttagttcaattatttaattattaataataataatacataataatatttcagaaattgtatcactaacacttatcttcttctcttcaaaaaagaaaaaacaattatcttctttctagatggccccctcaactttaacaaatcagacgtatctattcttctttgtactttctttttcgtgtacaactgagtcattgatttaattcattttgcatttgaaagagttcattaacaaaattgtgttataagaagtataaaatattacgagttgtaacataactctaaataatttccttaaaattcttcccaagtcaaaggccaacagacattaagataggtgactttttaaaaagttcttatgttgcatctattttgaaaaagaatgtattaatttagcaaagctaaagcaggtaatatatggataaaagcatgaccgatcatgaatttcattatgaatattataacctaatatgaatggcttgtgcacgcaagctgacttttgaacaccatccaattacattaaaataaaaatgtcacaatgaattcatgctgctattaattaactttcgaatagttatatatattaggt

SEQ ID NO: 3602 - DNA, 1046 bp, Glycine max
  Soy_ogl_3945 Gm11:37295455..37296500 Cluster 14
acttttgaaagatgcatgacaaatattatttatatatatataaatcaatctgtttcggttaaacattcggctggtagttaattactcaatgcatgccaatataatttaggaaaatgttcggtgtgtgttcatagcaaaagagaaagaaataaaggagaaaaataataataaatgtgattagagataaatttaatttatattttaattttatcataaaaaatattacatttgtaaaataaaatttacattcaatgaaaaaaatgactgaaagaaaagaatctcaatcaaattttttgataaatattacttattaataaaactaatgaagctttgaggcagacaatgggcatgcaacttgatagctttggaccacaaacattgaagcatatcagacagtttttgaaattaaaacacgtgaagtagcaacttggttgtgctataaacattgtgttaaacattgttccctgatagaaattatttcaaggactgatcaataatggagtactttcttgtcctcatgctcaaacaaattgataagaattattactaaccttacactttacctgatcagttggtgaactgaagtacattcgcgcaaacttttcagtgacttataatacatcctcagtcttctaactttgcagcggtttatccggcgggtattatatatatgcattgtgacgaatggcgatgggtttggtttagaacattaaaaaattgcattagaaggtgatgatgatgatcaatcacgccaaattaatagagaatattaaaagtatcaatttgctgatagaattgttttttttttctttaaagaaatgatagaattgttatgtactatgtatatgtacaagtgtgtgttaagttgcttccttggacttcttgtcttggtaataataatgtattaatgttcttgtaagtcacttttcaataaatgaaataaaaaaatcacattattatttgaatttaattagaaagtactgacacttttgttttaaaaataaatatttagaagtcatatagttatgatttctaattaaaactct

SEQ ID NO: 3603 - DNA, 1014 bp, Glycine max
  Soy_ogl_4633 Gm14:3969987..3971000 Cluster 14
ttatccataaatattaattattaatttttattagcggatgatttgaattcatgacttatctctcttccttcatcattctttactgttaagtcatctttatattttctataactcttttgacaaagaaaaattttaaatttttttatatttttaaatatcttatgtattttcatgattcatgttgcttattaatttgtgcatattatttaaattaaaaagtaattaataacttaacatatgttttacttataactgtatataagtaatttaaaaaaatgggtggattcctggtaagtttcttgaccccaacgtaaatgagattggattttaattacttttaaaattgatgttgaactttttataattatatatatctcattaccttcttttatatataaaagttaatttattttgataatttttatttttatactttaaaaagtttactatggactagcttattggcctacgacccatcaaggactagattagaccaagaaaatcctgcccatcataaaaatgacttgattcaatttaatttttgtcatgagcgtatcgaaactaaatatctatcaattttactagtaatttgaccaagtcagttcaactcaacctaaaaatacattaacatgtgattgacacgagttcaaatggatcgaacgggtataaattcacagttctaaatattaatggctggccaaaaaaatatcagataatctaatactactatacttacaaaatctataattaaatattattaatttaaaaacttaaaaaagtatcatataaagattaatccgaccatgccacctaaatgataatttctcctagttgatacatacaagagaaaagagacattgttcgaatctcacattccatattacaaatgcatgtttgactaattccagcaccaactaccaccgaaagagctagaatagtatgagaaagagacagagagacacgacggccttattaattaggcagccatgtgtagttgcaaccgctgaaggggca

SEQ ID NO: 3604 - DNA, 1073 bp, Glycine max
  Soy_ogl_5626 Gm17:10052928..10054000 Cluster 14
cacacacattaatttaacaaattacatatatgataaaatgacatataaatctgtgcacatgatttaaaattatggcataaaagcatgtcaggtgaaacattagaaatacatatgaagatgaaaaaatgtttgacatatctagtttacaatgttcttgatatattcttttaccaagttattatcatataatgcacaaatgttagagaatttttttttcaatctataagctgatattaaatttatctctactggtaggtgatatggaacattgacgacattctattctggcatgtcctcttctccttaaactgactaattaaaaaagtactgtgttaacaaaatggattggcgagtggcgaacttaatgattctggtcaaatctaagacggtagttgacttcaaattttgctatgtagttgacatataggccatgaatccacatttaagaaaagaaaagtttgtgtctgacccattcatcaatcaccatacataaattgtcgtttgcatcacgccgagtcaaatgctcaaacctttgaaagcacgcagagtatattgcaaatatcgcttcttgccgtgtagatgggcaactcttgcgtagagatgacataatttatcagtatagtttattcttatgattactgttacaataatcccttaatgaaatttttttaaaattattttttaattataaaaatctaattcaagtgtcaaaagttttcttttgtcaacggagcctacctcaagttgatcctatgatatatttttaattcttacgaataattttttttaaaaaaagtatcaaacatttatgtaatgtcatatttgtcatactttgtattttcctccgcatgacgttacctttcaaaatatgtgcatggttgatttcatctattacattgtgtatataatactttgtttttttatagactaaaaaataagaataataattaataatcacaaacgagagttgttagcacaccatcatatctcctcatgtttcatccattgagaatttcatatataggttatcaaccttttaatatttattgtcaaaataagtatacatccaacaa

SEQ ID NO: 3605 - DNA, 1000 bp, Glycine max
  Soy_ogl_5829 Gm17:40862501..40863500 Cluster 14
ataatttgtctttactcttacttggattgattagtgttagcagagaaatagttttttctaaagattgtgataaagagtaaaaaaaagattctttttaaaaaaattgtgataaattttaattgaaaataatttaaaattaggcaaagtgtccaatttttatttgttgtaaatgttagctatcggcaattaaggaaaaccgtatctaataataatgaatgcgtacttgctttcgtatccgttattaggggatatatagcaaaaaacttctagatccatgagacatttaaggataatattttttcatttttatcttttatatttttaaaaaattattttaattttttatctttttaaactcacaaattttactcattacatatctcaactaatgtggatccccttcaccttattatcactgtaggactaacctaatgataaaattactaaagtctaagttttaagtctaccaaaaaaagattatttgctattaattttataaaggaaagagacatcatatgttgagaagaagtttatttttgttgttaaaagagacttattatataattatcactttgtaaagtaaaatatttttcttcaattttactttagggcttatcgtcagatcgacactgcagtgcttttcatgtctaatcgatggaagaatcattttaaaccttttaaaaattataaaagatcaaaatgaataaaaaaaccaaatacatcgtttgaccaagatctaaatagtaagctaggggaataatgacaatggctaatgtaactaataattttgttgacgacaattttttaagttaatttgaaatatttaaaaatcaaacttagattgaaaacattacttaatacttaaaaaaataaatttacggacttttatatcttcttataaataatatcacatggatcctgtgtaatcacaactataatcgctaataatcatgtatgggccaagacaattcaacatgtgatctacatcccattattttta

SEQ ID NO: 3606 - DNA, 1000 bp, Glycine max
  Soy_ogl_5889 Gm18:2237201..2238200 Cluster 14
ttgtatttcgactaaatcaatagatatacatacaatttctgtttcagcgcccactaatgattgttttatgtccttgatgaaatattaaataaaaatattaatattcgatgcttaaaatatatggtaaatttgtagcatattatccaattatatactcatatttttttatttcgttattttttgttttattaattgtgcaattttacattaacattttttttgttcatattactttccttgaaaaggattcattattttttttatttgattaacattatttatatcttcaattttttttatgtaatttgatttatattcaagctaaaatacaattaaacaatttttatattcaaaactttatccagttctaaatattcgattggcataaatttagtcataagactaattgaaacaaaaaatacactaccttaaaataactattaataagttattaaaataatctcattttgatcctttttttttttataaatataatatttttttaacaagagtataaagtatcctcacttaaagacaatacgattttaatgattagatatggtagcaagtaatttctttaattttatactttttaacaaagaattcccccaatatattctaaaatttacgcatgcactttgttatggattaaggaacatgtacatatgatggtagatgtcaaatctttggcttggtatctaatggctatccaatgcaagcttgcaatacattccatgaactcgtatcatatattaagtgggtgaacatttctcttttgcatctataagggcaagagctctattatagatattataatagcacaagcactaggaggaggcagccaagttatcatattctgaggagcaacatctgaagctgctagagagagctttcggttatgcagaaggctatccgtaacagcatccacttgcacaaatggtaggtacaagggtactcgtgttggaaaataaactaatttctacacctccatatattatcc

SEQ ID NO: 3607 - DNA, 1000 bp, Glycine max
  Soy_ogl_1454 Gm04:47045701..47046700 Cluster 14
aaaaagaagaagaagaaagaatactagaacagattttttaagaggatcagaacaaaaatcatcacaaagttatttgagcagaaaaaagtatatttaaaatcagtcttgttttcagaagtttaaaatcttgttttgctgaaggtaaaattatttttcccacctaaaatgtaaccaaatactctcgtcccaatgcaaacgtgattcttcgccaaacagttggtgtagtgctactggtagatgtacaaacagagaaaaattcaactcgtgttatttcaaaactcttgtgagttacttcaggattagttcaatttggcttggtctttgcttaaacacctttcaccctgttatgcatggactcatggtcatggttatctttagctttttaaattttattacccaccattacttttaattagatgtaacgttcatcttccccgtcttgcctcatcaaattaaaatttgctctaacatggaagagaaatgtttgattcattttttcaatggttttaaaagtcaattcttctcatgttatcagtcgggagtgaatttagttcatatttattttattgttgcaaacatatttttgaaaaaaaataaattgtaaaagtattgagattctttcttatgcaaaataaaatttataaatcattagatttatcttaaaattagtgtaccgcaatttgaactggcatccaaagtttaagttaaagttaagtttgtaaaccgaatttgcaaaaataatttaattctttttttttttataagactgaattattttaggataaaattttaaataataaaaattgtgtttatcttgagaatgttggaggagttaaataataaatataaataaattaatctgagggttaaatcaatccatcatgcctaaccccagggttcattaactatgcatcaaaacaagttgattggtaagttattatgtgtaatccaatgtaaaagtagataagttaggcaagttgacgtgacgaattaacctctt

SEQ ID NO: 3608 - DNA, 1121 bp, Glycine max
  Soy_ogl_105 Gm01:4340380..4341500 Cluster 14
aagtatcaacgcattgtgtttaacccgattaaccttgcctacatccgatagactttttaaccaagattttcactttgatgaaacaattttgcaaaagataacctaacctgaccaccaaagtatgttttttaatagcctttctacaatcaattttaagtattttttgattacaaatcccattaatcttctcgcatccaagtgtttgataaaattaataaataataacaatacaactattgctagatcacatggacttaatgaacaaaagactaatagttggtaactctctttgctttcctcttgttttatgttaatctaatctttagtattaaaagaacgattagttctgccacacgtctgtttttttctcttattatatttctccgtttagtagattgatgactaacaaataataataagaacaaaattcagatgagagaaacaaaaagatatatatgaataataaaaaaaaaattattggtatgtctcaaaattcaaattgcgtgtagtattctattcaagttgttccttaccatttaatttctcaaatcgatataaagagaaaggataataaagttatttgattagaaatataaatatttataatctttaaaatatagtataaaaggaaaaatattaaaaaagaaaataaataacactcaaattttttgtttaaaaaaggaaaaaataactattttaacaatgaagaccgtaaaaagaaaaaagtatttgtaaaaacaaataatattcatattgaaagaaaaaaatatttttgacttttttaatacacttttgaatccgtcacgtaatgaatgattttttccttaagaactattaagtatttttaaacaaacaactatgagaaagataaatttgaaagatcttttttggaacttacccatcaaataaacccctaatgcaaatgacaccgccctctatgaaagctactccaatgatcccaacaatgaataaaataagtcgagcttgagtgaagttaagtttagtataatttggctctttaatatttagtttagttcttaatttacttgacttactgaatccaacattcaaattttttaaatcctatatatttaaaattttaatttattagtaaattttag

SEQ ID NO: 3609 - DNA, 1056 bp, Glycine max
  Soy_ogl_3328 Gm10:2704801..2705856 Cluster 14
gttggcttatacgttctcctaagatgatgcaaatatataatgaattaataattctattgttctctatttctatctacatcgccctttggtgttaaatgaaatacttgtaattacatgaatgtaattcgtaatatcattttaagtctttgttaaaactaatgtctaggatagtttttccttcacttgattgtttttttttttacaaacaccttcacttaaatttttgaacctacaaaataaatgttagctccatcacgtaacttggcataacaaacttcatatatttcatatagttgccatgtctaaattgcgtattctgtcccttcaaaatcagcttaattaagttccagaaaatgaattgtgaatatataaatccagtttcatataatgtactccatcttctctttttatcggattccatctgtttttattttttcattatattatttctcctcctccggccccaccacctgctatctataagacctctccctaatagaaaaaaaaaaaaaattgattacacgttgaaataaattataaaatcaaattacacctttcaaagtttcatatataatataaaaaaaatcttacacattgaaattttgtgtacatcaaagggtttttttttaaaaggtgtttcttatccaataattcaagactaattccttaggctaaagcatagagattacaaaagtaaatttgtcctcaacaaaacattttccataaacgtagtttaaaatataaatatataaccctgattgctgtacttaaagaactcaattattttctgactgtccgctagaataaaataaaataaaattattgttctccctttttataatttaccctagaggccacaactttcctcactacattagttactcagtttgtcttattaatgtaagaaaatacaaatgttaaaatattgaatttaattggaatgcataacatcattattgtaaaggatttttacattattatctatgtatagactccttttttttagttcactaagtatagactgttgtattttgtataattgaaagtatttaattt

SEQ ID NO: 3610 - DNA, 1097 bp, Glycine max
  Soy_ogl_4694 Gm14:5895904..5897000 Cluster 14
gcatttgagaaaattaaatatacagatatatttaaaaagccggtgattagaaataattgagagaaatatttttagacttggagcagagaagatatgttttttttggaaagcggagaagatatgtggtgaaatgcacttctttaagaagatgaagaatgttgagaatctctacttaaaaaagtggggagaatgaaaactttactcttcaaattagagattctaacttataatataatattagattagtttcacaaatctacaagtaaatcacaattcacgtcgtctcctcaaaattgggccgtttctcccgttatttgtttccaaagtttaaaactcagtccttggaagcttagtagaaagagaaataaaaatttcaatgagttctacccttgagaaggacaattttgtcttggacatcaataattctctagtatttttacagaaaaaaaataaaattgaagagcctaaaaaggaacttcatgcgtgaggaatttaaatgtttaaatacatggtcgtgatttttattttttttggccaatacatggtggagggtttataaaattatatttgtaagttaatacagagaagtcaattaattaaggccttgctcaacaggcccattcttttgctttcctggtcactgggctagcctgattagaatagagctcaaacgggcctgttacatccatttgacataccataatatatagtgtaaatcgccaacgtgaaagcgtttgctagagtgtttttattcttaatattttcaattaaaatatattttaatgatagccaaatatatatatttctttaggtaaaatattttgaatcttataatggtgaaaacggagttgtgtgtattcaattataaaaaatatttacatacatatttattgtgctagcctttttgttatttgttatgtgaatttcaaatggtgaaaatggagttgtgtcacttgtgtgtgttgtgctatatcgctgattgtgttgtaaaaaattttatagttaaatacattgcattctttattaccagcagtatagaacaacacgcacattaagttacatgtttaatttgaatttgaataattagaatatacttg

SEQ ID NO: 3611 - DNA, 1333 bp, Glycine max
  Soy_ogl_1108 Gm03:45872468..45873800 Cluster 14
gtcatttttggtattttatgttttttaactagtttaacacacaattttatcaaatatttataatttaataagttagcttaaaagttttcatgaccaactttcatatactaactaattttaaagttaattttgtcaaacattatctatatattattctattataatcaattatttaatgtatcatccatcttaagtaagtatatttcttatccaacaaagagaaactagttaaaaaatataaaagagaatagactctctctatattatatataaagggagagagaaatttgtgtttagatagtattatcttacagaagcgttatcaatatattatctaatacactttttgactatattcttctttatttattgaaaatcaatttttttttgagtctcacgttatagttaatgaatattttttcataaatctcaaccaataaaaaaaagtatattcctaacattcctcattatattatataacattgacatgcaaatttaaaagatatagttaaaatgctaaaaattaaaaaattgttattcaaatgcttttaaaaaaaatatttgaataaaaattgtaaccttaaaaatctgatataatttttttattaattttatgaaaagaaactgcataaataaaaaaaatgtataatttagtaaaaaattaaataaaattatacttattatctagcgtgtattaaacattataggattaaatttgagaaaattctattcttatcatgctttcattttgtcgggttttggattcaaagaaaggcgctaaaatgtacaaatttttgtttcatttgtctaagtgaagaggtgttaaattagggttaagaaattaatttttgattgagaattacaaccattagagagaagatagaaaattcaactcatgcactctcttgacaaccatcatccaattgtagctagaaattgtatttggaacaactgaaagtggaatagtgaaagtgaaacaccactaaaacgaaagtgggtaactatattgtttggaatagatgaaatagaaatgaaagtggttgggatccattgaaaaaaaattcacctaaaaaatgaggtgaaagacagcataattaattaatagtaatgacactttttattgttgttttaaaaaagtccttcctttctttttttattgtctctctcatgatagcctcaatgagctctcgattaatgcatgtatttgagaatgtcatataaatcgattatggtgtgtgaaattgattattagcgtgtttggatttacatccacataactcaaacatgaatcataaaagcaacttttaattgctttaggtgcatcttgacatta

SEQ ID NO: 3612 - DNA, 1093 bp, Glycine max
  Soy_ogl_1233 Gm04:5455285..5456377 Cluster 14
aacgaacatgaggttgactaataacatatattaacaattttgattgataagataaaaaaaatcataactaggaactaaaatgatatattttaaactataaaatctaaaagaaaaaaatattataactttaaaaatcaaaaggattaattaaacctaagaacattaggtcacatgtatagtaatgtaatgaattaagaataattatatttatacatttttttccatctttttcctcacctcattgttttctcatttctttttcttttctgtcatgttacttaccaagttaccatatatattactttcttcttcctttcatctcatttctttttcttttctgtaatgttacttaccaagttaccatatatattactttcttcttcatttcacttgctttcactctaaaatggactgtatacctaacattttcaaacagaaaatatgttgccggcttcgtgtatctcagaaatcagaagattaccatcaaaaaataaatcagaatatcataaattttacgcatggtagtgattttttatgtgcttttttttttctaatctataaattttattttgaaggacttccttgtctcccttcaattttcatctacaataataataagagagagctctaacgttgccacattttgtagcagtttagttagacaacgcgtaaaagaaagatcagaaatgtctttactttgtttcctctaaaaaggaagttgttctggattgttatgagaaattaaaccgagtaatcatgatttgcacacaataattacggttacatttaaaaattttgattttacattaccatagtcaatgcaattgacaacttgacaatcagtggtgatttcaatttatgctttggctgactgtgctttcacattatcaaattgttaaacatccaaaggaaatcaagtataaaagtattttatgtgtttgagaggtaattgccaagctgtttttttattggcctatagtttatacactatcttataaacttaacaaacatacttttttttttattggtttatcaaattttaaatgttattgatttataacatttttaatgttatttgaagtgatgttggaat

SEQ ID NO: 3613 - DNA, 1043 bp, Glycine max
  Soy_ogl_2163 Gm07:3435058..3436100 Cluster 14
gagtactaaataaatgaaaagaacattttcctctacttttacagtaatttagagtaaaaatttcttttatatgtctaactaaaaaaaatagtgtgaccgcagtcatgagacttatcgagatgaattaatatattttttgattaaagtatttaatgaaaaaaaatgtaaaacactaaatagcgatttttcccatgtattttagattaatgtatttaatatgaaaataaaatcacatttactctcttatacaaatagtaaaaatatattacttctatcttttttgtcctcttttcgctttcttcttctttatttaaacttatccaaatgtagtgtaattgcggtcatgactcatgaaacttattgggatgaactaatgtattttggattaatgtatttaatataacaattaaaaatattaaatgatataaatgcgtaagtacaaatggtttatatatatttttcagatatgaggtccttttcaatataattttgtcttctcaaatcattcctaactgaaatatttgtaacaattttttaataaaaaatatcccaacaaataatatttctaaaacataatttattttaagtttctatttcatttttaacatgcattattgttgtgatttttttaaatactctccttcaattaaaagaagaagaaaaaatacaagttaatgccattagtttagaccatgtgtcttagtcttagtctttgatctttaaaaaggtatatcttgatccttacagtttccaaagtgtgtgaaatgatccatatattaattttgttttgttaaatttcgagagaatgcatcatataggatttaatgtgtgtgttttttattattaaggtttttaaaccgtgcaaattgatactgatatcctttttccctcactcacctcattttcatacaatgtttagataaaactagggatatcaatttggatcaaattaaggcattaagtaaaagatggttgcacgtgcaaaagacatgtttggcggggagcagcaggcatcaatttaaagttttgaactatggtgttgc

SEQ ID NO: 3614 - DNA, 1027 bp, Glycine max
  Soy_ogl_5280 Gm16:3999774..4000800 Cluster 14
aaacataatttcttttattaaatatattttttcctcaaacataggaattaaaattcattacctttaaagttattagcagaaacacaaatattatcatgtttgtatgtctctatttttattgtgttattgtgtcaaaaaataatatattataataatttctaattatattttttgaattatgtttaataaatgaaaaattaaaacaaactgaatagcacaactaaaaataaaagcaattaattggtcatagaaaaatcataatagtcttgactttgaaaaatattcttccttcctctttttctataaattacctcatcatttacaatgacagttttatcccatggaaggcctgcctgttaaattaattaaaacagtaatagtaataataataaatagaggaaataaaatataaaaagatgtgtaagaatgagttagaataaaaaataatttacatactaaaattcttgtcattgaaggaagtacctttaatcaaaattgtagagagaatatagaatgcaacaacataaaataataggaagaaaaaagaactcaaatatgatttgagagagaagaaaattagaagcaattataattaaaatgagagttttgaggagcggtgtaattatatttataaatagtgtgcataaaaaggaaagcgtgcaactttttacatttaaagtagtgactaagaagttacaattggctaactttggttggtgaggaagtgattaaaagtgggaaaaaaaattgactagatgaaagtaaatcacataattttttttttcatttatatatgattgctattatttttgttttaagcatgtaaaatatttaatagtaaaatcaacaaataaaaatgaagagtaagagcattataacaatcgcctttataaaccagagtttatgtatattaggaggcccacaaggaagtgtagcccatacttatcaccaagcgtgggagcaatcaaacttcaaagatcctttttatctgaaggaaaaaaggaggtgggggcagggaaatgaggct

SEQ ID NO: 3615 - DNA, 1200 bp, Glycine max
  Soy_ogl_5292 Gm16:4381401..4382600 Cluster 14
ttatggtcatgatgtttttctaagtatagaggcatgttgtaggttcttaacttgattgatatatatgtatacgtcaattttttttataaacaaaattgattaagtagagtaaaaaatttattttcactagaataaaagagcctcacaaatcaatgggataaatagacacgcaacatggtcgattcaatacactaataagaaaagaaaaaaaaaaaaacaagacctgtcttggccttaaaccaagtttataatttagtctttattaaattcaaaacaccattggaataacaaacaaatcaaacccttaaacacaattttattatgcattcttcacgtagctagtagcttttacactttcattaaagagtgcgtggaatctcaaatgtaagaagaataaaattgtaaaaataataatcttataccttctttaaaacagacactttcagaaactattgttttttagaggtcgaaaactaaaattatcgagtgaatgtttgtaaacaatttcattttatatatagatcttcaaatattcacggttcctataaatttgagggaataatgatacatatgcatatatccatgcttatatacacccaatatctaatattatatattttccaccatttctattttattactaagattttttatttttagtacatccacaatttttgttatgctactaatccatactctgtttgtaggtttctttctgttgatcttattttctttcggtgtaactgtacaagggtagtaaaacgtttttataaaaatgcaaaaaaaaaaaaaaacttcataattacttctgtgtcttccttcactttgtttctactcctttcacctatatttttttgtttttactccttttgtggttttttccagcaaatattaatttttagttgttcattttattagcagaaaaaaattaaactcacgttcttttcttccttctcctctagcctatgtttgacttcgcttctaattacttgcagatttacaatccattatatttataaggacgctatttttttttattaaacttgttatataataatattgttcaaagagagttttttttaagtgatgaaaaagtattaaatttttaatctaataaatatctatataaaccgtttaaaatagaatgcttattgattatgtaactgattacaattacgacaaaaagaataaagacgtgta

SEQ ID NO: 3616 - DNA, 1300 bp, Glycine max
  Soy_ogl_6947 Gm20:43223001..43224300 Cluster 14
gtgttaatactcacaattcacacagcaaagctactcaaagtaacttgcaattttcacatccgttacgcgcattttcccttgtcaagacgtggaattgaaccaaacactccattggatcatctagaatgagatggattatgttgtaaggaatctgaatagtaatccacttgtcagtaaccagcttcccaacaaagtttagggctagctacgagctcaacagagttacatactatatagaatccaacccacactaacaaaaaatattatcagaatgtgtgaatcaaggccatgaaaaaaaaagtttaaaaaatgaaaacgtggctttgtaagtattggaatataagttttgggtattttttttttataacaaattgtttagttagatgaggatattgtttttttttcacagtatttcaaatagaattatctcgaaagagaaatatacgtgagaaacaaaacaataattaaaatgaaatatttgagtgattatttattcaattaattaagtgaacaaaatttagttcaaaagcttgggtaaatgcaaaaacctgggaacctctaatccattgtagcatgaaaatcagaattttgaaaaagaggaaatgtttaaattagaaatcaggataatatttgttttttttaatccgtaagtataaagataaatatgaagaaatttataacaactcatatgttttacttaactaattaagttaaactattgttaggataatattcataaatacaccaaagaacgacaaaaaaaatgcaaaaaatggaagattaataaattggaggaaaataataaagaaaaattaagatgtttcgttaacgaggttaataaagatttggagatatatatcatataagagcattcaattttcatcctcatttttacaaaacaagttcaaaacctaaaatgaatgacaaaacttgacaatataattaatgtgttttttttttttttaccttaaatctgtatcaaataataatcttccatactcacaataaaagggttttagacacagtaaagaaagagtacattgtgcagtggtagacattaatgctcatagaaaacagacagtactgataaaatcgtttgaattaaaaagtttgaggaatcttcaatataacgtgagataaaaaaaaaatacaaatacatttgaagcatttgatttgaaagtttttttttatattttattttaattaaaagaacgaagatttacaataaatataaattatgaaataaaaataacaaaaaataattactattaaaggacaattactaattaacaaaaatgta

SEQ ID NO: 3617 - DNA, 1000 bp, Glycine max
  Soy_ogl_1937 Gm06:14037601..14038600 Cluster 14
taatcatgttaagaaatttgaatatagtatgttgttacttccaaaacagataaattttaaaccaaatacttataatgtttcttttgaataataaatttacttttaacatctttaactttaagtataaaattcttgaaaacaaaattctcatgcaatgctattaaaaataggggaaatgaaccatgagaacggcaaagatttatattctttcacctatttaatttttacagcatatctacttttaaccgttttttaaatttcattttaaatttagaggttacttaattttaaatttataaaaaaaattttaacatttgatctataaaacattattttaatctatttcaatagtacaaaatgaagtaaactaacactgcatgagaatgagaattgctaataaaaataaaattcccactttatattgattgaaaataagttcctaacaatttataaaagtttttttttttagtttttgtgttattagtaagaagtcttcatcatctttttcgatcaataatctttgttaaaaaatttaacaggtcatttttaatggaaattatattttaggggaaaaaaaaagtttcgcgtattggtgttcgagagcatgaaaatggaacgtccaacaccaacgcattattgatataaacttttaggcccaaaatattcaaactatatatattggcgtgtgtcttatggccttgataaaaatgtcagccaaattggtttgtagtgcaaacagcaaacctaaggtgacagtattgtcatgttgaacctcatcccttacaatgtgttgtgagttagtgttgactctaggtgtgtgtacgttgacccagttatataggtcagtgcatgcatacctaaaatgaatctcaacctagtcatatcctctatgctattgagccttcagtttgttggtctaatttgaaaactttactttcttttgctgttctaggacaattgcatgcattgtacataccctcgattaagtacctgagataag

SEQ ID NO: 3618 - DNA, 1200 bp, Glycine max
  Soy_ogl_2137 Gm07:2770901..2772100 Cluster 14
gtgtacatcagatcaaagatagatatgattcataccatatgttttttttatggagtagtatttaagaaaataaggttcttattatattattaaaaaaaaaagttcttacttcttgcatataaccttacaagtgtcacgtttttataccattcatttcctgtttactagaagtcaagccagtttccatcatgttattaaattataaattacttttcgttctgaatgcacattaatgtgttagaggaaaattatgctttcaaaattaatgcaaggacaatattaacccggtaataatgtaaacaaaggtgtgtgcatgaagacaaacaagaaacgtgtacaccagatcagagataaatatgattcataccatatgcaaaaattatattgcacccagaaccaaatattgattagcaaatactattatcatccctattattttttaatttattttatcacctctgtaatgaaattatttgaatacataaaaaaacctataacttattataaatgtttatattcataattattattttagcaaatacgtacacgtacatcaatattttttcagtcaattgtattttaaaaaattcagcaatagtaatgataataagttcagttacgtttggtacaaagttagattttaactttatctatgtcttctgtaccatatatttttactgttaaaatgctgacacgtgtgagatgtatgtctcccttgttttttttgttttttttttttttctgtttcctacgatggaatgtgtctgtgtgatcagagcctgtgtttttccacatctcaaaatctacccgagtcattgactattattgtccttcataatttgcaatttgctgaaaaagtcctttcttttttcgagtacttttattttaatcatgtatgaaatatttatttattttattaatgattaattttcattaacaaatttgattagtcattcttaatggatttcttttcctttaattacaagaattaaagcttaattctgacttaaaaagattaaatctctattactcagatcagcgacttgtatttttcgaatatcaataataaacttactattcgaaataaattttataatattatgggttagaaatcaaatctagtatattttaagaatccaattaaatttaattatattttaatatggtttgttgttctatatattttcaaattgcataatt

SEQ ID NO: 3619 - DNA, 1000 bp, Glycine max
  Soy_ogl_4139 Gm12:379171..37941500 Cluster 14
tcatttaactaaatatagaaaaactcacataaaatacatttttataatattgtttaatattttttatttagtattttgtttaggattatttttaaaatttttattgttataattctagatttataacttaatatgtctaattgtgatgtgtaaataatgaaagatttaatttaattaatattttctttaaaaaatagtttttttgttgatttttttttaaaaaaacaaatatttttattatattttagatggattgatgaaccaactcatttaactcaactcctggttgccagtccagtccatttttatagctctactttttaatatactttttttataatttcagagtgaataatacagtatagttttaatttttgaacgaatcgaaaggataaattagaagtgtactcaagttaattagattttgagtattacttgaccataacacagaaaatatataggaagagtataactgctaattcagataggattacgcaattgagtttgattgttaggttaaagtaagttgttgatttttcttcgggtagataaagtcataataagagtgatacagaagcagagaaaagaaatgggtcctgaaacaataaaaagcccaatccatgtgatattgcagtgcatcagaaaaaaagttaaaaacaaaaactgtagaatgtagatcactgagcacgcttgctggattgttattagctaccaaagagactaaccctatctttggtagagagaaaagaaaatgaggaagaaagagaagagacagaaagaagaaaggtttggtcgtgtgaagagaaagaaagaagaaagggaaatctggtgtaattttttgttaccattactcgagaattttagaatattgcttgtcaatcatgagtaggttagtggacatttcatatacctggtaatttttttttcctttctgtttcttacatttgtagcatattatatttatttatttattttataattttttacattgaacttttgt

SEQ ID NO: 3620 - DNA, 1151 bp, Glycine max
  Soy_ogl_5765 Gm17:38971550..38972700 Cluster 14
ataaaaagtgtaaataaaactatattaaaaagagagttgcttttttgttaatagaattaaaaagagaattgttaacattcatattatagatatatttatcaaatctaattaatatcaatgttgtgtatgtatgtataatattaataagtcatcttgcttgcttgctttgttgactcaagtatgaatagtactgaagttcgaattttctaatcgcgtattaataataaaccgcaaacctcatatgaatagtgtttcatgatgtaaattaatttaactaacttggtacgcttaaacttaaatcattattgcttatactaacactttcatttatttgtcggttgcaaacaattattagtatatctactttgcaagtataaagatgtatatattattttaagagaattaattagaaatcatcttaaatatgttatgtaaaataaatttttaaaaaattaataatcttaccacatgtaataaagtacaaagtaaatgatagtgtaaaaaatatttataccgccaatgtttttaatgattttttaaaaaagttaaactcattataaataccgtcaagaatgtgtatttataaatagtccgtttattttgggcgaattatatgaaataaagaacaaacaaaacaaaagaaaaaactaaataacaaccaaagaatccctataaaggaattggaacacttcatttggggggagcgaccaacaatgagatgaatctgttaacctagaagctggaaccccacttggacaaaaagttagcaattgaattcacctccatattcacgtgatgaagagtaaaatatcaaaacccctcttcatgaattgaaacttctgattgaatgaatagtgtatatgcatggacatgcatgcttaattatctgccaatttggccaatcatctccaccatgttcatacaatctgactcacgaaattctcctaaaccccttctcccaacataaacgaataccatctgtcaatgcaaggagctcagataggagaggatcacccaaaccacaatgacgagcacacaagaaaaaccatctgccaacactactatctctaatcaaacaaaccatcaatgagtggtggatctataatttttttttagtgagaacaacaaatagtttataatattattacaca

SEQ ID NO: 3621 - DNA, 1000 bp, Glycine max
  Soy_ogl_4917 Gm15:8467501..8468500 Cluster 14
agaacaacaaaaagatgctcttcaactctaatccttgcattaggcatgattaaagttgtgctacgcgctactaatgactttgggccttcaagtgggttttaaatcggcttctttatcttcttcaaatcctacacaaaacaacataaaagttgtaaaaactaaataaagtggaaaaaatatctaatcctaattacttaaaaaagaaacattaaaaaggggtcaaacaattaggttaaaaaaaggagaagttaattgcttaaacatgagaagaaaaaaatgtgagtttaaatgaaacttatcaaataatagattgttattttgataaaaaaaattcgtgtcatattattttgataaatactaccaattatttgagactaaataattaattactttgaatcaaataataaattgttttattgtttgcaaagtttggatgctaaaataacaaattatttatttcaaataataaaatattttgctattagagaatgttcacccttccaaatactagattatttatttttaaaaataaatcatttgggatatcagaatggcattaagaaattttagatcaacacaacatattattttaaatgattacaaaattatttcaaaagtaagaaattgagatttgtgatataaaaaaatctaaaaaattagttcaaatcgtttcaaaaacattgtaaatcctttttaaccaaaaattgaaacttgctaaccataaaaaaaaattcaaaacataatttaacattaaaattatttgcagaactaattgagtttgagtgtgaccaattcaagtacccttaaacttgtcaatctaacaccaagcaatatgaccttgtgagatctttctcttttatttatcgtcgtcaaaattatattgtccgatcttgtgcattgtcattcacgcgcagttgtgttataaattaatgaattaattagctccatcattttattaaaaaagcttacaaaaccctcatacttatgttgagaataaaag

SEQ ID NO: 3622 - DNA, 1200 bp, Glycine max
  Soy_ogl_2903 Gm09:370301..371500 Cluster 14
aatggaagaaattttttaatggtaagataaaagaaaatatagcaggtgcacatattaagaaattctatcttttatttcctaatgttgatgttatcagtaggaattattcatgtctaaattttcaaataaatatatttttataatatatcttctgtattttttttcaaatgataaataaaaattttataagtaaaaataatattttatttataatagatgataatatatgagtaaattaaaataaaaaatgatatatctttctaggaagtgtatcctttatccatttgtcaaaaaccgaagaatatccagttaaataaacatgaaccatagatgaaaatgaatgatacaaatcttgccacatataccacattatctgtgcttctctctcttccctgcattgaagaacattaaacactatcagaacattattctttcccaaatgccaatcataaacaaaataagcactcgatgaattccttttgttcaagtatttgcatccttataagtatatatttgtactttgtagattaagtcactaatcataatttccataaactgtctttaaggggcatttgagtgaatagtgggaggggcattatgtttctaatcttgattctttgattcttgggactatgatttaattgttaggtgactttgaatgagctggtgtacgtgtaaaattaaaggagtagtagagagggagttccagaggcggaagtagccgacgacggtggcagtcttgcaagggtgacggtggaggatgagattttcaacattatctagtaacatagtgccattacttctttttttgtttgactcagaaaaaattaagatgcaacacgtgacatgattggagtcatttatatgatcctaccgatgaaaatgtctcaactgcacagccagttcccaccaagaatccgtatttatctttttgagacttgttaaaactatatcaaatatctcatttataagttattatacagtaactactagtaatataactcttcaaataaatacaactttttctggtcatttttataaaatcaaaattagacgtttggtttagtcctttttataaaaatcaatttaagatgttttctgtattaattatttttcaaaaatatacccttaattgtatgaattaatttttataagttaaataaatgataagtgaaatacattcaatgatttaaactctga

SEQ ID NO: 3623 - DNA, 1296 bp, Glycine max
  Soy_ogl_3535 Gm10:44955401..44956696 Cluster 14
actttatcaacttaaataagatactaacactgattcaaatacatcatatgtttgtggttagttgattcaaaaatcacaaaaacaatttctttttatgcttaagagtattctgttctaatgtatgtttcatgcactatatataaacaataaaaacgttctgttctaatttattcgtttttttttttgtttataattttctaagatcatatctgtttatactctatttttaaaattcactaaacataaaatagcacatatgactatgattctatccagtcttagcataccttccgtctaccaaaagatatttaaaacacatcaattttctatctttagatcaattacatattcaatccttgaaaacctgctacggctaatcaggggggaggagatttgctagacagatttggttcctctgaaatgagacaggggaggggtcttcttgcgatcattaaacaatcacgattctttgtgtggaatcaacgatttttcaggtgctagtgttttttttaaggcaaaaaagggtgaaaccaacaagttggaagataaaacgatctcaactaggttaacacctctgaaacttccacctagacacacaagacaccccaaatatattaaataagaaaaaggagaaggatggacaaaaacatcattgggggacaacaaccaagcgcaaacaaagttagagacaactatctaaacctgcagctaggtaaatcaattctatcatttacaaaaaaataaaataaactatcaactaagggatagagtcataccaacaaaaacaatgatgattagcatcataggcaactaaacaatcagcacaagtgttttttttttctcaaaaaaatatgactaaccataggtgctagtgtttataaaattgattttggtttaaaatatttttaaagtaaaatgatttatgtttgaatatttttatttaaaaagtaagttaataataaaatttagtttataataatattctatccaatgcaaaaaatatgtttatttaaactcaaaatcaactttgaatttagaataaattccttagcataaaactaaacatgtaattttttttctaaaataatgtttaagcaatatttcaatatgattttgaatgaaccaattaacgtaaatccaaaggaggatatatgataggggtcgtgatcatatataacaatccatagctagttgtcataacaaaactgccattataagtaaactagcatcagtacgtaactaagtcatttaatggataactaactctattacaatataaccactgataagaaacta

SEQ ID NO: 3624 - DNA, 1000 bp, Glycine max
  Soy_ogl_42 Gm13:37159201..37160200 Cluster 14
caagaaatggtatccaaagcattaagcatcatttcatcatgctattgaccatcacaatattaattctaaacaagctaaactgaagaaaaaacagtcaaatttttatagtttatctgcagacaatatcattttgtctggaaaaattaagacaataaataagttaacaaactcaatcataaaaaaatggctaaaagtaattacttcaaaaggaacaacacgctccttcaatacttctagtatatttgaaacaatatcattgtccattaaataaaaaaaaggaagaaaacaaaatcattcttatgcaaagataactcctttttcatctcctttcatataataacttgggaacgataaaatagtaatcatattcctgctatattttcttcacaacacttatttttatagaagaaacgggagaagtgataagatgaatgatataatagagaaatagaaggaaaaataaatctaaaatgattttctgagagaaaaaaaagtgtgagaatatcattactttcaatataataaaagattatcttctttttctaatttgaaacaaggcaacaacaagcatatatatcaagccaacaaaaccatttgttgctctcgccaaaacgatgtaaaattcctatgttgttaacttagtttggtttaccttattttgtcactcagatataaccccttattttgcatatggctaatttgtactaacttgaaaatgtataataagtagagcaaattgtaatttttatatttaatttgcatgcttttcaaagaactacaataaactagaaacaaaagtacaaagaagacaggatcacgacaaattgtaaccaatggaaagattaaaatttcaatacaaaagaaacataatattgttagtcctagtcaaagcatgaaaaacattctaaaaaaacaaaagcataacaaactgtaacgaaaaaaagcaatcacaaggtcaccgatcaccataagggattatcattttgcaggggcttcgtga

SEQ ID NO: 3625 - DNA, 1154 bp, Glycine max
  Soy_ogl_1905 Gm06:11575372..11576525 Cluster 14
gttcatattagcattgtttggtggatcatggtcaatatgtggggaacggagctttaccgtgtgttgacgattggttatagttatacagttctaaatatacgttcttaagcagtagaataacgtggacgcaacaattcacagcacagcttcttgattgatgcagaaaaatatgtccaacacatgtgaccatacaagcatgcatataatggataatgtgcatactagtagaactgcttcgaatcccttaatgtcagtgttttctccaacatttttggggttggagtaaaaattaaaaaataacccctatacaataaatatatatttcataaataattcatccaaaaaattttcataaatttataagttcaactataaaaaaataacacactaacctcttatatattaaaaagtttatcataattattaatttaatattttttttttcagatttttaaaaagttgtgacactccttggaataaagatcctcttacgcatgtatataagggacactgcttaatattttaagttgtcaattcccagcaataatataatgacaaaatatttcaacatgcttcaaagcaaatatacaagcttctatgctatttttctttgttgccgtggttctattcagcgatgtactgttttatgtcaaagcaaatgcacaaacaagtatttttaacgctcaaatcaataagcgtttagataaagagtaagaatcaaaatatatacttcaaaagataaaaccaattatacatagtcaaagaaaaaaaagtttacaaattatcaaattacacccagtaaatttgtcgaaaacataaatcataaatcaatgaaattctctcgagacttacttaagaatgagaaaaaggaatgtaatccatctagaatagaatctactctatttatttaattttccacttttgcttggctggctgaataaagaaatggaacgagaggtacgactgatcgatgagtcttttctctccttgatttctccagttctatttttttttttttactaatccaaatttgtggactgaatgagtctaactaaaataaaatatttgaggatatactttttaaataagtatttttaaataatttaaataataatttataattaaatgacagtataaaatttgcataaatatta

SEQ ID NO: 3626 - DNA, 1000 bp, Glycine max
  Soy_ogl_5437 Gm17:1071001..1072000 Cluster 14
atctttgaaggcatcattctagtcaaccagaccatccttcatgaggttattataatttatgatagtatcatttttccaaaaaatgttaaatattaacttctttgttattatttaaaaactaaaatacattaatatactcgaaacaataatctaaatattttatttagtttctctaataatcatttttttgttgaatctactaatcattctaactatttagtagaaaatattaaatgttaaattatgttttttaaatataaaattgcatatattttatttaaaattttcaattaagactattaaaaatatataaccttagaggaaaggaaatgcttgcataaattgactcgcgaactatggtacatctcatgatgaaagactcaagaactggactgcttgcccgagtcagttggatctcctcttgctagctgataaaataggtgttaccctcataagagtttaatttattcctttatgttccttgtccttttatgtttctcattcataaaaaaatatatcgaaaacacttttgaaactttaatttacctttttctatattttttatgttaattttcacattatttaatttcttttcaaagacgatgttgtctaaagttagattaggcattaaatatgagtactttttctcgttctaggaaactagtctattctacaagccccaactcgttactatactacattaaaataaatgtgtatttttgttttaaaaaaacaatacaattgttgatgagcatcagaaattgatagcatataattgtttacactaaacagtgaaatgaattgctaggaggagttgaaaaaataactatataaagcgtgtttatatattcaatggtttgcaatttgcatgcaatttataatctatttgtagtgaaataaggtacatttatagataatttacgcagttataataaggatagtgaccagttgtgcatatactagtatttatataataaaatcataggggaaatagaaatgt

SEQ ID NO: 3627 - DNA, 1000 bp, Glycine max
  Soy_ogl_5615 Gm17:9719201..9720200 Cluster 14
tgacaatcctaattctaaatattttatatttttatctccattttataatatttacgggctcgttcttttttaactttacttttttattcataaaactcacatgtaaaattttacttaataaaaacaatctcagtttcattcaaattaatgagatgtttttctaaaggattaatgacatgttaataagtatatatttggattctcatccataaatcatgacgcacatctcaataaaaatttgggtcaaattcagtcaaaataaatgaaaactacgttgagtaacttcactcccccatagcgttaaactagacacatggtaatatattttatcttctaaagtatatattttacaaaatctataattaagtatgcaatatcctgcttcctataccacgctactcaagcaaccaccgagctctaatagccaacaatatccattgaacattaaaatcctttaaccacatatatcccaaattttgaagtagaataaaccgggaggccttcccttttctaacttctaaggacttcaaaatatgatctttattatgtcctctttaaacactacactagcctatgagtgttttcaaaaggcaatatataggatgcatagaagatgtaattagatcagtctcgcgagtcagtctaccacaatgggaacttttaaaaaatgacaaagatttccgttttaaagatttgtgattggatcactcatggtgaatttgtgagtaaaaatttaagtttaatttctgtataatacatttttagagcaggataaataactttaaatataattaaattttaaattaaaaattcatctcataactaataaaaaagattaaaacttataaaaatatattggagtcttatcgaaaaatcaaattaaggtggttaaaaaaatatgttttgaaatacctctttatcccacttggttatagttgaacaacaaggtgacttatggaatcttatgaaggaggcaaggttttacctgtttgggtggaga

SEQ ID NO: 3628 - DNA, 1200 bp, Glycine max
  Soy_ogl_3604 Gm10:47356101..47357300 Cluster 14
cttattaaaaagcatcagtgttttctctatatatcgccttttttataaataaaaaaatagtcaaactcagttttttatagataaaaaaagcagctttcttacagtactaagaaaaaagatttttttttctgttttaaatttcaaactcaataaacacactatccaataatttttaaattccagtaaaaaaataaactttactttaaaaacaattttaagttaaaaatataaaattattaaatattttttaacttttttaaaaaaataattttaactttttttctagggagactaattttaaagtaactgataagattaaaaaaagtttaatttataattttaccttattttataaaattccatttacgaaattagtaacttaaaattattgaaataagttttaaaaaattatcttacttaacttttccgttaaacttgttaaaataaatttgaaatattataaaacaatttcataaaatcaaataaatccttcgagtcaaaatgaaacggaaaaccaaacataatagtactgcttaaaattaaacttgtaaaagagacacctttcaaattaagaacccatgaagtatatatatatatacatacaccatcctcttatgccgaaattcctctaaaaagtatatgcacctgtctctcataccgaaaaccctctaaattgcatttataccgaccttcaatacttaaaatccttatatattaatgctcttcattttcacttgtcttctttttttatgagtattttcatgtgtcttctatttcacccctttctggccggaccttattaattaggaggtcatctagaaggccctttaagaatttcctccacaaaactcacatgatggttttcactacaagaaaatattatacttaatttttttaaaaaaaacaagtgaaacagtttcttagaagaacttcaatgggagtgttattttaatactgtattaaaacattttcttagctctctttattatttatatgactcaatatatacaataaaaatatacaacaatatagaaaagttataaaagagtagggtattgtgagttctaaaattttgtgagttttttagttggagaaaaaaattaattgaattacttaaaatagaagaaaatataatattatgaagaagtgtgaaaaatataaaatattgtattaaatatagaaactcatgtgaattagtcg

SEQ ID NO: 3629 - DNA, 1000 bp, Glycine max
  Soy_ogl_6745 Gm20:34498901..34499900 Cluster 14
ccattttcacctttcttgttcatcctctctcgaggaaatgtccatgaccaactctccccaaacctccataaccattgcaccccaactccaaccaacaccattgtcacaaccattgaatgccacctacacactacaccaaacccaccatcgtgtcaccacccaatcacccaccaccaccacatgcatcactatgaccccatgaacctccacatcacaccgaaccaccattacgtcgcaccactcccatataattacggatccagtagtgtgtattacaaatgtattagaaattgagtaattcacaaaacattagtttgtattattgaatgagcaatccgtaatacaagcaaacgagattatacatctaaaattgtacctcaaaatcagaagggacaaaattttcccaattttgagttagaaaatcttatttcaagtgtgatgattttttttaatcattaaggtaacaaaaaaaatgttattaactataatggaaatatattttcattttgaattttgtacacctcccccgtattataacggaaatacattttgattgtatattttgtacaacaaaaacaatcatgctttcatgagaaaggtattttggaaataatgaaaaaagctacacgtacacatgggtagttcaaatagcattattagagtgctaatagtagctccctaaatataaactaatatgggctatacttggcccgtatcatacaggcaaaacttgggtcgcaattagttactgtagtccttcataatttttttcctgctcaataatttcattctcaacttctgtgttgagatgttcaacacatataagtatgaccgaaatataacttgaatttgtctaaaatacattaggactaattttcttaaattcactctcatcaaaagtattttttgagttggatttggtggttggacgagatggaccatgaacactcctaagtttcaacaactctaacatggatgcatatgcaaatatacaataagt

SEQ ID NO: 3630 - DNA, 1000 bp, Glycine max
  Soy_ogl_1757 Gm06:1256201..1257200 Cluster 14
aagttcccaggattcagctttccaaatggtctcttaatatactgccaaaaactgagctttcaggattttcattcgagcttcgggtgtcacaaaactaaatatttacaacacattagaacgaaaattttatatagaattctttaagtatccaaaattatcagataaattattggattatgatagatacacattttatatgcagacatattaatactttttttaaactatatatattaatacgttaagaacgagaaaaatatttctatccgaatgaaaatttcgtgtcaatgcaaagtgtacaaatttataaactataaaagaaattatttatatttttttataaaaatataaaaaacttcccataaaagtatcaataccaatttataaacataataataattatattatgtgttatattttttttttgagaagatattccgtgttatataaaaactattcaaatattttttttcaggagttacctatacaaaagtaaatattactcgccagtttttttttttccggagttgaatatacagggctagtttttatttttatgccagggccagttaaaatacaagttaaatatttgtacattttttaatgtaactaaagtcttaaaaaagtatttggcgtcagttatttaaactgtgatatatcattgtttttagacactctacaatcacactgtgactatgtagcaaaaataaaaataaaaatatcgtgactataattacaattgcattggtcattgataattttgtataatgttaaggatttggtaacttcaaaaatcaaaattgttatcgcaatttaaaaccttgcagttgtagcaacaagcaaatagaggcacggtttccttgtgttgaaagaaagaggggcagcagagggtagagggagagaaacagacaaatgcggcacgtgagttgcacgcgtggacgagaatatagatattttgttttatttttttgttataattataaatttgtttttgttaaaa

SEQ ID NO: 3631 - DNA, 1074 bp, Glycine max
  Soy_ogl_3322 Gm10:2467727..2468800 Cluster 14
aatatataataaaattacttataattacaaataaaaataaataaatattaataatatctaaccatacaaaattatgcaggcacattaataattaagaaagtacaaataaaattattaaatttttatcttttaaataattaaaaaaattaataaaatatactaaatatcttttaaacacttattaagagtattatacataaatggcttaaatacattttttcctttaatttagaggttttttcattttcgatattgtaattttttttcttttcattttagttattgtaaaatatatatattattcctaaagtattttaaataaaatttttattgtttaaaacattttttaccgttaaaagtgttatcaaaacacttcaagaaaaaaaacaaaaaaaacatattttacaagaatcaaaatgtaaaaaaaatttacaaaatcaaaattaaaaaaacactaaattataaaaaccaaaaatatgtgtaactctccataaatttatcccttcaaaccacgttgaggcaaaattatcaaaacgttgcttgtctctcgacgtatgcttacggtgttcagggtacatagatcacaaccaaacaaatgatgtctgagggccaaaatgaagctttaaaccaaaaaatcccaaacatgcctttacagaaaagaaatttttaccaagacatggggtcttgtattaagtactttacatttgcacatggaatgcgttgatgtaatgtaagtattataagtttgctttgtgtgacgcgttgttcaatgaactagtggttcacacttcgcataaatataggatcttggtagaccactggggtgttcgtaaacctatttcatctcaaacaaatagtgagttgacacccattatgttatttactaacaaataaagagagagaaacaaaaatacagatataataaattttttaatatgataaaaatattaaataatatttaaaatattaaaatatttatataccattattcttaattttatcatccttcttaacccatgcgatctcattgggtattatgaaatgaagctatattttaatggattaagcaattaa

SEQ ID NO: 3632 - DNA, 1047 bp, Glycine max
  Soy_ogl_4864 Gm15:2139121..2140167 Cluster 14
atgaaacctcgttataaatactaattattttattaaaacaagtaaaattattatagtgcacagctcttccaactccatgagaatccaatagtcaaagaaggacagtgtttaaagtagagtagataattttatatcctcttctcttatggtgtatttggtatgaaagagaagaataatgaaaatagaaatgaaaaaaatgaaaaatttgaaaaataaaatgataaattaagttatttgattgaaaaaaaataaaaaaatatactatttccaaacttatttttattttatttattttaccgtacactcaaatattatattcatctatcaagccaagccttattttttgtgagcccccaatcaataataatatacttttgcaggtacaggcattcagtgacggtgagccacgtaaaattaatgtgacgcgatacccaaaccctgtcctgggcctttgttgaggtgggtccatgctcacattatgtgccggaaaagacaaagtgctaaagcccacgtttcagcctcggttccataatggcatcaaaaactaaaaaagttacttaagtttaatcaaggcttaattattcattttatcatcattttattttaaataatttagtttttctctatacttttaaaaaatttaatttaattcttatgttcttaaaaataaattaatttgatctttattttttttaaaaaaattaatttgattttcaaattcttaaaataaattattttaattcttaaatttttaagaaattgaggagtaaattggttcatttctaaaaatttgagaatctgaacattttaaatttgagatcaaatgaattcaagaactttatgattaaattgaatattttaaaaattaaggaattaaatcatttaaaataattgggggattcaattcataattaaggcttgaatctaatgtaaagatagtactactatgtaatattaattcaaatcaaattaattttttttcttttaatttagttggaactagctatttatattttaatttgttttcttatgattttaaaattactt

SEQ ID NO: 3633 - DNA, 1100 bp, Glycine max
  Soy_ogl_1070 Gm03:43495501..43496600 Cluster 14
tggctaatttcggataaaaaatgtggctaattatgtgattgccaaaaaattaatgcttgaaaaatatgaaattattttttggttaacgtgtgctcctcattatttgaatatgtttttgaatgatagtagtattatgcttcatgttataaaacttgcatcgaagacttcaaaggtaactaatttatgtacaacatatgattttcttatattggctcaggagaagaaatggtaaccaatttcccagtgttatctttccaaatttgtttgaaggcctcgagtaatccttagagtaatattaacaatagtatttattggtagttcttttttggaaaagccaatagataaatatattaagagcaatgctattttgcacgaggtgcagctagcacgaaacacacgaatgcatgtatgaacggttgttatttttttaaaataaatattaattaaaaagtatagaaaagtatcttttaatagaaaacacatgttcctctgtgtccgatgaatcagcacgtgtaccaaatatcattttccatatatcaagggttttataaccagtattcttaaagtattggttagaaaataaaaaaaaatataactttatccattctaataattttttttaatttcttaaacattatttaaataatatttttttatcttaagaacactttgttaccacttgacttgtattaataaaactcaattttagccaagaagtgtctaaacataaaagcccaatcgtcagaattacaaagcataatatattgtatgttaatagtatttattggcagttgacatacttagaatgatagtatacaccgaactaaatctatggtattagtttataggtcagcgcaatgaaaaagcttgacccatcacaagtttagattgggttgggctaatattttttgcaaattccccatagtctgaaaagtagacttaaaaaaaatctagtgacttgtaatgatttatagatttttttttttttatgatcatgaaatatttttgtcagagaaatatttgacttgttgaatttgcaatgattttttttctaaaaaaatattttttttaaattggaattgccaaaataatgaaaatta

SEQ ID NO: 3634 - DNA, 1000 bp, Glycine max
  Soy_ogl_2147 Gm07:3143301..3144300 Cluster 14
tcaagctatacttgcgtatgcaattttttcaagcatataaaaattgattctcaaacgtacataaggcaatagaagaatgctaacataaatgttatttcttttttgtgctatacttaaatgtgatttcagacgcttaaaagtaatttcctttttcgtgtttgatgtcctggaactgccaaggcaataaatttcatgttgagtttgttcaggccagtcatgtgggatgcagcgtgttaaaaaaggctcttacagaacgaagatgttaaagacatatctagtgagctatttttacagtctatgtggttttttttaaagaaaattcacataaattgtgtattttaattttaagagctcctaggagtaggttttaaaccacttatatatgcggagcttatcaataaattcagttatctcatttttctttctatgtttagctgaacagtgaacatacccaagcattacacagtcaataaacatgttaaaacaatgttataattttttttaattattatggtattataatttgtcttggtataaaatgttgaaaaaatataaaataaagtacaaaagaagttgaagttggtatttttttattatcaaataacttataatttaaaatcaacaaacaagttgtactttttttaagctcatagtttgaactttaacttcaaatagtagcttttaagttaaggacaagctggccatacataaataaaagatattataaattgactttatcatctattcttaaatgtaagataaattacacctacaactcatgcgctttgcattattttagttttttcccatccatttttgtgattttccgcattttacgaataatttttaaaaaatttgaaacatattattcggataaacttaaaaagtaacgtatattaattacattaaagttttcccgctgaagataataacgatagagcatgtattttgtttttttagttacaaaacgatatagcatgtatgaggatttgctttaatt

SEQ ID NO: 3635 - DNA, 1214 bp, Glycine max
  Soy_ogl_4901 Gm15:4104101..4105314 Cluster 14
tgtgatgaaaattttattaatgttactcacaattgtatcatttgaaaagtttattgacaacaacaaaggtatttattattttacaacattgatctattttttaagattttataattgtgttaatatattcttacatgttatttatatttggttttacatgagatgttcgtggccttgcagcacacgcagtagactcttgcttgcaaaattgtctggacaagtagtaataatttgttatgagaatcttcatgaacaaagttattaaaattattagaaaaaaagagagtattcatgcattatgtaataaacaaatattaataattgaataacatttttttatttttcttaaattctttgtccaaatatatttctttatttttctttttttcacatattatcgaatatgtttgcaaatcaaattaatgatgacaataataattaattagatccaaatgaaaaagagtggaaaaatattaatgaccaacaagttaatagtttgtgaattttttatgagtttagaaacacatttcgcaaaataagtcttactgaatttttcttttaatgttctcccttgtataaaattttgtttaaataaaatcattttcaacgatcaaataataaagataatatattataaactaactcttttgatgtataatattcagatggaaaagggtacttgcaagcggtatagtgcacatgtattttactcttgatcaatattgttaaataaaatttgtctaattttattttgatttatataagtgattgttgtaatgagttgcaaaagagactcgatagaaggcaaaattcaaaatagagaaacatttctaggataatatatagtcatttatatgttggagtttcttcataatttttgaacaaatttatcataataggagaatcctgctaagttatgtagttgcttacaagttatttatcgatttaatgaaaaaaaattaatccaacaaaattttctttcttgttgtgttgaacctcggtttcagtaaggaggttacaatgcataccacagtggtcgctaggttgcatgtttctcctctcattctctctcttttctaccattaaattgttctattagattgtttgtttctcctttgttcttcctttttgtttgtaccaaaattttccaatttttcatttttccgttgttattgggattcctttttcctcttcattgaaatacaacaagttta

SEQ ID NO: 3636 - DNA, 1104 bp, Glycine max
  Soy_ogl_6868 Gm20:39425301..39426404 Cluster 14
tatagaggcgagtggagtagataaggtgagtaactattaccagtacacacggatattgaattaagtccaattcagcaataatatatcattagaggctagaacaggttaaaatggaactgattgagttgcatccatttaagttaattttgaatttgtaatctaaatggaaccaatttaattaaaaacggtttggataaaataaaaaattgaacggccaaataagagaattctatcataaacggctaagaggaatcacaggaagtgcctcacctcaaagccaaaaagaatacatatagtgctttgtagtataacataaatgtgaagaccatataccgttataaccacacagcagaaaatttaagaaaaaataattcagcttaacagttatgcactggcacttgagtaaaaccgtatataaaactattctatattatgagtgcacaatcattttttcttaaaaaagtactaagatataatgctaattaaatattgagatagagaaaagtttgtttgctaattttataataaaaataatgctactaactaaatttagtaatatttaaattattttattatgcttcgagtatatctgtatatgtattctcgggaattattcacatgcacacatagataattttcatggctatatataaatttatctatataaattaaatatagatcgataagtaaattgacttgagttgatcgcttgaactttaaactgaacttgtatataaaaaattgtttaaacttaactcaattatgtaaatgatcagtaaaccttgaattacttgattttagacttggcttattaacttgattattttttctttattgcatttctagctccttaaataaaattttgtttcttaacttagtagtaaacaccctcatgttaaaaatgtaaggttaaaatcgtaacaaaacttataaacattacttaattaagattgaaataaattgttgatgatgaaaatggtggattaatttcttttaaaaaaattagtataatctattaagattgatattagtcagaggtttaattgcatttttaagtctttctggactcgattgcacaatttttagttccggatgctttaatta

SEQ ID NO: 3637 - DNA, 1123 bp, Glycine max
  Soy_ogl_6911 Gm20:41727178..41728300 Cluster 14
gtcacgttgtgggtgtcttgattagaaatagattttttttatgtgtgattagaaatagaattttgaacaatatgattaattttttttaattgattaattcttcaatgtagatggaatatgtaataacatggataatacttcctctttttttatgcataagatgaatagataatattgatgagttatgagaccatcttgaacgaaaaatgtttgatggatttcgtaggataagaaaaggtttcttattttcttttgccgcttgagcaaatccagttgacactatcggtttcttaaattttggtttgcgtatcatatataaaagtaatgcatctctaaaaaaatttaaggataaaaaatattttttctagtctaaattacaagaaaaaaaggaaagcataattaagtgaaaaaatatgtgagctgtttgatattttttatcattcaaacaaaattatgtataactatcacaaatataatgtgacattgttaaaatcatctaaattaatttaatatactctaaaatagaagttggtatctttaaattttgactatgggagatgcctttgcgcttgtgtatatactatttaatgagtatttggacatttaaaacttgctatcgcaaatagtagttgtattatgtcttttctaactttattatattaatcaggcaaaatattaggtgcgtgtataccaaaagaatattaggtgcatgtataaaaaaagaatatttggtacatgtcctcattcttggtttgtgttcatcaggctctactcaaggcatttttattcgtaatcaaaacagttgcttttttgtttgattattttgtctcacttattgatttctatgctattgagatacatccattccttggtaataaaaatttaacgtgagtgcaattgtgttgataatttccagacggcttcttgtttcatttcgattgactttatcaaaggaaaaatattaataaggaaaatgtagatcgaatccaaatcttggaagtctaaatcaattccttgtcttgctttgtttaattgcttgtgtaactctgttttattgattgtaaaattctaaatttgcaaaaaaaggttagattatgattcgctctttttaagagttagatta

SEQ ID NO: 3638 - DNA, 1200 bp, Glycine max
  Soy_ogl_2679 Gm08:14262601..14263800 Cluster 14
taattgaaattgaaataaaatgaagaaaacttgggagccataccaataaacacatttggcacctgttctaattccttcactgtattcctgaaattgaaataagcaatttgtaacgagtttatgacaatgtggaaatgtgatttgtacctatggaaagtttgggatggtcgtagaatacaacaaatgtgatgcagcgcaacaaaactttaaattgaaattaaatttcaattcacagtgtatgaaagtgtggaaaatacaatttttaccaaatcaatcattaaggagtttatggaggaagaagagtagagcaaaccgtattaaatttagggaacaagacacacgcacgattgattgtcttgaatgtgacgaaattattcctgtaattttagattttttgcttaaattattttgctaatatgactaatagcctaaatataattggatgtatgtgtaaagtgaatttacaactgatagtgtatactaattaatctcaaacttaaatttataaatataaaattaatttcatctaataaaaatatccccgcacaagttaaatgcaagtgtatctgaagtggtgtatgatgtcataccaaaacaaggtagtgtatgacttgatttttttgtaatttttctttaaaaatagaattataagttttgtttaataaaagatttttttcattactatttttgtaaattatgtttaaattgattttttaaacaaaaaatgaagtaaatactaatttaatatattgtgagtgatctcatgattcatgaaaatagatatcagtattatcttccagcaaataaaaaatgatattagtatcatctttcaattagttgttgataaaaaaaatttagtttaggatatttttttaatttaagatatttctgattagaattttttgagatagtgaggtactgaaattcatttaaggaattaagctctctcatagatatttttttatattgacaaatttaggattgaacccctaataaataaaataatatattaaaaaaaaagaataacatcaatatgttatttaatattttgttttcaacacttattttcatgttgatcatattaaataacctaaacttagtcattacttttttttgttaaattagcctttaatcctctaatttatctaatttattttcaatgttcaattagatcctctaattattaagtaattcaattaa

SEQ ID NO: 3639 - DNA, 1139 bp, Glycine max
  Soy_ogl_4468 Gm13:35939401..35940539 Cluster 14
ttacttctctcaaaaaattatttcctgcacaaccaaaaaatcaaactattgtaagcatatttaagaaacttaatcatctattaattatattatactacttaaaaagattgactacaataccactcgaatcaataattttgttggtatattagcttatatttggataaacatttcaaatgtatttttgttctgtactgaacatattttcaattcagagaagaaaaatagttgtatctctttaatctgatgtatttttagaaggactccacctctatttcaaatatgcctttcaatggtacgtcatatgaattttaaaattatgtaccatgcattttttaataccaaattactaaaaaaaggaagaaagaagatatattgattcacgtttgtgaaatatgagggtaatattataagaaattaatacgttcttaatatcaatgagttgttaatcttttaagcattatatgctttatttttccgtctcaaaatatgccttttgtataatgcctttttggaggattttttcaatcatatttcctcccagtttttagtctttcttttggggtctccccattaccacataaagaaaaaaaaaaaaagaaatagtgattctgttgggttatctaaatttaggatatccaattattcattaaaagaaaaaaaaaatcccctctctaccaaaaaaaaaaaaagatatctactttagtaaaaaatatccattagtcaaaagttccgttcctatcaaatcgaaagaaaataaaaagcttcaaataaattttcacaatatttccaattattagaaagggggattgtgcatatcaaactctaccaaagtatacataaataattttctaagtgaacctttatttttacctgttaaaatataaatgttttcactttaacttttgaaaaatttgatatcaatttaatacattgattacacacagtatctattgagcaaggtgaccaatctagatggaaaagaaaaaaacataattaaaaggaagattttaataaagatgaaaaattagtttttttaagtttagattagttatcaacaaaggttatatttgacaaaattaattaaaaagttagttaaaagttggaaagttgaaaaattatttttattaaatggttgg

SEQ ID NO: 3640 - DNA, 1068 bp, Glycine max
  Soy_ogl_5287 Gm16:4283201..4284268 Cluster 14
tctttcgcttttcctttgtgtttttttttttcaaagtgcaatttcaatacaaaagtttttcttcaattatttgatcaaatgacgatccagctattctttttaactgaaaaaactagagaaattgtgcgatgcaagtgagcgcaagtgtatgtccatcttttgctttcccacaatgtaatacaagacctgtttatatcaatcattcaattcatctatttttttttttgaaaaaaaatgtaataaatataataagaagaatatttaatcgacataaggtcatgatatagtgattgttattacgtgattatcccgataggccatgtgtatatgagtgagtaattttttttaatcatattactgatgtgaaactgaggtccctcatgtaaagatatcattatgtgtcaagttttgagatttggtctgtcttgtgctaaattttggcagtcattctcttttttcaataagccgttgatataaattttggccaaaaatcttagttgataactaattatgtatagtcatttttttacttacatcttttaaaatactttccaaatcgacttattctcgtgcagatatatagtaattttaataccattttgtactctgtggagatctaaggcacattcagagttattacccacattttaattaaacaaaagttttattatatcccaattataaaatataacaaaaaatatttaactaaatttaaataaaacattataaattacgttaaaatatgtaaatggtcccttaacttattttttattttaaattggtcttttaacttttaaaagttttaaaataattttcttatttatttaattcatgacaacttaatcatttcataaaactgttcgtttttaattttttggcatgattttgaatttttttattgatttaattttattgattcaagatgtgaaattatgtttaaatcattttcaatttgctaatttttttacctataacttaatttttcaaagttttgtctaaattaccattttggatttagtttctccttggaataagacttttaggcatgccattcacttgccaaagaag

SEQ ID NO: 3641 - DNA, 1100 bp, Glycine max
  Soy_ogl_5841 Gm17:41443101..41444200 Cluster 14
acttttactttttaattactcgctattaacaccgataattttagaattgacctaatgatgaatgagaattaaagcaaattttgagaaaaattattttagtttaaataagagatttttataatgaatttttttatcaacatatatgacctttttatacttaaaaaaaattaatagcaaacaatttttgttggtaaccctaaagcttgaactttagtaaccttactcttggccgaccttgtacgtttttttctcttcattttttttctcacattatattacttgaatcatacctatgttttctcccttctctttcttttcctccctagttgtgacatgaatgctccgtttgaaaccattgaaaatgagattcacacaagaaaaaaaaaacaattatttaagtgcatgtgttggaatgaaattaagtgacaacatctaacacaaaaatcatatcaaaatactaaaatgatgtagaaggcataatgataatctgaacaacatgaatcgatatgacataatatcaatacaaacacacccttaatcatttattcattttgttgcttagagcagttttagtagaagaacctatttttaatttttggataatttttttgttatttttgctctaatggtgaactcaaattagatacttgaatttcacttgtgcagaacaaaaaatataaacttttttctttctaatgacattaaaaaatattttttttttacaaaagggattttttttttagtttttcttctgaaattctaacttccggcatgaaaaactctcgagtaagaataatagtaaatctagtggataaaatccttattaaagatgctaatgaaagtggaaagaatgaaccaaatagctcatgtgatccaatcttataataattctttcactttgggaaagaagaaagaagaaaaagtgttttggtacaaaaatttgaacattcatctctttatatactttttgtattagagttttatgttattatatatatatatattctccttttctttttattttttatacaattaaataacaaaaaagtttttttcctactaaaaaacccaaaagtgtatggttgtgcgtatgagctatg

SEQ ID NO: 3642 - DNA, 1187 bp, Glycine max
  Soy_ogl_1902 Gm06:11334701..11335887 Cluster 14
ttgtaatattttgagtaaatcatggttttagttttgaatatgtaaaccgttacaatatagaataaaaactttgatttaatatttgaatgtgtaaaaaatgtaataattactttttgtgtacaacattataataaattgatgcttgaaatacaacttaatgttaaattggtctaaaaaatataatttaatgttaaattgatggttgaatattaaagctaaataacaaatagttttaataacgaaattgttgcactttttacccatttaaggattaaataagaattttcatttccatgggaactaaattattacaactttatatattcaattattaaaatgatcatttattctaatatttttttccaaaaccacccttaaataattaatgtacaaagagataataataatattaaaaactaaactctgctattctcttgtctttataggaaagagaaagagacaattcataacagttattatttatggactaaaataattaaaaatattttaataaaaataaataatgcaggtgacaattaaaaagagtattataaaaagggataataaatttttaaaaataatgtattatatttaaaaatagaggaaatattattttactagttaagagtgtgtttgatatcgcattaaactggtttatagcttatttaattagtttgattaaattaaagtgtttgatagattatcctattttactactttataaattataagttttcagacaagctcataacttgtaatttattatctttgtacaatgtttattcttaatatattttagaataaaatacattttctcttgagagataatattatacacctttctcctcatattttaaatttttttaaaagcaaaacatttcattcaaccaccagaccaagataatagcacagccacaagaagtgacctggctaaatccaataaatgaccaagataatagcacagccacaagaagtgacctttcttctcatgatactgtcatgtattgacagcacccaagccgaacatgcacgacgtttttagtgttgaaggacatttttaaaaattataaaagaaagagtggaaataacaaatgtaagaattcatttttttttcttctaattatgttattgagaagaaacggtgattaacatggaaaactacgaacacatgtaaaaaaaatattttt

SEQ ID NO: 3643 - DNA, 1060 bp, Glycine max
  Soy_ogl_2919 Gm09:815501..816560 Cluster 14
gaaacaagactatgaagacattttctatcatcttttcttttattttattaactcttcgttaaacccattaacatagttttttttttttttttgcaaatagtaattggataacaagagaaagaatatctaaacttcttttacgagatagttaaactatttttttttacatgatagttaaactattttaaattcatgtttttaaaaataacaagggataataattgttttaaattaagtgaggtattttttttaattaaagttgaataattgtttattaataaagtatgaatatacaactgactataatgataaaatgaaagagtttaaatgttatgcacgtataatatagaaagattattatactgttaattaataaaaaaattgtgagatatgatttttaatataattattctaaaaatcaacgcataacaatttttttattggatgaaaatataaaaactcgttatactagcagtgcatttactattcactcgtactttaattgctaaaaaatgataatgccttaaacaactctatttttttatgattgaaaaaaacaactgtatttaagagaatacgagtggagtgaaagtttatattatattataaaaaatcaaataaaatattagagtagtacttgtttttgctcctaaacaaaagacatttaagtatttttttttttttgtgaataagacatttaagtagtatctgttttctttttttaagccaatctattttctattttgaagacacgggtaattatacagctttttattggagcactaattgaccaacggaaatttgtgaaaaacatttacttcatatgcattttcatacagaaaaacattgtcacttgtttcatacacattcagccaagagagaaaatgcttgaaaatctctgtactttggtggaagaataacacaaatagtaagtatacatctttcatatggtcatttaagatatgctttttccaacctagagcatctctcccattcggttcataccctatcgaaagattatgtcgattgaagtctcctttcacatttcttcatcttaact

SEQ ID NO: 3644 - DNA, 1065 bp, Glycine max
  Soy_ogl_4001 Gm12:4742821..4743885 Cluster 14
cttaaacttttgatgtaaattgctaacatgttttaactataaaaaatatgaaagaatattcacacagtcaattacattgaattgagttagattttctttgtacaataatttaaacttaacatttaatttcctacaaaataaacgtaacctttaattaagagatttcatttaatcatctcttaaataaattatcaaatgaactaccaaataatcttcacttattgtgtatattttatttttaattgattggctatgcagtaaaaaaaaaaactgattggttataatttcaatttagttttacatttttactctattgactaaaagaagttcagttatagttttgttatacatttttcaattagtaaatagcaattagcaaagttaagttacgtttggtacaaagttacgttttttttactctgttcgttaagactttgctgttcacatgtctccgtatataatttcatttttttcaataaatatttattattagtttatcaatttattattagttgaagaaatcaaattcgcgtctctacagataacttcactttaacttttactttgattcaatcttttgatcaccacaaacctataacaggtttggtgagtcctaaagatcttataaagcatgacttaccatacaggtatataaatactaaaagacgattatgatactaccatcttcagggattcaattgaaacaaaacaaaaaaaagttataaggacctaattactgatttggtaaaagttcataacctataaaataattaaacctaaaaaaaagtatttttgtacatttcaaaatgaaaaatcaggggaataaaatatacatattctgatattatatgtagtcttttaaaagctaggaatgcacatgaggctatagtatggatttaccactaataagagtgttcccatctaatctaatgaaaataaaaaaataaaaaaattgaacagacaaaattaaattttgaaaaattaaattttttttattagattaagtcggatttcaaatttaattttcaaaatctatccaattcaaatctaacttttacatatgta

SEQ ID NO: 3645 - DNA, 1057 bp, Glycine max
  Soy_ogl_5832 Gm17:41246054..41247110 Cluster 14
aaccaaatactttatttgaagaaacaaatccatccttggcgatttagtttgagcgtgtatgttgagttgaagttgtttatttgttgtgtactgttgtcatttttttttttctttagcatcttccattttttttttggaagtgttgttggatatttttaatgaataatcctttgacagaaaatttaaaaaagcgacaattatttgctctcaacgttttgaagtgctgcacaagctaaccaagcaaaatgtaacccaatttatgataacacgaggagatataaaattaatttaatgataaaaaataaataaataaaagaataggtagtaagtttgaattattttaataagaaaaactaataaatttataattaatatttgttgatgaaaaaaagatgatagcctattttacatatagtgagtaatagcttgaagaggaaaaataaaaataaaataatagcaagttgaaataacagtttgataatgtacatattgttgtctgctagtatgaacttaacaatgtacccgttagcaatattttcaaaaaaaaaataaaacaaaaagaattgatgatactttcgacactttgtaagttatcaaacccaagcaaactaaatgcataataatctcctcagtgacatgtcaaatgaaacaattaattgcagtaaggtgggaatataagcaaactagataaatactttgattaagagaggagggttccatcaatgaccactttcaaaatagaaaatgaaaaaaagatggacgtgctttctaaatagaggaaaataattcataagtatggctctaatcttaagctttattctatgtcacggaaaacatctcaacaacttttgacatgatgtatcttagacatactacctaatacaactttatttttatttcaccatgttttggaccattcaaaatagccaactcaaccaactcttgaagtctgaactacaatcttatgatcaatttcatgcaagtgcctcactaatcaatcaataattgcatcaacctttatttattctgtaaacaatttaagcgaaattataattaa

SEQ ID NO: 3646 - DNA, 1021 bp, Glycine max
  Soy_ogl_5864 Gm18:1333280..1334300 Cluster 14
tctaatcttaacttaaatgttgaaacaccattgtgcgtgagctataagttgcgtaagatgcaagcgagagcatcatggctaagtgattctcattcacttattaaatgtgttacaaaaatttcttggcattggttatattattaaaaatgttataagaacttctccgtgacttattgtaagggttaattatcggttaaattgggttgagtttaattaagagattttctttccaaatattcgtcgggtcatattttgtttttcatttatatcccaaaccaaagctattatagattattcgacagagctacatatggttagattcatgtaaaaaattatatataaaaaaagttaacacaacaaaagaaatcaaaaatatgaaattatgggaaaatatcaaatatgtatgaaaattagaaatgctaggaaactactccataatctccaaatttcatcagacatacataataactttagaatacacaagttgaatggctcttccgaattccaatggaaagactatcgaagaggaatagaacaaccaaattctgctaacaaaaaaaaaaaaaagaacaagcaatttctccaacctctttaaaatggaacattaaacttagtattttgacttttattttatttttaattaaataatacaaaaatacattgtttatctattgagagggaaataattggcattagttataatgtgttttgtgctgtttcagttaaggagtaattatatttttttaaaaatgtataaaactaatgaatatattgttttgttattattattattttatttaaaaaaaaatatttctgttaatgtgtatcacatttggaccactaatggcctgttagacttatccatatacgtggtagacctcattaaatgtcaacgattgagctcaacactaacatgtatggtgagtggctgaaatcctcatcaaaagcatattataagatttttttaaaacaaaagaactgttcacgctaatgataagctttgtatttgctgaaagctaac

SEQ ID NO: 3647 - DNA, 1000 bp, Glycine max
  Soy_ogl_4140 Gm12:38097101..38098100 Cluster 14
acactccaaaggacatcccatccagtttgatgcaaaggtaatttattgtctcccagtgcttgcaaattgcaactatatatacattcaattaatatttgaagtcctcacctttaattgcatcaagtacacataagaaatctctatgactacatgatgtgatattgaagatagaagatccattaattttttgaccaagattttcattctcagacatctacttccttcatgtaagatttccattatcccatgcaccagcctatatatatcagacacgttactccttaatgttctctactgctatctgattgaaaggttctttaatttcgcctcaaccacagaatcatcgtatcttgctattaatattgctcccgaagaagatcctaggtttaaccttgaaaatgcctccttctgcgatcttcaatcatatatatcagcatacgttctacaattcaatcgttgttgtcgcaacaagaaagaagaagggcattattctgataataattgtcaaaaatatatcactaagttcttagagagtagtgcgggggattttagaaattcactcttaggacttagaaggacgggtttcaagtttaatagttaaaaattacctgacaaaaattccaagcattttctaaatttgcgttaatatccaaatcaagtttttatagtaaactgttttaattcctctcaataaatccaaatatattaacatttacactgttttttataaaataaaaaatgaaatgtttttatatgttagttaatgataatagtgtacatattaaatatttagaatataatttaaaagtatacaagtgtaaattttttaaaaagttgagcacttttgtatttagtggggcttatgcttcgttgaaaaagtgtatatatatacaacatttttaatatactcaaatatgaaattattacttatactaaaacaagttgtgttagtggattaaaatatgcatttccaacacttgaacttgaaattttttattaa

SEQ ID NO: 3648 - DNA, 1100 bp, Glycine max
  Soy_ogl_5583 Gm17:8330101..8331200 Cluster 14
ttaaaataattgaatatcaaattcacaagaaaaataccaaaatcgcaaaataacagtaatagggataacaaattgcaattaagtctaataaaaaaataacaagggaaaaatattttcaatatcatgtaatttaaaatgtatatttgtgatttaaaaataaataaataatattctctaagaatgttttattactctttttagaaagaggttttagttttctaaaattaaaaaaaaaaaactctttacactaatttatcatcgtaattaagaacatgaagctcaaattgaatacccttagaatcaaaccaacaaccacgaacttggtatcaagttgagtgtgttgtagatgttgcacttattcctcgagcatatataataaaaagttcaaccattgctcttgctaatgaagagttggagtttcattgtgaatcggggagctttgtgattattataaggaaaaactcatcaaataaaaggagggttcagaccattattgtgaacttagggttttggatttgaggaagaaaaaaaaaggtgcatgtcaaggatcgagttgaagggttcaacaacaccggagtgaagttagggttgtgacaaaacgacaatgttttgaggaagttatgtgtctggtgaatgttatggtgttgtgcttggcgtactcgattgacatcacattgtagtagagtattatgttttcttcactaggagagatcaaggaaatctagattaggaaacatatgaggttttcttcttttttttggttttttcttttttatatatatacaaaaaaaactcttattttaaagataattttcaaaatttgatagattttacgtgagaaatcaaccgatgagtagcataaattattttcaagataaattttgaaatgaaaatgtagaccgaaaatcatataaacccttaattattttgatctatttatttttaaattagaataataaatatttataacaacttattctttgatgtttagatcaataactggcacctttttttagaaaggatcccctaacatttagagactaatcaagtagctgcaaatctgcaattaaacgaaatcatttagagtttggacttgtgca

SEQ ID NO: 3649 - DNA, 1000 bp, Glycine max
  Soy_ogl_2138 Gm07:2772601..2773600 Cluster 14
cactttactttaattaattttttttcttatctgctcaaccaaacaaccggtattttcgataccaatttgatctttattatttcctgttcagctccctttcacgtgataaatatatataacaaataaatagaacttgaccctaacacatgcatgcccaccttgtaaacgtgactagcatatgtagtgtactcctaatagtccgttactaataaaagagtgggttagagtgtctcactgaaactgtctaggatttaaaagtttctggtttgggatttgcccataggaaaaacgtaactaattaaaaaggagagattatattaaaaattattattcaagttttttagtaaaaaaatactacttacgtactaattaatttaataaatactttacaactgtaacctgataaaaaaaaacgggcaaatttgaaaattcaatacttgcatcaatcaatcagtctaattttaatttattagctactccataaaagagacttcttacgtgagtgcacaaatatatttttttctttaaatttttttagaagtaataatacatgaacattcatatcattatagatacataaatgcgcatttaacaactttgttttctttctatcttcaaaaatatttttttgaataactttaagttatctacagcttgggaaaggaagagaaaaaatataagtaattaatttaattaatgatgtagtgtgacaagaaaagagagatgagacaaaacagagttactgcttaggtgtttgaatttttttattgtcaagtataaccacttttttatttttatctttctatcatatttataactttttttttgtaaatactcattttggtccctggatgtttaattaaaaaaatacattttaacatttctttaaataaataaaaaaatataaaaaagtgtgaaacagtactagattgatttttaaaagataaaaaaattaaatttaatttctaaatgtgtaaaaagtgcaacaagttgattctac

SEQ ID NO: 3650 - DNA, 1084 bp, Glycine max
  Soy_ogl_3492 Gm10:41001317..41002400 Cluster 14
cacacatacaatgcacgagatatgcacataatattaaatattaattgattatataagtaaggcttaatttttttatcaataatctatagtaattctttgatttttgtcctcaaggttttaatagtgcaaattatattttttagtatcacgattatggaattttaatccctccatcaatcttttattaaatatttaacagattttttttacattataattataggttgatgacaacaactagtatgcatatatgtttattcgatttaattacgcttttggtctctttgatattagaattacaagaggttaaaacaataatcaagctaggttagcatgtgtcggataaaacttcagttgtcatgttaatatttagtgtcatgctagtacaatatgtcaaaactaacatacaaattgacataaactaaaatcatatgattacaatagattcagaacctaatttgtgcaattagaatataagaaactaaaattacataattataataccaagaaaccaaaaatacaattaaacttataagtaattaaaaataaagaaggtaaattatcttatccaatcatatcattacatgagtaatatgctgactatataatattttctttacaatttattttgcaagtaggggtaaaaatataaagagggagtgtgaaagtgtgaccaattaagtgtatttatattttaaaaaataacattttgttaattgatttttaggtttaagtttgacacattacatagcctactaatatttggcattttcatataaattaaagggaaaaatatatttttgtccttgtgttttttgttaaatatgattccagtcttgttctattaaactgattttttttttagatttagaaaacatgtaaatttagaccttcctccaattttgtttcagccaaaaatagtcactaaattttaagtttaaacatgaaaaatgaataaattcatataatttaaaaaattaaaggactaaaaattaaatttaaccaaaagtacaagtctacaagaactaaaaacatttttgattaaactataatgattatatgatatttgatgaatactatggaa

SEQ ID NO: 3651 - DNA, 1000 bp, Glycine max
  Soy_ogl_5258 Gm16:2757301..2758300 Cluster 14
acgcaaatgagcgaattgaaatatgaatttcaacattaaaatatcctcaccaccacccacgtgttttcgtcttgtaaatattgttgaacatggtgttgaaggtcttaaaacatgatgttgtcaggatcaaatatgtgaaagttattatcagtttatcgcaacaataaatatcttattatgacactttatgggagaaaaaggcacaatgttcataacgaagttaaagaagacttatattaaatccatgccttaagggttcaatgtcgaagttgagctgctcttgttcattgtcattattttggttcctttaacacacacacgcgcaaacgtattcgtaataactcggaggaccaataataacgtgaaactcgagcctaaggtggaatggtttcaaactctttggtcttggaaaggaagttaaaactttcaatagtcaatctagtcttaattaaggactaatataataacgttatacaattttaaggatcaaaatgctagttcacccatactatactatcttataaaaactcgtgccaatctcatcctttgactgtaaaagcctaaaaggacacatgaaccaattatgcttatcacaagaatatgatcaacattatatgtttggaatatcgtctagcaactcatgaattatttgatgtaagatcatctaaatcgttttagtttctttatttagtacttatacattagttcttttttcttttctgaaaccttatgtaatgtatatgttattgagatgaattttatttttctaaaaatattttcacgtataaataataattaaatcctaatcacgagtttagaaagaatttaatcatttactaactgtgttggaatttacttgaaagaagaagcataattaaaccaaaatcaatgaaacatgacaattaataaattacttttatctattaatagttttaatttttattattgaataattaacatattaattaatgatgtgacatttaagttgacaaacttattt

SEQ ID NO: 3652 - DNA, 1015 bp, Glycine max
  Soy_ogl_1563 Gm05:2941901..2942915 Cluster 14
atacacatttaacctttgtgcaaaccaataatctgtgtatactaaagatgttacacacttaaacgtatcctcaccggaattaaatcagtggaagattgaaggaaagaaaaggtgagctcaactgaccttccagattcgaattgacaaatataattccattatcaaagaaaaatagagttacagaggcattgggagcactgtgcaaatccagactacttaattatgttggctttttaaaatcattgatggtgaggtggattttccccctaagaaaatgcccacaattaaaataggcataagaaaaggatagcaggaagtcctgcagggaaagagaaaaatgtattataaagatggtatgtttgattcttttcttattcattggttttaaaacaacttcgcattatttaccagttaatttcttatttaatatttattaaattttaaatttatttctaaaataaatattttaaaaattaaaaatgaaatagttaaatatattttttcattttcttttttcttcatctagtccaagcttacactatattttgtgtcttgcactaacttccaaatgaaaaataaaggcatatagcattcagtcactcagaaattggtattgcaattccagagatctcacaaaaaactaacagaacttaaaacataataataaaaaaaacttataatattgtagaagtcaagccatattcctaggcacaagctcatcagttttaaatttggtcccaaagacggtcgggtttgggttcgagttcaaatttaatataactatacaatatacgtataagaggggaatttctttctacatataacatttttcttgtacatccaacatttttttgttttttcctaaattactcaaactaaattcatatgatttatatagattcgcaatcagtataaatcatacggatttaacagggataattttgaaaaaaaatgaaaaaatgttgggtgtacgagaaaacacaggctacaggaagaaattcccatataagtgttt

SEQ ID NO: 3653 - DNA, 1400 bp, Glycine max
  Soy_ogl_3339 Gm10:3083301..3084700 Cluster 14
ctcatctattcatcaccaacatcttccaacaacacaaggttcctgtgatagatttcacaggatatgatgatgatgaaaattgttgtcacgggttatatatttttaatcgtcaaacaggttagtttgttaattttgttataaatatcagttggagagattcgaaccggtaggttatagatagcgagagagatttgcgaggcatcagaaggggttctttcagatggtgaatcatggtgttcctgctagtgtcatggatgagatgttaagggtcataagaaagagtggtattctcgtgaccctaaggtgagagtgaggtatttctgcaatggagatcttcttgtggccaaagtagcaaactggagggacactataatgtttgatttccaagatggtcctctaactcccgactgctaacaagggagagggagcatgtgttgcttaatttaatcatatttagaaaattttctttagtaaccattcataagatataagaaaatcaaaaattgaaatgaagaaagttaaaatttacttatgcaacttagttttcaaagactatagatgaaagagtttttataaaaattaattgtataaatccattttaattgagaagtttaaatatttaatctttttttttctcttttaaatgtttatagattatgtttaatactcaagtaggacattaatgtttaagcactcaaattatttgtgttgaaaaaaatcgttgaaacatgtttctttaacaaatagcaaatattaataagaggaatgcatggttataaaaataaaagtgaatttttttattataagatattatttactgatcagttgtaatacatcttaacatggtttttaatataaaaaaatattttagttcgttaacaatgtcctagcctcaaggtattgatgattggcaaaacccaaaaagtataaaaaaattcacttaatttgattcataaagattggaaatgttagattaatcccttttaaggccattaaattaaagtattctatgtttaaggattaatatatcaactcatgtcaagcctttactgacattaagaatatagaagtttaactagtttataaaaatcacatacaaatgtcatatttaaagattaatatgattaatatttatatttttttaaggagaggcaagattttttgtttatatttttttaaggagaaggcaagattttttggagtgtattattcactattgatcagtctctggccgaaatttcttatgaggtttcactcaaaacgagaatgcatgcgtgtataattggacagaaagaaattcctttgtgaaacttgttttaatttacctgggaaacagggaaacagtgattcaatacatggagcatattttcaaaatgagggagatatattgtcacaattac

SEQ ID NO: 3654 - DNA, 1354 bp, Glycine max
  Soy_ogl_1418 Gm04:45550901..45552254 Cluster 14
tatttctctctctttttttttttactgatgctgcttgtacttcttttcattaaaaaaagtaatcatttttatttaatttctttactcgtgaggagtttgtcattctaatttttagtttagtttaaatatgcttaactaaaatatattaaattcaaaatcaagtgaaatataaatttgatggacttaaaactttgtatggtatattaataaatacattttttctccgtttatagttcaaccaaacaaactttgcagcctcttaaagcctttttttaaaataaattgatgtgagtttttattaacttattgaatgattttcattccaaaaaaaatgtaaaagaaaaattttatacgtatcaaaagttatattaatattccagcatacagttttttttcttttcttttcctttttaaaaaaattacacgttgaagtgtttttatctctcgtatgcttctttttttaaggcatctcgtatgcttctttggtagaagacattctattataattaaagccaaacgtattatcagcgttatagataccttgctgagataatgactactgattggagtttcattggattccactgaaaaagacattggaaggaacataaatgataaatataatacatttttgtccaccgctatatatgttgcagtattttcatcattggacttctcattttaatttgtgtggttttcgccaagaaatatattttcaatctgaaataatcataaatcaattaacgaatccctagttaatgcatgttttacaaataatggagtcccaaaccccaaataaacatgattattattgaatccttgaaaggttatgttcataatattgtttctttcttcttctttgtttggtaataaggttatgttcacaatattgtttctcttctatatctagaaaacaacctttgaatgaattatcccatacccattccatacctcaactgatacacctatgacgcaattatctttaaattaaatcatcttcatactagattttttttaccttttggataaagtcacctttgctcggtattcactattcaattttcatttccaaaaattacggtccctttgtccatgacattttattggcacacttaaacatataattgttccagttccaccacaagaatttaccaaaaaaaaaagttccaccacaagaaaaaagaagatattattgtagacacagatagttttcttgtatatttagggtcgataagtattaatcaacgaacaatatgagccgcgggatcgcttctaattaggaaggccatccttatcctctaattcggtgtctgatatcgaaatgtctatggaatattttaaattcaggaaaatg

SEQ ID NO: 3655 - DNA, 1004 bp, Glycine max
  Soy_ogl_1433 Gm04:46094582..46095585 Cluster 14
caaatggtactgatcatgaaactaaaaccacggtagtttttaataaaaataaacaaataaatggcaagagcaaaagtgaatgttgttttatgtctgtgtgtatgtgtttgtgaaagatagaagtcagagttttgactatgaaaattaaggttgggttgggtcatgcaattgatccaaaagtaggtgttgttgaacacccaccttgctgctattctcacttagtacaatttcccctttgctatgtttagacagtgacaaagatttagaagaaaaaaatgagtataacttatatatatattgtcattgtgaatacacatatttaataggaagtcaacatatcatcataataatcaaccaagagaatgatgtgataaaatgatcaaattatattggatgtctgaatacttatattaacattgtatataaattaaattaaaaataaataaaatattctgacatgtgtacttgctagcggtatttatgtagaaatgtaggagggtgagtataggccatattaagtatatgcaattgtattcatccacattccacaaccgcgttggatgtcaatcttatatttaattagcataatcataattattttacattataaattaagaattcttaatataaaatataagtaatgtttatatcaataactttaattaaatatataccatctcaatccaataacctacataaaaatgcaaaaattattaccaaatataaattgtatgtaaaaatgatctcactcagacacacacaatatgtaggaaaaaaatgcaaataagtgagaaaaataagtaaaaagaattataaaaataaggtgaaaattagaggaaacaattcattcgaaatgaatcacacatacaaaaaaaagcaaatgaaagagaaagaaatattcaaataaaaagaaaaaaaatattaaaatgagtgagaagattatgtaaataagaagaagaaaaatgaagaacagtcatttcaatgagtaggaaaaaaatatatgt

SEQ ID NO: 3656 - DNA, 1116 bp, Glycine max
  Soy_ogl_1729 Gm05:382714..38274623 Cluster 14
tttgctgctctgcctgcatgcgtgttggggtgtggccactctgtctcaccttatccttctaaaactaaattattacacacaatcacattcattttttaataattttcttatgtattaatttatatcaatattttttcacagtcataatatacatcaaaatttaattctactttacgtgtgcgtttcttgttaacggagttatggattaacgtagcactcctttcagtctcaactataaataataaaaataattattttacactaattaaaaaattaataagagaaaaatatcataccaatcttgtgatctagctatatatattttctgcaacaaaaagtcttttaaaattatttccttttatttattattatagtgaaaaggaagtccacattctttttggataaaaagaagtaatatatatatcagcgcacaaaacaaatgaaaagagtgaatgtcacaagatacaagagaaatcctaataagccgaaaaagagtcaaatctagctaggacaacaactgaagaaaagaaaccaaaacaaaatattaaagatgctgttagaagagatacatggcgactcctagaagacaaaagtggtgaaaaacaagaaggatttgtcacagtaacgatgtgctacggcagaagagtacccaaaggaagatgatgacatgccaaagcaattacaagtacaccatgaaaacaactctcaagaaccttaccagagactggttaattgcacgcacattcttccatgtgctaactatatatctatttttcatatttgtcgtatgccattctatatatgccctgtgttggcaggttaatttcccaccatagattccagctggttatatatgtataacctttgatatctcacgtaaagtataaaaatctcctcccctattggtagggagggataagtaagggcataggcctcaaaaaaacatgtatttatcaccattccatcatcatccttttcaaatattaatttattcttaaattgtatttaagttaatatttttattttttattaatgctattcattttttatgggtatttattttaaatgtgagtgtgagaaggagtattatattattatatcgagatttgtcatccc

SEQ ID NO: 3657 - DNA, 1138 bp, Glycine max
  Soy_ogl_5518 Gm17:5118863..5120000 Cluster 14
ctatgtgtctttcatgaaagtgtgatacataaaaatttgaagagctcaatctatttgaaccaaacaagagattccattccaaccgattcaatttcgtttgactctcgatttcgttggattttatatatattccatcaatttatatttagagaaagttttattatttgtaggaagtgctcttcttttctttttatatttcttcttctgaattcaaatgtttgaacttttaaatgtagactcaaggctgctgaataagtaaacacagttcaataattattatttataaggattacctgatcttacaaattagacaatattttgagaaggaatttttacaagttcttttaatctattaggttagagattgatgtcatttatcttatttgactgttattaatttaagaaaattttacataaaatagaaataaaaaagcaatttttttctattaaacaaattattctcacttatatgaatacatgcagcaaaactttacatcacagtaccaaccgtgcatcctttgggtaaaaattttataggttctaatacatgttcttgaattctaagtgtttgacaggataacaagtttttacaaaattttaactgaaagtataaatttttacttagtattaactggtactaccggagaactgaagacgtttgataaaaaatcgaacaataatttgtcagtttgattcgcgttatgcaattcacaatattattacaagtcctcgtaactttttttatttggtatcccttaaatttcgtaactggaatgagcatcaacctctcgtcttctgtgcagaatttttttatcaggacattctgtgcagattaattcagaggaagaattatttttttaaactgtttttcttttaattcgatactattttaactgtctttctcgataattcaacatagaacaaagaaaatgaaaagtacatcacgtaccgaaagcacgtattagacatttatatgaattgaatttttgaatgcgttgtattatacccagacaacaaaaattgagacacgtaataaaataattaaatataaattatcaattgaatttgtatctgcagcctcaataacatgatattttagaaaaataaatatttcactaaaaatattctctaaaaaaat

SEQ ID NO: 3658 - DNA, 1147 bp, Glycine max
  Soy_ogl_6877 Gm20:39709854..39711000 Cluster 14
catcatttcatatgaatggtatgatgcatcctaccaacaatatatataatataataaaaatattacttattaatattcaagttaataaagtacatcatattataagtgtaaatttataatatacgttcgtatagtaatttaatcttcttttaaaaaaatagtttaattttcgttaaatcaatgctatatcaatgaaataaatctaacatctaatcattagttacaactttattttaatgatgctaataaattaaatacaaggctagtttaattaaacctgaactttgctgcatattattatattatataagtataaaatatgtattgataatgttataggggggggatcaatgatataaagtgggtacatgcaatgtacgacgagcatatatagaatgcaattaaattaagaatgaatggttatgaaagattggttgatggttcggttagggctacaatagctgttgggaaatgttggttgactttaagttgatgattggagtaaatactaaataggtgtgggactctgcaactataggcctcaaataataattagggtcatatacaagtcacccttagcgtccgcaagttgccaccacgttcccatcgtatatattccagttctgcatcattttatgctatgcattctgcactcaaaatacattaattattcaaaattgggagcggaaagtagaaaatgcatcatcttatcttactaattattcttctattgtttctggagctaattcacgtagttagggtgatgcttaagtaaatattactactgtaacctttttaagtggaattttcttatttgtctcctctcttcaatttcaacatttagtgattgaaaattttcgtatggttaaaattttaagaaaaattataagtgcataatttctagtaatgattgccggcctgttaataaaatgtcgtgtgttattaaaaggactattttgtaactttaaattttaatatttatatattagtaaaaggacattttttttttttataaaatttcataaaacttattgaatgtaacttcttgttaaatactactattaaataaattaacttctcccaaaaacattgtacgtatttccatttctggtcttcatgcttgctagctatttaaccctcaagaatg

SEQ ID NO: 3659 - DNA, 1000 bp, Glycine max
  Soy_ogl_4957 Gm15:9533801..9534800 Cluster 14
aagcacataggtatatgttttaacatgcattagttggcccactgtaactgaaagttgcccttgttcatgtctcttttcttatgcttattctaattttccaaatgctgattgtttttctccaacctaatcgtatgttgttaagtaggctctttgggttcatgttgattatgattcgtcctataattggtactattatgcatattaccaatttcgttaaatatattagaagttttggtaatgttacccttgtttactggaatatgtaatgattgcaatttcactatttgttgagtagtccaatgtccattgagatcgatcttaacattcattctaattgaatggttccaaaggtgcaaaacaggcttattttggcagtagagagttttagcatgcagactaggacgtgcaactacatgaaaggaagaggaaccttatagttgacttctcgttggtagctttgtgcatttaatttcaaattaggtaattgacacatgatttaacttgcatttggtccgtccattataaccaaaagttgcccatgctcatgtctccttttcttatgcttatttttatttttccaatttctttgtctccaacctaatcatattatgatgctgctaagtggtccttgtgggttcatgctgataatgattcgctgtataattcttactattatgcataatataatttttgttaaatctgttagaaattttggtaccgttacctttttttaatctttaataggtcagtttatttatactaatctgttaaaaaaatgtttattttaaataaaaattttattttatattttttaaaactgtttttgcttaaaaaataatttttcacttttttaagaaacaaattttatctgttttttaaagaaacacttgatgtttttttcataattattttttaaaattttaaaaaaactgacccaataattataacttaccttttatttttgccgcacaatcagccatttaccatgtaactcctgata

SEQ ID NO: 3660 - DNA, 1000 bp, Glycine max
  Soy_ogl_1571 Gm05:3246101..3247100 Cluster 14
tactattcttattcttatgttgtctctataagcagagctgttaacaaaattgaagagacacctctgatgatatttgcacttataaattaaatttttccatattacatcagtactttggtaatgttttttttaatgtagaatggtaacaaggttagaatgtagagctttatgaatattaccataaccattcatcactaagttgactctagtgggttaatactttgataatgtaaataattttatattgaaaaaaaaatagttttgatgaagtttatgagcctatttagatataaaattagaaaagcttttgagtgttttttttactggaaaaagctttgtattttttactggaaaaaactttgtatttttaatatagaaatttcaaaagtttttcaacttatattcaaacagacctttaagaacataaataattattatagatttattaaaaattactcctttgtttattttaacatttagtgtttgctactgaccctcttgaagatttgcattcttgtactaatattgtgtttgtgttttgtttgtatggacgaatgtgcatttttttttttcttttagaaagttagttaacatgtaagttgaaagaatgatatagaacggaaagtgtagaacttagcagcttcaggccctgcctccaaatttaaacgcaagataatagtattaaataattagattaaaataaatgaaaaagaaagaaaatataaaagtaatatatagaggttatattgggcttgtttcaattaccccttttgtcaagtgtctacttgaaagaattttctttttgagagttgttatatccacttttcctctttacttattcagtctcctttagggggaaaaatgcactccctaagaagcattacaaaaaaaatggaagatttagttatgactacaaataaactttctatatatctcttcacagatccttttgtcatattcaaaaaaaattcgaattatagatcctaatttagaactctat

SEQ ID NO: 3661 - DNA, 1096 bp, Glycine max
  Soy_ogl_2178 Gm07:4219005..4220100 Cluster 14
ggtactgttcgtgaaatccatactagggtagaatccgccgtttcgaaagtagatataagtcccctttaccgtaccaaacacaacacagaaatctcttatattttgattgggagtattattgtcatttcacatctaatttattcttttaaaattataacaaatgacactgttcattagaaaatttatggttcatcgatgaacaacctaaggaatttgtccaccctaaaagcttctccttatttaaggtaaaatcaaggttggactttgcatgatgttgtccaaataactatttttctcttcttcccctccctccctaaattaataggtgatggaaaaaaaatttaaatattttattttttgaaatgttgctttttatttcacttagaatgattttattcgtgtaacacatattttgtttgattaagttttgttgctattcttattgaaattttaaattaatagtgtaaatattttttatataattggataattatgtatgataaaataattgatttttgtagtacttactttaaaaatcatgcatagatgtgggactgattaacattaattattacaataatgataaatgtactaacgaatggattgtttaacaattaacatcccatttccatcactgatatgcctacaatttaattaagctaacaatttatttaacaacttgctatatacctacaataaataaaccaacaagtgaatgaagtaaataagcaatgtttttaaagtcaaataaataatgttaattattactactgatacacgagcatattatcattattatgcaattaatgaaagtaataaacacatatataatgcaataaacgataacactcctgaaaaaatcaatgataatactaaaaagtgaaaaaataaagaaagcaaaatgctaatttcataattttttattaatagattaaagaattatattataattggtttcatttaattcgttgttactaacatatttgtgtcattttaaataaatcatatatgcttggaaattgattttatttagttttgggctagttttgcatttgtggacaaaagattgtaggcctaacactacagtaaaataggc

SEQ ID NO: 3662 - DNA, 1000 bp, Glycine max
  Soy_ogl_2909 Gm09:583501..584500 Cluster 14
aaaatatattttaagaattttaataataaaatgttacaaatacctcaaatcatcttatataaaatatatattattcgtctgtctctccttttgactttgactcaaattgacttatagctgacatcctaatatattgaaccacaaagaaatgtcattaaaaaaccaatttatttccaatacaccacaaggtaccggtgtgtgttcaccatcttttgggcacgcaaagaagtaacaaacaatgagagataacataacaattttcaaactaattagcattcgctttcgtaagttgagagtaaaattgcaactagcacgttgggatctcaaaaatttatgcggttaaggatgacagtgaggaacaaacaaatagtaaaatataaaacatgttgtcctattacaaagacatatatgttatgtttatatatataaaaaaagacatatatgttactaaaagaaataaaatatccacttatcgaaaaaagaaatacaatatccaatccaatattatataaaccaaaaaaactcaataatacttctttcgcattcagaagctgaaaatgaaattagaaccattagtatcctaggattctcattttatgcggttaaggaggaaagagagggcaagtgaaaaaaatgtcgtattatacaactgcaaaaacaaatagtagtatatttctaaaagaaataaaaaatccaatccaatattataataaacaagaagtgttctggatattgaaactcattgcagtaattacacatttaaaattaagtttaattcaaagtattaagcaattttttttattaaaaagtatttttctattatttattatccgaaaagaatcacattattttaaatcatttttattataatcaattttgtaaaatcactttaatctaaaatgagttatttctcacggttaatcccatgtaattattttttcacaggaagccttttcataaaactacccttcttgaacttgaataccaggtttaatttgtt

SEQ ID NO: 3663 - DNA, 1200 bp, Glycine max
  Soy_ogl_3648 Gm10:49385701..49386900 Cluster 14
atgaaatcctgagtagatgcaaaaaagatttagaagtagagataagtaagtgatgagagttttgtttgagaaaaaggtgtaagaataggaagacgacaatggagtattattatatgcaacgccactaaacggatgctgagggccttggaattggatcgaccacttgataacttgaaacccaacaacgcctctcaatggacccaaaccgctccaactaaaaagcaagcttccacccttagcacatagttttacttttaccacaacataataaaattaaaacatccaaccctaactttatccataaacaacaaaataccctgtactttccctccaacgataaatataaatgtcttgacaggattttaattcaatttatatttgtaggattaaaaaaatcaaataatttataacaacttatatattttactcaatttctagacctttattacaagatttcaattctttattgtggaatgaaaaaaatatttttgggagagataatttatttccataatttatatacgccttgaaaacttgacagttaatagtatgataaatcaaagtttacccatgatttgcttgataagaaagaaagaaaacttgaggagaaaatttaattgtttagtgggatcttacacctctttttttttctttaatttaaatattaaatcaaattatatattggttgagatttaatataaaaacataatattaaatcttaatcgtttatgattgaatttaatcatttctctatcaaattagatagtttctatatatatatatatataagagaatatgtcggtgaaacaaaaaatatacccttttcatcgtttataacaatgcatgaagcatattaaaattttatgaacgaactattctttgacatctttttcatcggtcaatcacactattatataataaaaaactatagtatatttataaactttatgcaatatcatattattctctattttaaaaacattttagagtgatgaaaaaagtatgagtttgttgcaataatgtgttaatcatcgttgtatcattttggtgaaatcatttaaagaatttatataaaaaattgagagattttctacaaattacttaatacatacgttaattttatttagcttatagaaaaaattattttattttcttcttcttactttcttattttatttatgtaataaaaaattagatgaa

SEQ ID NO: 3664 - DNA, 1100 bp, Glycine max
  Soy_ogl_4493 Gm13:156501..157600 Cluster 14
tgcggatcagaaacgtaagtagaaattagaaactagaagaaacgaatgtaagaaggtttcggtcgcgatttgtttttaacttattttaattaagttttatactctttttttttggcagataacaagagaccgacaattttttttaagattaattataatttaatctaaatataattgtttgtacttttgtatacttttttcttttgtttactgttatactctttaacaattaaatgacttactaaaatattaagagtctctcctaatgattacatgtaacttttttttaaaacaatgtttttaatcccatatgttgaaaccatactatttcataaatgattgaaaaaataatgtataaaaaaattacatatgattattttgttaatatctaaatgatatgacaagttattaaactattaatgtaattattatattgtcaactaatattgttatttgttagcagaaattaaaattattaatgaaaaaaatataaaaatcaaaatgctaaaaattttatttagacactaaaaaaaagtttagggataaaatgttttgaaggatgcaaactatgaatagtaaaagattaattaagcagctaatgaataataaataagtacctacatcataattcattttttatgataaaattaaagaaagaaaatcccactctcctttcttatggaaaagagtggaatatgaacgtaacgttattgtttcaagcattctaggaattgattatgacaagctcttcagtcgcacagcgtgggtacgttgttgacttttcgccaagaaaatacatgtcatgttctagtttctaattacgtgtttcttatgcaatttcgttatcggaaattaaccatgatttctcttatttttcaagtccctaaagggcctaagggggtatatacgtatgtctaacgtacacaccactaagataatatgattcaccaccacacacatacacatttagtatagcagatactctacatcactaatataagccatggagaagaaaccagtagtctcaaattaagccattaattaagccattagtctcaaattcttgatgttaattctgctgcatgctttcaaaaaaataa

SEQ ID NO: 3665 - DNA, 1500 bp, Glycine max
  Soy_ogl_4543 Gm13:38347201..38348700 Cluster 14
catgtttttcaactatgtagtaaaataaaatgttttccagctacgtgagaacactcgccgccctaaaagccaaaaagtcaaacaactcagcttcgaagcaattagggagtagggaccattttaatgatgacttaataacatgaattcaatgaatggtctccatcgagttggagttaatctagaagaaagtttacctggattgttcacttaaaacgaacattgaacaaattaaggaggaatagtgcgtgaatggcgattctcagaccagggaatcattcctctctaaaaacaaagaaagataggatagacaagaataattgtttctatcttcatataattatttaatcacaaattattattttttatgaaaattcttttaaaatttatacaaaaaataattataattaaatgataatataaaattattttagaatattaatatataaatattaaactcattgtattgttatggaaaaaaaagcatttaaaccgtaatgaataatattttttaacaatcattccagaaaaactaaatatcctacttccattttgacgtgaaagacttcatttgtaggtatgtacctgtctgcatatatagtttgtccattcataattgaccactcaacccttcacttccatggctgattcgaattgatacgttgcctctttttcgaattgtcgttttcatgtcgaaacgtgatgaggcttcgttgcaaaatgccaagagtatttcgacgttcactttcatcacagagttttcctcttcctttcctggaaattgctatgccaacaaattttgtaagctctttatgaggtcaagggacacgatgtacacgatgctaataaaatttacatcgcataaaatggaacgaacagacgtaagggaaaatagcaaggttttatttttataactttgattaaaacaattagagaaaaaagatcagaggaaaaatgagagttaaaaccaattcgtcttgtatctaagtgagcattgttcaacaagtaggaatatgaggaaattaataaattagaattgattaaaaatgaagaaaataaaaatataaaatatagtgtgatatatacatgattaatttatgaagtttattagtagtagtaactaatgattagctaattaaccaattaaactaataaataaacaagctaactattcttaaataactaattaacaacaacatcagccacaagatgaaagatacacatattttttttatcaaaaatattaattgttattttattattttttatttgtggaagatttgaatctacaaagtatatcattttttctttttatcttacgtcaccaactcaattttatatctcttataaaatatgcatattaaccaaccatctatagcttaagatgagtcatatatatcaaacaaaataaatataatcaaattaataggcaagaaatacagttcaaaagctgtaaccaaactagtgctagaaatcttcaaatgtgagagtaatcaatcacca

SEQ ID NO: 3666 - DNA, 1100 bp, Glycine max
  Soy_ogl_6637 Gm19:50020101..50021200 Cluster 14
gtttcttcaatctttctacattgtaatttggtatcttctgcaactcttgtaatttgacaatgtacctctggtacctgtgtgattattgatatatttaccctttactaatagataaacaaaaatattactactaattactaagaataagtatatataagccataaaaaagatttttttttatcggccaacaaagatatatattaaagaaacaaaggtaccagaagtatcatacaaaagattaatttcgtgtttagcaagtgcaatttgtatcatctattcaatcttcctctttttttcttcttttcaagattcaccaaaaaaataagaatacaaatagatatgaaatgtctgtcttttccttaattagttaacataaaaataacataagttacattttgtttttttttagcattttttattcataagaatttaagataaatatgaaaaaatttataacaactatcgcacattcattcaacaaagtgaattaagcccttgctttattgttttagctccgatattgctatgaaattatttttaattttaccattttctatcatgcatgactctttgaatttctttccgaaataaagacaaactaactgaggttgttccatattgacagcattagttctatcgatcctcgttattatctttatttatttttttacactttttcacacattgatattataaaatgagaattaaataatttccatattgacactttttcacacaaactaacttattcactctgcatgtgacacttattaccacgtgctgatggtttctacactcattaatttaataaaatttcattaaactcttttaatatgttattaattgttatgaatattttgaaatttaatttaatttttattttttaatttagatctctactcttttaaagtgactgattttgattcatgtcatcattacgtaattattatctaatattgtgttaaccaatgagaatccaatattaattcaacgtacactatcatcattgtattttcttatggtgtgtaatgtttcgcatgttagaaaaattattaaaagtattaatttaaattagataatattaagtaattaattaattt

SEQ ID NO: 3667 - DNA, 1100 bp, Glycine max
  Soy_ogl_5875 Gm18:1826401..1827500 Cluster 14
tttctcatgtccttgtcttttaatttgcataatatatactggttggaagaagtcacataccaattgaatcctcttataacccaagatgtaattgactttactgctttggtttaataataattttaaaataagttcaattagaagatagaagtcaaatattagaagacaataaagacgtttagtatgtgcactatatcacaggcatggacggatcaagagggcaagtaggggcctttgaccccttccttaggatcctatgagtttatctgagaaaaaaaaattaaaattaaaaaatattaacataaatatgcttttgagttattatctgtttaaaaattttctaataatagattaaatctctgattttatccataaaattaataataaataacttattacttattaaatcattatttatttaaatttaaatatttaaataattatgtaacaagaaattccgttcctccccttttatccactcctgagtccgtctctaatcacaaggaagcaaaaaaatgccttgtttgaaatataattctaatagccagagtaagaaaccaaattacagaaaagacccgaacactaaagaaactttttagaatataattaagctacacttgtactcaaagcattatgtagtacatgttttgatttcatgatccgtggagttgtgtgagatgtgaaggggtcccattgttctcgtaacaactggattcagaaaaggatttaaaaagctgacctaaaaggagttgatcaacaccatttttggccaaaaatctcttctcatttgtgtcaacaaaagctctccaatattcctcaaacctcaaattttatgtagacaaataacatttccaactgcacagcaggtttatatccatataacaatgcttaaaaaggagttctaaatactcacgtgaatgacctgttctactacgtaacagtatattttgttgaaacaatagtctttgtatgatagagtatataaattgtgttcttttgcacaggaattgagacttataaattgtctcaactaactcaattctcaaacaatacacctaaagttcttatatagaaaatcttcattcaaaaaatgcttatcc

SEQ ID NO: 3668 - DNA, 1500 bp, Glycine max
  Soy_ogl_2933 Gm09:1560401..1561900 Cluster 14
atggttgtttatatactcaaatgtcgattaaacagtgcgataataattattgcaggagattatgatgatcactcctccacctttgtattgctgtcctcattttaatgatgtggttcgactaatagttaatacataagcatgcgtttgtcgttgtgtaatccagctcgctatgcatatactttgcactaaattgctcactttctacaatctctctggtgattaatttcttgaataaattcctttgtcctatagactctccactcatattatatgtcttttaaaatcttttagatcatgttagtttaattttgttatgcactatgacctagtgatggggaaagaatagtttatacaagatcttagattcaaatgttgttattgtatactcataaaaaatgtcctcttttattattatctcacttagctacttaaatagatttcacagttatattttaaactttttttaacaagttaagatatttttgtcacaataaactgataatttatgtgattaataaatttttgaagaacttacattaccttaacgacaaataggatgacatagaagaagtgtcatatagttatgaaccaaagtatagaaatactatcaagacttgagagattcataataatgagggggaaagtttgaaacccatatatgcatattttcaaaattaaacaaaaactcgcgcgtattttttgtttccttcccctttaacacagtctattcaaaagtctagttaaataaaatacttgtgctccggtacacacgaaaaaaaaaattgcaattatgattagccaaagttttccaagctgtaaggctggagagacttgacagtcccattcaaacttcaaaatatatgtgcaaattggtaaaataatgctatttatgcggttgaaaggtttatgaacatattttcgatgcaacgaagttctacgtaaattttccacatttcatcacgtactggctttaaacatgggattaggctaaaaatgtgaatgtcctactcaaactttaaaacttacatggaaaaaactgttttggacttttgccatgatgtgtattttggtcaaacaatgttggtatggttgaacgttctatgcacattttcaatttatgcaaccgagtttgtagtgaatattcttccaaatttcctggtgcttattccatgcttcaactataaaattggtgtgttttctatatcttaaatcttaaaacttgctttttttttaataaaaaaaacacttaactcacttatccttgggttgtattcggcaacaatttttatgataaatttggatgaagttcaaattaactacttcaacattttgatgtgctgtgtagacattatggaatgcaacttttaaataatggctacgatggcccctccccccaatacttaaaagagttataaagtaaacaatgtcacaattcttatgcaactctcaacactgaaaaaatgatgtatgcacatgtttggtaatatttaaagttttaaa

SEQ ID NO: 3669 - DNA, 1000 bp, Glycine max
  Soy_ogl_4695 Gm14:5897101..5898100 Cluster 14
atatgataagatatgttttggtaggtcatatcatcacggattatttaagataagctgtaatctatatttatattaacactgtcaagtgactaccacatgttgattggacagttttttttttactatttaatcttttatttcaattttactcattttattatttattctttcactttttttcttcttctaaaatccatgcaatgcggatttcgggataggaaaggagaaggtaaaattgacacctttatcctttatctttcaccaagttaatattatatctaatgacatatagcaagaaggtctagctggtaagcatgtatgagagtaatcgtaaatttgttaatatgagtgtttaatttttatggataaaaaaatatttaatgacacattaacttgtgttaaagtactctattattccttttgtacacatgagacactgcctttaattagtgcaatttgcgaatctcatggaaacaaaatggatgtggtgagagtgcctctgcctccatatccaagggaggaaagatttgtctttagaaaaatgtgaaccgaattttcattagtacttatgttctttgaattggaatggatataggagggagaatatattatattcaatctaagcagtgtttgaccggaattgggttcacttgtttctctttgaagtcaaaaaaggtaaaagtgaaagaaaagctaaaagactattaggaagattacaatcaaacttgcctaaattgaaaaacggtctttacttttttagatcagcaataaagtctcgtgttgggttgcttgttttagaaaatttcaatacctttgcgatggggccgaatacagagattcttaatgtgtttatttacctagctctttgctgctaccacagattggtttaaattttcaattatgatatataattgcacactttctaagctcatgaattcaaatcctttcacgagagtagagctactaattaacaatagagcgacatatctttactactagg

SEQ ID NO: 3670 - DNA, 1037 bp, Glycine max
  Soy_ogl_3769 Gm11:6291729..6292765 Cluster 14
aaattgagttatactgtacgggtgaggcgatttcaattcttcgcccccccacagccataattgctgaaaatcaaataatataatctagctgatcaaataatataatctggctatcaatatagttaaaattgaatgtacttcttatatttgttgaaagtggataagcacatactaattggaatggttgtattgtatcatttgtatgtattgaatatcagatataaataaatctactgcagcctcgtacgtagtaacgtgatagccagttgatacgcttagaaagcatgcgcaatatatatggcacacagatcaatttatttatgacaaatgctagctaataatctttgaaatattgatcatgaaattaaaagaaaaaaatttattgagatgtgtcaatatttattttcattttaattctttcataaacattctaagaatattgagaagcaagacttttatttatatatgtacacaatacgtagctcaattccctactgattcattttaattctctaataaacattctcgcgtaagcatttgagatgaaactataggtctatttcatttggtaaaaagtatggtattgactgtataaatatataactgtttcatgtttaatttaaaaataaaaataatcataaataatgcagtacaaatcaaataaaagatggacaggacaatctacctgtgtctacactttatatgcttacatacaactcaaagtcaaacattttcacgtacctatattcagaaactctaacttggaatcaaataattcagtcataccaacctcccatcaactaatcttagtgaaggaactgtctaatctcattgacggtattgcaatatgcaaactgttggatcaggttgaaaacagacactaatctaagtgactccttaaaattaatttagcaaagaaagaaaataagaaagaatcaaacttttcaactaaagaaaagagatcagttagtagtccttcaaaattatagatgagatattattatttatattattgatatgatcatttgggcataact

SEQ ID NO: 3671 - DNA, 1096 bp, Glycine max
  Soy_ogl_821 Gm03:3296501..3297596 Cluster 14
aaatcatttttaatggtcatttattttttaaaaaaatcacttttaaaaatgatttgacttcatattattaagtatatctttatacacgttacatttcatttattttatattcaagagtcacttattttgattttttttttattttcacctttaagaatgagattaaaatatctttatatactcacatcccattttttttttcacttattatcaaatgaaccatggaccaagtatatcaaatgtcatttattttgagaaaatattttttatttccacttttaattacaaaaatagcacttttttataaaaaaaaattgcttctcatttctacaatgatttgcgttagaatacgtttcttatactacaagtgttaaaagttaaacatattttatttattaaaaataatgattttacaggagagattgttatttttcaaattgctatgaacaaaaagattaaagataagtttaagcatttttaaaattatgggattttctaatctatgataatggcaattaagattctaacacctgaatggaatttgattacaactggacgtagggaactctttggtactatataagttaaagttttttttttaaagataattgatttaagccatacctacacgagtttgtgcaggattttgcatgtcaataggtgtcatccaaagcatgggaccaagtggcttcattaattctgttttgaatttatgaatattaaagtcttggttagagtggtttagataaaaagcctatgtgggttggtggcgcaaaagtatagcagcagttattttcagttaactgttcagttagcaaattttattcgcagcagttctgttccaaaaaactgaattgaacagaagttcagttcagtttctatttgaaagaattcagttcgattcaataccactggcttggaatcaaatttctctacaaagctattagtcaggatggatgcatggcatcactaaatatcatgcaccaactaagcaaatacattaattaattagtgttgagagcaagacttgaaactaggtcactataccaactacaaaagaaactaattaaacaccaaacaaccaaacaaaaacaaa

SEQ ID NO: 3672 - DNA, 1021 bp, Glycine max
  Soy_ogl_5632 Gm17:10380418..10381438 Cluster 14
gaagtggactaataggtattcaaaaatatattttatcaatatattttatcataaactctattagatagatgtttttccttcgtagtgtggcagagtggttttgtatcattgaaatagaagaatttttttaggcttagattcctttttgatcctcgtaatttaactttctttttactctttcttcttgcaaaaaaaaaaatatctgtagtatttatagattatgcttgtgttattttttttgtccttataacattttaaatagcatatttttcattattcaaagtgttgtttttgacattaatctttcgattcattaggaaaagtaattaatttaggatttgatcaaaagataaataaatttctatttaaagtattttaaataaaaaaataattttgtaagaatgaaaaaaaaacactaaattataaccactaaaaaatatttaatccttatttggatgcatcttttccatattagcaatttttttaggatacacccaagatatgtttctccacgaataaggattccataacatggattactagaaaaggaaaaaaaaaaactgataatatctcaatagacattaacccaaaagttggaacgttgaatcgtatccatcaactatgaacaaccacggtcatatagtaaaattgttgcaaaggttctaattaattgtcctagacactaagaaacgtgttattttcgagttgttgttgttataaaggattaaattattttcctttgagaagtattgttttggatggaggcgcactcacttagagtgtagttggaaacacgtataaactatgtaaaaatttgacttttcaagacaaaaaatcaaaagcgtgagatttttttttcttttaaacgcctgttgcgttgagtcaccgagtgcaactcgtacacaaacacacgcttaattaaaagcctaacacaaaatagtgattctcaaccaaaaaagaaagacctggatcctctccatccacttttctcaagttcttgtccaacccttctatccctcta

SEQ ID NO: 3673 - DNA, 1000 bp, Glycine max
  Soy_ogl_637 Gm02:44047101..44048100 Cluster 14
acaaattaataattaatatttctccatagaaaaaacacctaacttataagaagataagacttttgaagtggaattttagtaaatgtaatcccaagttgaaatttgaacctcttgtttaaatgcttacctattgaacataatttctaacttggtcatgcagctatactttatatttaatagaaaaatataagagaccgtcgaatccttcatatatatcatccgttagtttgcttcagaaaacagacattgattctgtgtttctttttcccctcatccttctaactttcggccaatagggtcggttcccactttccaccacttctctttcctaaaagattccgtggagaaattattctcttcccactattctcgtcattattttctgacttagaaaaagttattttaaactaatgcttttgttacacatttacatgtacaagtttttcagcaattattacaattattctcttcccactattcttgaaatacaaaatcttatagttttacatataggttgtgcgaagaataacaataaatgtgtgcgagaaaaaaaaattcggaccgttaaattattcgtctcaattaagctgagtctattggaatttgattttagaataaaaaaatttaatataatttaaactattaaagtaataaatatttactgaatattatgatttatgtctcagtacttgatatgtgcttaatttatcaaatcaaatatgttatatagtatgaaaactgtttgcacgaagacgtacagtaagaaaacatacaattgttgttatatattaacttaaaagaataaaaacaagcattgatggaaatcaaagaaaatgaatttataagtgtttcgtgagtgtaccaaatcgtaaacattatttttttccttataaaaaaatgtatcaagttatagaagctctttaccaataaattagaaaatatatttgatattatagaagagaatataaattatacaaagaatatatactatcattcaatc

SEQ ID NO: 3674 - DNA, 1084 bp, Glycine max
  Soy_ogl_1674 Gm05:34665501..34666584 Cluster 14
gacttgcgacaattactactagtcataatatttttaagttacttttaaaactttttagtaatttaactttttcaccaccaagtcccaaattagtaatttagttattaaatgttttgtttttttatttttggccgtaattctacgttgaattattgctcacgggatataattaattaattattatacaaaaaatgttcacataaacaaatatataaataaggagatgaactaaaacctatttacatactcaaaatcaattttgatggtaagtttccaaacaatattctttctttgtattagtggaaacataagtgttttgatgcctatgtgtctatataattctatttcgttaaaattaaaataaggagaagaaggaatgagaatcgaagagaaggaatgtgcatgtcgatgaaagcactcacgatagagaaaaaaagaaagcaaggattaaaaaaagaaatgcgccaaatgagaaagaaatttttgtgtacattttttctctttttatcctttaacttactgcagcagttgagggagaataagagggttgcaatatatccgagggataaaagcatctaaaacgttgcgtacactaaagagaaattatctttattaataattgtacataaatcaatttttttaatacttattatcaaaacaaaaattatgttatttcgaatttacatttacttaaaattgaatctataaaattatattgatccaaaattaattttgaaaacacgcacttagtcacttaaagataacataagttgaattattttatttattattattatcattattatctttctttcatttggaaaaataaaaaaacctggcctgaaaaggataacataaatgggcagccaaacgagtgaaacaagtaaaaagtcagcaattatttggtttagaaaagagaaattcaataaataagaaatagaaaaaaagataattttaaaaaagagaaataaaatataaataaaataatatgttatatggtttattttaagaaagcaggtgaaaaataatgtttttgtatcaaagaaaatttatttttgtttgtccaacggcgtaaaagtttgga

SEQ ID NO: 3675 - DNA, 1200 bp, Glycine max
  Soy_ogl_2648 Gm08:13103501..13104700 Cluster 14
tagacaatatttttttaacatataggacttttaatgaaaaaatttaaatatacatggtatacttacattcctttacacataatttattgctcaacttttttaattttatggaactttaatttgtgcattgtatagaataaatgtttacttttatattaataaaataatgttttaaatatataaattatattataattaaattcataataataaattatatatgaattaatttttggatttaaaaaaaaacaagggtgttgtaagattatttttaagacttaattgcatttttgttctcctcaaaactgtgcttttaaatttttaaaccttcaagttttgattatgtcaattagctcccgtggacattgtaaattaatgactgttgtccctaagtcctaattgtgtcaattaggtctcccaatgaagtattacaattatataattttgatctcttatatattgtaattgtgtgatttttttctccaaaatactagttcaaaatttcaattgcacaatctatgaaatttgaggctgaaattgtaccattatgatattgagaggttaaaatcaggcaattatgatacctacaatgttcaattggcataattgcaacttggggagttaaaattacacatttgtaatacctaaaataaagggcccaattcactagataactaaaatttaaagattaattgaaaaaaatgagaaccaatttctcgctttctaacgggaaaaaaaagtcttgctttctgatttgggtattttaaattatagtataagaataaacaaaaaaataaataaatgataaagaagacatcaattagacaattactaatgtttttttcttggaaaaggcaaaaggttatagtaaataagggaggctatggataaccacaagttatggtcatatcaatccagaacaacacagcgctgcaatatgtccctaggaataaattaactcggttagcaaaaaatgcatcttcctgccagcagtaaataattcatggctacaatatgacatatgattatattccaaaaaaaaaaaaaacctgcattcctaacctctccatccagcataccatgcatccacagccaaaaatatgtttgctattgttccctattacaagaattggctcaccctatagctagatacatatgtataattcagttaagtcattttattgatcctgaaaggatcag

SEQ ID NO: 3676 - DNA, 1000 bp, Glycine max
  Soy_ogl_3399 Gm10:6612501..6613500 Cluster 15
tttaaatatagttagttaaagccatttaatacaagttaataaagtaaattgtttgaaaataatattttaaactctaaaaaaaatgttaaaaagatgggcgaacaaatcaaccatgataaaataagttgcctcatgctttacctatgctttagtttttgctttcttgggcttttgccccttatatcagcaaaaacaaagttggcacatgctaatgatttgttaacttaaattaaatttgaggcagttgatatttatatctctatttgttaataatgcacctccttttcttatttgttttccaaaaatatcttcaattaaaaattaagttccacagtcttcctaaggccagcactattgaatttgaaagatacagacttttctccttccttagctgcgacttcccctggctcctatctccaacaccttttactagggggcatagtactacattatttatttttttaccgaaattttcagcattgagctttaaaattcttcttctaagttttgttgcttgtcattagtattactgttatatgcttcagcatgatgtttcttgtcgatgtgcccagaaaagagaaagaaaaaagaaaaaaagaatctagttaactttaggttgataagtagaaacgctacaatctaaaacaatttagttgaattcatcacactctaaaaagaagaaaaatgagagtgataagaatttggataatttatcaccaagtaaaaaccttagttctataaaaattgaaaacaattacaataaaaatatataaataaatttcactcaactgatttggaatctaagtacatgctattttttgtaaaaaatattcactgggtagtcataaatattcattaaagtaatggataaacttggtgggctaagaaaaagaacggaatgacattaaaattaaaatgacaataaaaataaagtgatccaccaaaaatattcaaagttttatatttattaatgaataaaaaaatgtgttataccctttaa

SEQ ID NO: 3677 - DNA, 1032 bp, Glycine max
  Soy_ogl_4086 Gm12:34282669..34283700 Cluster 15
tataatgaacaaaaacttctctgaaacaagttgaatcaaatataaactactaatgatgggttcctaaataatttcctccacacacataaatgaagtgcatgcttgaaaattgcttgtttatgagaaaataactgtttacttttaaaaaaactctcttcatgtcgtaaaaataaacaattattcctttaaaacagcctaaactaaacatgcactaataaaaacaaaaaggaagaaaagattctctaagaacaacttttatggtgcaaatctaatgcgttgcttagcccaattgtttattttgcatgactttattttatataatttacgcaactttcttctctaacaatgtaactttcttggtttgccaaaaaaaaataactttttcttggtatctcatatacccgtttttgccttgacaataaaattttagccgatagatcattagtggagccaaagaaactgtaacttactcctttaatgtaacgaatgcttccttaaataaaaaaatctgtgctccataagaaccttgtgtcggctttctttaatggcattagttttgaagatgtaattactaattacttgataatacaaaaaaaaaaaaaaaaacttaagcaattggcgataaagttgctttaaattcccagtaagtgctacggtgctacccctagtaatatcgcatattcacatttcacgtatattatattatttgggtaagtagagtagttaaaattaaaaaaacgaaaaatcttaaaaaatatttaaaattatttgagtaagtagagtatattatattacttgatttttttttttgttgcttataagttgtacacttatgcaatgcttttttttttttaacatcttgtgctcttgtaagtgttgaacattttcaattaataatcctttcaaaaacaggtcaaagcgagagcagaaaaaggaaaaaaaaaaacgtctaagctagtctaatatcgtaaaacattaactcattattgaggtatactagtatccttagatgttgcattctacataccctaa

SEQ ID NO: 3678 - DNA, 1006 bp, Glycine max
  Soy_ogl_6049 Gm18:15762401..15763406 Cluster 15
tcctttttttttttggcacaaaggaaacctctacctctctctcaaaatggttcgtttagatcgccctatttttcctttgaaagtgacctttccccattaaggcttcagcaaaagatacagaaaaaaatgtgagaaaataaactgaatggaattaataacttgtattaaactatcatatagtaccaacaatgattgacataagctaatgatttatgtctcttgattaaatggttcaaaatttgaatcttgaataatccttagatataaaataaattagaaaaattttattcatttatggtagctgagatatcatagatgacaagtgataaatgaactcttccatgaaatcactttcttactttgttcttagagaatatatttcacatagagatcatttattcatatcgtaagtttatgtattatttttataatatttcttttcactatcttcctttaccatattaattatttatctcatattttctcttttcttattttttctttgttgtataatttttttatataaaatttacatatcaatgtacatatcccttattcccttttcatggatgcttggagcaccaagaaaaatgagaaagtgagtgacgactttcattcatttgaacacctctttcttgttatataaaaggaggacaattatgaatttaattactagttatttggatgtatatatgttatgatataagtacatgtagtttatttatagtctgtttagacttattttataacataagaacttaggtaaatgtttggaagggtatatgaaaatagtttgtgatatatgcatatatgattttcagtttatttcaataagcactttaattaggataacttgtaaaatcaacttataacttaaatgaaaataatgaaactttttttttcattataaaaacaacttatacataagtatttagacaataacttatttgaaaagtctttacttaagtcgttttactccaatgagtcagtgtttgagaaggtttaa

SEQ ID NO: 3679 - DNA, 1121 bp, Glycine max
  Soy_ogl_4727 Gm14:6882480..6883600 Cluster 15
gtatcaatccgataaaaaaatgagacagacagtcattttcaatccatatataaaatatggaataggacggattgaactgttttgggtgagttagtgataagacgggacaaataaatccgtattgtcacccctaattggatttacatgtttgttaaaaatatgaatattttcattcttaattataataaaggactgcaggggtcgtagagaatccgaactccaaattaagtacttggaataaaagaaatgtcataaaaggaggaagaaagggttatgtacttggaataaaaaaaatgttgaggaagaaagggttatgtaataaaagagaatactaagtaaataaaagaaaattcaaatttatttaaatagaaaaatgataaattagctagatgaaaaagtaataataaataagaagttaaattattttttggctcctcttttattagcattatttaatttggttatctaattataaaaaaaaaatgcaatcttttcctcttaacaacattaatgaaattatcctttcacccaaaaaaaaacattaatgaaattagatacaagaacatcaattaatgcatagttaaaaaataaaaaactatatgtgtactgctaacttttattttctttcaaatattttaaggaaacacaattcccttgtactgtatatcataaaataaagtagtatattttgaatacctattttttttttcaatatatgtacatcaagtagtacctagctaattgaaaaattaaaattagaactacgaaagcaatgttatactacatattctagacacattaaattcctcagacctatcttatatatttaagtaatatttggctcaacttatttttaacatttttttaaaaaaaaaataaaaagtcgggacaatcactatttctatagaagctctaaaaaaataaagagctcaatttttgtaaaaaaatcatgaaaagggagctttaaaaaactgataaaattaacctttttggatttttttcctaggaactcacttcgaatctctaacaactctatttgcgtatattttacattttttccatgtaaatagttgaaatgttttcaccctcatcaaataaacttttttatttctccaaaataa

SEQ ID NO: 3680 - DNA, 1000 bp, Glycine max
  Soy_ogl_3057 Gm09:11179301..11180300 Cluster 15
tttaagagagagtaacctgtgaatcaagaagtttgtagtgatattttagggtcccataatgagccaaaaatcctaatcgtgaaagtataaatgacttatcttttataagaaaaatatttacttctaatacataacttttttttttttttacaaaaacttaatttaccgtttctatgtatgaaatcataaactctcacacgtccaaataacaatgaaaatgatttaaccttttttttatgaatatttaaattttacattgcaagtttataatatatgattttgatatattatagtaattttaatataacaataatactaaagaaattattataatttttactaatttaaatataggtcgacctgggtttgaaaatgccatttaaatgatttaagtataatccttttaatcaaataattttttataaaaacctaaacttaacctattttttaaagaaaattaatctgatctagacatgatattggctagataataggttgggcctattccaagtccaactcctgcttacaaatatatctaattatcctgagtaggttggcatcggtccccctctcctcttttttatcagaggttcatacattaaggtaacggcattgcatgtgatttcttgggggcaaatcatcataaggatatggacaaatatagtgtctaatttttttttttcatggaaaaatatagtgcatgtctaattttgtgtttatattttcttttttaccacccatccccggtctagttagaaagagttttttctttaaaaaaacattaatttgacatttataaaagttaatatgatcaatgttgttgatattacaaattaaaaacattaattttcaatacatttctagcatccatatgtaatttatctaaattttatatttaattgttatatatatattaaaagtttttaatattatttgtttaggatccgtttgaggtgattttagttttcagtttctaaaatttaaaaaataacaactagtt

SEQ ID NO: 3681 - DNA, 1456 bp, Glycine max
  Soy_ogl_813 Gm03:2945245..2946700 Cluster 15
tcctatgtgattcacaacaattggcataattcaaaagcaacaaattcctaaaacaaactaaaatagaacaacaaatagcaaagacctcttcaatcatcctttctcacaaatcaagaaaagaaaatctagctctgtggatcactctacaagctaaagaagatatcacaaatgttgaagctcactattgactcatgtctcaacaagaaataaggctcaaagagtataacattgatctgatttcttttcctactttcaatgaataagaagtttagaaatcattcctttaatttatattttaactacatggaaacttggaaaagataagaatgaaaatcctgttgattaattttgagattagatgagatttataaaaggtgttaaaaatttccatctaatactcggttatattagtctaaaatcgataataagcatatcctaggatgccaacaaccgattattgttgatgacaatcaatttatagctagattttttgggtaggatatttgatgattccgataaatattcgattttctagtcttaagtatcttcatgaaaattgcagataattttggtgtcgaaattttggaacatgtttcatattgtttcaatttctacaactcaagatacacctaaaacaatgcacctacgtcaggatgttgtagatttagtttaagacttaataaaactattactgtaaatggttttaatcacttataaacgatccaaaaaaaaaattgtttagttttatgatttgaaaaacattatttttattctcacctttcaaggtaagtcccatgagcctatcttagttgagatttagagtcttaaacaaattcccaattcttggctttattttcaacgaaatatccatgcctcatcagctagaggtcatgttctttaacattgttaaaagaacacacaagaaatatcatgagacaacactactctttaaattttttttaactcaagttgataatcatccgaaacaattctccaagaaaatgcaagaacataatttagaaggcacataactattcgaaaaacatttaacccttttatttaatattaaaacacatatttaattacaaatatttattatacacacacttgctaataggaaaagaaatctgaagcccacatgcatcgggaagtctgataattttatttggatcatattttaatgtttttatagcaaactggaaacaattacaaatattaattatacctttaccagttttgtcagccatggcaagagtaaacgcataatatgatttgtaacaacaatcgttagatggattgaacttggatcctgaaatggtcaaatcaggctcacaagtgtcaattaatggttcatatccatcgcatgctacaggaagatgttcagatgttgtaggaaatgttgttgtcgccaaaccataagccataacaaacataacaatagcccaaactttccttt

SEQ ID NO: 3682 - DNA, 1500 bp, Glycine max
  Soy_ogl_6189 Gm18:55694401..55695900 Cluster 15
attttttaataattattaatgttattatcaattttctttaaacctctaaaaaaaacattttctttaaaacaacatgttactttgaaaaaaattatacgatacggacatgcactgacataccaacaatccggtctcatgatcaacgaaaacaattcaaaaactgctgcactgataatttaacgagtcaaatgttctgtgattcacattgtatccgtggcccaggttgaaaccaaaatttgaatggtgataattatcttgtgaattttatttgaataattattttggagataaattatcttaatattttaattcttaggatctttaattgtcccttttgataatttatatgtaaacaaataaaattttcttaggatagttgattcaataaagttttatgttaattaggtttaattttttattgtaggacaaagaggaattgttgatggatgataggagaaagagcaaggacaaaatggtcaaaatgtcaaaattctagcttgtgaaggaaggcaaatggctcttaagcctaaaaaatatgacactaagcgctaaatgcatgtcaaagaagagaaggaactagaggaggccttcaaggggcacttaagcgttagtctgcaagtgatgtttttaaattagcacatgttgaatcctatttagggaatttatgcgtttttgttttgatgctttgtaatttcacatttttcaagtatttttctctgcaaaaagctgtgagagtgacctctttaattagctctcattggctttttcttccttctccttcatttctctatatatgaattttctttctctttatggtaggagtagttaggtctttagttgttgggattgaatttagtgagacccactcatgtatttcttgtaaaattctaactctatcctcattttaatatattacttgtctacttttaagctttaatttctttgacttgatgaaccatgattatgtttttgagttggaatgtggttgtgaaactctttttgactctcgatttgaagtagagcaattattagattttagatttaggaatgagtttatattcaatgatctctctattaatgcttgtgtttagtgaaaatttcccgattaatatctcttaagggattaggtatttaatgggggaatttgatccaaatcttctaagggttaggaattgttgaatttttgtgtattgaaatatattgaaatgagtgtatgagttgatgttgagaattgttatgcattggttatacatgaagaatggcatttcatgaagtgaaatcccgacaacatttgacataccgcattttcagaaaataggatttggttcaagattgccctttgtgaattctagagtatctcttaatttgaaaatgtcttcgataaaaaacctaaatagtttttcttcaatcttttgtttctaatttcacttttacttaattctcttttaattagtgataacttttaatcaaagtcttcattgtacatttaattcttaattc

SEQ ID NO: 3683 - DNA, 1200 bp, Glycine max
  Soy_ogl_4351 Gm13:29752201..29753400 Cluster 15
aaatctttctcataataatttttttttaaaaatctcataataaaaatgtgctaaagagtttgttaaaaaatagattgttgctacgtgtgatctcgtttattttccaaattagagcgtacaaatatagtatctaaaaaattatgtaataattaaatgataataatattaaatagttattacagcaatcaaataacctcctaactaaattagaagtatccgtcttaatatcccgtttcccttttgtcacgacggtctttccgttgaatttaattagcagaatacattgaagggaatgtttggtagttgagaaattttcattttctcatgaattttaattcaggaaccttagttcttcaggtttgatatctatttttaagaaacatattttctgaaaattatcatttttgagaattatttttaactcaaatttcgataaaaaaaaaatattcccatggatggggttggaatcatactttcccaagtttaatttttgttttactataataaatatatcattttattcttattaaattatttagcatttttttttcatttttgcaaaaatattttagttctagtaaaatgtggttgctttatttttatcctcaaaatgttttagataactttttgaagtttttaaacaataaaaagtgttttaatgacgaaaaaaaacattttgtaatgactataacaaagaattttcttttttaaagatgaaaacgaaaaaaacctaattacaagaaaaaaaagtattaaacctaattaaaattactgataaaaatatcatgaaactttttaatttcttcaaaaaaattaaaaataattctcaataatcaacaaagtaaattttcttcatttcaagaaaacatgatgttcatacattaaaaaaaaaaaaatctcttccctactacacgtctctttagtctaataaaattcttgtaatggctgagcaatattagagggggagggtagtgtaaggaatgagaagattgagaggttggttcagcggtaaccaaattggtcaacagggtgaagatgtgcttagcaaattggtccactagacgaaactgtgtatgatatgattttcaagtgaaaggccaccagtatgtgtgtgtgtatatatatataattctggtacagcagacggaatggtacacacccagttagagaaagtcagtagttatcctagttttatgagat

SEQ ID NO: 3684 - DNA, 1000 bp, Glycine max
  Soy_ogl_847 Gm03:4618101..4619100 Cluster 15
tgttagatatataagagaccggaacttatatgaattagtacaggagaggatcatgatatatgaagaagcaatcgcaaaagtggcacaacttttgtaatctgtattttgaaacttttgtaatatttagtggcaaagcttttgtaatatatttttaaatataataattattgtttcttaagaaatgcatgacaaaaattccggaaccttggatagaaatttcatcgagaagttattcgcacggaacacttgatagtcaattaattttcaaaagtttcacacattcaagtttctaccattgtgaagaaatgagagaagagagcttattgaattgcaccctgtgaagagaaaaaaaaaaaaagaaggctaaagttaagacgatataagattgatggtaaaaaaattaaaggagaaagaaatatgctataaaaaaagttaataaactaatatataatatttattgataaaaaaaaaagctaaagtggttaagttattaccgtgaaaaagaaaccgaaagaaaagagtggactttaacggtaagaaagatatgtcatctattaattattgaaaattcaatagtaagaaaatgaaaacatatataatattagactaataatttagatatatatatataataagtttgatgattatttattaccaaaactatgtactttgttttgcaagtttgtctttgtgtttgccttaatatattgttctgcaaattgtgatgttgtgattaattactataattataaattacaataactatatgtaattttgaattttgagcatataaatattatttaagtgttttggtcccctaaaaaaatttggtgaatctctctctcagcaacaataaaatcatagaccaaattaatgtatgataattatgcatcactctaaattataacaacttttcacttgatatttatggtcatcaaaattaaattttggattactatctctttcattttttattatgtgtctatgacttttgtaaatt

SEQ ID NO: 3685 - DNA, 1300 bp, Glycine max
  Soy_ogl_1330 Gm04:40900901..40902200 Cluster 15
atacttacattgtttatcgtcacttgaattcagatgtagcattcattctaagataggaagataatctataactaaaaataagaaaatataaaattttgttgtacacattttttgtgctatattttactcgtatacctacttacataaactattatttctttcctactatcttagtttatgttgcctcactcttgctttacttccccttaattccactccccaaatcatccacacaccctctaattgcattatacataccacccattaccatttaacttagcttttattatatttttagttattttatttatatttttaaataaaaatagagacacgcgaaatatctctattcgcatatcaataataataaaataatatttattagacagatagtttgtaattccattcaacaagttccaaatgaacacatatggcagatccttttattctttttgaagatggttggctatttggcacgacgcactgctaatctactgttatttgatgcctttgaaatagacgagttagcatcaaaccagaatttgaatttaagacttgcatagatgtggtggttatagtgttaaggaacaagttattgacttcgaactgcttgtgggattcgtattattaacttttccccccttctcgtctatctctctacagttttattttattttgtcttttcccccctagaagtgcgattacctcaacctcacgtacacacaactttataaatttaatttatatgcattgtttatgaaaatatttttgcataaacatatctaatagaaattcatcttgttgccaaattatataaataaatatgatgtagcatagggtgaatttatgtccgtataaaaatattttatattatcagtatataaattaaattcaataattattttccaagcacataagatatattcattcttattaattaaaaatataatttgcttgtgaaatagggaggtgtgaaccaaaataagaacaatcacaattaatgatcaaatttagcaacaggttaatgacagtcattattaagccgctgtagtcgtgacagctgattgatttttgtcattaatttttttttttacttaagtcctttagtgattaaatttatgactgataactccagtttctaatataagtacttaaatctattgtcaattcctttactaatcgtgtaatattttaaagtgttagttaaagtgattgattatttagtaacaaacaataagtggtcgcaaatggttatttgtttttatggacataaaaaagtttgatcgtcaaattgatatca

SEQ ID NO: 3686 - DNA, 1064 bp, Glycine max
  Soy_ogl_5356 Gm16:26879201..26880264 Cluster 15
attgagtttgagttgatcaataattaattgattttacgtttgtatagagcaagctgtcaccagttggggattgagaaacctacttaatttaaccatattttattgtcttttgattgtatacatatcaagtatcactcataagcttgataaatatttttttccgcgagaaatgttagcggtattttctttcaaaggtgagattttttttaaaaattatcaattttggtgaattttagttcttatttaatataaatcaggatagagaatcaatgagaaaaaaaaaacctactaaaaattatgattcttaataaattttaaccaattataaataaattcttagaaataaaaatttagagagtacgctagtatttctcttttttcatataagatagcaactcccaaaatttaacatattgaaaacatgataaatacacaccattgaagtaaatttgtcttaagaaatgagaagataaaatgcaataacactttgattttaatgaccaagttagatgaaaatgcgagcaccaatcatgaaattaatgaaattagaaataggtctgttatatcaaaaaagaaaaaaaaaagaaataggtcgatctgaatcaatgaaattagatggagtagttaagttgattaattaattgattttacgtttatatatatagagagaatgctgccgacactagttggagattgagaagtctaattaaactatcaacttgataactataagtaaaatgtgtttttttttttatctccccaagttttttagggtgtgtttgtttcatagattaatattaaaaaattatttttaaaaatgtatacattctcatgttcgtgacaagtttttaataagtattctcgggtattattgattcttcttaagaatgttagaatttctcattttaatgtattttcctccatttttattcctccagagaatttcttttttaaattttctaacaagaaaataaatattctcatatccacattgccgaagatgcaataagatttcatgaaataaatactctcttattgtctaatatacataatatatgtaactt

SEQ ID NO: 3687 - DNA, 1200 bp, Glycine max
  Soy_ogl_6021 Gm18:11855401..11856600 Cluster 15
cgagaacaatgcgtctgcgtgggcctacgaagtttttttttttttttttatcataaataatttagatgagttggatttcataattcacttgtaatggattcttataaaaatatttacagattatctcttaataaaactttcacattaacaataaaaattaaacatattttcttataagatacgaatatcttttatccttatccattggattaattttttttttggttgtggtcccaaaagtgagaccagccacatgcagtttgtgaccctagcggacttgttttcttaactcattaactctatatgccctatgccacaagcaacagcaaattgcttctgttgctgcttattcttgctctgccaaatttatgtacatgtttgtcctgtcgatctagtaggaatgattttaaagggtcttcataaaattaagttacatactcatgaagaggtgaggaattttatgttaaaataatgaagcatttgatagaagagaaaaagtttttcatgtatgaaatcatgattcctgaaaactgtgaaatacaaaaattatgttttttggaataaataaaaattttagaatcttaagataaattttctagaaatcaaagagttatatattatttttatcatatcaaacaatttaataatcatatcaaataatttaataaagagtaagatgatatatttactgtagtaaaaattaatcagaaaaataagattttcaccttttcacatgaaattttttcctgagaaattgattaaaattaaacatatgtattgtgtattttttttattaaggtattgtgtattgatttaagtacaaatttcatctgattttttaaagcatataatttttaattaaaaggaaacaacattacatgaactttataattaaatacataaatgtagctaaactgtaatttttcaacttaatagttgtaattaaatatttttattttcacaattgaaaaacaattcataagctaaaaattatatttgtataaaacacaatacgtaaattgaacacaaaatatgccaaattcaaaggttcatatacagatctttacataccaaagaagtacagtgtttttttttttacataagtagaaatacagtgctatgtgcccctgttaaatcccaagagccaaaactaattaaatacctgagattataggacttgtaacattactctaattaata

SEQ ID NO: 3688 - DNA, 1108 bp, Glycine max
  Soy_ogl_3090 Gm09:30835193..30836300 Cluster 15
ctctaactaattcagttcttgaactcgctattgctttaaatttgacagtgtaaactatgttttgggttactctaaatttactaatattcgaattggccctctataaaaaattgtataattttgatcctaattttaaatttttttttcatcctctaaatttgaaatgtatcacttttatccttaaaatgcttttagtagtattttatacaaggataaaaataatttagatagtgcataaaaaatacagttcaaaattaggagcaaaataatataatttttaaaagtaaccaaatttaaacagtaataattttagaacgacctaaaacataattaactcagtttggtattataccgtgggaacacaaaaaaaaaagtgagttgtgatcttaaaacgaaactaataattagaactaacataatgcagtcgtactatcatatgctttgtaaagtgtaaagaataggattgggttctctccatgtgctctttgtttgtgactttaacatgcatattgagatcttttcgaggagtcttctcttggagggatccattataccaatttaattttgattgttggacaaggctaatttagattttatgaaatttcaagcaagctcgtgtaattacttattagtgaagtgataaagctgatttttttaattatgtgtataggtaagttaggtaaatttctattagtaagttaggtaaatttatatcaaaacctttaatttttttaatgaagtaattctatatttagttttattattaatcaatagtacaaacataagtatttttaattaacaatagattagttcatttagttaaacatgatatacgaattatttataaacttttaatttatttttatgtctttaatttctacaaataaaaaaatatttttattaattctgttgactttcatttaataatgacaaattgattatctaaaaaaaagtaatgaaaaattgatgagtagatttttgttaaaaaataagcatcttaggggataactaacggtcaaattgatatgttggtccacacatgattaataaattattgtatttattaatgatttagtcttttttttacacttagtcattggtaattagt

SEQ ID NO: 3689 - DNA, 1128 bp, Glycine max
  Soy_ogl_883 Gm03:35280101..35281228 Cluster 15
ttatagttaattttgactcttcttattgttgtttaaagattcaatatattttataacaaaaaataaaataaaatagtatataaatgtaatattaaaatagtgtctttatttgaatgaatatgagatatctctacccggaattaaagattaattctttaatatattacataatctaaataatcattataaatacattgtacagtaaatatttttgtttgaccaaaataatgctataagtacatttgatgttggggcgtgtggagtgacaatgtaagtacagcaatcatatcaaaatttttaagagaaaaattaaaattataagaaattgtaaaaaaataatttatgcaaaaaaaaaaacgtcacgggagaaaaggaagcataagaatacatttaaaaatgttgaaaatatcattcaattgtcatttcatattcgcataaaattttcagatctttttatttccctcgattcagaaggaatttgatttgcaaacgtgggattgtgattgtagcttgaggacgaaacttctcattctgaactttctgaacaaatattaggcgacgacggcaccaacatgggaaaaaaaacgttattgatttgaacgcagtgattcaaaaagcgcttatactaaaagttatttccaatttgagtgatcactgagcagatcagggaaagtgaagatagatgccatccaatgactgaaatgcataaaaaaaaattgttttagacagcgggagaagatctgcaggtttgcaatttgcattgattcaataatttaagacgaggaatgataaccacattctttttaatatttggttttgaatacttttttaattgattaaaatttattaaaaagcattaactcagaaataaagtctagcaaaataattgattttcaatcaattctaatccattaaagaaagagtatcccaaagaaaatgttcaaagagaatatcgctattattatttaaaaataaatacagagatttttatgttattatttaattatattttttttaaaagtatagtaagtttattcacttttccatcaacttaaaagttatatttatgatgttttaaaactacaagatattaaattcataatataattatctgatattaggatttgt

SEQ ID NO: 3690 - DNA, 1000 bp, Glycine max
  Soy_ogl_671 Gm02:45282901..45283900 Cluster 15
atgaaaaaaataatgtaataccaataaactgtcaataataaactaataaagtaattaaatataataaataaatatcaactcatcttaattaagatatttttcatatttccatacatagaataattagttttaaaaatttgtgtagtagaaaaaaatatgaataataaaattaaaagctaaatataatgaataaatatgaaccaattttagttaattatattgtttttatgaaacttatataaaatataaatattatagtaaacattataataaatgattcattgaatcctgaaacacttgttaagagatggatctagatttttttcccatccaaaataattgaagagtatttaattagagaaagaaaactattaaatcagatatgtgactgagattaaattgaagagttatctctgagcttcctatttcactaaatgaaagtttaaaccctcattttttcaattcttgattggagttcagcttcccctcgatccttttcagatacgacaccaattacctatggtggtgacgatgactatatactttcaaattgcagcaccagctgtctgcaacgacaacaacatctatgaagtttcaagtatacattattgcgattcaaaatcacccttgcgctacgcactcctctctaccatatctgttatttttttttatacaaacttgcagtttcaagtatatagtgtgcgcaatcagcctttattcctttccatgattttcttcaattttatttttctctttttctattttttcatcaattttcgtaatccctcatcaattcattatcttattattctctcaaaataaacaatttgattaagaagtaagaccaagagacagaaagaagaaataatatttccttaaaattcaccataacatcattgtcttcaacttcctgtaattgttttgtcactgcttgtgttctttttgctgtcattgtgtgtttttgttgtttcttcatcttaattactttctatttttcttt

SEQ ID NO: 3691 - DNA, 1000 bp, Glycine max
  Soy_ogl_6358 Gm19:3406001..3407000 Cluster 15
gagtaataatgacaaaattagtaattattaactaaccataatataatcttaacactaagaaaaattaaaaatgatttataaagcacaaataagaataagggattttttttaatataaacaaaatatgaatacattttttgttgagttcaatattaaggaatagatctaaactaaaagaagtatattttaacggaaatgctaatttgcacgaaaactgtttttgtgcagctagcacgaacgtttattttattctagaaatcattttatagattttttaacttaattacttaaaaaaatgactgccatccatttaatagttcgtctgttttgtgtgctaaattttccgtcatatacaacattgatcatattttaatctttgtaaaaagaaaaaaaacttgtcatagattattattttttaaaataaacttgttatagtatttatagtatatattgaaatgtacataatatcgtcggtaatagaagcatggtacttgaccaatttatgagatgctataaatataattattatgaatatgcataactgatccttcggctacgacaccagtattcattgaaagtacagagtaccccgaagtttgtttttataattcataaattaaaagttttttctaagattatttttaatttcactatgcttaatttatttacagttttatatgtttttttttctacttttctaatattagtggaccgcataaaattaataaattattgaaaatagttaaggtaggaaaaaattaataatattagaagagttttaaataagagcaatatttatcattaagcgtatgaattagttggcataagattgttgaagttttactcgaatttaagtttaaatcttgaataaataatttattatatattccaaacaatattttttttatataaatcatagacttgtaaaaaaactaattaagagcaactttgaaaagtgtgttaagagattttctcataaattcaagactattaaaatttc

SEQ ID NO: 3692 - DNA, 1326 bp, Glycine max
  Soy_ogl_848 Gm03:4620750..20075 Cluster 15
cattagattttgctactgcttaaaatgaatatacggtaggtggcatgttaatttcatgggatccagcattaaaggcggagatttatgttaatagtgtatgtcgcttcctcactcttacgtataaattaaaatgatttttgaaacatatctaaagcatacatattaaagagatcaaattccttgtcactcgtactgacatataatttttaaagagaccgtatatatattttttgaaagaaaattttgtttaaattaaatagaatcatcatgaagaagaatgttatacttaactatactgaaaacttaaacttcaaatcactggttgaaacaaactaaatattctagtgatttttatatacggtgttgaagtatgagtaatgaactcgcatcattagtagagtaattttatatatacacatttatttcacctaaggaaagcatgatttcatctcttttactgaataattgttctatatatagaataagtcaaatatttttgttcaaaagtacaacttaaacgataaacttacttattctttttctcactgaataggggaactatagcagtgttgagatgactaaagatcaaggtcaaatcacaaattatcttgtgtcatcaactaatgtatattatgttttgacattgcctacaataatgcatttataaataataaaaaaattgcctacaataatgcaacaaatatggtactatatatagttaagtagcatgctacgtacctcattgggaaatcactgctgaaacccttctgttagggatatgtcattctctctatactcgacaccacattaaaactagaacctttgaaacttcaatcattaatataaatgggggaaagatagcgttaaaagttaatttgagctgtcatgccttatattatatccatataaaagttaaagacatgatatgaattgccatatatagactatatataatactgtcttatatgctgtccctgctttcgtcttcccacttgtctttaaatatcatggtttttatttggcatgattgtttaatggaggatgagggttttactcacaacattgaggaagatggtaccacaaaacattgggtgagatattcagaggtcaaagtacaacaccaattataaatttcatttatattaacatttaatgttaaaattattttttgaaccgattcttgaaagttatgattaatttatactagtatagtgttatttttatatatacaaatttgtgtaaggtgatggacactaagtaagttattcatacaaaaataacaatgtaatcagcacacacttttgtggatttcttttatagggatgg

SEQ ID NO: 3693 - DNA, 1000 bp, Glycine max
  Soy_ogl_2046 Gm06:41038901..41039900 Cluster 15
tgtggtggtttagtctatttgttttaatgagaagatagcaacactttggggagaggaattgttcctatattctacttcatcaaaagattaatttcatgactttcaaatgtagaaactttttttgctttaaaatactattattttgttgaagataataatagagttaattctttgggagtcaagaaatagagttaacacttgtgggaaaaccattataatagccctctttaatgtttactaaaacaaagaagagtcaagaatttttttaatataataaggagtataattttatagtaaaaaaagaaagattataataaataagtctatgaattataaataggagagagaaaaaattattcaagaaaacataattaattaattgttgaaaaacggttaaaactggatggttaatgacactgaatacgtgcaaagaagaaatgctagagtttttttaatcattttattttatttgttgaaagtataaaatgattttgcttattgttaatcttcataggaaatctgactaaaatcaatctgactaaaatcacctttaatgagtatttcttctcaaacacatttttttttactcttttacttatataatacaaaaaacaaatatttattcaaataatacatccaataaattatttatatgaaggatacaaaagtattgtgtaagataaggaattgatttcttccaaatcaatttcacacttgcacaatttttttttaaatgtagtttagaaatcggtcttgaggaactgatttctcaatgtgaatagtaaagtgtatcattggagtaaatatttttttggttgtattattatttgggtaaatatttattttttgggtacaaaactccattttttaggtttaattataaattttatcaccaaaaaattattattttatgaaatttaccttctaagttttatttccgtgccttataccaccaaactttcataatttcataaattttatcactcaattgttgttttca

SEQ ID NO: 3694 - DNA, 1088 bp, Glycine max
  Soy_ogl_3402 Gm10:7183913..7185000 Cluster 15
gagggaattaatattttatatgttggactgtatagatattttataaattcagaattttgatgatcatttaatatataaaagacaattttatatactgttggttaaaaaaaaaaatcgaacttcaaaattttataaacaccacctataagcacaagtttcacatataaagattgaaatatgttttcttaatttagaaaattaattttggatggactgatattaacacaactagctaaaaaagtatgttttattgtttttattataaaatgagcgtgttctaatttaggtttctataacaaaaaagtctctattttttgtcttctgaaatttaaaatgatcgtttttttagcaattgaaattatcatttttaattcttataaaatgagtatattttgattttagtagtccctgtaaaaaattttcatccctccaaaatctaaaatctctatttttggttataaagttaattttaaggtagaaaaataacatttattttagagatttaaattatcttttttaacactattgtatgttgatattgtatcacagtcactcgtgagtgtcatttcgaaattggaatggttatttgacattatattaaacacataaacaattaacaagccacatagcaatatataggaaccgaagataaggtttcaaccttttgaaaaatgaaaatcagaagaaaaaaattataagcactaaaattaaaactcgctaagttatatagtgagagatttttcaaattaaattataaaattaagtgatttgataaatttatttcttaattttattttacatatataaacattacatataaaacaacgaaagtcgaaaacgaaagaaagaaattgtgggagggggatggcccccatgaaactcaagtagctctacacctgttcacgaagaatctccacatcgaaaaacgtttttatattgaacgaaaaacattattcatacatagtttttatttttaattttagtataaactttgaataattacaaaaatattgtctaatttttaatttgaaaaactatatatgaatgaaataatggtaatatgttgctttactttttttcttgtaaat

SEQ ID NO: 3695 - DNA, 1317 bp, Glycine max
  Soy_ogl_3425 Gm10:33863501..33864817 Cluster 15
tcttattatcttatttaatttcttgcataaaaaaattagtttgaacttaataagttttataagagattgatatatttttcatgatagaaatattttctatatattaattatttcatacttttaataggtaggtttagatagagtggggagaaaagagttgaaagtacaaagttcaagtaaaattattataaaattaaatgtctaaataatattgcacattctaattatcactaaattctatttaactaaacgataaaattctaaataaatatcactaaattattttttatttaaaaaattgagatggtttttagcggttttctaataccgacgcccatagatagatatcacagtaaagaatcaccaccaattctacgtcagctattagcgacacatcttctaactgttattgtgatatctagctatgctgattctttatttttattttttaaaactttttataattattggcatcttattgggtgctctacttctagagcaaatttgacaaaatcaattagatcaaattatgggtactctgtcatgagtctcaaattaaattcaataacaagttgaatatactacttagactatgaaatgcatgcccttaaagaattaatgttttaggactctcttttgtactttttttatggacccctgttgtacttaagttataataattaatagttgtttttttttagtcttgttgattaagaattggatgtaacttttgatttgacaatattaaataatgcagaaattttcctttctcaaatgaaatatcgccaccatttttacgtaataggaaccaacctcaagcctgttaattacattgtttattcatcaccacagaagacttcacttttatttttaactttttataatcattaacaacttattggtgatcagtttctagagaaaaataaaaaaatgacaaaaaccaaatgaaagtttgaatattggcaattaaatatccgtcataaatataaaattttcttgatctgttccggattctaatgttatttatatacattaatgttttgaaaatcggactcgcaggttccattgggaaggaatcatatgtctgatctaatattttctgaaaatcagtatatccttgaaccggttcaaaaatgttgaatcggtcggaaaccagtaaaaattagtaaatttggtgggttaatcgatttaaacagttttaattaaaattgttttttttataatttttttttcaaagtaacgttgttttaattttaaaaaagaaaaaaaatattataactcatgagaattttaagtgaagtttatttattcatttat

SEQ ID NO: 3696 - DNA, 1400 bp, Glycine max
  Soy_ogl_4207 Gm13:22657801..22659200 Cluster 15
gataaagattaaatcacatcaaaattgaacacaaactttgttagttcgtttatatagtttaaagactaaattacacctttcatttcttataaagtctcagtctgctgtccaacaaaaaatctcagtttacgtaggctttaattttttcctcaattttgttctcaacgtatctttgagttttacgtttatcctttctgttaatatatattattaagaaaaaatatgtttttggtttttgtatttctaaattgataaatttagtctttctactttgtaaaattttttgtaaatttagttcatcttgtaactttgtgatggtcaaaagttgtcactaaatattaagtttaaatattaagaggaattaaattcacatatttttaaaagttgaagaactaaaataatcaattttaaaatataagaaccaaaatcaaatttaactaaaaatataagattgaaaacacaatttttctatatattattaagaccgtatgaaaatagttttttaaagcttactctttaacccttttttttcattttttttatatttctctttactcattgagtaaaaaaaatatttgaattcttccttaacacaatccatttgataattgattaattcaagctttgcttccttgtttagatacatgctagatttactttaggttagagaggatgatgagcatgttggtcgagtaaggagataaagtgagagtatttataaagacataactttaacatctagttcaatatgcaaattaacaaagtgataattgtatagggaagagaaaattttacttgttgatagtaacaaccttttagttataacactagatatggatgagtgacaaccatgtcaatgcaatcgtgtgatgataatctaaataaagaatgaactccttcaattgttgaattcaaatattctaaactccttatttggagggtgtaagcaaataatagagattttatacttccaggtgtaagaagctccatgtgttatagagtttaagtcacatgttgagcttcaaattatgccctaaactctacaagtaaaaatgtcaaaatagggtcagactataagcttacttaattccaggatttatcaagttatagatatagtgatttactatttttataagttgtctaaggctaacttaattcgcttaagcataccaacttatgttgagttaggtccaagttttttttatatatataatcattcagtttttttttatttgtgaatacaaattagtttattgttgatttttttttttgtatttaagcctttttctattttgtgtattttttattttttaaaattgggtaagttagttcgtaaattaactcactcacttaacccaccaaactagaatttttatttgtgaatacaaattagtttattg

SEQ ID NO: 3697 - DNA, 1000 bp, Glycine max
  Soy_ogl_4731 Gm14:12808901..12809900 Cluster 15
gttttggtgcttataatgtcaatggagttgatatatatatatgtgaaaacagtgataaatttttgtaggaatcgtaagcatacataacattaatattctctttttaatataatttattttatattcaagaattaaatcaggatttaaaccatgacctacttaattaaagagtacaagttgttacccgtacttgttatcaactgtttttagttcggtaaagttagtatattaccctcctaggctcctaccaatttttattccttatataacacagtaaaatataatatttgctcattaattttgtaacaatattcttggcttaattatataattatcccttaattataattaaaagttcaatgttccttaattattaaaaagtttaataaggtaatttaattatttaaaaaagttcaattgaatctcttaattgctaaaaaaatcctttaattatttttataaagttcaattaggtctctaaattatcaaaaagtttaattaagatcttttattgggtctctaattattaaaaagttcaatcaaaatttatatattttattatacaaaaggatatgatcgtagtattttaaataatttaaataattgagggatctaattgaaatattttaaataattgaagggcttaggtggattttataataattgagaaatccaattaaaattttaattataattaaagtactaagttaatcgaatattctttcatataatttgattaaaggaaaaatcttaaattgtacgttgtagttttttttttcaacttgcaggcgttttttttttttttttggttgaacagttgtaggcaaaagtaacttgcttatgcatatattgagaacatgcataatcattgttctttggttttctaaaaaatataataattttaaatattttttattgacttcccttttataaaataaaaataatgaatattttacttttataatattatatttataatttaataattttataaatagta

SEQ ID NO: 3698 - DNA, 1100 bp, Glycine max
  Soy_ogl_1916 Gm06:13269801..13270900 Cluster 15
atttgggtggaaaacttctaatgagattgagatgttataaatcataaatgagttaatatggtgtaacttttgattgatagaagggggaaacgattcttaggcttatcaatagttcacgttaaaaagcctatcattttatatcgttgcagactcctgccctaaaaaaaaaaagtcgttatttaattattttgtgactaaaatatggttcgtcggttgaaaacaaatgtgattgtctagttggcatttggaaattgagtcaaggaacacaaactctacatgagaaagctcaactcaactctagaggctagtacatgacataaactccctattaaatgttgttctttatgacctaatacttagctgtcagaattctcagtggctagattcccattgttccaatgcgtaggcactcacgaaaaaaataaatgaaaagtcctactaaggtttgtatacgaagccttcttaagtttcagtctgaaatttattataggaaaaaccttaaaacgtctaaacaatttacattctattataaattttcctaatactttcttgataacagaattttttttgatatttatcatataaaacaaataagaagattagtaaaatatgtaggatttaaaacgtgttaaaacattagtaatatttaacataaagaataggaatatttactattaaaaaaaatgtgtaaaacgctgaaaacttgagacgtgggataccaatccacatgacttttgaagtcatacatgttttttttctaatgtgcaacaaacattattttgttgttaatttacagatttaaattaaatataatttaaatttctataatataacaattttttgctttaatttttttaaatgatgattttagccttattatttttacaaaataatttttgtcattcagtaataacgtgatatgaatttaaatatgtcatgtcaatgattattttgatgtaacatatgacaatatgtttagatacatatttattattaaataataatagagactgtttttaaaatttacaagaattaagatcaatatttttttaaactaattaaaatatcccatatttgtaggattgataaccgtattatac

SEQ ID NO: 3699 - DNA, 1000 bp, Glycine max
  Soy_ogl_2330 Gm07:10827201..10828200 Cluster 15
gttttgttgtgttctccaatctagcatgttcaggtggtgccctattttctaattactcttacgtagtattgtcaaagccaattcttgtttctttttctatgttcttattcgtacttctatgtttgctccttcattcttctaagtttgtatgggcagttttttattttctctttcctttgtgtttcagacaaaatagcaaagaagaatcccttgcatagcattctcatacaaacatgagaggtgatagaaatcttgaatgctacttaagagatgtgagagaaatgtttcttttctattttttaaaatagaaaatattcaattgctataattactattacaagctttaaaaaatttaatggaaagaagacataattggatatttttgtcctaaaattttggtggagcttgctaatacacaccaactagggtggatattagcagtcccctgtatgtatataatttgatacaactactcaagtttatctctgtattcaaagtgatcccaagatgttatcggttttagacaaaatagcaaacgagcatctcttgcatggcattctcataaaaacatgagagaggtgagagaaattctaaatgctacttaagagagaggtgagagaaataccttttttattttttaaaacagaaaatatttaatggaatatttttgtcctaaaattttggtgaagcttgttaatacacaccaactagggtagatattagccgcccatatatatatatatataattactcgaatttatctttgtattcagagtgattcccaagatgctattagttttatcaatagtactaattctacctttagtgtttgctatgttattattgtgattttgaggctttcaattatatgatttaaaattgtcaaactgaacttagatgcaaatgaaaaatcattttatttctagttttagcttaaaatttgaatgaaaaacatttatatttttttatttttaggtttgaattatgggtgacaaccaaa

SEQ ID NO: 3700 - DNA, 1046 bp, Glycine max
  Soy_ogl_5756 Gm17:38261255..38262300 Cluster 15
tacaacagccttataaaggcttgagtataaatcaacaacagtctgaaacaattacaattttcaaatgaggaagaaagtctgttgagcaaaatagagatattttaatatacaaacttgttttctcgatatatctcttactttaatgtgacctcctggctctaattattagagatcacgatgatggtgtcactatgagtgccaaaatttctttatcaacctttgaaggagtggaacaaaattagacctatcaagagctgctttttctttcaaggataaggatgagaggtgaattgtgattagtcatccgctccacaatggctatatatgtctcctccttataatggaagaatttctaagtggtcactgtttggttcttgaggcagaaagaattgtcaatcctgtatatacccaacttgatcagcacgaagctatatgaaccttaaaaattcaataacaaataggatatatatatttcgaagtattggtttaaggcaaataaaatatagatttgatggatttcatatatttaaaagatggatttcttactatatacccttttattttactcttaaatataaatttcacccgattaatctgaacgttggttagaaaaaaaatgaatttaatatttatatattaaagtttccttttaactcaattaaactatttgttcatttcaattcatttattcattgagtaattttttttgtcactctgttattgtcgtaagacattaacctatttttgttaatgagtaatcattaccgaaaaatttacctaattatcttctctaataaagttttttcttctcactttactaaagaattctaactaagttttactcaaactaattaatctcgagtaatttaaatctagcaactgagaattgtatttctatttatataaatacttataacttatggttattttaaaaaacttaattaactctcaggattcgatcttcaaaaccttcatatatactccccttctacatgcatgcaagaaatttattctatttgccggatttgggaaattataattaggag

SEQ ID NO: 3701 - DNA, 1300 bp, Glycine max
  Soy_ogl_23 Gm08:17589401..17590700 Cluster 15
aacacattaagatttcagtctatcatgtatggttcgagaaatttcagctctagtgaagtctgattgggagattaattagatgctgctatatttggagaaaagctaattttgtacctaattctatgaccaacttggatcttcacaaattttctgttgttccaaattgtgtgcttattgtttgttataattgatagctatagatcttaatttattctgcaaatgatctccttcttaggcttcggacctttgttacaccagaaaaagaagaattttagatcttgaattactacatttggattatcaaaactaatcttcaatttatatattttgcttttgacgcccaatggatcgagctgaaaaaggaaaagaataattaaagacgtatgtacactcgatgttattccacctgggtgagaaattaaagaaatagaacacagagaagtgataatatgattcgttatatatatgataagatataagaacaaaaatataaaagatgaaaagggtaaaacgagtgtttacactttatactatctatgtgtttataaatcgatcattattgaaagaaaaatcctaagaaaatattcttttatattgtatcagcattgcactccgtcaatattgttgattgttgggatttgttttgtgcaatgcatcttatttttcatttgagataaacgaggaggaaaaaaggggaaaaacaaagataaaatcaataaatataatgagaggaaaactccctaaaaggttgagggttagtcacactgaaatatgaaaaatataatttttgtttagaaaataacatatggatacttgtagaaggagatagatagaagaagaaaaaatataaatataaaaagtaatataatgtgataaaaaaaataagaatatcaattaagtgtatatattacactttatgtatcgatattctttttatttttaaaagaagaaaaagctaattaattaattattttattttttatataaatgtagtcttttttaagggctatcattatgactcacctcaaatcttttgttcacttttataatgatgaggatcttcgaattttgtaagcgtcagcacggctttgtcaactacagtagcaatcttcaaagcttgagtccacacgtctcgtagcatttttaatcggattcttaaagctggatttttttagctaaaattttgtgtgcattatatttattattatttttacttaagaatttttcatgtttggaggttggatttttagaaaataatttttaagaactctttttttttataaaaaaatatcatttttaa

SEQ ID NO: 3702 - DNA, 1300 bp, Glycine max
  Soy_ogl_5377 Gm16:30223701..30225000 Cluster 15
tagatttggattacaatttggaaagctctaggtcatgttctggaaagctcttatttgattttgaacagctcatgatttggaaacttgagactgaaattcaaaatactaataagtattccatgatgatttttcaaaaataaattgaatgaataccacttatatttcagcttatatataaaattcagaaattacttcttttttattttgattaatcaagtttaattaaatggaatgaaattataagagaaaattatggtgagaactgaatagaatttttgaaaaatcgagagacgaattaatctttatgttgcattaaaatatatatacataatttatatgaatatcagctcctaaatcaactcttatatacataaaaaaattcctaccaattaacgagacagatttttacaaatttgcttgagaatgaaacatatgtaatcaaagcatatatgtttaattagatgggattagttgaaatcataccaataatttgttatgatatgggttgataaatttacatcataatttatttataatctatacaactatacacttccatgctgtcatgtcagcatatttgcgtacgtgttgatttctaacatttattacatcttccgtctactctctacctaatccagcgttcattcccaaatttgacttaaattaacttatcaaatcttttacccttccattgtccaattatcatcccacactttcttcttcactagaaatggaaggtgctattctttcttaattaaacgcaactttgtcaaccaaagactttgttgtataaaatagtgttttaaagcatgatttactcattctttgtaataaattaaaaaaaatactcatttttgtattttttttataaaaaatatcccttggagattaaaaagcctatattttcatatataagatttcgtcgttgcttactacttcgtattttgtcgtcattgtattgatattactttaaaaaaaatatatcaactagatctatttttaagatagagaattcttattaaggtattttaacatttaagtttaagtcggtgaatatgtaaattagtagactgacaatattaaggaattatgcatacttgattcttttggctgtgacttatttattataagatctgaaatgaatgtgagagagtaactatttggatagtcaagcacggccatgcgtcgtgtaaacacacttagtgtaggcctctcaaacaaactagaagaaaattatagaattcttaacaagtatgatgtggaaaaaagccaataaatgttgatatttccactactattt

SEQ ID NO: 3703 - DNA, 1238 bp, Glycine max
  Soy_ogl_841 Gm03:4536663..4537900 Cluster 15
agtgctactagaaaaatttacacctaaataagcccttaatagctgagggactacacctaaataagcccttaatagctgagggaccattcttcttgtctgtgttaacatattggcaaccaatcaacatataactgagaggtggataagaaaccagcaacacaaaattacgtaactgagcaccaaacaattaacatacacaacaagaatcaggaggctacaattctcttttaacgcattggataggtccgatctagggtaaagaactaaagtctacactttagattcaccgacaaaaaaaatttactattaatatttataaagtaaaaaagtttcatatgttaataaaaaggatacatatattattaaaaagactcaacataacatattaagtaatccatttcttttaaaatttcttttgggcctcattgattattgcgtcaaccttgcatgtgacctttaacaacattctttggttaacagttataaaatgtaagaaattgatcccattaacatttgctaagtaacatttattaaaattgttgtgatagatgaatttcagcccctttagcaatattttcttacttacatttattaaaaatgttgtcatagatgaattcaacatttcttttcaacattttttttttgaaaaaaataaatgttgttatagatggtgccaaacgttgttgtatattttttttttataaaaaaaaaaaacaaatgttactatagattaacatttttttttctaaaatgagattgcaacatttttttattaatgatattgtgacattgttccttgtaaaagacataatgtttcattgtttttacttatttttatttatttatttattttctttttcaaacttttcaaatttaatttttaaatattttatttaaatctaattctacaaaagcctcataatgtcgcacactctctctcttaatcgcatttgtcttttcattttgatcttcaagttctagaaaatctaaattaaaatcaggttcgtgtatgactttcctcttccattaaaactcaaattctatttatataatttttccaaaacctcctatttcctcatgttttgcatttgaagtgtttgataaatgtccctagtgaccattattttattagtactaattaatatatgcaatgttaaatcaatattattgatcaattaacactagaaaatcgacattgaatctactatttggaccatggtcaacaaaataagactcaa

SEQ ID NO: 3704 - DNA, 1100 bp, Glycine max
  Soy_ogl_1805 Gm06:6596601..6597700 Cluster 15
aactggaccaacaaaattcacaagttttcatgccctgtatataagctccttatctttcaaggtaagccatttttaaaattaatgacaatattttaaaaaacaaaactaataacaatattttattacagtttaaaaaaacaatattttattaaaatgattatatttttattgatttttttttactggattgaaagtttattgcttaaactttaaacttatatacacagaccatttttagattagtatacagcagcaagagaataaactagagaggctagtagaagtccatactcagagtcggggagttcaataataactacaggataaatttttattttgtataataactaaaatttatgataaataattttattttatttttaatatataaattgtattataatttgtaataaatactaactattttttttgaaaaaaacaaagacaacatgaaaaagaaaagagtttgagtaaaatttggagatgaaagtttctttcgttactcgatgataaagtaagattaaactaaagagcttattatcttaggtctcttccataaattcgcaaacccgacaacatattaactgttttctactactactgcacttattttccctccgtattctacaaagacaatccaaataattaatcaaaggaaaacttaaaattgacacagcactacactctctaagcgtttatccaccaggccaaagtgtcagcagatgaattcaaagcaaagatagcaaaggactcgaaacaaacggaaattagatctaacaaaacaagctaatttctcatggcaaacaaaagttcaatttttttcttaaacagctaattgatatattaatatattgaaataaaaggagtacaacaagaggatacaaggatagaaaagttcaaattttggttaaaagaattgtctgacatatttaatacttgaactatatttgcttcctagggagaatacttcgtgaggggggaaaatcctcaaattccgaccatagcacagctcacaaacccgtaggaataacccacaagtgaagttggggctcaagtttcagtctaggcactagtggttagatggattatatatagggtgt

SEQ ID NO: 3705 - DNA, 1400 bp, Glycine max
  Soy_ogl_2065 Gm06:43934801..43936200 Cluster 15
tttagagtcaatgttttttttttcaatagtaacattcaatattaaaaatattaaaaataattatgtaggaatggacttatattatttcaatagtaacttgctcagcaatacaatcaagaatacaaagatagtgatggtaaccaagcattcgatatcttaaaagcataaaacgtatttaacatatttaaatttaattactaagaaatttattaataaaatttaaaattatttttttaaaatagaaatttagtcacgcgcccaaatccaatctcaatttaattaccagcttgcctaatatgggattcaacggggggaaattcttcaaattacttttttgcgaggtattttttttcgttttttaatcaaaattgggaacaattttatgaattatttaattcaagcaaaagggcctagaaagtagcaagaaagaacagaagtgtgaagacgctcttggcaatgattattttccggctttgtgagttcactttccttctttcttcacttttttcctttatcaacatagcctttaaagatattttctataaattttatcaaaattcctttataaaaaatagttaaattatttcaaagcccttataatttcattaaatttttacagtttaatatttttaattttattcttaattttgttaaactataaatacttatcattttaatgaagttcttgtatttaaaaaatttaaatagattcatacttgttaaaaattcaaaattttagaaaaattatttctataattttggtgaataacaaatagacatgattagataaataagctatgaaaactaacatttacattttttatacattaaaatttatggagaagggatgagtgtagaacatttacataagtattaatatctaccttatctcaaagaaatgagtgtagatttaaataggtaacttgtcataagtaaaagtttatcttgctctacttgaccaactccctagaattactagcaagtttacttttagtatacaaaaatcacataaaacgaattaaatgttatactaacctcaaaaaaaaaaaaaaagtccccacttcatctgagaggcacacaatttgtatagaattgtctgaaaatcatataatcgatattctaaagacttaatcttcctaagatcatccaaaacctctcaaatattgcttaagacaaaagaaaattgaaatctaacatctagagagcaaagcacaatctagaaaactttacttgacacaaaaaaatgtgacaataaatagtttaagttgaagacaataggcagccaaaacaattgttatttacctgaatgaaaaacctcgtacctcagcagcggcagggaccttcgttggagtttggcggtggctcacggcagcgacggactgggaagagctttttgaggt

SEQ ID NO: 3706 - DNA, 1300 bp, Glycine max
  Soy_ogl_2386 Gm07:35843401..35844700 Cluster 15
agagtaaatatatattttctctcattttcatatgctttccggtttgtggagcaaaccagtataattatccattttcgctgctttaacaaaagtaaaaagaaatgagaatctctatataagcaaaagaaattctctccagaagcatctcaaaaatatgatgtgtataaaacaaaagttgactaaaaagaaaaagaaaacgatcccaattaggaaaagagggaaaccaaatggataatttcttttacgtagccaaacttttttttttttgggtacattattgttcttttctagtctccttattttgctctctttcaaattttatccctgttcaaaacaatctttaagcattcttcactttgtaattgtaacttcccttctatttcctcgaaacatttcttttgttctttccttcttttttcccccttccatccttttccggttttccctttacttgttccttcttgttcaatgtttgttcagtttaattacctacatacgaagttagaatagtgagtatgaaaataaaatttccttgtaacaattaagtcttacttagtgaggaataaatgtatgtaagcatttttaatatatagccactaaataacattatccattcaaagacggaaggctcgaagaaagtaagcacgtatgtaaccatttgttgatgttcctcatgttcatatggcatcatcatgtggtcatgccattttacggctttaagttagtctcctttggagtgcatgcatgggtccactactccatgtaaagtcacccgtttcccacgtgtggtgaacactcgcctttgagcattctcatgtaggcatagcaagtttggaaccaacatcagttgaagaatgaaattcaacacaattgtaatgaaactaaacttacattatacaattaatcataatctaaaacgatatgatgatgtgtattttataatattaaaagaagtataatttttactcgatctctgtattttttaattttatgtgtttattcattttcttaattcaatcatatattttgataaattttgttttgatgctttaataaagttattttacagtatgatttatgaataggctaagatttatgaatcaatttatgttaatatttgaaaactttgatggcaaatttaaattgaaattccatacacacatgtacaattttaaatttgacatctaatatgactttaaaatatttttagttataatacgattatacttatcaattttatttttctcattcgtataccaacaagtccttagtattaggggaactaaattttgtcctttaa

SEQ ID NO: 3707 - DNA, 1300 bp, Glycine max
  Soy_ogl_2434 Gm07:39134101..39135400 Cluster 15
gaaattagttaatgcatgttgacctgtttacaggtaatgagaagccctaacgctttcttgcatatagtagttgataaagagggcatttattgacaacaactatcgagtttgtaacgttttcatttatgtgagctttttcggcatggattattacgtgcctatcttatacgtgtgatggtaattccatttttttggtgtactgatgtactacatgtactagtaattcctaacgaaacatttttattatgttgatattcttataaatattaaatgaaaatcatgtatttaacatttaaaaatattaaaaagtattcaataatttttatatactagctatttgaagaattattaaaaagaactgttaagaactaaaaaaaatatttatcttttatatatttctataagataatatattttgattccaagtttttgatttttttttatcattctaatatataagttattgaacactagtacttgattgctctctaaaaaagtattgctagcttttctatatgactttaaatactccttccatttattataattatcgtgtaaaaagaaaaaagtatcttaatataattgtcattttaatttttttaatgtatgattaattttttttacttatatcccttatatattaatgataaattataaaatttaaaaataaattaatgataatgtaaggttaattttgtaaaaatattattctttttcatttatttattactttttcttaaaaatagcctagaatgactattaatttgggatggagagagtaattagtaagaaatgtagtaataattattaataaatgcttaatgagattaacttaagtaaaagaccaattgcgacttgtaaaagatattagtctttataaaatataaagtaacgaattacagttgaagcatttttaacactacccatccgcatttttcttttaaaaaatattacctaaagtatatgagaatatgtgaaattgtggcttaaatgtataggcaacagttgtatatataaccattgtctaaaccttaaattaatcattgtccaagttgtctatataaatagtgtggaatgtgttgcctaaaatacatggcaaccttcatatatttgtggcctcaacatttattgttggagtataagtctaaagcttgagtctcatattaagtataaaaatataatttaagcaacatataagtaaaaagacgcataaacctaatgttttatagttttagattaaagtgtaatgtcagttcacttgtgtgatgtgttcatggtctattgacataaatctccttag

SEQ ID NO: 3708 - DNA, 1100 bp, Glycine max
  Soy_ogl_4337 Gm13:29121301..29122400 Cluster 15
ttttgtatctcaagttttgaatgcattttatattttcaagacattaaatatatttacttttttatttaatactttgttttataaagtagtaggataaaatagtacttatatactttttgtaattaattgatatttattaagattaataaaattgtgtcactcacttcctatatatttacatgatttcgtgaaaattaataatttttaagtaataatagaaattgtatattacgaaaaatattattgaaaaaagtgttactaaccttttctggtgacaataaatataagtgagctgaataagagatttttagccgaaaacgcaagcatgcatatgtagtgaagataaaggaaaaggatcaagaacaacataatatataaagaagaaaagaggatcaagaacaacataatatataaagaagaaaagaggatcaagaacaacataatatataaagaagaaaagaggacacttattattttcaaaggccctacgttccattgaacatgactacattagtatgcatgcgagaggacgcatatgcatgcttagggggaatcaggagaggctatcgattactctgaatgaatggacaataaaacacacttaggttggatattgggtccagtgaaatgggttagttcctaagaacgtgatacattattaattaaattttggttgagagaagagttcaaattttttgtatcccacccaatcttgaacaagattccttttgatagaagatacccgtgaaataaatataaaaaaaaaaacactttggtgccatacaattaatatataagctagaactaacgcaagagcagaaaaaagaaaaacaacaaattatatggagtattgtatcgcctactttgccacatcgaaatttcgacttcaataaaacaaaaatggagacacaaatctaattcaaagatatatactactgttttttttttctttccaaaatcttgttttgcaaagtgatctagtcaagtttctaatgattgacctgctagattctcatattgatgttggtggagagcaaggtgttgatcttgagcacttaagagatgttatatgaatacctttaaagacgctttaatattca

SEQ ID NO: 3709 - DNA, 1000 bp, Glycine max
  Soy_ogl_5662 Gm17:13006301..13007300 Cluster 15
aacacatttttaatgttcatgggctacttaacacaccagctcgtatatagttataccctagcaacatactaacggaccattattatgctaatttctgcaattggtttgttatcaacctcgagcactgtcccaacatgacaaacaatgaccgcttctccatcaccttccaacctcagttagcagggccgacccaataataagcaaacaattcggtgcttttatttatgctgtacaaactttgtgtataagctgggtacatcttgtactcatcacaaacttttgattaataaacttttttgcttgtaaaaacaagtttgcttctaattataaaaatcacttaaaaaatataatcagattacaaatagcttctaacttagtaactttaatcaaattttaaatttctttcagcttttgattattttgaaaaaataaaacaaatgcatggaaattctttaaagtgatctcttttttaaaaaaagaagtgatttaaataaataaaaaaactataacaaacaggcatttagaataatcttcatttttatatattggcgtgtgtggagattattttgattgtaactttgttcctacttgaagaactatctgtcgcacaccctaggtgtgtagatattattttgattataattttatacctatttgtatgactaggctatagttcaccttatgtgtgtagaaattttgattataattttatacccatttgtagaacaaggctctagtccaccctaactctcctgctccaacaaaactgctttacacaagaacaattccaattattttgagaaattatccaacactatatttttaaaagatgagtactaacaatatactctgttaacacacattttattattaattaaaatctattgaaaattataaaatcataagagactcattaaataaaaaataaaatttgacaaaattagatttttaatcaatttcaatgaagagtcttggacttaattaggcattgaatatagtt

SEQ ID NO: 3710 - DNA, 1000 bp, Glycine max
  Soy_ogl_4038 Gm12:14603701..14604700 Cluster 15
cgaaactgaaatgcactttaatgatagaagtggccgggcaagaatcacatgtacatgatttattttcaaatgttttattctcttttaatttttcctttgcagtcatctatgttggagaacatgtcatattagcgggttaacgttagagaataaattaaattacatttatttttaatagtggttaaagatcattaataatggttgacacaaatgtgagaacttatattctttaatgaagttgtctaaggtttaaattctaatattaaatattaaataaactattttaaaagaaaaaacgaaaattaatcactaatttttagtgataggtacttcgtatcaatatagaggtaagaaaagaaaaaattattgttagatatttagcttcacataaatttctattgcattcaatgctatacactggtatataaaatgtatattttcttgttagactggttagacacacaagcatcacataaatttctaaagtattcaatgctacacacaattcctataatttctatattttcaaaggtagaaatgcagaagaatgtagaatgacttaagacatttatagaagctatagacgataaatatctagttgattaaaacattaataaaatcatgaaaagggtagtgtgtacgtatttgtgtatttaaaaatttgtgtatttaaaaagccagcttttccatgtttgaccatgcgcatttttgttctttttctttaatttttccttattttgaaagtcacatgtatatccattagtaaaacattacaagattccgttgtgaaataattaaagcacttgcgtttcacccagaaatactagctagcgtaacaattattcgttgactggtattacaatgaatctgtagtcccgcatggaatcatttgaaacgtgaaatttgtagaaaaagctattttttcgtccatatagaatactccattaacatcaagagtagaacattgtagccacatataattaaataactgtctaatatg

SEQ ID NO: 3711 - DNA, 1104 bp, Glycine max
  Soy_ogl_4755 Gm14:35242401..35243504 Cluster 15
atagatacttataactatttaaaaatacttaatgtgtcaataatatccaacaattcatcaaatatttttttttgaagaaaaatacaagtaagacaaaaaaatacttaaatgaacaaatcttcaacttgatcttttaaagtcacatatttatcattgaattttaaagtttattaaaaaaatcttaaattagtcttttaaaaattaaaatatctagtatagtaaaaatatgtcaccaagtttctaaataacaaatgtaaagtgatcattaacaaatactcaagacattaaaactttgatatattaatttactaacaattttttaagaaactaactaatatattgacaatttcaatattttgagaaattaatttgtttatttttttaaaagttgacatatagcatgtaattctaaagaatcaaattaaggatttttttttttaaaaaagaataactttcttaacaaaaaaatttattaggtagcgtacaaaaaacaattttaggtgtaatagatatatactagtatacttataaattttatgtagttatgtatttatctacaaaaatagacatatgttgaagtgtgagcatgctagattctttgaaagctcatcgttgtcgtattaaacacccgagggattggaacatgacactattagttttaattcgaagcccagaaaacacgaaaaaactttcgaaaagttgcagacttaaattcctacatattctatttttgcaacattctgttatatttatcgttggttccttattaagtgacctaccacgtactcgatgatgttatttaacttggacaatcttctgtttttacaagtcagaacttagttttggagtatctatttatctatagagttgaaaatcccaaaggaacacgtggaaaatcgggaaatgtggataggaacaaagatatcttcagacagtaaataaaaatggggttggaagaatttttaatagcaaggagattggaacagccacgcaagtgccgttcctatatgaattgtcgttgaaaatttgaaatttcttttttttttttttaaagtcaaattgttttcatgttgtttgaactttcatcaagtttttaattagatc

SEQ ID NO: 3712 - DNA, 1200 bp, Glycine max
  Soy_ogl_5978 Gm18:7440001..7441200 Cluster 15
ttatttcatatagttttatttgcatatttagtcaattcaaagagcttcacagaaacaataaactagtatgttaagcctagtaaaataggcatcaaagattagtgcatgttaaaattccaatatgactaccacaaacataaaaaggatgatgttaaaacattcatttggatcattaattaaatacaacctaaatagatctcttccattctagcaacaactgaatccatgtcttatgagctgtagaggaaaatatctcagacatttgtgtacaattaaggaacaggattttctttgacttaattaccaaaagcgctataaccatcaagaatagcaccaaagcagctaatagaactgtttttgctcttcctttgggcatcaaaacacagtggctttgcatacgaagttctagatgcacaaaaatcctagtgatcaacataaaattcccattttgcaaattaacactcaatttccctgcctcaaaatcaaatacgcaatggtttaagttctaaaatataaacatcagcgctgtcttattttacactccaggtttagttcttaagtgaaataactgaagtaatggaaaaattaaaagagaaagaaacaagtgaaataaattcatttttttggttaccttttgttgcttagcttgttcaattatctcttttgggcatttttttaaagaaacaatcagggttgatgccttcaaaactgtgatttggtttctctattggtcaaactagcttatatgctaaggagcttgaaaactcaccgaatgccttaccaaaaacactagggataaactaaataatataagtcattaatggaataactaatatagttaagtttctaatacattgatgatttattatgtacatttacataatattgatacttggctttctcctcaactatccagattatttagtgcttatttggttctacactgtgctcattagatatactaatattggttcattaattttgggataaactgacttaacaaagcggatataaacttagcaagaaagttagaaaaataataaaaaaactacctgcggtccatttcatgtcagcattagatttcatgtcagcaatcataataaagcttcaacattcaaccaccctcttcccgcacatgaatataaaaaaaaaaaaaaaaaatccaaaattgacagatgatcgtagatgatggatatctaa

SEQ ID NO: 3713 - DNA, 1058 bp, Glycine max
  Soy_ogl_6101 Gm18:48113801..48114858 Cluster 15
aaatagtatgtgtggttctgtaaatctgtgtcagttgaaatcttagtgattgctaagaattatacataatattaggattgtgagacgaatcaatataattgcatgtgtttcttttctttattctattactcttaatttcatttctactaatgttaaaggatttgaatatgtagaaaaatcttatttaaataaaggattttataaaaaaaaattttctcaaagtacaataccttcctgtcatcctatcaagcttaagtctttcttaagttagcttagtttgtttagtctttagcgttttctaaaatgatttgaaaaaaaattaagaaacataatttaatctattctcatttttttatatgtttttacagtttagtattagagataacctttgggttgaacacctttcggtgttagaggaaaagattcacaaactatcgtgacaaatctagaaagttatctcattgtggaaagaactgttacagggcccttggaggcttcgctgtgacttttttaccattttggttatttttttctcaagcaaattaaaaaccaaaatggatggtcaagtaaattatttacatgtgataggatatttttaccacataaaatatagtaggtgttattctatatgatgcaatgatattttacaagttattttacaattaatataaaataataatactttttttttcatcaattgtaaaacaatttgatgtaaaagatcattatgtcacatatgatgatatctcttgcatcttacatacgccacaaaaaaaaacccttgataggtaaataatttatttgaccatccattttgatattttatttgagaaaaaatccaaaatgataaaaaaaaatccttctttagagacaattacttttactgatgagacataatgaaaatattcattaaatcaatgcattataatcattgggagaggttaaaaaaaggggagattctcaaccttcaagaaataaaaatggaaatcttgttccgaaagtcacaatggacgatcaggaagatatcaataagatgcaactcaacgccaatactatgt

SEQ ID NO: 3714 - DNA, 1046 bp, Glycine max
  Soy_ogl_6708 Gm20:23832401..23833446 Cluster 15
tctctccatgatttttattagtatgattagaagccagccaatcatgtaggtgactgtcaaagaaggcatatgaaggcaccttggtttgtttaggttgaattgtgaatttgattcttaaaagtgtatgttaattttaatttattccttaaatattaaaaattttaaaaaatgtcctgaaagtaatttctgtcgtttatatttgtcattcgttttagaggtctttacatgttgttattaaaatataattaagagtatgtttggtccaatttatttttagcttaatttttaatttaagcttaaataaaaattgaaatagaaattaagctaattttttttttaaaaaaaaaagtcatgaaatataagctcttatataaaaaaaagtatcttttttaatgaaggaaaattaaaaactagtaactttttaaaaagttagcgtgaggagcttcttgttagcttgagcagagcttattttacaagcccctcttcgatatccagtaaagacaaataacttataagttattttacaagcaagaaactattttttaaaacaaaagtagtttagacaaatacactaaaaaatagaaatctgtttattttattaatataagcgcttattttaactaataaatttaagcaaactgacattttatctttaggttaaaagcaacttaaagttcaaagaaaattgggtcaaatatatcataaatctatgatatcattaaaaagaaatttaatttttagagaccaaattttatgttcattataacctgcaagaacctatttgaaacgaaagatgaatatgaaaagcagaagctactttcaagaatttttttagtttattaatattgagagacttcatattttttaggaactaaatcgactattctatcctgtagtttttaatgtaagaaaataatatatttgcaggtttccaaactagcctatagggactttagtaggaaattgaggcagacatgtagaaattctattaataatgttacttgtcagcaaggaaaataaaccattaaattgcattagcatcaaaa

SEQ ID NO: 3715 - DNA, 1400 bp, Glycine max
  Soy_ogl_6039 Gm18:14639701..14641100 Cluster 15
atgtttttaccgccgtcggtctttaccgttttcttctgtcccaaattaaaagcctctccatctcctgctgatgataataagatctcccttctctgtttttttttatgctgtttttttttttcattcaaataataatgtataacaactgtattaatatttaatagtatataattttaaagaataacacagaaaaaaaacagaaaaactaaatttctcataagagcgacaccaccacagttgattaagttgatcatatttctcaatagctatctatttaactacttttttttttcttggattgcattgatgtaattaattaagatgctaagtaaaatttaacctagacactaaataaagtatgaacatatatagatgtttttcccttgacttaacttgggatgaaatacgttaagttatcgaagattgaatacgggattgcagttgtgcaacaaaggattaccaagcacactttgtctcatattttggatagagtttttagtgttaatttggaaatctcagaatctttccttaatttgcatgtcgtgactttatccaagtcagtaactacggctctcttcctacctagctattaaattgtatgcaaactgttttgcggcttgtataatgatgagcttcacaagaattgaagatccttttgtgggaaattagggattgaattaggaagattaggaataaaatgattttttaataaaatattaaattaaatattaaaataaaaacataaaattttctataaggtccttaaatttgaattacgaaaaaaaataaatttaaatttgattgggtgatatgatcatgttatatatatgaagttttgtgattgaattatatattatacatatcggtataactttaagtcacaccaaagtattgttcatttgtttgttacacgttttagataaaaataaatctaaagtttattagtacaatgttagaaacataatttcaaaacccagttctatacaaaaagcctttcgaaagtttaattccaaaatgtatgacaaatagaaaagaactattggtagctctcttcggtttctccttgttaccatcagcaatttttggaattttgagtgatcattttgaaatttttaatgccatttagggctagttttaatttcacacgtaagttgtagcatttgtcccctctaggaaaaaaaggtaggtttgtggacgagataagaggtgatttaaaaaataataattaagtgtagtatatgtcgtatttttaatgttattttttaattaaatcaatattttatctcaataattagtgctatttaaattgtgtaaattattattttacatggttgaactgcttattttaaactaactgcttattttaaactctgtacttgagttgaattcttacaaataaa

SEQ ID NO: 3716 - DNA, 1163 bp, Glycine max
  Soy_ogl_6698 Gm20:3849575..3850737 Cluster 15
gtagtagcggatgacaacaacaaatatcattatcaaatatcaaatgtgagaaatgtatgttttttaaattaaaaattaaattcacaaaacttttttcttgattttgaaaataagtgtaaaaatattttaaaaatgatttaaaaattattttagctccatttttactaaacacgttttcttttaaaaattacatttaaaaccctaaacccaaaaactcacaaccaccccaaactaatgactccaataaaaaaaacttaaaacttgtaagagtttatatattgaatttattcataaaaaggttaaaaaggatccatatacagcagcctccttgatttaattaccaacctatatttgtaccccaagacctaaggtatcgttaatcatttaataaattatttgttttacgcatttttttggatatataatttttaaataaaaaatctactataattaattgatatttttaaataaaaaatgaaaaaataaaataaatatactagtatgaagtaacaaattccttatctatcaaggaagctgctacaatccaaatttataacaaaaaagtttattaataaatataaatatacattcactttaattagaatgttttaataaaattactgtatataataaattactcgaatcacaaattactgtatataataaaatttttaattttataataattatttaaaagttatatgtatggtaactgttaattaattataacaatatatataagaaattttacactattaaaattaaactctttaaactctcgtgttcaatacgatttttgtaagctcctccgtcaaatatccagatggaatgtactagaaaaatccagatggagcgagcattctatagcaattttttttgttacataagaaaagaattataaaataatttaaatactcttacaaattacgtaactttctttgaatgccttatccaaacacacagtagaattttgcacaaataaaaaatctaatatgatttttttgattaaatagatcgttatctttgaactatttggtttgatttacttggttgattacatttcgaaaattataaatttcgctttcattaagaatttgaagctgagtctgcggtccatattttttctataataaaggtgatagactgatagccgtgtctcacct

SEQ ID NO: 3717 - DNA, 1400 bp, Glycine max
  Soy_ogl_2010 Gm06:18883101..18884500 Cluster 15
acaccaaatttttttaattagtctatataaatattaaaataaaacttccatataatttcaaaattatataaaaaatattataaaagaataaaataattaccaataatgggaaacaattacctatcatattagtcaagtaatagatgatgtttctacttctaaacaaaagtctacctataattttgaaaaaaatgaataatcaatttatgtacaatgcttaacataaggaagatagtgttatgtaatttatttccatgtctatcaatgttaacctaactacgtaaataagggtcttgaaatttctcttctttccttctaatgtcttctccatctttaatttctctatttttaattaatctccttgtcgttccaccatatcacttgaatgcacagttatgcaagatcataaaactcaatgttacaatgtaacaatgtcattgaattttttatgtttagttgtgttgcaaatgtaaagagggataagttaggaatatataaaaaataataaaaattaaaacttatataaaacataataattcttatgatcttgatggtgaaatgttatttaaagaattaagagtcattgagtaattttaacaattgaatcaaaatcagacaatttctagcgtgaacacatataacatatggtttatcgatggagaacaacttaaatatcattagatataatttcaaataaaggaatagctgagattaaaataataatatgaaattctaatcattataaaattatattaaaaaaatactataatgagatcatttttaaccccaggtaagaaagagaaagtgacaccccaaagatatctttgtccattccctttggcgagagagaagttgtcgtcgttggcacccaaacccaaagaaaatggtaccttgatcccatcttagtttgtgttgaaaggaagtagagaaaactatacatacattttcgactataaaagaaaatgggataaagttgaatatgatgaacaatttaaaatgtcctagtctaatgttccttcaatgttgatataggtttattcatttatgtgaatgagtcactcaaattagaggtttgaacctaaaacatcatgtatactacccctaaacaccccactactaaactgactctaaatcaatcctaatggtttttctaaagttaagatgaccattcactaccacaatataattttcatttaatatgacaacagatatcatgttgacataccaagttatccattacaatctatattgttcaattaaaaaacaaaataaactgaagagttataacttcatggttcacctatgaaccgtttgttctatgggtccattgtagaattcacgtaaaaaaattaagctttatgatattgagttctttgaagatatttcattgtttccttaat

SEQ ID NO: 3718 - DNA, 1106 bp, Glycine max
  Soy_ogl_2360 Gm07:17791883..17792988 Cluster 15
cgtgatagttctttctctcacaacaactttatatatattaatagattagataaatagataaaataaatttatacaatttttttataaaaaaagatatggatattgagagaaattaaagactatgttaaactccaattctggatagcaacatcattttttttttttgtctagactccaattgatccacatgctggttggataacaacattaaaaacaattaagaatctatatctaaattttatgcgtataaaatagtttgtagaaaatcttgctaaatccaagattatttcaaactaaaatttaaatacagattatattaaataccattcacattagcatattattacatagagatgcctgtgttataatggtgacttagtagcgaagagaatgaagataagatgatgaattcgaatcttgaatgtttcactaataaaaattatcagactaatatttatctataaaaatatagataaatgcattatttcatagtagctgtataaaataaggtaatataaagggaggctcgataaaacggaccgtaccaccacagtgcgaccgccaacagataattaatcaatcactctggatatagatttaattaattgattcatcttcgtgttaaatagaggagggtaaaaacgttgctttcttcattcatatgcattgcttctaatacaatacgatgtgtatagagatgttgcacctttacagtaattaatgactcatctacataaagtaataaatttgtaaagtgatcttaccaattaactaattaatcaagattaaaaaaatagttaatttagttaatagtaataaatttatcttaaatttataattttttgaaaattatccatgtaattaatacttttctttcttttgattgtttgtaaatatatatatttttaaaatatttttaatctaaaaataattaatacaagaaaaattataaattaaatcttataaaaatgattaagtatcattttaaatttagatcttatacgaaaaaaaagtaaaatagaatggccttaaaacattgggataccactgcatcacagggatttttataataataaacaataacaaatttactgagtgagtaaagg

SEQ ID NO: 3719 - DNA, 1186 bp, Glycine max
  Soy_ogl_2437 Gm07:39206415..39207600 Cluster 15
gatggtaattaaatgataatgtgaaaagactttactctatcaataaattattatttgttcacaaatatgttaacaagtgaaactttacctttggttgagtcatgtaggttcagactaaaattatcccttaagagtagaacctttagtagatcataggaaacttatataaactgagtctgataacctctgctcaaaattaaataaattagtagttatcaaatggcaaaacgtgttgcagtctaagtattaatatagatcaatatttaatctaaacactaaaggtcagttagttataggatttaaaaataatatcatcaccaaaagggtcaaatctaatatatattctatgttgataattagtaagaaataaaagaaaaagagttaaaacatattagttaaagatactaattagagtataagtacttactagcatttacactaataatattcaaatatgtcacctttatgctattatttttgttagtctatataaactcatggacgttggatcatggacgaagccaagatttttatataggactggccaatataaataatcataacttaaaaaaaaattaaatttctacatgcatgacatttacaagaaatttaacataaccaccaacacacaagtgtttactaactagtagcaaaaaaagacgagtagaaaaaatagcagcacccctctcaaaaaataacatcctttatctcctacaggaagatgaaacctataaaatttaataccaacaataatgttagtcatatccttattatcaaaatataacatttcaacaatgtcaataaaaacttagcaacatgtcagacttaacaactaatttgagaaaggttgaaacaagatataattatattataaaagatataaaaagatcaaacaaaaccttcacgtatgaagttgtgctcgcctttgtttcattgagtgaaaatcatcaattatcatatatgtggtaaatttcccagcaatctcctttttaaaaataaacactcatgtaattagtgagaaaatcctcttttatcttgctacataaccttcattttataattttcatggctggaaaaacatgttgtgtgattgttgttggcataggagaaagagtcaaaacaagtcataacaatctattaattgaagaatacaagataaatttttctatctcaattaactttttat

SEQ ID NO: 3720 - DNA, 1084 bp, Glycine max
  Soy_ogl_3069 Gm09:233201..23351684 Cluster 15
tgacaatggagcaaacacttttaccagcatcgttgagtccataacccatgcaacgttttaaattgcagttgtagttacgtcataactctttatgttgcaatttttttaaagaaaatgaggttgcatttgtgatcgtctcaaaaatacaatttgcaaaataagagagatgggtgaagagtaacaagttgtggaagaatggattcctaaaccatcgtggttcttaattagaagcaatcttgcaacaactaggagttgcaacacgcctttgaaaaactaaccttagaaactaattcctctggactgaaaatataaaaaataaaataaaattaactcatacacgtcaaaaaattaattaaaatcatttaatgtttatattctccataaaaaatgttaattcattttctaaaatatactttacattaattgcatatgacaaaaagagagaatgctataaataaaactctaattaaatgaaaaataatttaaaaatattatccttaaataagaaagaattagttcaaatttatttatattttaatccaacacacattgattttttgttgcatatattttggtccaaagaaattatgtttcatgatgagtatggtataaatattaggtataaatacgagatatgagatttttaaaaaatctaagatatgggtatattagcataatttttttttaaaatatgcatatataaaaaactttaattgtttataaatacgaataaattgtttaaaaactacaaagaaaaataacttataacatataaggagattaaattctttaacatgacaaagaaaataaattactacttttttttgtgaaaaaaacaaaatactacctaaaatataagcaacaaaaataatgtgtgttgaattaaaacataaacaaattttaactatttttttctatttaatgataatacctccaaaatacccttcatttaattagagttttatttacaacattttttctttttgtccagtgaaatatattgccttaaaaaaactactattattgattctatgtgtagtaaacaaatagctaattcatcaaaactaattaaaataatttagtt

SEQ ID NO: 3721 - DNA, 1100 bp, Glycine max
  Soy_ogl_4747 Gm14:28927901..28929000 Cluster 15
agcttgcataactgttttgagttttgctacttacccctttatttcctttaaggacactcctctctttttttcttttacaactaaagtaaactcatatataacttcaacaatctcacaacagaaaatttaagccaaacattcataaaggttatgaataactctatggcacacaaaacaatatatttattaaatctatttatagatattatgaatctaaatttaattttgtcttacaggatttataaagaatttaacatatattacaaaaatctacaatattatagaacatctctgatttctaacctacgacaaaaaatatacgagtgcagctttgtgaaaacttgatcctatctacttaatgtattagagtctatttttttaagttaattgattttggtattaataactttttacccttaaacttaatttgaatgcttgttcaaattagtttgagctgtatagtatacaccaaaacatgtgtcagggtaaaaagaattaactttaagaattgcccaaacaaaataatgactaataatgctgtcgtttttattattactattatactttacaaaaaattgcaggcatttgatagcatcataaactaactaatctaaatatgataaaatgatgtcactttctttttaccagtagtgaaaccttttactaactataaattaattttaaacatatagttatagagttacttgataataaatgttatcgatgaatctatataagaatattacattttacaatgataaaaaatattacatttttacaattataaaagtatgataaaaatatgaagagctcaagcattacaacgctaggccttttattctcttactggcatatcttaattttttcactatttatattgagcagaaaagtatgaaatcgtattagaaatgagacgggaagcctgaaaatactcagccctggcttttactattactgatttgctatttccacttccccttattacttatacattcccctggtatttctttttccaaaaatgtcctgcaaattagcttcttactcaagtgtttttgcactacgctttgtaataccatccatccttgtcgcacataacatcc

SEQ ID NO: 3722 - DNA, 1100 bp, Glycine max
  Soy_ogl_5113 Gm15:43279901..43281000 Cluster 15
aaaaaaaaactgtcaatttctataataattacatcaaaggttatacttaaagtattttttagtttataacattttttccactaatatcaaaattaaacttttgaattgtgttcattttataagattaatttaatttagaggttgaaataaagtatttatttttactatttttttcataaaaaaaatattactatcaaacatatttttaaacaattgagtccccttggtttgactgtttgagggtctacgttcacgagctttctatttgacaagacagattttgaaaaaaaaataataagaaaactatgaaataaaaaacgctagaaggagggcttgaacctccgaccttgtggttaacagccacacgctctaaccaactgagctattccagcttgataaactttagtaaatttaaaagtttaaataacaactttcttataatcctcacgttgattttgctatatgtaaccccacgtgtcacacacttacacccatagcttgtacttaaaaaaagtatgttacaaatatttttaattcttttccattaaattctaaaggtgggcgaaaattagcacgcttatcctttcaattaaaagagagtaaggggttagtctttcgcaaaataataaatcaaagtttaaatttttgttggaagagataaaaagaagaccagtggaccaggaaaaagagaggaaaaaacaaaaaaaaaatatagaaaaggtaaaagtaaaatatatgcattatgataattgtatgatttttttaaggtataaatgttcatgaacaactaaaaacaaaaattaaataaaagcgaatttccaataaaaagaaccggtggatcatatttttctccaatctaaattttgttcacatctcgaatgattcaagagtatattcaaatatattttaatcgaaagtgtgaatgatttgcatattttaaataactaaaatggttgaaactaagaagataacaattataactaaagaaagaagtaacaagtacttgagcatcaacttagacacttcctatttgccatagaaatgttgacctattgaacagctagaaacaagagaaaaaaaagtagagaaattaaattttc

SEQ ID NO: 3723 - DNA, 1100 bp, Glycine max
  Soy_ogl_6360 Gm19:4992001..4993100 Cluster 15
agtgtaagataattccacctatgcataaaatatgtgtcaccaagttcaattttaaatatggcaaaacaatattttaaaagctatttgaaaatttggaaattagttcaaagtttacaagctagaaattaggagttgaaaaattaaaaacttgtacgatagtgattgaattgaaagtgttaagtttggtgatgttaactaacaaattgactaataaatatataaaaaaatacttaagtattatatataactttttctgtattacgctttctttttccacaaaaaataataatataattaaataatcttgggatgtttaaaagaaaattttaaaatatttgaatacatttaatattattttaaaataaaaggaatagatatttgtctttataattctaaattggtaaagggtaaaagggattacaagtaaattaatgagaataaaaataaaataaaaattaatagcttatagactatatattaattgtaaagtagcttataaattaaaaaatattaaaatatataagtccacgtacttaacaaatatcgaattaatttaattataaagtagtcaaattaacttctacactgatagccagaataatttgccaaacatcttcccaatagtgtagacttctttcagatatcgcatgcagtaaacaaatacatgatggaggcaaagcatcataattaaagggctagaaagaaccataatagtcactgtctcaatatgggtcgtcaagacttaattcctattaattaccattatatcagttaactcgttttcacaaaaaaagtcaacaatcaattacaagttacaacctagctacaagtaaataatttttaacatatatgcccccactttgaaataaaataacattaactacgtcattctactatgaaatgtggccaaaccactaggttaaaacttcaggacgattattgtaaacaaaaaaaaaaaaaaatcatatctgtcccaatcccaaacaccttacacagagaggttccgtgttaaaaggcaaggagttaccagttgagttgatatcacccctgattaatctctcatgtttttattaaaagcgattaatctctcttcttaggtc

SEQ ID NO: 3724 - DNA, 1061 bp, Glycine max
  Soy_ogl_6407 Gm19:37116781..37117841 Cluster 15
gtcacgagagatccgataaactaagatgtcatatgagaactccattcataaaatattaaatgacgtttatgtataattatacgaaatataatttttgttgggtacaaatgcaaaagatataaatagaattagttatagagtaaagtgaatcatttggatataattgatgatatatatatatatatatagaattagttatagagtaaagtgaatcatttggatataattgatgatatataataagcataagtgatataaattgaaagatataaactgaatatataaactaaaaaaagatgattccatcatcattttattatgacattctcaattttgattcttgctcttatcatcaaatcaaataaaaagactgaattttcaattccgttcattttccttataaaagtgaaataattatttatgagaccaattccgattgagtttttcaatttttttattatgaaattaatatgaatttgaaaacgtaatcattgtcaattctcactgttttattatcaaatcaaataaaaaagtttgaatttggaaatgtaatatttaataaaaatgtaatatttcaaattcattctttatccattcttttacatgcttccctgcctctttctactctatatgacatttttttcctcactttgtttgtctgtttcattttatatttctctctctttttgtattattgtataaccgtattatctttatttttttccgttttagggtgtagcagagtgtgttcttatatattcatcaagtaacgatttcattctcttccattttgtttgtcatcttctacttaaaaaaaaataaaaattacacactgtcttttacaataattttaaaactgacatcttcttttgtttttgttggtggtggtatgtttatttggactttatattatgtgatgggtgtgtacgaagcagaattagtgattgtggttataggtgactttgatggccaagactagatgatgatttgatcatgttgcagtgagtttttgttttctttttattctttctctttatttttattcctcttgtttctgttac

SEQ ID NO: 3725 - DNA, 1000 bp, Glycine max
  Soy_ogl_599 Gm02:41795701..41796700 Cluster 15
tgaaaattcttctataaataacattttatttttcaaaactgtcacagctggatgtttggtctagtggtatgattctcgcttgataatgagtgtgggaaagtatgctatttattattttactatctataggtttatttcgtggttttgagtttgaaatcttgaactgtgttaagtgaactttatatgtagttcccaagttgcaacctcaaattagtactactctaattgttaatagaaaaaaaaattgttaatttttttatgattttatccttaatttacagttttgacaagttaacttgaccaaaagacttagtgggtgtttaatttttttccaatgaaaataatttttaaaagttttctttccacgcagttgtaaaaaattacttgaaaataaattaaaaatacatttgcacatatgcaattataaaagaaaaatctcaataaaagcacaaaataaactatggtgaaatagattatgcgagagcaaggtttttcttgctcagaatatgaaaatataattgggataaattgtagcacggtaccaatccaatagtcctcttcaattgaattgcaaactacaattagccaaataattagctttttgattggtgttaaaggacgatgcctattgctccaataggaagaacaagttacttaaagtgatcgagattgtaaccaaaggttacatgtaaagatatatccactcataaattttagtggtttaagattatagtaaatttttcttcaaaaaataaaagattgcggtatatttgaaatatggtaattacattttcagtttcttattttacaaatagtgtaattttaaaaaatgttttgtccactaaaatggggtatgagcctgagtgcttgtagttttcaaaaacagataaaaccacaaatttgtagtgtaaggtcaaaatcaccaaagagaaaaggtatttcactataggaaaaaaaatgtaatagtttaaggagtgttagtagtattcatttgcacgtg

SEQ ID NO: 3726 - DNA, 1372 bp, Glycine max
  Soy_ogl_2392 Gm07:36287134..36288505 Cluster 15
aaaagaaaaaaaaatggttttttactagatacatgtgctaaaaataaaaaaaaaaaaatttaaaatttcaataaatatagttggacaccccaaatcctatgcaacacacctagtgagagagagaaaaatattgagataatatatgatatgataaaaagaaaaagataaaaaaaaataaaagatattgacaatgtgtttaaaataaaggatatgcaaatatcattgttaaaaaaaaaatattcaacgtattcatagtaaaaggtagagttcctagtacttattaaaagaatgaggacacaataacctcttttcttcaatttggctcaagtataattttggactctcaaatttagatcagttttgttcttgtcctccaaatttagatttgttcttttttttttctcttagaattagaagaatgctaatattaaactctttcttggttcttaggaatactattgattctagttttaaattttctaattcaaagtaacaaattttcctcacttatcaatctctagcgattgcggcattgttttattgagttcttgtctcaatccatttttattttgtcttcaaatttttccttgaattttctactttttgggatgtatgctgaattttgatccataaaaaagaatttttcattggttatatatatagagagagaaaactatttttgtgagaatatgtgcatatataaaaacacgagagcaacaaattataatcctcggattaaatttaatggtctagattagaacccaaattaaaaaacggcacggccccattctcctttaagtttgcctattatctcctccttccagttcacgttctcttgctttcattgtgtgttaatgcttaatactgcaactagttggcttagaggggatgctctcttccctgcactatgcgccaattcttctaccacaaaagcgattgctggaatcaaattttacaccctttctctactcatcatgtcacacaccctttctgttcgtaacgtcgcacgcaagagaaggggaaaagacacttgaacctaattcctatattctctttctaacgtcgcaccattcctgttttcttcgtcaattgtttttcatctctcaaagtgcgatcttttttctttgcatattaacgtgatggatattgcaccaatttgactccaataatcgatttcagaattggcgagggtaggggagtgagcgtcctgtttcacgaaagatagcatcctatttcagcagacaacgttaacaaactatattgctggcaacatgagaaacgaggcacgtgcttttttgtatttggattaatcttgaccataaaatttaatctgagggttataatttgatgttctcatataagcaacttgcac

SEQ ID NO: 3727 - DNA, 1248 bp, Glycine max
  Soy_ogl_4359 Gm13:30050101..30051348 Cluster 15
ctatgaatgtgtgaatagtgtgtcatgattttgctttttgtggaaatgacctttttaccctatcatagaagaagatctcatttggatgacaattcgttgttggtgtcataatgttggaccaaaaggaagcagattcggtacccttagtggtccaaaaatattgggcccaaagggagcaaaaaggccgatccatgtagttcctataagtagcaacgaatttgtacagcattggagcaaagggttgctacaatgatatgtaaatcttctacaccagccatgtattgtgttgaagctcattatttgtgacttgttattgatttttgtctctgtcctaaaataatagttgtcctaattattttatatataaaaaaatgcaataagtagataaaaaagagtgaggattttataaatttaactttatattatcattaatttatttatagattttgttatctattattaatattataagagaataacccttagactttagttttctgatattatcccaatgatgcattctgactctttctgaatcattctgattgttgagatactcagagttaaggtctttatcattcttaaataagctttgcatagcttcattctaattcaagtatgttgtttttctttattcttagtatgataggcagatagctattagtaacttaccttcccacttttatataaatttgatttttcccttattaaagaataagaaggaatcatgtagattttttgtgagagttattttctctccataacttcttgaaacctctcagatgattaattttacagtttttgtttacacatatattcatattaacgtgattacttaattataaaaaattctaattgattctacatagtgtaataataagaattgcgtaattatatgagattatatttttattttatttttttgacaattatataaattaaatgaatgtctttctctctctttttatatatataaccaaaatgacatcattatacaaattagtaaacaatacaccttttactccatacctattttctactacttttgagtatgttttctgctaaaaatttagattttttttaattattgtataatatgcatcatcaaaagatttttttagccccctttaacaaagttctgaatttgtccctattgctaatgatttatcataattaaaatcatgttatctatactggattcaaccggaataaggtaataatttgcaaaagtatctctgaatatcacat

SEQ ID NO: 3728 - DNA, 1142 bp, Glycine max
  Soy_ogl_6118 Gm18:50842859..50844000 Cluster 15
tatcacttgtgttcttatattggtccaatatcatgaccactcatttcatatattttcaagatttactatcaattggtagaacatttatccaaggtctaaaagatttgacacttctattttgttatgaaaaaatagcaacttgtttcttttgtttaagcaattcatgtaagtattcacggtagagatgctctaatgttttctaagggtatcaagactccttgttgatatcatttaatttttcaaacattaaagtcgacaacttattttttatgatattaattatttattaagcaataagaaaataaaaataatatagatgaaagagaatttaattagtaaaaataaaaataatatagatgaaagagaatttaattagtaaaaagcacgctaagattgcatatagaatggaaggagtaacgcgcacacatatatctatatatactaaaaattgttatattatcattgatttgaatacaacaactgaaaacgacttgaaattgaatataacaaattaaaaataaagaatcatgtagtagaaagttcttacatcatggattaaatgcatataacatttatgtaatcaacaatgacatatatcaaccgtcgatgggcttacgtttttttgattggtgttatttactaaaaaaacaaaaaatggaaataaaaaaaaataaattcaaataacaatgattttataggacaaaattaattgttcatagtataaacatgtatttgtcgattgtgattattgaaaaagtatattaatttaggagatattgttataacttaattagagatttcaaatttaaatcttgtttatgtagttatattaaacattttgaaagtgaattttgtcatttaaattagtcctacctaatttcaataagattgtcttcggtaaaaagatatcatccattaaaaaaaaaaacacatgtatttatgtataatgagaatagttaacatgagagacataacattatcaatctttaattatttctcatcattaaagggaagatattattagagataaactctgttatctattttgaatagtgtcatgtgctcattaatttctatgttccaatcattcacggaaagtccctcttcaaaataaattaattcaaattttattataaacatat

SEQ ID NO: 3729 - DNA, 1104 bp, Glycine max
  Soy_ogl_6121 Gm18:50970801..50971904 Cluster 15
tttaaatcaagaccactcttgaacctttatcattcactttgccaaacatgggatgatgggactgctatcatttaaatcaaggccactaattcatatggtttattattgttatgttattgttatttactatgatttgtgaacctttcaagagatgtgaatgtcagttattgagattgtgtataatatttttttcatggttttccaaagtccaaaacacaagtcatgaatcatgatcttggaattttaagattaaaaagtattaattagtgtcttttttaggtattgattagagaactaaaaagataaatatttttattgaaatgtgtaaaattatattgtttataatctttttgacattctcttataatttttataataaatattttattcttttaactctttaaccaatatgttagggtacttgccagtaaaaccctcattttatttattactacctccaaatttaaccaatatgttagggtacttgccagtaaaaccctcattttatttattactacctccaaattaaaatataaggaaaaaaaatcaatgtgtaataaaataaaatatacctccaagtaaagtttaaccaactctttattatttaatgatattacttctaaaaatatctttctgagttttatttctaacaacttttttcttttttgtattatgcaattaaatgcaaccaactatttcttatttaacaatactatctttatgcttaaatgatgttaattaatttttttaaataaagagaattttttttgttatatttcaatcccgatggaatactaaaaataacattaatatttattacagtggttataagtggtagttagagaagttattagtagtataaattaatagacagagataaaattatagtttcaagtgacacttaggctctgctcagttcgcgcgacagaaataagaggcttcggacggaaaggattttggtgctgatgatttttaaaagaagtaattaagtaacctgcttgtgggttcaagtatttaatttcctattttatttcaattaaaaaattttataatatcatttctattcaatttctcacttatttcttttaaatcaaataataaaac

SEQ ID NO: 3730 - DNA, 1047 bp, Glycine max
  Soy_ogl_2757 Gm08:18307101..18308147 Cluster 15
aaaattctaaaaaaaaaaccgacaattaaaaaaacggagggagtattaattatatttcccgtcggcaactaatcgtcaactgagattattgatcaagtactaaattatttaatctagacacttcaatttttattttttttttgtagattttccatattggtataaggttcccgttctcccctcatagatgacaattaaaaattattgatatatcactgactgacaaaagttgttatcatgatattgctaaattagtaaactttcagatgagtggtgatacttgttgtcttccatgcatagggttcaagtgttctttttagttttccagaaagacaatcttaatttgaagagcttaattagaaagcgcgcagagtctcaagtttctaattaatgtatcaacagtatcatgaatgatcatatgctccatcattgtttggaactttgcctatgggttaatttccaccatgtccatgtgcatgcgtagaagttatcacgtgcctcctgcaagttatatacatatataagctggctcttatcatatgtgaatttagttcatggtgtttgaatttagcactagtttcaagaacttttgaacaaacaaaatatattttccattgtgcaaacagcacagacgatctaccaaaaaaaaaataaaaatcactagacttaaaataaaacttgaaagccatctgagcccatatattatgaaaaccaacctgcacaaattacaaattaaaaaatgaaatagatcgagaagatagaaatacctcaactttgccaaaagcaatattcaattgcaagtcttaaaagagaaatgtttgtagtatactttatataaattatatgttgacttcgttaatagaaagtaaactgatcaatttatttggtagattaaaataaagttttaactaataataaaaatatttttatttcattttctgtctgttcactttaaaaataacattaaaaaaataatgcataaataaccttttagttcccacaaaatatgtttttaattttagtcttttagttgtttttagtccaata

SEQ ID NO: 3731 - DNA, 1049 bp, Glycine max
  Soy_ogl_2653 Gm08:13337001..13338049 Cluster 15
cgaactcagagttattctaaattaagcaatgctttggagttagaacattttagtatataattacattaagaggacaaattttgccaactattatacatgtcataggtagagtcatcttcaccagtttcttcttcagcattttttaattacttttttggttattatagtcgcaacaattttttctttttctatagtttaaaacatttcattttggtctctacacttataattacccttttgtaacttcaaagagtttaagatacggagaaccaagagtttaaaaattacacttacaaggatctaaacggaatgttttaaactataaagactaaaataaaaaaaaaatattagggaccaaaaaaaatcttttttttggcataatcttcaacaatttgtttgataaattagaatatatccaaattagaacatatccaaatttgataaatttgtttgatccacacactggaaaggactagtgacaaactaatttgataaatttgttttttactgcaatttcttttgagatggactaccagatagtagtagatagagttaatagaaattcctttcaacataatgagttaggaatgattctttagtcttagtttctttccaaactttcggttaaattttattaggagacaagctaattatgttgttcattctttagaaaggacggcatatttgtatgctagtcaccacatcttccagtatattccaccatgtattgaggttcttgttgatatagagatgcaatgagagtacattctagtaaaaaaaaaaaaaagaatggactacgtgttagaagtaaaaatcacttaaggttgttgcttctagaaccccctttctaacttccaaaattgtcaatctaaaatgtataattacattcggaaacacaccccttttattacttctcaaatgaccattccaaaaggtaaaaaaacattctaaaaagggttcaggaaaaaacttggaggtacaaaaagcaatagccatcacttaagtagatttggaatgggcataaaacaacatggaaccacatggacata

SEQ ID NO: 3732 - DNA, 1000 bp, Glycine max
  Soy_ogl_2826 Gm08:39425401..39426400 Cluster 15
aatgaacactcgcggcagtactactaaacataagccttacaacttgctggctatattttttattaagaaggatggttcattttatcttttttcaattgttaaacatcaacttatttaggagaaagaaaaaagatatatagagagagttttgtttataatatgtacatttgtctcatttaataaaaatattgtataatgcttttcggctagctagtttcttcttagaatatcttacaaattaatgaataaaaactaatttctcgaggtctaacttaaagtcttctaataatgttttttatatacatcaattttaagattaaatttgattacatgctttagggatataaaatcgttacactctaattaacacaagttgataattattaatttttttgagcgggatgctttacattatcattattcaagtatttgtgatttaagtaatttttcaggattttaaacaaataactaagtactgttatctgaagacttttttctttttaatgtcataggtgtgcctatagccttaccaaatcaaagaatctcttggataagtatggattccttttgcctactttcacttacaccaaaatggtcatgatctagagaagagaaaggagtatctgagtacaaaactatacgacaacaagagtgaatgctatcttacgcaatatatttacacgtaagtaatactccccagttcatagtttcagtctcaaaatgtctcataataataattgtgtaagaagaaaaatatatttcaaaataattatcatattattttttcagctataaaaacacaaaatgaattaatgatggtaacattaagtttataaaattgttattatttttcatgtattaagtagtttttcttagtttctgtaaaataacctaaaatgataattataataggattgacagagtattatatttgcaattgatatgatattatgtgaagttgactaattaattgttacccaattttgcaggctttggtaga

SEQ ID NO: 3733 - DNA, 1000 bp, Glycine max
  Soy_ogl_3107 Gm09:34908501..34909500 Cluster 15
atataatatatttaattaatttacacggaaattaggaaaaatggttaatgtcattttaaaaatattttttttctaaagttctatttatttaaatttgatattaataataaaaatgagatattaaaattataattgaaggatatttttggaatgatatcattaaatatagataaaatagttaaaatttgtttatatttaagtagattgtatattttatttgaaaaaaatacgatttttttgaaaattcaagtgtcccttttagacacaaaatcaaatatgttacagtagctttctttttaattaagtactccctttgtttcttcttaactgtagaaatatttaaatatttttgttcatatttaattgtataaaagaatataaaaaaattgtcaaacataaatacaaaaaagttcaacacatactgattcaaaataactaactcaaagaaaaaaactgaaattaaaatatcaaggaaaattataacaagaaattatgatttgtgtgctttgtcacttaacacatttaattcagtcgattcaatggttttaatattcagttccaaagtcttctttacatagtttttttttggatgatattgattcatttttgtgttggattggaaatagagtttgtgataagattcgtttaaaaatatcataccgcaacatattttaatagattgaaatgcttgaaattaaaatatttgaataatgaaaaaacaaacaaatcataatttccatggactataacaaaagggacaccaaaattcggataccgaatattcaggtattttgtttggagtcttgtgtagaaaaagaaggttcatgaataatgaccaagagtcattccatggcttcttttattcatgagtagtgtgtcttttctgaaagtgagcttttagttgaatatatggttagtcaaggaaaagaacgtgaccactaaaaaaaggttgacgagaagatagaaattttcagttcgatctgcatttctattccttctt

SEQ ID NO: 3734 - DNA, 1000 bp, Glycine max
  Soy_ogl_4056 Gm12:16263301..16264300 Cluster 15
agtgaaggaaatctcaagtcagtttaaggattgaacgtaaataagtcacttgtggctgcaacaagcttaataattgtgtgcatgtggccaaaaataaattctgtgagaaagatttgaaacaatatgagataaaaatatgctgatagtgtatatggagaatattttgttggaagggaataatttattttggtaatttttatgtttggggtgattagtctaatgatttttggttataaagatatgttactttctggaaagaaaaaaaaaatgttattcaatacaatggaaatttagacgaataaaatatgaaatgtaaaatgataaaataggctatgtattaataacttaaagtagttgtataatattatttaattacaaatcaatttctaaaattaatttatttactgggttaagagtcttattagttatgattttctaatttctttattctgtaattttacaccgacaatatgttccattaaactcatgttacattagcaattactacgaatcagggaacaacgcacatgaagataaaaagcttctaataaaacaaaaccaacggataagcttcataattttttcttaatgacagagtcttttttggtaagttttttcataaacactttaagaaaaagaaaaaacaagagtttctacataaattatataagttaatttttagaaattttttcatctttaaaggagctatatatgagagaagagagtttctataaattgcataaactaatttgagtttacaaagaaactcatttttttttcttctagagatatttgtggataagcttactcaaagccaaactttttactaatgagcattatagcactaaagataattaaattataaatttaatattatatgtttgtattaataatatcacttagttgttaaagatgatactttcttaaagttcttaacttatgtattattcaatctaaaatatacttgatatatcaaaaatccttttgcattttggcatag

SEQ ID NO: 3735 - DNA, 1000 bp, Glycine max
  Soy_ogl_6361 Gm19:5305601..5306600 Cluster 15
tccattcctatatataaaaaaataaatgagaacatttttttcttctaaatataaaaaacgtatgatcacttttaatgcattaattattaatttatttttatacttttatttattattaataagataagttgctcttaatttttttagtaagataagtcatattcattggatgaaaaaagttatccattgaaaaataaatagtgtcattaaatataaccacaacttaaactatttaatttaatgagtattcttagaataaaatttaaatttataatatcattaattaaatttaactaacttaattagttttattggtgttagatgaattaggtatttgttagaagtagtataacacaaacaataaagtatattcattaatattagaacagggtatatgacactttatatggtacttcttcaagttatgagttaaggagtggttatcatgaaatggactaaaccctggattaaagagaccttaattaagaactattttcactaacaaaatgcactccaatttctttatttgagaataatgtagacattttatgttggggaatttggggcagcaaccacgagctatagaccaagattactaaagaattgaactgcatatctttactcaaaattttaagctatcttatatatcttcgattgaccttttcttagtcaatgtgagattaacccctcacacttgccatttctaataatctcgcatgtgtatgagttttcacattgttatatatgttccttcagtattgttcaccaactggacacattacctaaccaattttatcaccagaaagactagacttttgattcaataatttctgctcttagtttcctctctaagctaaccagactctaatactatttatagtttgtcacttcggcctatccttctgaagtctaggcccaatttttttttaaattttagaaataaaaaaaggaagaagaaatcttaatgacgtgtataatttcacttttagaaaaggtatag

SEQ ID NO: 3736 - DNA, 1000 bp, Glycine max
  Soy_ogl_127 Gm01:39840601..39841600 Cluster 15
actattttttacaaaagggtatttaaaaaaaagtaaaatctacgaagaaatatttgtaaagttttaattatgaaaatttaattactaattttttagaatcaaatattatttcgagcccgtaattgtttttttacgagagccagtaattgttactaccagttatcattgtagcaagaaaaagggaaatggaatcttaattcttttattttaaacaatattttagacttttttacaaaaataggtaaaaaaaaatatttacataaaagtgtaatatgaaaactattggcaggcagaacatgggcgattttgctttcctatatgggttatttctttaactgatgtagaaaagtaaaattacctatatcccatcaataatttccatactactttttatgtaaatagtccttttaacctagtttcgtaaaaggtccaatttttaagatcttctttcaattacgacggaaaataacttagcttttttgtgagtctttttctctaatattttaattaaaatttgtcacatcagcaataaaaaccagagagattgttacctttttatataaaaaaacaagaaatatattaaccagatatcgaaagaagggaacacaaataaacaattgaataggttaatttaagtacaaattaggaatgcaagaggattaaatagagtgagaggagagacataatatagtgacatggcagagtgtatgcatgattgtgtttaagaatttatatattataaataaattttgcatttgttatcatgcatatccagaattttaatatttttacatatcgaaactcatagcattattctgacatatcatttgcacatatttattgaatattttctttgatgtatatgtccatccattctgatatatacattatttgcttttatatatataccatgctataatatctttaaatctttatgtgatgatgaataattcataatcatagatggaccttatgaagttttattgtaatatataagata

SEQ ID NO: 3737 - DNA, 1180 bp, Glycine max
  Soy_ogl_592 Gm02:40949521..40950700 Cluster 15
ataaatttttatattctagtacaaatattattttctcttttaatataaataaacttcgtaagtgagtaattgacattaaatatgcacgttacaatcttttttttctcctattttgtctcaccattcacaaattattaacttttaacaacctaattttaatttcagaactttagaagataaaatgaacgtttaaatgttcttgctattaacttcaaataatcttttaaaatccaaaagtcaatgaagtatacaactagtagttagctatgttgataactaggtagcggaaattttgaacaaaaggagcttgtttacattaaaatatgataatctctcaaagaagttactgtgatttttgggtcaccaataacataatgttgatgcgaaatattatctctcccaaacacatatactcttcctaaaaaaacataaatgttgataggtgaaaataaaacataaatgttgatagttttttttttttttttttgagtgagcttaagggcataaatgttgataggtgaaaatattatttctttcccaaacacttattgggccaggtccaggttttcttcttccttatccctctccgacttgggcgactataaacagtctctagaacaatcaaatgtaaggaacactggttaacaaaatgagctcagtagtatatactttagtttttgaaaacaaatttctttgtattttttaaataacttatttacttataattttcatatttaacaaagatgatagttttaatagaaatcaaacaaaaataataatattttttagaagttggatttaattttagcatataaatttctgtacaaacatttttgttgcaacccctaaacatatgtattcaaatgattgtgctttttggcaactaatattaactatgaaactttatcaggctttatattgtaagtattattttatcatgcatattaaacttgtcctcagataaattattatgcgttgcattcccaaacgagtagagtaataaatagactcttgaaaaataatgctgaattgattttgtttaatgctttatttgtcaaaaacatggaagaattaatagcctgtcccgcacgtacaaaactttaatgtaacaagtgatcgttaaataatttttggtgttgcaaagatgtcatacgtaataatcaagcacttttttccatta

SEQ ID NO: 3738 - DNA, 1300 bp, Glycine max
  Soy_ogl_2038 Gm06:38923101..38924400 Cluster 15
ctagagaactgattgatcaaaacacataaatgctttagagattaaatatattacatttgaatttatttatatgttcatcaactcttttatttttatagaagtaaataattataaataaataaataaatattttttctctctaccttcgtatcgattttatatctttaaaacaaaagttaagattttatttcaccaaaagatgttatcttatcatggtgacagatgataaagatttataagacgttaaaagttaaaaaaaaaaaagataatatttaaaaaaattacattaaaatgtgtgttaatctatggagagacacaagtgtaatttagcctccaaaaaaggcaaggataattagagaccaaggtcttttttttatgataagtacatttataaattgcaagctttgtccttatatggttatatgatttgaggttattgtatttttttatttattgaaatatttttgcttactttaaattacttttatatattatgtgtggattatctaaccatattagatttaaaaaaatgatataccaacctcttgtttttttgaggtaatgatgcagactaacctcttctgctaactctcgttggtatttgatatttactatttaatattgtataaagtgtcattaaattttattcattaataattgattaatattgtcatcgatacttctcaaataaaaataaatcaatattatcattaatacttatcaagtcaatttcacacggatttagatataatcatagttgatattattataaagttttttttttaaggagatattattatatggtggaaatagtatacttacaatttaaattgaaacaagcccgagtactaaattcttgtcaaactctaacagaacgccacactaaatttagttaaagttcatatgacatgaaattaaaaagaaacaaattagaatttcatcaaaatatatcaacctcaaactttcatatgttcgtctcactaattcctgaacgtttttctctttcatagttcttgaggataaagttagagagccaaactagtttgaaaatgaataatatatttgaaaattctgcaataagaaaagagaaaagaatccaattacttcataaaatagattaaaatgcaagaattgtgaaaagattaaagtaaaaccaaaaatagatttaaaattatttatacgaaatatccatattagccatattgtagcgaaagtatattaagctgattttgtaaaatgatacatttaagttcattagacatgtatcagtataatttgaagaagaatcaggttcaggtga

SEQ ID NO: 3739 - DNA, 1100 bp, Glycine max
  Soy_ogl_3078 Gm09:29328201..29329300 Cluster 15
aatcataaattctaaagtcatactctcatccccaatttttctttataaaaaaaataaaataaaaagtaaatgtacgttgatataataactcatttgcttatgtaacaaaatttcctttgatcttttccgttctcagtgaattagttgtcacatgcatgcactcttttttatttgaaaaattctcatgcacataaatacggaataaaatacatgagttattataaaattctatgatacatatttttcaataaaaaaatttggcatttgtctcatgcagttagacacttaaatttaatttaaatgtaaacgggcatagatattaaatctgccacgcttttagatgttttttggtaatgaaattattagatgtattttacttttttattatttaaaatggaaatacaataagttattaagttaaataaatgtataaagtgtagaatattgtatgaaattaaattattatttttatttagttacactactaaagtaaaaaagaaaaacattaaaatatttataagagaaaaaaatattgtctgaataaaaaaaatcacaaaagtacattttaatttagttacgctataaaaataaacaattatgaagtaccaaaaaatattgcctgaatcagttgcaccattaaaatacacttacataatcttcgtaaacatgatgctaaatttgttataaaaaataaaaataaaaactaacaataatgaagtaaggagccaatagatgtggcaagtgacactaattggtttgtcccctttcttttgtggagcttgtgctagttgcttagcaagtagttaggcatggaatggtcataaaatgatatttatatattggctgtcaatttgccatgcaaaaatgaagggctgcgaacgtattacaataggctaggggacaaccacttgttcaattcacgtttaagtttgtttttttatcttttgaaaggaatgtttaacgaattaagttgctttaaataatgcctcgatcagttgcaccataggaaattaagtgaagggctgcaaatgtagtactattatactccaaatgtttagttcacgtttaagttttttgtttaatttgtttgaaataaattt

SEQ ID NO: 3740 - DNA, 1350 bp, Glycine max
  Soy_ogl_3414 Gm10:9931351..9932700 Cluster 15
ttcaacacatgagtgaagagaaaattctttttattaaaattaattaagatttataacatttgttaacatgatttataaaaattaaaataaaaatatattaaattttttcatgataaaaacagtcactgaatttaaaccgctatagtcaattactttcaatgcaataataaaaatataattttaaaaaaaatacagaaataagaggtggaaaaaagttatcaagagacgcgaataaaaaaatttagataaatttaatataactctttattaagacatgtttgattgaaatattataaaataatattagtggtaattattatttaatattataaaattatatattatgaaaattattttattcagcaatattggatctaatacaatgacagtgaattattttaatcaattttgtgtcaaacacatagtgtgattaaacatgacaaagaatgatttgaaattggaataagtcacatgcaatagttttttattttgtaatagttgagtaagaaaaataaatataatgggaataataatacctaaatcacaagctccttaatttttatggcatcactacaccaactactgtgtgcaattaaaaaaaagaagaagaagccaaagtatagaatcaaatttgcacttctcaacttctatgtagggaccctcaaggtaccgcttaggcaaaactcatgtgctggaaatctaaaaaggttgactggacacggatagaaactgatttactaattgtgtatatcaagttcataattgagttttacaactaatttattactatattaagtacaattttttaaaaattccatattcatagactcctataatttattacacaaaaatatcctataatttaaattttatgcaatgaaccatgcatagtatactaagtactcatttcatttatgatgctatcaaatggttacaagagttaccgattgacaaagtggttattgtcttattgaggtcattgcaacgtgttgtctctttttggcacagtggaaaggatgatgcctcaaagtttggaagaatattaggtttgtgtacgaatctcctttcgtctttcccaaactgtcatgttagttttgttcaaagacaaactaatgtagctgcacatgccatggctacggtttctataatctatgttggtcctatgtgtttacaattatatttcatcatgtattatccaacagatttttaatgatataatattatgagtatgttgctataaaaaaatactcatcttatctcattatgggtcgtcctcttaagcttaacttggaagatttgaaagagacaacttaactagttaacaaacaaagactagggtggaaaagataa

SEQ ID NO: 3741 - DNA, 1078 bp, Glycine max
  Soy_ogl_3797 Gm11:8151401..8152478 Cluster 15
ttcatttcatttaaccaaaaaaaataaaaaaatcttcgctctatgaacaataatatagacattctataactattaaaatgctaatctgatgtccgcgaataaggatgtcccatttctaaattttagttgaattttattctttatattgatggatgtgtatatatacaagggatcgacttaaccaaaatactattaagaatctaactcaattaattaaatatgatggataaattattataaaaatatatatttactttttttttatcatcatagataaaacatttcattaaaaggtacaagagctactagcatgcccatgtacgaaattataataacaaaagaaccctgctaagtaaacaaactacaacaataggcaaccttaagtattaggtacatgtctttaatttccacatataaaataaaaatgtcaaccgaaataattaagattaaaagatttggtttatcaagctttttatgtcacttcttttcaaaattcaaaagatgagagatggagaggggtaaatatttgtaaaagattatgtgacattgaatttagtaaaagttaaagtattatatttcggatattaaaaaaatgtgtatttgacaatactaattactactttcttatgtaattatgctcaataatctttattttattttactagacaaagataatttataagataaaatatgtatgagatcataacatcttgtctatctttagtgttaaaagtgagatgagatacaatctataatcatattgaaaaataatgagatcatatatttttttaacataaaaaaatgatctcccatatataaaatgagatcactaataagtcattgactattatgttgttaagccaagttcattgagagattatcttagaacacacatcctcgcactttttaaatgcatgatgatatacagagtaatacaagctcctaagattggactaatgatgaacaatttaaataattcacatgtaatcataagttaaaccttgtttcctccgttatatgacaaaaacaaaaagcgattaatcaaaatccatttatctcatgtaagcaattgtttagc

SEQ ID NO: 3742 - DNA, 1000 bp, Glycine max
  Soy_ogl_4269 Gm13:25790101..25791100 Cluster 15
attatagtgattgatgtgatgtacctcaacaagatatcatatcccatgatttcaagttctatgttaattatatattagataaagatagattaagtaactatatgaacaactttctttagtgaacatagtaaagatatataacataattttttcacattaaaacagattttttttatatttttcttaattatatgtgaaatttaagtcttttttaggcaaaagaaaaaaaagtcttctagcaacttggtatagaaaagaaaaaactttaaccttgtacttttatgaaacaaatcgagggatcctataatcaaacaaaagcatatatatggttaatagtgataaactatatgtagttatcttttttttttttagtgcactatatgtatttatcttgattacaattagatggtgaatctcttttgatgccaagttttctccctctaactaccaaggtgagatacatatcatcctaacaagatataataatcccaaacaattaagtagatcacctgtaattaattcattaattgggactttcatacggagcaatcattaactaatttttgctcaaaagtctaaaatattaattaattagtggtatgtataatactagtactaattgttttgcttatagactatgaatccggtcatgcccttcatcatttaatttgatcaatatttataaatttaattttgaagtataattaattaattaatttttatgttgagttgatttaaaaattactgatttttcaataacgttatcttaaacacaagtttataataaaacttaatataaaaatttcaagacagaacaaaaaaattacaattttttttacttttaatcgagattattctttcaaaacaaactttaataataacaaatatcaagactccccgaaacagctataaaaggaggggaaaaaacatacattccaaatcatgacatttcattaataattgataagtagcacgtgagttgaccttcgaaataatctga

SEQ ID NO: 3743 - DNA, 1000 bp, Glycine max
  Soy_ogl_5086 Gm15:24725601..24726600 Cluster 15
aactaattattttacttttcaaaatcatagtaagttcaatttaccgacaattgaaacataggcaatgtttgatataaggggaaaaatttatatccgataatcattgatttttaagaattatgaaaattgaaaatgatgattactagaaataactaaagtttgtttggttttattacaataatttttatttttaacttagaaaagttagattctcactcctctcatgaaaatgtgtcattcgaaaactcaattaaaaaataattcgtgagaatattagattcttagaaacgatttttaaaatgtgcatacaaagcgtgagagtttctattgtaccccaaaattttgtgggattttaatactattgattttttaaccaaaaaaattatcatgttatctattttctcattatataaaacaaacttttgataggcaccaaagagagtatgctacactactcctaaaaaatataccattaaagagatacacataaaattaatattctttattaattgtttttcctaattggtgttaatcaaatacaaactgtttatccatgtgtcaacatctcattatttaaaataaaaatttaatttataaaatacaaatttaactccaactaataaaatccttaaaccatttaattttctttcttttggatctcattttgctcatcctatcaacttttttttttcaaattaatccttaattaattaaaatatttataaaaaatttaaaattacacctattttaaaataaataatatgattaaacataagtttagaaatccgaaccttaatctctatcttccatatcgccatcgtatataaaaacacattatgtgattccaaattcttacaaaggaataggatgttttaatttattctaaatttttattcttcaggaatcactatcaagatgagtattcttttatttaatatgaaatttttatgtatacaaaggttgcttttttaaaattaaaaattaaaaaccttgattcatt

SEQ ID NO: 3744 - DNA, 1400 bp, Glycine max
  Soy_ogl_5349 Gm16:26680101..26681500 Cluster 15
acttttcacattctcttgtcatccctatgtataaatatttatattgaataaatactttagaataaattgaacaaaataaataataatataatagtaaattaaataaaagacttgatatatcattttaagatttattaaaaaaatcttaaaactatgttactccataatgtaaccatgccatttttaataaaaatattatttttcttatattatatatttttatattttcaaatacataaatataaaataatcaatttaatttcgtgtgaaacatattaataaaataagtgtctttctcaaccttgtttgagagctttgtttccactgccacggttgaggctggtggttggccaagggggcgcctttacacggcgactcagggagaagggcatgcgccgccacatctgccacacgccacttttccacgatacctactcaccgacgaccacctagatagacttgtcagagcctctccaattcgttccattggagtaaataacaaagccttgttaaaagtttcaatatctttcaagcctttgttttgcctttcaaaatcaacttttctattttctgatgtaaaacacaccatttaatacaacttctcactcaactttttcaaaattaattttatcctaaccctaaaccagacagacactgaaaagctctaataaccccaaactagcaatagtgtctaattaatgaaaagtgaagtagcgtgttaatttttagaaatattttgttatttataaattattattttattattctaaggaatttgaaattttaaaattattctacatatctttatagtgtcctgaatttttaaaaatatatattaattgtgttggtaaattattatgttatttaaatttcaaaattttaagaactatatgatattttcaaattgttatgtaacttaaattttagaaaatatcataagttttgatataaaaaaatatactgatattcacagatagggacaaatttacggaatttaagagtgggttacgaccctttcctcctttattttttttcataaaattatacaaattttaattattttattataaatatttgtttgtagatttagatatatgtagttttacagatttttttatattttaaaaaatatattatacattaaatttaatttatttcataaatattaaattgtttttaaattttataaaatttagtggaatgaatctatgtaattaatgagaaactttaatggactgcaaacacgtgattgataatgactctagcaacaagacccatttgtcagaagttggtatcattttgcaaagatgtaggactattctctcataggtagatatcaaatggattatataaaattggcatgcctagtaacttatgtgtgttatttgaaacgtctcatt

SEQ ID NO: 3745 - DNA, 1064 bp, Glycine max
  Soy_ogl_5701 Gm17:15963501..15964564 Cluster 15
tttcgtgttagaaatcccttacaagttcctttcgagatttcaaactaaaattatgtatttagcacggaaaattattttgtcataaaactccctttgtcttagaatcacctttaaaaatagaatttgaaacttatcattaacttaagatatagtttctaaaagcttatcatgtctagttcaaaaatatgcaaaaacatttttatagagatcaacacaaatgcaaacctataggaaaaaccaagcacagtcaggctaaaaacataaaacagagagggtcactttgcctgtccaaaattgtccttatttttaactcatatcttagagacaacccaactttctttcccctttgtttagcacactttacctttatttgttagttttgttaattttgattttcttgtgttgatcttttgtggtttagttgtctgcctcagtttagcttcaactaaactatccctggaagcatcaacttttttcattaattattttagctttagctaaaattcttcattagtgcataatcttattagattttaatattttcacatcatcacaagagttataaattataagatttactttgtggttaaaaggaaaaagagagagagataagttatgacttcgaatcctcttcactagcaaaaaaattaacaaatcgataactaaaattggtggttcaaaaaaaagcatcacaccattactcataacaaattaactagaacttattatctttttagtcctttagctttttgaaattgttttcagtgaatcttttctttctgttttattcctttaattttttttgtccataatttgtctttttattttttttcatccataattttagtctttttacgtttttttcatccttaattttaatccttttaagagactaaaaagataaattctaaaaagtccaggaactagaaagatagtttaactagtttataattattaacaagggtaaaattagtacattagtaatatttaaaaaagcaataaaagtaactaattcacctatttgattggtctatataatttcgttacaacttacaagtgtctta

SEQ ID NO: 3746 - DNA, 1000 bp, Glycine max
  Soy_ogl_5725 Gm17:35222101..35223100 Cluster 15
ttttttctaactaaaatatcaagaggttttatgttttttggggtctgcctgttagccttcctcctagttccgcccatttgtccaaaggacattggttaagctaggaatcaaaagtgaaaagttttttttttttttggaaatatataacaatacatttactttattgtgattttcaatgtaatctcaacttaaagactttctattgtatgtaaggtcaatacttagcaagacctatatttttttattagcattgtaataagcaaatagaaagtttttgttgaagattatgtttgagctgtatagaaaattatggaggagtgcattgtttcattcctcggaaaaaaaaaatcacttttgattccttaatacaacgtcctaagggaatcacttattatttttcataatagaattaagtaggaaatgaattcacaaattcaaatgctagctcaatattaaaacaattaaaacctattatcctttccctagtacataataatttaaaaaataatttttttattaagtgtgcattaaaaactcactaaacacactaaatgccctagaaattaatagaattcattaaataactcatatataaaataattaggaagaaaaaatattaaagtatcgttagtttgggcaaaaatattatgtcaaaattttctttatgtattgtataaaagatattttaaatagaaatatatgttttaaatttctcatgagagactaaatgcttgtaacttttgttaaatgaagggatctttttgggttaatatattgtaggtctgaaatattcacaaatttttctaataattttcgtgaaataacttacttttagtataatcttcttttaattatattatttcatttacaaaatttgaacttaagacattatttaatttaaggtatttaaatctagtttcattagaaccaacataatgttggtaaatgtacagattaaaaatatattaaatttttataaggattaaaattgaattttgaa

SEQ ID NO: 3747 - DNA, 1000 bp, Glycine max
  Soy_ogl_5731 Gm17:36157701..36158700 Cluster 15
ttgtttgttgaagtgtttttttttaactaattgtttgtgatttttttttatccgtgagtattgtaagtgttattcttcataaagattaaatctagttattttaaaaagggacacatgcctagaaacataatcattgagacttaaaatttgtaaaaatcaataatttcaaaataaaaataaggataaatatgattttaatttttatatttttcgctttttcatgtttgggaagcttcatatactttaatttaattcatgtactttattaaaaatatgcttttagtccattcacacatattctttacaaatggccttagttcttgggaaatgaattattgttagtatttactttcaacaacatcaatttttctcacatacacattccttttgtttcgttatgaagaataagttatgaatttcaaatcacaactatcacatacaaatatcgatgaaaaatcatgtgatttcattgatctacatcaccaactgttgaagaatataatgaaggtggaaataaagacaaaaataaagtagttgaaaattagaatttgatatgtctaaggagacattttaataacttctttttttaaaaaagaataatttaaaaaaaataaaaaaacctaaccatcaattctaatagacaaaattaatgtcccatgtgaagaataaaaacacgtttttaataaaatatataaactaaatttgactatatcaaacttcaagaaattaaaatcaggaaaaagtgaaaatataatgaataaaagtatatttttcccataaaaataatcctataccgccgccaaactttcattgtccttcaaacaaactttcattgtccttcaaacaactcacctttacttacgtaggcagctctacatgccacattaaccatcaaagagtaaatggatggttggattaaaatttataaatataagtttaaattcaaagtatgttgtaaactttttttttttgatagaaatatgttgtaaacttaagttta

SEQ ID NO: 3748 - DNA, 1007 bp, Glycine max
  Soy_ogl_6025 Gm18:12048701..12049707 Cluster 15
gcttttcttctcctaatttttattttgattatcacgattacctctaactgaaaccgcacaacacgtgattatccaaataaaaattaagggaaataaaattttaaggaaaaaattgtaggaaaaaataataaagtagagaaggtaaagattgtcggaacaaataaaaattaagatatcacataagtgactaacacattaataaaaaaatgttgttgttcaccttttcctgttcactcaagtatatcttaaaattttgtttgtttccactactatttctattctttctaatcttgattttttttatattgtttattttctctttatttaaattttgattataacaacacaccaggtgatcatcaaaatttaaattaaagaaagagaaactacaagaaaaaaaaaatcaaagaagatcgaaattgtggaaacaaacaaaaattaaggtataaaatgagtgaatgcaacacattaataaaaaaacattattgttcatcgccttttcctattcactgaggttatactttagtttttgtttgttttcataatctttaccttttcccaatttttttgtcttgtatagcttctttttactcatttttatttcgacaatcatgattatatttacccaaagttgcacaactcgtgattgtcaaattaaaaattaagaaaaaaaaactatgaaaaatatcaaaataagagaagacagagatcgtggggacaacaaaaattaaggtataacctaagtgaatatataggaaaatgtgaggaataatgtttttgaattatgtggtgtgcccgatattgtgataggtgattctgagagagagcgtagtaggtcattcatgatcgagagaaagcagtagaggggacatgttcatgggaacgagaaaaaacaaagatgtgatcatgggatggagagaaacaagaaaaaggaaacatgtgatcatgagatggagagaaatgaccaaatgaccaaaagggaataattccttttggaatttaataaa

SEQ ID NO: 3749 - DNA, 1034 bp, Glycine max
  Soy_ogl_6034 Gm18:13045001..13046034 Cluster 15
gttggtatgtcaggtcttttacttcgaatggaagaaactccggtgttcttttacagaaaaagctgaagtaatataacagtcctatattagcttagtactatgaggagaaaagaagaatatataatactagttaaaagaaatcatgtcgtgcgactagtaattaaaaatattaaagaaaaaaattaattaaaaattatgatgatagtatgtagtgtaaagaaaatcacaataaattatgttgatacatttttcataaaaaataaaatcttttttattctttaatccgtgtgcttaagacattaactaacatttttaatgaagtgattattttattaataattctcagttgagttttagatttttaagtttaaacagtgtttcattttgtcttttctaatttattaattctattcggagttgtgatttaaaaattcaaaattagatctaaagtttgaaagccatttcaaactcatctctttttttttttttttttgtaatttagtatctttaatagagttttttcctttaaattatgcttttttaattatctacaaagttgaaactcaaatctgtgttggcaaacttgtttattcagcaactattaagataaacttaataatgagagattaccatagatacatgaagatttaagtttattgtatgttaaaaaatattaatctatttagtaaaaaaaaatagtcttaagattttgaatgcaactcaatttttaccctgccatacacgggtaaacaaatggtttaagtgtttttatttagattttatcttttatttaattgtaaactcaatttttacttgttttttttatctaattgaggttgcaattttatctaaatggatttacttttatttaatggaactaaaaaattaagaaatatttagaaagaaaatatttaaaatatgaaaaaccacaatagaatttatagagcatgtatagtaattaacttgtacataacatatatgtaataaattttgtttacattaaatttaaacataaatatctaaatatctaagag

SEQ ID NO: 3750 - DNA, 1000 bp, Glycine max
  Soy_ogl_6035 Gm18:13085501..13086500 Cluster 15
aaaagtgttacaagtatatcgttaatcctctttttctaattaagaattatgatatgatcttcataaatcatgaggatcatgcatgaatttatttcccagtgatggaactaggatgctttattagggatggctaaatacataaaaataataaagattttttctcttttaattgtgaaattttatgtgttagacaataatcatattataaattaagcgttgtgataatcattctttagagttttgtaaaattttatatgcaaggtcgcatataaagtagtttgataagtaggattggttaaaaaaaaaatcaatctttagagttttgcaaatacctagctacacacatatttcatgcatgatttggaacaagtttatactaaatttggaataataagtctaatttgacagatatcaacgttactagaaaatatttacaagtcatgttataatacatgcatatgcgagaaaaatactatcttataatccaagattcgaatgataaaatctctatttaaagtcaaaagttatgtattgcaaaaatattggttaaattttcttcttgatacaaatttctttatattgttattatattgtagtttttttgcataaaaagaacataacctatatgttgtgtgaggtttgttagattaaattctaaaattgagtgaactttaataaaactcttttatcatctttcataaattttaatatttttgtcatatatatctccgtgtgtgagtgatgagtagaatagaaaatctaaagaaatgaataaatggtataatatttttcataataattaaaaaaattaatttaacacaaaaatttaaactctttatcaaattattttttattttttgttatagaaaactttggtttaagtttttacttgaaaaaattggcagctccatccctcttttcacgactgtgtgggagtgggatttttttttctttttctgagagtttcacctcctaaacctcctttctcctttatatacac

SEQ ID NO: 3751 - DNA, 1100 bp, Glycine max
  Soy_ogl_6712 Gm20:124101..125200 Cluster 15
aaaggtaaaaaaatataatattgcaagtataatagaaaatatttttcaataacatgacctaagtaactaaataatacaacaaaggtaaaatgaatgtgtcactacatttttataacaagtagtgtgggttcatttgttagatttttagattttgcgttaattttcttttttaaatttaatcaaaatgacctttaaggattaaaaaatgataatcagtaagatcgaatccacatactcagcagtgctataaaaaggcgtttgttattcagtatgattattcagtatgatatcaacatcttgcatgctcaacatatttacagttagatcttttactgttaaatctgaaggtctgaaattttttttgtcaccgtgtgtaaagagttcggcttacgcacgccagacttcgcattattagaataagaaacttgacaaagttacattcgaatacccaaacgaattttcactataaacaccacaatatacaaatctgctataacatttattatcgtctaattaattaaggaaacctcatatgatatgatgtgagtttctcatttgcttttttttaatacatgtgttttcaaattgattgaatcaaatattaatctcatttacgatatataattattgttggttcaagacacaattttatacatgaaaaaaattaaatataaatttttttattaaataaatctttctttctcatctaaataatgcgtctcttttagtttaacaaagtacttacgtattttttaaaaaaagtaaaatgcttataaaacgtccagcaaaataatatcagatattattataccaccaataatatctaggagtgaaagtttgatgagaaatgtattttgaaccgataatatctagaagtgaattaatcgatgtatacattctcccttttaaaatgcttaaatgagagttttcaagagaaaattgaagcgaagagagaataggacaaaagctaacatttggtaacgtgaatgaagacaatgttccattgatgaattggagtcaaaggaacacccaaaagaaataaattaggacatcgagaaggaaataaaaactcagaataaaatatctttgaatactgatgg

SEQ ID NO: 3752 - DNA, 1000 bp, Glycine max
  Soy_ogl_2749 Gm08:17675401..17676400 Cluster 15
atatatataattataatatgttacttacactatataatataattttttatttaaaaaatatatacattttttaattttattactgataaaaagtatcaaaatcctaaatctaaatatctaatgattaagttctccacctccacgttcacgcagacatgcattgtgcctcttattaatatctaatggttgtgccttttaattttttgttcctgaatgtaccgtacttaatttgattgttttcggcacttcttgtgtcaaactcaatctctattaatatagtcgaaaaagagacacttcatatctctatctttatttttttttaaaagaaaaaaaagtaattataaaaagtagtaataacaatttttttgaaaaagtgacagaaattacatcttaaaggttcatgaagaaaataaaaatagttatatatattaaagaataatttaagaatgcaaaaaattaaaattgtgcctcttctcaaatctcaacgccaaactgtgcaccaagttcaagttcgagatttctagtgtcgtcaagttgtgcgtcatgttcacgttgactctcgctgcaccgggtttgttttttccctttcatgctagattgtactgaaatcagaaaattttcttaataatattcatttacttttgaattgaaaattgctaaattattaggactatgaactgaaaattatttcctaatttcatcatgttgaaatgagaaacgagaagtttatgtattttagttgtgaaccaatattttgtttgctaaacattttgtttggtgtctcgtgaactgaaaattaattataatattctatttggtgtttcaattgtgaacaatattctgatttctaaattcatggattttaatgccacggtgcatgctgttacaatattttgtttgctataacatttcatcaaagtgtagatctatactatttgttacaatttaatgctctaaatttatattatttatggatcagtacaaaatgtaattttttatt

SEQ ID NO: 3753 - DNA, 1100 bp, Glycine max
  Soy_ogl_3847 Gm11:16366201..16367300 Cluster 15
tgggaggattaatttgtctgagttaatgcatatatgtaattaagaaaaatagtcaataaatctgtaacatatatctcatctaattaggaaaattagtccagcagatttctaatcagaaaaattagccatgcaaccaattttgtaaggcaatcacgtagaatcctaagatgttgagatcttccataaatgcagaaccaacccattaagctcttttctctatccaatattaccagagtacaatattgtttcctttcctcaccccactcagctatctcaggtctcgtaaatagtgtatctctattccttttcacttaccagactgaatcgagcaaggtcacaatttttttaggatgggtcacaatttttttaggatgggtcacaattcatagattttttttatttgatatattaatttgccgttcagacacgtggttctgcctcctgaagttgccaaactgcttccttagaatcggcttctctcctaataaaaaagggtgtgtttgatttaaacaaaaataggatagataaaataaaagagaaataattttaaaaaaagagaaataatttataaaaaaaaaatgagatgttgtgctgtttggtatataaataggtgaaaaatattatttttgtataaaaaaattgtctaaaaaatcaaattttttttaaggaaaacaacaattcttttgtctaaaaagtcaattttttgtctaaaaaaatcaattttttttatataaaaagacgatttttatgtaaaaaaaatcaattttactataatgggaaagaaaagaatttttccaaaatcacacgaatcagtcgtactgagtccatctttctctttaataatttatttctctctttagaacaaaacgcaacctaagtaatttttttgtaaattatttttttatcttttaaatattaattttaatatccataaaaaattaatatatttttagtttatatatttacgaaagtgatttggttttaatctttcattaaagactacaaacacatttttatggatacatataaaaactaaattgatctactaaaagaagtatctgtatgctttgaattatgcaggcacgcagaatttgccttct

SEQ ID NO: 3754 - DNA, 1232 bp, Glycine max
  Soy_ogl_489 Gm02:11244808..11246039 Cluster 15
caactcataagtaatagttactaatataaatacctctttaattttaaacaattcaaaattacatctgacacactaaataatatttttttaaaaataactcattaagttattctcattgtagatattctaaagaatttaagtagtttaagtaagactgacctaacgataaacaaaccttaaaataaattttaactttttttattttagatatgttgagtctttttactaatatatatgatatttttattaatatatgagatttttttttactttataaatattaataacaaatatttttatcagtcaacctaaagcttaaattttaactgctatatcttgaacagattttgagttcaggacaaacaatactacaatagagcaggaatacatgtaaacacgtcttttattagggatcccaatgcgaaaaaaataatatttttaattaaacctaactgaatagacgaattgaaaacaaacaaatttgttgatcgtacgtttcgtctagttgctttattttaagtaacaaagagaaaaactctaacgtgtagacttgtgaactctttatcacaggaatttaaaatttgcaatgaatcacactattttcgttcattttctctgcccctctcccatcagtacgtggattctgctggattcgctttcagaacgatttcattttgaaacaaaaaaaataaaacgtaattaaaaagaactgcgtaaggttttagatactaataaattaatattaaggataacattgtaaggaaattctcacttaaagacaaaccatacgcagtcatatttgaaaacaaaccatcataaaaaaaatgttattattgtatttttgactctcagcaactctccgaaaattaaattacgagtattcattagattgaattaatccaatgaatctgacaatacaaacctaaactaattaaaatgattcggactgatttgattaattgattcttttccatttatatttgaacaaactcattataattagttcgattatcaaatttctatttcttcaacatgaatacagcagatgattggataaaataatttttaacttattaatgtattttagactttagaacttaattttttcttttatattaggctttatttttcgtttatttgatcttcttatgacattatttaatattgccatgtattttaatttgattatattgattatataatttttttaatcaagaagttaataatatatc

SEQ ID NO: 3755 - DNA, 1500 bp, Glycine max
  Soy_ogl_1360 Gm04:43172501..43174000 Cluster 15
taaaatattgaaaaaatcggaaggtttagtagcggtggaactaagtttgcagcagatagagattacgaggtcatccaacaaggtgaggcagtcatggcggacgtcctccaagaagaggaaaccactcattttcaataaaatttttttttaatttaatccagtatgattattcatacaatagtcctacacttatgtccaggacattcttaatcgtaggcactagatttctttctcatgctgggagatttgttgagttctacttatatattttttcttttcattttgaaagcaaagagagaggtttatgtctataaagacaaaaataggcttatgaattatatatattttttcatttgagatatttgtgcttattttatatatctatcttttttattttcctctactttttttatttatttatataaccaaatattttgaaaaaaccatctcactttcacttttttttttgttattcttttgtttcacttttatttctttacctgaaccaaacatatcttgatggtattctaggtttttagtttacaagggattgaaactttgccctctccttgaatcacccctaacttttactttttcacccaagttagagtgactcattacttgtcagagtgcactctacaaagaaactaaatatttaatttataaatttatttttctacaaaaaatgaggttacacttgtgtagcttgtctgcaatattatcgaatgcatgggtaaataaaaaacttattgtatttatacattttttttatctctcttatactataatttcttattttctctttattttctaacatgtgagtgttcaatttcatgttggattcttcaaaatcggcttgaaatgtcagttaacatgatttttagtaatttttgacatgtttgattgtaagttgaagaattaattcatggttttgagttgaagtaacttcaaaatcaatttaatcaaatttcattcaaaataaattttaaaacattcatctaaacacactatacatcatctgtcctctctctctttattatctttctcttccttctatcctacgactcaaattggagtgtatctttagttttttcctaaaaactaaagtggtcatgtttggcctgaaaatcatttgtactttttgggacaataatatttaattattttttaatggaacagagtcggatttcattatttatagaaaaaattagtgaaaagaaattgggggatgaaaaggcaggaaatggtctcaaaattgcatttagaaaaattatttttcacttttttttacagaaattatacttgtacagcaagaaatagcttgaaatttaaaatcgaaaacaactaaacaataatgaacgtaggcgaaagcaaatacaaaaatttgaaagaatgtaaattgaatttcaaagtggcgacacaagaaaataaatgctcaaatttaaaagaaaaggtcaaaagaaacacgaagaaatttaaaaatgcgtggactgtaaaggc

SEQ ID NO: 3756 - DNA, 1500 bp, Glycine max
  Soy_ogl_4455 Gm13:35166601..35168100 Cluster 15
tgggtcattttaagacaaaatatgaaccattttgaaaattgaagaattctaaattaaaagaattaataggcatatgatattagtgtaaaaaatttatactatgaaatcaattacaatcttatattttttaagaagttttatttaaaatattttatcaaattttagttattataatatattcttttattccctgatttttttaaattataaaattaatagtattttttatccttttaaagaaattttatgagaagattatattttattaattttagttattataaaattgtttttacttcttggatttttttccttatctttaaaataaccacaattttatcttttgttgtcatgggtcaaagacaatttgtatttcccaacacacattagtttagagactaatttagctagtttaagagaatttacatatggtatgaattaaactgggattctcttgttaaataaattatttatacacataaaataaatgtaacagaatattataccattgtatcaaccttttgggttaatattatctttttgtttttttaattatcttacaatcattttttatcagaataatttagcttgttattaaatatgaaataccttaaatagttaatttaattattaatgtaattaacattttagaacatcaatttgtgaatattttacatacaacttaatgatatatttactagataaaaaattattttttatggttgatcctttttctttcgagtctggatcccttcatatttaattttataaaatatctcattttcacgtctctcctcatgagaataaaaatatgaaaaagtatgataaaaaataaaaaatattacatttctaaccatcaataacatgtgagaataattttccagaacttatagcaaacatgaatgtataaaatattctcatcttacgttatcggaaatgaacttttaattctttatacaaatgcactccaaagattaatgagagatgtttaacattacttcaccttcaaagaaagagattttgggatgagaagaaggaacgtatgctttcaaatattattccttttgatttgaaattcataattttaattttattatagtgataaaatacttatatataattttacttctttttatctattatttcattcatctaaataaataaaaaatattattcaattctcatcttatttttgttcatctaaataggacatctttttaatatttttttcttttttctttatctatttgttattgttattgtttgtaattttcaagaatagacaagattatggaccttgccaaaaatgtacgaaaagatgaggatcatctctgaaattcttatcttatacagctgcctaatgtttctaatgatgcccctcccttcccccttctatttttctttgactattggcaccacccattgctcttcttacattacacccaccttttgagagatatatatatatatatatacaccatgttattaacgaagagtatt

SEQ ID NO: 3757 - DNA, 1258 bp, Glycine max
  Soy_ogl_5374 Gm16:29901416..29902673 Cluster 15
gttccaaggatactaattagcaagagcttaaaatatttctaaattttttaactagtacctaataatattagttaacatttatcatttaactttatgataaaatttaagaatattaatttgaagtgttttgtttgttaccattaattggattcttctaggggaaaagagatgctttgtcatcactctctttctctcaattttttgttttatcctaagatatagtcctacaatttgataaaaaaaaataatggagaataattacttttgtctcctaacatgaaaaattaatttattcaaatttgtttaatacttgctgaagacgatttacatctttaagtcattaagtctaaatgtttacagtagtaattatttttatattttttcattaacagtttttaatagttatcaataatcatatttagaacattcattttatgtactactaatcccataagttattgagtagtgcaatttattctcataaaaatttgatttagtacaagaaaactcttaattaaagatgttatcatattagattcatcccataaatttctcaatttaaataaaactaattataatcagtgtgacttttgggtatagctttttgcaattcaaaccaacccgaagattcaataaattatttcttaacttttaataatttttaaattgtagtacttattttttctttatttatttattttgatatccattaatcttatttgtttgttataaagtgttttaatttaattcaccaaaaaaattgttaatttaatcatgtttattgtataaatttttcttatcatgttttaagtaataaaattaatgagatatgtaaagtgataactaaatattaattaaaataaataattagtcattaaaaataaaaattaagtttacccttgatcaatgtaaattaaaaaatataaaataaacatttagcggagataaaaactttaattaaaattgaaagaaaaaaaaaactcatttttaatcataatctggttacctaaatcaaaccaacatgatattacttttttgacaaaaaaacctacatgatattgatcaagttagttaggtttggattcaacaaaataaattagaactgaattaaaacaaatcaattaaatataggatgagtttgtttaacttaaaaaaaatcaaaatgattattttttatataagcaactttttaagaaaaatattagatttacttcttaaaataagaaaaaaaaactttttttagccgaaaccgtttata

SEQ ID NO: 3758 - DNA, 1135 bp, Glycine max
  Soy_ogl_5743 Gm17:37352769..37353903 Cluster 15
aagattaagattaagataagataataacacttgaaataaatatgaaaataaaaagaaaaaatttagcaatccgtgataagcgctagctgaagatcataaaatgacaaggtcatcatcaacttgaatatcaattagcatgagttggcttatgaaaaatgcatagcttgaaaaataatgttaaaagggtgtgagatacattatcttgcaccatttacaacaattccgaaggaaataaaaatcatttaattaaaacaatttttatttgtgattttataaaaatgagtaacagttttttgcaaaactacaacacaaagcataatgtgtgttgtcttttactaatttgtggggatgtatttagcgcttttcattcatgtacaattatttttaataaatactaaccttcatatttttgtaacatattaaccatccaattttactcttataaattatgtgacactactagttagttatttggaattttctttacaaaaatcctaaatatctatttgtagcccgtagcagtctatttacttatttttatgtgtacaataacaacaataaaataaaaacctaaaatatcatgtaaattattcaaatcttccaccaagacaccttagcgtgtttcgaaaaataaaaaagacaaaccttagcgagttggtggcccgtagtaattttactagtttcttttcattttggaataattaattttaaagatttgtttactataatattataaaaaaaaatattcaagaaaatggaagggagagttttcgctttgatttgattcagtttttattgtcaagtgaagtttgattttgttgacaagacgaggaagaaagagaacaggttagagtaaaaaaaaaattgataatcgactaacaatatattcaaatagtgtatacgagaggaatatcatttatcttagtcagttctattagattgagtatgatatcataatttataataatttaaattataattcttcatagaaaagaattaaatgaaataaaaattaaaaatatcttaatagaaattaaactgataatcttttattcataagataataaatcactaatacacatattttgtttaattaactatattaacattttttttatatggatcattagtcaag

SEQ ID NO: 3759 - DNA, 1000 bp, Glycine max
  Soy_ogl_819 Gm03:3238801..3239800 Cluster 15
ccgttccttatttatatttattcatttattttcctacttttttctggagttctacttttaagttgttttaaatccacatctaacatttattccctggttcaccataaatgaacgtaatccaatagtgcttttgatatatataaagtttttgccccctctaatctagcagcagtgtgctttaattgaccatatcagatttctttcttttttttattttagttttattaataagtaataactgtctgtatttgtagaaaaaaaatatataaccagtaatcttggggtattgagtaagaaactaaaatgataaattttttaatttggatgcataaaattacattgttcagactatttttttacgttcttatgatttttataataaatattttttctctaatttttttaaccaatgtactaagagcattgattaacaaattaaaaatataagatattaataaaattaaatgtatactataatatttaatactttctaagattttatattggatgatatatttttatttaatccttttctttacagatatttttatttaatcctaattactgaatgtttacatgcataattttttttaaccgaatgtttacaaaactttgagtcgttatttaattggtttaatcatttaaaaagcttatagtttttgttatcagccagttaagtttatagttaaattatgatagaaatgtgattagataattagacaacgttaaaactaaaaaaaaaaacataacaaaacattttgttcatattttataattttatcataatgttttttttttgtaagttatcataatgtttttttaatctttaacggatagataagtttacaaatatagtggtgagattaaacccttgagctgaatgctgatagacatagtgatagctagattgatagttaagtcaatttgaaagttcaaacctacattcaaagtctttctaagattatttaccgtatcactctagctccattacaactggtgt

SEQ ID NO: 3760 - DNA, 1051 bp, Glycine max
  Soy_ogl_907 Gm03:36572301..36573351 Cluster 15
ctgccgggatttatacaattacgttacactgtgcttggctaataaaaaaataaaaatttcatcactttaattatttagaaaaaactaaaaagcaaattgagacgacaattttttaagaagatatcacatattctatcctatatttgtctttttctaaaaaaaaatattagagtattatatttgcattttcggaaattgaatcttaacgtaaatcaattagaagtttttttcattcgttataaaattgaatctaaatatataattataaaatcattatcatttaaattttgtagtttttttttcattatagttcagtgtctgtatgcgttacattacataaaaaaaatttagaattttttttttagaaaaacaaaaccttctaaaaaaattcgcacaaatctttttatggtagcaccgaggctctctgatcggtggtagtgtaatgtaatgttggctcaaatcagtcatcaatcgaaaatatgttctatttgcaagtgtaactgtttgtgaccacccgctggccaaatgagtaaatttattaagctcatttgatttaatttcaaatatacagtagagacttaggtcatcatttttagtccagatgagcaatcaacctatgttaaatatcatttgataacattacccaatcaagaaatagaaaaattaatagtgtcattatatatattaattgcaacataacctaatataattagcaatcaacttatgtgaaccaacaagttgttgattgaagtgatataggatttgatttttttaaataatgtctcaagttcatatattataaatgaaaaaaatatataattgtaaaggaagattttactaaaatgattaatcaattttttttaataaaaattaataataaataaaattagtgaatatttcacatcaatgtcataatgataaaaaactataagaaatattatttatagttaataaaaaaaatccaatcaccaaaaaccatttacattgcaacaaaaccatttacagctaatcttttctttgcttctttctgtcattgtaatttctacaacat

SEQ ID NO: 3761 - DNA, 1600 bp, Glycine max
  Soy_ogl_2750 Gm08:17710501..17712100 Cluster 15
ctaacaaattataattacattaaaataataaaatgtatactacaaataataatatataattttggtggtaaaatcatgaaaataataattaagcattgcaattttaatatataattatataagtatgagtgacaaatattttcacaaataaaatcatatacgctatacacatataaaaatatttatatgaaaaacccacgagatttatatgtgagactcttaaatttttattttatttttactttttatactcgtctaaaatataaatcttatttatttttccaattttttatttaaattaactatacgtgtgtttctattataattttaagtaaactacatttacatgaaaaatcgtgggatttatatgaaagtcttgtgaaaggtttacttgatgtcacaaccaaaattatggctagatgggaaataaaaatttttaaaaaaaagtcaaaaaataagttgctcccaaaatttaatcatgaaaaaattgaaaaagcaaataagagttcaaaataactgtgcaaatttaacaaatacgtcttttatttcaagggaaagacatatgtgttaaaaatattttacagtaaaaagaaaaataaattaaaaaatttatgctgacttgacgcagtattatttattgtctagatagatggcataatattgattgtgctcttttgtatttctcgagataatgcaaaatctcaaaggtatataattcaatagaaatgaactttttttggcaaaacaaataaattcatacgtgttcatagccataggtgaatcaaaaagcaaatagacaggtttaactcgtccagtagtcctgattatgaaatacagttagcaaaatatctgtataccagttttgtgtgttggctgcatgctaaattcgtcaaggttacaaggtgctcattgtggcgttactgttgaagagtcaatcaatcgagaaatgtaagattaatgtttgaataataatacgtgttcagtaaacatcaaatcacgtagagacaaaaggaggagacctgaaaggtaggtttagttggaaattggatggaggacaactatgaaaattatgtgcaatatctttttttagatacttttgatgttgttcttttcacctaaaaaaacttataacatctccgatgatattatataaacaattgataaattatctcaattaatttaactaattttttcttcaatatttattttcataacaattatttgactcatatatattttatttttctcttttacatttaatacaaaattaagtaattcataagtaatagttatttatataaacaattctctcaaattttaagcatgcatgtgacacccaaaataatattattttgttaaacaatccattgagtaatttttattatagacactcttagtcaataaagattaatattaaatattatttttttatctaaaccataactatcctccattaaaaataaacctattaaaaaattagagacatctaattaaattggaataaattcatgctagttcatcacgtacttgttgttattaaatatttatgtttgacatcagaaacatcaaaatattgtatataaattttgtccaaaacata

SEQ ID NO: 3762 - DNA, 1078 bp, Glycine max
  Soy_ogl_5171 Gm15:49119501..49120578 Cluster 15
gacgtaactttctttaaaaattaatgcaaacaagaacactgtccgggcacatgtataagattattctttttaaaatctaatttgaatatatttacagtatattttttatattatcattcaatatttcaattacagatcattaagtaaatttattgattatataataatcactttaaaaattttacctaaaataatttttaattgattaaaaaataaaaacttatatactgataatgaatgaaaagtaaactcttatttgcaatttggcattcctctagcatatgtatctgacaataattttttttgggaagcaataacgtcaatagatatattggatgagtttatttaaactagaaaaaaaaatacttttatataaatattttaaaaaaacagataaaattagtttcttaaaaaaataaaaaatatttattttaaataaaaacaatttaaacaaatacgtcagaaagctataaaattacttattttatcgaagaaaaacacttaagtaaactagccctttatttccatatttccgcatacaaagaaagtgttttccgttttccccgctttctttttcctcccccaataatgtacttacgaagcatattgcagatataattggaaatttgaaatgcacatactattttttctttttattgattaccaaaatgatgttcatattatatatacataacgctccaatataattattatgttaaagatcacatttgatcatcattggtggacatcttggatatttcctcccagcacgaatgatcacatcgtgttggtgaattaatgtgtcagaaaacgattcatttttgttttgaatcttgcatgtgcttcaagtccaaggaaaaatcatgcacaccaaaacaaaaaaaaacaaaagaggacttattttagagtcataagtttaccaaaacatatagctaggtagaaaatattaatatacgatcatagtccatagaattataatagaacaagttgctttgcttcatggaaagaggagcagaggtgtaattgcgtctcatatctttgaacttagagcaaattttctggtataggcagttattag

SEQ ID NO: 3763 - DNA, 1000 bp, Glycine max
  Soy_ogl_6425 Gm19:38488901..38489900 Cluster 15
aaactaaatgtattagtgtataattattgcttaattaattgtatttatctatggtgcataagcctgatagtttttaaaaaattattaatatcttactaataccatatttaccagtagtatgtgtcttgtactccttccatgactttttataagataatattttgaaatttctttatcctttttataggattattttctaattctctattgtattaattattttttgatcaaaatatccttaataattctagttcataaataataaatgctaataatcacattttcttagtttattttttggaacccccttttacaaaatggaaacataattcttgtgtatttttttgacggaatatttctattaaaagggtatttttagaataacaatttttcgtaaagcacattgaaggtgtaaacacaataagaggagatgagaatagctacttccaagatttattttgtttgggctttggttatatgtgtacccatattatgttatttgttattttcaaaatatattgttggtactttggaatttagtttttttttattcttgtaatttttttaaatttttagtcctcagaaattatatttattttgtttttaatctttaaaatacttttagatagtgctttgaataggaaaaaaatgttatctaaaacgtaagaaaaaaaatatttaaaccttccctaaaatgacaggcggcttagacaattctacaaggttcacttatcctatatttagttggagagaaaatcaagtggaaagaaaacacgaaaacattttcatccgtttgtttggagaggtaaaaggagagcaaactatgattttgatatcaaaattttaaaaatgttgtgtaaaaaacttaataacattggtttgtatactttcaagaagtttttatgttgtgttagattttatacttttcaaatcctaagtattacccattattttgacgatattaaataaaagtaaacttaaagacgaccttaaaattatt

SEQ ID NO: 3764 - DNA, 1000 bp, Glycine max
  Soy_ogl_870 Gm03:33227801..33228800 Cluster 15
tagaaataaataaatgcaatatctttatataacactgttagtttcatttttattgtaatctattatattttattgggatgactttcctatctattttaataatatagtaacttcaaaaaataataattaatatactttgtaataatttatttattgttgtaattttatatttctagtatagaggggcgaagtattaattatagcatcaaactcttattggaaatcaaccatgtctatagtattatagaataaagagtagaatgaagaagaaagtgaaggtgggaagggataagagaataaagaaggatgaacaacttacaaactaaagaaatagtgtaaacaaatgaataatgtgtgaactttgggtagtttaaaagtgacatactgtgtgaagagagaaaacatgaataatcggaggaaaaaaaaaaaacagcagtccaacattccactatgttttaaaatttatttttctgaaaattaataatcttatacattttaacaatttatccttaaaaaaacgattcaatctctaattttttttataatacttagaaaaaattcttatgatgtattcacaataaaggcatataagtttcatccttgcatgttggaaatgttaataacttgtttcgaatacttataaacacttcttatatattcccttgttgaattttaaattcgggaaaaaaattatgtctttgtttatgtttcattttcaaaattacatgaattattcataatatttattatgtttattttttatgatttctattttatttaatgacggacggcaaactctaaataaatttaaaatataaataaaataacaaggaaaaatttctaataaaattctattaacatgcttgaacacgtgtcatgaataatgataaattaatttatatttgagaaaatttgagttattttacattatatattacaaattcataacaattaacacaacaatacgcctgtacatggcacgagccatcaaactagttct

SEQ ID NO: 3765 - DNA, 1189 bp, Glycine max
  Soy_ogl_5174 Gm15:49371801..49372989 Cluster 15
tgctgcgcatatgacctcttgaagtaaaaggtgatttgtgatcagtgttgtgaatatagcattattcgttatactggaattgccatcctttctcacttatttggttgctactggcctacacaatttttcatagcatgctcatcaacagttattgttggatctgtttgctagacatgtttgctgaggatttggtttgaattgcaatatttgtttgttgaagtttaattttgttaggttagaaagttcatttttaaaaaaattatattttattaaacaggaactaaattgaaatatataataaaattattactaaatataaaaaataacgagataactatctaacttgataattatatatcggttaaaatatcaacagtaaaactccaaaaatgagtaggaataccatataagctccctttgtttttttttcttcttaaaatctacatgataaaaaaagggggttttcataggagtgatgatgtttgtcaaaatcaccccttccatgtgaactaatataattaaaccgctcaaaattacttacatggatcttccaaaatatcattcacatatacccaaccaattcatggaaaaagtattaactagaggggaaaaaataatgtgcctttttgcctaacttttgacaacgatgctttggaattcgaacaaacgcaaataaatctatccttagctgtctatgatcgtatttttgttctagatgaaaccaaaatagctgtagcttgaccttaggatttggtgatttgcaacttgccaagtcagaaaccacttctctttgactgatatgttaggcctatattacacttctgtgtgctaagtcaattcatgtagacagacattggctgctaatcctgcatattatatttttttgaagattaaccctcattcttgctgcacatgtacggatatatattattttttcctaatgacaaaaaacaagatttaaatttatgattttatatcactagatcaactacatattgagtattaataaggtctagttacttaagtaatataggtgaattgttgtaatagatttgtacatgtgcgaatatagtaagcaatcttgatcttttttttttctaactaatattttaacttagtatgttttggcccaaaggaaaaaattaatgttgtaaattaaatattacatttaactacattattttgaact

SEQ ID NO: 3766 - DNA, 1704 bp, Glycine max
  Soy_ogl_6367 Gm19:8240301..8242004 Cluster 15
attacataaagtagttgtaatccgtgggtaaccaaaagcaaaataggatatttacaaataaaataaaaaataagacaataattgaggcttataataaatgggtggtaaatgatgccagctccctagtacatcgcaaatagtaaagcccttgcatgtggtcgcttaatgtaaattattagattaattgtgcactgttgcactttgtcacattatgagtacacttcgaatattttaattctcttattagctttcaacaacaaggactcttttgttttttttttctttttccctttaaaacaggaataaaggatttatttactcttatctgtagaatttagaagaattttagccatgaaaagagagataacaatcaatggtagtattgttttcccgaaaagctagcttaagtcaagaaacccaatcgaatttgagaataattgattaagaatttaggacacacagaattaccagtattgatctttgaagcatgcgtgtctcatatgtgtagaaagctactaaaggtactacaagtctacaatttgttcatcaacttatatttatctattttttttccttttccattgtcatgattctatagggaaaaaaattatatgaataaactgtttttttatatccaattagtacattttcattagtgtatgatttcttttaagtgtaataattaattagtatgactttactctttactctctagttgatcccataacaaaattattcttttttttttcttttcttttaattttaacatgtcatctgaaacattgatataaaagttgtccgtggcaaacataatatccacaataaaacataatatatatccacaagtaacaaaatgaagtgatgagttataaaaaaataaaataataataaagtgatggatgctgtgatagtttggtaacgtgtaacaagtaacaaccatttaaagtgcgaactagctagtaactagtagtaagataagtctaaaaatgaataagatttagatactataaattttttatgcttgcattttgaaaaacaataatcaacatgatattttataaaattatcatttaacctaatttagtctttgaagagaaaataaaaatcaacaaatagtcttttaaaattacaagtgtagaacattttaatttttcatccaatttagttaatattttcaagaatcaatttgagttatgtactaataattttttagggactaaattattacatatttactttttgagagactaattatgtgtaaaaaatgaaagaaattaaaaatgattgaaggttacaaactcatactatctagtgttgataccaattttagtatcagtacgacctatattttatgaatacacatatatatatccaaagtcaaattcattatcttaactcaaatttattgtttaatatattaaataataagtgcctgtgatgatatgaatttgggtgagtttccacatccattcctataatattttggtaataaatactctcacactcaaactaatttcttaatggataattccttttcatcatagatagtttcttcacaaggattcgaatctaatttggctaattgtcatccctaaacaagctgagtattcatctgttatagattttatcaaagttataggtaaagaaaattgtacgagataattaattaattttgtataactatatgtcaaaatgccgtccaaa

SEQ ID NO: 3767 - DNA, 1189 bp, Glycine max
  Soy_ogl_478 Gm02:10510712..10511900 Cluster 15
ggaaaatacttattttgggatagaggaaatactatctattacagtattatttaatatgcagaatattttatttttttacttcatttcatcgaagtaattggagagtagaatagtgacggtgctaaaactagagattctcttttttttcccggtgattcttgcattataacattaactgttcttaaaaaaaggacattaattgtactatttttgcactttgttattttggtccaccgaagaaatctccttgaagtagaaccacaacatttatttatgcatagttgcgggaacatatatggacccttcggtgctgttgtgggcagatcgagttaattcgacagttcttctatttttctttttaatgaatagtacattcaaagactgaaatagtaattgttgtatttaatgaatagtaccatatccttcgaaatagttataaccgtactaaatatttgatgggtatttaattaattagatgtttttatttatattttttttcaatttttatataattaaataaatggaaatatgagatacataaatagatattttaaaacagttttttctttaaacttaatttttgtttttatgttaaacttaaatgcatttttttgtctctacatatactaatttacattaatgtaaattaagttcaagagcaagttaagcttagtatatgtgatacgctttatcccatatgcaattattcttattaaaagggacaagaaaatatatttgaaatatatttttttatcaaaaaactttattaacataacacactggttggagaaaaggcatcgcattcttttgttttccaaatatagcataaaaaatagaaattaaataaacatcttgacactccaaatgtcattcaaatctataactaaaatattacgagtttgaaattaaatataagtccgaagaacaactataaagtccaacccctatgttgcaatctattagagaactacttcatacaatattacataacacaaacaactataaatgaggcctaagcctctcctcttgaatcatcaacaacatccaaagggaacctccgctgcaagtgacaattaatccaaacagaagcaacacaatgagaaagggagtgagatatatccaaactcatgtatacgatacaaaaatgaagcacaattaattagagacatgcattcacaaataaagcatt

SEQ ID NO: 3768 - DNA, 1503 bp, Glycine max
  Soy_ogl_5719 Gm17:33803447..33804949 Cluster 15
ctgatcctcactttctatgtttggccaaattcattggatgatgaacttccatctcttatgagtacaaaaacatcagtattgtaagctaattaagtaacatatattgggtgaagttctcttctctcaaattgcaatagcaaaatgaaaaaaaataatgttaagccaaaagaaaaagaaacatttgaacaaataaaaaaataaagaatatggaagaaaacacctgctaatttaatagtgatcaattaaagcttctaatctccctacatgtatgccaagaaagtatgcaaaaagaaaagtacgttatttttatcaaataaaagtcaatagaaaaatacaattaaataatagatactaatatgcagaagaatattatgaaaatggtgtcatatagatactaatactcaagaatggattagaaaaaaaaagaaaagaaactatgaagagagggtaattaaagtcatacctttgaaactcttacatgaaaaattatcattcgagtccacttttacatgtttcataactatagtaattatttgatgcatatcttcataaaaaaatttagtttgatcatccttcatctcttatatgtacaaaatgatcattattagttaagtaagatttttttagagtgagattctcattatctcaaattacaacagcaaaatatataagagagtaagaaaatttaaatcaagataaaaaaaaaaagtgatccctaaacctcttggaagaatataaaatatataagagaggataagaatatacttacatcgtgcttttaattatgataataataacgaggacagtttaagttttaaaaaagttacaaaatttaaataaattttaaagtgtatgactaaaaagtaaattttgtataactattgtgaataaatgagtaatttttctataattttgtcaatatgtattaataacttttttaatatcgtcaaataccaatttagtatttaggtccactaaatattaattattcatgcactcctaaataatgtttaatttctagtggtcctattgaaactaaattaccacgttttttccgaaaccaaaatgaaaagtttctaaccacgtgttttattctaacattgactttagttgtataactttctaacaaaatgtgcagtttgatttgtatgagaatgaaccaagaaataattaaattttaattatacagtgtttatcatataattatttttttataaaacataatataaagtacaaaaatgtttatatatataatttaaatctttataaaatataattgtgctcattatgcttgtttttgtttaaatccaatcaacggtcaccgtaaagtttaagtcctcatcaacaactatgctcttaatttttatgcttaattattaattgaattaaatattttaattattttaaatttgactatatatttacaaaatcattatttttaaatttagttaatatttttcgtgatatatatttgaataactaaattaaaaataaagcatttta

SEQ ID NO: 3769 - DNA, 1000 bp, Glycine max
  Soy_ogl_2003 Gm06:17200801..17201800 Cluster 15
tctcatcttatgttaaaatatacaattcattttgctgacagatttaagtatatgacacttcagtacttcactacatttttcaattttttgttcaattagttctattagtttttattttaaaaaattattactttttgataaaaaaaaagtattattaaaatatcttttatattaccgtcacttaagagatgtgagtattatgtactcccatcatgtgtttgtttttttttttttttttaaaaagatcttgtgttcagatatatgctttacttaaaaaaatattaaaactaattttatgactaaaatatctttcgcactctcctgtatttctagatttaaatattgcattcttctcttttcttattttaagatatgcattttaatgaccattttttaatttaatttattttaaggaccactttgacaattcattacgattataaggactaaactgattgataatttaaaattttacgaactattctgctattttattaactttaggactaatatgaccaaccatttcaattttagagaataaattaaaaattcactctttaaataatatataaagatgtctaattagaattttcactttttactgagaaggtgtgtaccgactgaagtgtagttgtttcaatttagaggtttcaaattttaatcctaaataagcaattgtattaaatatctagaaaaagaattcacttgttcataatgatatttctatccgagttaaataaaattacctcaaatgaaaaaggatacttcgagtataaaccaaaaaataattctcatttttcgtaattaaaattattcctttataatatgttactttttttttatttagttaatatgttacttatctatctctatgttgaagttaatgtgataaagaattagattaaggatatctttcctctttcaatgcaagattcattttggtcggtgtctaaaaagaagatcaaaagaagaatcacaggtgcgcagcatacattgctca

SEQ ID NO: 3770 - DNA, 1553 bp, Glycine max
  Soy_ogl_2751 Gm08:17822181..17823733 Cluster 15
tatgttagtgacatatttttttatggcattccttctaacatattttatttaattttaaaatttattaaaaacaacaaaacagttatctttaaatgattaaaataatggtttcatttacttaaaagttctagtacaaagtaaattattacacacgtaaaattataagttatctttgtttcagttttatctcaaacacatcaaataagaatactaaagatccatatataactttataagttgatctatcgaatttagagtgaaaaataattgaagaataaaaggatgtatatacagccaatctttaatcatatatcattcatttcagcaaaataaataatcatatatgattaaaaaattgtttaaaagaatattaataatcctataattctttaaacaaaagttatatagcaatatatttaaattgtcactattgatacatataatgtgaatatgtacccaaaaaaacttataatgtcaaaatttttactatatttttgtgtgcttcaacagtttggcctcaccatctttaacaaaactacaattcaacattcgcacagataacaaatttcattttcatgaatcataatccaataaacaacttgggcagagcaagtcccagtaacggatcacctaatttggtgaaaatgggttttatacttatatttttgcctaaattagtttcaaagtaggttgaagaataggaattataacattaattaaaaagatttgagataagatatgccgaaaaaacgaacaaaataaggtgcatcaaaaatatcaagagacagaaatagcttgagggaaaagtaaggtaatgcaaagcatgggtagtggaagaagtgaccggtagagttgaccgtttgtttcttcactattcctattcctataatcttaatcccattcccaagtactaaaatttaattagctatttatagatgaaattcattgttaataaattcataaagtgtgcttgtaaaaaaaattaataaagtgaggaacgaatataatcattgcataaatagtttgtctttaatttttgtttcactgaaattaaattatataactctaattttatgttttatgatattatgtcaataattatgcacattcaaatttagatgaatttagcatttgtgtgtttgtattcttatagtctatatgcttatttttaaaaatatcccatgcattaataaaattatgcacattagacattaataaaaatatcttatgcacattcaaatttagatgaatttaataaaacttttcaacgtgatgcttaaactaataaaattcaatatctatacattagacattaattaaaaaaattaaatattacaacaattatagagaaggaattcatttgttgtagccttgtaggagtatgttataaccttgttatagacatcaaatttcattaacaaatcatttgttaaaatgttttaattcagtagatcaaatctaaaagaaatttcatgctttaaatttatttgataccccagtaattattttgttttaatgtataatatatttgtaaaatataaataaatattggg

SEQ ID NO: 3771 - DNA, 1100 bp, Glycine max
  Soy_ogl_3137 Gm09:36683301..36684400 Cluster 15
cgttgaaaaatgcaaaaaatatcagaggaattaaaaaaatgacatttctatgataaaaataataaaaaaattgtcaaacacaaattttcaagtgattaaaactaaaataagtattggtaaaaaaactaaaataagtagcatactttatatcatgcttgcaatcatgtatgttaagcattactctctccagttttaaatataaaatgaaaaaagaagtctcaatagttataaatataaggaaatctcaactaattttactccaaataatatcattttcaaaatattcttcattaaatatgattttaaattataataattccttattttttatatcaaattattcaataaaggtagtttaggaaaataatttatttttaattaaaatttttgcaactaaatattattaactaatttttttaattagtataaattaattctttttcttctgatattcaaaactggagagatatatatgcacctatattaatgcaagttacatcaatgaccacatttgccatatgtttataagcttaattggttgtgttctttccaacccatccaccaatgaagtgggttgggcaaatttaactctaactagaagcctaaaactcacattgacacctctaaactaaccagccttaagcttccacctctaaatgagctcatttgtacttataaaatcacctttatcatcttcaacaaatttctatttttagtccaataaattttctctaattttctttttctcatgggctcaaccatgtctcttaacataatagtatcagagcctaggcatcctttgtgaagattttctttttttgttgccatttggaaagttagtatatatcttatctctatttttattaattttattccaattcttttttttacttaattagatatccctcggtcaatatcgctcacttcgtggtgatgttgcggtaattgcactattagtaatagaattatatctactttgttattgctatttcacccatcaccatatgagaatctaaactgatttataatcaccatactgttgcaatggcttaattagttattgatgtggtattgtgtgagtgaccacagttggagcgttt

SEQ ID NO: 3772 - DNA, 1344 bp, Glycine max
  Soy_ogl_3150 Gm09:37218101..37219444 Cluster 15
ttattggacaagtgctctattatttcagcaaaactaaaattgtaaagaaaattactactccattgataaattaccaagaaatgaggtgaacacgaggatgagaatacgattactacaaaaaaaaaaaaaaactattaaaaaggtgtggccatcctcttctagtaaagtacgtagtaaatcgctaaattataatcctctatagcaactttcatctaatcctccacttgcccacttgagataaatttttgtatcatttgttatgatacatgacacataatcaagtttgattaattttatttttgtaaattaaaaaaactcaactacataaaaaaataattgggaccataaacatgtgatcttaaatcacataatatttttttctaataaaattgaattcagcaataatccccttgctcccaattaagaatggaagagtaatcaaatctctagtcaaattcaaattgagagaaagacacattttgatatgcgactttcatcacaaatgaatgaaaagttaagttatatttttagagaaatctacaaaatattatattttacctttttatatagttttacatttttctacttatatcctttatagttgtttttatatcgctaagaggtcagtttaaagcaaaaaagtaaccaaattaagtcaaaatcgtggatagcaagcctaaaattattgttaattgaaacaaaagtaagagataagggggttaattgattaaataacaaagtgtagaaaatttagtaataaaaggcataaaaataaagttgagaaagtgtagatgtagatgataattaagtttgtagttctctcacacgaaacacatcacatgtatggactgcatagttaaatcctagcctagtgttagagtttgaaaatgactttgccttgttcacctctttctagtctcatgtctatgctgatctctttaaagtccctttcgctttatttgttcacataaagtaactctttttgatgtattcatttttggactttgctccctttacaaaaaagtatagtttacccttttatctattattttaacaataaatattaaatgaagaatctctatatacaattaatgcatttttttccattattttacaaagacggcttactttatgtttacaatttttgtaaatgttcagctactttgataaattagttgacatattacaccaaaaccgtaaagaaacccctgaaatttccttattcattattggttcaggtgaggtctacattttttggattgtttatgttcattgagcatgacctctatcacacttaccctgtggttttttctatctgcagctatctatcgatcatctttactt

SEQ ID NO: 3773 - DNA, 1332 bp, Glycine max
  Soy_ogl_3374 Gm10:5320901..5322232 Cluster 15
agaactatacatttttagacaaccacattaaaattcagttagaaaagttttgtcttccttaataaaattgaccctattcaactcaaacaaattgggcaaacttaagcagatatgtttacattggtgaaaaggaatggaatagagaaagacaacatatcatggggatgttatgctcccatatcctattatatttgtttaccttggtttttctttctcctccttttcatataaaatgaaattaattttaatttaaacatttcatcataacatgactaaaaataactaaaaatggaagttttattccattaattttcttttcactctagtattttattttattcactccatcataacatgactaaaacatttcattcatttgttcttatcgatatagcctaatacttacaaaattaaaaaaattcaaaggataaggtgagtttaaaaataaacatcaaaagccaccccgtttgaatggccagcctctgactcactcgcctcaaacagactggtaaaaatttacgacaaaaacaactctaattttatatttcgttacggctttgacaattagttgtttctgtaattgtatttttaagaataaaaacaaagttccctaaaaaaaaagttaaggttcaacattcgagtctctaaattaaaatttgcacttcgatctccgatttacacataaagagaactcaagttgcagtttattttcctggctaagctttagaaatcactgattcagttgaacatcagaaccgatgttataaaatttggataatatacacaacacaaggccttaagctttaatttttttgtctatcattgtaaaaaacaatgaactagttaaaaaattatttaatatcaggtttttacgtttctttaccgcctaaatggcaatcaacttagtaataatatgtttggttttaaaaaataaagtgaaaggaaaaatgaataaaaaatgtaatgattttttaaagttgtttgatagaaaaaaaaagagaaaaaataacaatatacatataaaataacacaaacaccctcaaataaaaaatgaaatttacaattaaattgtaagtataaacatatatttagaagtagttaatattattatttttattgtggaagtgtgtgcatgtttatgtatataatcccagtgtttacatgcatatatattttttgtaaaattaaaaaaaaaatacattatactaacatacatatacttttttgtaaaatttggtaataattacacataggatctagttgagctgtctttgagtattataaattttttgttattgtgtttaatttttatgaataaaaaaatataaaaaa

SEQ ID NO: 3774 - DNA, 1331 bp, Glycine max
  Soy_ogl_4042 Gm12:15155913..15157243 Cluster 15
catattcttgtttagaaggtttaaaataattctttatcttttcaaatattttttttatcttatcttatttaaaaggtttaagaagatctttcaatatctaaatatgtttaattttttccttcaaataaattatattttatctcttaaaaaaatataaataatcaaattgaacaaaagaaaaataaatgaccaaaattatcagttatacttttattgatggagctttgaattcaataaattttaataaaattgtgaaattaatgcacaattgacctaatatataaatttatggaaagtttgaaattgatccatggccattctatatttgtaatagtaaatattttaaaattttaatttcaatcatttaccatctttatatctttatttaactttttaaaaaatgatgacaatttctagttttgctaaaaaaaattagaatcaaatagttatacaaaagatactttacaagtttaatttaaaatgttaaattgaataatcctttatttttaattcgttggttcaaaaactttaaattaaaaaaaatggcaattgaaacggtaaaaattttaaactttgaaaactttaaacattggaaacattaattcaaatttaatttaaaattaaaaaactttataattctttattcttatcaaaaattaatttttccttaattgtaattagtgaaaattaatcgaaagtttgattcatgatcaattatatatttacaaaaataaatattttaaaatttgaatttaaattatttagaatctttattttttgaatcaaattattgcggttcagagttaacatttaatcatggatgctcaactaatagttaactgacaaaaggataataatcgttgattttgaaaaaataaaatacctaaatatcttaattttaaaatagggaaactgaaatcgtagattaaacattatatacagaaggagctatcataatgcattataaaaatatataattttaaccttaaagttattataaaataatcttataacaaaatgaaaaacctatcataatgcattataatagacatatttttttagaattataaaagatataattgagtatatatacttagtaaacttcacatagtaatcgtttaataaatttaattaattttaatcagaatcatttcaatttttatatttttatgtcattttgcatcgtcaaaattcactttaatttttaaaattttttaaggttttaaaatagataattgcatcatgataaaatagtcatttgattcatgaaaagttttattaaatcaatttaagtataaatgaattttcgtaatattggttccgattttaat

SEQ ID NO: 3775 - DNA, 1200 bp, Glycine max
  Soy_ogl_5176 Gm15:49456101..49457300 Cluster 15
ataaaatttgaggatttagtgagacgtgattagatttgaagaggagacaagattaggatttttatttatattttagctgaaatttggtattttagttagtgaatttttaaagaaggtttaaaatgatttaatcaatgtaacttgccaaaatttgaatacaaaataagaattttgagacttttaaatagaagaaaatgattaatttacaatagacttttttttagggagaggggatggtggtaccccggtaaaaggcaacaaaaatcttcgagctaaaaaagtaattataacctatttatatttgtctcactttaaagagacaagtggatgttcaattaaaaaaataagagattaagttaactcaaaaaatattaagagaacaaaatcatacattaattaagtataatagaaggactaaaagtgtaattaaaaaaataacaaaattaaccatttaactttaaaatcatactaattgacattttgatctttcatggtgaaaaataataattaaatgaatagtgtcaaaataagcaataaagttttattttgaaatcatacaatgttaattaacttcagcatacaaattgatgaaagagaaaacaaatttgaattagtgtaagattttataagcatgatgcacatcattcctatttttctatccaacttgcgtgcgtatagataatttagtttgacacattaatttaatcattcaaagctaggaccaactacaacagttgttttcacaaatcacgtcaaactaattagaccactaactataaactagctaattatgttttagtgatttattatgggccgctaacagctaataactaaactacaaaaattatcatcaaacacttagatcaagtgacataaagttattttaagttcactaatgtttttgaattgaagctttagatatctaattattaaatacttagaataaagattttattattcgtaataattttatttgactggacgtaattatctctagtaaaaaattatatttgaactcataagtgattgaaatgtgtacgcatggtttacaattcttttatagaacggatgcgtttaagataatcataacaaatgttcatcgagtacatggaaaaggaaaaaagaaaagaaaagaaaaaatggcggttataaggaaaaccaattttaatgatatgatttggtaaaatattccaatatctt

SEQ ID NO: 3776 - DNA, 1379 bp, Glycine max
  Soy_ogl_5726 Gm17:35315420..35316798 Cluster 15
atagtattatttgtgatgatcagcaaagagtatataaatatttataaataatcattaaaaaatacttttaatatttttttactagaaattctatttcctgtatttaatttttattttaattagttttattatcagtgaaattttcttaaatattttcaagtttatatttcatgtatatttatcaatatttcatacaaaataagaatacaagctagataattttttccgtcgagacagctagagagtttgatagtttataataaaagaaaggtaatttaatagctgtattgaaataaaccaacctaataataccaaaataattattttaatcgactcctttatgcataaaaaaaatcacctcaagccatcgtcaatttaagtaaagtgggatatttatttaacacgtttttcttatttaaaaattgaaacctaaaatcttgcttagaatattattagactccctatccatggaataaaatatcaaatatttagaatattttatgctagatttgacgtcgttaagtgtaaaagtatacttcaaaaaataaggtataaaataatgattattgactaaaaatttaatacttttatgatttttttgaaaaatatttcattaaatttttaagttttacataaaatgaacatgttttgctttgggtctctatacttttatttttatttttttacctctttaaaattattaatttttatttctatgaataagtaaatttgattttgattcctgtaaaatatttgttttttatttattttaatctctttaaaatctaactttttttttactttttattcctaaaattcattttaagataaataaataacatatattctaggatctaaattttgtttttgaacatattgatattctatcacaaacaccggtggtaacaggtgttatttggggacttttttacccagaaaatataaaataaaaaatatttatttaaataatataattcaaaaaatatttatttcaatgagacactttactgtttacattgacaaatcgatttttcaagaatcgatttcttaatgtgaataattttttttgttttaatttaaaaattaattcgagaactaatttcaaaattaagattttatttttttatacacacattattatgaaattggtttttgggaatcaagttgataatctgtgtgtgtttttgttcaaatccacatcatgaaatcagttactaaaagaacactttgtattattttttttatttcttctaattttatttttgtattattgaatttttttaaaaaaagtgagaatactttgtagtttgaaaatctacttttttaaaggaaagacatgaatgaaatatttaatatgatacaatgagatgataaataat

SEQ ID NO: 3777 - DNA, 1000 bp, Glycine max
  Soy_ogl_6131 Gm18:51917701..51918700 Cluster 15
tcaaagagttttttttttatatttactctctttaataacttttaatttgaaatttgcaaactccaacaattgaatcatgtgataataatccttttggtgatcatgcatatacaattgtagataatttaaatattcatgggtatgtaattcttatagtcaacatttatctacattttaaaaagtatattgcacgttaaaataaagttttttttataaggtaacaaataattttaaattatatgaatatttgtatacttaatctacttaatgtgaactatgaaatcaactgttcgattaaccaaattcaacgccaataaataaattattacgtgaagtaagttaagcatgacttattatttcctagtggacaatgatctaccccgtccccccaccctgtctttatgtatttatggatacgtatatgtagagggattaaattatttaagagtaattttttgtaaagttattctcttcaatcccttttatatattaaattctattaatctaacagttaaattaaaatatcttactaactaaataaagtctacaaatctttataaaattttaaattatttaataatttattaaataagttcgattgattataacactaaataaaatcacaggcacgcacacaaagctgggggagagtaagagagcttcaaaatcaataatattaagacaatgagagttgtaatatgttatgacttatatatgtggggaaatatttaacagtaaaatatatattaacaacttaattaattaatgactaagaatttaaatagacaataaattgaatacttcaataatattttacaaattactataatgtttcacttagaagacccaaattttatttatttcttacatgcttgcttcctttgttttttcttttataaaatattatacaaattaaaataaattatgaatcaaatcaaatcttgttcattgattaagaacaaatataaactaatgtaaattaactacaaagcaaggaaca

SEQ ID NO: 3778 - DNA, 1100 bp, Glycine max
  Soy_ogl_6383 Gm19:31472301..31473400 Cluster 15
aagaacgaaaccctacaatcgcatgttagagagaagctcttgttcttctgaaacgaacggtttttccttcgtaaccaagcaagccagtgtgacgaactcatgattagtattttgaagcctcacccagtcaccttttgtgtgaaacgatgtcgtttcaataagttgccacgtaatccgttaacagaggagacgaccaagtgacaaaatgggtcaatctaatccgttttaaataaatgaacgatcaaagtaaatattttaaaaaataaatgattaatttaaacaaaaaataagattaggaactaaataacttatttgacctttttatttgtttaatccattcttacattattcgatccagtgaaattaagaatacatatttcttcatctttcacatacctaagcaaagtgataataatataacaaataatatgatacgataaaaaataataaattttttaaagtaatgcagtattaacttactattactctggaattaatgactaattgactatcatgtttataatcagtaaaatacaaagaataaataataaataacatatactatgataatgtaaaaatatattacattattatttaataacaagttgttagatggtaagtttattagattttataataattattttaaaaattatttttatctttatttcaaattggttaactgggtaaaaatttaatatataaaaattaatgtgaagattccaatcctttgaatataaaaacagaacggcaattgaatcatacctgatacctgttaattattactattattattattgacgttgaaagaaaaataattaaaatccagaaaataaattatctaaattttaaaataaaatatcaataccatctacattctatattattaaatatttatgatcttctttttcatccgattcatctcgctataatgatttccacatatctccactatgattgccataaaagtcaatatatacattaaaatatcaaagaacgtacacatgaatccatttcagttgtcctacctcgcattcagtgtggtaatgtagtatctttcttttctatctttttgttcatttcatttaaaaattgtattg

SEQ ID NO: 3779 - DNA, 1127 bp, Glycine max
  Soy_ogl_453 Gm02:9238901..9240027 Cluster 15
attatagctcatgacaaatagaaatcgtaggtgcttaggacaagtgtttaagaaaacaattaactacagggtttttttaaaaaaaattaaaaagagcttattttcctttgaccagggatttatttatttatttttacagcaaccaagggatttaattaaagacagaagattagttattttttttatttgcacattgtgccacttacaaaaacattaaaagggatagttcaaattaaattcattattagaaatactaattgaattactgccgtaagcatatcttccagtaatcatttgaggaaattaaaggtacttaccattatttaaattataagcagtaaaaaatttgtttaaattataaaaaaaaaacataacgttattggtcatgcatgaatgattcaatttaatttgtaattagtgtataatattttctatacaagttaatactattattaaatatattaatctttccaaaaaaagtattatatatatgaatctttccagaaaagaatatggcatgtactgaatgtaaaaatattacatttaaaaataatacatacccgaatttctttaaataaaattattttttaacaaagttttagacaaaaaaaaaatctctttaattgctttgtatatgaaattcgtttattcaaatgtagtatcacaaaatcaaataaattgcaccaaactaccttgacaaaacttcacatggaggagttaaactctattactgtaccattgggacaactcctttctaattaatgccttatgtaaaatgcatcaataattgaagcaggagtacttatgacattttattttttcattattaaacaaaatttaggtgaggttcaataaattgtattgcatttctaacataagtaaaacttatctataatttatttatcaaaatatcttaaaaatagtacattaaaactatattactaatttgaacgaatgttggttcagttgctaagataaaagatcatattctacaaaagacatgttcgaatctcactctcgatagtaggtataaagattttattgatgaataatttgtgtatatttctactagcattttgtgaactataagatttgattttaatgctctttcttatccaactcatcca

SEQ ID NO: 3780 - DNA, 1100 bp, Glycine max
  Soy_ogl_477 Gm02:10492801..10493900 Cluster 15
gcatttcgaagcactcaagaggaaattcgaattcaaattgaaagaagtagttgcagcgatttttgtagaagacgcaccaaaactagcaacgctattagaaataggaagttgaaaaatattatatacatgtcaaaatcatataatagattgaaaatctataaataaggtcttcaataatcatttttctttggattgaattactataaattaaatcctcatacactatttctccacacacaggtatgactattgatttgaaggtcatatagtgtatatatttattttacttttagtaaaatttattttcatttgatttattttttatgcacttccttttcattctttaactttttctaatctcaatctcttcttaaaactttactttttcaatctagtttcttatcataatttaaaacagtactttaaactaccataatgaaaattgttattgaaattatgattattatttttgttaatatataaacaattaattcttttgagttgaaaactataattacttgtttaataaaaaataaattacaacgaaaatatgaatcctgtcttatgataaaaaaatcttatttattaataaaatctagcgtgaaaatataattatttagattggaatttatcaaaaacatttttttataattttcacggttaacagtatgatagtgtagtgatttttcatttcattccatacaaaataaattatattttcttgcctaatgagcatttcttatgctattatttagcttattgataaaaaaatgggttatcctaacaaaagcataacaataaattgagtgaaataacaacgtaaaatactgatatcttattcttaagtgttatatatatatatataatgccaaaactatttttaactgaaaagtattatcttattaataaaactactttggtggcaaataatagttcgtagcaacaactttagtggcatgcactaactccctattatagtgactaggacatttcatatagatttggaccgcgtcttctgtactcatctgcatgcatgatgattataatttgttataacatttttcgtgttggttgtttataagccgtacactgcttaaatt

SEQ ID NO: 3781 - DNA, 1104 bp, Glycine max
  Soy_ogl_823 Gm03:3318197..3319300 Cluster 15
caagcatttgtctcatctacaactacttgttttatttttaatttttaccatttctttttttttcttttcaaaatatcaaaattttaaaagaaaataaccttatatattattaaccagggatgagaccagaaaaaatattaagggggacgaagaattaatttactacgattaaaatttatttatataccaaatttcaaatattgtaaatccttagttaacaaataaacagtaaattaaattattcttaaaacaaattaaaaacaattcaaaatagaatagttatttaagagcgtctataattcatagttctttatggatttttttaatagatcttactctccactttactgttaagaatttttattattttttctccgtgataaacattaaacgaattgtttaaatgaactttaaatatatatgatttatcgattaaaattgattaaacaaagttgtttatataaataacatcaagttattggtttcaatatggtagattttgttaaataatgttatttaaacttaagtaactcttatatgcaacaacgttaaacaggatctataacaatatttataacgagaaaagacaattaaaaagcaaacaaataatctaaattcttcgtatatttttgctacatagaaatccagattttagaatttaagtgtatatatattgaaagcaattaaaacttaaaaacaatccaattaaaaaaagaaagttattacagacttacagtgttgcctagtaacatgtatttgtaaaatatattaaaaacaaaattacatcctaacatgaaaaaaaaatgaaaacatcccctaaaggaagatagcttccaacaacacacgcctaataaaactaattatttatgttatttatgtattaaggtctgatttgacacaaaatatataaaaaaatagtaactttggtaacgttaatgtatatatcagtaaagagctatgttttgtatcagtaaagagaatctactaggagagtaaaaataagacaaaggattaatgtacatgttaagaacattttaatttgtgttttagggagggcgacttcccccctttctatgaacccagttccgtctctgttcttaactt

SEQ ID NO: 3782 - DNA, 1100 bp, Glycine max
  Soy_ogl_6070 Gm18:19106401..19107500 Cluster 15
tattcatcggcctagtatcaataaataaaaagttgattaaaaaacaattgtaaatcaattaatgagtttaataggtaagtattttaggtgtgattttttaaggctatttaataaaaaaaatattattagaataatttttaaaatagttattatataatttaataaatttatcatatgatacaataatttgtgattaggtgataatacaaacaatctttacatcaccagtgcatatgttatttattcttaattgctaattgaaatattattaaaaaatatattttgatgttaattaaaaaaatatttataaaacattacaaacataaatatagaacattaaaaacattacaataaattttactacaacaaattataaactttgaagttcaatgtagcggtagtgcatctctcaagtaatcgaatggatattactagattttaataaattatactctctccgcccaaaataataattattcaaagttgttttacacatactaagcaaataaatagatgaaaaaaatagtaattttataaaattaattttatatcaatattaatttatttataaattttgttgtccattattaatattataaaagatacaagtaaaaaaaagtaattaatgttacattaaaaaattaaaatgacaattattttgaaatatttttttcttactcgacaataatgggacggagattaatttctatggtctttattataagtaacaaaaatcactatttttttggcttaaatataaacaaaagttttttttgtcttatttaatgagactatttttaaaattttctttatttaataggatgaaaagaattttttatatgcttaatatcaagttctaatgaatgatagtttaaaaaaaattatttttttggattaatataatttaatgaaattaattaatttattaataagtgtgaaatcatttttttttttgcttataacagggatcatagggagtatatgtgtgttattggttctcaaaaattacaacttaatattaaatttgtaattaaaaatcataatttaatgaaaaaataacttaacactcaatacttaacggcaaataattttttatgtat

SEQ ID NO: 3783 - DNA, 1000 bp, Glycine max
  Soy_ogl_6320 Gm19:1611701..1612700 Cluster 15
taattgaaacgtgatcgaagacaaatgcatctcacactccaaaaataaatactagtcaaagatgtattagtgcttggataacactaatattgatgatgttattctttgtgatctttaacatagttgaagtcgtagaaatacaaagaagacattgtcctaataaaaaagaagcaacaaccaataatagaagaaagattgtaaaatgtaataaacaataattctctgtaaaagttgttgcagaaacaatctttgttcgtagctcagcttcactcctatcttatctaaggattttaaaaatagaggtatgagcacatgtaaagttcacaatatgacccatattaaatcatcttgattaggtccgaaatttcatgttgacaactaatgcctcgacagtgatggatgattattaaacaaataattaagattactcagttgtcactatcgaattaaataaaagactagaatactataaaatacttgaagtaaaataaaaataaaaaggaaaattttggtttttcattcctcgtttagtatggattgactaactttatcgtaactgtatatatgctaacttgctaaccatatatgtttattacacattgctatcggaccattggaatgtgatgttactaaaacaactccaacacctacgtaagatttgggatcagtaaagttttgtctgtcgttgacagatttagtaattaattaggaaaacttttcatgttggacgacggtttcttaaaaaagttttatttgtctattatttagagaaaattaactttccttaaaaaagagaaaattaactttacaaataaaaaagttatgaggcaataagggtgtatacttgcatccttttaattacaatatgtctgaatttttttataacaactaattagatttttttaaaaaagtaacatgcttcttaaaaaacattttaattcttttcttaaaagtgaaaatgagtatatatatacacacacacttatgaaacggctttgtg

SEQ ID NO: 3784 - DNA, 1000 bp, Glycine max
  Soy_ogl_5084 Gm15:24040601..24041600 Cluster 15
attcttaaaatattgttgtcaatgttacttgtgatttctgaatttctttttcaaagtctcgtttgggcactcatgtttatttatctaccatttataatattaaattatagactgaatatgaattattattacgaaaaaattgttcttgtgagtttttttaaatcctataagtttgtaattttctaattttaatagcttttttattcattttttttagatttgtattttttttcaattttattctcttaactagtggaaacaatgcatgtccctatttttattatgctaatacatttttatcgtgttaaatcttgttaattgtaaatttgtgttatatattgatttgcatattaattttagtttaatatttttattctgaatacatctctaaaatttttaaatacaaataaattaaaagagaaaatattttgaggttaaataaagttaactaataaaaaaataaggttgagagaaaaaaaagaaattgacaatgtaaaaataatgggataattatcgtagtttaaaagagaataatagaagttaaattgatttgaagataaaattgtttgatgggttaagcatgtcaaatatgcttaattgtttaagaagagttgtttttttttatatttattctcctttttttattcacattataaccatcatatttttttgctataaatttagtagatatgttctcaaatatttattgattattgaatattgtgttaatttttattttaattgcataagatacatggtatttttctttgacacacgtttgttaagggaaaagctaacagaagcaaaaaccatgatgttaatcggtgtttgggtaactaaaatctacatgtttacatataaaacatgtttacatataaaaagggggaagtataaaaagttattgtagaacaatttttttcgtggttaaaaaatccagtctttaactacacgggaaggcaaatagcctcgcacattaacgtactacacttttgcatattct

SEQ ID NO: 3785 - DNA, 1011 bp, Glycine max
  Soy_ogl_6656 Gm20:563301..564311 Cluster 15
aaatttgattgattgtatgatataattagcttaaattttatgaggatatatataagttttttaatatataattttgttcggagtagtcacttaactgatgatagtgtaaaataaaagtatatatacaaatttatagtaagatctatttttttgggggtatccatggtcaccccattgactaattaaggaggaacctcccctgatcagtgaccatcatcgatcataacatcgttgtcgtagttgacttgcactaatatgttaattatgaatcgattttatttgaaaatgaacagaggtagtaaatacaatcttgttggatattacttagttatgaagtttagacttttttttatgggcgttttggaagttctgtatttgaaaatttgttgaaaatactttttcattatgttacatggaagattgagaacgattgatctcaataacagcatgtttataatatgttatcaatggaaaacgtttccaacgaaaatgatagttatcatcattgatcaggtatcattaatgcccgctattgttgtcattaaagagtcatttagtgactatatctatatttacgatctattcttacgataaaatattttactagggtttttcttgcatgtgtatgtatatttataggtatgtaatttcttcggtttccgttataagaaaaaaaaacatattttacatttattaaggaaatatttgtcttcattaaagtatgcgagtctcaattaaaaaatgaacattttttttaaactatcattcatttaaatttgatatcaaatataaaaaaatctttaatcttattgaatgaaaaatatttttgaaatagtctcattaaataaaacataaataattaaaatttgtttacatttgagaagaaataaaagtttttttattgtttatattcaagatcagatagaaaacatattaaggatgctattatactaattaaatatttttgttattttttcttaatcaaaatataattttatttattttaatttc

SEQ ID NO: 3786 - DNA, 1250 bp, Glycine max
  Soy_ogl_1789 Gm06:5127051..5128300 Cluster 15
caacagtgtaaaaaatatttgtacttttgctacattttaattaaattttggataaaaattattttttaagactttataaaagttaattttttgtttgatcataattataaaaagtacttttattttaaaaattgtaatacaaaataacaattaaataagcataaatttaagtttttctaattccaaattttaaaagtttaagcaaatatacaaaattatataaaaattaaaacaaaattgtttttaataaaacaaaaaataaaaatttaatgttgaagtatgcaaatataagccaaatatttgtttcgtgtagtttaactttgatatactatcaatgataaaaaaaaaatcaatatcaactaaacagtaatcacattatatatgaccttttaagtaagccaggttaattatattttttgtccttgatttttttaaaatttcacttttaatcataaacaaaatttttaccattcttgttcgtatatttatcttttattatattaggtttagtcattatttataaataatcatattaattaatgatatagcaatcatgttgatcattcaatcacttatcaactcatcaattagtatgacaaaaacaatcacataaaaaaattgtcaaaattttcttctattcgaaccaagtgactatataaaaaaatttaattacaataaatgtttgaacatactatccccggtaggatattgatcttattgaagttgaataagattattaaaaataataaaattttcattttttacacattaaaaaacaagatcatatttttcgtttttttttttcacaaacaaatttatagtttagtcatccaaatacatattaagataatagaatgatcatttatttgtgtaagagagggagagagttggagtaagaaagacgcgcagaaagagtgtgtgtgattgggttggatgggggaaggcactgttaatgcgcacgcgatgtagcataaaaacatgataacatgatcattaatacctttagaccatctatcacatccctcggattcagattttatttccctttttccttttccatattccgacgcctctctcccttccctcatccgtaatccatatcaatttcacgtgtgctagttaattattgtgttacaccagtttaagaaattaataaattaatgctactaataaaaattgtcttaagaaattaaaaataatgcaatatactgtaaatgaagatattactagttgtataattcctaatttac

SEQ ID NO: 3787 - DNA, 1402 bp, Glycine max
  Soy_ogl_2534 Gm08:6923833..6925234 Cluster 15
tgtacttaatacattgttgtgcaagtataaagctttacgatctccatcaaggattgatccaacgatgaataaaattttaaattttttttaaaagagaattatatgctaagtgtttttactaaaaaaaatgtgtatttttttaaacatatatgatctttttgttttataaaatctaattgtaatttttgttatgttggtgagtctaaaacttaaactatggttctttacccatctcaaccattccttcatttctttaatgcttcaataagtgattgagtgtggaatccattcacacgtgctgattcaattgaaggcatgaagccaatatttgttgaggcgaatattgtcgcattttaacttgaaacgcgagacacggcacgcagagaattaatatttatcagcatgcagttaaggttttaaataatggttgtaatttcatgactcgatgattttgtaagtgtcttaattagaatgtatcaagacaacaactgcgactgtgctctcgagttgagtcgtacgtggatccgtctttgagggcaaaacgtggatggaccaggggaggttaatttactccatatgtactatgtccaatgttttttgttgctttgaatttgagtatcactcatagtcctgctgattaataaaaacaaattatattattcaggctaaattatagtagtagttttggttctttgtatcattttttaaattcattttagtctttcatattttgtaaaatttattgtggtctttttcttttaaatttggatcaaatttatccttctgaagcagtaatggttttcaattaatttgggttaagattttgattatttttttttactgatttaagacctatataaaaactataaaactctcaattgatgttccaacagattaaaaagggctgtaaactatgagactattttagaaggacctatttgtatttgattcaaatttataagataaaggattaaaataattgtttttcaaaaataaagaaaaaaatattttaaaaataagataaaggactcaaagtataatttagtctattatttataaaatatttaccaataagctcgtggatcaattaatgttaaattgttctatacactttaattataagtcttgaattaagtctcagataataagtatttaactatgttaaactaaaagagagagttgataataattataagaattatgaaaaaaaaaatcatgtacgtgcaagtaatagctagttctgcaactagaatcgactctggccaaatgaacaataattagtatcaaatacattcttatataataaaataatttaattatagaaaataaagaactagctagagagaaaatgttcaagatcgagtgttgtattaaaaatgaattatatgtctgcttgtgataa

SEQ ID NO: 3788 - DNA, 1100 bp, Glycine max
  Soy_ogl_1870 Gm06:8831901..8833000 Cluster 15
gttacaagattttatagatatgaaaccatgcatctttagcttctaatggatgggaagaaggaaagtaagaagaaggagaattttttttatttttctttaattaaattaaaaaaaaatatcatgccttcatatacacatctaagtctttatcacctcttaggctcttacacttagcctctctttggaagcaaagatatatagaagaaatgaagagataggagaagaagtgtacgaacttccgcactcatcattggtttggtgcgcatgaaatgttgtagaaaattttaaaaatcatgcaagacccacacaaaaatctttcctcactcatagaagaagcaagcgaaaataaaccgtaaaagaatattttttggccttttattggttgagaaaaaataacatgtcattttttatttatttatttttacttttcaaataattctattttaaatattgtttctctattttgtcttatttctcatcaatcaaacaacctctattttattttattttcttttttctcaattacctattttctctccctctatttcttctccctctatcaaagattagcttagtggtaatgtcaggtgctcgcagattttgcttgttagagtcatctctgttgcttgaaacgtccaccacgtttttgggggtgccaaaatcttttcaaacattagtcttaagaatttaatcaaaatatattgacagtatttaaagaattcatgcccatccaataataatttctcatttgtcatattggataaaattattgaattttataataattatctttaaaattatatttacaataatgtgtaagctttttataatataaaagtttaattttactagtgtgtcaaattaatctcttaagtttttttggtcttcagggttatgtacagttaaatcacgtaattaaaaaatataacactgaccttaggatatattttataatatattttaaaataaatctactcttaataatacataataattattaaaaaaacatacatctttgcaacaatacaaaacattgattcagattgattcatgatgcactcaaattgcttacgtgaaagtgacatattttctctacttat

SEQ ID NO: 3789 - DNA, 1110 bp, Glycine max
  Soy_ogl_3006 Gm09:5151249..5152358 Cluster 15
ggaatataaaaagatttccaataattaaccaaacatatttttttaaaatactaaaaaatattattctcatctaatattcgcaagaatatttttacaaatccaacaagattacgtcaaacaagcgttcccttagttttgtcctaatagtagctattatatttagtggcttacctttcccacttgtatataaattggttttccccttattgtaaaaaaaagaaataatataaatttcccgagagttattttctctcttcttcaaacctcttaatgattgattctatagtttcttttagatatatatttgtgttaacgtgattattaattataaaaaaattgatatgtgatagcataataataaaggttgcataattacatgagattatgttcttttatctttccacaatcacatcaattaaattgaacttatatattttccgttacaaaggagtgttccactctctatatatcaccaaaattgcatcattatagaaactcataaacaacactccaggttttactccaatcattgtgtatctactttctactattatttttgtgcatactttctacttcagcttttttttttgttgttgttaaaagtaattattttattgtatgatgatatgtgtgcttggaatcacacaaagaaaaaagaaaaagaaaaagttcaacaccctttgacagagttttggatccgtctttgataatctaagaggctacaagtgtttaggcacaaaatagcttgagagttagttccgtttcatttgttaaaatttactataataaacaagataaatatttttattttatgtttgatttgaaaaaaatcatccaacaacacaaattaatcaaacaataataatcaaaaaattatgagacaattttttatctcaagtataacgtattcaaaagacacatatattcttacctcttttcaaacattatatgttatcatgccatatattttgaatttatattatctactagcagaaattttatcatgttatttattttgaactcacattatctattagttacattaatatgatcatgtcatgtattttaaatttatattatcaattaagttgtgtcttggtgcagcggtaa

SEQ ID NO: 3790 - DNA, 1400 bp, Glycine max
  Soy_ogl_3793 Gm11:8033301..8034700 Cluster 15
agcggcgaaataaacaaaaactctgcaataatactttaacaacacattctttgacataaataaaatggaattatcaaaaccaaaaagcactgaagtatctatctaacttctgagtggattaggcagcaaaaaacagacaacaaatgacatttgatttccttagtatgacagaaccatctaaccacagtacagtgaagcaaaaaaaatcccataaataatttactttcacaaaaactactaaatagtcacagaagctgagaaaattgtcacagaaatcaacaaaaaaaaaaagacacacatatacacgctgagacatatatatagtaggtctatagttgatgagtcggatgatgttaagctaatggagcgtttggtaagaaacaatttttagttttttgagaatctagattgagaatctttatttttcatatttggtacctattttaaaaaataagatttatgagaaataaggttttctaggaatattttttgaggggtttacatgaaaactttattgtgaggatgtgaaaatcttagcttctcaagtcaaaattttcttttactacaagggactatttgatagcctaaatttttttacatactttgaaatcatttataggaatcgtgattagtaggaaaaattatgattcttgaaaatgtgtgaaatatatttggttagttttaatatatttcttaggaaataaagattcttggttacattatcattttttttgtgtatatgagatctttttatgaatatatccttcgttaaaaaatacatcattgaataatctcctccataactttgacttttttattatttttttggctttgtattcttagaatcatattatagaaaccaatgattgagttctatagttaaaattgatatgacaatagaaaaataaacccaaataatttatatcatgtaatgtttataaggataatggtaaatataaaaattttggaaaatgagaaacacttgaaaatgtagaaatatataaaaaaaaaaatacactacaatagcagtggagaccaaaacttttgaataaataacaatcttatttgtaattataaaaaataataatgtagtcattttgcgtgattaaaattttccctccactcgggaaaccgaccccctaggaatgtttttacgagaatgttgactaaaattattttgtgaaaatcataatttcttggttttttttattaattacatccaaacgtaagaataataatttcttaatgtaaaattcatgaaaaaagtaaaaacttttcagttatcaaatatctcctaaataaaaatatcatattatttttattaaattatttaatatgtgtgataaataattaaagtaaaaaataaatatatcacataactttttttatgtcctaaaaac

SEQ ID NO: 3791 - DNA, 1300 bp, Glycine max
  Soy_ogl_4380 Gm13:31092401..31093700 Cluster 15
attggcatgaactgcataggaacaaagggaaaagtctcagtgattgttttttagcggacatattatttgtgtttttatttaatttattatttatttttagtctatggttctctccattttcttaacttttatttcaaattctggacgaaaaaaacatatacaagaaatttttatttaaaatttaaaatatttttttggaaaattgaaaattccctgtttttttaaaatcttctttttcatccacaatttttatatttattttataattcaattaaaaaattaaacattaataacttttccttttgttcaatgttctggcaaataatgaagataaatcttctaggaatatgcagtaataattcccttccacttctccttctcgtatctcacgtgactcatttattcaattgtttcttttaatagaaatattctaactagtttggtacaggtctacaaatatatacttgatcttaatcttattgaattccatatataaggataagtcatcgatttataccaagactccattatcctagctgcatgcacataattgtttctttgaaggcataattaacttgtttttatcttagaaccagaatagtttttattttatttttaagaaagaactagaagactttatatcataattattggacggaaaaaattcaacctacctttttttgcggaggttcatgctcgctactattgaactgaaactatgagctagcatgaatattgaagactctggctctctaatccagccagaaaattaatcgatgagtggatcaaagaattcaatcgtgatgagtatatgtcacttctaaagaaaaaaatatgagacaaagatgagatgccgccgtcaaaagcacaacttaattaatgaacttatagattggaatgggatgaaataataactttacgaatgtgaaacatgtttcatccctatgaattaatgttcatcatagcaattaagtcatatttgcacgacgacagttccaggttacaagttaacacgtcccctttttccctttttttttcttacttcttatagggatctgcatgaactatttctttcgatttaaaataaatatcatcttaatttattttacacatatcacaaaaagtaataaatattataatttaccatatgatattatgtgacttcaattaactaattcacactttgatttcataaacatgaaattttaccatagtgtttttgtttctcttagcctaaagatctgtaaaaagatttgaaggctttggtagagtggtaagtatttttgtttaatgataaatg

SEQ ID NO: 3792 - DNA, 1327 bp, Glycine max
  Soy_ogl_5373 Gm16:29758601..29759927 Cluster 15
attagttaaatttatttaatttttttgatttcatataaaaaagaaatacgttttttaaaaactactcctaatcatattgtttgagatggagctcaaattttaatttgaatgatacttttgaaataatagcattaaataggattgaattcattgaaatttgtctatatttgattccatcaaacttgaaccttttttaaaaatatatttaagtccaaagataagatctcaaacaacatataattgcttttgaggaacctgttggaaaaaatattaaatggaaaccgcaagactttcaattactttttaataaccatgatatgtggacatcgatagaattgtattgttctcatctaacttatggtacagcattcattttcatacctataaataatgatgatatttttcaccaataatgtttgtatttattttatgtatatctttattaccttatttattatttatttaaaatattaaattgtcaattttattgttgaagtattattcttcttctttcttatagtttctaaagaaaaaaaaatgaataaaccactattttaattcctaaaagtgtataacaatgtcattttagttcataaagttaaaaaaaaatgtgacttaagtgacaatgttaatatatgtataaatcaaaatgacagtaagcgagagatttcgatgaaacaattctggaaattttagacacatatttgtaattttcttattttgagaaactaatgtagcaatgatagtttgccaagatctcttaagtattaaaaagaataaatcactattttcatcccttaatgcactgtcacattaatcccagaaactaagaaaattctaaataaattcatgaaattgttagttgtttcatctaagtccctatacttgaccatatattttcgtccctaaacacacacacacatataattttaaaattttggacgcttttcaggaatttatttgaaattgttactttcatagaccaatgtaatagtgttatagactttcagaaattaaaacagtaatttattcttttgaaattgcatacctataaataatgatgatatttttcaagagtttcaaaactcccgtgaaaccaagtttaacatttaccaagttcccgtaaatgctatcaataatgcatttaacgggattttgaaccttgtaaaaccaattgtctttaattttcaatagcagttcacaaatttttcttacttctgcattattttgctaagaaattgatgtttattgtttatcaaacaattcacaagataaaaaattatcttacaacttaaaggtttgtcctgagttattcttcctattttgt

SEQ ID NO: 3793 - DNA, 1100 bp, Glycine max
  Soy_ogl_5963 Gm18:6405601..6406700 Cluster 15
aaattaatgattaattttaaaaaaatccatatatatacgattaaatagtaatctaatgttataaaaataattcaaattactgaatacctctaattactgacatacatggcacggaatagatttgttgataatcccacatcgccttgttactcggaccaaattaccaaattaacttttcaaagtcgacacataaaccccaaatagagaatcttgtatcatcgtgttgaaagagaaaaaatgataagttcatgttaattactggattgttttttatttgaataattaagtgtgtgtttgggagagtatttataaatttaattttataaaatctgatttaacttttagaaaaagtttaaagtagttttaaacactttaattggatacatttttaataaattttatataaaattcttaactcaacatgtaaaattttggttctactattctcgtgtttaaccacaaaataaatggcaagccaatgataactttacaaatgtgacatattgtggtttcttcttgtatgattgtgatagctatggtacattgtcgggcaaattttcgttttttaagatgaaagaaacattaaaaaagaaaatattaaataatttatatgaaagaaaaaatgcagggagtagcaggttcaaatatttgcaaaaacaagtcaagatctcaaaaagaaatacataagagataatgaattattattgacaaacactcactttctctttcatctttttctatttaattttctttttatttttcactttttccccatcatatactttatcaaatttattattttgcttttctgcaaattgcttgatagtagttagaaagaaactttgcataaaagcatcaaatagtaaatgaattctaaggtggaaaagtgactcaagtctcccatcatgggacagtaattttcttctattagatttcttcactgctagatctatggctaaaaatgatttgtttttcttttttttttccccttatttttcttctctttgcttattaatgcctcatttataacaccatcattaaatataatctttaatttatgccttttcaaattttatttgagttaattaatcacgcatact

SEQ ID NO: 3794 - DNA, 1223 bp, Glycine max
  Soy_ogl_2582 Gm08:9637401..9638623 Cluster 15
tgatgcatctaaacatttgttgaataatttaaaatcacttaagtcgtttttttattaaggttaaattgtcgtccaaaaaaactttagtaaaataaaagcataatagatagaatgatttgtaatatattcaacttaatataattaagcttaatgaaaaatattgtaagtgatgtcataactaggggtaggggtgaacacataagttggtttaggtttttaaaatacttagattcaaagccatctatgttaattggattggtttgatttgaatctttttaaaacaaaatatgcgatctaaaccaaaacaacttaactgtatttaattggtcatcaaattcactgataaaataaaataaatcataataaaatgaaaggaagttgatgatagcatcaaacgataaaaccatagatttgcatattataaaaattatagaattacaaaataaataaaaaattaaagacttgttaaaatgatgtaagcatgattgggtcatattcgatgtgcacctaatgcaattcttatcctattgtttttgaattatacctgtagctttttttttgtagttaattttttgggagttataatgttactaattaatgtgaactattaataattttattaataattattttttgttaaaaaatttaattgaccaattttaataatttttctcttctaataatgtttttttatttgtaagatttcaagtcaatatcttaataaatgatatgaacttagttaaacttgtacttatgacatgtttggtttaaaattccgaataattaaaaaaactgtagtttattacaaaattaagctccttcaaatagacatatatttgttttcttttaataagtattttcaaaagttcctttaaagattattatttctattaaaataattattaatttaagcacgcgttaagcctcggttaataatacagtaaatttatatcaatttaaaattaataatacggtaaataaaaaactttatttataaacgtacattctataggacatgtggtctgcgagatctagaaactagtgctttcatttgcacagaatatactattatcaatttaattaattgtgatcagcttctaagcttaactataagcatgtatgtaaacgtaataaaaaaattacaaatatttattaaataaagatataaaatataataattatcccttttaatacaatttcagtatttttaattatttaaaatc

SEQ ID NO: 3795 - DNA, 1157 bp, Glycine max
  Soy_ogl_6736 Gm20:33954244..33955400 Cluster 15
gaaaaatgatataaataattatgcaaaaataatatctagattaagttgatttatagaagttgaattccttccaattgattcaattgtgtttatactccaaaacattgatttattgtcatacacctctaaataggtatttaagattaactttccataactattaatgtgagacaaaaaaatcctttaaacaactgcttaattaattataaagaaaacaaccaatataaaataaaagattaattaacgaaggataaaaattgtaaatttttcaaataggctttgtctctagagctgctctttctcttttggtgtgtaagaatgcgtggagttttcttacttgttcttatttaaaaatataaaaaaatatgatttcgaataaatatattttaacacctaaaatctatcagaaggtgagaaaagtgagaataatataagtatgataggtgacatgacgtaataaaaagaaaaaaatagaaaaaaatgaaatttgttaatgaaatgtttaaaattatgagatattcgaatattacagtccaattaataaatgaaaaatattatgttgtttaaaatattgtgatctaaatgaaatttctaaaatgttgggatgtttaagtatgactactcttttgatattagatcatcacatgactttaagtttgtttgcttttttgtgttttatattcagtttgtaaaataaacttaattttgtaatatgtttaagtattttgaaaagtatatttacctattaaaattttgtctaaaaatgtaattttgtataaacatgacttgagttgcatttctaaacttagtttcaaatttaaattaacctgaacttaaatttacgaatgatcttcgtgacgattgcatcctatagcatgaactgattttctttcttttggttttttaaaaaagaatgtatcgtgtttgacgtcttggcatgccaaattgtatgtcacgggtttaatttatgatttttttttttactttttgaaatataactagtttttttatgggtaagaatcaaaaggcaagaattgtaaaaaaaaattataataatttacgtatcttagtaagccaactgagttagactccattgataaaaaatagttaattaaatctttaaaatataaaaaaatattaacaagagtattaatatt

SEQ ID NO: 3796 - DNA, 1059 bp, Glycine max
  Soy_ogl_483 Gm02:10793542..10794600 Cluster 15
taatttggcatatattttattttcaacttttaaaaaatttgcaaattttatttcaatcatgttttcgttaataaacccaaaaattagaggtaaaatttgtaaacaaataaaaaagttggagtaaagtttatcaaaaataaaaagttgagtgtaaaaattgtaaaaaaacaaaagttaagataaaatttgtaagttttttaaaagttgggagtaaaatatgttaaattaatttgttggggataaaaaattttaaaaattaaaaaattagtggtagaaaatataatcaatccttatttatactcaagtcctgcaatttattagcatatcaatttgttttttggttttaaagttattttgctcttgtatatttaaaatttgtattatgtcatgatgtaatgattattcattaaatataaccaactaattagtttattaaaatattaaataatcatgaatgaattatttcatgattatcgttgtttaggtatatgttttgttaaactttggtcttatatttatagtaattattttttatagatataatttcaaaaaaattagacttattgaaattatgataaagaaaaggaataactaaaattaagcttttattgtattgtataatattcgtcgttaatataatttttaaagatgtgtaaattagtttattaaagtattattttattaattaccaaaaatctaatcaaagatattatctccgtccccatttaagactcttaattcagttaataacgttaaatttactaaaaatttatattatttttctaaaatcatccttgggacatattatatctcttttcacttaattattttttcacctaattaattaaagtgttattgaattcttgttcaatccctcataagagaaaaaaataatttatcttattaatttataacatttattgtaaaataattaagaatattttaattaaaaaataattaataataacttgaaaaagttttataaaataagacaaacaaactggaaaaaaattatatttaacgacaaaaggtaatatatagaaacaaaaatatgatagt

SEQ ID NO: 3797 - DNA, 1300 bp, Glycine max
  Soy_ogl_507 Gm02:11996501..11997800 Cluster 15
ttacaatttatataattaaaaactctttattacaatttgtaatgacctgcggttcatgtttagagttttgtaagtttacttttaatttttgtatattattattttatttaaatattaatttttgtgtgtatattccttactaagtattttgatggttgggtattttatgtgtatatatttttaataacttaaaattatatattacttaatatattatattaaacatttaaaattattatttaattactactgattcaactccaatttaacttttaaatcttgaaccaattgattaaaaaatttgtttataataattaaagataaaactatttaaaaaatgatattaaataagattattttctttataataattatagattaatcagacctcaaagttttccaattctaataagttttgatgtccctaacataatctagcaatctcaggcacccttcaccctacctcctcatcttcaaacatctaacttttagtgagcttcaaaatatgttaaaaaggctaattaaagctgaatccgcaacaaaattaatagttgcttttgtatcacttttgaggtaattttgctctaaacgtggaccttggttgtggaaccaaaaacacattttctcttcgatctataagttttgctctccattatcctttgttgtctttttttgtgcgatttcttattcaccaatagcattttgttttttttctttttttgtcatgatatgattagaactagtctttgttagtaaattgcacaaacttcttctaagattttgtaaaattacataaatttttttagtttttttttacatttacactaaccttcctttagtagagtcgacagtatataattttaaatgactaatgaaggttaacatagaaatagataaaagtagaaaatgtttatatataatttcatgtaacttcaggaagttagtgtaatttaatttttttattatgttagaatacacacaaaaagtaattactattttcgagtgacaatgatatgactaaaattcatttttattttgtgaagatacataatgaaaatataatttcttctatgtatcttacaaaattgtgttgagggaggttaagtattttgaccagactagtttctctagaatatcttgacaatattttatcaagatacacaatcaaaattaattttctcaaatttttattttaccgaaaacactaaaaaatggggtgggaagataaaagggaagtgtcaatatcatggggcttgtcttgtcaaagtagtactacaacattaataaggcattttctatt

SEQ ID NO: 3798 - DNA, 1000 bp, Glycine max
  Soy_ogl_534 Gm02:13824801..13825800 Cluster 15
taagtacaagatactcatgttttacgtcaaatgcttaaaaaaatttagttgatatctattttgaagttataaatttatttatttattgaataaaaaacatccaaatatctaatttcttttactaagcacggttttatgaatttttaatttaaaaaaaatttttttttgttaaaataagtattaaattaatttttttatttatgatataaattaaaacaaaagttgaattcataattttttatgagtaagttgagtacatatatttgttacgctaagaaatatgctcaaataaaaaatattattatgcttgcaagttttctttatattcagttttttccaaatttttgagataataatgaatcctaagtcttaactattacaagcgtatttgcatataatattatttaattaaaacatttattgaaagccctgttaaagtattaaaataggtctaaaagttacatctaacaacaaaagtaagtaagattctcggattaatattcttcatttaattttcatcaaataattatcaatcatttctataaatgtcacgtcttaactttattaagcaaagagtttgtagtcaattcttctttattgaagggcacatcttgtgctcaatgtaactgtaagcttttcatatatttaataaattttgcttataaaaaatcttcattattgaaaagcccaatttttttaagcaaaattcaatacatgtgatgtaaaaaaaaaaagatttctataaatgtatttataatatattcataatttactctagcttatatttatatcttaaactaaaataaataatttaaggagttgatcgaatagaacaaaacataatttcacaacacaagtcatcatcccttccttctaaattcttatttcacaattttttttagtaaacctaacattcataattatagctaatataaagataaaacttatacttatagtctacatctaaaactaaagggtaattaaataacaagtgaatagt

SEQ ID NO: 3799 - DNA, 1128 bp, Glycine max
  Soy_ogl_851 Gm03:4818001..4819128 Cluster 15
gttcaaaaaattcattaaacaaacccatgtgcctcgcatgtgaccacttgggttatcagaactgacactatcactaatttttctattatattaaatatgatattttttaaatactttttaatttgttaattctttaaaaattgttgaataactgattaacaaattatttaagaatataactgtcgcaacatttacaaaatattttagcagtaaatgtaaaaaaaaacctaaagtagagagaataaagaaaatttaaatattaaaaactaaataaaaatattactattactcacacatatttataattttaaaatttataaaataaagatttttacattcaaacatatcccaaattatgatttgattaaattagtttgtaaaattttgtcttaattcacatatagggaaaattttaaaatttgtaagaaccaaacgcaatgaaattattttggagaactaaaatcaatacagatcaaaatttcgaagaccaaagtcatacttaacctttgtagttattattattctttgtgtcgttattgctaatgctagttaagatggatcaagtagcagcaagttgatttctgtgctttgggctttgcacaaagaggttgagcagcatagcaattgatgggttcattttatcacctcataatgggttcaattcatcctgtgttagtaggattgaagtttttttttattcatcagaattgagcatgatattatagccttatagcatttatatattttattcaattaattgatttagactctttaattaataataagattaaagttaaacatgactcaaattgagttaaatttggttaagtttgttttttaagaaaagtttgatctgatttgatataattaaagttcaatttgaaacttattttttagtttacaaataatttaactctttagcttgaagtttaagctcacaaataatttaactctttagcttgaagtacatgagccaatgataaaaatgaacgggaatcaggataccataattgaccttcgattgatagcttcagagaaaacaatactaattaaatttaaatcttattgagatttaagatattatatatatgtgttatttatttcaattaaaaataaaaaattataata

SEQ ID NO: 3800 - DNA, 1128 bp, Glycine max
  Soy_ogl_881 Gm03:34842801..34843928 Cluster 15
tttatttatatcataaattatttaacatttgaacaggcaaaaaaaagatcttttaaaattgtaagtaataaataaatgaaaatatatttatatgatattttgttatatatattatcatttttagatgtctattgttttatttaaatatattttattaaagatcgtctttcctttttaacttgttaattaaaatactaatttgtagaaatttctaaataaattcaattagacaagacgataattgataataaaaaaagacaataaaaaaattagtgtggtaatagacttatagacactcttatgttgtccatgatacaataaaaaaatattccaaaataattctttccaatttcattttttataccgacaattcattttcattatatatagttctatcacccacgcacttatagttctacccatataagctcacactagaattaaaatatatagctttcatgttatttgtgcaaaacgatccaataccctggagtaaagtcacaccacaaatccacaatacaaaaaattatactaaagccaaattttactacttaaaggaagatcaagcaaataattaagtacccgccggagttgaatttttacatcaataaaattttgttttaatgaaaattcttatctataacaatatcaataattaaccaattcaaaagaaaaataaaaattttctgtattttaaagaatttttataattaaaaaatatggacaaatagatacttgagtgtttgtctttctgctggtaataataataataaacaacaaaaattaaaaattaactttgatcatgtttgtatttttttcaattttaattttattcatgtgattttttttgttaatttttagttggtaaatttgtgttttttaattttaattcctttaagtttttaattttattatttttagtcatccgtaagtttatgcttataatgatcaatattaggaaaaaacacaaagttaaagggagaaattttttaaaaaatataaacttataaaaattaaaaatgaaccaaaaaaattacaagggacaaaattttaaaaaattaaatttataggaactaaaataaataaataaaaacgtacagaaaacaaaattaaaaaaatataaactta

SEQ ID NO: 3801 - DNA, 1480 bp, Glycine max
  Soy_ogl_1345 Gm04:42240921..42242400 Cluster 15
tacttattttaatttattattccctacgttttagaaaaaaaatttgtttcaaaatatgttattttataaaatcaatgctacattaaatatttttttccaagactatctttaataaatacttagtgtaagtaatacatagaaagaataaatgaatcattaattagaaagataaatgatatattaggaagttatctaatattttttaaaaaattcaataaattaattaaattccttaatatatatttgtgcaaaaatcttaaaagtcatatactctggaatgaagagataatgagttcagcaaacaatcacaaaacaatcatttagctactcaaccatcttttttttttttttttgaaactcagtcttaccttttttttcctcaaaattttgttgtcatcatgataaaagtagagaacataaataaaattatatgaccaaatgaaagaatttgtattttcatagtcgtaagaagataatcgtcctttttaaaatggaaaatgaaaagaagaatgatgttcaaccatctctccccttcctcaagataaatgaagtaccaaaacttgtatgtgattgaaataatgagggaaaaagatggctaagcaaaagtaacccttaaaattaatgataccggaaaaaatgcatcttaatacttgataaaattttaagaaaataattattatgcgaaaaattattagaaaattaaaacaatttgcgctttgagggttgatgggttgtgttggcgcaagacctttgaaacttgaaagatccgtccgtctgtctatgtctccatgagcctgaggggtgctgaaagtaaagctctccgaaaaagaaaaaaaaaaaaaaaactctgtttttgtttcattatctttttcctcgtaattttattattatttttggtgacttcttaaatttattataatataatagtatttatattaaaagtataaaagttataacttttaattaagtctatatatattcaccaaattaagtgaaataatttctcgtatttctaccaatctcaattatttacttaatttgaaatttataataaaaatacacataaagcatagatagttgtttataaatatttatacatatttttagtttgaccgtgactagctggtaaatttgtttttcttttcacttgccaaaacaataaaaatttccatcttcattactttattgattaaaaaaagcatatcattagggtttgaaaaaatatatatgcaacaacttttatgatatggagaaattcacttgaagaataatttttatagagttatttttttattattatttttttatatctaatgattaagattagttaattattacaactattagatcttaagaaataaatagtaaggatatgagaagtaactcttaaaaagaattcctcctctaataatgatttatatttatttttagagctactttgtgaccaaataaattaaaagagaatgtctgatcattataa

SEQ ID NO: 3802 - DNA, 1000 bp, Glycine max
  Soy_ogl_2074 Gm06:44449101..44450100 Cluster 15
catatgttagttatggaactaattaaatatatatataaattcaattcaaagaaacatttaataattaattttattggtaataaattcatattaatcatgtgtgatatcattaagcatatgaattgttaccgaaagttattttttattactgcattattaatataaaatatttattgattttattaatgattaattttcattggacattagttatctttaataaattcttcttttttaattatattttttttattcataaaatttaaatttaatatttaacttaagagaactaaattcaatattcttgaaaccaataaattattagtttatacaaaataattttaacttaactatagattttgaatttaagttttaaacatgtgtaattatattaaatacttaaatacagttaaatatgtaattatctctcatgaaatatacttaggtttttaaaatatgtcaaatttgatccacaaaggttggactagtaaattcaaagctacatgagaatcttgagaagttaaaaatcctaacaagttacatgtaaattaagataaatctatatgttatataagataaaaatttgacatattttaattttataaagatgaaatatatactaaaaattttacaaataaaaaaacatacatctctaattttatgaggaaaaaagacatattttaagtttttttaataagattctttacttgtttaaacaagtaaagcagaaagtgaataaatatagtacttaaaataacattacttgtagaagaaaaagctaatgaatgtattgcaaggagcaccattggattcaaaattttgtccttcagaactatttattatgaattttattttcttaattttaaagtaaaaaaaatatcttttttttttaaaaaaaaagaatttaatgaattcaatatcccttcttttagtggaaattaaagaagatgcaacaaagagaaaactccaaggaaaattgctttgaattgctactgtggcc

SEQ ID NO: 3803 - DNA, 1400 bp, Glycine max
  Soy_ogl_2230 Gm07:6248301..6249700 Cluster 15
ttacttgattatttatattgccaacaactactaaatatttttcagtcttaggaaatactgtcaatttcaaatttgtctggctaagaagcaaaactcaacttatatggcctatggctatgaatgcttgaatagtttgcatcagagaaaaaaaatcaatattaattttctttaaggaaatgaggaaaattaaaaaagaggagataacgtctcagtttaagacaaataaagtctccaaagcttaaaaatgtttacagaaatatttacatttacctcactaaaaaagtggaatgagaagaaaaatcattataacattaaaatttacgaaaaaaaaattcaacccgaaagagattatgaaaccattataaatttataatttataaccctcctggtatattgcatttaattgacgaaactgatcctcgtcgagttgaaaaatataaagacacataataaagacgcatgattaattatgctttccgttcagttttattatttcaacataaaaatttcacactgtatcgaatattatattttatttttttatatatatgcatattaaaaattaaattaaattatttattataaattattgtgttcaaatttcaaaatacatattttctcttcttgcatatacccacaaacgacgcagttggttcctctcatgagaatcaattgctcttcactcagtttattcacactccctgatcataaaattcctttgcagagttgaacctattctattctgtttgcctgaaaaggaactcgaataatgaggtcagtgacatatttgtcaagttttcattcattttcatcattgctacttcagattgaacttcgtaatttgtaccgttttatatccctgttcttgagccattgctataatgcagtatatttttctatatccagtatataatattatagataaagaaaatgttcacaactaatgctgatgcaatgatgttttactaattaacaaaccttgattatcgactttgaggaaatagctgcattttagagttaagagaaatggaaaaaatgcactttagcacatttcttattttcaaataatttttatgagagtctagtaaaaaaaacagtgaagttcataagtcttacataaattttattttataatagaaaatgtgttgaaaaacaaattaatttttttcttcaaactaatattttttttaatctttcggtacatcaaagaaaataaatcttaactaatctaaaatttaacttgaaaataaataaagtctgactaaaatttattaaaactaatattcttgcatgcaaagtatttaatattcctcttatcaatgatatttgtcttgaaaaataaatttgttagtgaaaaccaacattaggtttaagtgcaactaacttcgaattttttaaac

SEQ ID NO: 3804 - DNA, 1326 bp, Glycine max
  Soy_ogl_2608 Gm08:11461680..11463005 Cluster 15
actattttttatttaaaaaagtttcccaatatttttttagtaaaaatattgttgattttaacctgcacttatatcatttgaaggacttaggtttagaaatgaatgaatcaacagtatataaagaacgaagccttattttgtaagatgagatcaatccgaagcaaatgattatcagagtgaattgttgaggattaatagtcaacaacttgatcgtgaggtttcttctccttcttttcgcttcgtttaaatgatcttaatcatcttttcagtctctcaaattatgtatgggtattttttttttaattctagaaatcaaatattatatttttgtcccttaaacttgaaaatgttgattttaatttcttccttcaattaaaaatttgtattttttaatcttttaacacaaatctcttaatttgagagattaaaaatataatggcaaaaacagatttgttgggaatataatagaagtttatgcaactataatcctatttcagtatttacacaaaaagaagagagaagagagaagagaaggggactcaattcactcaagacttagtataaggaaaacagagacatagtaatcatagcaatgacagaaataggatgagagaaaggcaaggattttaatttaaaatttactttagttggtttttttaattaccttttcgccttttttattaataaattaagcttcttaaattttaaagagatttaaacaaaaaaattgtttgatctaatttcttcttttaaaaaggaaaaaacacatttttttagtcaaacattactttagaaaactaaattctttcatgagttatttatttctattttttgcaaagaaaatgttatgccaaaatatgatttatttttttaagtgtattatttaagactatacttgttcgtccttattaataatgtttggtaaataagcattttttttatagtttgtagtggtttttagacactacttgtgaagtaatatttttaaattattagcatctatcttttgttttatattttattctcctttatcctgaaaccaattcttacattttattttttttataattttctacataaggtataatatatatattttttatttcggctcttcttctgctcacaaaggagagtgatttttaacataatacttcaagatattttaatattatactaattaacataaaaaggatgacatatgcttaagtgtattacacatattaagattaataaaattaatagtaaaacacacaatatgaaaaaatataatgattaaaattcaaaattatgatttaaaaataattgatctggacataaaaaattagg

SEQ ID NO: 3805 - DNA, 1000 bp, Glycine max
  Soy_ogl_2658 Gm08:13393201..13394200 Cluster 15
ttattcttcatcttcaatggaacattttaattgtatttatccttgaattttaatgaattgaattttaattaattatgaaggaaaattatcacacatttaaaaccatataaccatttagatacacattttctataagcatttaaattcatattatatcatatatcttgaaccaaaataaaaagatatatgcatattatatagcatgctttattgtaaattaaagaaaatcaagacaaaaattgtatacttagcaatggagaacattctatcttaattatttgttcaatcaccgttagaaaatacgagagtaactaccaatttgaaaagaaaaaaaaaatacctgattaaaaattcagcaataatatatagaaaatatgagagtaactaccaattttgaaaaaacttcaggaaaaaaaaaacaatttgaaagcaactacccttctctttgacagttaaactttacccaaatttcataaaaatgtcttgacggaaaatagtttttacagctacatttaatgcatgctctttgtttttattggcgctgtaataatcccataactcgtctttatttatccacctaattaaactgtgtaagaactctgaaattgggttagagtacctcttgtatatataccaaaaaaatgtaccaaaaaagagtgccccttgtactttatttgtttaataaaatcttttcctataattaaaaaaaaaagaaggttttacggccacgtcaaatgagagtaaggagttctcattgtcaatttaaaatgtttaataatctccacaataatatgcttgataatttaaattttttattctaaataattaaataatattaacccaaaattaaatagttcaacaatcttttaattacttgaatagcattgatcgattaattattagggttatgaaattattataaataaaatatcaattattgttaaaacatatataacaaaaatatatagaaatatatgttaacatgcacttcaaattgata

SEQ ID NO: 3806 - DNA, 1200 bp, Glycine max
  Soy_ogl_3447 Gm10:38729001..38730200 Cluster 15
tgtcgttatagtcttacattctcatttattatatatattttcatttattatatataagttttaataagaaatatagaagagctaataaaataagatttactccttatcttctaattatactatttgaggagatcttctaattatactactataaattgtttactttttagaaatgacgatttaaaagttgggtaccctaatttattataatccattttaattaaatttaacactatataaaactcaattcaaatcaaaccgtcacgtgtttttataattagattgaaacaaatattttatcttgaatcctaattaaacaactatacttattggagatggaggaattgtagataaggctcattgtctttttagggaagggtgcttgttaattataccttattattatatttttatacctcatgcatagttgatattactttctattttttttatcgctataatattggtggggagattttttatttatttataaaatttaaattcgagagatgttatttaaaaaaactaatttcaattcaaatcaaactattgactttgttaataattagttttagatttatatttccaaattcttatcatttttaatgctcaaagttactttataatttttagtaatatttttggataaatacaagaaataaattaatagtttttaaaccattaggatcggtctaatgggatgatttagacatttagagtatatacataagtcttaattaagtttgaatttgtcattgtacaaaaaaaaaaactaatactatttttggttagtttgcacgggtactgatttacttttgtttcttctttaaatttcgtggaagaactttttgtcaagttcaataaactttatgttatgtattttttttaaatgttagatctttgctatttaaaaattattttaaaatctaaataattcaattcaagtaaggtgccttttcagcaaaacaaaaatcttttggcatttattttttgttttaaaaagaaaataccaaactttagaaactcacttgagtcaacctaatgataaaagattgtataatttgtacgaggttaaattcaaatttaattatcatcgttatacaaaaaaatcaaacaaattcctctttgtaaattaaaattaattttttatggaaattaaaattaattaatatgaattctccttcacttattttattcttt

SEQ ID NO: 3807 - DNA, 1100 bp, Glycine max
  Soy_ogl_3856 Gm11:16908901..16910000 Cluster 15
taaatacaagccagagattttcacacttatatgagaaaatgtgttatgtgagaatcgaattcaagtttcctcctgtaacatttattgttaattagagacaaacttaattatagtaataatgaagatatacaaatgtattcctttaaaaaatttacatataaaaattattttttaatcttaatttgctccctaattttatatatttgtatccactgctccaattactcactcactttgaaaaaaaaaaacgttttagctatttttatagaaaaataatatttgaaaaattaatatcttaaaatcagttttcatcaaaatgttctgatccaagattgtttttgagtctctttaattttgaagtttgttttgactcttatgagttcccagaatttaattcatcaaattttttatataagaaaaaaatcaattttgataataattgatcatatatataattaatttcaaaataatctaattttcataactatttcaaacacacttacatcacaaacaactcctcttaatttaataatataattttgaaaagacttaaatatatttttagttatttgggtaaattttttagtctcttgtgactaatatttggaggtttggatgcacaattttgtggtgatttttttatcacaagagagactaaataaaatttcaagaaatttaaatgactataaaagtacaaattttagtttgggagagtaaaaaagaaccctaaatttaagggattaaaaatatacttaaattaaaaaaatatcatttagttcatgatcaactgatgcaagattattcaaacataatcaaaagtgtcaagatgcacaaattttattagtatcggcataaaaatcaattcttttgaaatgaatatatgaataaagtataagaagaatcagggacggatagggcaattgtctccactaactttttattttttatttatataatagacatgtataattattaattgtttttataatctaaagtataataaaataagatttatttataatataaatattgtctccacaaatttatttctagtctcactctttttttttctctcaattaagcatttataaaaaaaaatc

SEQ ID NO: 3808 - DNA, 1100 bp, Glycine max
  Soy_ogl_3915 Gm11:35952001..35953100 Cluster 15
atatataatataaaattaaatctttttaaaactataattgaggaccaaattcatataaattttatatataaaaacataataatttgattcgggaatcgaccgtgacatatgttgctttaaaaagagggtttgattctaattttttaaattacatatacaaatgtaattataaattcaaagtataaaaaatattttaacattctgaatataaattttttattatttaattctacatgcacattagcacattacttacacgtatatggcctaaaatttacaggtttttttatatataatatgattacacatgatttttctcattcttttttcaatttactttttacacaagcagtttaatatcctaacatgatatgttttatactaaaaataataccatatactaagatgtacaaaatatgatgcattatatcattagtactataagcttaattataatatatattagtaatataatttgtatacaataaatattataaccagaaaataaagctaataactgttgtgagaataatttgactcttagagaggtagtaagatatgtatctggattattaattagagaactcctccatcatactgagagattaagtagaaatgtgttgcagttaattaatatgttcattaagtcatatcatgagtgaaaccatttaccattaaggggcagttgtaaagaaatgagacaccccaagtggaaggggtcatgaagggaggataattctaaatagaaaagatttgagagaattttttataagtgagagagagctatcattatgtcttttgttatttttatttgtgatgtattttgcatgtgttcatatgtgtttaagttgatggtgtgatcacatgactactcaaatgagtattgaaagtctttagccttctgttgtatggaacataaaacccttagacattttctaaagtactgagaaacttatagatttgagaaattctgaagttctttgtaaaatatttaaaatatatactgaaatattttaaatttttcgaaaaagacatttagggagtattttttttctgaaaagataatttatttatttttataataattataaatgattctt

SEQ ID NO: 3809 - DNA, 1149 bp, Glycine max
  Soy_ogl_4340 Gm13:29127812..29128960 Cluster 15
caaccactttatttaaaaatattttatacaatttatatttaaattttttgcatgcatttatattaaatactcagaaaaggagttttataatctaaaatgattctacttatctcaaacatgattctcaaacatgattgtttcttattaaagattatcgtgatgtttacaataactaaaaaattaatatactaactaattagatttaaatgtattcagaaaaaagagttttttcatctttatttactcaactcaaatataattgtttcccctgaatgaaatttatgctccctagctaccttaagaaaaataaaattaatttaagttataatattattaatgaatcaattaaaaatatgatgttatagaaatatatttttaaaaatagaattaatctgaaactgataacatttaaattaattttattataaatatttcaatctcataaataaaactcattgaaaaaatacaaatacatttttaattaatttaataaatttattatatatttatgtaaaaattatattatcaaatttaaaaatattaattaactttaaatttgtgtgtatgaagttacaagcatatattaaattaacagaaagagagtgaaatcatagtataataatattaagttatagaaattcataaacgataaataattatacaaatttatgtaatagtaaactattttatataatattaagcgtatatatatattaaatatttcagaaaatgaaataacatgttaataaaaatactatgattttatcaaaagagtgtaaatttgatttttaccattgatgtaataatcttattgatggttaatctattaatacttttgtaagtgttcaggtctattcaaaatctacgtaaactttcagtgttcaattcatctcaacttttcaattaaaaaaatcaatatttttttttatatttgactcaaagtaaatatattttcgttgaaaatgtttgtaatatctatcattgaaatttaaagtaatttaatttataatattattaatccatcaatttaaatttatgtgatataaatattaatgaacaaatttttttatataaatttattaaacattgagtcaaatatttattttggaacgaatatgatattatagataaagtattttaaaaattaat

SEQ ID NO: 3810 - DNA, 1044 bp, Glycine max
  Soy_ogl_4775 Gm14:44421001..44422044 Cluster 15
catatgttttgttcgtttctttagcaagccagaatgaggttcaacccattaattcactttagacccatattgcttgacctggtaaaaacatgggtaaaggattgatgggaggatcaatccaccaacttgttttttaattattaatatttatttttaatattgtgataagatttacaattttagaagtctcaaatatgaattttgtttaatttattttatgcactggatgttaaaatttttagggatttttttatctaaataaattaatattcaaaataatgtaatttatttaagtttttaaaatattttattatttaatatttgttacagataaaattaattaaaaaatatataaattttatttttagcacgttgactcaccaactagcaactcatttcattttcaatttaaggtcattttataaatatttattttaattatatgaagaatattttttcacattttgaaaaaataattataataacaaaatttaaatattgaatttgatccatgcaatacatgttctaaaatactaaaaaaaatactagttagatatattagttgaatgaattagtccattaagaataaattacattattcttgaagtggtgtgggtcctttttttgagaggaagtggtgtgagtttgtgtcacaaaatatcacttaattactttaattgaaactagatctaaacctgtggggtgcacaaatttgtaaataagataattaaaagttcaaaatattaaaaacatataaattattatccttttaaagatttttaacatatatggaatattatagccaataaaaatataaaaataaatttcaaaagtctgtttaaaaatatatttataaatagtcaattagaacgattacaaaacaaaaaatttatacattaatctaaattttttagaataaatttaaaatccagcaacattgacatcatatctataaaaggaacaatatcgagatttcaatatcttctctatcataattaaacttaactactgccacaaagttatatatttttaaaatctttttgt

SEQ ID NO: 3811 - DNA, 1000 bp, Glycine max
  Soy_ogl_5392 Gm16:31397901..31398900 Cluster 15
aagtccatattaggtactaccagtataatttaggaattttcagttaacctttgattcacggaattattttttatttctggagatattcttcttaagaatattagatgattagatggaaataatattattcttagtatttcaagaaaaatatgcttatttaactattaatttttttttggaaatttttttatattttcagaaattaaaaatttgtctggtttacattatttttctagaaatgtatgttatattactaatttttaaattaatgaacttattatgtatacctacacaacaaggcacaagactagacactgtaatttgtaaataataatgaagaatcttataaattttttcaataaatttcttaatcacaacttactagctatttaaagaaatgttgtatcaaaatatcctcttcaaccttgtaaagaaacaaccaatacaaaaagacatgtaaaacaaaactttaaccagatccagtactgttatcaaaattgaattgcaaaatttgaaatactaactgatatatgggcattgaaattgagggtataataaaatttttacatgattaatatgattataatattccatatttccatcatctttttatgagaatcatctcaatataataatatcaatgtaaacatgaacattttacttttctgaaaataaaaaatgcttaaaactattttttactaacgtaaaaatatacattctcatgtcctcattcccaagaatcctaaaagattcggtgaaacaaatgcctctttaattttggagttgttttacatttttgttaatactactacatcaatataattgttacgtttttattcaaaaacaatattaaaaatatttatagaaaagctagtaactctttttgatactcactactggattttttcccctttctttttaacttatttcgttttctatttcttactcaatatgtgtccatgctataagatgtacaaatgaaagacattcaaaagcatca

SEQ ID NO: 3812 - DNA, 1024 bp, Glycine max
  Soy_ogl_6172 Gm18:54503977..54505000 Cluster 15
ttctcttcccacttgaggtacatatattatactttcgataagtgtgaaattaattaattattctaaaactaattacgatgaatagtagtttgccgtaagcatacagtactatattcacacttaacatgaaatgacattttctgaaaaggagaatgttatatcactaaaaaaaatcaatgaattatcgattaaattcaattatcaaaattatttttttctcacaaattttagttacgaattttaaaaaaaaatatacatcactaatttgaatttttccttctagtgtaaaaatatctttaagatattaattaaagagggtacacaaaaaaaatatattaattagagagctataagtgatcgagtaatttttacaacaaaaatattaggttaaacaggtttcagtctttttttttttaacaacaggtttcagtctttatgaatagaaaaatattcatttgtaatacttcaaagtaaaattgtctcgttttattctttcatttatagaaatatttgtggtccttgtctttcataaaaaaatctttttgtctcttatttacaaaaataagaatttatatcatacattttcataaataagagactaaacacgagaatttaattttaactaactaaaagtgaatattatcctatttgtataagaactaaataagtttaatttaaatatatttcaatatttttttttttagaaatgatacaactcttacttgagctaagtagaattactatataaaagacaaagttgttgacttatatatttagaatccgaatttgaaattactatagttaatttagaacaacattatgtcatttaattcatgtgcttaatttattttttctaatatttctaatatactctactataatttttaatacattatatcataattttcaatcaaaatattatatattcctcttaaaatagttgcttatgtgggtgttcaaatccaaattgatcaaaaataaaaataaaaaaacagctaagaaaaacccaaaaacaaactgtttg

SEQ ID NO: 3813 - DNA, 1330 bp, Glycine max
  Soy_ogl_6664 Gm20:1041184..1042513 Cluster 15
atttgtttattattaacacattacttggagtagaaatgagttatgtgaagttagactttgctaacttgattcataatcttaaactaaagtttgatttatatattaatagtactttttattataatatatttgaactgatttatgtaaaagtttgatttgacataaaaggttttcaaatttttcataataaagtctacacacaagtaaacagaccattgacaccacactaataagcttataaacaaatataagtcgaaaaacctattagtgtaagttacaaaaaagctaataaatttatcaatataaaactagagttataaattaataataataataataatttattgttattaaatagataaacatacgggaccaaacgagttatttaggtaatttaaggcttgacctttttatttaaacaaaatttgaagaaagtcttaacgtaacctttttaataaacaaacctaacatatataaacaaacctttaagcatattcatttactttttcttttataaatatatgtattatatagtattatatatacaaaatagagaataatatacgagtataggctagtagtattttttcaacaatttaataaaatgaatctacaatttcatttttttgttcagcctccaatttcatataccattatgctctgtactaaatactaattctggcatgcatgttaagagacattctattcataaaatgcagtaatgtacactatctccaggcttccaatttgcgcgtggatactactacctaagttattgtccgctaacaaactcatttaattatatatgaacaacttacccccccttgttatattgtatcagaagtagaaatgttctcttttttttttttaaaggaagtataaatgttcttaaatgttatacaaacggaaacatatattaattgattgactttgacccaaccatttatcatacttgctctctagtttaaattttttttaaccataactgaaaaatcagtacgtgccaacttttctttaatattttgattgattaaatgatatttttatatatcaatgtgaagaatgtaccatataggtggtgtttagtccattttcttaaatatgagattctcaagaataagcttttagacaaaatttataaaatatatttaattaagatataaaatattatagatcattatacaaaagagatcaattagcaaatgacaatgtaaaaaatctggtaggataataccacagagaagctagagaaaatgatggtgaatgatagctcttgtaattaaaaggaaaatgagcaatgcatacattctattttagggtgtaaagatgg

SEQ ID NO: 3814 - DNA, 1400 bp, Glycine max
  Soy_ogl_3268 Gm09:43369201..43370600 Cluster 15
atattattactatattaattttcactatgatttttaacgaatctcaaatatatttttgaataaaaacttttaacatatttctttaatcaggttgctagcaagaccctaagattatatagtatttagctactttattagactggggcttgatatgataactttccttaatcaaatggaagaatgactatgggtttttgcaattaaaatttttacaaataaagttgagtttctaagttttgctacttggatctttttctggttggccttttttgctcgcaacccaattaggggagttactattaacactatcattttgctacttacattaccaatgtgttttaaatattttttgaaagacccaacatttgctttttagatagtgtttttttttttttttgtaacgttttttagatagtataatgaaatgaagtaaaaatcaaatctaaaaagtattgtgagaaaatataataattgtaacattactcttctattattttttgaaaggtgttttctttttttataataggcactttaggtcgcaaggctaaaaaaaagatacacgttaggatactatttatttttgtattgttattgtgttaggagtatcactttacaaggagtgtagcaaatagcgatttatatcttgagaaaagttggcattaaagaggagcactttatagtttatgcccaacatattatggtccactcccttttgttattaagagcttcttaatgttggaaatcaggaagcgtcgaaaagcttggaattatagaagttagtaggtcgtcatcaattcattcatactataaataatataataaatgacacatattcaccataaataaataaatgcatatactaataatatataaagataagttggaaatcaggaaccgtcgaaaagctcggaattatagaagttagcaggtcgtcatcaattcattcatactataaatagtgtaacaaaataacacaacacccactcataaatgatcatacaataaaattattataataataattatttttaaaaagtcatacaaaaaataattaatttttttattattaatcagtaatataataacctttacactgaataatagtatcgtgtctactctccaacaccaaaaaaatatcatacatctattctcagatcccgatgtccgaacaaagacagtagtgaataccctgtcaattcgcaaaataagagatacattaagatatttttttcgtaaatctaaaattgacaaagcctgaattcctataaaaaaaattatcctcttaagattataatgtgctatgttgtttgctttaaataatattcagatattccaacttatatctataattttttatatcaattatataaaaaacattatatttattaattatatacatt

SEQ ID NO: 3815 - DNA, 1200 bp, Glycine max
  Soy_ogl_4710 Gm14:6271701..6272900 Cluster 15
atattaaaattgttagtttttttaaatcatgagatcaaagttttgtattttgaaataggagaatcaaattatagatttgacaaaataggtggactttaaaagcctaaaatgaataatctaacaaagaaagataatgaattgcaaaaaactgttgtaaagttgcaagtatggcaatatcataatagtgaaactatgtcacaatggatgatacctagattttaaagttaagtttatgtatacaaaaattatttaccaaaaaaaagtttaaaatatgacaactgcttcttttttgcggctcttattgatgaagtggacattggacaatgacaagtataacattggactaacagttcatgaatagactaacttgcctattttcaagtggctatcctgttatggctttactagtcaatgttggtctatgcaaaaacttaaagttggtttaaagtgggtgtcaatttatctccattggacgccaacttgactattcttccttgcgcacttttggacttcatttttgttttggtgcttcttttatgtccttgtagttgagaaatcactcttatccaaatgttgtcatgttttcctactcatgttttcctatattgataaacccaaataactaagtaaagtcatgcaattttcattaaacgtctcaagaatatgaatcacatgaaattcctatttcttgttgttgagttgttttctcattaatatcctatgggttaatgcaaatataatttgaaatagccctatgaatctacatgagctatagatttataatttttgtcacatatgagattcaattctcagccgttaatgtcatatcaagagcattaaataattgttgtccatcaagattaaggatcacaagttgtacccagattctatctatgagtacatgcaaaaatatctgtaaataggtaaaataaatgtttgcttatgggaggcgggttagtttccactgtcttccccacacctattttattagtatataacacaactacttatctaagatatagtatataaaatttagtatataaaacttcaacacatatgtatacaaaatttaatataagctatatcaaagtataaatgcacccatatgtatacaaaatttagtatataaaaaacttcaggttatttttttggatgttttttaaattatgttttgatgatttaagaataattttagtgtgt

SEQ ID NO: 3816 - DNA, 1009 bp, Glycine max
  Soy_ogl_928 Gm03:37430101..37431109 Cluster 15
gcagtatcatggcagacgcaacagggtctgaataatgaaaattgtggttatgttatcagaatgatgtataatagtaaatagtatatgcacagttgctgtgcaattattcaaattgtgttcttggatcatatatcatattaagcttttcaatatttgatataggcgaatacattgaattgaattcaatattccaatgttgggcgaggacagaaagaaatgcagtaataccaattgtacaatcaatggctaccgcctttgatattcttatttgtgattcaaaccaccatatattcgcttgttgtgtaagtgtttactgattgggaacaacatgataagaaaacaacagttttattagaccagaagtaattaaaatattaaacaaactagtggagtatataaaatatattaaagtaaccatcattgaacacatttataaaaaatattaaagtaaccatcatcatttaattttcggtgcgaaacattttttattgttttttttttaatttagtggtatagtatcacttcacacatgaaactattttaacttaattaataaactcaaattcaaaaactttatcatacgtaatcgtccaaacaaactagactactttataaatagtcaaatgtatataaacatttataaaacaataatacttcttttaaagtataataaaagttttaaggtaataaataataatcattttgaaaacaaaaattttagaatatgagtttaatttgaaccaaactcaatactttagagtaaagattatttcttacttattttaatactatttttaactagcgtggaatttagattttctcaatatacttcttcacccttaacatttttaatgtaatatgtaaataatatggtgtaaaataaattttgatatgtgttagaacgtgagtttatatttaactttaatttcgagagttaactcataaagcgaactagaattgttttccattaatatactttagattgatattatttttatttttctcaata

SEQ ID NO: 3817 - DNA, 1000 bp, Glycine max
  Soy_ogl_2402 Gm07:37747801..373800 Cluster 15
gcttacttatgaagtggtcggcattatatggctttaatggaaaaaaaagtgatgttaatttattgtgaagtaagttgcgcgtgaaaaccattttgttcaattcaaagcaatatttattgttttgctaattatctaatactaatagacatgaactgcccactttccttttcttcaatgaaagtagacttattcgccatgaggctttcattggactgttactgaacttattctacattttttttcacatctatagttttgtttaacgtaaaattggatattaaatatgaatatttcttttgataaaagttcaaatcttattttatcactcggtaaaaaaatcttattttatcatggtgtaaaatattagtttttttttagtagataacgtttgttttacggtacagttttatattttcaaaaatattatgttctacaatgttattctcatagatatgtttgattaatatttagtaattgaaatatatttaattaaaaagtaaaaatagaaaacgaaatatagtagaatgcagtaaaaatatataggtagttattgtaaaaaaatactaacttgtatatcctttctcatgtgaataaaatttacttatgtaactttcctgagaattcaacatatctgggaatatattcttataactttctgataaacatggtatatgtatttccactctcctatcctcgataatgaaagaacatgacgtgaaatgaatgttcctataaaactgtattttatattttcttctagtttaagcctaaacacaaagataatggactactttttttaagtgaattaattgatataaaattgtttttagcttaattaatagttgtaaattctaattttaaatatgtaattatgtgttaataatgaaacaatttttttttagaccttttattctcctcgtcggtctttcgccatgaatctatatatattaaacttttatcaatttcaaatattaatcattggaataaattataaataaaa

SEQ ID NO: 3818 - DNA, 1000 bp, Glycine max
  Soy_ogl_13 Gm09:3519101..3520100 Cluster 15
tggatattttttctcatttatattttttttattcacaaaatttaaacctagttaagatcttgctttagtcaattattactcacatcagcaatttattaatgtacaatttaatattagtttgattttctataatgaaagtctccaaataaaaataattaattgaatactaaaataatatattaattatattatattatatatattaaaaaaatcagggagtgacccccctcacctatacgttggtctgcgcccaagtggttgcgagtagcttcttctgcaactctctacgtggagcaataaagaatgtctaattataaatttaaattcactttttgatccttatagtttaaggattgcttaattttgatcactcaaatattttatttccatatttggttattatacttttaaaatttagtattttagttcgttattagtctattattaatttttaatagaaattattgatatgacatcttaattaatgtgaccttaacatgttaaaataacaaatgatttcatagtgtaatacataagttaatatgatacaaaaacataattttaatattcaatttcacgtcaattcattcgatatcacatcgacaacatatatgtcagattatcactgtcatcttttatattaagatatcaattttaagttaataatttttgttaaaaattcgaaaacagattcatagtgaattaaagtgtcaaaattttaaaaaggcgaatttaagccttaattattctaaggattaaattagataacaatatctaggcgtgcccatctatctagtaattaaagccactatatcaatgattatattaatctatatttgagttcttagatttgtttatttggttttggcggttagccttgatttgtagagggaatatatacgaatatatcacttttgaaaagtcgaaaattgagagaaagtgagagtgatcacagactttctggctagttgccaacataattggatttgagagtcctata

SEQ ID NO: 3819 - DNA, 1202 bp, Glycine max
  Soy_ogl_3025 Gm09:5888801..5890002 Cluster 15
tgtgagaaatagcttattgaagaagatcgaagtttcctctaaaaaaaaaagaagcttattgaagaagcaagcaatccaaggtaaataaaaggctattctacgagagaaatcattaggttagagcaattttttttgttatttattatttaatattttagtcatgacgtgttttaattatatctttattttaatagtatgagtagctaggatgatacacattgaatgatataacactttgatataacctaataaaaggtttaattgctttactaaaatagaggttgtaattattgtgtaacattttctgataatataatgtgagtcacgcattttgttacgataaaataaataaataagcaataatgtttaattgatttattagggtctagggattccttggggtgaaaggctaagaaaaatttaaaaaaaacattgtttcctcctttaagtaaaaattgaaaaataaaaatatataaagtctaacaagaagaatgacttattatacccacggatacttttataaatataaataataaacaagttgttattacctaggatgatccatttgttcacatgtttgaaagattttttgcaaagtttttttaagaaacacatttaacaccccttgtgtttcattgtgcagctacaacaatttttatttaatggcaaattaatcatttcaaccgttgaataaattaatattattattttttatcatgcatatatcaatttttacgtactaaaatgtatttttcatctgtgtaaaattgataaaattcagatttaattcttacaaaatgtttcatcttttttcgtcctcctaaaattttaatgtctcattttttttcttcttgaagttaggttcaccactctaattaccaataatcattgtgattgcaggttgcagcatggatcgtgcaatgctacactatttttaccgtttacaagtaagaagtgatcactctggagggtgttaatcgtattatagcagttctgtcggtgtggaaaatccctattatctgagtgttactgtactgatttaatctatttaggtgttagggatttcagacttaggggatagggatagggctttggcttggctcttctcaagcgatcattgcattttttttataatttataatggtttttaatttcatagataatattttaaaatttaaaataaaaaataacgtaggttggtg

SEQ ID NO: 3820 - DNA, 1000 bp, Glycine max
  Soy_ogl_3146 Gm09:37137801..37138800 Cluster 15
ttgcaatatatttaaaatctcaacgaacataaagtattggttccgttgtgatctgatgcaactctttgccagctgccagatatttaaattactggctagtactctgcccctaccttcttcagttcttctaagttctaactaaacaatagattacacacaaactctatttgaatttaattataattcacttacaatataaatgatttgtactttctgattaaaacataattcataaaaaaaattataaccaagtgatatctacactcttgagtatgactagccccctccttaatcggcccactaaagaataaaatacttccaaatattattactccacatctaaaagggatcaatctcatcacttatgtgtatacatacatacatgataaaaaaaaatagagaaaatgaagtgtactttataaaataaaagttatcttaaaattatcacgatatactttctatattcattttttacttttatcttgtattttaatataattttttaaaaagaataaacttaaaagtaattcaaaatatatttgatgattaatgagaaataattaaagtatacataaattaaacaagtcaagtttaagtttttatgtttttttaataagaaaaattcatatgtataaataaaccctcaactcatacttaacttatttatacttataatagcatctactcttaagtataattttgttgatataattatttaggcttaattctatttttgtccccaaagtttcacaatattatagatatttgtatttctttttttttttttgcaaaatttatctcctaattaataaaacgtcacaaattttgtttccacgtagaaaaatttccataactaacatatttagtgatgggttttcctttataccttcataattttgtgacattttttcacgttggagcacaattcgcaatgttttgtaactcggaggtcaaattttgtgggaacaaaatttatgacattgtaaaattttatgtgggg

SEQ ID NO: 3821 - DNA, 1035 bp, Glycine max
  Soy_ogl_3174 Gm09:386366..38675900 Cluster 15
cgatatgaaaaataaatcagtgaataaactaatttaacctttttttttatccgcaatataatttttttaactagatagaaattaaaatcttaatagcataaagttgtacaaatatttttagaatttaatttaaatatactgatagggtattttttacaccgccattccataataaattattatttatggtaggattggtgatttttataatcagaaccgctatttagcttgaaaaaaatatgtcacgtattgcacgaaattcaaatctcaaataacaatattttttaaaataaacattgatttttttacaagataaatattgattaaaaatagaattatagaaacatatataaaattatttttaacagaaatcacccttcctgtcattatacgaaaaatattttcgtaccaaataatttttttgttttttacaataattattttaaaaatcataactaaatttatttgtaattaattaagagtggaaaaatctttatactaattataatagatgaaaattaaacccacattattatttttgaattaatatgatattaatgcaaaataatcattaacgatttttattattattttttgttgataaatttgacttgatatttagtgagttttattgtttcaataattatttttttcatctatcacacttaagtacgagattttacttaaaaaatttgaatttaatgtcactcaacccgaccatatattgataaacctgtgttactatgcctatctttacaattgaggaaaaaaattcctattgttaccgaatatttatgtaatgctaaattattattaagtttataacttataatttgattccatcaaaaaataacttatacctttgatatattctttgcaaggtaaatgcttattcattaatatgcaaggtaaataattatttaatagtacttttttgttttttcttttatcattagaaatcaaagacaatattaaaagagttacactcaagcacctgacctattcagttaactgaactagatttttttggtgtat

SEQ ID NO: 3822 - DNA, 1000 bp, Glycine max
  Soy_ogl_3486 Gm10:40846901..40847900 Cluster 15
atggtaccttttttttttctttatcaatatgtttaagtaaaaaaaaatctcgtgaggacaattgtccccatatgccataggatcattcgccctcaatgaagttgacttttaatattttagtaaatcatcattttagttcagataaaatgttgtcatactgattattgaaaatatgaaaattcaaaataagttttcatgttgtaaaataagtccttaaatttaactattaattgtcaattcttaaatatatgttaatgatatcacttaagtcaaatatttattttttaaaatttggactaaaagtgagtgacaattgcactttaaacaaatgattttttttaagagattaaaatcacaatgtctcatacttttgagatcaaattaactatttattcttttatattttgaaaaaaaaaaaccacgccttgatatttttaaaaaaatccaattttatagaagactgaaatagtaacatcttgaactaagaaaaaaaaactatcttgaaaaaaaaaaacttaagaagaacaaaacaaaaaccaatagtatattattatgagtttaatgattatatattaatagtgtaaacggtgaagtcaacaaatttatcactaatattaatccgtgaataaaaaataatataacattattttatgacgtaaatgtacatgctattactatagggataaaaaagttgtttcaattttttttttctcgtaccgtacattatgcaaatcacaggggaaaatacattaacttattaaaatagaaattattaattaaaatgagtaaataaatattttaaagagatatttaaattaattttaaaaatacaaatggataatatatgtttgtttcctttaaattttttgaagttcgaaattactttttttgtccatttttttgtatttcattctaaatttgaaatgctctagtccaaatgcgctatctaacggagcttataaagggatatataaactacttttaagaccaaaaatcattt

SEQ ID NO: 3823 - DNA, 1206 bp, Glycine max
  Soy_ogl_3904 Gm11:35526101..35527306 Cluster 15
cataatactgtattttacagaaaacgcatcaaccccccttgttaatttttaaatgtcgccattattcatcatcacaaatcacttcgtagcaacatacttttcagtgtctttggataggaatataagatttgtagaaacattagccatagttggttttaggttttcaattacaatgaagtgtgcaataagctccaaaagtcacacgaaacattttttgtatgcattttaaatttgatggaaggataaaagttacatattttataaaattaaaggattaaatttctctattttaaaattaaaagattaaaattacagatttaaaaaatatgaggactaaatacatttattttaaaataaaaggatcaaaattataaattttaaaaaatagaaaaaccaaaattatattttaaataataagcaacattaatcttgcttatttaatttctagtaacaaaatcattttagtataaattcacttactaacaaaatcatgtgacaaaaaaaaaatataaacaaaataaaatttggaaatcatttatatttgacgcatgacatgcattctcaatatctttttagcaaaattaatattatttagaattgttacacattttaaatatataatttgaaaaaatatgtttcctatttatacctttcgaattgattattgttaatcttttatgaatttgaatatcctccattaataatgtatataactttattaacgattatatattgttgaagtgtggaagaaatgatcatcattactactacttaaaatgttctgtttttttttaaaaaagtaaattactctatttcctctgtgtcttttagattttaacactattattttagatttacaaaatatgtgaaggtaaaggtagttatagatatttagtcttaaaattttaattgtttacaattaaatataaaactaagtgttgctttcggaggatgctaaaaagtgagagaacaaagtatccttaaagctcaataaccttcgccaacacctttcacatctttacctaatcatgaacttaagatgaatcatacaggttacctttatttatataagataagatgtctttttgaaatcctctatatgttttgctctggcaatggctcatgtgagccatgcgcttgtgcacataagatcttaccagcttcatatcaggtacaattgcatgattctgtgtctatgacatgtaa

SEQ ID NO: 3824 - DNA, 1059 bp, Glycine max
  Soy_ogl_5398 Gm16:31853801..31854859 Cluster 15
ctcttccaataaattgttttttaatataaaatttagaattgaatcttcattctatgtaaattatgagtaaaataattcattttttatttgaaactcaaaatggttccactatttcccgctggggtacgtcaatacgtgggtggagttgaaagggcgattcacaacttatttgtcagcccaactcgtattgagccagatgacgagatttattattgacacctcttttagctattagcaccctctttccttagtttatttttttattataaaaataccatacccttcacagaaatgtgtttcccttagttcacagcacaaaatggaaacacatttctgctctgtattcgggtttgtgttctcaatacaaaacagaaatttccgtttggcatttccataaagcgtttgttttgtattttcataatataaagaggaaaggtatttttcttttgtataagatagtactttttatattaatcaaattaatgatcatataatatctttcttaattaaaattaaattaaatatgaattgatttatcattttgaatattagtcgaattaagtatcatatagattgcatttttaaatcgaatttgaataacaaaagttaccatttataatattaatcggattaattattgtaaaaattatcgtttttaatagcaattgaattacttgtattgtaattatttctattactttttaaaaggaaatttctattgctgttaaaaaaatgataacttgtgttgtcattagttcaattttaattaaaatataaaatttctatcacaattaatttcattactagtcattagctttgcaatctcgtaaaaattagagtaggtaaacttgtataaaaaaataaaaaaatagagtgggtaagagcatatgagatttttttttattttttgttttttgtttgcttttttcagatacacataatacataacaatcaaataattatgcaataatgaatataataaaataatacatactaatcaaattatgcaataatgaatatactttataattatcaaaaaagatatatcatcattataac

SEQ ID NO: 3825 - DNA, 1000 bp, Glycine max
  Soy_ogl_5951 Gm18:5791801..5792800 Cluster 15
ccccaaaaccaccaaagtaacaaagaagctatttatcttctaaaaaaacaaataaactatttaagaaaggtaaaaaaaaaaaaaaaaagatcgacctacaagccatcaaatacacaagtctaggcatatgactatcgcatgattgtcactaaatgaaaggaccatatcacctttatattagtgttttttttagataaccttttattagttaagttaatcatttttaatcttcttttatagttagtggttactcattgttttcggtaataattactagacgattcagaaaaaatgattatcttgtattaaaacttttctgttgcaaaataagctaatgttttaaatttatcatgtttggtttattagactaaaattattattggattaattatatttttagtaaacttatatgaatttttatttttagtcaacaaacaaaaaactaacaaaattttcttccatgatatttttatgtgtcaatattataagtctttaccagcaaatttcactgttagatgttagatgatgttattttattatcatttaattatgtttcttgatggttcattatatttttaagctattatgcttaatagaatagtatttttataatctctagtgataggtaaaaacctataatcgcttttgtagtcactcataaaatccgtctccaaatattttgtaattaacatataatggataaaagtttattatagtcaaataataataattgaataacatttgaattctgattaaaagtaatcccttataataattaataaaaattaatcatattttagatggcacaccatctcttttctatcaaaaattctggaaaagagttggtggtgatgtaactgagttggtgctcaacatattgaaccatgatggtgatcctacagagttgaattcaacttttatctcactcattcctaaggttaaacaaccagtccaccctatagtgatttcaggcctatgtaacgtaatcttcaaggtcgtt

SEQ ID NO: 3826 - DNA, 1000 bp, Glycine max
  Soy_ogl_6255 Gm18:58724801..58725800 Cluster 15
ttttgaactcaatactggatgcaatgaataataggttgtatagtttagatcaaaattaccattttgctacactaacctaggataatatcacctttgagaattcaactcatcataaacctctaaaaatacaaggttaccatagtagacaaacatttattaaatatcgttgctctagtgaaatcattgctgacttgagcattaaatatcttttgcaatcagtataatcaaagttaacagtctcatcttagacacgttaattcttaataagtcaatatttagacatggaatatcttaaacaaattgattagaatttaattttgattatgtatcctaaattaaaacaatattttttagataaatggcattcattcttcttatatatattttcacaatattaacatagtgtttggttggagcaaaatgaaagaaagagacgggagtgaggaattttaaaaaacttatattattttgttcaattttgaggaagagaggggagcaagatccttccttgttccattttagcttctttttccaatattggaaggatttggaggggaggaaaaaagagtttaaaatatttcaattgtgataactaaaatattttccttatttatgttttagaatttaaaattataagggttcaaatgtaaattaaatttttaaatcctttccatctgcttgtaaaccaaacaaaaaaaaggattatttctccatcaaaattcctccccttccctcttcttaaccaatcagtccctaagagttagtctagatatataactaatcaaatcaaaaggtcaaattgaccataatcctgttaagttgataataatttactttattgtaaaaaagattccgatcacgtataaactatcttctttatattgatttttatacaactaatttcattttagagtttaattactatggactattgttataatttttttacactatcaataaaatttttatgttgatgtaatatttaaaataatcattttaa

SEQ ID NO: 3827 - DNA, 1098 bp, Glycine max
  Soy_ogl_490 Gm02:11335303..11336400 Cluster 15
tatttgtgatcttcttttaattttaaaaatacccatatataatgttatataaacttatttcttaaaaatcatatcactgaaaagttaataaaaatattttagatataatctaatataaatatacacgagttttataaaatggttcctatagttttatttttctggatttatatgcttatatgtagcttttttaaaaaaaaaaaaaaacaaaggaagactgagagtgccttcaggtaagtagtttaattaggaacatacccaataagtttatcagatgaaagcttatattataaacttgatcatgatatttgttgaaatggactaaaaaaattattttgattgctatgatttttttgttagaagataaaataaacttattaaaggttaagaaggtgtttaaaaaaaaattatgaataatttataattttttatttttaataaatatttgttaactcatttcgaaaattttcataaataaatttatcaaaataaaattttctatttattccaatgtttcgtatatctaattagaatcataaaaaataaaaaacatgtaattgaattatttatccaaatacatcaaagttactttcataaaatcaaataaactttatatagactcttaccaacaccctcgaagtttaagacaaacaaaaagaaaataaaaggctggatggatgttaaaattggtaatatgatggaattgaatgaacgtcaacttttttctcccaataaaatgtaggtctagacattgactgcacaggctaatgcttatgtgtccacatctagttctacacagtgaaaagttaagttgaaatgaaaaatttcaattaatttagaaagcatatgcattgactataagattctcacgtagtcacgttagcataacttgaaagttctagtaaatgtatgattatatatgtgtcatattttgaatgggataaagacgttatttcaaacaagttctatagaatattttgtatatagaatgagttaacccctaaaggcctaaatactccaaagatcgacgcaacaatccacacccttgctctaattaatccccatttcatatgtaaaatactcaattatttaatttgt

SEQ ID NO: 3828 - DNA, 1173 bp, Glycine max
  Soy_ogl_878 Gm03:34770801..34771973 Cluster 15
tatgtttgaactactttattttggcttaaaactaaaaataaaatttttaaagtaaagtataaagtagaaattatttgttaactttagattaaaatttcttttaaattattttttgttgttgttgtattgtgtagtttggaataagagacaaaaaaaaggctatgtaatttattcttaaaagttctagttagattttaataaaaaaaatagtttctcctcttttttattaaaattaaactccttaattgtatgatatttttatataaatgtgtttaatttaacttctcttttagcaagaagaattgtcaacggcaaatcaggcatatagtatctaattgttatttttactttataaaacaaataaattaatccttgattttagttttattattacatgtaatttttttaataataatacaaagttgaaacattctttaatcatcttttttctctcttatttttacttcatctttcatcttaaaacaatgtctattaaatttaaaatattgtaattaatatgtaataaaaataatcaaattataaatgaattaaataatttagacttagcattcataattttaaataaatgaagtacgagatttaattggatttatcttgttaaacgaatactagctttctggtgctggcaaatcacccaacaaatccatgatttttatgtggatacgattaggtaaattatcttttgaattgatgtggaagagacataaaactgaaaccattaaatattttaactataagtaatcaagcaaactatacacgataattattttcagatgttaaaattctattattaatgttgtctaggggcttcagcgtcttatttcacacaaaaaaaaaatattatatacgttgtattcaaaattgatcatgttggtaatcaagcaagttaaattgaaaagtatcaaatgccagcaataattcttagtcatattttattatttttgtcaaaaattagtcattgaattagttagaactattttttcctattgataaactgtaggaggagagttaaaacaaaacaaaaaattctaaaaagtaagattcagtaaaggaaaaacatatacacaaatttagacattaagtttgttttccatggtataatttgacataatggaaataaaagattagtatggatatataatatgatgcatc

SEQ ID NO: 3829 - DNA, 1686 bp, Glycine max
  Soy_ogl_1625 Gm05:28958715..28960400 Cluster 15
tataaaatgatatcgcataatttaataattaaatttatcaaaatattattttaaaataaatattacactgaggacgtgtatatgtggtctatctttattttttcttttgaaggaatacgatgtatccttataaagaaaacaaaaaatgagatttggcgtagctagcttcgtattaaaattacacgtgaataacatgcatttgactcccggttccagttgaccggcgaatatcctgacaaaatcttacaggctagttcctttactttcgtgtttcaaccatctctcataaaataattttcgttttgtttgttgtttgatgattgatgttatccggtaaaataatatactttattaaattttcctttatagtgaacatttaattttaaataatgtccggtcctttatataaaaaaaattaaaatttgttttcctaagtatgagaaacataaactaattaatatattaaattttcttttatatttttatttagtctgaagtttattaataagacatctactcattttacattaaagttgatgtattaattggtcgattaacaatataagtcacacttattagcttataatatcattagatataatcactactttaatcatctaattctatgaactttttgaaataaaatttaaaatttggatattattaattaaaaatatatttttttatctctatattttcagtcaatcttgagtttatttcttgtgctttcaaatcgatgttttaatccctatacatgaaaaaaaataagtgaatttagttcctgcatattaatggcattagctctgtttatgatgtcgtgatttatggtggatttagtgttaatctttttgtgacaaacatatttttgtcactgttaataaaattatagagataatttattttgttattattatgaataatattagtgacagaataaaatttagtcactagtaatttagtatcaagctttattttcattattatttttaattcactaaaaatcacattgtttctggttaaatactctaaaaattaaattttaaaactttttctaatttaataattattgatggatttatcccaaatgcattcctacaaccctatgctacaaagcacaaagaaaggagacaaattttaaaaccagtagctgcactaaaagccaccataggatcgtgaacaagtagcttctccccaatctcaaattttcgtaacactataatatttgcaacactttgcattgccctctactacataatctcttcaacgccacccagtatattttgtgcttcttcattttcttcattcccaccccatcaaaacaaaaattaaacaaaagtttataaataataccttttagaatctgaaaaaatggaaaaaaaataaatgggaaggaacgacaagactgatttattaattaggataaattaatcaataggtgtccttaatcttgtattttttttatggtttcaagccacctcgaattaacttcaatgactcaaaattacaaaaaaaaaaaattacaagattaaagaactggttactttttttatttagaaatgtattaattaaaaattgttaaataattcataaacctactaatttatttaacctagtatttaaaaacccacctatccctaattgaaataacttctaaagtgaagaacataatataataaataaatagaa

SEQ ID NO: 3830 - DNA, 1200 bp, Glycine max
  Soy_ogl_3808 Gm11:9075301..9076500 Cluster 15
tcttaaatgttttcctataacttgagtcaaacacaaagtaaaagcgatcaactaaacaaagttcaactaatatgatttttctacgtattaaaaaaatgatggattctttgattcatcctagtatatgtgcgatcaaggtaatcccttcctatccactctgccgtcttgccacgtcaaaagaaaccattactgattatccactcaattacatcagagaggactatgcagtagaaatctccagtgccaatccaattgttaatatatatttttatattttaatatttgccaattgttaataatatttccctttgtttaatttgattttttaatccaaacaaatcaaaaacagtattaagatacatcatgataaattatttgcttaacttgatgtgtattacacgtctaaattatctctttcatctaaatatataaattaaggttgtcatatagtctaatttgtctaatattgaactcgaacaaaatgtccaactgatgtacttttaatatgggtataaaacaaaagagataaaaataaaataactacatatataattgaatactaattcttttaatatctaaacaacaaaactcaacaaagaatgtaatcagaagtcagaaaattaacgacaacgacaagttaattattaaaaaaaatgttttacgtgctttctcattactttttaggtgattcgtgataatgcatctatactttgaaaaacataagattaatctagtggttaaaaaggatgaatgaataagaaagagaaagattttacattcaaattcttccactgatattttgacaaaattaaccaactaatattgtggataaaaaaagaatgcatctatactttgaaattatattcattaaaaatgtgttagctatatatatccatcaaagtcatcacttcacatgttgagaaacgaacataatttgtgttgcaatagtgttttaatgggtctatacttcgtaattaaattcgtcaacttgatgtctaaaactcatctcaaatttctccatcaaatcccatcttttcttttgtgtataccggacataagacaaatagcgttttctccatataggtgatcttttatattttctaattttctttttaaatataatcaacttaactgccataattatgagttacttcaacatccaccagcttgtcaaataagcaaattcgaattttctctgct

SEQ ID NO: 3831 - DNA, 1100 bp, Glycine max
  Soy_ogl_4058 Gm12:17128501..17129600 Cluster 15
ataccttcaaagcaatttccttggtgttttctgattgttacctcttctttaatattctactaaaagaatgataattgaattatttaaacccttctttaaaaagatatttttgtctataaaaataagaaaaaaatttcataataaacagttctgatttttttgaatccaattgtgctccttgcaagacattcacgaacttgtttctacaagaattcttttttttttttacactcaagtaatgtaatttttaagtactatatttatttactttcttttttacctgtttaaacaagtaaagaatattataaaaaaagaaactaaaaaatatttttttcctcataaaattaaaaatatatatttttcgtgctcataaaattaaaatgtaataaattttgactccaaaataaaattatgatatatccgaacctatatcttgtggcaattgaattttttagggttaaaaacagccctaaattataaaaaactgtcacaaattataaaaaatacaagttgcattttcttatttattcttataatttatcatatttttattatatttgtgatgatttttaacctttaaaaattttcgtgtaagtttatatttatgtgaatcttattttagatcaaaatttaatatattttaattttataagaacaaaaagtatactaatttttttacaaagaacaaaaaatatatatatttctaatagtatgagaacgaaaaacatattaaaaaaataaggaaagaaaattttcttcattctcttctttatatatatatactctcaaataacacattttttattttattttccttttatttctctctcttctatttatttccccctaaaccacagaaaaacatagttaacaaaatcgacaaaataaataattttcaacacaaagatgtctaattaagagcaatttaaaaacaagtacagaataaaaaaattaagagatgcactgaaattggtccacttggtccaattttgtacatacatcccaacacatctcactaatttgtttgtgtcccggaaacacatgttaatatataaacattttaaaactaaaatgccgaacaatattaattatacatacaa

SEQ ID NO: 3832 - DNA, 1042 bp, Glycine max
  Soy_ogl_4077 Gm12:33729301..33730342 Cluster 15
ctaattatttgaataattaaaggactggtgtcatatatatagtagtcattgactctcaaatagcagatatgcacaccaacttttctcaatgcttggcaaactaagctgggaaaaggatttacagcctgtgaattgtgatcgcctaaatgcattaatatagtaatattaattaataccaattaatgtacaaaatttaagtataacattttagatatatatgacccttcaatcaaaattagtagaatttttcttggtcgatacgaaattaacattaaaagttaattagaatgatttcaaaagtttgctttatattgcgcatacataatttgttctcaactaaaagcattaataatgaaacgaaattaacattaaaagttaattagaatgatttcaaaagctaattacttgtctaacttttcgtccacttgtatcctcttgttgtgtgtctttaatttaaaatacaatgctgattgatattacattaattacataaagttaagggaataatatatagttaaacatgtgatctaattataaaattcattaaattgaattttgtcggaggatttgcatcttagcggcgaaattttcgtttctatttatttgttattttaaaatcttattatatccttaaaaaaagtatatgaaatgtcaaaataataaataagagagataaaaacatatactaaaaattacaaatagattttttttataacagatgaaagtaaaaaaccaaatacaaaagtcaaggatggaattctcaataaataaataaaattcttgtagttaaaattaatttatgaataataattttttacttcttccgtttaattttttaacaaatacctataatattaagaaattttttgagaatctctcaacatttttgtcctgacaatataagtttataattaaagaaatttgcaagctaaaatctaaattaaattcgcggcgtaaatgtgttgaatgattgaaaaggatagaagagaagggtttttcagagaaagaaaaagacagaagagaaaagtcaaaacaagttctc

SEQ ID NO: 3833 - DNA, 1265 bp, Glycine max
  Soy_ogl_4079 Gm12:33835901..33837165 Cluster 15
cccagattaacagtttgccctcaaggagaaacataaatttagtttattttaacttgttagagtaatttgttgcaactatatccaaatcagtggctttaagcatgcgtaactcatttgtcctcgagatagtgaaattcatttaaaatctcttacaatagatgtttttctatatatatgaatctacaattgaactcctaatcatacctttaggagacaagattatttgctaaccatgcacatcaagttaattgttagcattgttataatactcttcctttagcatcgtgtgcttttgtatgtatcattagacattcttaattaatggccatttgaaagaaaagtttattttataaaaaaaaaacacataacaggtcaacagcagaagaaaaaccagtttcaattaaagaagagactataaataaaagaagtattgaaaaaaaagaaaattatttcgattattttataaaaaaagaaagaaagaagaggaatacaaatgagtgaattggattattccacggaacgcggagacttgaagaaatgcttgattatatatatataccaaattgttcagaacattaggcagagttccacctttatttaagtgtttacttggattcaagcactaaatcaagcactaaaccgttccatggtgaacataatattcaatttctcttctaagtcaggtttatggggacatcacattcagacttgttatattgagttgtagacatctagattaagaaaaaaaaagtccatacaaattatttaacagctggaaaaggaaagacatttagtcttttaactgagaattttttttaaaatataattaaataagagtagtaatagatatattggagtgataatcacgatagacactactatcactcgcattcatcaattgctactaccatttaaatatttttattattatttaaatgatcgaatattttagataaattttaaaactctaatgaaagaaaatcgaaaattacggatgaaggtagagcaggcaagattttataatgagtctgacgtgatatatgaatccaagacttaaatttagtttgtttacttgatatgtgtcattttctaatgtttggtttgacatatggaaataagtttccatatcgtgctatggggtgtcaaatattttgaaaaaatatacataataaaaatgatatttcgctatgttatgaggggttaaagattagggatattcttaaatatatgtttgatttttttggatgatgttatgccacaaactc

SEQ ID NO: 3834 - DNA, 1197 bp, Glycine max
  Soy_ogl_4762 Gm14:42782101..42783297 Cluster 15
aataatcttatttggctcaaattttatagcgaaaggtctccaccaattagtgaatttgatacggtcatttgactccataatataggtaggatgtttgtagtcaaagctgttaaacataaaaggaaaacaagattatcagaacaaaatagaaaaggaaaagagataaaatatagaactttaggtctttcacagagagcggaacaaaatcaataaacactaaaaagtttaaaagcttttacaaaccttattcactccaataatgcatctattggattacaataattaagacaaattatatgcatgtagtaggattgagatcaaaccacttattaaacaaaggcaaaaaaaaaaaaatgatgatgacatgacacaagaagaagaaacaaaatatagatttcctgataagatatagttttaaagtctttccttttctcttaaaccctctccgtgtgtatgaaactaattttgacttgggagattatattgttggtctctaaaaaagaatcatgacattgtaaaaccctaaattattttcatgacatacacttcattcttacacttcattctcttataatctaacattttaaacaagtcatttatgttttcttttgcatcaattatatacttttagagtaatttaattccttgtgtttatcttattttgttcactagatcaaaagttgagttcagatcatctaaaatgtgcaatatttggtaaagtatgataaaattacttactcgtataatgcttaaactataaaaatttaccatattataatcattatattcaattaaattagatttacttttatgagtcaattttattcaatctaaaaacgtttttcacataataagattgcttctccagtggattttttttgttcaatacccaaaatattacttatagaaagtaatgaaacatctattagttgagttaagtcctttttgccattatttttttttatttttcgttatacttgtatactttatgtaaactaatagatgttttatgcataaattacaaaaagcacacttacattaatgtgataaataactttatgaataaaataatgtacgttaataatcatatctatttacaattcaaaaaaaaatctaacttatatgtgatctataaaatcatttttatagaatacaaaaggttaatatatcaattcaactaagaagaaaacattcaag

SEQ ID NO: 3835 - DNA, 1300 bp, Glycine max
  Soy_ogl_5047 Gm15:14539401..14540700 Cluster 15
atattgaccttgaatatacaagtgtatatactcaaggaagaaatttgcttaagtaatcttacctaactcaaataaaattacattccttcgtctcttttatctctatcaaatatgtgatgacccaaatgactttcctttgcatatataccaaacaaggcagtattttaaacttagtaaattaagtcaatcccaatctttgatttatcagatatttcacaattgacacaggtgtcgttctttcaagtaatgttaataaaataagagggtttcattgatttaattatatataaactggacacttaccaaactcactatttagtatgagtttgagggagaatggggagaatattaaaataaaaacttgatcatacatttatacaccttttcattttagtttttatataaaaaaaattgcattttgatcctttcatgaaaaaaattacaaataaattcttattatttgttgagattatctgaaatatatttattttatttcgtacaaaaacttatatttaatttaatctttttcataatacaaataaattcttattatttgttgagcactacacactagcttgtaatggaaatccaaggtcatcatcttcatattctccttttatgcacatgcccaggaaattgcaccctttcaagtttcaactttattaattgtcctatatacaagaagtaaactaaagtatcattttttaaaaaattaatttttaagtatttgtgtttgtttaagttaagaaagactataagacatctcagtctgaaaattgtctatgtctggttcattaatggtgttttcttcctatttctttttctaggcaaattctatttggatataacttaaaataatttaccttgaatagtggtatttttagaaattgtttttttctttttgtctcaaaaacattttgatgaggagtttttcttaaacagaagtatttttaagttttattattactctaatttaaacacgtcttattataatctcgtatattgagcatctttttagaattttatttctttcaaacatacttcttacttttaatttaaaatttaatttgatataataactaatttaaagttatgtctccacatgcagaacattttaagaactttttcttaaatagaagtttgttattactctcgttgagacatgttttatcctaatttcttatattaagcatttattttttaaatttttattccttttaaatatatttctcaatttcaatttcaaactaattaatttgatataataactaatttaaagaattgtctcaacatgaagaac

SEQ ID NO: 3836 - DNA, 1100 bp, Glycine max
  Soy_ogl_6007 Gm18:9159301..9160400 Cluster 15
ctatacatgactttattattccttttctccatttcgttatattgtgaacttcgactttgtatttaagacatttaaatatgtttttaatcttttaaagttgagttattttttttaattcttcaaatttgaagttattttttagtgcttgaaatctgtaaaatacttttttcaatctttttgtatagcatgagccaaacatagaacgagacatctgcaatttatgacaacttttgattattaaaatttgatttttttttctctgttatattttagcttctggtggttaaaaatatcataatcaagtcacaaaaagattaataattcattaatcgttttaaaaactgttttaattttttattggcttgattttggcaagaaatagcaacttccaatttaaagggttaaaaagaaaatttaaaggactatatcactaaaatgattcatcatcaagcacatcaaaacatttgatgaaagcaacatgtcctctctattatgatgtgcgaagaagtgtggcatataccagtagaaataagataggtgaaataagactttgttttaatatatttagtttttttaaaaaaacttgaatatctcttggttttaaaaaaaaatagagaaaattttatagtaacatccgtacaaaaatatactagtaaattttattaccataattctaacaacacactctatttaacatattttataataggttaaactttattgaagaatacaaaattaagggagaaaataaataaagtgagactcacaaaaaatgtaattttaaataaattttagtcaataataaaaagtgaacaaaaaaaaaagtatgcttttagcatttttcattacaaactcttcgtgataagtccatgcactccttttttttttttttaatttttgtagggaattactatatgtggctgaatccacaagtaaatctctacatgtaactttaatttctgtgtaattctttaaggttgattatttttttcactttggcttaagggatgccaaaacgggtttgactcagcagattgacttgtgtagtccatccaaacgagttcagtgttggtttgaaaaattcagtccttcaacccacc

SEQ ID NO: 3837 - DNA, 1208 bp, Glycine max
  Soy_ogl_6711 Gm20:28387701..28388908 Cluster 15
gaggttaaaaacaatttttttaaaatataaatactaaacaaaattagtatttacacagttttttaacttgtttttagttcttactatttagtaaaaagacaggtgttgtcacgcctgtgtggctgtacttttattttcctatcgcctttctttgagttaaaattgatatatttttacaacttatttcattatatctaaatattaatagtattttaatattttttatattgcgcgcatgtgaaggagctcaatgatgaaaataaaatttaaaaaaaaaatgaaagaaggtaaaatccaccaagtggccactttgaatgacttaaaatattagtaactaaaaatagtaaaaacaggtactactcaaaggatagaaatataattttgaatagcttttttaaattttattattttgattttttaaaaattttattcaaatataattttgagataactagttatccacatgtgaaatttatgtatttgatcattattatttaaatttttattaattttcttattgtttcatcttaactttattatttcgtcctattattgttgttcatctaaactttattgattttcttattgtttctatctagtgttgtacacatttatatttaatcattacctatttacacaatagttaaattagtaaaccataaatcaatgccttcaacttatgattatcattgatgtgatttataaaacgatgattgcatttggttgcattttctagtttatattacttactgagtttaatatttaaaagtatccttaattcccttgataaaaataattgctccataatttaagtgctgagtttttgtcaaaaacaaaaaatcaagtgtagtgttaacatgtagtcttgccactaaagaaaaaattaaaaaattaaaaagtgagattgttctcaagcaaacagagggcatgtattataatcatgatttgaatggaagtaatgatagaagagattttaggaaggagatttctcttcaccaatacaatacacatcaatacaccaactacaaccatacaaaaaatgagaaagaaaagaaaaaagtaagatgaaaacaacaaacttgcggaatatattccactcaatttgttgcaacaagaatgaaaaaaagtgaggttgaattaaccccattgatgtaaaagtgtcggaacatgttgcaatgttcatttcctacatgataatcgcacaacat

SEQ ID NO: 3838 - DNA, 1075 bp, Glycine max
  Soy_ogl_479 Gm02:10533801..105321 Cluster 15
atcccttaatttatttattaagtttaatttggtctttttatttttaaaatgttcaattagtttccttttttttaaaatagattcaatttagttacatttttcttcaataagctttgaacattttcaaaaaagtagaatcgaatttggttttcaatgggacaaattgaactcattataaaaaaatcaaggatccaattaaaacttttaaaaacaaagggaccaaattgaacataataaatcaaggaatcaaataaacctaaataataaattaagggactaaattgaaaattttaaaaataaaaaaatgaaattaaacttaaaaattaattaaaggaaaaaataataatttaagcagattttttcaaaaaaatctaacacaacgaatatatgtttctatagtgttaattttttatgaaaaaaataacacaatagaaacttattttcattttctattgtaaaccaattaatacaaaacataattttgttttgtattgtcttggcacaccaataaaatgaaaacatatttccattgtgtattatgaataatgaaaacatgttttgttgagggtatttttagggggaatttcctacacataagcatggaggtaaacttagcaaaaaaatgtggagagaatagcaaagcccacctggattaaatgggaacattttttgagtttttctttagcttattttttattatctatatttggcttgcaaaataaaaatagtataacacaaatataaaatacactcattttgttcctatttataagacctaataattatctaattcaccaaaattaaaaaaatggttaatttaatttaaaacaaaaaatatcttaaactttttttcaaaactatatcattgtcattatacttacctttctcccttctaattgtttgcccttacaccctttattttaattagagatattttattttaagaataattaatgcatagtacattatgagttaggtcttataaaaaggaccaagcaccactctaattttggtcttagagtatcgaagaaagtaataattttaaaagttataaacatgatgtaattacaatcta

SEQ ID NO: 3839 - DNA, 1328 bp, Glycine max
  Soy_ogl_583 Gm02:39545801..39547128 Cluster 15
aataaatgttaattgatagttttaaatatgttcatataaatagatgcataaatttaaatagtcagcttatatattaatgattgacttttttcctatgcacaatgtttgctttattccatgcaaacagaatttaaaaatcgaacagacagattcaatcatctgttatcattatgccttctaatcttcacacccataattttttttttgggagtatctcagaagacaatattttcaaaaaaactcttttaattatatatatgttatcaaatttgactaaaattgaaatcgacacattaaaagttttgcagtaatttcaatggtcatatcacgcatatcaatggacatacacgggggaatagttaagcaaaactaacaaaaacaagaaagctgagtgacagctgtggaatcttccaacatctaataattatgaaggactactttacataaattattttaattttaacaatagttatactttcaattgttataatataatcacaattttttataataattgttccatttaaaaaaaaattgtaattgtatattgtatatttgtatagataaagaaataaatgtaaacattacttttaatacttactgttttttgcaaaaaaaatatgaattggagattataaaaaatatatagacaaatataattaatacagaataaattaattttaatattataatattccattggtaacctggaaattttatatgaaagtcaaaatccaaatctaaacatttaatttgtttttcaaataataatagtttatattctaaatacattaagattatatccttctatataaaaaataatatatccttaaagtaaaaattaaactcatatttattacgctttagaatatttaaataaattgaaattaatgttgataaatttaataatattcaacatgttacctttaatataaagataataaattggaataaacaagtatccttaaaatatatgacttagagatggggatggctattttttatatataaaaatcagtacaaaaaatttcacttaattcatagaaatgaataatttacttgaaattatattaatatttaaattattttagtgaaattatataattttattataataatttcaatttaaaatgtattttttaatggctgtctctctttctctacttaaaatatttattgaatattttattttacaaaaataaaaaacatgaagaaaaaaaatatcaacttaacttaccaaaaagttagatatataaaatattcattttaattatttttttctattttattctcaattgaataaattattcgatactttcttctaccca

SEQ ID NO: 3840 - DNA, 1232 bp, Glycine max
  Soy_ogl_634 Gm02:43689834..43691065 Cluster 15
aatacgaaataatggggtaggggcctaaaggtaaacttaagtttacatagttataccaaaaagatttaatttagttgtttaaggaaaatatgagttgttgtaaactattttagtatctgttgtcgatttctatatgaaaaaagtataattgtgccattaaaatgagaccaacttgtataacgcataaaaatagtaagtggagtttacagttagcatgctttactcaatccaattatgaagatgggccaagtggactcggtccttatatcaaatgattataaagacattaatcacgattaaactttttattatctaataaatattttaaaagatttttatttaaatttacggtagctgccctatttgtaggaaataaggctttggacgtagtctagctaggctaattttataacaatcctattaaatattaaataaatggctttacctctcacgtagtgtaaggttggctagctaaaagtaaacatctgagcaaagaaatgttatagctaggttacgtaaatttaatgttctacttttacctataatcttatcttggcttctaagacacaagttggactagttgatacgcacgatatgtatttcactggtcttaatgaccgtagcaatgtataagcttccgtatttaatttctcaatttgccaggattaatatacacatttccattacacatgcaccacacaactcagttcaagtccaattcaaattgtttcacttgccatgaaactcttagtataacataatttgcttccttgactctatattaccattcaaacttgaattgtggatgattttgttacacgagtggaatgttggtagcatgacaatggtggtgcttccgtatcatgaatatatagctaggcaagttttgttttgtgtaactaagaagtatgggatagttctatttgatatgtaactaattctccttgagttgacctattttaagaaaaagtgattcctgtggatttaactctattattaggccaaaaattgaataaaaaatttgatcgagattcaatattagaatcacttttactaataacttttgatattattagagatacatttagattaatttcattgagtcgatctaatttcatctagactcactctattactaaattggagatcaaatcgtaaaatttgattcaaaaatttaattgtccaaccacttaattatatctatgattttttatattaataggggagctttc

SEQ ID NO: 3841 - DNA, 1000 bp, Glycine max
  Soy_ogl_885 Gm03:35762301..35763300 Cluster 15
taatcaatctttgttgacaacttaatttcattttattatattatttttatttacaagattcaaactcaaatcttaattaaggggatcaacctctgttttactcaatccttgttgatattacatttgcctattttatgtttactttttaaaataaataaataattttttaacatataatgaataattttattacttaggaaaaaataactttttagtaaaaaatgtagttgacatacaatttttttatacaaattatttatttattgaatttaatcttctattcatccaaaaaaatagagagaaaattttataaataaaacaaattaatcacttattttttaattttataaaatttaaagaataaatagtgtattcactaaaaatataaatatatttttttacgttatcatccaacaatccatcatggattgtatgtttattgattttatataattattttaaaagttataacaaccatatattttttttattgatttgtattattctttttttttactctaacagtacatatataatattttttccagtaattttatttttttaaaatacattctactatgacattacttattttttttaaggcattaaactcaattctactaagtgagaagaaaagcaccacgacctaagtttggattggcccattactattcgaacctctaagatataagggctttgttatttccagtcccatttttattaagttttcactccatttttttaatatttctttaagaaaaatatcattgatggaaacatatttctattgttgatatcaacaatattttttcaagatatataatgaaaatatgttttgtcgtgtatcttgataaaatattgtcgagatacacaacaaaaacatatttttgttgtgtatttctataaatcttattgagatacaccatgaaaatacatcatcattgtgttattaggaagtgtgaatttataatacacaatataaatatgttttcgtcaatgg

SEQ ID NO: 3842 - DNA, 1031 bp, Glycine max
  Soy_ogl_888 Gm03:35878605..35879635 Cluster 15
caagagattttttttatcaagaataattctttataaggagtcgctcttaaacgaacttaaattttctttaaaaatatagatctgatcttatttttatttcaaaattgtaatccaactcaaatcatggagacgcggctgaaaaaaaactcgggttaaattctatgtgctacctgtgactagaccgttccataacgagtttgattaagtcatggacacactctgagatattattgttagtaaaagatcttaattagtaattacaatgggttgggaaaaaagaatctaatccacctcataaattgacacaactcatgtgaggtaaacttgcaatcaagcagtgtaagggacttgtgtctaacttacaaatctgtccaactcaatttatatttttgtgttgaattattgagttgggtttgcttttgtttaattaacacatccaaataaatttagatggggttatgggttcttgagttttaaagtcgattaaattcaatccaggcagattatataataaaaataataactgattaattttttatgccgtatgtgagagaatgtgagtaattaaaagtaaaaatgtgagttgtaaaacaattttaatgattttactgaatactaaaatttaagttatataatgatgaagcaatgaagtaaaacttgagttgtaaaattgttgtgtaagttttatctaatagataaagattaattataaaaaaaattctcaaatcaaccatatataatcaaatcaatataaaaaaagataataatatcatttggttacaaatgtcaatatttatcacctttaaaataacaataatatattataaaagaaaaagatattaacaagggagatagataaaatcaaatattttgttttaaaaaagaaaaattataattgtttctaggatgaagactataaaataaaaataatattcataaaaaaatagtacatatgtctaaatagaaaaaaatatattattatttttgtaataaatactaaaaaagagaataaaatattttgtcaagaaata

SEQ ID NO: 3843 - DNA, 1000 bp, Glycine max
  Soy_ogl_1329 Gm04:40644201..40645200 Cluster 15
aaaggaagtatattaataggatttaagaattaaaagaagaaaatatttattataaaaattatatgagaatacaaaataagtcatgaataatacaattgtacatcccaataaaaaaaattcttcttatccttaaccaatatcctaaggataatagttagtatttatcatattaataatgatgtggaagaatttttttggggggttattttttaagagaaaaaagaaagtgtattaatataaaagggagtggaaataaaatttgtctaacattttctaaaaataaagtatcaattagaaaaatcatagtgaccaatttttttttttgtcatttttatgtagattttaattgtggttgttttataccttttctttttaacttttgtgaagatttagggttagttggtttatgttttaagattattttaaaaacttatttatttatcttttataccttttatacaaccaaagtaggatttatttatttatttataattatacacataaaatatacctttttattgcagttatttatattttcatttttattgggtactaaattaaaagcttgaacaaatgtgttttgtcttaacttatcttagaattgtctttttcttaaaaaaggaagtgtagaaaaataaaatttaagaaaaataatttttttttaaaaaaagttaatcaagaaaagttaaaaaaaaaactgtagaaaaagttaactttttatgagcttttacctctatttctcttttttttttcaaattacaaaattgaaggacgcactacttcaaaaaattcacttaataagtaatttctatattaatatattttttattttctatttttatattattaaaaagtaatttaattaaatacattcacaatgtaaagtttttcaaattactattaaatcttaaattgagatattaattaaaattgttgactttttatgattttactttaaaaattatatttagattgatgattaattttttgattttttaaa

SEQ ID NO: 3844 - DNA, 1000 bp, Glycine max
  Soy_ogl_1344 Gm04:42221701..42222700 Cluster 15
gagagaaaatgtcaaaaataacatttatcttaaattaaacatgttttagtcaatctaaatatacataagttcatttgaatccctaaaacttcttttagttattattttttaaaaatatatgaggtgtcatttgctctttaaaaaaatgtcaacttttaattatttataccacctttaatttctatcaatattataaaattttatttcttaattaattaatgatatcaattttagtcttataaatcaatcaaagagagatggaattcaagagagaaatattctttgaactatgaaatagtttttttttttctaacatcttcaacacgcttcaaatttcgattaatttaaatagagttaaagtgcatactttcatttgtaaattttatacttaaatttgaagttcttatttaaaagaaatttaaatccttataacttatattataaaacatttgtaacacaacatgaaatataatatcattatactaatatattttttaaaacacattacttgatatatacataactcatttagacttattcttgaaataacttgattcattctaatctcactgagagtctaatttcatacatattactaaaaatattttttactctctaagtatggggatatcattttaaataattattataaaaaaacaataatctttccctatactacaatatataatttgatgagagaaaaaaaatatttatagtatcaatatcttttaattaaattcataaaaaaacataagtaaaatcttaatttaatttactattacattgaatgatatcttcaagaaaaggatgtgtttgtcgatcttgaataaatcatctaagagtcatatcatctatttttctgttgtccaaatggaattgtgatcttgaaatatatctcacgagtaaaattagccatataaaattttaattatcttttaagcaggctttgatttttatcacttaaatggaagtagttattaataccaaaaaaaaagtggag

SEQ ID NO: 3845 - DNA, 1181 bp, Glycine max
  Soy_ogl_1979 Gm06:16092420..16093600 Cluster 15
tcttttcattatgtgatttgatataatatttaaagaattaactgatgtggtacaaattggacataacatggtagtaaataaaactaattaaaaattataaaatatttgtactataatgacataaaactatactctaactatattgacttaattattgtgttgatgatgggtaaattttcatttttatgacaacaataaatcaataaataaacattttcatttcaagtaaattaatttaaatattgataaaatcaggataaaaaacttgattctaaataggacatcgaaaacccaagtgactaaaaatatatatacttttcctgcatccaaaaattgcggggcttacttaatttagtgcatatcatgttgtttttaaattttgaacatatatttaactcattaaaaatggatatgcatgaaccttctcaagtatcttagctattctttgaattttgacatatgtcttagaaagttcttaagataacacttaatctattttttttataaaaaaaaggagtataaggatcttggattacattataattatgtcagagaagaaaatagctttctttttcacatttgtgaaagcctccactacttgtatatatatttggatgtctcaaatccttgcttattggagtgtgactgtactacaggtatctttggttagtttggcgaatcatgatttacgaactttttgaaataaatggtagaacattttatgttggacacttggacatattttgatgtagtgatgatatcatcatatattcatatgctttgaaggtgggaacaggaattaagtgtacgtaaggatgcaacttgtactgtaaatgatatacttttaggggccgagatttgatatcacgatatcctattagtctgatatgtaaggtattatgattcaattcaagttgaattttaattaattattatttctattaatagaacacttcataaacaaagtaacctttcacttttttatttttatataaagttatttttaatattgatttaactgaactttactgtactgcattcatatacttatatgatatttctgattaagagagacttttatattgaagactaataaaaatatgaagtattatatttaatttttaaatctgaatgagtgttgatatttagaatattaaaataaaaataagatgtgccatgta

SEQ ID NO: 3846 - DNA, 1049 bp, Glycine max
  Soy_ogl_2342 Gm07:15042276..15043324 Cluster 15
agaataagcctccattccttttaaaaaaaaagagagagagagaaaagaataagcctccctctttttcaaaacaaaaaaaaaaaaagagaaaagaataagccttcctcatttttttttgtaaaaaaagagaaaagaataagcctcccaaaaaatataagtgttagataatttgcttcgtgaaagattttagaggaaaaaggaataatgtaatattttaaaggggtgaaaaaaataagataaaattaacgaaatctaaaaaaaagtattgaggtaatttgtgtgtgtttgaattgataatgataaaattaattttaaataaaattgattttacacaactaattattattgtccaacacaattgattgtgaaataacattacttttatttggataataaatatcagaaaatagtttttaaagaaaatattgtttaaatattttgaatcaaaattaattttaaagatataatgactaaaacggatatatatatatatataattaaataggcctaattaaaattaagcctatataggtgtattcttcatttgctttcggatcccaacaagcttttcttttttattatttggagtcggattcacaacaacttttcctctaatagtacctataatctatagaaatattaacatattaatgcatacgaataagagaaataaagttgtatcatttcgttatacacatgatataacaagccgtattgtacatgtacatttaaaattaaataaatatacagagtataatatagaaattaaattcacgtttaataatttatatgagtaattttaatattattttgaattttttatatactattaattatttagtttaaattctaataaatataggttagtaaatatgtcaataaatatttaaatatataccataagttttcttccactttatttacatcttgcatattctattttgactttaaaaaaaattatttagttcatttttttctaattatgttattagtataaaatatttaatgactttcctgataattaatctttataaaaaattgaaatttgt

SEQ ID NO: 3847 - DNA, 1056 bp, Glycine max
  Soy_ogl_2734 Gm08:16907245..16908300 Cluster 15
acataacataaatcaattgttacatatatagttgtttaaagcttaattaactagtaatattaaatttaagtcttaaatatataattatgttaaataattttatcgtttataattattttattttattcaaatataattatttttcgtaataatataaggtgcggtgtaaaaaagttacttcttttcccatttctttcgaaacagagaagatgaaaaaaaatgaatccaaatcgtccatctactttcacatttttctgagtcacaattttatctagtcatttcattttatttcctgttcaattactacgtaataacaaaattagtgattcagatgttggccggagcatatacgcctggagaggatcaagatgtgaaaaattatggaaattagggggaaaaaaagtttttccctccaatctcttccctttccatcaataaaatattaccaaacaagcaatgccttcattctctttactttaacttccttatcacctttttttaacataacaaacaaaacctttttcttacatttcataattaatttttctgacttttaactattcttttgacttctgagtaccttttctcccctaacgaatactctggccatcattaattcatttatatttcctttcctttgataatcaaattagacattctagaaataaattgtacttcaagacaaactttgagtttgtttgattaaagaaaacattcttttcagttagaaataaaaaaaaatcattttcatgtattatcgatattaaagaatttgtattatgaatcaatcaaaaaatatttcaattacatttttaaaataataaatatatactttcctataatctcaaatataaaaaaaaacatttttcatggtctaagtataaatttttttatctaattttatcttatttaatgttattattttaaaatactttttatttaattaaagttctagtttcaatgattcatttttatctttataaatttctaatgaataataagttaaaaaaatatttttttaattgaaattgatgtaattaaatataattaattaat

SEQ ID NO: 3848 - DNA, 1130 bp, Glycine max
  Soy_ogl_2774 Gm08:20155501..20156630 Cluster 15
tttggcttttacactaactaccttgtaagtcatgcttaatgcaatttcttattacaatgtaaaaattctttaaaatggtagtgtatagaaattaaactctttgttatatacatatatcaatgtaaaaaaaaaaaaaagtttgtccaattaaaaacaaatcttgaatcatttattaagtgaggatataataaataagattgaatcattatgtgcttaaaaattgatttacacattaattttgcaagattaagataataacaattacatggaattaattttgttttaaaaaaattgaaaaaaatcattaatgttggttaaatgtaaattttcatacttcgtttcataaaaaaagtttcatccatgtgtgttatatttagtatatcattcttattttaataattttacttatacatgttaatctataaaaaaaaaaagttatcgcagtaaaaagatgttgagtaatttattaattgagaagacaataaataggaaatgattaataatttacccataaaacaaataactattgcatatttacatgggttaatgttttttatttttattttagactttaattttgaaaagaaaaacaaataactgttacatgtattaaatttgatttttgttatgtaattacatatatgttaattagattaaaaaaaagtaattttgtttagtaataaaactatctccttgaattaagtgtatttttctttaaaaagaactgcatccgaatgtgttttattttatatatagattagtttataaaagaaaattaaactttatcaaggtaaaataatattgaataatttattaagtgcgaagataattaataaaaaatgaatactaatttgtctaaaaattaattttgcttaaacaaaccaattattattatatggatttaatttggtttatctgatttaatatatattaattagataaaataaatattgattttaattgataaaaatagtaaaaatttcatttccgtaaattaagtttaaattttcctgtgaatatctagtactttatacacatattaacttcataagtatattaattttgatcaaattaatttgatggcttcaaaataactaatatttggcatcttttcaactaaatattaaatt

SEQ ID NO: 3849 - DNA, 1100 bp, Glycine max
  Soy_ogl_3055 Gm09:10454201..10455300 Cluster 15
tctttatctattatttctattatcttttattataattatctttaaccaattcaatatattattgtactaacctcttttcaaaataaaaatgacaatctaatatcttaaaacaatttaatctatctttacccttgctaaaagatatatttagatatccttatctaaataattattagattatttttggggtgttacagtatcttttaatatgattccaaaatagatgaaagtaaccaattgaaacatattatttaaatttttatcgatttaattcgatcatatgtagtttttggagatgtgattgtctttgaaatcacatctgaaataaattaatatgatatatgtcttttgtattatagattgaggttgacaatcatggacattaagtttttatttttgttgtgttctattacgagataaaaaaaatccttttttcatatgatctttaaagataaattgctattattttaaattcctattattactctaaatttaactgatattttattaatattttatgatttagtttttcaaagtattatgtatcttgtttaaggaaaatattcaaaaataattcttactaatcaatattttgcacttaaacaagttattttagtgaaatggtcaaagacaaatcatgcaatttgcatatatgacattgtgccaaagttattaacttgatttatttattttgggattcaagatataattaaagatttcaaatatgaattttatatgttatacaatttagaatgtggagatgatttccaataatgatgaaaaaaatgatggttgcccaaaaatttaacatattgtggtaaagatatatcaactttgttatctttttttttttttaagtttaagatataataacctcaaatatgaatttcatagattatataatttagaaagtgctgattttgaacaataataaaatcttgactcttattccatgagcatatcaaaattttacaaatatagattactaaaaaaactattttttgtttgtttatttagcttcattgaataataatatcaatttacatatttatactaacttacaaagtgccataacctactttatattataaatgattaac

SEQ ID NO: 3850 - DNA, 1325 bp, Glycine max
  Soy_ogl_3404 Gm10:7299488..7300812 Cluster 15
tctaacaaaaaaaataataactaacattggctaataaaaaatgtatcatatcttttttatttgctaaagtccataagttctagaattgtttgatttttctctcttaaccagatatcatttaaaaaaaaatacaaaattcaaaatgtcttaaacatatttcactttaatttttcaccaataatagtttcttaaaaaaaaaattcaatgatcgcttttattttatgatgcctttatttttatcttgataataatttttttggagtgtagcaaagacaagacattcacagtttttttgggagtgagagagttgataatgaaattatggaagagagagaattttcaattttttcattttaagagttatttgaaatttctttgttttacttgtaaaaatcttccttaaatttctatggctttaattttttaaaatttaatatctaaacaaattattttgatttataatattttaagttcacttaaaaatcaaaattttatctcaatactctttatttatttatttcaattcataagaattaaacttataccaaaaaatttataacaactcgatcatatatattattcaatctaataagacttccttaaatacactcttttataaatgcattcccgaagaagtcttttatgctaaaagaccacatttataagaaacaattttgttatacttcaagagaagtcttttaactaaagactacaaataataactttcatgaaaagcaaaatttctcttttagtatataacacaaatgcatacacatgatttaaacttaagattccaattgttaaattagataatctcatattaattgattcatgtaaaatcacattaatattgtaataacatttgacggtgaaggaagtggtacctgtatagtaaattaccatttcttcttcttctttagttcaagcatctcttgtgctttggactgcattattaatactatcattttgcccctgaaaaaaaattaattgattcatgtgctagctcaataatacttaaaacaagttgagaattgagataatttttattttctcctaaaattgaatctcgctatctcgattaatgtctctatgtcttcagagatactaacaaagtaacaagtgacaataatgcttcttttattcaactggttaaatttaaagataaatcataattaattgaattgaaaattcacatattcttgtattataaattaaaatgcacactttaaaagcaagattttcactttcgatatcatcaatatcatctctactctatcttttaaatgcgcattcacactactaatgtaactagtaaaaacctaatc

SEQ ID NO: 3851 - DNA, 1025 bp, Glycine max
  Soy_ogl_4015 Gm12:7779001..7780025 Cluster 15
tatttttaatttataataataaatttcccatcaattatatgaacattttaaataaaataaaaatatatgtgtaactataacccaatatattttttatgcctgaatattttcactctttatacatttttggaaaacttgagaactaattatgttggttttaatatagaaaattaattttatagagaaggtatttcaaacatacataaaattagaattattcgtgtgaatgcataagtatcttacaagttctggtataaaaagttatatgtctctctcaccatatttttatcgagggtatgatggaaggaaataaaacaagtggaaaaaatttaaataaaaagtaaaataaataactttttcaatttttatttctaaaagtaaatctatctcaaatttcttttcattttttccttaattaaaatattcctaatcaaattttttcatctttattttttttattctcattcaaacacatcattcatttgagagtaaattacactaatcacctttaaaattttgtataattacacaaatattttttgtttttttttactattactgccatctttttgtatgagatgttagtgtaacatataagaggatatttttaaacataaaggagagtggtcatgagattttatggacccaagaaaaaaaatagtaaaatacaaccctttattatttaagtatttaaaaatataacaactatatgttatataaaaaatagatacataatttcattaaaaaataatagggtttgctatattaaatgaataacatacttttaataaatcttaaaaaaatatcatatttttttatttaatttactcttgagttgtctattatttaatttatttttaaaaaatacatgattagatatttatatataagataagcatgacaacaaaatagagataggtttgactctccttgttccttttcgcgtaaaagacagaaaaaggtttagttaaaaaaaaggtagatttgtatttttttttatatcgaatttgggtatacttgccagg

SEQ ID NO: 3852 - DNA, 1000 bp, Glycine max
  Soy_ogl_4024 Gm12:8124001..8125000 Cluster 15
aattgataattagtttcctctgctaacatgtagatagttataagggtaaatatcaagctcaattacgtagattttatatagatttttaatgatactgattttttttttcatattatcattcaatcgatcacaaattgctattatgatataaaaaaaagtttataaaatttactttaaaagtatattaaaaatgattttttataggttggtagtgtaaaaattgttacactaacgatttatgttttttaaaatcataaaataaaagttataaataatcataaatcatttataagttgaaatattttttctcttttgtcctaaattgtcttagttgtaaattaaggcttttgcgggaagaaattgggatctattatcgtataatacatttttgaaggagatgaaggacttcaaatgtgattaagttccaaaaataaagatcaattccataatttatatgtaaaaatatcttaagagtcctaccaaaaagtgaaaaaaaataattatggtgattaaaagaaatttactttcatataaaaaaataacaactaaaagatctagttggattagttaaacctggcacgtgaattattgtaaatctataatacttatctttcattaattcttatggataaaaaagaacaagctaactaactcaaagtacaattatagtatctacatgaagggagcaccgagagggtaatgggtagtaagtaaagtatatgtgtagaggaatccatgtctcatgagaataaatatttcatatccttctttcgcgatgatttacttaggaataaaatatacttgagttaattatttttattacttcataacaaatacatgataaatttccctttcctactatattattgggactaaaaaaaactatctgtaaaacaatcacctccttaaaataaagtaacatttgtaagaaaaaaaaataaagtaacatttttcaaaaaaaaagtaaattatatatatatatctcctgaaatttaaaaaa

SEQ ID NO: 3853 - DNA, 1100 bp, Glycine max
  Soy_ogl_4085 Gm12:34281544..34282643 Cluster 15
ggctttgtatttctcaaaagtaataagattcgagtctctcatcatgaactaaaaacacgtttttattaaaattagaaaatgtaaaaatataaggtgtataaaaaattatactacctctgctaaagaaaactttatactgccttaaaatgtagtttctgtcaaataatattaaaataacgagttttggatgataaacaatataatagaatgtttatttattattagtcatgaagattttactttataaaataaaaaataagttaaggagataagatttttaattaaggaagaaattatacaaataaaccattcgaatgaatacattatttttatatttttaattttgataagcgatatgttaaaatataaaaagtatattaaaattgattagttaggcaagaatattcgaagctttaggatattattggtaatcttacaccccacgcaagcacgtacacacacaaaagaagaaaatagtgctttttggtattttaatatcatcaaaccgataacttttttagataaaacttagttgaccgatctagaaaaaaaatttagtaggaaaaagataatctatactatatttttacagacaaaaagtattatgtattacttttacaaatacgcaatctcatgataaaaaattaaaaaactcaagtttctaaaattttaaaaagataaaattagtatcaattttttaaataattttttacattctttttcttaaaaataaattatggagataatcctattttttttatgggagcaaaaacaataattattaaatatattcaagtaaaaaaaattactagtggaaccattgaccccatagtcccaaatctacattcgccccttagtaccaataatattatataaatatatggtgaatttgtttgaacttaaaaaattaactttaaaataagcattttttatataagtgtttttttaagaaacaaatagaatttgtttcttaaaataagtaaaaaaaatgattttttaaagtaataaatttaaatgaattcacctatatattgtttacacaatcactaatggatcagcaaacaattattgcttgcatggtaattgactaattttgagaa

SEQ ID NO: 3854 - DNA, 1000 bp, Glycine max
  Soy_ogl_4250 Gm13:24633001..24634000 Cluster 15
ataatgatcattttaatttttggatataattttaaaataatgaactttttaatttttgaaatttatcttattaaattctcatacataaaactacataatcaattgatgtttgacaaaaaaaatgataaacagaataaaaatcaagtgaaaactgaaaagaaaaactaatgaacaattaaaaaattaaaattttaatattaaataatttttcaattgctcgttaaactaattttatataagtatttattttaattaatattaagtgatgaaaaataatatctaaaataaaaaatagaactttttttatggactcactttgaacactttcatcttgaattttgatgcgttataactttccctctcaatttacacttttatgaatagcaaaaatgatcaatatttgtttccttttataaaggataatcttatagttgtaactttaaattatttgacccccaacaaaataattttaaaatgaaaaaattttaattgaaaaaaattaattcgcatgtatgttaaatttatttcaaacactaccttgactttattttctaatcaaatcataatgcgtgtatcattagtatattatggttcgcggttaaatgttgatttttcttatatgatttgttttgatgtttataataaacaagaaaaaaataattaataatataactatagtttttttaataacagaatatttaaacctagtattaaaacgatagtaaattttttggctggattaaatgatagttaaataccttcaaaatatcttgaaaatgcttcagtttgatatctttttcctctttccgtattaattatctttgttagattaatataaagaagtaaaattgtaaaagtattaaatcctgcgtaaataataatagatctgaactcataacactgtctgattttaacgactagctaccatcctaatctcgactactattattctggtttgattgtttgagcatgacacgtacaaattttgttttaagcgcaa

SEQ ID NO: 3855 - DNA, 1323 bp, Glycine max
  Soy_ogl_5095 Gm15:39305878..39307200 Cluster 15
aattagatcattgttggaacttaattattgaaaaatataattttacaagctcgtttaaaaataataattcaagtaactaattaaaaattattcaacaacatccaaattattttaacatataaaaaatataaaaaaattgagtaaacttatactatttgagcacggtattttaacaagatcatacacaagtggctcctgaattctataaatgagaaaagaaaaaaaaaggtactagtagatacttgcacacggcaaattttgctacaatatatttatgggatacaatgaatccaacttattcacgtatgttcattattatgtatcatgcatcatttttaaattcgtacacattatatatacgaaatatatacataataatttaaatgaagtttaagaaatataaactaaaataaaattattgtgattatatttataatttattgagaatatttgaattcaaaatataaaagaagaattcaagactgacatgtttttaactgaaagtataaattgagtcactaatataatgtattataattcaatataatagatgtatcatccttatcattaattcatgaaatgttcttatcattaatattttctttttttaattattagtcaatttattttctttttaatgaaaaatgttgactatagtacaatactaatttcatactaatcacacgagtcactgttttcagtaaaataaaactgccttgtttttttaattttaatttatgatcactttaaaaaaatgacaacccatatacggccattcttgtgtttcatgcatctttgttttcataccgaataacaatcttttcttttaattaaagatatttttagcctaaaaataatttatgtaagaaatattataagtttagttttatacaaataaataaatatcattttaaatttgtgtatgataaataagaaaataggaagtagttaagataaatttattattattaattaaattaattattttttttaattttagtgaaataaattattggatcttgtaaattaaaaacgaacagaatattatacaaaatatatttgaaatgtatttttttaattaacattctgtattaatttaaataaaacaaaaacaaaaatgccctcatgtatcacgcgcaaagaaaccgtcaccattcaaactctctttgacgtgttaataaattagatggctatgaaacgtgcaattcgttacagaatgagagttagtaatcaatatcatgtgtagagaattcaaactctcttttttaattaattaattacatttgattaaaattcaaactccttgaccaaaatgaaagactg

SEQ ID NO: 3856 - DNA, 1100 bp, Glycine max
  Soy_ogl_5132 Gm15:46738301..46739400 Cluster 15
tgattcggataatacatcatgatttgatgctgtgtaattatttgattcacttacaaaccaaattcaaattaatacatttatgttttattattaatatatatggaacaaaaattaattgaaaatatatgttaattaattttttaaattaaaattaagtcatttataattattagtacgtaaatcaattaactcaaccttattagaaaacaagacttctaattttctatttagattaagaaagtcttattagaaaacaagacttctaattttctattaatttactttctattttatgcatatacaatatattattgtattatcgtggtgttttcaatcctgttattgcaaatttcgggtaagtggtcagtgaaatatctattgctcaagaatccatttgaagaaagcaactactattgaagaagataattataattgaaaatatcaaaaactatgagatcaagttagtgagtctcaactaattaacaaaagatcatgaaatgaaaatgaagatataacaaagtcaaacaatacggattctatggatgtatttcagtatttgtaatgaatatagtttaattaagaatgatttagtacgaaaattataatatctgtacctctctaattcattgttattttaattttaaaatggatacattgatctttatagtgtcttcttgctcaaaattattcaagcttttttttttttatcaaagcagattagaaaatttcacctaattaatttaaattcaattacttgataatatattaaaattagtctgtgtttgtttctatctttttcatgttaattaaactttgaacccgaattgtttatttttttttaattggccaatattagttttgggttttaaatcgtttctaatttgtcaatatcagttgttggttttaattcattgttgtaattaataattaaatataaatatttatatttaaatttggatttattattaattttactttagatattagttgtgctgtaattattttttttatataaaattgataatttattcatacccaaattatttggctaattagagaaaattataaccaattagaataccctcttgaaagtgatttga

SEQ ID NO: 3857 - DNA, 1000 bp, Glycine max
  Soy_ogl_5664 Gm17:13121801..13122800 Cluster 15
aagagtattcacaatgtggaagttgtttaaaagattgtttatcaaaaaaatattattttagtacaatgtggaagttgtttaaaagattgtttatcaaaaaaatattattttagtgtgtcatataaaattttgagttacttaaaattagagaaaacggtttatataaataattattgttcatgaattacttaattttgtattaaatgtaggctaagagaaaaaaataaaatatttatgagttaaataacttgttaatagaaacttccattataaaaaaaattaattgaattccttaatattaaatgacataaattgaattacttatatatgaataccattaaaggtgctctaattaatctaacctagctataatcatcaggttaatcacatcaatccactgtgtcaaacatgataatggtgtgtaaaaatgttgaaaagttgttgaacggaaatttattaaatcttctctttcacattttgtttgttggaatgtatgtggtgggtggttaaatgaaaaattctaaattttcttataatctttttataatattttttcaattttttttcaagtatttgtgcaataaattattaaaataagaaatatttttatcattatttcatgaaacagtgtaattattaattaaaattaatgataacaatttaatactatttgcaaaattttaatattatttttcaatattattattataagagtaaaacatatgctaattatatacagttttcattatttttttcctcttttaataaaaatatcaaaatagtatatcaatattcttttggcacgtacagtaaatagcatatcaacattactgcataaataataaaaaacacatttttgatgaaacataaatcacattgaagtctcttagtggatactactggtggacactgtattgcgatggctaaagtattatataattagaagaaagaaaaacaaaattttgatacagcttattgagtatttattagtgttgtttta

SEQ ID NO: 3858 - DNA, 1100 bp, Glycine max
  Soy_ogl_5699 Gm17:15743201..15744300 Cluster 15
aaattattaaaaatttatatgttaaaatatgaaacacctggaaattgatgttaagcaccactattaattagtcaacctatattacattcctttgtaaattaactaaactatgaatataaactaattattttttatgcataaattttaaagaatttttttttaaaaaaatatacctttttaaattaattaaactatgaatataaactaattattttttatgcataaatttttaagatattttaaataataattttaccaacttcaacttatattgaagtaatagggatcgctaaaaggaatgtgaggtttcaagtccatatgtttcattttttgtataaaaaaaatatattaacatattttaaaagttcaattaaggtttcgttaggtcatattgttggagaaaaaatattctcagattaatttttactgtgcctcacaatagtattaatgttataaatgaaagttttggttcttttatatgtaattgatcatctttattcatatttaatggaaacaaatattaaatgagttacgcaggtaacaaagttttcaaatttttataggttttggaatgaaaatattaaaatgacaacgtatttgtaattaataatataataatgatcaaaatgagaaatgtacatgagtcatcatttcatgtttatattttcttttttattattgtagcctacatttttcctttctttattgctgggtattgctggatatatgtatagtaagcgttcaaagtgaaactacagaattttaaattttcataaaagaattcctttcatcttactaagagcatctatgatgtatatataatagtttatatgagttgcttatcataatttatgaatcttataattttatatagatttaagtattttaaacaaaaatttattttaatattaaaattataaatataagtgtttaaattaattttattgatcctaccatacttattcatgatatattattattaaacaatgtttacttatataagcaacttcatgtttcaagctaaaaaaaaaaaaaacttgagtaacgtttaaagttaaagcactcccatcagtaagaaaatactaaatagtaataccaat

SEQ ID NO: 3859 - DNA, 1000 bp, Glycine max
  Soy_ogl_5737 Gm17:37108101..37109100 Cluster 15
aaaaaattgtacgttgtcaacataatcctttttctctttgaaatatatgttttgtttatttttcattttcatttttcaattgatagttttattaatatgaatgtaaaaatgtcaagtttttcaatctattatttcttggttttatgattttataattttttttaacaaagcttgaaattaaataatgtagtacaattaaacttcttttcctgtcgaaaaagatttcattgatcgttgttaattttcctttcttagtcattaactatatcaatgagaaaattttgtataaaaaacaaaatgctacagcaatcaattctgcgggcaaaatggcctacatttactgcacatataagaaatataagaaaatgaacctgtcacaaaagaaattactatgataatatcatcctaaatatgctcacgtattcttccactcatctatgactagaaacagtcctagccacccaaatttcatgttactcttttgtacccaattttgatttgatactaataaactttatacaatatattgtcagcctctgcatgcacagatacttcaaaattggtgatgtattactatattagaacttgaatgttttatatcctaacattttatatacttttcttttttgatagagacagatttattattatatataactttttatgtttattattatatataacttgaatcatatcaatagtaagtataattacaattatgtttttcaatcatttcctatgagattagacactaacagtaatgcaacgatgataacaaatcaatataagtattaattagaccaacaagaaatatgaaaaaaaatattgataaaatataagaaatatataaataaaaaatgtaaaaactatatttttcttaatatatattgttgtatttatatcctaaaaaaatgtcgcattcacgtattatatcatatgtaacatatatagttgtaacacatactcttcacgaacactgcagccataggaaaacattccc

SEQ ID NO: 3860 - DNA, 1090 bp, Glycine max
  Soy_ogl_5954 Gm18:6043811..6044900 Cluster 15
caatatattccttccgtttctttttgtgtttttacacaaaaatcaagaaatgtaatagcttttttaatttgaataaaatatttttttctttttcatttctagttcacaagtgtaaattattactctttccatttctttaaattgttctccggaaaaaaatatttctatttatctgtgatttttaaaatataaggttacattattttttttaattatacccttacattaattattttatacatattaattatttattgatggataatttggtggacagaaacacaaatataaactattgttggagagataacgtgtagtgaaagtgaatttacagggttataataggaaaggaccaaacaatttcataaaaaaattattagtttccgtggtttttgcaaataaaattaattcaattatttagaaagagagagagagtaatgataaggtgaaatataagagtttaattaacaaaacggtaattactattaactttacaaacaacaggaaaataatttttttctttaaaaaattcaataataaaaaaggaacaagggagtattatataataaagtttgaaaaagtgtggaattttcgcaagatttaaaatagcgttaatgctattagaaaaataaactaactttcatgaaaatatttattaagtaggtaaaagttttacatttttcttccttagtttaggcgaaccccctcgagatatgttgaagcttttggctgctcatgccaggcttactccactctagatattgtaatttttttgcttcttttgttgctttagcatacattaccaaaaagttccagtttaaaatagaaaacaacatcaaacttacttatggtgttgattatacaaaaaatttgtcttatatgcaatataattagggaaagaatatatgttagaccaaggatgaatccaggaaaatattaaaagaggatctgaattttttttacatgactatttaaatattgtatttctaataaataataagttttaagaatatttattattaatcttatggataaaattagagatatgaactattacaattaaaaatttaagctaatatcaattaaaaac

SEQ ID NO: 3861 - DNA, 1032 bp, Glycine max
  Soy_ogl_6008 Gm18:9161601..9162632 Cluster 15
tagtattttagatttaagtcaataagattttattgagtgaattctctgttaagaacacttttagctttccaatttaattcaaaagtatttgataataataaatttttgtatgatattgataaaataataatagtattaattcaaattgagtttaatttataatgattatcattataatttttttaccatagacatccaataatatttgattattttattcattaataagacttcaaagtaaaataaatttgtattgagtatatgcataaaaatattttacagtaataatgtatataaaataaacacttcaagcttaaccatcaatagttaccataaaagagaaatattactaaaaaaatttatttaaattaaatatactttctttctcatgtattcatttttttaaaaaaatacgaatgtatatttagacaatacactttcttataatttaaaatgtattttaaaaaatatttagaaaagatattgctaacaaaattaagcatataaagaattcatgaaaaaacattcaaatttaattaatagtttaatacacaacacttataaaatgtaccttattaaggttgtacaatcaatgtgcctcatatattaactatattctttattatcttaatataatttattttttgaaaaaatgatttaaaacttattttttttatgcaaataacaatgttcttcccttgtggattttgaaatggacatatttttcctttatagatcattatttatctcttcattcttttcattaccgatacaaaaggctggtgttgttaactacagcaataggtgaccaatattatatgaatcacttgcatttgaatatagacgaaatgtcaactatgacgtcaggtccataaaaaaaaaagacaatgaacgaattacattattgaggtaacagtaaaaactaaaaagtcaagacttaaacatgttgttgtgactcataaatacctattttttttatctgatgtttaataacttttttttaagttgagttattaaaataatatttatttt

SEQ ID NO: 3862 - DNA, 1518 bp, Glycine max
  Soy_ogl_6027 Gm18:12094883..12096400 Cluster 15
gaaaatgacaaaatttgatttttttttaaaaatatatttcaaatgcattcaataaatattctaataaagaaaattgataaattttaaagttattttaaaataaattctaatgtattaaaaaacactgttatttgaaatttatttaaataatataaataaattaatattgagaagaggaataaaaaagtttataagataaaaaaagtttgtgtgagaagaaaaaacaaatataacaacagacgatgaagaaagtaggaaaagcatataaaagcgagtgagagaaaggtaggaactatttttttattcatttatttcaaatataaaaaaaaaaaatagttcctaacttgaaacacaaaattaaagaggtgaaaggaggattacaaatttcacaatcaaggaaaggaaaaaaataaatatttaagtgaaaaattcacattacaccaaataaaaaaaataaaattttaagaaacatggagagaatattaaatataaatatatgaaaaagaaaaaaaaaatacataggtactaacctgattgttagaaagaggagcaaatttgaaacagttttttcgttcgaaaatgtcgatacatgattcctagcatcattatttatccgttcccggaaatttaatttgcctcactctttacctttcaacttctcccacatcagtcacgtttaaaattgtttaaatcctcattaccattatggttgtaaaggcatggtgatgactttattaagttttacaaaactggaaaaaaatgaatttattagacataaaaacgacacactaatatttagaaacggctaaataatgatttaattcaatggatattaatataatttttaattcattcaaaatttaattatatgtttacagttatttttatctaatcatttttcacacattatacttttatttcatacatataattatatactaagtataattttattttccataattaaattaacatatttataaaaaataaaaaaaaatattaaacttcagaagaaatattaaatgtgtcattttaatgcaattaatctaatatttatatcaatatataaatttttttgaagaagcaaaaatagtattattaatactcaaagaatatataaatatataaataaatacctttttctttaatagtatggcccaattttgttaattatttaagatttttaaaaaagagtttataatttttattatttttattttccagaaaaaataatatgtaaaaacaatggctattaataatgttaaaatattataaagcattttaagtagaattatatgatcaatttattcatgtattaatgttaaatcttattatattcaatgacttgcaaattgtaagttgatgttattgcaaattgtaactttatcaatagttgattttaaaccaaaagaagtttacataatcaacccctattattaattgtaacttttgagcaattgaagaatttcaagtcttctttacatataatataacttttgaccaattggattttatgag

SEQ ID NO: 3863 - DNA, 1009 bp, Glycine max
  Soy_ogl_6373 Gm19:12214573..12215581 Cluster 15
aactatttcaacaaaataattttatcttgtaaactagctttttagttaattttgtcaaacatatacctagaataatcctatgatttataatatcaaaatttataataaaaaaaactttgataacaatcaatcaattgaacacctaaaaaaacttaattgattgtttaaagtatttaactttctattttagctataactttctattatgaaattgaattatataaaataaacatttattttgtatctatctttttgttttactattaaattatatatctatgactgtcagacttattcaaaatttgatattaaggttgttaggataatatcacatgatttgataatgaaatcaataaatttatcttttcaaaattatttagaatgtcattttatcaaatttaataccttcatatttaaatatatatggaaaaaaaattaaaataaatacataattctcatatttattgtagtagaaaatggtttttaaaataactattatttctcatttttaatacacataaaatttattaaaaattataaagttgaggtttattacataatatgtgaattttacacagttatgtaatttttaacaaattttagtcactcatagatatattaaagcataaaaaatgaattaaatagaaaatactatgttaattctttggatagaattaacagtaaagtcaatatttccattcaaattcaagtttttttttattggtaataaggtatatataatttaatacttcttcggtctcaattataagttttaaaaaaataacaacttcataataattaaaaaacttaattaatattatttaattttgttgatcgtacttcttttgtctcgaattatccttactgaaatttgatatcaatatcaagtataaaaaacatcatacaaaattgaatcacaattatattaaaaatattttaaatataataaaattagttaagatttatttatattagtcaatataaccttttaagaaaatatttgatacca

SEQ ID NO: 3864 - DNA, 1288 bp, Glycine max
  Soy_ogl_6393 Gm19:34636785..34638072 Cluster 15
catatttgagaagaaaataataatttaaaagctttagtaaaaaaattgacaacatcatcacacatgtatttaatttataaatagtgagatctaattaatttacaagatcaataagattaaaactacatatattttaaatcaaagaaactaaaaatgtaattaaattcaaatttagttcaaaagtaattatgtgtaaatgttttaatttcttttatgttaatttactttgaaaaatcagatttaatttttttaaaaataaataagattaaaaatgaattttaatttacagctttgcaataaatacttttattgttgtaatatcaatttatatttgaataatccaaattagaaaatatgtgaagaatatatgagatattttgtgaaaaatgttaattcatgagtatatcttaaatatttagtaaattgcatcatttactcatgagactttgtgaaattacatcaagtcttcatatttttttaacctccacaaaaacctcttaattatttgaaaaatactacccatatactctttatacgttacattgatcccttaattgtttagaaaaatattacattgtgttttgttacaagggagattgtcgtaaatatttaaaaaacacgaagaattcgtgtaatttattttcacgaaatctcaaaagtatttaatataatttactctaaaatatttagatttgaattttcaagtttatgttagaatacattgctcccttgaaataatatatgctttttacatgttttaaacttttggcatgtggtttgcgtcattacctaggatgtataatttaacaatatagaggcttatttagttttaattattgtgagtgcacaatttattttagaatttacatttcaagtattgatgtttaattcaatgtttataatgttgaattcataattgaaatttccacattgtaaatcagcacttgttattgttcatcaaagacatgcaagcataacaacttaagaagtaataatttttcaaaaaaggacaataaaaatttagtatacttacagtacaattgaacaaacattgatactcttttttaaagagataatcaaacacaactgaccatgaattttaaaaactcctaattagaaataacatttgctcattctttttttaagtttaaatatctttttagttcttattatttaattttttttatttttcattcttgtaaaattatttttttaagtcattaaaaattatgtttcttttaatttatttttggtccttaaaatacttcaaataatattttggatagtg

SEQ ID NO: 3865 - DNA, 1037 bp, Glycine max
  Soy_ogl_6674 Gm20:1340101..1341137 Cluster 15
tcttattaataattatttttattaaaaattaaactcaaatttaatcttaattttaatatattaattatttgtgtctaataaattaattgtcttaaagcaattttaaaaaaaacctcttaattataattgtaattcataagtgaggagcaacaaggaaagattatgttaaaagaactaaaaagaaaagagaaaacacggaaaaacttgagagggtatgaataaaagatgagcattcaaaaaataaaagtgtgtaattgagtcaacctttgcaaaatttatttttagtaaaattgattattgttagaattaattttgaagggaaacgatttatatgtaaatacttttattctaaaaacaaattaattgtaaaacttgtgataacaaaagttatttaacgcagaatttatacataaagttactttaacttaaataacgtatttggtttcacattttagatgtgatttcatatgtttgcgaatttaataaatttcaaaagctaattaatagttatagattttaagttttaaatgtgattcctcctcaaaagcttttcaaataagctaatcaatttacaatagaatcaaacaaagtaagcataaaataatcaaacataaaatatttacctaaaattatttataacataaatatcttaatgttattttaaataagtttaattatacttttgctctttctaatgatttttcattttagttcctataatttaaaatagtatttttatttttatagttacaattttttaactcgttcatcctcaacgtctaaaattatctaaagttattacattcaaaactgctacaaaactaaaattttcaaaattcttttacatgtaatggtgttagataaatttatacaacgagagagaccaaaaaggttgaaaatttaaaactataaaaacctaactaagatattttaaactatgaaactaaaataaataaaaaatcgttgcaactatgggaagaaaagaataattaaacgttttaaataactcaacctaaaaattgaaatgaaacatggga

SEQ ID NO: 3866 - DNA, 1000 bp, Glycine max
  Soy_ogl_6676 Gm20:1400501..1401500 Cluster 15
aaataataatattatattagcattgaaactattaattccacatgtcaaatattatcacaattggatatctttggagtacatctagttattatatacttacaaaattttaaacaaaaataaagtatgattctaacattttaatttttgcaaaataaaataaattttaaatatatagacctgatcaatacaatttgatccaattcatttgtgatttaattggtttggatcatgtctactaataaaattacataaactcaattcaacccagtaaaattttattcaggtgagtaaccgatctagttaaattcagcccaatgtggtctgaacaccactagacgagaaggaacattgtctttacttaaggtgtgataagagggtacatattttccaattttacggatcatcactaacggcaaatattaaaatcggacataaaaaatgttaggcagtaaaaaaaaagtaatttaggtagttaaatcaaaactattttacacgtacaaaaaagatgtaagccttaaattttttaatatataaagtttaattaagattttagttttcataatataaatctgttttagatttagttcctaaataaaattcttgacagtttcttatttttatgtttttattttgataatgttatttataataaacattgacacaatactattcagcaaagcagaattttcaagatttatgatttatatttcatattttgttattaactaatataattataagtgtaaaatatgtttttaatttttatatttttgtttaatcttatctttagtctttgaacttttatttcatgcaatttatctataaactttataaaaaatatatttttaatctctggactgactttttaattttaatattttctcagcttcaagttatgatgaggaattaaaaaatatttttttataaagttaaaatatgatgtgaaaattcgaaaactaaaaattaagatcagatgatattataagtattaaaaacatat

SEQ ID NO: 3867 - DNA, 1000 bp, Glycine max
  Soy_ogl_3031 Gm09:6260501..6261500 Cluster 15
aataaaataagtcgtatatgatggtatgatattatatattgattatatatctatacataattatatagtctatatttatttctcttacttttatatattaaaataattctccatcaaatatatatgtcatattttatttttaatcatttggatactatatgagatattagcgaaaataattttttattttttagttaaattttggattagtcaaaagtcaattttttttatgaacaagatggttaatataaaaaatattctacttctagtttctaactactttaattaaaaaaattatacagtaagaattatatatattcatcaaaagaataccaatgcaattacctatcaaggaagataattgtcacaaacaaacgaagctcgcacaagataaaacgtattaaaatatgtattcataaacaaagtcaagactcaagatattggttctcacattttagtattttaagcacacaaatattaatttggataaaaaaaaagatatttttttgtaaataaaatttactgaccgtaaaattaatttagaccaaacggaaaaactaatcaaatacggaaactaatgttcaatccaacttgtcttcttatagattttaaaaaggttttactactattcatgtaatccttttactacattgttttttatatatattttggtccttatacctaaaaaaaattaccagtacatgttttagttctacataataacttttagttatgttttggttggtctcttccgtcaattatctctttcaatgttattagttaatactgccacaaaattgaattaggcaatgcaagaccgtcacaaattttcttataattataagcagccgaaaattgttctcgtcacaaaatagaaattattttcacctaacatttgcttgtaagcaaacaagttacaagctaactcggtcaccttatttgtattagtgcataattgttagaataaaatatatttaattaaatttctatgaaataaaca

SEQ ID NO: 3868 - DNA, 1282 bp, Glycine max
  Soy_ogl_3256 Gm09:42882119..42883400 Cluster 15
ctgtcaccaatctttctccttaaaatgttcatttattattttctttttcacgtaattggacttctgtacctctgcaggctactgcgccagcatttcaatcgggcgccacttcggtaagtaactccgtacaaattcaaccatcatttctcgtgccattcttttttatatcaaattcttataataagttaataaataataactatatttttcaataaaaaaaattagtaactatatttgtaccttttatacgtatttttttatgtattaaacttttttattatttctatggcattatttaattcaatatttttagttataatattaaataaattggcatattaaaagtattatatacttttaaaaaagttaaattactcattttgtatgaaactgattaacgacaatattttttatttaaggatttacagtattaaataagcataatattatttctcgagatacgcatgcatgcataataataaagaattgtatatttgaatttgatatcattttaattattatttttaataaaacattctaattttgaattatttgaatccatatcacttgtagttgtaggtccattagatttggggtattgtatattctctattgagtaaaaaatgagtggaaaagaaaatatatatttgtaaaatgatatggatatttataaataaataaaaaataaaatatgctctctataataaaaaaaactagtcaagatgcaagatatattgaaaggaaaataaataaataaatatattaacagttataataaaacaaacaaaattagcaatataaattaacttgaacatattattatctttttaattccaattcacacacactcccttcctttccaaattggaaagaaacaatttttggcatggaacccacaaaatttttcttttctaccttatttatacgaaaacaaaacaaattagaaaatactttcttttctttctattttcatgctaaccggacatgagtaaggcactttaacatttaactttgtgtataaatgataatatttttaaagaccacgtatattttttttatagaaaataatattacttaaattaagtaaaattattataggtaatcatttttctgagcatctaacgtgattatatatcaattaggacttaaatcgaacatcattgattatgttaaagcaaattttataataggtaatggagacactgattggtgattaaaataagagtatgtcaatacttaaaaaaatcataatatgtgaaaaatgtttatataataaatttgt

SEQ ID NO: 3869 - DNA, 1300 bp, Glycine max
  Soy_ogl_5955 Gm18:6045601..6046900 Cluster 15
tcattccagtatatttactaaataaactaattcaagattttaaataaaatatttaatttaaaaagttaagttttaactctttcaataagatttttatgtctattaatacttagtgatctatatagcaaataactcaatttctcttaaatcaggtattgactttagttttgtaaatgaaaaacatgtgctgaaagagatttatttaattaattgattttgtctaattcaactgtcaatagctacaattttttaaggcaaaagaaaggaatgtcattattggaccatggatgaaacgatcccaactaagttggcactctaacaaccacaaatcaaatataacacccccttaatagagacaaactttaaagtttagtataacttttgaataataaaactcaaaaaattcttttattgccaatgaattgttcaatttaaattattattattattatgtaacttgatcaaattcatgtctattattttgttctttgtttttccccaagaaaaaagtcatttatgataaatgcgaacaatacgtgttcaaaatatttgtgttggtatcatcacatatcaatgccatttcacaaggaaattccaaatccatgtcgggcataaataacatgtaaattgtattaaattctatcattgttaaagtgctaattaatagtcaagtcaaagagagatataaaagtagtgttatgccttttttttttcttcctatcaagaggcacatcttttcttataatgctcatccataaagtgtaagtgctaaggaggtactgcgtacatacctcgtattaatacaaataaggtgctcctattccattgatcctagattactgaatgaagattaaagaaaaataaaataggcatgttattgtttagatattcaatttctatgtatggattgtttaacattctctaaactacttgattgattattaatctcatgatcattataaaaatgtgatgaacattcctcacataaagtgtcccttaggtacttttgcattacaatgtagtattaaaaatattttcccacatttggccttttgtgttggtttttctttgtgacccttctgtgtctcacaatcttgttttaagtatctctatttcactcaattcctttacttttttcctagctatcatcagtcttttagtttggaatgctagaaaatatagctaggaaatatgtagacttttttccttgtgcttttactttcttgaatttgttatttttatctgatagtgcctgtaacgctttctctaatgtttatgggcatatgggttgggtggtaga

SEQ ID NO: 3870 - DNA, 1158 bp, Glycine max
  Soy_ogl_5958 Gm18:6065043..6066200 Cluster 15
gatcgatgcttttaactgtgaacatgtatcatgtatatatgattgctatgattgtttttgcctgctgtcattcattctcctgcagcacttatgaccaaattctcacccttactatatttaagttctattttcatttattttgactgcctttctatatattgagtacatggtgaggagaggcatgcacttaggcacgctacggatttagtaaggaactgatcgaggatgtctttaggggagtttggtaaaagataaatttttattttcttgggaatgataagtcgaaaaatttagttttcatgtttgatatatattttaaaaaataatattcttaaaaaataatattttttgaaatattttttaatcaatttttcacgaaaacttcaagtagaggtatgaatcttatttttttgaatttaattttttttattacaataaaaatattatattattctatataaaactttagataaatacatattttattccttgaaaatgtataatactaatagattagtatctgaaaaataaaataaaaatcaaatttaatttctgaataggtaaaaaatacaacaatataattttatagttaacccacttatgttatctttaacgtaagtgcatacttgtcacaaccttaatgaatagattgaactaatttgataatgataaaatagttttcaaaatttataattctttttaacggctaccaggcttcttagttagtgtcgagtcatgtttttaacaaatagaaaaatgccttgctcctccacttacaacaagctttccattttccaacctcttcagataaaaaaattaaaactagtgtaaaaggagagaaaaaggacatgtccacttattcaccaattatttaattacatagctaaagcttagtctcttgcttaaattttccagacaatcatgtcaataaaagaattcactacatgaaaattaaaaattatttcagatttcaacacacaatgaacaatcatttggctcaaacgcatatcactactaattaatatgagcaaaattatcgatacctataaagggataaaagaaaataatggaagaaaaaatgctcctcattcaatatccttctatatatctttgttcagccacaatttgacaaagctaaagtaaaaaaaaaaaaaacaa

SEQ ID NO: 3871 - DNA, 1084 bp, Glycine max
  Soy_ogl_5175 Gm15:49454701..49455784 Cluster 15
tttcatttaattttcttatttttctcattttgattcctaaagtttaaggattggtgcaaacccttgtgtatgaaagagtgtatcaatcattaatcagcaatatatgagaagaaactatctccccatctcaagcttatatcagacctctctggttagtccaccctctcctctctttagggttttagccgctgcaagtattgggtggtaaccatatagtgatagaaacaccaccacgtccagtgataaaattaaaaaattattatgtttcgtcctttaaattagagaatctgttttattttatctccatataaaaatttatactttttagctagtctctcaaatttgaatgttgttttagtccttctatcaaaatttgagagaccaaaaaattcaaatttttatttgagtgatgaatcacacgtccctttcattctgttgtgtccattcaaccataataactgacaccacaattctatatattggggactcttggctaaattggctgtgttgctgatttgctaacgattctgtctcctcccattcagtaggaggtccattcaagattcccgaccgtgcttatgttgcatcacaccctttgtcattattcactaaacatgtttaagaaacattattattgttacactacaaataaactaaattatttttcagatatttaaacagaaattgtttaaaatttgtttgagtaaatttcatttaattgttcgattaaatatacaagttcaaacttaaatttaaattcgaatattctttgcttagatgcactatattgaacattcatattaattctcattaaattaggtagaaatataaactataatatttaaatatgttaaatataaaatattttacactgcgtagtctttaaattcttttttaattcctatcttgaacttgattaaattaaattttgatgaattatatgttaattaattcggtgaccatataaccttctttagaaatatatatatatatatatgatgatatccattacaaaaaagtcatttattttcttattataaaaattattttattttttcataaataagtattattcaattactag

SEQ ID NO: 3872 - DNA, 1301 bp, Glycine max
  Soy_ogl_5371 Gm16:29655100..29656400 Cluster 15
aagatgagtgagatgttctacttgaaggagtgaaatgtattttgagagacaacacacaacatgtacactaccatatacttacaaggaaaatgataggagtatccacctaatcagtttgtgttgaagttgaagaaaaacaatgcccccaagttgagttcaaattgcaagttagtggcattgtagttttttttttctttctttaattaattatgagaatttttatttatacaatttcttgtacaagtaaaataaaaatagaaagaaatggattaatattgcaagatatgatagtggataatgttgtggtgtttgtgtataagtggtagccatccctgtgttaaaaggcttcctcgaataaacaattcaaaaagaaagagattataacatggcgaaaagaagattagccatatactatatagatatatttccttcttttgtagaaattgatggacaatggggttgggatccccaagctgacatagaccttaataaacaatgagttacaattagccatatattatatttttaaaaatatatatttgggaatttgtatttatataatttctttatatgacaaaataatgtacaacacaagaaaaaaagattaagtgtgttgtgaattattgttgcgatgaagaaaaaaaaagtgttgtaaaatatattatacataaatatgatataaaaatgactctatttttaaataacttttattgttccatgagacagtattcacttttgagttatattatttatatatataataatatatatatacttggctatttttatatataactatattttctctctatatattttattataaattaaccctcttatttcatacgtctctcttttttctgtctattttccttcgttgtataatcttctttttatacagatacaatttctcttcacttttatatgtttgatcccctaaaagaaattcatatggtgcagctaagccaacctcatacagcttatatctatgcctactttgtgcatggcttgagaagagtgaacataattttagattcatgtttggaaaatattggagaaaaagtttgagaaattatgtttattttactcatattttatatttttttcaataaaaggagataggaaaccctaaaaaaagaaataggaaaagaaatagaaagaagcataaaataagataagtgattttatatatggagataaataacatatcaattaaatataaaaatatattataaaaatagaataattttgattgtatctatgttttgccttggaaaaataaagaaataattggagacaag

SEQ ID NO: 3873 - DNA, 1096 bp, Glycine max
  Soy_ogl_3149 Gm09:37211005..37212100 Cluster 15
tcaaaaaaccttatgagatttcaacagttggttatggacgttgtgtgtgtagatgttgtttcaagttaacgtatgtttccacgctttaaaagatgaacaaatttgattgcgtcgcatgcatgctgttgtgaaacgtttaaaacttcaaagccaaccttctaggaacttgtccttctttgccccaatctctctcttcctacgtaagtacgtatcttgtggctcccatattccattaaaccaacaagcacttgattgaaatgtaaattgtcatatatagcatacgtagggtccatttgattttttctttgatagaataaattatgaaaagttaaaataatttatactaaaaaaatcaattaatatttataaataatttgtaggatgaatgattaaaaaaaatgaagtattgtgaaagaaaaataatgactaaaatggatgtaaaatttggagcgggaagaaatgaaaactatttttttttaggaaaatagcatcaattgcaacaaaatatttaaattatgagttttacggcatacaagtttaatatgtaaggagtgtgatcatccttagataagatatcaaatttgaatggtgaataaaatttactatgagaaatagttttactcgaatctcatagaattattatcataaaattattataaataataaaagtcttttatacataattaatatgttggaaaaattcaatatcaaattgattcatacatctggtgttaattaatttcctgtctgttaggaaatattattagtgcaaaccaaacaatgaaatataggaatagattcacctcaaaaaaaaaaaaaaaaggaagggatttatttgacttgacatataaatccactaaagttgaccttaaaagatatttaagtgatttgaatgaagttctagattcaaatttgaaatttcattatcgtgattataagaaaaatgactgacttatactaattaattaatcaagatctaatgttacttttagagaagaaataaattatagcataattagtgttagaattataacccttaatttagtgaactaatgaagtcgcggaatatgtaacgtgaatacgcggtttcaagttc

SEQ ID NO: 3874 - DNA, 1000 bp, Glycine max
  Soy_ogl_3454 Gm10:39257201..39258200 Cluster 15
ctctcataatttaagagttaaaaacttaattaaccctaaaaacaataaagcaattattaaaaaaaaaactgttatagatagctcttactcatccgactatcttttcgggccactttttttttatttaaaaaaatatatattatatttcaatttcttttagtataacaagcctcttaaaagccattttttcttccttaaaaaaagtcaatttttctccctttaagactaaacatttcagtatttactttaaaaattcataagataaaatcaatttttgttagtataatttatttgcaacggaagagagaccagaaatttctatttgctgtttcagcacgtggcaccaatgaaaaagtggatttgctggttgaaacaacaatttgtatttgttggttcttgttgagtatcagagaagcacatgaattttaatattttttagtaattgtgaagctgatctggactcttgtcaaattatcagtttaactcaatcttttgagaaaaaaaaaaagaagcccatatcaataatatattttaaatcagactcattttaataatcagttcttaaaagaaatcaaagggatctattacttcacctttttacattattaatttgtatatttggtgatatttttcgcttgacaagaaaaggaaaaaaaaaaatgaaagagggagaacaggtgacacgtgcatacacattaattatttgactacctatctcaccaagctagtaatattctgtatcttctgtcgattggtagtattatttttttctttctcaatcacggatataagtaataaaaaaatatttttattttgaatagaaataaattttaagtatttatgttttatttaataaggtaaaaaaatgatacttgttatcaagttttgaccaaggatcaattttaaaaaagacttaatgatttaatttaacaaattaattaatttttaaagaaatatgaaaaatttatttgtttttagttataattgagtcgggaggagt

SEQ ID NO: 3875 - DNA, 1000 bp, Glycine max
  Soy_ogl_3455 Gm10:39315801..39316800 Cluster 15
tccatttaattagcttaacgacatgcttcatggactgttcacactccatgggcttttatatcttaaaaaatgtatttttttatggtttcataaaagtaaaataaaaataataactagactaataaaataaaaacagcatgggtcattttacttgaaattaactacatttcaaaatagtcaacaacaaaccaaaaccataaagaatgattctcatacattgagtgattaatttggactataaaatgataacaaaggatacataaaaagggtttttagtttgatttttagtcactttcttaatttatcttttaaacaaatatttgtttttaaaaatgtttgaaaaataggttaaatttcatattttaaaaaaaaaattgtgaacctggactttagctcacgggctaaatgatgcgattatgaccttactaaaatacaactcatttaaaatgtggactttgtgagatgggttgtgcaaattgtgggtgtgaacttaaatgggcatgtttacctactatctagctctaattgagtcttataaataaaagcaaatgaagtaataatttctaaatattctaaaacaaaataaaataaaaagcatgtatctatataattaagtcaagcttgtaaaaaaaagtcaatattgttataagaaaattttaactgagcttctaggtttgaaatttggcctcttttctcactatgacattcctacaatggtaaatgatcacatctgaaagttaaaaaataaaataaaattagcaatcaaatttcaaaatttcaaaatatataaattaaacttatttcaatatcttttgagaaatatgaagagttacatgctaatttaaccatatatatgttttatacgtataaatcatatttaatgatatgctatcgatctgatagtttttttttttttttggagaagtctgatagatttagtaaccatttgtcttgaaaaattatgccaacctaactatgtggccggctaaaaatgaataat

SEQ ID NO: 3876 - DNA, 1071 bp, Glycine max
  Soy_ogl_6723 Gm20:33257830..33258900 Cluster 15
agaaatttgtaataatttatgtattctttttaatcaattaaattaaacttctttcatacttatatatcatattatatatgtattgctgtttagtatattcaatttattatcattgtatattattcgtgaaagagtaatagtgtccatgtcttccatatacaaaaaaggtgtatcatttttttatgcatgaaatagggtatatcttccaccgtgagaggcctaaaattacgctgacaaagagagaatgttgatatcattttctaaaatatttgattggaaggaagtattcttgacttttgatggatggatgattgggtatataatgattacaacaagtgcatcataatgtatttcacagtctgtttccatcggaaggcaaggggtgaaactggaggagggctaaaaataatggtgaaaaagagtaaaaatatagtataaagaggcttcaaagttcaatcgattaggtaagtttaaaaatatttaaaattaatatatagagagagaaatttaaactaggaaaatgatcatttaataaaaaaaattaaaagcttaagttttttttaatataatacgttttagtttgatatataaaaccaacgtgcaaataaatttaggaaatgaattgacataaaaattcaataattgaagcttatgttcggtagagacaatttaaaagatggaaaaaaaattaaaagtgtaagaaatgaaaaaggatgaaaaaaatgaaaaattagattgtttgatcgagatgaaagataatatgaaagagatgaaaaaattaaattaaaataattagatgaataaaaaaataatgatgattcaacgtatgttcattttattccaccaagaaagcatactttgttaagtagctgagatgaatttttttctttttacaaattaaatataccttgagcagaggtccttggaaagtaaattcaaaagtcactaagcttatgtttggatggaaaaattaaatcaggttatttcaattgagatattaaaatgtcttctatattaggattggatattttaaaagtaattgaaatgttattatttttgtaaagttgacaa

SEQ ID NO: 3877 - DNA, 1300 bp, Glycine max
  Soy_ogl_606 Gm02:42471601..42472900 Cluster 15
aagaaacaagaaacattgtaaactgatataaactaattaatattaattaatttcgaccagacgaaaaggaaaagggaagcttgtttataattttaaaagactaaatcacttttatttttagatatttttgtttattatatatatatatatatattactttctactcaattaaataaaaaaagaaaaatattaatttttccttgcaaaatatatccataaaatcatctaactttcttaaatcaaacataacattaagctcttaagtaattttaaattaattatacttactaattaaaaaataataatacttccgagcgatcgataacttactaatcgttaaccaatgaagggcagtggaggtctcaatcctaacgtgcaggaatatcctaactgttaatcttatctgaaagaatctttggagagatcgtcaaccttttctttttcattgtgtgtctttttgcgtgcttttttcgggtctgtaataggttcgttgttcttgatttgttttttttatttgactactttaaaataaaaatattaattttataagatatcatacatcaataactattaaataaaaaactaaaattaaaattataactaaactaataaaatatttaaggatgtatataagagattagttttggatgaagtcggaatattttttaattgagagttaaaaattaatctcttgatatacattcatttaaggagttgataatttttaatagatgcttttatgaatacacgttgtaaataaaaattttgaacacatgcttaagggtgaccgattcatttagcgttttcaaccacggatccatgtccaattttaaacaaatattcataattttttacattttatatgattttgacgtgaaatttagaaaatacatgcatttaaattatctatccaaaacagtgtgtttagaaataaaattttgtattaattatatcacagtgactttaaaacttttaaaactcattatataatatatatgtgaattgagtgttgaaagtttatcgggatcaacatgtgttaagattcaatgacctagaaatcaaactcatgttatttcctaattgaaccgatctttatcaattataaatataattttattatgattcttaactatcaaaattaaaaatatattctaccttctaaattagtgagagaaattaaatccatttttacaacttggagcgagtgattcacggggacagtatcactgtgtcagtttcagtcaccgacaagaccctctggttagtcaaacttgctacagtgcacattttaataatgttt

SEQ ID NO: 3878 - DNA, 1031 bp, Glycine max
  Soy_ogl_2706 Gm08:15677201..15678231 Cluster 15
ttaaaaaataaaaagaaatatttttaatcgatcccacgtgtaacaaaaatcatccctagaagtaaaatagttgtttaatttgcttcttttatttgaaaaataaataaattttaggtttaaatatattttttatttttacaatttaacgtttaaatgtattttttttcattcttaaaacactttacataactttttttcattattcaaaatattttcttactatttaaaacaatatctaaaacgccttaaggaaaaaaaaatacattttacaaaaactaaaataatttaaaaaataaaaaagcactaaattacataaaaaaatatgttcaagcctaatttttataacataccaaacaataaataattttctattaaaaataatataataataagtttagtttctcaaagttataggaaacaaagttcttgctaataaaaaaatgaccttaaaataattacaactatctactaggaaaaataaaaaagaagatatgattggaccaccatttgagtgcaagttggagaatggctaaaacattgccggctaatattcaactaataaattggaacagctggtttggttgcttttagtatgagaaaccaaagaatcaatgtctctgccatggaaaagccaaaacaaaatagtttggtccggtggaatttctcaaaggagttttgagtaatttagaaactacgtcttcagtagattggtgtttggatactcgtacagatgcacataggttgtgtttgttcgaggatatcacaaattattctaaaaatgtaaaatattacctttttttattggacattattgatttcgaaaaatatgaaatatttatatttgatttacttcttatttttcacaataaataaatatttaatataattatatatttgaatctcttttgaaataagttatctatttggcatctctaattaaattaaaataacttaatattggttgatctaggtgatcataccctctggttataaaaacataaattacttcttatagtaattaccaattcacg

SEQ ID NO: 3879 - DNA, 1300 bp, Glycine max
  Soy_ogl_4412 Gm13:32417501..32418800 Cluster 15
tgcaatggccaatggtataacttttattaaggaggtctaatttaattagttagttgagtaaaatatgtgagttattttaaattacttaatatattttatttttaaggataaaaaattgtacaatttttgaagtagttgttataaaaattattaaacttttcataaataacaatttgtttttagatgataacgtaaaaacaatttatgtttagatgacaacgttttttttttaatcagaatttttagatgacaatgttctattcactctcaaaataacgattttttattagttgggaaaaatgatgaatttacttcaatattacgatatatgataattatttatttaataatgatacaaatgattagcatttgaaatgaaacagatttcaatatttcaatttgaatcaattataacgaggtaatttaattacacaaaagacagtgggggataaaaaaaagttagctatcattaattaaaaaaaagttagctaattaaaataaaatgtagcaagctaggaactaccaaagctaaattccgcgcatcaacaaatgtacaaatggatttgattcttaatatctcttatccaaatgaaaatgacattaggaatatgtaaagatgtaaacaaaatgatatttttagtatgatattactttaatgatcacgaggccatgtgcacacttcaaacgattctaatatacttgattaaaatgtaaagaatttcaggcttcagactttttttggaatataattatattttgatgttaattaattccgtgagttgtaaaaagctgctgtccgttgagggaaggggggaatattgtttaatgtgtgtattggattgagaattttaattttttttattaaatttttgtgaaattgaataaagactttgaacaatataaataaattttatgatatttgattaagattatcaaaaaaaaatttaaagagaatgtcaaaatctaatagtattcagttgagcttttttataatttataaaagttttcttgtattaaaaaataaataaattttgatggattatgttgtaaagtgaattttgtgtgattttagtagatacattcattcaacaatctcactcaaaatcttaagattttatactctcattattttttttcttttgttgtccaacatttctttctttcaagccacataattcgttctcttcagtttcattgataaatgataaactacttggtcatttatattttcctatcgtacacgctttcctcgcaatcaggtaaaagatctttccacgtttttttttccttcctttaataa

SEQ ID NO: 3880 - DNA, 1105 bp, Glycine max
  Soy_ogl_5922 Gm18:3281101..3282205 Cluster 15
attaataaaattaaatgatttcaactaatatttttaattaatatgaaattaattatttttacttatatactttgatacatatcgtttttttacattataaactacattgcttaacacgcctcatatagatatgaggattttgctaacaagtgttattgaaatattgattaagaaattagaggaaaaaaatatttactgtgaaatcatagtagaatgaaaaaaattcataaacaatacaattttatatatcctaataaaaatctttttttaattgcttaattaatgtcctaaaaacacttattaaatacaactcgttgaaaaaacctctattatttgtcttgagattataaatgtttattacttcttttagattttgtctttttaattttagtctctaattaaaaataataatttattttaatcatttggtaatgttgatctgtaaatcaataaataaataatgtttgataaaattaaagaattaaaatgaaaaatttataaaataaaataaaaataaggtggtcatgcctatgaattgattaaattccagaaaaagaaacggaagtctactcaagattgttactactactagtctactagtattagtatagtaagtttgatgagctgtcatagtagggggcaccctaggcaattaagtcacaaattaatgttctattaatattagcctattaattgtttctgctgaccataacagaagcaaaacgaatcaaagttaatgggttttaggttttgcaagtactgcttctttaatagcggtggctattatatagtgctccgtacatttctagaataatgttatatattttattagtaatatttttagtatactttataaaaatactactatcaagtgaaaaatgaaatatttaatatataagtaagaaagatactaatagcgtgtctggttgcgcgtcctgttctacaagatttatgtccaattctcattttaaaggagaagttactttttctagcttcagattagtacgtatttaatccacattttttggaagttggacggatccaaacacacaataaaaaatattttttaagtgtaatacttttttagagaatttggaagaagtta

SEQ ID NO: 3881 - DNA, 1194 bp, Glycine max
  Soy_ogl_5013 Gm15:12403801..12404994 Cluster 15
aaaaaattcacttatgtaactaatatattacaagtgatttatatgataattcacttaaattttacatttttattaccaaacacatgcatgtatcctttccttacaaagtactcattttgacagcgtttgaatggtgggtgcttaattaagaagagagactaagactatttttttaaaaaaaaaattaattaaagagactaaacagatcaattttaaatttaaagaataataaataaaataatcttgaatttaagacaccaaaaacattcttaattaagttcacaccacttacccatcataagaatcaaactcacaaagtgattttgaggatcttgtgttgtggtaataatctctagcaagtcgggtccacttgtttgacattttgttactagatatattatacattctctttgttccaccaagtcaaaatgataattatttgtaagatgggaaaacatggtggatggaatatcccgcacatagattatccacattgttcggtctctctcttcaggtaccttaaaactacaggaatattgttgagtcaaaatacgaagattggaatgccatgtaccttttgaccatgtgtgcgttattgtctaccttgaaaccatactgagtcatattaacttttgatttaaatgtaataggtacgcattaattagaacactataggcatcacaattaattggtctactagtgtgttcaattatgattagttgttgtaagttacaagtcacataaaattacgttgactatgagattcaatatgtctaactagttaataatttgtttggtaattaataaacatcctcgtctagccaaattattgattcaaaacaacaaaaaatgttagtttagaataagaaaaattgcttgagtcagttgggatgtcatctataaccaaaagaaaagggagatcgatttagtaataaaaaaattaagttatttaattattccttatttgggaacggcccctttgtaagaccgaagtactcttggattaaaaaacagtaggacaatagcaataatattcattttgatatctgcattggagagaatgtttgagatcctcttcaacatcttaaagtgtaaaaatgccttaatgtcagaaatggaagggaaaagctaggacatatagaattggcagttcgggtgaagacgtgactttttgaatggaaaaagaaattaaac

SEQ ID NO: 3882 - DNA, 1521 bp, Glycine max
  Soy_ogl_2790 Gm08:22460301..22461821 Cluster 15
acttgatgagactatctggttgagacaacctagaacattgaatgtgcttctactatatatctgcattatcaattcccaatcagttgaacgattgtaaacaacaaattaaatgaatgaaaaatttaagtttttgaagttttcctttcgccaattgcatatataattccattggcagttgattcttatagtatatataatattgtttttttatatattgaataaaaaagttataggtcaaagtcttggaattgatatttatgaatattaacaagaaaatacctaccactttgtatttgctttcagcttcctagattactacaagtgttgattctcttattgatagcttatagttcaatagcattaggacatcttttatctttttatcttttttcagtgtggtttggatatgaaaaggagtttatattttgcttttgaaattatcaacgatcgtatactagtaggatttattacaagtacatagtttaataattagtttgtcagactgtttagaaacaagtacctgctttaataaatagctttgccaaaatgcttgaccttcaatttctcgttagatatccttttattggaatgtccattgttattgaatactttttgcttaaatttcttattaaaaggcaaattcaaggtgttagaaaattacagaaggttgaagcaagccttgattttttttttaaaaaacctgaatgagagccaatgccactttgcttccaaaagatactgattatattctacacagaaacatctatagtaacaccattgttttccatgtgtgtgaactatatcaataatttcacatttctatttttttttacaatactcacaccttctatttataataataaaaaataaaaaaacatttcttctttttgtttatcataaaagaaatacgagggtaatgtaagctgagataattatttttagaagaagataatttgatttaatttatatcttttgataaaatatgggcatgccaagctatctaaggatgaatgtctcatttaatttggatttcaataaattaattagttttattccgactttttttttgttaatgcacaatgaggaaaggatgttactatttttttttttttttggtacaacggaggtagctataaggtggtatatatgttaaattctcttcatttttttttacctttttttctctgggtgggtaacgattttttgttattgaattctttcaagaattttcggagttcaattaatttttttttcctggtgattctaagcgtatttatagtatattgtaagcttagatattcgatgatttgttttatagttcaattgtgtgcctgacagacatacttattcatgtttgtgtggctctagattttattttttattaatacttgtcatttatttttatttattttggatgacttgacttttgattaaagattgatgtaactagtcgaaccatatgtttttgttgccatgcattatgcaatttcttataaattttttgcaaaagttcgacatatg

SEQ ID NO: 3883 - DNA, 1416 bp, Glycine max
  Soy_ogl_4054 Gm12:15925385..15926800 Cluster 15
cgaaaaatgaaaatatttaagaagtgctagtttagtgtgcatttacttagtttcatgttggatttcctctaatcacgtttaaacgacttagtttgtttaagttttttatttttattttgtaatgtttgtttaaactgtttttacttaaaataaatgccttttgttggtgggattgtgactttctgttttcaaaaactgaaattatttatgttagatttagtgtatttggtttcaagttggattccccatacatactaggtaatctggtttttggtgcatattcacatttctcgttcgaaaatttaattttgaactgataattaatttttaattgaaataactttaggcttgcgttgataaaaaaaaatatacttattttttttattaacattttagaataaaagtattaaaatataaatcacaccactttaaaatgtattaatttaaatatatttttagttagttaaattaagggtctattttttaaaaaagtctcttaaatttggtaaatattttttttctctcaaatttgataaatatttttttaatccttctccccaaaagtgttaaaaaagaatcttgaatgtgtaatttttggtggattttgacggccttaatttattttggcagtcgaaagcagccacaaattaaaaaatcaatatcctccacatgcgtacaataataacatgtatggagagggactaagaaaaacatttgactaatttggaggactaaaaattaaattttaatttggagggttaaaaaaatccttatatttaaatgattaaaaatatatttaaactaaatcaattttaatgaaaatcaactttataaaataatttaatttaaaattaattttttcaatgttgaccaaaatacaaacaaattattttcaataattgattataaaacacattttacataaagcttagaaacgaattataaatagcaagaatatacttacatctttattgctaaacaatttatgaataaataaatttataatttatatcctcaatcatggcattataagctgaagataatttatcatacaaacatattagaatctaattccatatatttaattaccattcatatataattatcactaacatattatcgattctaggcaatatgcataacattttaaatctctgttatgccttagagtaacgaaacattctagaacaacgtgttgacgaatcagataccttctaaacatgatttgttggatatactctaaacatctttcacatcacatgattagaggacgagttcagagaattagtgaacacttattcttgattaaacacttctcaaacaatcctatcacaaaataaataaaatcaaataaaaaagacaactagttgtttccataggaattaactaattatttaaactataacagacatgttt

SEQ ID NO: 3884 - DNA, 1100 bp, Glycine max
  Soy_ogl_6163 Gm18:53849701..53850800 Cluster 15
aaaaataattattgatattcaacattatattttactaaaaaattaaaattagtgacaaaataatgatttatatgtaattttaaaaaaatcatcactaaaatttttatgtccctgatattaatgaaaaagaagaagaagaaattttcatcactaaatttagtttttatgttttatttttttgtagtgaataacttttaaaattatgggtagcgaatattttcttgattatgcacaccatacgactgatcttataaaactaaaaagtaaagttccaattatagcttcaaattagggtgttcaacttaaaccttttcgatatttattgaattttatttatattttatatgactttacttccgagtatttgaaattcattgaaaaagtagtcactttaagaaagaaaaaaaagatccgttacttgaattactaggatccatagatctgaagttcactaagatgtgtataaatagtcaaagaattttgagactaaaaaactattcgtgtttatttaaatgttagaatgtcttttgtatgtacttatcctcggcttgtcgaatagtatactgcgaagaagcaggacaccttgagtaaatgacaggagaaaagttacatttcctacccccttgcatgtacaacatggttactataaaaaatgtaaaattcagcaaatttcgttttgtattataatataatatagatatcatatgcattataacgagtgagtgcatacttttttccattgcaatcacgattatgacttcttctttttatccaaccattatgaaactaccacgtgttttggtctttctcctttggccatataataataaccagtgaataataaattactacgaaaaatgaaaaataacgcatggcgagttgccgtggctgcttatagaacaaccgaaaaggcagaacctatttctcaccgaagtccaaatttggcgatatattcgaaattactggggaaaaaaaaatggttcccatttaaactgagactcacgagtattgatcaaacataatccacctgtagcctccccctgtaccactgtagttttttttttttgtcacttttttccactggtcatatataaataact

SEQ ID NO: 3885 - DNA, 1027 bp, Glycine max
  Soy_ogl_1322 Gm04:39411801..39412827 Cluster 15
ttgaatgttatgcatagtctatattaattaaagtttttttttttatatttttaggctttaacaatatagattgtatataacatttaataaatgttacaaaaatatattaataacatttatttataatttgataatatttttttaatatgacgaaaaacttttaataatatttttattaagtattaaataaaaaaatatcgttaaaagtcacatatttatatgtagcagtgtcatttgggatgctggccaataatattattggggattcatatatcatatatggagttgtgtgtgcaaaggagttagtgtaagagatagccacaagtcgacaaaggataggatagtagagatagtcgtgcgcatgttgaaatcaaactgaagctgtataggaatctagcttaatttgcgctactttttttatgcactgggagatacatatataacacagaaaattaaagtccccaaagctccatgaattcatgagcgacaattgatgcaagaggagacaataagtctgaggttacaccttaagttttttcaaagggagaattgtaagttattatcatgccataaatcagacgatctttagggactactgttcaaacaacttctcaaggaattttctttttcataggcctcaaggaaagatttaagcgcatcaatgccatgtcgaagatatatacaagtctcaaaatacttgaatggcgagtaatgaaaaaaatccaatatattaataatatggtaattagtatactaatttatataataatatacgaattagtttattaaatttaaatttaacatgccaattaaatttaaatttagtgaaattatttcttaatatacaaacatagaattaaaaaattaaataaataaaaattaaatgaccaaattatcaggataatttctatatatggatgatacgagtgatgataatgttagtattattataatttaaatcaatgttagttttcccttgattacaattgaaataaaaaagaatacagccatttatattgttagtatg

SEQ ID NO: 3886 - DNA, 1181 bp, Glycine max
  Soy_ogl_2350 Gm07:16880601..16881781 Cluster 15
atgttaactaatggggtaatttcccccaaaaatattttttttatttaaatatattaaataaatatatttttgtgttataaaaaaattaatattacccataagatagtgtttttaaaaaagaagggtgtaaaaaattgtaaaacataaaagagaagataagtcatggctataattttatctattttattcttttaatgtttttattttttcttatccctttttaaaaaagcttgttggaaaaatttctctacacataataaaattaccatgggatcttacatgaagcacgctgtaaaatttttatttttttggctctatatataaactaaataacaatacaaaattcaaatattatcatatcctgtttttttaaaaaaaaaaacaaatccccaaaataagttgaaaaaaattaataaaatatttaaaatctagataaaatcttaaagatttgaaacataacaaattcaaaaaaacaaatctcttacaattttcatctgttgcatttgttttgaagtttgaattgttatccaacaaagttaatattttttttttgtttgaaaaaatattagaaattttttgctctcactgattttttttatcgtcccgtgatgtcacaaataatcgcaaactcatccctgtcctaccgtgtaacctgcctacgacttatgactattcttacggacaccattcaactggtataatattccaaactgtttgataaagtcgtaggttcacctaccaaagaagaaaaagtctctaaaaacaagtctaccatgcattctcgttttcctttactctaccagtatatatagctccacgcacgacgtgggctactcccaaaacttaactcaaacgtggattatcattataaaataaattaacaaagtttagaatacattctttaacgcgggaacacattcttcaaagtatgtttgataaaactttttgaaaagtttataaagtaatttgatgaaaatttatttggtacatgatcgtatttcagtagtttataaaaaataaattaacttataagttactaatttctttctcaattttattctcacggaactattttaatttattttatctttttatttaatttaaaaatcagtttacctattttaattttcctacaaaccctagacagaaaatttattttcttagttattaagagacttgga

SEQ ID NO: 3887 - DNA, 1235 bp, Glycine max
  Soy_ogl_2354 Gm07:17242601..17243835 Cluster 15
ataaaatatacaagaaacatacaattgaatataaagacatataaaaaatgataatgtaaatttttttaaagaaatgattatttttttaacaaattaataaaaaataattgtttgattaacatttaaaaaatgttcttcataaaaaaattattatgagacaagaacattataaattgtttcattaaaagtacaaaaacaacataatttatcattatttttagctataaattattttttggaaaatagttattttttcaaattcatttaaatataataaacatgattattttttaaataaatttgaattagtcacacttattattttttaaacaaatatgtaatctaatgtagttattatgaaagaaaaaagatgattgataatttaatgtttaccaggcaagaaatatgaggttgtttgaaaatttaatggggatagagatgaaaaggggagaaagaaataattattttaaaattgaattataaattgctataatatctataaattaaacttgacgacacaaagaaattcaatagtttttttgttcaaatatttatagtgttgcactcgtattaaaaaaaattatgtgtatgcattagcatttacacacacaattaaacacatgagcttaaattaagtttaaatagtttacaagtagcttgactcatttatccttccagaaggtggcggtaatgagttaaaactaagattatgacatatttttcttcacttttcatactttaaggataggcacatattacattgttattttaaaccctaaaactaaggaatgagtatggaaaataaattacatgaatcccatcaaaagatatttttcttaaaactatatagaaaactcaataaacgaataaatcgtgagaaaaacacaaactatatttaatttctacaatttaagttaaaatttatcaattggataagtataataggaaagctaccaaaacttattgttacatttctctataaaaacacttcttgtttcataattgtagaataaaaggttaattttaatccttattatgagattagtaaattagaaaaaaaaattatgacatattgcataattattttaaactatgaaaatgatgagggtaaaaaataaattacatgagtctcattaaaagattttttggtcgaatttgattctgggaacaaatatcaacatgtgcatgagtgtaataacttgagtctgagtcacaatattatttacatcaggtgg

SEQ ID NO: 3888 - DNA, 1500 bp, Glycine max
  Soy_ogl_3889 Gm11:30039901..30041400 Cluster 15
aattttcgattacaatataaatacagtgaacaaaatgcatcaaggactttttttcacgtgtcattataaaaaatcaaacaagaaacaagataaattaaaagaatatcaaccctcgcacagtctactaatcaaataaatattaactaaatattaaacatgacatacgtgaggggaaaaattagggtaacttgaacacgtgagaaaaaaattagggtatacttttttcttaatccaatctcgtttatgatgcatgattgtcattccaacaaaattttataaatcaaataaaaattattttactaaataaatcatttctcattttataaatcaaataaaaattattttactaaataaatcatttctcaatgtatgaatgcaatgtgacttacaccattatgcaatcctatgatatagggtgtatttgattgaaggaaaactttttttttggctgaaaatcataatttttaggaatgatatgattaaaatttgtttggttggttataaatattctcaaaaactatttacatatattttctgataattaaagattttcacttttagttttaataaatttttcttataagctttaattatttgcttcattaaattatccaatatgtgatatttttttatcgtagtaaaactttttttccaacacgacaaaagttaaattctcacccctctcattggaacaatttcttgagaaacataagtgattacattccaagaaaacaatgtttattattttttaaataataaaccaaacataataaaaaaaatgtgaatcaaatttttttctttataccgaacccccttagggcggaagattaacacaattattttatcatgatgtattttctttgtataataaaatacactgacacaaaaagatggactaaaaatccggtacattcatacaaaattctgaaaacaactcactattgcaagccacggaggaatcaaggtctaaaatatttttaggaatcacgaaatcagttatacttggagttgaattaccccatttattgttcttggcaaggctttcacaattttctttcttttccccttcacttgcggttcttgaagcattgaaatcttcaagatgagaaaagtgtcgtctaatgatttgtcttgtcttagtcttgatcttggtccaaggcttttttgctatcttctttggagataacatagccaaagtttgtaatagggtgccattgttggtattctgtggtttctttgagccagggtgccttcttggtatcatagcttaatctccaaatattgttctcaaacttgatttgaatgattaatttgtttattttctggtcataataacaacttatcaagatatataattaatttttttattttttatgatagtaatatcttattaagtggaaaagagatcgacttacgaaaattgcgtaatatataaaaagtaaaaaataaaaatattatacctttcctttttttaactttattaaaatttgaattttacaa

SEQ ID NO: 3889 - DNA, 1056 bp, Glycine max
  Soy_ogl_4192 Gm13:21793101..21794156 Cluster 15
catgcctatttagcaaaatatttttaataaaaatattattattagtatgatgtattatattataattatttaatgatattacaaaattattttagtggtttgataattttaatgttgaataagttaattctcataagcatagattggtagcatgaatatgaacttttttcttttggtaggactcaaaagacttttgtgatcttccatgtgtaatgttagtagacaagtttttaccacatcaatcttgtggtttaaaattgccttaataattaatgaaaatctttatctttattaaagaaaaaaaatagaaatacaaggcatccaatttcagaaacataaaaatgatatgtaagtcattatttcacactctaatatttttcaatgcataataactttactatatgttatgcgatagtttttttatatttttaatatgaaataaacatttaaataaactagtggaacaagtccaacttatataaatggaaaatctaaacctaaatataagttcgtgataggtaacaataacttagactatataaatataaaatatgacatatcaaacctaggtaagacctagtctggcccatcccatccacttctattcaccatgcttatcatccaattcacttctattcaccatgcttatcatctgttgcgtgtaatggtgttgctcattgtgtccatgtcaaaatgttacatctggtgtataatgatcatcaccaaaatgtcaaaacaagagatcacatgataagaggtatagagattaggtaagaatggtgtcatcctaacaagttcatggactacaccattgccttacctcttaacaaatacaactgaataagatgtatttaggactaacaaatttttacacttttgaattatatgactcaactccgatttatcgacggttgaacttttgattttatccacaacactcttgaattactaataaaactaaaaactaaaaatgatatattttagaaaattaaaaatacttaatttactaataaaacaataaatacaaagttatgctttgtggatgaaatactatag

SEQ ID NO: 3890 - DNA, 1072 bp, Glycine max
  Soy_ogl_5353 Gm16:26822422..26823493 Cluster 15
tttgatagatttaaaatttttgttattacataaattatgtccatttaaatacatatttcaacaattctcacttattaaaatatctcttaattaagtgattaatcttatttagtccttgaatatgaaatagattttgttaaaagaaaaatatttacctcatgcacactcaccattttcaacaacaaaaatttatcattactttcaatggagataactttataccaaaatcatgattaaaaaaaaacaaacataaagtctaacaaacatatacatagagttagtacataaatcatatctccaatagccgaaatcaagaggttcgtatgaggagatatgaatcaagttttcgatcctaactcctaagatagtaagatacatcttgatcttgcaatcactaatatttttttcaaatgccgcaacgaatataagatgataataaggcattaagtaaagatcaagttgttgtatgataataattagccaataacgttaagaaagaagacttgacatcgcgtgcacatttgattccgagtttaaaattaatgtttgatttcacattaaataaaagttaagaattagttgagtgaagataactttaaagtaatttttccgttgaatctaattttttttattgagttttactcttaatttaactttatataaaaccatctaaacataaatcatgttactttaaaattaatttaatcaaaattgattttaaatttttcaaaatcaattttcacaacattcattcaagcatgtactcaatcactagcatgtaatcacgtcggaagaatgtagaacatttaaaattgttaatctaattaaataagatttgaccaaataaacgggcacctttagtgacagcagccacgttaattagtcacattggtaatggtattaacagcagatatcaaaacttaactcgtgtgtgtaaaaattaaaactaaccatttttttttggtatagaaagtagagacaactttaaagaccaaaatagcaactaaaactataatttttatacttaaacttattttttttagtaaacattaatttgttaattttattaaaa

SEQ ID NO: 3891 - DNA, 1100 bp, Glycine max
  Soy_ogl_5705 Gm17:18786901..18788000 Cluster 15
caaaccttcttctcttcctagcatacttccattttcaatgcaacaacacactctcttttttatatcaacaatacattttcttctctttcatcacactctctcctctctttcactcttctcatccccttttatttggaaagtgtaaaaattttaacattttgaaaaatactttctaaaagaaaaaagatattttctttaaaaaaaataatactaaaagaaaggtatattagtaaagttgggaaagtgaaaataacaattgtctttattgtttttatttttcattggattgattcattttcagctctagttatcgaggtataataaaaaaaaattcatatttttttgtttttatatctacttattatctattttatgtgaatatttaaataaaatatatcctgttctttaataactaattatttattttatttaatattaaattttttttatagttatcactttatatacatcattaatttcttgatccaaaatatattaaaaaaatcattattgaaatgaacaaattaaaatacttttgtttatgaaaggataaaaatagaagacaaatttaagaactgataaatttaagacaaatttctgaattgataaatttgagaaccaaactagttatatttgtttgattcagatttaaagtgaaaaagtcaaattaacaaaatcaaactaaaataaatttaattgatgatatgacttgaattgtaaatagctttgctacagaacatgaaattagtcttaaacttaaatatattactttatccacattagtaaatatatttaattataaaatataaataattatttatcaactttttttatttaatagcttcttcttattcaggattaatgaatgactttgaaccatatatagagttacacaactctagattccaatttgccataaccctactgataagatagtttaattaacatcaagtacacactttataatttagtttcaacttgatgttacaagcttgtaacagttggaaaattcaagcaacgacgtaactaattaaaaaaacctacttgcttgtaaaacaagatcagatactttcttagttaatcgaactcatgccaatagt

SEQ ID NO: 3892 - DNA, 1087 bp, Glycine max
  Soy_ogl_4061 Gm12:24277114..24278200 Cluster 15
ttgactcagaaaaagatagaatagttactttgactttgctctctctatatataaatgtttacttaaaaataaatgagctagagatcacgtaataaaaaatctaacgttagctagagatcacgtaataaaaaatctaacattttggccgacatcaaatactacataggaaatatatttatattttaaattttagaaaaataacgtcagaaaatgaaatgaaatttcaaaaatagtatttgtatatttaattaaacacctttttgtctcacaagatatcattttataaatttactgcacaaattgaatgcaatacaatgtaactaatttaatataatattatctcacatttaaatttagataaattaaagatatatttagatttaagtcaattatatatttttggtagaaattacatatcatctctatgaaacaattttgttaaagtcaagtaacactcaaattcgacatgacttgtcaagttgaaataatgtacgtgttataatagttgatttgcgcatttagtgatttaagtcgaataattagattttattaagtgccaaaaaaattagattctttttgtatataaaaatttaaatgagttggatacttattaagaacaagacatgtctgaacactaaaaaagacacttacaaagtcagttataaattacctaccatgtgatacttacatatctatttatcactaaaacacattactaattcagacaattaaattcgttctgttgactttattttcgattcccctagttggcggatggtcattatcatctaataattgcatttttaataaattaattgcataatttttatgccttgttgagttgaacttagtcaacccatgatagtggttgtcttctacacactacttaatttttaaaattcacataaagcttgtatgttttaattacttaaaaaaactctaattaaaggtttaatgttttctattctttgatagtgatattgttaaaattatagacttggagtattatcataaagtataattatatatttttcaaaaaaaagtatatatataatataatatatattcactactattttgtaacaca

SEQ ID NO: 3893 - DNA, 1083 bp, Glycine max
  Soy_ogl_4247 Gm13:24289518..24290600 Cluster 15
agagatatacaaaaattgttttaataatgtatcaaaattaaagtttataaataattattacttaaagtgaagtcaattctcttttaaaaaaattattgcattctacgataattgatgttcttagagatttattaaaagaatatacctctaaaaattatttactgttaatttgaattattagataatgaatatttattatgatatttttaagttttgtgttttttatgtttctttactacaaatttatcatcaatataatagttattattaattttccaatatatgttttgttcactttgaacttttactatgaaaagcaggttttaaaatgaatatagaatcaaaatttcatgaaaaatatgatccataaaagacaatttaatgaaaatgttattgatggaattaatcacatattttttttctcgttttaattattttatatacatattaattctatatatctcttctattgagagttgtgttaaatgaattttaaaatataaaatcttgtttggtgttttatttgaatttctaaatttaaaactttggatgaaatgcatttaaaaaattgtattgatcttaaaaagctcttaactttttggtgagcattttgatattaatggtcttagtttacttttaaagttgaaaatattaaaagtctagaaaaaagaattgataagacgcatgtcttgaagttttgttgctaaacttgacagattatgcatcataaaaaaatagtgagcatgtccattgcttgatggtacgtacacgtataataaggagtgtgttcatcgcacatacatatatatggatgcttactgtgtaagaggtaatgaggtattatcaataaatatttttgatacattcaattatttcatagtgttattcattgtttttattttcctgacattgatgtcaaacattcactatatttgaggattaatctaagaaaattttcgactgaattttcatttgagattttttattctaattatgtttttttattaacaaggtttaaatttgagatattgtttaatataatcgaattgaatatcatttgcaccaacattttgttgtgatgtt

SEQ ID NO: 3894 - DNA, 1147 bp, Glycine max
  Soy_ogl_6067 Gm18:18758054..18759200 Cluster 15
aaagttgataggtacaaattgtttaaaatctattttaaatattttattttgtcatgcgttagagattataagtatttttttaagtcaacgattaatctggcttcgtcatacatcactagtgttagttcaaaagaattttacaaactattaatacaatgaaattgtcaactaatataaaataaacaattatttctaatataatgaaattagatttcatcattataataattgtattaaatatttgttataaattaataaataaatatatctcaaataattaatgacaaaaaatttatcactagtaaaaataagttattatttttgcaataattactaatatgatataacattcatgaaaattaacgctagaacttataataaaagacacaaattcatcattaatattttatattagtgaaaaattatttatgattgtatacttttgttactattgatgaaattacagtgacgatttataatttagtcactgttatgaataataattgtgacaaactaaaaattagtcacaaatgaaatataattattgtttaattataattttgtcactaaaagtcatattttttgtactagccatgatttgtgtttatttatttttttatgagggactactggtatgttaatatggctaaataatagggatttcaaatattatagtgcattctgtaagaaaaaattatatatattatagtgcaccagtaaacgagactaaataaattattttaaccgtaagtggtaaagtattgaatctcactttaatgatgctttctttgtctaaaaatgattgatatttaaggtatttttgagataggtaaaaaaataaatattttaagggaattaacatttattggtaaataattttattaaaatgtctttgttttttcttttaattttaataaatatatcattaagtctttcaaaagaatactatttattagaagatacaattaaaataaatatttaaatatcttattaaaaaataaaaatattaaccaatttaaatttttttcaagaattaaaatcaatcagtcattttggttcatagacagagtattactttacgtatttctcaaagttttaaaaaccctaaagacaactaaggttacaattaatcttgtgaggtgtgact

SEQ ID NO: 3895 - DNA, 1000 bp, Glycine max
  Soy_ogl_1618 Gm05:27230701..27231700 Cluster 15
gagcaatatataagggatccaaaagaaaaaaatgaatcacctgtagatctaagaaaaggaacatataggcctaatttaaagcatcgagtatgccacttactaatttatttttattttagttttttgttatttaattaattttaagaaaatatatcatgattgttttttatttggtacaaaaaaaattgtttgttaagagaaaaatctaatgactgtaaaaccataaaaaagaacacataccaagtgttaagctatgttttacaaaactagttgaaaaattaaaaagttaaaaaattagtttgaagttaaaaaactataacaaatgattaaaaaatagttaaaagttgaaaaactatcttaatgaatcataaatatttagtaaagttgtctatttaagtagatgaaaaatataaaattacataattaaacatatttatgtaatacttttatgcaaattttaatttgattttcttgacaaaaaatatattttatagtatttataattttagtatattaaattaattttaaacatttgttataaaagacccaaaaaaaaatacaaacgtattatatatcactctcaatatcatatataataaaaagctaaaaattagaaaatcatatgtatagaaaaaaaggataaaaataataaaatttaccttaaataaaaaataaaaagagaaaatctaatgaatgttcaaagataataaatataaaaagttagaaattggatattagcattttaaaaaatgttacttaaagtaatatctcaaaaaatgttaagaactattaaaaataactcatttatcacaattaaataaaatttttaactgataaaaaaatataaaaattaactaaaatgacttaccaaatcaggctcatggtatatatgtttgtgatttggattgagtcttgctattttattattctcagctaaaaaaaactgctattcattcttttggtacggaaatatgaaaggcaagtgcaaagaaaagatagt

SEQ ID NO: 3896 - DNA, 1000 bp, Glycine max
  Soy_ogl_2054 Gm06:42568401..42569400 Cluster 15
gacttatgaatgcacacaagttgactgttttttttttctaagaagatttattttatactcaaaatcaggatttaaaggatagatcatttagttaaatgacagaaattgagatatcactttgtcaactaatgttggtatttcaaaactatatgctaaaagtaataaaaaagaaaaaaaaattgactttatgagatttgtttatattaaaaagtggattgaatttaaaaacgtttacataatttaaaaagatgctagataaatagaattatatataacataaaaatcttaaaaagttaaaaaaacacataaaataaattagatttaaaaacacacatcaatttttttaaatcacatattttttactggaagtaattatatttgagcggtcaaaaataaaattctttctccaaatattcaacgcaactaacacacatcaaatttaaagtatgaaaatgttactacttatttccattattgttagtaaaaattaagaaataatcctatatcatattatatatatgtgtgttgattcgtataaaaaaaaacatttcattgactttgaaacttcattttatttaatttatttaatgttccaaactgtcaaaatttatagtggagattcaaaattagttgtttataatgctaaaagtcataaaagaaattaaaaaaaaaacaaatttgactttatgaaattcgttatattaaaatagattaaattcatgtacacacattccatgtcagttttcagcagtcattgatataatttgaacgagaacatgcttaaattaaagttaagaatgatactaaaatgaaaataaaatattttggaccaaatcaaaatttcactaaacacaggaagtactacactacaaagagatttaatttagtccatataagagccttcatatgaccattcaaatattttttttaaaaatacaagaatgtgtaaaaaggatcattttatttcaattttatacaaaacgatcaagataaaaatgga

SEQ ID NO: 3897 - DNA, 1126 bp, Glycine max
  Soy_ogl_3855 Gm11:16829001..16830126 Cluster 15
cttgtgtcgcatttgaaccatattattttaattggacctccagttggcccctttagtgggagaggattcggatccataatttttctgcttcccataagtgcatttgcagtctgaaggtttaatttttattttataaatttagcttaaataattactttttgttatatcattataaatttttatatttttttaataatctctccaatattttttaattgtaaaataaaaattaagtatttttattttatgaaagtccatttgtatttaatatttaatattattagtgtcattgaaaataaatgatcaatctaaaaggaaaattttactattacttttatttattttttaatttttaaaaacagagcttcatagtatacatgcagtaaatttttggctgcataatactaatggtttttataagaaaaataattgtttattgaaatagttcatcaaaacatgctcattttttttatatagtacagatcaaattggtggaacagaatgaatgacttgttgtaaaaaatattatattattttcgattttcacatattaaaaagaacatcgtcattttttttaatattcatttccaagattaaattaatacacgtctttttctcggtgtcaaggaatcttgtcatagtataatcatcatttactactaaacgcatgcattaactcacatagtcgtttcaaattattaaatagtctcaaatttaaatcttaaataggtaattaaataattttttaaaaaaaattatcattcattatcttactggtatcagataaaaaaatttggtagaagaattatcagtgtcattgtcccagcaactgaactataatcttatctgatgcatttcaatatgtcatggttgtaatttgaattaaaaaagaagaaaaaagattgcagtttcaactttcaagttttaaccataatctaatccactcgcagaagtgacatccctcatatatatacaacgaatgaaaaaacgaaacgaaaccaacagtctcaatcccttaaatttctactgatataagtcacattcctcgcctaatgtgctcacataattcacatcactccgatgatgatgtatctctaaagttatattttttttcttcaaattaacg

SEQ ID NO: 3898 - DNA, 1137 bp, Glycine max
  Soy_ogl_3888 Gm11:30038575..30039711 Cluster 15
ataaaataatttaactaatatatcttttctttaattgaaattacataaaggcatttttaaaattattttacctaaacctttagcaataaatattttaaagtaaaaataatatttttacataaattaaatgcaatatataaaattcattaatttattgacttaaaactaattctattcatctttgcaaatttaacaatacgcgtttagatttgattttaagaattcaccaaaaaaaaattgattttaattaagacaacacagacaaactacaaaggttcctgaatctaaaagtgaacattgtatagttgcccagaataagtgaattcatatccattgtctatttttgagtgagctaatctttagttagattttcatttttaaataaataacaaaaacattcgttttaaaattctgaaatctttctataatatctttacaaaaattattaaattatatgattttatacttctaaaatattaaatgtatatttacttttatttaatatttatcttataaagtactaataaaattagtaagaagatccaacctctttcattttcatttagttgcatgtttgccacttgccaacatcagtccaacacctaagcagctaagctaaagtcgttatttcatacttctcttgcgattacaaaattgccacgatttcctctgtttttaaatatctgatatctttttctcattcggcaaaataatatcaatattgtttgcgagtatttttgtttaccttttttctttaagaaattgaaaattttcaacatgaattaatctaagccattaaatgattaaatggtgggaataatatctctttactctctaaagagataaggcccacttcaaaggattgtttttgaaaggccacttcaaattaaggatcttaatcctttctattaaattttttaacaaatttgtgtagtaaaaatgaacattatataaaatatgcagctaaaaaagagtgaaaaagataattcagcaaaaaacaaaagagtgaaaataattcttaaaaatacttttatcaagaataattctaaatcttagaaatgcttcagtttaaaaatgaaggttcagatttataatatagaaataaatttaatggaagtgcctttgaaaattattttc

SEQ ID NO: 3899 - DNA, 1174 bp, Glycine max
  Soy_ogl_5070 Gm15:17494201..17495374 Cluster 15
acaaagtttagagagaataataattatgtggattctttccaagaggagtaatttatagatacaaaagataattgaaaattttataagagataaataaaaataagataaatcataaaagataaagaaagatatagacaccaacaatagattattcataataaaatgtaatttggtaaagttaaaattatatttgtaaaaaaagacttaaaaattatatttaagtcattagggtttatttttaagtttttaaaatagttctctctcttctcactttattaatggtaattttggtattaggaaaaaaaaggattttttgtacagttttggatagaaaaaaaattgaaacagagattacaaaagttatctcctttgtctcttattttcacgttttctaataattttcacactcacgtaaaaggaagaagatgaattcaaagaagagagaaccaccaaataaaaatttctaaactatattatgaatatgtgtaagtcttctaaactctctcaaataaattacaaagtataataatagtgaggaatatgttctctaatattcttgtaatgtaattttttgtatgttgaaccctaataaattatattacattaggcatcctagtatagttagcgataccatttcttttcttctattagaaagtttttttgctattattttccattacggaatgtgggatgtaccagaatgtatgggtgcattatcaggaaaatacatgcttcacgtcgaagcgacttgagtttgcattagttttcgtgaaatgtatatattcaaatgcttttgaccaaaagcttttattagccaagaatagtaatcgattgaagatttctttgatgccttgaacgtgaaatacattgggtcttagaatacttttataatgatatgtgagtataatgataacattttcatatgcttttggtggcttcaatcatgttattttaaagttttatttaaaaagaaaatttgtaaaattatttttatagataaggaattattttataattatacatttacgtgggatttgttaattacaaaagtgattaaatatatggagtttctaattataaattacatggttggttgatataaggatactatatatattttgtttggatttaatacaaattttaattataatacatatatggattactcaactaa

SEQ ID NO: 3900 - DNA, 1061 bp, Glycine max
  Soy_ogl_5088 Gm15:29640582..29641642 Cluster 15
gtctttagatttatatagatcaaaacatgttcgcaaagttgaatatcaaataatttttagtcaattgattggttttaattactaagatgttcaattaattagatgaaaagaaattcgttattaaaatatattatttccaaaaataaaacatgttataagaataaattatttttaaaatgaataataattttattttcaaaacacaatatgtttaacactttatgaaaaattcactcaaaaagatttaaaattcaaatgtccagaacatattaatcggataaattatgtaacagaaaataaaagagtaaatataattattgtcctaaaccaaagattttaaaaatttgcagactatttatttgcaaaatggtatttttttaattgattatgcagttaaagtaaataaaaatatttgtaagcactaaattgtttaatattgtataaagttaaaccatctaataagtgaaaaaatactcttttttttacaaaacatacaaccatatatcttttcctgttcgtagagacataatcatcttctatgtccaccatctacagttaaaaactaaaggaaaaattaaattgttgcagactacttatttgcaaaaaaaaaaaaagttttttaattgattatccaattaaagtaaatatataatgtttgtaaacactgaatttcttaatattgtatgaagttgaaacacctaataagtgaaaaaagttctttttttttctcaaaacatgcaattatctttctttccctgttcatagaggcacaatcaccttctaagtcctccacctgaaaactaaagggaaaaaaaataaggaataagaaaatagaaaaggagcaaaagtagaaaacatggtaaaaataaatcatttcaacaatgtcaagccaatatcatgtctctttcgccacaatcaatgtctttgtacacattctcgtgtataaagttgaaccacccaataagtgaaagaatttatttttttttccttcaaaatacacgaccatctttcttcccctccgtagaggcactatcaccttctatgtccaccacctacaattg

SEQ ID NO: 3901 - DNA, 1141 bp, Glycine max
  Soy_ogl_5676 Gm17:13786660..13787800 Cluster 15
ctgtctaatcataatttaatttataactttcaaacgaaaatttaaacacttacccttatcataattttttatgcctttaattaaacatgtgaatttgtaaaatttatagatacaacaattaaactatgaaaaagaaaaacagatggaataagtaagaataaacaagggaaatatatattggccagctggtctaatttgtgactgatgtgatagtgggcttccaaccttgttgacttttatattataaaaactaatagattaattatattttgtaattttctgtgtggaaaataggccagtaagataggtacgtataggtagtgatcccatggcgttggcatgttcatataattatttagttcaaatgtccatgaaaatgagccccaagagtatttctgttattacaagtttttttttttaatattcatgttttatcaaattaattcttattctaagtttaaagacaggcccccttttttatataacttatctaaactttgatgaaaataaataaataaaaactaatctttgacatcataaacgccaacgtatcattccattaccgaattcaaaaataaaaaacagtaataatttggacgctctcgtttattttattaactattttatctagtaattttgtttataattagacgtaagtggacaaaataatcacaatttgatttaaataatatttaaaggagaaaattttaatatatctataattatatataaaggaaatatagtattttggtgtacactttgctatacctattttatccatatatctgtattcataaattattattttattcatataactattttgattaactatccattaattattattattatctttctttttattttagaaaaagcatgaaaaaatagttagatacaatgcctgttttccctagttgtaaataaaattaatcattttttgataaaaataaaattaattaatcataaagataattaattaaccgtgtgtttggtacgcggaagggaaggagaggagaaaggaaggaaataaggggtattggaatatgtgcacaatttggttacgtggaaagaaaaataaaaggtgaagaattaatcccaggcctttttatttctttgcaaaacatcatggaaatacgca

SEQ ID NO: 3902 - DNA, 1100 bp, Glycine max
  Soy_ogl_5677 Gm17:13804601..13805700 Cluster 15
tatggaggtgtacttagccaaaataggtgatgtaaataggaaatgccttactcctttcccaagtctaaatattaataaacccattatggaatgcacagatcttaactttttaatgttttcgggcattttcatgttttaacaagttcgaaaaaaaaaaacctggcgagcttgcccagtaagataaattatgctcagttacatcatttttgggtcaaaattttgctcaattacttaaacatacctaaatactaggaactgtagctaatatcattaagcccataaaatgaatggaccggaaaaaagagaatgtaccgaaaaaatccataaaatgaaatataacaacctgcactgcacctattgctcctccacccactaattgattttgacaaacttactcgtctaaatagctcaacaaatctttaaaaaataattaaatttcattttttctagtttattattatttttcaaaagagaaaaaaaaaacccttttatccatttagaccaaaagagacccccacgaatatgttcaaccctggcagttttacaatacgtacatttcgattttttgtttatatgtaagtaaatactaaattatttaaatagaaagaaaattacatgttaaaaattctttcaaatgatcagttgtgtcatacttctttgtgtaagaaaattttcatatttaaaattgaattttaaattttcaaagtgaacgaatacatgtagactaaggtatgtttgaaatatttatttgttctttatatttgtcatctctcaattaaaaaaaacaacacattagtaagttttttttatttctttttacacactacatttgttttactggaaataaaatggaagaaaataaaacagaaggagagaatttaaaattatcaactttccattatttacatgagaagagagataaatatagaggagggaaatttttgagacacaataaaaaaaaaaaaaaatcctcctgatagggagggtggttaatttcttcttttaattttctcaaaaacaatttttttttttacatagaatgaataattttatttatttacactcactttttacctattcaaacaagttgaaagaaaatt

SEQ ID NO: 3903 - DNA, 1078 bp, Glycine max
  Soy_ogl_5688 Gm17:129323..15070400 Cluster 15
cacaagtctatgtgtgtgcaaaaaaaaagttccaggagaagtaaagtttaattgctttcctttcataacttttattcgtcaacgaattaaatcaaaatagaaatatatttattatacaaaaataaataatataagtgttcaattaattaagttgatctaatgaatctaaaaacttaaatcaaactaatgaaggccttattatttagataagttttaatagaggaaaatgaaattaacttctcccaaaagttactttagtttataggggaagcttattttattctttaaaaatttactttatgtcaaacttaatataatctaacccatgataactctatcaaacaatacccatgaccagttgttaatatcttggttacccagtttcttttaaattcttttagaactatgacaaaatggaaattctcttcaccgttgtaaataattttgggacaaaaggggcagtaattttgtgttatttctttacatatgggtagagttgtcaaacgtcaaaataaaaaaccacaacaaaagttattcggaaaataaatcacacaaaagttataaatggataaagttaaaatgttaagtgtatgaatagaaggaaaagtgagaggaaaaaaataaaggaagaatgaaaacttgataaatgtgacatgaatcgatgaaagttacatgaaatcaacttttattttttttgcttagttttgaaaaatgtcaaatgaaaaacataggaaagataaattgagtttttttttttcatttttaaaaacctctttgaaagagtacgttttaataaacaagctttaaatggaaaggtaggattttaaaattttgaagatatgttagttataaaacttaagttagcttttagatggaaaaaaacatcaaaatttctagatatattctaacaagtttgtttattaattatttttttagataactcaaaaaatctttttaatcttatagttaagtccaatatgcttaagagcaaagaccatttcttaaacgattgagttacattattttcataatatttgttacgatctatttaaaaaataactgtttataatgtatcatt
